United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 24

SEQ ID NO: 1041130 - RNA, 22 nt, Human
gacccugccaugagugacaggg

SEQ ID NO: 1041131 - RNA, 19 nt, Human
uggcauugguccagauaaa

SEQ ID NO: 1041132 - RNA, 22 nt, Human
gagggagagugauggaccauug

SEQ ID NO: 1041133 - RNA, 22 nt, Human
ugcuggcuggccuggccuggac

SEQ ID NO: 1041134 - RNA, 22 nt, Human
cugcucugaagccaggauucug

SEQ ID NO: 1041135 - RNA, 22 nt, Human
gcagcuggaagugacacucugu

SEQ ID NO: 1041136 - RNA, 22 nt, Human
accacugggcgggcagccugcu

SEQ ID NO: 1041137 - RNA, 22 nt, Human
uccagcagguuggucaggugca

SEQ ID NO: 1041138 - RNA, 22 nt, Human
gaggcagaaguugcagugagca

SEQ ID NO: 1041139 - RNA, 22 nt, Human
uaaagguacgaagugagggauu

SEQ ID NO: 1041140 - RNA, 22 nt, Human
auacagaagaacuauagccacu

SEQ ID NO: 1041141 - RNA, 22 nt, Human
agagacaccgcgcaucauggcu

SEQ ID NO: 1041142 - RNA, 18 nt, Human
ccgggcuuuggugacaca

SEQ ID NO: 1041143 - RNA, 22 nt, Human
ggcugccagugagugcagaccg

SEQ ID NO: 1041144 - RNA, 22 nt, Human
cugccuuggcccuaguucaugg

SEQ ID NO: 1041145 - RNA, 22 nt, Human
ucagggcauggcugcacuuggc

SEQ ID NO: 1041146 - RNA, 22 nt, Human
acagccuguguaccagcuggga

SEQ ID NO: 1041147 - RNA, 21 nt, Human
ggugucaguuuuggucauuag

SEQ ID NO: 1041148 - RNA, 22 nt, Human
uccugccugagcguggaggagg

SEQ ID NO: 1041149 - RNA, 22 nt, Human
cagcucugugcaggccugggga

SEQ ID NO: 1041150 - RNA, 22 nt, Human
ugcucagacaagcugaacagua

SEQ ID NO: 1041151 - RNA, 22 nt, Human
cugcucuguucccccaucaucu

SEQ ID NO: 1041152 - RNA, 22 nt, Human
agcugcucugauaaaccuacuu

SEQ ID NO: 1041153 - RNA, 22 nt, Human
caggcagcugaggacuuugcua

SEQ ID NO: 1041154 - RNA, 21 nt, Human
uucaaugaaaacaaagugagg

SEQ ID NO: 1041155 - RNA, 22 nt, Human
aggcacugggaauaugcugagg

SEQ ID NO: 1041156 - RNA, 22 nt, Human
auguguccacaggugugagaga

SEQ ID NO: 1041157 - RNA, 22 nt, Human
ugaggccacuuccccacagccc

SEQ ID NO: 1041158 - RNA, 22 nt, Human
agcuguucccucacugcaguca

SEQ ID NO: 1041159 - RNA, 22 nt, Human
cuuucagagguuacucaggaaa

SEQ ID NO: 1041160 - RNA, 22 nt, Human
gugcagugaaaaaagaaugucc

SEQ ID NO: 1041161 - RNA, 22 nt, Human
ugaagcaggaaccagcagcauu

SEQ ID NO: 1041162 - RNA, 22 nt, Human
ggccugugucugugccuguccu

SEQ ID NO: 1041163 - RNA, 22 nt, Human
agccuggagaagauguguauug

SEQ ID NO: 1041164 - RNA, 22 nt, Human
ccuccugggccuugcucuguga

SEQ ID NO: 1041165 - RNA, 20 nt, Human
uggagcugugguaaggagca

SEQ ID NO: 1041166 - RNA, 22 nt, Human
gacagggcauggugcagaguuc

SEQ ID NO: 1041167 - RNA, 22 nt, Human
gucccuaguggaaagacaugau

SEQ ID NO: 1041168 - RNA, 22 nt, Human
gagagcugcaagguagggcggg

SEQ ID NO: 1041169 - RNA, 22 nt, Human
uagaaaucagguuuuuagaaag

SEQ ID NO: 1041170 - RNA, 22 nt, Human
aguacagaccugucucuuccug

SEQ ID NO: 1041171 - RNA, 23 nt, Human
gccucuggagccccagugcucag

SEQ ID NO: 1041172 - RNA, 22 nt, Human
ugcacccucaucagucaaaugg

SEQ ID NO: 1041173 - RNA, 22 nt, Human
caugcuuugggucagaaaugcc

SEQ ID NO: 1041174 - RNA, 22 nt, Human
gggcuguggagccgcgagggcu

SEQ ID NO: 1041175 - RNA, 22 nt, Human
cgccaggcuugguagcucaugc

SEQ ID NO: 1041176 - RNA, 22 nt, Human
aggggugugcauccuggaggau

SEQ ID NO: 1041177 - RNA, 22 nt, Human
gggcccuggauuuaagcaugga

SEQ ID NO: 1041178 - RNA, 22 nt, Human
ucuugggauugcccugcaguuc

SEQ ID NO: 1041179 - RNA, 22 nt, Human
uggaggcauaggccugggcccu

SEQ ID NO: 1041180 - RNA, 22 nt, Human
auaaggcauauagucacuuuuu

SEQ ID NO: 1041181 - RNA, 22 nt, Human
ggagcuggucagccuugagcau

SEQ ID NO: 1041182 - RNA, 20 nt, Human
agucccagaucaaauuucug

SEQ ID NO: 1041183 - RNA, 19 nt, Human
ugucucugaaagaugagcu

SEQ ID NO: 1041184 - RNA, 22 nt, Human
gcucugagauugagccuuuggu

SEQ ID NO: 1041185 - RNA, 22 nt, Human
ggcuccuguggcaagacagcuu

SEQ ID NO: 1041186 - RNA, 22 nt, Human
aacaugaagguaggaugguuuu

SEQ ID NO: 1041187 - RNA, 22 nt, Human
ugcagauucaaaugaaaugcaa

SEQ ID NO: 1041188 - RNA, 22 nt, Human
ggcucuggcaaggggaggcuac

SEQ ID NO: 1041189 - RNA, 22 nt, Human
cugggcagcuaccaccacugcu

SEQ ID NO: 1041190 - RNA, 17 nt, Human
ucaggcugugccuggua

SEQ ID NO: 1041191 - RNA, 22 nt, Human
ccaggacuucgaggcuacagug

SEQ ID NO: 1041192 - RNA, 22 nt, Human
ggcacagggaggcccuggugug

SEQ ID NO: 1041193 - RNA, 22 nt, Human
aggccuggcuuugguuugcuga

SEQ ID NO: 1041194 - RNA, 22 nt, Human
caaagcucaugcucuuagccau

SEQ ID NO: 1041195 - RNA, 22 nt, Human
agaugauggccauguccucucc

SEQ ID NO: 1041196 - RNA, 22 nt, Human
gcaggcagucaucuuucauauu

SEQ ID NO: 1041197 - RNA, 23 nt, Human
aaaguugauuugcaguuuaagag

SEQ ID NO: 1041198 - RNA, 23 nt, Human
ugcuucucugcuugacaguucug

SEQ ID NO: 1041199 - RNA, 22 nt, Human
cccauuuagauaacaguucaaa

SEQ ID NO: 1041200 - RNA, 22 nt, Human
cacagggcaccaguuggccauc

SEQ ID NO: 1041201 - RNA, 22 nt, Human
cgcagcagccccgugguaggug

SEQ ID NO: 1041202 - RNA, 17 nt, Human
aauagcugcucagagag

SEQ ID NO: 1041203 - RNA, 20 nt, Human
cagcaguggaugagaguuuu

SEQ ID NO: 1041204 - RNA, 22 nt, Human
cucccuggaggugagcuggcac

SEQ ID NO: 1041205 - RNA, 22 nt, Human
aaggcacugaacuuaaauucug

SEQ ID NO: 1041206 - RNA, 22 nt, Human
ggugcugguucaggguggcugu

SEQ ID NO: 1041207 - RNA, 22 nt, Human
cuguagccagaagcagaaggcc

SEQ ID NO: 1041208 - RNA, 22 nt, Human
gcugugcuauaucucugagugu

SEQ ID NO: 1041209 - RNA, 22 nt, Human
uggcagggugggcuucagcccc

SEQ ID NO: 1041210 - RNA, 22 nt, Human
ggcaggagggcggacaaugacc

SEQ ID NO: 1041211 - RNA, 22 nt, Human
ccacagaaaguugucuagagua

SEQ ID NO: 1041212 - RNA, 22 nt, Human
aaggucauugguucugaauucu

SEQ ID NO: 1041213 - RNA, 22 nt, Human
cccauuuaucccaagguuacuc

SEQ ID NO: 1041214 - RNA, 19 nt, Human
augucccaccgccccugag

SEQ ID NO: 1041215 - RNA, 22 nt, Human
ccaaggagaaugacaccaugga

SEQ ID NO: 1041216 - RNA, 22 nt, Human
gguacaaggagugaagguuugg

SEQ ID NO: 1041217 - RNA, 22 nt, Human
acccugagucagacagccugac

SEQ ID NO: 1041218 - RNA, 17 nt, Human
ugcugccaagucccaac

SEQ ID NO: 1041219 - RNA, 22 nt, Human
uccuuccugcaggccaaguccu

SEQ ID NO: 1041220 - RNA, 22 nt, Human
acuccugggugcugaccagcgu

SEQ ID NO: 1041221 - RNA, 22 nt, Human
aguaucaaggaucuccagcacc

SEQ ID NO: 1041222 - RNA, 22 nt, Human
gcuccagaugaaaggccagagg

SEQ ID NO: 1041223 - RNA, 22 nt, Human
ggccucuggucaagacaagcau

SEQ ID NO: 1041224 - RNA, 22 nt, Human
ggcugccugccuccaagccggg

SEQ ID NO: 1041225 - RNA, 22 nt, Human
uaaagguagcaugaaacugcaa

SEQ ID NO: 1041226 - RNA, 22 nt, Human
aacuagaaaacaagaugcugau

SEQ ID NO: 1041227 - RNA, 22 nt, Human
cccugagagugagugccaccuu

SEQ ID NO: 1041228 - RNA, 22 nt, Human
gcacagccagcaucugagggau

SEQ ID NO: 1041229 - RNA, 23 nt, Human
cccagcuuucccacugccgagag

SEQ ID NO: 1041230 - RNA, 22 nt, Human
aucaguuucugugaagaacaca

SEQ ID NO: 1041231 - RNA, 22 nt, Human
gggcugccuuucuucugggagc

SEQ ID NO: 1041232 - RNA, 22 nt, Human
gggagguucuguucgcacuuga

SEQ ID NO: 1041233 - RNA, 22 nt, Human
uuucauguuuauggaaaaugag

SEQ ID NO: 1041234 - RNA, 22 nt, Human
gggauggcuuuguggcugacuc

SEQ ID NO: 1041235 - RNA, 22 nt, Human
gggagccuugggagugccagcc

SEQ ID NO: 1041236 - RNA, 22 nt, Human
gcugccuguccugaggaguccg

SEQ ID NO: 1041237 - RNA, 22 nt, Human
aagccagguuccauggaggagc

SEQ ID NO: 1041238 - RNA, 21 nt, Human
uugcaccaugauaaauucaga

SEQ ID NO: 1041239 - RNA, 22 nt, Human
uugaagcaugguacuuguucaa

SEQ ID NO: 1041240 - RNA, 22 nt, Human
uggaaagaauuccuaugguuca

SEQ ID NO: 1041241 - RNA, 22 nt, Human
aucaguuuuguucacuacuaua

SEQ ID NO: 1041242 - RNA, 22 nt, Human
aaaugucugagacuucugaacu

SEQ ID NO: 1041243 - RNA, 18 nt, Human
cucagggcaucagucugg

SEQ ID NO: 1041244 - RNA, 22 nt, Human
gaggcucugugaugugccaggc

SEQ ID NO: 1041245 - RNA, 22 nt, Human
cagagcagguaucuuuggugaa

SEQ ID NO: 1041246 - RNA, 22 nt, Human
gcacugcagccucagauggugg

SEQ ID NO: 1041247 - RNA, 22 nt, Human
gggccuggcaugcagccccguu

SEQ ID NO: 1041248 - RNA, 22 nt, Human
gagcagggagacaacucuggug

SEQ ID NO: 1041249 - RNA, 22 nt, Human
gcaagcaagcagguagagcuga

SEQ ID NO: 1041250 - RNA, 22 nt, Human
caaaugaagaaccuucucaccu

SEQ ID NO: 1041251 - RNA, 22 nt, Human
ucucccacgguacaggauaaac

SEQ ID NO: 1041252 - RNA, 22 nt, Human
gugucccaauguucaggacggc

SEQ ID NO: 1041253 - RNA, 19 nt, Human
auuuacugccuaaaaucuc

SEQ ID NO: 1041254 - RNA, 22 nt, Human
ucaaaugcaggucuggucuugg

SEQ ID NO: 1041255 - RNA, 22 nt, Human
acagccugagaguggagcuggc

SEQ ID NO: 1041256 - RNA, 22 nt, Human
gucacacuagggccaaguggag

SEQ ID NO: 1041257 - RNA, 22 nt, Human
cucaggaugcaggucacaggac

SEQ ID NO: 1041258 - RNA, 22 nt, Human
cugugcuugcggguguggagcc

SEQ ID NO: 1041259 - RNA, 22 nt, Human
agcagcucaaagccugcaagga

SEQ ID NO: 1041260 - RNA, 22 nt, Human
gaggacagcuuagggcuuccug

SEQ ID NO: 1041261 - RNA, 23 nt, Human
aagaauaaaugacauuaaaggug

SEQ ID NO: 1041262 - RNA, 22 nt, Human
gaggcugcugagagcccuguuu

SEQ ID NO: 1041263 - RNA, 18 nt, Human
aguggucuguuauaucau

SEQ ID NO: 1041264 - RNA, 22 nt, Human
ugcauauuuguaugauguuuag

SEQ ID NO: 1041265 - RNA, 22 nt, Human
uaaggcaccuguccaggcuggg

SEQ ID NO: 1041266 - RNA, 22 nt, Human
aggacugggugcagagggcauc

SEQ ID NO: 1041267 - RNA, 22 nt, Human
uugaacaguuuugucagguuca

SEQ ID NO: 1041268 - RNA, 22 nt, Human
ccagcagcuuuauuggcucucc

SEQ ID NO: 1041269 - RNA, 22 nt, Human
cacacaugucucuccaugcucu

SEQ ID NO: 1041270 - RNA, 22 nt, Human
aguacuucagaggcugcccagg

SEQ ID NO: 1041271 - RNA, 22 nt, Human
acguuuucagugacugugcuuc

SEQ ID NO: 1041272 - RNA, 22 nt, Human
gagggcagagucuaaugaugca

SEQ ID NO: 1041273 - RNA, 22 nt, Human
uucacaggaggguggaugcaug

SEQ ID NO: 1041274 - RNA, 22 nt, Human
cccagcccagcguucgaggggu

SEQ ID NO: 1041275 - RNA, 22 nt, Human
agcccaagcauaggagggaggc

SEQ ID NO: 1041276 - RNA, 22 nt, Human
ccaaaguccauaguuuacuuua

SEQ ID NO: 1041277 - RNA, 22 nt, Human
gccaggcuguggggaacuugaa

SEQ ID NO: 1041278 - RNA, 22 nt, Human
ucauccaguucacauggugagu

SEQ ID NO: 1041279 - RNA, 22 nt, Human
uggccuggcagagcaaggccug

SEQ ID NO: 1041280 - RNA, 22 nt, Human
acugucuguccugcucuccgug

SEQ ID NO: 1041281 - RNA, 22 nt, Human
gcauuauuaauagcugcaugag

SEQ ID NO: 1041282 - RNA, 22 nt, Human
ccagcugauucgguggugguug

SEQ ID NO: 1041283 - RNA, 22 nt, Human
agucucugugagcucccaaugg

SEQ ID NO: 1041284 - RNA, 22 nt, Human
gcccagccuccaagcuccaagg

SEQ ID NO: 1041285 - RNA, 22 nt, Human
agcugcucaggagagccagguc

SEQ ID NO: 1041286 - RNA, 19 nt, Human
caagugaagccugggaugg

SEQ ID NO: 1041287 - RNA, 22 nt, Human
cagcugcccauccugggaaaug

SEQ ID NO: 1041288 - RNA, 22 nt, Human
uggccugucuuguugugcuaga

SEQ ID NO: 1041289 - RNA, 22 nt, Human
uagacacauccguggaagcuuc

SEQ ID NO: 1041290 - RNA, 22 nt, Human
ucccagggugcgccugcccucg

SEQ ID NO: 1041291 - RNA, 21 nt, Human
gugucaugguugacuuuggca

SEQ ID NO: 1041292 - RNA, 22 nt, Human
gcagcugguuaaugggagaauu

SEQ ID NO: 1041293 - RNA, 21 nt, Human
aggucccagguuugggcagca

SEQ ID NO: 1041294 - RNA, 22 nt, Human
ugagcuuacgugggaacagacu

SEQ ID NO: 1041295 - RNA, 22 nt, Human
ucagagucucccccaguuuggg

SEQ ID NO: 1041296 - RNA, 18 nt, Human
cucucugggugaggacaa

SEQ ID NO: 1041297 - RNA, 22 nt, Human
agacagagauacuauguuguca

SEQ ID NO: 1041298 - RNA, 22 nt, Human
uggggugggcaugcgcuguccu

SEQ ID NO: 1041299 - RNA, 22 nt, Human
ggccagaaguuggaaaagagcc

SEQ ID NO: 1041300 - RNA, 22 nt, Human
gccucaggacuggcauacucau

SEQ ID NO: 1041301 - RNA, 18 nt, Human
ugugguggagcugccuuc

SEQ ID NO: 1041302 - RNA, 22 nt, Human
caggccuggguucaaaucccuu

SEQ ID NO: 1041303 - RNA, 22 nt, Human
gccagguggcugagugacugag

SEQ ID NO: 1041304 - RNA, 22 nt, Human
gcagagccugacgggauuuuuc

SEQ ID NO: 1041305 - RNA, 22 nt, Human
agagcugcaggguggacccagg

SEQ ID NO: 1041306 - RNA, 22 nt, Human
gcugagagcggccagcugggaa

SEQ ID NO: 1041307 - RNA, 23 nt, Human
ugcagccacucaggagcucagug

SEQ ID NO: 1041308 - RNA, 22 nt, Human
cuguagcaaguuauucaauaaa

SEQ ID NO: 1041309 - RNA, 22 nt, Human
agcuccuccugugccaggccag

SEQ ID NO: 1041310 - RNA, 22 nt, Human
agagacaggauaucugcucaug

SEQ ID NO: 1041311 - RNA, 22 nt, Human
cuuagaaauuguuacucauuca

SEQ ID NO: 1041312 - RNA, 22 nt, Human
aggcacugauucuguuuuccau

SEQ ID NO: 1041313 - RNA, 21 nt, Human
ccaggguccagcugccauggu

SEQ ID NO: 1041314 - RNA, 22 nt, Human
uccaguggcacuggagacuaga

SEQ ID NO: 1041315 - RNA, 22 nt, Human
guuuacaaauauuuuaaauggu

SEQ ID NO: 1041316 - RNA, 22 nt, Human
ggcucagguuaccagucccucc

SEQ ID NO: 1041317 - RNA, 17 nt, Human
gcugcagcgguaggcag

SEQ ID NO: 1041318 - RNA, 22 nt, Human
augcugaggacaaagagaucaa

SEQ ID NO: 1041319 - RNA, 22 nt, Human
agggaagagcuugcaagaaacc

SEQ ID NO: 1041320 - RNA, 22 nt, Human
uccuugaauccuagcauccuau

SEQ ID NO: 1041321 - RNA, 22 nt, Human
gucccuuggcucacaaacagcu

SEQ ID NO: 1041322 - RNA, 19 nt, Human
uggcagggagugauauuag

SEQ ID NO: 1041323 - RNA, 22 nt, Human
agccacagcauguguguaugua

SEQ ID NO: 1041324 - RNA, 22 nt, Human
agacagggucuugaucagagcu

SEQ ID NO: 1041325 - RNA, 19 nt, Human
cagaacagaggucauggcc

SEQ ID NO: 1041326 - RNA, 22 nt, Human
ugagcccaggaguuggaggcug

SEQ ID NO: 1041327 - RNA, 22 nt, Human
ggcgcuggccacgguggcucug

SEQ ID NO: 1041328 - RNA, 22 nt, Human
aguuuauagcccagauucaugg

SEQ ID NO: 1041329 - RNA, 22 nt, Human
ccuggaaggcaggcauggauug

SEQ ID NO: 1041330 - RNA, 21 nt, Human
auugaaagucaacaaucaguu

SEQ ID NO: 1041331 - RNA, 21 nt, Human
ccuucuccacagggucuccgg

SEQ ID NO: 1041332 - RNA, 18 nt, Human
agaguguucucagugaaa

SEQ ID NO: 1041333 - RNA, 22 nt, Human
cagagugaaaacugagcucaaa

SEQ ID NO: 1041334 - RNA, 22 nt, Human
agguggcuccucccauggcugg

SEQ ID NO: 1041335 - RNA, 22 nt, Human
uguaccuuuuucugugcaugcu

SEQ ID NO: 1041336 - RNA, 22 nt, Human
ucucuggagcugcagauccagg

SEQ ID NO: 1041337 - RNA, 22 nt, Human
ggcaggagcucuccaguuugcc

SEQ ID NO: 1041338 - RNA, 22 nt, Human
uaaaauguagcuucuaggcugg

SEQ ID NO: 1041339 - RNA, 21 nt, Human
cugccuugaaugguacuggga

SEQ ID NO: 1041340 - RNA, 22 nt, Human
uugggcaaaguguuucuggagc

SEQ ID NO: 1041341 - RNA, 22 nt, Human
cagcucuggcgucagggagcga

SEQ ID NO: 1041342 - RNA, 22 nt, Human
ugggcuccagcaccugugcucu

SEQ ID NO: 1041343 - RNA, 22 nt, Human
gucauuucuguuucuucagugc

SEQ ID NO: 1041344 - RNA, 22 nt, Human
auucuuggagcagucaaagaag

SEQ ID NO: 1041345 - RNA, 22 nt, Human
uuugcagcaaggagagagcauu

SEQ ID NO: 1041346 - RNA, 22 nt, Human
agccuggauccuaggcucagcu

SEQ ID NO: 1041347 - RNA, 22 nt, Human
cugggccucauccucagaguuu

SEQ ID NO: 1041348 - RNA, 22 nt, Human
gcucugcucuugacuuaccagg

SEQ ID NO: 1041349 - RNA, 22 nt, Human
aucccuggacggcgccucccca

SEQ ID NO: 1041350 - RNA, 22 nt, Human
agggcugcaucugccuggugaa

SEQ ID NO: 1041351 - RNA, 22 nt, Human
cucugguguccuuuagaauuua

SEQ ID NO: 1041352 - RNA, 22 nt, Human
guaacagaggguuugcagauau

SEQ ID NO: 1041353 - RNA, 22 nt, Human
gcugccugaucauacaccaggg

SEQ ID NO: 1041354 - RNA, 22 nt, Human
aucuacaggcugaggugggagg

SEQ ID NO: 1041355 - RNA, 22 nt, Human
gcaucuuucuguccauucagca

SEQ ID NO: 1041356 - RNA, 22 nt, Human
ggcagggguccugguguugacu

SEQ ID NO: 1041357 - RNA, 22 nt, Human
ugagccugcaauaagcacagcc

SEQ ID NO: 1041358 - RNA, 22 nt, Human
gaggagguuccggguggagaag

SEQ ID NO: 1041359 - RNA, 22 nt, Human
agccaagcacucaacuccugga

SEQ ID NO: 1041360 - RNA, 22 nt, Human
cagcugagucugagguucuuug

SEQ ID NO: 1041361 - RNA, 22 nt, Human
agccugagugcuuaggacuguu

SEQ ID NO: 1041362 - RNA, 22 nt, Human
ucucuucuuguguuuuccugcc

SEQ ID NO: 1041363 - RNA, 22 nt, Human
cauguacacucauguaacuaua

SEQ ID NO: 1041364 - RNA, 22 nt, Human
cugggugguuuugaugugaauu

SEQ ID NO: 1041365 - RNA, 22 nt, Human
aguggccagugcugcucugggg

SEQ ID NO: 1041366 - RNA, 22 nt, Human
uggacaggugagugacucaggg

SEQ ID NO: 1041367 - RNA, 22 nt, Human
aguucacauuccgagguacugg

SEQ ID NO: 1041368 - RNA, 22 nt, Human
ucacagggauggaauagaaaua

SEQ ID NO: 1041369 - RNA, 22 nt, Human
cagagggcucaguccugcugga

SEQ ID NO: 1041370 - RNA, 22 nt, Human
ugcugggggcuuucuggauacc

SEQ ID NO: 1041371 - RNA, 22 nt, Human
aggugccagugcuguggucccc

SEQ ID NO: 1041372 - RNA, 22 nt, Human
augggaugaacuugaucugcuu

SEQ ID NO: 1041373 - RNA, 22 nt, Human
ugaguagcggcuauguguaacu

SEQ ID NO: 1041374 - RNA, 22 nt, Human
ggauaagaaaauuguaauaacu

SEQ ID NO: 1041375 - RNA, 22 nt, Human
gaagcagcuagcccacuaguca

SEQ ID NO: 1041376 - RNA, 22 nt, Human
uggagcaggacugcugcccuca

SEQ ID NO: 1041377 - RNA, 22 nt, Human
ccagcccuugcugaaggguggc

SEQ ID NO: 1041378 - RNA, 22 nt, Human
cuguuuucaaagagagagaaug

SEQ ID NO: 1041379 - RNA, 22 nt, Human
gagcucagauucuggugucaga

SEQ ID NO: 1041380 - RNA, 22 nt, Human
cuccagggaggucugcaggacu

SEQ ID NO: 1041381 - RNA, 22 nt, Human
cagcaauauacacagucuaugg

SEQ ID NO: 1041382 - RNA, 22 nt, Human
ggccccaggaccuccacggucc

SEQ ID NO: 1041383 - RNA, 22 nt, Human
guguguccucaguaguggcaug

SEQ ID NO: 1041384 - RNA, 22 nt, Human
gcauuuaaauuugaacuucaga

SEQ ID NO: 1041385 - RNA, 22 nt, Human
agagcccuuucuccaggcaccu

SEQ ID NO: 1041386 - RNA, 22 nt, Human
agaguguuauuugcucuguauu

SEQ ID NO: 1041387 - RNA, 22 nt, Human
gcagggccuuagcagcggcugc

SEQ ID NO: 1041388 - RNA, 20 nt, Human
uguuucuuuuaaugagcggc

SEQ ID NO: 1041389 - RNA, 22 nt, Human
gagcucauccccaugguccguc

SEQ ID NO: 1041390 - RNA, 22 nt, Human
gcugguuagaaaacagagcuca

SEQ ID NO: 1041391 - RNA, 22 nt, Human
ugcccagcacugugccagucac

SEQ ID NO: 1041392 - RNA, 22 nt, Human
cuggcuccacucccugccugac

SEQ ID NO: 1041393 - RNA, 21 nt, Human
gcaaggcuuuuguguuuccca

SEQ ID NO: 1041394 - RNA, 22 nt, Human
cuucugugcuucacaguugcca

SEQ ID NO: 1041395 - RNA, 22 nt, Human
uucucuuauucuggauaugcag

SEQ ID NO: 1041396 - RNA, 22 nt, Human
uagaggugacacugagaccaua

SEQ ID NO: 1041397 - RNA, 22 nt, Human
gaggugaguggaucacgagguc

SEQ ID NO: 1041398 - RNA, 22 nt, Human
acccugccgugggcugcuugug

SEQ ID NO: 1041399 - RNA, 23 nt, Human
uggccuggagagaaaagaugagu

SEQ ID NO: 1041400 - RNA, 22 nt, Human
cagcacugcugcuguacacaca

SEQ ID NO: 1041401 - RNA, 22 nt, Human
aagccagguguuuaggccagcg

SEQ ID NO: 1041402 - RNA, 22 nt, Human
gugaggugggcuggccagagac

SEQ ID NO: 1041403 - RNA, 22 nt, Human
caggcugaggcaguaggguuug

SEQ ID NO: 1041404 - RNA, 21 nt, Human
ucugucugguuuuagaguggc

SEQ ID NO: 1041405 - RNA, 22 nt, Human
acuuagaacaggcagaauucca

SEQ ID NO: 1041406 - RNA, 22 nt, Human
auugacaagacaauggcucuua

SEQ ID NO: 1041407 - RNA, 22 nt, Human
gugggccucuugaggguggcua

SEQ ID NO: 1041408 - RNA, 22 nt, Human
cccucaggagaugucagcugga

SEQ ID NO: 1041409 - RNA, 22 nt, Human
gggcagcagaggaucccuuaau

SEQ ID NO: 1041410 - RNA, 22 nt, Human
uugcauaaaagaguauaucuua

SEQ ID NO: 1041411 - RNA, 22 nt, Human
cugcaagauuggaagaugcaau

SEQ ID NO: 1041412 - RNA, 22 nt, Human
guuuuuccugcugacuuggguc

SEQ ID NO: 1041413 - RNA, 22 nt, Human
gcaggaaagguugagacuuugc

SEQ ID NO: 1041414 - RNA, 22 nt, Human
aggggcugccuggcuuggcacu

SEQ ID NO: 1041415 - RNA, 22 nt, Human
ucauugcagcuucagguguuca

SEQ ID NO: 1041416 - RNA, 22 nt, Human
agggccuggaacuggagaccac

SEQ ID NO: 1041417 - RNA, 21 nt, Human
uagagaaaagaagcuguuccu

SEQ ID NO: 1041418 - RNA, 22 nt, Human
agagccaggaucuguuuugggg

SEQ ID NO: 1041419 - RNA, 22 nt, Human
ccaggaguuugaggcugcagug

SEQ ID NO: 1041420 - RNA, 22 nt, Human
aagcagccaccucaucuccacu

SEQ ID NO: 1041421 - RNA, 22 nt, Human
agcaguggcuggauggugugcu

SEQ ID NO: 1041422 - RNA, 22 nt, Human
agccugucugucuccaaagcug

SEQ ID NO: 1041423 - RNA, 22 nt, Human
uggcucugccacuaacuuggua

SEQ ID NO: 1041424 - RNA, 22 nt, Human
uacaaagugagcaaccucuuuu

SEQ ID NO: 1041425 - RNA, 22 nt, Human
accuggagucauuugaggagua

SEQ ID NO: 1041426 - RNA, 21 nt, Human
agggcagauuagcuguaagag

SEQ ID NO: 1041427 - RNA, 22 nt, Human
agacuucucaguuuuauuagua

SEQ ID NO: 1041428 - RNA, 22 nt, Human
uuaagucauuucugauuauaga

SEQ ID NO: 1041429 - RNA, 22 nt, Human
gcagugccuugcuucucugucu

SEQ ID NO: 1041430 - RNA, 22 nt, Human
ggcagcuguaagaugagugaau

SEQ ID NO: 1041431 - RNA, 22 nt, Human
ccacagggacuguuaaaacccu

SEQ ID NO: 1041432 - RNA, 22 nt, Human
agcugccaggccccugagaacc

SEQ ID NO: 1041433 - RNA, 17 nt, Human
uggcuucccugggccac

SEQ ID NO: 1041434 - RNA, 22 nt, Human
uagggcaguuucauguuaucuu

SEQ ID NO: 1041435 - RNA, 22 nt, Human
gcugggagcccuggucugcucc

SEQ ID NO: 1041436 - RNA, 23 nt, Human
ggguccagagacaggcaugggug

SEQ ID NO: 1041437 - RNA, 19 nt, Human
uggcagaggcaguuuguac

SEQ ID NO: 1041438 - RNA, 22 nt, Human
uagagcuagcuucaaaaugcga

SEQ ID NO: 1041439 - RNA, 22 nt, Human
guggaggagaggcgccuugcgg

SEQ ID NO: 1041440 - RNA, 22 nt, Human
gcuggccauucucuuugagaug

SEQ ID NO: 1041441 - RNA, 22 nt, Human
gccuggucucuuucaugucagu

SEQ ID NO: 1041442 - RNA, 19 nt, Human
cgcaggagccgaggugacc

SEQ ID NO: 1041443 - RNA, 22 nt, Human
gaagcccaggcuuccuuggcuu

SEQ ID NO: 1041444 - RNA, 22 nt, Human
aggcucagauccuuguguccug

SEQ ID NO: 1041445 - RNA, 22 nt, Human
uugucuguccaggcaccccaag

SEQ ID NO: 1041446 - RNA, 22 nt, Human
cuucaucaacucuaacaaaugu

SEQ ID NO: 1041447 - RNA, 22 nt, Human
agucccagcuucccccaugcag

SEQ ID NO: 1041448 - RNA, 22 nt, Human
ggcacugaucugauuucccucc

SEQ ID NO: 1041449 - RNA, 22 nt, Human
gcccugcugucuucagaguaua

SEQ ID NO: 1041450 - RNA, 22 nt, Human
cucuguccacagguuugucccu

SEQ ID NO: 1041451 - RNA, 22 nt, Human
gagaggccauggcugugcagug

SEQ ID NO: 1041452 - RNA, 22 nt, Human
acagagguaggacaugagauau

SEQ ID NO: 1041453 - RNA, 22 nt, Human
gcagcuggucuggccuagagua

SEQ ID NO: 1041454 - RNA, 22 nt, Human
uccucagggggccaacccagcc

SEQ ID NO: 1041455 - RNA, 23 nt, Human
aaagacugcugagaauuuuagga

SEQ ID NO: 1041456 - RNA, 22 nt, Human
gagccaggguuugaaacuagac

SEQ ID NO: 1041457 - RNA, 22 nt, Human
cagcucugaggaacacuccuuu

SEQ ID NO: 1041458 - RNA, 22 nt, Human
cuggcagcguguuuaugaacau

SEQ ID NO: 1041459 - RNA, 22 nt, Human
acauuucugagcagggagcugu

SEQ ID NO: 1041460 - RNA, 22 nt, Human
ccagcugcugugcagggaggcu

SEQ ID NO: 1041461 - RNA, 22 nt, Human
gguggguauugaauacaggugu

SEQ ID NO: 1041462 - RNA, 22 nt, Human
ggcuucauggaggaggugaguc

SEQ ID NO: 1041463 - RNA, 22 nt, Human
aggucacacaacugucagaggc

SEQ ID NO: 1041464 - RNA, 20 nt, Human
ugucaugcauuagaugaaga

SEQ ID NO: 1041465 - RNA, 22 nt, Human
uggagcagcaucacuuugagcu

SEQ ID NO: 1041466 - RNA, 22 nt, Human
uaucuuuagaggaagagaaucu

SEQ ID NO: 1041467 - RNA, 22 nt, Human
ugaagacacauacaagggaaug

SEQ ID NO: 1041468 - RNA, 22 nt, Human
gaagagcuauguccagggagca

SEQ ID NO: 1041469 - RNA, 22 nt, Human
cccagcacaggcaauuccauac

SEQ ID NO: 1041470 - RNA, 22 nt, Human
agcuuccuguugagagagggag

SEQ ID NO: 1041471 - RNA, 22 nt, Human
guccucugcccaggucaagguu

SEQ ID NO: 1041472 - RNA, 22 nt, Human
agcugcugcggaaagaugccac

SEQ ID NO: 1041473 - RNA, 22 nt, Human
ggcagccuccagggcacuggug

SEQ ID NO: 1041474 - RNA, 21 nt, Human
aaaaugugagcgugaugcuua

SEQ ID NO: 1041475 - RNA, 22 nt, Human
gaggcccuccagcugucagcug

SEQ ID NO: 1041476 - RNA, 22 nt, Human
auuucagcccaguaugagcccc

SEQ ID NO: 1041477 - RNA, 22 nt, Human
auccaguuuaugucauauucuu

SEQ ID NO: 1041478 - RNA, 22 nt, Human
aucaaaguccaucagaagguag

SEQ ID NO: 1041479 - RNA, 22 nt, Human
agcuggccuucggugucacugg

SEQ ID NO: 1041480 - RNA, 22 nt, Human
uuagcugcauuaucaaaguuau

SEQ ID NO: 1041481 - RNA, 22 nt, Human
uaagaacaucuguccccagauu

SEQ ID NO: 1041482 - RNA, 19 nt, Human
ggugaccaccuggucagug

SEQ ID NO: 1041483 - RNA, 23 nt, Human
ugccagaggcagucacaguggug

SEQ ID NO: 1041484 - RNA, 22 nt, Human
aaaugucuuugaguauuucugc

SEQ ID NO: 1041485 - RNA, 19 nt, Human
cugagcagcggcagcacuu

SEQ ID NO: 1041486 - RNA, 22 nt, Human
gcagcuggacccacacggcuua

SEQ ID NO: 1041487 - RNA, 22 nt, Human
ucacuuuugaucccuaugcagu

SEQ ID NO: 1041488 - RNA, 22 nt, Human
uuugcauugcauuaaguauucu

SEQ ID NO: 1041489 - RNA, 22 nt, Human
agcauuuaauuacaguuuaauu

SEQ ID NO: 1041490 - RNA, 22 nt, Human
ucaguuuuuaaaugauauaauu

SEQ ID NO: 1041491 - RNA, 22 nt, Human
gaagcccauuuguacagcacau

SEQ ID NO: 1041492 - RNA, 22 nt, Human
uggagcuggaauuucugggccu

SEQ ID NO: 1041493 - RNA, 22 nt, Human
ugcauauugugaaaauguagau

SEQ ID NO: 1041494 - RNA, 22 nt, Human
gagcagugagugaauguugccu

SEQ ID NO: 1041495 - RNA, 22 nt, Human
cccagcucucucaguucugcuu

SEQ ID NO: 1041496 - RNA, 22 nt, Human
cagcucaaguuucccaggucag

SEQ ID NO: 1041497 - RNA, 22 nt, Human
aucuggcucgcuaggcucuggg

SEQ ID NO: 1041498 - RNA, 22 nt, Human
ggccucucauguccugggcuuc

SEQ ID NO: 1041499 - RNA, 22 nt, Human
aaggaaagacauauaaaugacu

SEQ ID NO: 1041500 - RNA, 22 nt, Human
cagcuggcuggucagugcacaa

SEQ ID NO: 1041501 - RNA, 19 nt, Human
ggcucagggcgcugccgcc

SEQ ID NO: 1041502 - RNA, 22 nt, Human
gcagggcugcagagggcacugu

SEQ ID NO: 1041503 - RNA, 22 nt, Human
auucagcauaaucaguagcuug

SEQ ID NO: 1041504 - RNA, 22 nt, Human
uugcauugaaaauauauuuuaa

SEQ ID NO: 1041505 - RNA, 22 nt, Human
gccugcagauauauaggauggu

SEQ ID NO: 1041506 - RNA, 22 nt, Human
guguccagagaaacucacagcu

SEQ ID NO: 1041507 - RNA, 22 nt, Human
cuggacagaaagggcugcugug

SEQ ID NO: 1041508 - RNA, 20 nt, Human
gugcuucagaagccauugcu

SEQ ID NO: 1041509 - RNA, 21 nt, Human
uagaaaucagcuggugccucu

SEQ ID NO: 1041510 - RNA, 17 nt, Human
gguguauggggagggaa

SEQ ID NO: 1041511 - RNA, 22 nt, Human
uggccacccagcugacgccuuc

SEQ ID NO: 1041512 - RNA, 22 nt, Human
gcuggccauggggagugaggag

SEQ ID NO: 1041513 - RNA, 22 nt, Human
agagccugaggccaggaaaaug

SEQ ID NO: 1041514 - RNA, 22 nt, Human
cagaguccuggacacagagaca

SEQ ID NO: 1041515 - RNA, 22 nt, Human
gccucugcggggcccgagcccg

SEQ ID NO: 1041516 - RNA, 22 nt, Human
uaguuauuauuguuacuaucag

SEQ ID NO: 1041517 - RNA, 22 nt, Human
caauauucaguggaaaagccau

SEQ ID NO: 1041518 - RNA, 22 nt, Human
caggggacauuaaagcuccaua

SEQ ID NO: 1041519 - RNA, 21 nt, Human
ccugagccuguuuauccagaa

SEQ ID NO: 1041520 - RNA, 22 nt, Human
aaggguggauuucugagcucua

SEQ ID NO: 1041521 - RNA, 18 nt, Human
gguggcucagucaugggg

SEQ ID NO: 1041522 - RNA, 22 nt, Human
aagcagggugucuugacccaug

SEQ ID NO: 1041523 - RNA, 22 nt, Human
acagaggaaggcugagcugccc

SEQ ID NO: 1041524 - RNA, 22 nt, Human
aagcugccagauucagucugcu

SEQ ID NO: 1041525 - RNA, 22 nt, Human
guuguauucuucaauaucagag

SEQ ID NO: 1041526 - RNA, 22 nt, Human
auguacauuuuccuaauguuuu

SEQ ID NO: 1041527 - RNA, 23 nt, Human
acagagaucuugacuuguaugga

SEQ ID NO: 1041528 - RNA, 22 nt, Human
cauugaaaaacguugacugagu

SEQ ID NO: 1041529 - RNA, 22 nt, Human
aucuaggauuugaaugcacagu

SEQ ID NO: 1041530 - RNA, 22 nt, Human
uccagaguacggaagagucauc

SEQ ID NO: 1041531 - RNA, 22 nt, Human
acugcagggcauccuggccaag

SEQ ID NO: 1041532 - RNA, 22 nt, Human
ucacaggacccugaggguggcg

SEQ ID NO: 1041533 - RNA, 21 nt, Human
gcugcugccccuagugaggcc

SEQ ID NO: 1041534 - RNA, 22 nt, Human
gcaggugguccccguggagugg

SEQ ID NO: 1041535 - RNA, 22 nt, Human
augggaggcagacacuaaguuc

SEQ ID NO: 1041536 - RNA, 22 nt, Human
accaaggaagagauucucaguu

SEQ ID NO: 1041537 - RNA, 22 nt, Human
uacaaaugaccauagccacuua

SEQ ID NO: 1041538 - RNA, 18 nt, Human
uggcagcaggaagccauu

SEQ ID NO: 1041539 - RNA, 22 nt, Human
aggcugcagaacagucaggugc

SEQ ID NO: 1041540 - RNA, 22 nt, Human
aggcucagagagcuguguccau

SEQ ID NO: 1041541 - RNA, 17 nt, Human
aggcugcugggccaggg

SEQ ID NO: 1041542 - RNA, 22 nt, Human
cugcugcucagugucaucaugu

SEQ ID NO: 1041543 - RNA, 22 nt, Human
aaaugucuuuaucucauguaac

SEQ ID NO: 1041544 - RNA, 22 nt, Human
gucaaacaaauuaacauaucca

SEQ ID NO: 1041545 - RNA, 22 nt, Human
gcaggggcuaaggacacagaga

SEQ ID NO: 1041546 - RNA, 22 nt, Human
gguggcagcgucuaucugacau

SEQ ID NO: 1041547 - RNA, 22 nt, Human
cucagaaucugccaaguucagg

SEQ ID NO: 1041548 - RNA, 22 nt, Human
ucagcugccccaguggccccag

SEQ ID NO: 1041549 - RNA, 22 nt, Human
ucauugaauuucacagcuuuau

SEQ ID NO: 1041550 - RNA, 22 nt, Human
aaagauuugaguucugcuuaua

SEQ ID NO: 1041551 - RNA, 22 nt, Human
ucuuuccuuagaauaauucuuu

SEQ ID NO: 1041552 - RNA, 22 nt, Human
cagaggccuauccaguguccau

SEQ ID NO: 1041553 - RNA, 22 nt, Human
ggcagggucuggacugaaagcu

SEQ ID NO: 1041554 - RNA, 22 nt, Human
gggcauggugaugugcaccugu

SEQ ID NO: 1041555 - RNA, 22 nt, Human
auaugugugaugcauggacuaa

SEQ ID NO: 1041556 - RNA, 22 nt, Human
gcugucagugaggugagacaug

SEQ ID NO: 1041557 - RNA, 20 nt, Human
gucucaaguaucucacaguc

SEQ ID NO: 1041558 - RNA, 22 nt, Human
cauaacuagagugaaauguuga

SEQ ID NO: 1041559 - RNA, 22 nt, Human
cacugaagaugcgacuagugcu

SEQ ID NO: 1041560 - RNA, 22 nt, Human
uuccauuuauucuuguccagau

SEQ ID NO: 1041561 - RNA, 22 nt, Human
ggccugagucccaccuggcugu

SEQ ID NO: 1041562 - RNA, 18 nt, Human
cugaaggauccaggugua

SEQ ID NO: 1041563 - RNA, 22 nt, Human
uguacaguguagucaugagguu

SEQ ID NO: 1041564 - RNA, 22 nt, Human
ugggggucaggaugaggccuug

SEQ ID NO: 1041565 - RNA, 22 nt, Human
gccagggcucgcggucccucgu

SEQ ID NO: 1041566 - RNA, 22 nt, Human
uggcagcaguggagguagaaag

SEQ ID NO: 1041567 - RNA, 22 nt, Human
gcugcugcgcuugucuacuguu

SEQ ID NO: 1041568 - RNA, 22 nt, Human
acauuucucagguaagucauuu

SEQ ID NO: 1041569 - RNA, 22 nt, Human
ugggcugcacccucagccucug

SEQ ID NO: 1041570 - RNA, 22 nt, Human
acagggccucagccagggcaga

SEQ ID NO: 1041571 - RNA, 22 nt, Human
ucaugcaaggcugaaacauggu

SEQ ID NO: 1041572 - RNA, 22 nt, Human
ugucucugugacuccuuccgcc

SEQ ID NO: 1041573 - RNA, 22 nt, Human
cauugaaauauggaaacugaug

SEQ ID NO: 1041574 - RNA, 22 nt, Human
gcccucucuucugcagccucca

SEQ ID NO: 1041575 - RNA, 22 nt, Human
cccagccuggugcacugugggg

SEQ ID NO: 1041576 - RNA, 22 nt, Human
gccggggcuggggagagacaug

SEQ ID NO: 1041577 - RNA, 22 nt, Human
ggaucauuaacacauccaucac

SEQ ID NO: 1041578 - RNA, 18 nt, Human
cuccagggaacucaguca

SEQ ID NO: 1041579 - RNA, 22 nt, Human
ugcugggcuagaagcugaggcc

SEQ ID NO: 1041580 - RNA, 22 nt, Human
acagggcaccugagguaggaag

SEQ ID NO: 1041581 - RNA, 22 nt, Human
agagugaaguuuuugaaaguga

SEQ ID NO: 1041582 - RNA, 22 nt, Human
acagguggggaggcugagguuc

SEQ ID NO: 1041583 - RNA, 22 nt, Human
agcagcaggagccgugggguga

SEQ ID NO: 1041584 - RNA, 22 nt, Human
ugagcccuaagggucaagcagg

SEQ ID NO: 1041585 - RNA, 22 nt, Human
uagcagggucucaggagucagg

SEQ ID NO: 1041586 - RNA, 22 nt, Human
ccaggccuguguuguguggagg

SEQ ID NO: 1041587 - RNA, 22 nt, Human
gcuguggccaacaaaccacuuu

SEQ ID NO: 1041588 - RNA, 22 nt, Human
uggcagagaaccugggcuuugu

SEQ ID NO: 1041589 - RNA, 22 nt, Human
auugucugaauccaaagcucug

SEQ ID NO: 1041590 - RNA, 22 nt, Human
cugccuggguucaaguccuguu

SEQ ID NO: 1041591 - RNA, 22 nt, Human
uggcugaaucugcagcaggaag

SEQ ID NO: 1041592 - RNA, 22 nt, Human
aggacaggauugagcugaacug

SEQ ID NO: 1041593 - RNA, 22 nt, Human
agaaagaacguugguuaucuua

SEQ ID NO: 1041594 - RNA, 22 nt, Human
gugugcagugagcaaaagaucu

SEQ ID NO: 1041595 - RNA, 22 nt, Human
ugggcagaggacagggaagauc

SEQ ID NO: 1041596 - RNA, 22 nt, Human
cacuggggaaaacaggcuucuu

SEQ ID NO: 1041597 - RNA, 22 nt, Human
ccagcugguguuccuuaggacc

SEQ ID NO: 1041598 - RNA, 22 nt, Human
ggggcagcucccgagggcagga

SEQ ID NO: 1041599 - RNA, 22 nt, Human
uggccugggccggcagauauac

SEQ ID NO: 1041600 - RNA, 22 nt, Human
acaugcauucucuaaaagcaaa

SEQ ID NO: 1041601 - RNA, 22 nt, Human
uuucucaucuggaaacagugcu

SEQ ID NO: 1041602 - RNA, 22 nt, Human
cuggagagggagcccuggcagu

SEQ ID NO: 1041603 - RNA, 22 nt, Human
caaaugcaaaauauaacccugu

SEQ ID NO: 1041604 - RNA, 22 nt, Human
gccuggcccagggcuccgcagg

SEQ ID NO: 1041605 - RNA, 22 nt, Human
gcagguggcagaggugggaucu

SEQ ID NO: 1041606 - RNA, 22 nt, Human
aaaaugcaugagaaugugcucg

SEQ ID NO: 1041607 - RNA, 22 nt, Human
gcagugggaagguuggcacaug

SEQ ID NO: 1041608 - RNA, 22 nt, Human
acagggccaggugagaggugcu

SEQ ID NO: 1041609 - RNA, 22 nt, Human
cuggggcugcagcgaucuucau

SEQ ID NO: 1041610 - RNA, 22 nt, Human
acagugaaugcccaagaaaagu

SEQ ID NO: 1041611 - RNA, 22 nt, Human
cugcccugccuggccagugugg

SEQ ID NO: 1041612 - RNA, 22 nt, Human
ggucagggggaucugugaggua

SEQ ID NO: 1041613 - RNA, 23 nt, Human
ccugugugcccuuaauucacagc

SEQ ID NO: 1041614 - RNA, 22 nt, Human
aguagaaagaaggcacugggcc

SEQ ID NO: 1041615 - RNA, 22 nt, Human
ucucagggcagcaaggaagcau

SEQ ID NO: 1041616 - RNA, 22 nt, Human
uguuacacagcagaauagcaag

SEQ ID NO: 1041617 - RNA, 22 nt, Human
caagagcuacccugugccauau

SEQ ID NO: 1041618 - RNA, 22 nt, Human
gccucacugcagccccaggaag

SEQ ID NO: 1041619 - RNA, 22 nt, Human
acauuugaggauguuaagaaug

SEQ ID NO: 1041620 - RNA, 22 nt, Human
cagggccaugaggcacaggguc

SEQ ID NO: 1041621 - RNA, 22 nt, Human
gagcacaggcuuugguggacac

SEQ ID NO: 1041622 - RNA, 22 nt, Human
ggugggcacccgagacuggauc

SEQ ID NO: 1041623 - RNA, 22 nt, Human
ggucaggggcugcucuacagag

SEQ ID NO: 1041624 - RNA, 21 nt, Human
acagaacuguauagugauaaa

SEQ ID NO: 1041625 - RNA, 22 nt, Human
gagcacagaaucuucccaugca

SEQ ID NO: 1041626 - RNA, 22 nt, Human
accccagcucugagccacacca

SEQ ID NO: 1041627 - RNA, 22 nt, Human
cggggacacacuggcagcuccu

SEQ ID NO: 1041628 - RNA, 22 nt, Human
gaaggaaaacagaucugccuga

SEQ ID NO: 1041629 - RNA, 20 nt, Human
gccugcagguuggaugggau

SEQ ID NO: 1041630 - RNA, 22 nt, Human
cauugcacgggcgucugucugu

SEQ ID NO: 1041631 - RNA, 22 nt, Human
aaggccaggacaccaggggacu

SEQ ID NO: 1041632 - RNA, 22 nt, Human
ucugaggcauacccaggccccc

SEQ ID NO: 1041633 - RNA, 22 nt, Human
gcccagcuuuuugaggcaggca

SEQ ID NO: 1041634 - RNA, 22 nt, Human
agaggcaguauacaauccgagc

SEQ ID NO: 1041635 - RNA, 22 nt, Human
caguagcauguaauaaagacag

SEQ ID NO: 1041636 - RNA, 22 nt, Human
uggcucucagcucccagcagcc

SEQ ID NO: 1041637 - RNA, 21 nt, Human
ugcagccauucagcccuaugc

SEQ ID NO: 1041638 - RNA, 22 nt, Human
gaaaggugccccauaggcagga

SEQ ID NO: 1041639 - RNA, 22 nt, Human
uuugcauuucucguaaggaaac

SEQ ID NO: 1041640 - RNA, 22 nt, Human
acagagcugggugcccccugga

SEQ ID NO: 1041641 - RNA, 22 nt, Human
gcucccagcauugcugcugaau

SEQ ID NO: 1041642 - RNA, 22 nt, Human
cccacucuggcucccuucuagu

SEQ ID NO: 1041643 - RNA, 22 nt, Human
aauguguacuuuuucaugcuca

SEQ ID NO: 1041644 - RNA, 22 nt, Human
uucagagaugacaccugguguu

SEQ ID NO: 1041645 - RNA, 22 nt, Human
gcagagccaugggagguuuuug

SEQ ID NO: 1041646 - RNA, 22 nt, Human
ucuuccaguguagacaucugcc

SEQ ID NO: 1041647 - RNA, 22 nt, Human
uuguuuuggaagaacuuacucu

SEQ ID NO: 1041648 - RNA, 22 nt, Human
ugggccuggaguuuguccagag

SEQ ID NO: 1041649 - RNA, 22 nt, Human
cuggagccuagguugaccuggg

SEQ ID NO: 1041650 - RNA, 22 nt, Human
aggcuucuuagauuggcuggag

SEQ ID NO: 1041651 - RNA, 22 nt, Human
ccucagagguuuucauucugua

SEQ ID NO: 1041652 - RNA, 22 nt, Human
guccagggaaauagcgacaggg

SEQ ID NO: 1041653 - RNA, 22 nt, Human
aaggcccuggcaggaagcagga

SEQ ID NO: 1041654 - RNA, 22 nt, Human
ucucagagagcuguguuuuccu

SEQ ID NO: 1041655 - RNA, 22 nt, Human
uguacaguaggaacuuguuauu

SEQ ID NO: 1041656 - RNA, 22 nt, Human
gcugccaugguccaggcuccag

SEQ ID NO: 1041657 - RNA, 22 nt, Human
agagccacugggagacagagca

SEQ ID NO: 1041658 - RNA, 22 nt, Human
acuugauuuugaaccuuucuac

SEQ ID NO: 1041659 - RNA, 22 nt, Human
uugcauugugauuacagaggug

SEQ ID NO: 1041660 - RNA, 22 nt, Human
gcugggagcaaagccaugcaua

SEQ ID NO: 1041661 - RNA, 22 nt, Human
cccuguccuuggcugugaggcu

SEQ ID NO: 1041662 - RNA, 22 nt, Human
uuaguaauguguuaauaugaau

SEQ ID NO: 1041663 - RNA, 19 nt, Human
ccaggccuccugggagguc

SEQ ID NO: 1041664 - RNA, 22 nt, Human
cauuuucucaaugaacccucuu

SEQ ID NO: 1041665 - RNA, 22 nt, Human
uguguauuaccauuuuacagcu

SEQ ID NO: 1041666 - RNA, 17 nt, Human
gcuuccugugcugggga

SEQ ID NO: 1041667 - RNA, 22 nt, Human
uagggcagagcuuguacacgau

SEQ ID NO: 1041668 - RNA, 20 nt, Human
aggcucagagcaguaguaca

SEQ ID NO: 1041669 - RNA, 22 nt, Human
gcagcugagcgugaggaagagu

SEQ ID NO: 1041670 - RNA, 22 nt, Human
uuuauucuugagagugagaaga

SEQ ID NO: 1041671 - RNA, 22 nt, Human
gcuggccagggcugcucgcgga

SEQ ID NO: 1041672 - RNA, 22 nt, Human
agggaaaggcugaugcuguggg

SEQ ID NO: 1041673 - RNA, 22 nt, Human
cggcagagacggcgcuuugaac

SEQ ID NO: 1041674 - RNA, 22 nt, Human
ugucauugaggaaaacuaggug

SEQ ID NO: 1041675 - RNA, 22 nt, Human
gagagugagauaauuucacaua

SEQ ID NO: 1041676 - RNA, 22 nt, Human
cugagaaggaagccuccacucu

SEQ ID NO: 1041677 - RNA, 22 nt, Human
uccugggccuguacuccauccg

SEQ ID NO: 1041678 - RNA, 22 nt, Human
ggcucuggugaggguaggagau

SEQ ID NO: 1041679 - RNA, 22 nt, Human
agagaggcgaguuaccugugcu

SEQ ID NO: 1041680 - RNA, 22 nt, Human
cagcucugcugggaggaugcag

SEQ ID NO: 1041681 - RNA, 18 nt, Human
aaaaugcaggcgacaugg

SEQ ID NO: 1041682 - RNA, 20 nt, Human
uccucagaagacauuugggg

SEQ ID NO: 1041683 - RNA, 22 nt, Human
guggccaggccgacugccaggc

SEQ ID NO: 1041684 - RNA, 22 nt, Human
uccuucagucuucugagccaua

SEQ ID NO: 1041685 - RNA, 22 nt, Human
aguguacauguuuacagcaucu

SEQ ID NO: 1041686 - RNA, 22 nt, Human
ggagcagagcucuucaucugca

SEQ ID NO: 1041687 - RNA, 22 nt, Human
ccucccucuguuagagcugucu

SEQ ID NO: 1041688 - RNA, 22 nt, Human
uggccuuggacagagcgcuccu

SEQ ID NO: 1041689 - RNA, 22 nt, Human
cugcaggcugagcgccugccgg

SEQ ID NO: 1041690 - RNA, 20 nt, Human
gccugagcuauugccaggau

SEQ ID NO: 1041691 - RNA, 22 nt, Human
ucaccacugaacagaccuuugg

SEQ ID NO: 1041692 - RNA, 22 nt, Human
augcacccagugucuggacuau

SEQ ID NO: 1041693 - RNA, 21 nt, Human
cccagggaagccgcagucacc

SEQ ID NO: 1041694 - RNA, 22 nt, Human
ggaagagccuggggugucaggc

SEQ ID NO: 1041695 - RNA, 22 nt, Human
cucucuucccgugaguguugca

SEQ ID NO: 1041696 - RNA, 22 nt, Human
gcuggggaggcagcagagaaca

SEQ ID NO: 1041697 - RNA, 22 nt, Human
aaguucaaggugauaguggcag

SEQ ID NO: 1041698 - RNA, 22 nt, Human
ucucagaguuccucuggagucc

SEQ ID NO: 1041699 - RNA, 22 nt, Human
cuuauaguaugauguugagaau

SEQ ID NO: 1041700 - RNA, 19 nt, Human
cuggugcuugagugaguca

SEQ ID NO: 1041701 - RNA, 22 nt, Human
agcucccagagcucgagaguaa

SEQ ID NO: 1041702 - RNA, 22 nt, Human
gccccuggcuggccagcuccuc

SEQ ID NO: 1041703 - RNA, 22 nt, Human
acagauauaugauuguguaaau

SEQ ID NO: 1041704 - RNA, 18 nt, Human
aggcacagagcauacaua

SEQ ID NO: 1041705 - RNA, 21 nt, Human
guggccugauuaugaaugggu

SEQ ID NO: 1041706 - RNA, 22 nt, Human
cuguagccaguuuggccucacc

SEQ ID NO: 1041707 - RNA, 20 nt, Human
ucugucucugagcuagacuu

SEQ ID NO: 1041708 - RNA, 22 nt, Human
aagccucuggggccucaucugu

SEQ ID NO: 1041709 - RNA, 22 nt, Human
ccugucaguugcugucagggau

SEQ ID NO: 1041710 - RNA, 22 nt, Human
cugacucagcagcugaugaucc

SEQ ID NO: 1041711 - RNA, 22 nt, Human
ccucugcucugguccaugugcu

SEQ ID NO: 1041712 - RNA, 22 nt, Human
ugaacagaucaauagaacugac

SEQ ID NO: 1041713 - RNA, 22 nt, Human
caggcagcgcucguggccuggc

SEQ ID NO: 1041714 - RNA, 22 nt, Human
uggcagaggcucugugauguug

SEQ ID NO: 1041715 - RNA, 22 nt, Human
gagagaagaauguuccgaggcc

SEQ ID NO: 1041716 - RNA, 22 nt, Human
ugcucugggcaacagccucccu

SEQ ID NO: 1041717 - RNA, 20 nt, Human
uaugaagauaugugaacagc

SEQ ID NO: 1041718 - RNA, 22 nt, Human
uguggcugcucaggugcagacc

SEQ ID NO: 1041719 - RNA, 22 nt, Human
cagggaguuuuuguuccucuag

SEQ ID NO: 1041720 - RNA, 22 nt, Human
agggaaaguaagcauuucauua

SEQ ID NO: 1041721 - RNA, 22 nt, Human
uucaagauaauaggaaugaaaa

SEQ ID NO: 1041722 - RNA, 22 nt, Human
agagaugucgccuugcccaggg

SEQ ID NO: 1041723 - RNA, 22 nt, Human
aggcagagaaaaaccagauaug

SEQ ID NO: 1041724 - RNA, 22 nt, Human
aggcuuccgaguagcugggacu

SEQ ID NO: 1041725 - RNA, 22 nt, Human
uggcccgaccucugcucaugca

SEQ ID NO: 1041726 - RNA, 20 nt, Human
gcagcugcccccagucccug

SEQ ID NO: 1041727 - RNA, 23 nt, Human
ugaugggaaggaacgacuaccac

SEQ ID NO: 1041728 - RNA, 21 nt, Human
uaucuacuggugucuuucaga

SEQ ID NO: 1041729 - RNA, 22 nt, Human
uugcaccaaaugaguuaaaauu

SEQ ID NO: 1041730 - RNA, 22 nt, Human
gcucuggacuggggccugagaa

SEQ ID NO: 1041731 - RNA, 22 nt, Human
uuucacaaugcaauccuacuuc

SEQ ID NO: 1041732 - RNA, 22 nt, Human
aucaguuuauacuuauaaaucu

SEQ ID NO: 1041733 - RNA, 22 nt, Human
uccugccucaggcucuggagua

SEQ ID NO: 1041734 - RNA, 19 nt, Human
uguguaaagucugugguca

SEQ ID NO: 1041735 - RNA, 22 nt, Human
uaaauguauaggcacuaaaccu

SEQ ID NO: 1041736 - RNA, 22 nt, Human
ugggacagugugccuugcuccu

SEQ ID NO: 1041737 - RNA, 21 nt, Human
agucccaggggugagugaugu

SEQ ID NO: 1041738 - RNA, 22 nt, Human
ucccagagugagccaggggcag

SEQ ID NO: 1041739 - RNA, 22 nt, Human
gccucugcccuccugggacugc

SEQ ID NO: 1041740 - RNA, 22 nt, Human
agucucugccagcuuguccucu

SEQ ID NO: 1041741 - RNA, 22 nt, Human
cagggccucauccucagagauu

SEQ ID NO: 1041742 - RNA, 21 nt, Human
gcagccagccgagaccaugcc

SEQ ID NO: 1041743 - RNA, 22 nt, Human
uggcagaguucgcuccuauuca

SEQ ID NO: 1041744 - RNA, 22 nt, Human
caguuuuugccauuaagaguaa

SEQ ID NO: 1041745 - RNA, 22 nt, Human
gagcagugguugaacagaggca

SEQ ID NO: 1041746 - RNA, 22 nt, Human
ggcagaggagcuggaaacaugg

SEQ ID NO: 1041747 - RNA, 22 nt, Human
aggccugggcaagaaggggcgu

SEQ ID NO: 1041748 - RNA, 22 nt, Human
accucccagcucugagcuuggg

SEQ ID NO: 1041749 - RNA, 22 nt, Human
ugucacauguguggcauuuuuc

SEQ ID NO: 1041750 - RNA, 22 nt, Human
ugcugccuucuaggcgugcccu

SEQ ID NO: 1041751 - RNA, 22 nt, Human
cagccagggucaggcagcuucu

SEQ ID NO: 1041752 - RNA, 22 nt, Human
cagagguauugcaaaagccuag

SEQ ID NO: 1041753 - RNA, 22 nt, Human
aaacagcugucauuguuuuaaa

SEQ ID NO: 1041754 - RNA, 22 nt, Human
uuugcauuauauuuauagaaga

SEQ ID NO: 1041755 - RNA, 22 nt, Human
aacaucagaauauccauguugg

SEQ ID NO: 1041756 - RNA, 22 nt, Human
uuuauuugucuugccauuuagu

SEQ ID NO: 1041757 - RNA, 22 nt, Human
ccuccugguccagcaucucuuu

SEQ ID NO: 1041758 - RNA, 18 nt, Human
ugucauugccagggaagc

SEQ ID NO: 1041759 - RNA, 22 nt, Human
aaaugcacaggagaaccaauuc

SEQ ID NO: 1041760 - RNA, 22 nt, Human
agccagagcugaugucauucuc

SEQ ID NO: 1041761 - RNA, 22 nt, Human
agcagcagaggucagaaaggua

SEQ ID NO: 1041762 - RNA, 22 nt, Human
ugucccaguuuugcagguuaga

SEQ ID NO: 1041763 - RNA, 22 nt, Human
agauguaguagugggucuuuua

SEQ ID NO: 1041764 - RNA, 22 nt, Human
gguggccucucaugcaagguag

SEQ ID NO: 1041765 - RNA, 20 nt, Human
uauaacaguguugggugugu

SEQ ID NO: 1041766 - RNA, 22 nt, Human
ucaggcugugggcacuggccau

SEQ ID NO: 1041767 - RNA, 22 nt, Human
cuggagccccaggcugugcaga

SEQ ID NO: 1041768 - RNA, 22 nt, Human
gguuggaggugggaauagcuag

SEQ ID NO: 1041769 - RNA, 22 nt, Human
ugcagaagcugcaggucagugg

SEQ ID NO: 1041770 - RNA, 22 nt, Human
cagggugcagugucgcugcuag

SEQ ID NO: 1041771 - RNA, 22 nt, Human
gagcugucuggggacucugggu

SEQ ID NO: 1041772 - RNA, 22 nt, Human
uagggcaggugaagaaaagcua

SEQ ID NO: 1041773 - RNA, 22 nt, Human
gagcucagcccaaagagcagug

SEQ ID NO: 1041774 - RNA, 22 nt, Human
ccagagcaauucucacagaacu

SEQ ID NO: 1041775 - RNA, 22 nt, Human
agcagggccucuggcacugguc

SEQ ID NO: 1041776 - RNA, 22 nt, Human
agccuguggaucccugcacugg

SEQ ID NO: 1041777 - RNA, 22 nt, Human
agccacagcaacaagugcaauu

SEQ ID NO: 1041778 - RNA, 19 nt, Human
acagaaauuaguuauuuuc

SEQ ID NO: 1041779 - RNA, 22 nt, Human
uuagaaacccagacucuuaggu

SEQ ID NO: 1041780 - RNA, 18 nt, Human
gaaaggagagacaguagg

SEQ ID NO: 1041781 - RNA, 22 nt, Human
guuugauucaagaacaaagagu

SEQ ID NO: 1041782 - RNA, 22 nt, Human
gagaaguuucugguuugcauag

SEQ ID NO: 1041783 - RNA, 22 nt, Human
uugaacauuaacuucagucuau

SEQ ID NO: 1041784 - RNA, 22 nt, Human
guggccagaagacugcaaugcu

SEQ ID NO: 1041785 - RNA, 22 nt, Human
cccagggacagcuagguggggc

SEQ ID NO: 1041786 - RNA, 22 nt, Human
uucaagaugacccagucacacg

SEQ ID NO: 1041787 - RNA, 22 nt, Human
ccagcccuccuccaucagagga

SEQ ID NO: 1041788 - RNA, 22 nt, Human
acuggcucagaguuccuagaga

SEQ ID NO: 1041789 - RNA, 20 nt, Human
cuguccccgaggucaccagg

SEQ ID NO: 1041790 - RNA, 22 nt, Human
ggccugagaaccauggggccaa

SEQ ID NO: 1041791 - RNA, 22 nt, Human
ggacacaagcuccggggcugca

SEQ ID NO: 1041792 - RNA, 22 nt, Human
ugguacuuggaggcagaaaaau

SEQ ID NO: 1041793 - RNA, 22 nt, Human
uauuucugggaguucagaaauu

SEQ ID NO: 1041794 - RNA, 22 nt, Human
guuugcauguguacuuaauugg

SEQ ID NO: 1041795 - RNA, 22 nt, Human
ccacagcaugcaggccugacac

SEQ ID NO: 1041796 - RNA, 22 nt, Human
gagugugggcacgggggccuug

SEQ ID NO: 1041797 - RNA, 22 nt, Human
augggggccugaacaggcaaaa

SEQ ID NO: 1041798 - RNA, 22 nt, Human
ccucaggggugcccacagcugc

SEQ ID NO: 1041799 - RNA, 22 nt, Human
cccucugcucaggugcauaggc

SEQ ID NO: 1041800 - RNA, 22 nt, Human
cauauaaauacaacauguguua

SEQ ID NO: 1041801 - RNA, 22 nt, Human
gaugugggguugagggaccagc

SEQ ID NO: 1041802 - RNA, 22 nt, Human
ucucagagaugucaagagucua

SEQ ID NO: 1041803 - RNA, 22 nt, Human
uucauucccaagaguaaacaua

SEQ ID NO: 1041804 - RNA, 22 nt, Human
cccagcuccgagcuccgagccg

SEQ ID NO: 1041805 - RNA, 17 nt, Human
cagggcugucugccuag

SEQ ID NO: 1041806 - RNA, 22 nt, Human
ggcugccaggagggaggccagu

SEQ ID NO: 1041807 - RNA, 22 nt, Human
uccugcugagcgucugucauuu

SEQ ID NO: 1041808 - RNA, 22 nt, Human
agcugcaggcccaugcucaguc

SEQ ID NO: 1041809 - RNA, 22 nt, Human
ucucagagcuucagaaagcacc

SEQ ID NO: 1041810 - RNA, 22 nt, Human
auauuucuccaaauguuuucaa

SEQ ID NO: 1041811 - RNA, 22 nt, Human
uagggcagcugcaucaggcacu

SEQ ID NO: 1041812 - RNA, 22 nt, Human
gcucccugccuacacggaccuu

SEQ ID NO: 1041813 - RNA, 22 nt, Human
cugaaggaagcagguggccugu

SEQ ID NO: 1041814 - RNA, 22 nt, Human
aaguuacaggagaaagagauca

SEQ ID NO: 1041815 - RNA, 22 nt, Human
uaugcauaugaccccaagcuug

SEQ ID NO: 1041816 - RNA, 22 nt, Human
ggcuuccuggggccuccugcaa

SEQ ID NO: 1041817 - RNA, 22 nt, Human
cugcaggcaucuaacugugggc

SEQ ID NO: 1041818 - RNA, 19 nt, Human
gcuuuuuguugucaaaggu

SEQ ID NO: 1041819 - RNA, 22 nt, Human
ugucccuggaacuauggcucca

SEQ ID NO: 1041820 - RNA, 22 nt, Human
guguggcuaccucagaggagca

SEQ ID NO: 1041821 - RNA, 22 nt, Human
acccugggcuuggccugcucag

SEQ ID NO: 1041822 - RNA, 22 nt, Human
aggaccuguagggccugcaucc

SEQ ID NO: 1041823 - RNA, 22 nt, Human
caggcagccugcggucugcaca

SEQ ID NO: 1041824 - RNA, 22 nt, Human
cauggcagagaaggggaacugg

SEQ ID NO: 1041825 - RNA, 22 nt, Human
aggccucuucagggagcaugga

SEQ ID NO: 1041826 - RNA, 22 nt, Human
ccagcucugcagggccuggggu

SEQ ID NO: 1041827 - RNA, 22 nt, Human
ucucaagcuuguugguauguuu

SEQ ID NO: 1041828 - RNA, 22 nt, Human
agcuggguguguaucagauaaa

SEQ ID NO: 1041829 - RNA, 22 nt, Human
cccaggcugaguuagagguguc

SEQ ID NO: 1041830 - RNA, 22 nt, Human
auuuucugguugagguuuaaca

SEQ ID NO: 1041831 - RNA, 22 nt, Human
gccugagcccaggugugcagag

SEQ ID NO: 1041832 - RNA, 22 nt, Human
ggucacugcucuaaacaaaagu

SEQ ID NO: 1041833 - RNA, 22 nt, Human
ugucucaggggcauugaaauaa

SEQ ID NO: 1041834 - RNA, 18 nt, Human
cagaagcaggcagugcag

SEQ ID NO: 1041835 - RNA, 22 nt, Human
ucaaauaugugauagaagcuaa

SEQ ID NO: 1041836 - RNA, 22 nt, Human
ugggggugugccagggaccucc

SEQ ID NO: 1041837 - RNA, 22 nt, Human
ugcagcuguuacggacccuguc

SEQ ID NO: 1041838 - RNA, 22 nt, Human
ugcaauaaguuguguuaucacu

SEQ ID NO: 1041839 - RNA, 22 nt, Human
gagccuguguuuccuguagcca

SEQ ID NO: 1041840 - RNA, 20 nt, Human
acuggagccaucucagccua

SEQ ID NO: 1041841 - RNA, 22 nt, Human
cuguuuaucuaggaguugcagg

SEQ ID NO: 1041842 - RNA, 22 nt, Human
uugaggagucaggggcacggaa

SEQ ID NO: 1041843 - RNA, 23 nt, Human
acugagccagggccugggucagc

SEQ ID NO: 1041844 - RNA, 22 nt, Human
gcugucuggguugagggcccug

SEQ ID NO: 1041845 - RNA, 22 nt, Human
auucuucauguugaagcuguca

SEQ ID NO: 1041846 - RNA, 22 nt, Human
ucagagagccucaggcacugcc

SEQ ID NO: 1041847 - RNA, 22 nt, Human
gugcaugugcauccauguguac

SEQ ID NO: 1041848 - RNA, 22 nt, Human
gggccugacugagagcuccuca

SEQ ID NO: 1041849 - RNA, 23 nt, Human
gguggcaggaguggaugcugagc

SEQ ID NO: 1041850 - RNA, 22 nt, Human
ggccagaggccacagcuguguc

SEQ ID NO: 1041851 - RNA, 22 nt, Human
ugcaguggugguaaagaugcuc

SEQ ID NO: 1041852 - RNA, 21 nt, Human
uuaagagcuuagcaguaggcc

SEQ ID NO: 1041853 - RNA, 22 nt, Human
cagcagccuacaaugcacagaa

SEQ ID NO: 1041854 - RNA, 22 nt, Human
uucuggagaucugccuauggga

SEQ ID NO: 1041855 - RNA, 22 nt, Human
uauuucugaggcccaggaagug

SEQ ID NO: 1041856 - RNA, 22 nt, Human
uggccuuggcagugagaagagu

SEQ ID NO: 1041857 - RNA, 21 nt, Human
agugaaauugcaucagaggga

SEQ ID NO: 1041858 - RNA, 22 nt, Human
gagcucuggcagggcaggucug

SEQ ID NO: 1041859 - RNA, 22 nt, Human
auuguaucuugucauuaugcau

SEQ ID NO: 1041860 - RNA, 22 nt, Human
acagguggccccgagggagugg

SEQ ID NO: 1041861 - RNA, 22 nt, Human
ugcagaggagcuggaaggcugg

SEQ ID NO: 1041862 - RNA, 22 nt, Human
gagcuuugcuggaagccugggg

SEQ ID NO: 1041863 - RNA, 23 nt, Human
ugcuguccaacagacuggccaug

SEQ ID NO: 1041864 - RNA, 21 nt, Human
ucagggcagugggagguuccu

SEQ ID NO: 1041865 - RNA, 20 nt, Human
uccagcugggaacagcugau

SEQ ID NO: 1041866 - RNA, 22 nt, Human
gcccucagcuccuggacacaug

SEQ ID NO: 1041867 - RNA, 22 nt, Human
ccuggccuuaagggcagggagc

SEQ ID NO: 1041868 - RNA, 22 nt, Human
cagcugaguuacucugaggucu

SEQ ID NO: 1041869 - RNA, 19 nt, Human
ggagccuggagcacgugcc

SEQ ID NO: 1041870 - RNA, 22 nt, Human
ggcccugggaugcucagcagug

SEQ ID NO: 1041871 - RNA, 22 nt, Human
uuaaaaccaucagcuguaagau

SEQ ID NO: 1041872 - RNA, 22 nt, Human
ccacagggcacagacaggaagc

SEQ ID NO: 1041873 - RNA, 22 nt, Human
caggccucccggugcacacuga

SEQ ID NO: 1041874 - RNA, 22 nt, Human
aaucaguucuacaucuuaucca

SEQ ID NO: 1041875 - RNA, 22 nt, Human
gcucuggcuacuguggcuaccg

SEQ ID NO: 1041876 - RNA, 22 nt, Human
ggcuuccuuucacuacccucag

SEQ ID NO: 1041877 - RNA, 22 nt, Human
cuccaggggccagaagccuggc

SEQ ID NO: 1041878 - RNA, 22 nt, Human
uggcaguggcucagagugcaga

SEQ ID NO: 1041879 - RNA, 22 nt, Human
aauucuagcauugugaaaauau

SEQ ID NO: 1041880 - RNA, 22 nt, Human
gccuggcaggccucaugagggg

SEQ ID NO: 1041881 - RNA, 22 nt, Human
cagcagagcugugugggaaggg

SEQ ID NO: 1041882 - RNA, 22 nt, Human
uagagcauuuagaggggcagga

SEQ ID NO: 1041883 - RNA, 22 nt, Human
aagaaucauccugcaagagucu

SEQ ID NO: 1041884 - RNA, 22 nt, Human
gcugcagcuguaggacacaauu

SEQ ID NO: 1041885 - RNA, 22 nt, Human
acacaggaagucagcacugaug

SEQ ID NO: 1041886 - RNA, 19 nt, Human
ugccugucaguagaucuca

SEQ ID NO: 1041887 - RNA, 22 nt, Human
ggcaggcaggagcgugcuuggg

SEQ ID NO: 1041888 - RNA, 22 nt, Human
ccagcugcgggcaucgagaguu

SEQ ID NO: 1041889 - RNA, 22 nt, Human
acuccuggggcugccaucacag

SEQ ID NO: 1041890 - RNA, 19 nt, Human
auacacauacguaaacuga

SEQ ID NO: 1041891 - RNA, 22 nt, Human
ccugugaggucaucugugguaa

SEQ ID NO: 1041892 - RNA, 22 nt, Human
aacaguaucuuuuaucagaaau

SEQ ID NO: 1041893 - RNA, 22 nt, Human
cuguguggccucaagccagccu

SEQ ID NO: 1041894 - RNA, 22 nt, Human
cugggaggcggagguuguagug

SEQ ID NO: 1041895 - RNA, 22 nt, Human
uucuuuccacagaggggaugau

SEQ ID NO: 1041896 - RNA, 22 nt, Human
aggucaaaccacagcucuaggc

SEQ ID NO: 1041897 - RNA, 22 nt, Human
cuggcugcaggaugaggcugcc

SEQ ID NO: 1041898 - RNA, 22 nt, Human
gcugagaggcacuaucuccgga

SEQ ID NO: 1041899 - RNA, 20 nt, Human
ccugucuccucuuaccuggc

SEQ ID NO: 1041900 - RNA, 22 nt, Human
uugcucagcacuggagccagcu

SEQ ID NO: 1041901 - RNA, 22 nt, Human
gucauuguguggacauggagaa

SEQ ID NO: 1041902 - RNA, 16 nt, Human
gccuggaguggcaggg

SEQ ID NO: 1041903 - RNA, 22 nt, Human
gcucaggaucccaggggugugc

SEQ ID NO: 1041904 - RNA, 22 nt, Human
aggcuuccucgugccuuagaua

SEQ ID NO: 1041905 - RNA, 22 nt, Human
gcuggcagaauuucuucuugcu

SEQ ID NO: 1041906 - RNA, 22 nt, Human
ugcugccaugcagagcaacaga

SEQ ID NO: 1041907 - RNA, 22 nt, Human
aggagggugauccgggcugguc

SEQ ID NO: 1041908 - RNA, 22 nt, Human
aaugaacaaaauaugcuuugca

SEQ ID NO: 1041909 - RNA, 18 nt, Human
ccuggaccugucuccuuu

SEQ ID NO: 1041910 - RNA, 22 nt, Human
cuaauacucauuucuguaacuc

SEQ ID NO: 1041911 - RNA, 22 nt, Human
ucucagagaccugaacucccug

SEQ ID NO: 1041912 - RNA, 21 nt, Human
uggcugccuacaugcugcagg

SEQ ID NO: 1041913 - RNA, 22 nt, Human
agccucugcuuaugcaaaggua

SEQ ID NO: 1041914 - RNA, 22 nt, Human
cucugggcacauuuuccaggac

SEQ ID NO: 1041915 - RNA, 22 nt, Human
agaaaagguugaaaguaggauu

SEQ ID NO: 1041916 - RNA, 22 nt, Human
acugcuuuagaccuagagcucu

SEQ ID NO: 1041917 - RNA, 22 nt, Human
cagggccagagagggcuggcug

SEQ ID NO: 1041918 - RNA, 22 nt, Human
caggagcccagaguccucagcu

SEQ ID NO: 1041919 - RNA, 22 nt, Human
uaaagguaugucuuaaucaaac

SEQ ID NO: 1041920 - RNA, 21 nt, Human
acagacagggccagugucccc

SEQ ID NO: 1041921 - RNA, 22 nt, Human
ugcucugguaacucacuuccau

SEQ ID NO: 1041922 - RNA, 22 nt, Human
aaggcugagacagcacaggucc

SEQ ID NO: 1041923 - RNA, 21 nt, Human
agguggggcugcaccucugcu

SEQ ID NO: 1041924 - RNA, 22 nt, Human
gcccucugcacagcucugagca

SEQ ID NO: 1041925 - RNA, 23 nt, Human
acagggcauugcuggccucgagg

SEQ ID NO: 1041926 - RNA, 22 nt, Human
gagucccaugaugauagccaca

SEQ ID NO: 1041927 - RNA, 22 nt, Human
ccagagccggauugugaagugc

SEQ ID NO: 1041928 - RNA, 22 nt, Human
gggcagugguccaggcuacagc

SEQ ID NO: 1041929 - RNA, 22 nt, Human
ugguccaggguguaguacagag

SEQ ID NO: 1041930 - RNA, 22 nt, Human
agcuggggcugcagagaacagg

SEQ ID NO: 1041931 - RNA, 22 nt, Human
auaauuuaauuuucacaguggu

SEQ ID NO: 1041932 - RNA, 22 nt, Human
gggcuggaucuccugcaggcag

SEQ ID NO: 1041933 - RNA, 22 nt, Human
cagccaggccuggugaccaaag

SEQ ID NO: 1041934 - RNA, 22 nt, Human
guccugggcccaggggcugccu

SEQ ID NO: 1041935 - RNA, 22 nt, Human
uggcucagaugcucuuccagug

SEQ ID NO: 1041936 - RNA, 22 nt, Human
ccucacucugcacccugcagca

SEQ ID NO: 1041937 - RNA, 21 nt, Human
uggcacugcuuagcagguucc

SEQ ID NO: 1041938 - RNA, 22 nt, Human
cagaggcugcucuggguggcau

SEQ ID NO: 1041939 - RNA, 22 nt, Human
ugggccugggcuccuguccucu

SEQ ID NO: 1041940 - RNA, 22 nt, Human
uguguccauucaggcacugacc

SEQ ID NO: 1041941 - RNA, 22 nt, Human
gccaggcugcuggcugcugucc

SEQ ID NO: 1041942 - RNA, 22 nt, Human
uggcagaggaaaaagucacugg

SEQ ID NO: 1041943 - RNA, 22 nt, Human
gggcacugcuggaggcucccug

SEQ ID NO: 1041944 - RNA, 19 nt, Human
gaaggagagcugaguuagg

SEQ ID NO: 1041945 - RNA, 23 nt, Human
auuugagaaaguauuuuuaagac

SEQ ID NO: 1041946 - RNA, 22 nt, Human
caguauguacucuuaucaugua

SEQ ID NO: 1041947 - RNA, 20 nt, Human
gucagugucuucaguaguga

SEQ ID NO: 1041948 - RNA, 22 nt, Human
cccugccuucuuggccuuuaaa

SEQ ID NO: 1041949 - RNA, 22 nt, Human
uuuauguaauuucauaggugug

SEQ ID NO: 1041950 - RNA, 22 nt, Human
gcaggaugggagcuucacuuug

SEQ ID NO: 1041951 - RNA, 22 nt, Human
ucaaaguaaaaguauagaguuu

SEQ ID NO: 1041952 - RNA, 22 nt, Human
agauuucaaugugagcauuagu

SEQ ID NO: 1041953 - RNA, 22 nt, Human
uaugaagauauaucugaucucu

SEQ ID NO: 1041954 - RNA, 22 nt, Human
uuuggaaaguguacaaauuuga

SEQ ID NO: 1041955 - RNA, 21 nt, Human
acagagccgggcacaaagcug

SEQ ID NO: 1041956 - RNA, 22 nt, Human
ucacuuaaaaauucuaguuaug

SEQ ID NO: 1041957 - RNA, 23 nt, Human
gcagaggagcaagcuggacacca

SEQ ID NO: 1041958 - RNA, 22 nt, Human
ugaagccaucccucagauggcc

SEQ ID NO: 1041959 - RNA, 22 nt, Human
ucuccuuuaagauuuccucagg

SEQ ID NO: 1041960 - RNA, 23 nt, Human
acacaauagaguacuauucagcc

SEQ ID NO: 1041961 - RNA, 22 nt, Human
cuucccacuaguaucacagagc

SEQ ID NO: 1041962 - RNA, 22 nt, Human
agauacauuaguaguuacuugu

SEQ ID NO: 1041963 - RNA, 17 nt, Human
cugagcauccgugcucu

SEQ ID NO: 1041964 - RNA, 22 nt, Human
gcuggggagggcgucaaggcca

SEQ ID NO: 1041965 - RNA, 22 nt, Human
aguuuauguaaaauuaguaaug

SEQ ID NO: 1041966 - RNA, 22 nt, Human
cucugugauuuugugagccaga

SEQ ID NO: 1041967 - RNA, 21 nt, Human
agacagagugcagucuacaua

SEQ ID NO: 1041968 - RNA, 22 nt, Human
acagacagauuuugucugaugu

SEQ ID NO: 1041969 - RNA, 22 nt, Human
cuugcuuuguccagaaauucag

SEQ ID NO: 1041970 - RNA, 22 nt, Human
gagcuucccucugcagucccug

SEQ ID NO: 1041971 - RNA, 21 nt, Human
guggcccugccgcagugucca

SEQ ID NO: 1041972 - RNA, 22 nt, Human
gccagccuucuguggccugcaa

SEQ ID NO: 1041973 - RNA, 22 nt, Human
uggcucuguuuuaugaguacca

SEQ ID NO: 1041974 - RNA, 22 nt, Human
aaugagcuagaccugcuuccuc

SEQ ID NO: 1041975 - RNA, 22 nt, Human
gcuggccugggcagaggcuaug

SEQ ID NO: 1041976 - RNA, 18 nt, Human
aggcccuggccucgaaca

SEQ ID NO: 1041977 - RNA, 22 nt, Human
aggggagaguuaaugugaaugu

SEQ ID NO: 1041978 - RNA, 22 nt, Human
aaggaagacacagaugaaguga

SEQ ID NO: 1041979 - RNA, 22 nt, Human
ccagaagggcuauugcagugac

SEQ ID NO: 1041980 - RNA, 22 nt, Human
aggauccuuuuucugcuguuug

SEQ ID NO: 1041981 - RNA, 22 nt, Human
ggucauugucagagccuguacu

SEQ ID NO: 1041982 - RNA, 22 nt, Human
uggccuuccuggugacucauga

SEQ ID NO: 1041983 - RNA, 22 nt, Human
uucuuuccucccagccuuugga

SEQ ID NO: 1041984 - RNA, 22 nt, Human
ggggauggauuccgggucccug

SEQ ID NO: 1041985 - RNA, 22 nt, Human
cucugcuuggaacuggacagaa

SEQ ID NO: 1041986 - RNA, 22 nt, Human
ggccucucucccuggcuugcag

SEQ ID NO: 1041987 - RNA, 22 nt, Human
accaaggaguuugguauuuuag

SEQ ID NO: 1041988 - RNA, 22 nt, Human
cagccugcccuggaagcccagc

SEQ ID NO: 1041989 - RNA, 22 nt, Human
ccagcuggagccaagguggacu

SEQ ID NO: 1041990 - RNA, 21 nt, Human
aaggagccuaggaggcucagg

SEQ ID NO: 1041991 - RNA, 22 nt, Human
ggaggccaaagugugggcggcu

SEQ ID NO: 1041992 - RNA, 22 nt, Human
agcugcuguggggcucggccug

SEQ ID NO: 1041993 - RNA, 22 nt, Human
caauguguguguuuuucucaac

SEQ ID NO: 1041994 - RNA, 22 nt, Human
agggaucaaaaaauguacaugc

SEQ ID NO: 1041995 - RNA, 22 nt, Human
uccagccaagggagguuacuag

SEQ ID NO: 1041996 - RNA, 22 nt, Human
aaggcugaggagggccugcagg

SEQ ID NO: 1041997 - RNA, 22 nt, Human
caggccucaggggcucaggcug

SEQ ID NO: 1041998 - RNA, 22 nt, Human
aagauucucagagugaaagaau

SEQ ID NO: 1041999 - RNA, 22 nt, Human
aggcagcuggcagcacccaggg

SEQ ID NO: 1042000 - RNA, 22 nt, Human
ccugggcuggaguacagcagug

SEQ ID NO: 1042001 - RNA, 19 nt, Human
accucugcagagauguuua

SEQ ID NO: 1042002 - RNA, 22 nt, Human
gccuucagcggccgcucgcugc

SEQ ID NO: 1042003 - RNA, 22 nt, Human
cagaaugcaaauuuuauaauau

SEQ ID NO: 1042004 - RNA, 19 nt, Human
acacagggcuagaguuaca

SEQ ID NO: 1042005 - RNA, 22 nt, Human
aggcugccaaagcuucugucuc

SEQ ID NO: 1042006 - RNA, 22 nt, Human
gcagcaaucuucacagugucau

SEQ ID NO: 1042007 - RNA, 18 nt, Human
acagacaaaauggaaaug

SEQ ID NO: 1042008 - RNA, 22 nt, Human
cauuuacauuuaagguuaauau

SEQ ID NO: 1042009 - RNA, 22 nt, Human
uuguccuuaccucaaucuggaa

SEQ ID NO: 1042010 - RNA, 22 nt, Human
cauuaucucuucuauaugcuag

SEQ ID NO: 1042011 - RNA, 22 nt, Human
uggcucaggagggaucuuugcu

SEQ ID NO: 1042012 - RNA, 22 nt, Human
accaucagucauugucaguggg

SEQ ID NO: 1042013 - RNA, 22 nt, Human
cugagcugggcucucuugaggg

SEQ ID NO: 1042014 - RNA, 22 nt, Human
cagagagaggccacugcuauua

SEQ ID NO: 1042015 - RNA, 22 nt, Human
ggccugagcuugggcagcguau

SEQ ID NO: 1042016 - RNA, 22 nt, Human
gcaugggcaagaggacuggggg

SEQ ID NO: 1042017 - RNA, 22 nt, Human
gccuggaggaauguagcugagg

SEQ ID NO: 1042018 - RNA, 22 nt, Human
agagcugugcuuugcaccacgu

SEQ ID NO: 1042019 - RNA, 22 nt, Human
gcuugggauaugcugauguaaa

SEQ ID NO: 1042020 - RNA, 18 nt, Human
aucuuuccauagcauguu

SEQ ID NO: 1042021 - RNA, 22 nt, Human
uaggacaggugaggggcugugg

SEQ ID NO: 1042022 - RNA, 22 nt, Human
gaacccaguccaggugcagccu

SEQ ID NO: 1042023 - RNA, 22 nt, Human
cuucagggugacgcaggcugca

SEQ ID NO: 1042024 - RNA, 22 nt, Human
ugcaccauuuugucaggcuacu

SEQ ID NO: 1042025 - RNA, 22 nt, Human
accaaggagccacauacaaccu

SEQ ID NO: 1042026 - RNA, 22 nt, Human
uggccuggaagagaggucgagg

SEQ ID NO: 1042027 - RNA, 22 nt, Human
aaaauguguuuaugcauuucgu

SEQ ID NO: 1042028 - RNA, 22 nt, Human
uaggcaggugugcacugcccac

SEQ ID NO: 1042029 - RNA, 22 nt, Human
acauacauaugacaacuuuccu

SEQ ID NO: 1042030 - RNA, 22 nt, Human
uugaaaggguuaaagugguaaa

SEQ ID NO: 1042031 - RNA, 22 nt, Human
uucuggaggccccuuccuucuc

SEQ ID NO: 1042032 - RNA, 22 nt, Human
aucaguuuggugcuuucaguga

SEQ ID NO: 1042033 - RNA, 22 nt, Human
ccagccaggcuggcuguggagg

SEQ ID NO: 1042034 - RNA, 22 nt, Human
ccugggcucaagugauccuccu

SEQ ID NO: 1042035 - RNA, 22 nt, Human
gcugccugauuuacauagugaa

SEQ ID NO: 1042036 - RNA, 22 nt, Human
ucaaugauagacaagaucuaag

SEQ ID NO: 1042037 - RNA, 22 nt, Human
uagagcuggaauuugcagcaag

SEQ ID NO: 1042038 - RNA, 22 nt, Human
agccaggauggucucgaucggc

SEQ ID NO: 1042039 - RNA, 22 nt, Human
gaggcugguaggaaaggaaaca

SEQ ID NO: 1042040 - RNA, 22 nt, Human
uggcagaguucgcugugccuuu

SEQ ID NO: 1042041 - RNA, 18 nt, Human
caguuuuuauaucuggca

SEQ ID NO: 1042042 - RNA, 22 nt, Human
gcucaagagagaugcaguucuu

SEQ ID NO: 1042043 - RNA, 22 nt, Human
uuugggaaacuuaggggucaga

SEQ ID NO: 1042044 - RNA, 22 nt, Human
gagcagcuagauaaagcccuuc

SEQ ID NO: 1042045 - RNA, 22 nt, Human
guguaaggccccagguucuuua

SEQ ID NO: 1042046 - RNA, 22 nt, Human
uaaggcacacaguugcugcaug

SEQ ID NO: 1042047 - RNA, 20 nt, Human
gaggccucagccucagcucc

SEQ ID NO: 1042048 - RNA, 22 nt, Human
acagaguaucuaucaggaguau

SEQ ID NO: 1042049 - RNA, 22 nt, Human
ccugcagguccccggaugcgca

SEQ ID NO: 1042050 - RNA, 22 nt, Human
gaagcagcugccagagaugucu

SEQ ID NO: 1042051 - RNA, 22 nt, Human
uucuuucccuuccagcagcucc

SEQ ID NO: 1042052 - RNA, 22 nt, Human
ucaggaucggccuuuuuuuaag

SEQ ID NO: 1042053 - RNA, 22 nt, Human
ggcagcuggguuggccagaaac

SEQ ID NO: 1042054 - RNA, 22 nt, Human
aagagcuggaugaagaaaucaa

SEQ ID NO: 1042055 - RNA, 22 nt, Human
gggcugggaauggcuaaguaug

SEQ ID NO: 1042056 - RNA, 22 nt, Human
cagcugccacaccucuuucucu

SEQ ID NO: 1042057 - RNA, 22 nt, Human
uauugucuguccgggucaaagc

SEQ ID NO: 1042058 - RNA, 22 nt, Human
caggcuggagugaguguagugg

SEQ ID NO: 1042059 - RNA, 20 nt, Human
ugagugauggaggcggguca

SEQ ID NO: 1042060 - RNA, 22 nt, Human
gauuauauaauggaagcucuug

SEQ ID NO: 1042061 - RNA, 22 nt, Human
acagggcagaaauguugcaucu

SEQ ID NO: 1042062 - RNA, 22 nt, Human
uguuaucugagcaacgucgacg

SEQ ID NO: 1042063 - RNA, 22 nt, Human
gggcuugcugauuugggcagga

SEQ ID NO: 1042064 - RNA, 22 nt, Human
gucccuggaucugggacagcug

SEQ ID NO: 1042065 - RNA, 22 nt, Human
ggccagggggcuucagacucca

SEQ ID NO: 1042066 - RNA, 22 nt, Human
cuggcuucugggccagggcaga

SEQ ID NO: 1042067 - RNA, 19 nt, Human
ucauucaggaccaguggau

SEQ ID NO: 1042068 - RNA, 22 nt, Human
ucucugauguauaucagagaac

SEQ ID NO: 1042069 - RNA, 22 nt, Human
auugaaagauaggcuacugugg

SEQ ID NO: 1042070 - RNA, 20 nt, Human
ucauccaggacaggaguggc

SEQ ID NO: 1042071 - RNA, 22 nt, Human
ccagcuggcaggagagucaggg

SEQ ID NO: 1042072 - RNA, 22 nt, Human
uggccaggggaguuccccucca

SEQ ID NO: 1042073 - RNA, 22 nt, Human
ugucucugguauuaggugaaaa

SEQ ID NO: 1042074 - RNA, 20 nt, Human
cagagacccaggcuucagcu

SEQ ID NO: 1042075 - RNA, 22 nt, Human
agcuucuggaaggcaaggcuug

SEQ ID NO: 1042076 - RNA, 22 nt, Human
uauauagaaaagcagauguugg

SEQ ID NO: 1042077 - RNA, 22 nt, Human
gauacauuuuaucuccuaacag

SEQ ID NO: 1042078 - RNA, 20 nt, Human
gcucccugguagaaauguuu

SEQ ID NO: 1042079 - RNA, 22 nt, Human
gcugcaggggggucuggacuug

SEQ ID NO: 1042080 - RNA, 22 nt, Human
ucccagagaaagucaaggucuu

SEQ ID NO: 1042081 - RNA, 22 nt, Human
ugaggccaggaucccaggcucu

SEQ ID NO: 1042082 - RNA, 22 nt, Human
caggaaccuaaagagacauuac

SEQ ID NO: 1042083 - RNA, 23 nt, Human
aucaagauaauccagaugaccua

SEQ ID NO: 1042084 - RNA, 22 nt, Human
ugggcagaggcucugaagucca

SEQ ID NO: 1042085 - RNA, 22 nt, Human
gcaugguggccuuaggguagcc

SEQ ID NO: 1042086 - RNA, 22 nt, Human
agcgggugcugugucagcccuc

SEQ ID NO: 1042087 - RNA, 22 nt, Human
gguggccucgguggugcacagg

SEQ ID NO: 1042088 - RNA, 22 nt, Human
aagggcaggaaaagauggaugu

SEQ ID NO: 1042089 - RNA, 22 nt, Human
ggguaauuggggccuugcagug

SEQ ID NO: 1042090 - RNA, 22 nt, Human
gcccaugcucucaggcgggccu

SEQ ID NO: 1042091 - RNA, 22 nt, Human
gcugcccucccagggcaagcuu

SEQ ID NO: 1042092 - RNA, 20 nt, Human
ugucauuguuucuaggaccu

SEQ ID NO: 1042093 - RNA, 22 nt, Human
auucuuggcaaggagauuuaaa

SEQ ID NO: 1042094 - RNA, 22 nt, Human
agcugguaugaacaggauagga

SEQ ID NO: 1042095 - RNA, 22 nt, Human
ucauaacagcuaagucccuuuc

SEQ ID NO: 1042096 - RNA, 22 nt, Human
guccugggaaggaagccaggga

SEQ ID NO: 1042097 - RNA, 22 nt, Human
ucagggacugcagagggaagcu

SEQ ID NO: 1042098 - RNA, 22 nt, Human
cacaccuguaauaccagcuacu

SEQ ID NO: 1042099 - RNA, 22 nt, Human
aggcuauuuccacucuucucau

SEQ ID NO: 1042100 - RNA, 20 nt, Human
cacagcuugccuuuuaugac

SEQ ID NO: 1042101 - RNA, 22 nt, Human
cugccuggcuaaacucaagucg

SEQ ID NO: 1042102 - RNA, 22 nt, Human
uggcagcagacaaaaggccauu

SEQ ID NO: 1042103 - RNA, 22 nt, Human
ccaggccucuggcugcuuaguc

SEQ ID NO: 1042104 - RNA, 22 nt, Human
ccagggucucugcugccugaga

SEQ ID NO: 1042105 - RNA, 22 nt, Human
ugugugacccccagugaagccu

SEQ ID NO: 1042106 - RNA, 22 nt, Human
gcucaggaaacagcagggcuug

SEQ ID NO: 1042107 - RNA, 22 nt, Human
agcagagaagacacaggcuuca

SEQ ID NO: 1042108 - RNA, 22 nt, Human
uggcucagaacuacuucuaguu

SEQ ID NO: 1042109 - RNA, 23 nt, Human
acagcugcaccuggccgccuggc

SEQ ID NO: 1042110 - RNA, 22 nt, Human
cuugcaggauuuugcugcugua

SEQ ID NO: 1042111 - RNA, 22 nt, Human
agaacagcaguuaugguucauu

SEQ ID NO: 1042112 - RNA, 19 nt, Human
acacagggaucagaggguu

SEQ ID NO: 1042113 - RNA, 22 nt, Human
ugauuuccugugcgcccuuagg

SEQ ID NO: 1042114 - RNA, 16 nt, Human
agcagccagcacugga

SEQ ID NO: 1042115 - RNA, 22 nt, Human
cacaagagagugcgcguugcaa

SEQ ID NO: 1042116 - RNA, 22 nt, Human
caugccaguuuugagaugcacc

SEQ ID NO: 1042117 - RNA, 22 nt, Human
ggguccagcgacagcaggcuca

SEQ ID NO: 1042118 - RNA, 22 nt, Human
ccacacagucaguuuccaagaa

SEQ ID NO: 1042119 - RNA, 22 nt, Human
cagagguagaaggcaugcagug

SEQ ID NO: 1042120 - RNA, 22 nt, Human
gcugucagcgcccaaggagcuc

SEQ ID NO: 1042121 - RNA, 21 nt, Human
ugcugccaucaugcagagaug

SEQ ID NO: 1042122 - RNA, 22 nt, Human
gggcacugcuuugcucugucac

SEQ ID NO: 1042123 - RNA, 22 nt, Human
agcugccacugagggugcacag

SEQ ID NO: 1042124 - RNA, 22 nt, Human
cagagcugguguuacaagucca

SEQ ID NO: 1042125 - RNA, 22 nt, Human
gcucagaggaugcuccuuuaug

SEQ ID NO: 1042126 - RNA, 21 nt, Human
ugggagagggcucagcuaccc

SEQ ID NO: 1042127 - RNA, 22 nt, Human
ccuggagccccucuggccagcc

SEQ ID NO: 1042128 - RNA, 22 nt, Human
aaagacuagcauuuauauguac

SEQ ID NO: 1042129 - RNA, 22 nt, Human
cugggcuggcgcauccgacacg

SEQ ID NO: 1042130 - RNA, 22 nt, Human
cuggccuuuuguuucuggagaa

SEQ ID NO: 1042131 - RNA, 22 nt, Human
ucucagaguuuacggggcugaa

SEQ ID NO: 1042132 - RNA, 22 nt, Human
augauucagcaauuuuauaucu

SEQ ID NO: 1042133 - RNA, 22 nt, Human
ucagagcugcccaugcaagggg

SEQ ID NO: 1042134 - RNA, 22 nt, Human
agcagagcgccugcucagaggg

SEQ ID NO: 1042135 - RNA, 17 nt, Human
ccugggaggaguuauga

SEQ ID NO: 1042136 - RNA, 22 nt, Human
aucuucaaagcacaucguuugu

SEQ ID NO: 1042137 - RNA, 22 nt, Human
caggagcuacucagguuggguu

SEQ ID NO: 1042138 - RNA, 22 nt, Human
agggaggauaguagucaguuua

SEQ ID NO: 1042139 - RNA, 22 nt, Human
acaaaaguguaggaauuccuua

SEQ ID NO: 1042140 - RNA, 20 nt, Human
uccuucaggcagggccuagu

SEQ ID NO: 1042141 - RNA, 19 nt, Human
agcaccugugagagccugg

SEQ ID NO: 1042142 - RNA, 22 nt, Human
accuuucaaaguggcuaucacu

SEQ ID NO: 1042143 - RNA, 21 nt, Human
cucaggauggcggccuggugg

SEQ ID NO: 1042144 - RNA, 22 nt, Human
cagggugcgccacucagaugua

SEQ ID NO: 1042145 - RNA, 22 nt, Human
aaaugcagaucccugaaucuca

SEQ ID NO: 1042146 - RNA, 22 nt, Human
gcaaagcugggugugaaugcac

SEQ ID NO: 1042147 - RNA, 22 nt, Human
gucagcagugucagcucugggg

SEQ ID NO: 1042148 - RNA, 22 nt, Human
ucaguguccggagccugagugc

SEQ ID NO: 1042149 - RNA, 22 nt, Human
cuggggcugcgguggaggagcc

SEQ ID NO: 1042150 - RNA, 22 nt, Human
ucugggggcgaccagggacugc

SEQ ID NO: 1042151 - RNA, 22 nt, Human
ugcagagggacagccacagcuc

SEQ ID NO: 1042152 - RNA, 22 nt, Human
ccaguugguuucaaugggacag

SEQ ID NO: 1042153 - RNA, 22 nt, Human
aguaacuaugcuugagaaucag

SEQ ID NO: 1042154 - RNA, 22 nt, Human
uacaguaaccuuauuugucauu

SEQ ID NO: 1042155 - RNA, 22 nt, Human
agaaaugcauuagcacauauag

SEQ ID NO: 1042156 - RNA, 22 nt, Human
agggcagagacaugcuuccuga

SEQ ID NO: 1042157 - RNA, 22 nt, Human
ugugccauuucuauucugcagc

SEQ ID NO: 1042158 - RNA, 22 nt, Human
aaaucagugcucauuugaaagg

SEQ ID NO: 1042159 - RNA, 22 nt, Human
ugggcucugcaucagugcccau

SEQ ID NO: 1042160 - RNA, 22 nt, Human
aagauuuacuagcauaauagcu

SEQ ID NO: 1042161 - RNA, 22 nt, Human
cacacaggaugaagcagcagaa

SEQ ID NO: 1042162 - RNA, 22 nt, Human
uuucaguguaagguuuccagga

SEQ ID NO: 1042163 - RNA, 22 nt, Human
caggggcuagcacuuaauguuu

SEQ ID NO: 1042164 - RNA, 22 nt, Human
ccuggcucuguccucgcgcaaa

SEQ ID NO: 1042165 - RNA, 22 nt, Human
uuuccucuuuguaccuugacua

SEQ ID NO: 1042166 - RNA, 22 nt, Human
cuuccucaugugcaaugcaagc

SEQ ID NO: 1042167 - RNA, 22 nt, Human
uggcagcuuccugcucauagga

SEQ ID NO: 1042168 - RNA, 22 nt, Human
uuuccucuucuucccaugucau

SEQ ID NO: 1042169 - RNA, 22 nt, Human
caggaacauuuaaccacagggu

SEQ ID NO: 1042170 - RNA, 22 nt, Human
ugcagcagacugaguaugagaa

SEQ ID NO: 1042171 - RNA, 22 nt, Human
ccaggcagcucugauuuauguc

SEQ ID NO: 1042172 - RNA, 22 nt, Human
gacagcagacagaacuaccugc

SEQ ID NO: 1042173 - RNA, 22 nt, Human
uagauuucaggcuggcuugcgg

SEQ ID NO: 1042174 - RNA, 22 nt, Human
cccagcucucgcacuuacuagc

SEQ ID NO: 1042175 - RNA, 22 nt, Human
ccagagcccagcacacggugcu

SEQ ID NO: 1042176 - RNA, 18 nt, Human
ucugucuguacaaguauc

SEQ ID NO: 1042177 - RNA, 22 nt, Human
guccuggcuuaguucgcuguaa

SEQ ID NO: 1042178 - RNA, 22 nt, Human
aggucauuuuugccuucuauuu

SEQ ID NO: 1042179 - RNA, 22 nt, Human
ggaggccaggaaggcucggaga

SEQ ID NO: 1042180 - RNA, 21 nt, Human
gggugcuguggucaugcagga

SEQ ID NO: 1042181 - RNA, 22 nt, Human
agcucugggccaggaacccuaa

SEQ ID NO: 1042182 - RNA, 22 nt, Human
aaauaauuauagcgagucuauc

SEQ ID NO: 1042183 - RNA, 22 nt, Human
ucauugcagaaauaaaggugaa

SEQ ID NO: 1042184 - RNA, 22 nt, Human
ucugcugcugagcacacuccua

SEQ ID NO: 1042185 - RNA, 22 nt, Human
uuauguaccugaauuaguaaag

SEQ ID NO: 1042186 - RNA, 23 nt, Human
ucugucacuuucugcuguggagu

SEQ ID NO: 1042187 - RNA, 20 nt, Human
cuucaggacccauccucccc

SEQ ID NO: 1042188 - RNA, 22 nt, Human
cagaauuuagcacaauguaugg

SEQ ID NO: 1042189 - RNA, 22 nt, Human
agggcccuccccgcucagggca

SEQ ID NO: 1042190 - RNA, 22 nt, Human
gggacagcuguagugcuuggcu

SEQ ID NO: 1042191 - RNA, 22 nt, Human
gggcuggagccagcuguggcug

SEQ ID NO: 1042192 - RNA, 22 nt, Human
uaaauguguguagccaucugug

SEQ ID NO: 1042193 - RNA, 22 nt, Human
ucccuuaaaacucauguguugu

SEQ ID NO: 1042194 - RNA, 23 nt, Human
aggcagagccaaggucaaaaccc

SEQ ID NO: 1042195 - RNA, 22 nt, Human
ggaugcugacuuuggagcaugg

SEQ ID NO: 1042196 - RNA, 22 nt, Human
uauuaguagcuugaaauuggug

SEQ ID NO: 1042197 - RNA, 22 nt, Human
ucagacaguuugcagugugccu

SEQ ID NO: 1042198 - RNA, 22 nt, Human
cuggcagcugcccgagaugccc

SEQ ID NO: 1042199 - RNA, 22 nt, Human
guggccucugugcuccugccua

SEQ ID NO: 1042200 - RNA, 22 nt, Human
ggggcagagaauaaaaaccuaa

SEQ ID NO: 1042201 - RNA, 22 nt, Human
ucugccugaaauucacauguaa

SEQ ID NO: 1042202 - RNA, 22 nt, Human
uuuauguaaguggaaugaugcc

SEQ ID NO: 1042203 - RNA, 22 nt, Human
ugcugcucaaugagaugccauc

SEQ ID NO: 1042204 - RNA, 19 nt, Human
ggcucucccuugagagagc

SEQ ID NO: 1042205 - RNA, 18 nt, Human
aggaagcaggaggaaggc

SEQ ID NO: 1042206 - RNA, 22 nt, Human
caaggcaggcaguucacuugag

SEQ ID NO: 1042207 - RNA, 22 nt, Human
ggucauugaaaucagaaggguu

SEQ ID NO: 1042208 - RNA, 22 nt, Human
gcaaggcugcugccacccaucu

SEQ ID NO: 1042209 - RNA, 23 nt, Human
ugccucugccucccuagucugca

SEQ ID NO: 1042210 - RNA, 22 nt, Human
agagugaucagauaucaggugu

SEQ ID NO: 1042211 - RNA, 22 nt, Human
aagcccagaugugagaacugag

SEQ ID NO: 1042212 - RNA, 22 nt, Human
ccugucugcagauaucucaggu

SEQ ID NO: 1042213 - RNA, 21 nt, Human
ucuguacaucauugagucccc

SEQ ID NO: 1042214 - RNA, 22 nt, Human
aaaagcucuuucugcuguagau

SEQ ID NO: 1042215 - RNA, 22 nt, Human
gccucugcucucagguagccuc

SEQ ID NO: 1042216 - RNA, 22 nt, Human
caggcagcugacugucagauau

SEQ ID NO: 1042217 - RNA, 22 nt, Human
aggccuuccucggagacaggga

SEQ ID NO: 1042218 - RNA, 22 nt, Human
auggggagagaagggcugagcu

SEQ ID NO: 1042219 - RNA, 22 nt, Human
uucucuagguuuuagaugaaga

SEQ ID NO: 1042220 - RNA, 22 nt, Human
ggcuccuggcaucuggugggua

SEQ ID NO: 1042221 - RNA, 21 nt, Human
ucucuacacuuucacuaggcu

SEQ ID NO: 1042222 - RNA, 22 nt, Human
caggugcuguccugcacauguc

SEQ ID NO: 1042223 - RNA, 22 nt, Human
cagcauggggcuuggagucagc

SEQ ID NO: 1042224 - RNA, 22 nt, Human
caggguggcaggcaccauggcc

SEQ ID NO: 1042225 - RNA, 22 nt, Human
ggucccaggauugguugcgcag

SEQ ID NO: 1042226 - RNA, 22 nt, Human
uuuagaaauucaucuauggccu

SEQ ID NO: 1042227 - RNA, 22 nt, Human
gagccuucaucgcagccuuguu

SEQ ID NO: 1042228 - RNA, 22 nt, Human
uuugacaggacuaacauauggc

SEQ ID NO: 1042229 - RNA, 22 nt, Human
acagggcagugucuugaaaaau

SEQ ID NO: 1042230 - RNA, 22 nt, Human
acagccauagaugcuuauguaa

SEQ ID NO: 1042231 - RNA, 22 nt, Human
ccagcagcccucuuccaagacu

SEQ ID NO: 1042232 - RNA, 19 nt, Human
agggagaauuccaagagga

SEQ ID NO: 1042233 - RNA, 22 nt, Human
uguaguaagugcgcaauaaaua

SEQ ID NO: 1042234 - RNA, 22 nt, Human
aggcucugguuggcaaguaaag

SEQ ID NO: 1042235 - RNA, 22 nt, Human
ucccagagugugggcaucaagg

SEQ ID NO: 1042236 - RNA, 22 nt, Human
aagcugccuugcugaggagaaa

SEQ ID NO: 1042237 - RNA, 22 nt, Human
gcuggcuguguuccuucugcca

SEQ ID NO: 1042238 - RNA, 22 nt, Human
agggagaaaauuggaugcacaa

SEQ ID NO: 1042239 - RNA, 22 nt, Human
cagccacguagcccuuggccgu

SEQ ID NO: 1042240 - RNA, 19 nt, Human
ccuuugaaucaggacacuu

SEQ ID NO: 1042241 - RNA, 22 nt, Human
auuguacuuuuauuacauguag

SEQ ID NO: 1042242 - RNA, 22 nt, Human
aucuaagaguuaacaucaagaa

SEQ ID NO: 1042243 - RNA, 22 nt, Human
gcugccugguuucucagcugca

SEQ ID NO: 1042244 - RNA, 22 nt, Human
gccugcagugagugcagaaggu

SEQ ID NO: 1042245 - RNA, 22 nt, Human
gcccugucggaacugcgaccuc

SEQ ID NO: 1042246 - RNA, 22 nt, Human
uggcuuccgccgcgggccucgg

SEQ ID NO: 1042247 - RNA, 22 nt, Human
uccuccaggucuaggguggcuu

SEQ ID NO: 1042248 - RNA, 22 nt, Human
ugaggcucaaggucugguggag

SEQ ID NO: 1042249 - RNA, 22 nt, Human
uuccucuccucacaugagucac

SEQ ID NO: 1042250 - RNA, 22 nt, Human
uuccauaaugagauucccagcc

SEQ ID NO: 1042251 - RNA, 21 nt, Human
ucugucucuccacugcccugc

SEQ ID NO: 1042252 - RNA, 22 nt, Human
uauaguaaaauuuucauuuaug

SEQ ID NO: 1042253 - RNA, 22 nt, Human
gcagggucgcucuaggagauca

SEQ ID NO: 1042254 - RNA, 22 nt, Human
ucuuggagaauggcagagaagc

SEQ ID NO: 1042255 - RNA, 22 nt, Human
gcacccaggccggcgacugcag

SEQ ID NO: 1042256 - RNA, 22 nt, Human
aaacugaauucccaagggcaug

SEQ ID NO: 1042257 - RNA, 22 nt, Human
uguauacauuuaacuagauaga

SEQ ID NO: 1042258 - RNA, 22 nt, Human
gcugccuuuugcuccucccacc

SEQ ID NO: 1042259 - RNA, 22 nt, Human
gcugucacaucaaggcacuaaa

SEQ ID NO: 1042260 - RNA, 20 nt, Human
uguauauuuucugguguaaa

SEQ ID NO: 1042261 - RNA, 22 nt, Human
ccucccacauugaggacaugcu

SEQ ID NO: 1042262 - RNA, 22 nt, Human
ugcuggccaacaaggcuccaag

SEQ ID NO: 1042263 - RNA, 22 nt, Human
uuauuuucuccucagaaagugg

SEQ ID NO: 1042264 - RNA, 22 nt, Human
uccucuggcccagcugccucug

SEQ ID NO: 1042265 - RNA, 22 nt, Human
gaggccuggagccgccuaggcg

SEQ ID NO: 1042266 - RNA, 22 nt, Human
ggagcugggguuggcaucuucc

SEQ ID NO: 1042267 - RNA, 22 nt, Human
augggguggaguccgggcagcg

SEQ ID NO: 1042268 - RNA, 22 nt, Human
ucugaggcuucagacuguacug

SEQ ID NO: 1042269 - RNA, 22 nt, Human
gcugcagcaagcccuccagggg

SEQ ID NO: 1042270 - RNA, 22 nt, Human
uuuccuaugauauucuaugugu

SEQ ID NO: 1042271 - RNA, 22 nt, Human
ucagcaauaugauaggcuuugu

SEQ ID NO: 1042272 - RNA, 22 nt, Human
gggacaggccccucgcuagcuu

SEQ ID NO: 1042273 - RNA, 22 nt, Human
ccacagggaacaugacagccuu

SEQ ID NO: 1042274 - RNA, 22 nt, Human
agccagggacgcugcaggcuac

SEQ ID NO: 1042275 - RNA, 22 nt, Human
aggcacugauucucagaguuac

SEQ ID NO: 1042276 - RNA, 22 nt, Human
aaguucaagcucugccuaaaau

SEQ ID NO: 1042277 - RNA, 22 nt, Human
guaacaaaguuucuaggugcug

SEQ ID NO: 1042278 - RNA, 22 nt, Human
gagagcuguguucauucuacca

SEQ ID NO: 1042279 - RNA, 22 nt, Human
ugaggugaccgcagaugggaag

SEQ ID NO: 1042280 - RNA, 18 nt, Human
uucaccagugugaugggu

SEQ ID NO: 1042281 - RNA, 22 nt, Human
ggcugccuucccugagccccgg

SEQ ID NO: 1042282 - RNA, 19 nt, Human
auagaaaggguuaaagaca

SEQ ID NO: 1042283 - RNA, 22 nt, Human
auguauguuaguguauuaucua

SEQ ID NO: 1042284 - RNA, 22 nt, Human
aagggcaggagaagacggauau

SEQ ID NO: 1042285 - RNA, 22 nt, Human
ggcaugggagugagcaaccuua

SEQ ID NO: 1042286 - RNA, 22 nt, Human
gaaggcuggcuuucugagagca

SEQ ID NO: 1042287 - RNA, 22 nt, Human
gcaggagcugcucuccugacga

SEQ ID NO: 1042288 - RNA, 21 nt, Human
uggcucugaaagagugcugca

SEQ ID NO: 1042289 - RNA, 22 nt, Human
cugcucuguuaauuaaacuuug

SEQ ID NO: 1042290 - RNA, 22 nt, Human
acaguaccugcucucaagcaaa

SEQ ID NO: 1042291 - RNA, 22 nt, Human
agcaggguuccaggaguugcag

SEQ ID NO: 1042292 - RNA, 22 nt, Human
cagucacacaaguggacuuggg

SEQ ID NO: 1042293 - RNA, 23 nt, Human
uggcuucugccccauucucucca

SEQ ID NO: 1042294 - RNA, 22 nt, Human
uggaggaugccuggggaggccu

SEQ ID NO: 1042295 - RNA, 22 nt, Human
acaggcuuacaggcugcaagua

SEQ ID NO: 1042296 - RNA, 22 nt, Human
uaccuuuugcuuauuaugacac

SEQ ID NO: 1042297 - RNA, 22 nt, Human
ggaggccaucagggagggcauu

SEQ ID NO: 1042298 - RNA, 22 nt, Human
augagcugggccauccagugau

SEQ ID NO: 1042299 - RNA, 22 nt, Human
ccucccagugccuccagagcag

SEQ ID NO: 1042300 - RNA, 22 nt, Human
agggccugacacccuugccagc

SEQ ID NO: 1042301 - RNA, 22 nt, Human
uucaagauggcugcaaauacuu

SEQ ID NO: 1042302 - RNA, 22 nt, Human
ugucucaguucccuucucugga

SEQ ID NO: 1042303 - RNA, 22 nt, Human
ucugagcuacgaugccugucac

SEQ ID NO: 1042304 - RNA, 22 nt, Human
ugaaggaauggaggaucagagc

SEQ ID NO: 1042305 - RNA, 20 nt, Human
agucucuguagugccugaga

SEQ ID NO: 1042306 - RNA, 22 nt, Human
auuguaaguagaaauguuaugg

SEQ ID NO: 1042307 - RNA, 22 nt, Human
aggagucaggaccaaauggaaa

SEQ ID NO: 1042308 - RNA, 22 nt, Human
gcagacagcauguugggcuauu

SEQ ID NO: 1042309 - RNA, 22 nt, Human
aaggugucacugggacaggaaa

SEQ ID NO: 1042310 - RNA, 22 nt, Human
aagauuucugcuuuuggaggca

SEQ ID NO: 1042311 - RNA, 22 nt, Human
guuuucuuugaaugcuucuaga

SEQ ID NO: 1042312 - RNA, 22 nt, Human
gcuguucccauguggggcucag

SEQ ID NO: 1042313 - RNA, 22 nt, Human
ggcaguggcuccucucuacucc

SEQ ID NO: 1042314 - RNA, 22 nt, Human
acugugugaaacaucaaugugu

SEQ ID NO: 1042315 - RNA, 22 nt, Human
uuguaacaggcacucugugcca

SEQ ID NO: 1042316 - RNA, 22 nt, Human
gcaucuucacacaaagccagug

SEQ ID NO: 1042317 - RNA, 22 nt, Human
ugggcagacugagcccuguccc

SEQ ID NO: 1042318 - RNA, 22 nt, Human
cagggcagagccaggauuucaa

SEQ ID NO: 1042319 - RNA, 22 nt, Human
gcagcugccgugagcucacgcc

SEQ ID NO: 1042320 - RNA, 22 nt, Human
gagcagcuccagccgcaugacu

SEQ ID NO: 1042321 - RNA, 22 nt, Human
aaauacagaguugcuuaaaagc

SEQ ID NO: 1042322 - RNA, 22 nt, Human
accaaggaagaaucuauuugag

SEQ ID NO: 1042323 - RNA, 22 nt, Human
ugugcuucugcagagacuauuu

SEQ ID NO: 1042324 - RNA, 22 nt, Human
ucucagggaccaugaugaugac

SEQ ID NO: 1042325 - RNA, 22 nt, Human
uuuuuaagagauucuccagucu

SEQ ID NO: 1042326 - RNA, 22 nt, Human
acagcugugaaaauccacagga

SEQ ID NO: 1042327 - RNA, 22 nt, Human
gccucugcaggugcgguuaucc

SEQ ID NO: 1042328 - RNA, 18 nt, Human
aagccagagaccacugcc

SEQ ID NO: 1042329 - RNA, 20 nt, Human
aguguuccggaagacuggca

SEQ ID NO: 1042330 - RNA, 23 nt, Human
cuuuccuuucuuugacacccagc

SEQ ID NO: 1042331 - RNA, 22 nt, Human
ccugccaggcuuugggcuucug

SEQ ID NO: 1042332 - RNA, 23 nt, Human
uacauuguggauggaguccuggg

SEQ ID NO: 1042333 - RNA, 22 nt, Human
gggagggaaagcuugaucuguc

SEQ ID NO: 1042334 - RNA, 22 nt, Human
aggguggggugcuacaucuuua

SEQ ID NO: 1042335 - RNA, 22 nt, Human
ucaagagagugcugcuuggggu

SEQ ID NO: 1042336 - RNA, 22 nt, Human
gggcccuggacguggcggcaga

SEQ ID NO: 1042337 - RNA, 22 nt, Human
ccauaaggagccagacauucca

SEQ ID NO: 1042338 - RNA, 22 nt, Human
cuggcuccuccaaggccuggag

SEQ ID NO: 1042339 - RNA, 22 nt, Human
aacucaguguguuucuuaguau

SEQ ID NO: 1042340 - RNA, 20 nt, Human
gcagcugaaaguaugacacc

SEQ ID NO: 1042341 - RNA, 20 nt, Human
cacguuuuuccacuagcaaa

SEQ ID NO: 1042342 - RNA, 22 nt, Human
ugcucugucaagaaaagaugcc

SEQ ID NO: 1042343 - RNA, 22 nt, Human
uggggccugagguggagcugca

SEQ ID NO: 1042344 - RNA, 19 nt, Human
gcugcuggcucuggcugga

SEQ ID NO: 1042345 - RNA, 22 nt, Human
cagcugcccaagccccagaugu

SEQ ID NO: 1042346 - RNA, 22 nt, Human
uuugcauuguaauauuuaguuc

SEQ ID NO: 1042347 - RNA, 22 nt, Human
ucccagagcugauaagccuuua

SEQ ID NO: 1042348 - RNA, 22 nt, Human
guggggggacguuggucacuuu

SEQ ID NO: 1042349 - RNA, 22 nt, Human
ucagggcagguuaacuugggug

SEQ ID NO: 1042350 - RNA, 19 nt, Human
ggaaacaggggccagagga

SEQ ID NO: 1042351 - RNA, 22 nt, Human
gucaaguuaagauaaggucaug

SEQ ID NO: 1042352 - RNA, 22 nt, Human
gcuguccaugucuggccucagu

SEQ ID NO: 1042353 - RNA, 22 nt, Human
gcauuccuacaggcugcuauga

SEQ ID NO: 1042354 - RNA, 22 nt, Human
guuacacaggaaaacauuagca

SEQ ID NO: 1042355 - RNA, 22 nt, Human
ugccuggguccaggccaagccu

SEQ ID NO: 1042356 - RNA, 22 nt, Human
ucuggcucccuggagcuccaca

SEQ ID NO: 1042357 - RNA, 16 nt, Human
agcagggcgggaagga

SEQ ID NO: 1042358 - RNA, 22 nt, Human
auucaguaggucuagaauaaga

SEQ ID NO: 1042359 - RNA, 22 nt, Human
ugcagcauugcaaagcagucuu

SEQ ID NO: 1042360 - RNA, 22 nt, Human
ggagagaauuccauggacaugu

SEQ ID NO: 1042361 - RNA, 20 nt, Human
agcugguuaucuuaauucuu

SEQ ID NO: 1042362 - RNA, 22 nt, Human
cacugggcaauucugagccuaa

SEQ ID NO: 1042363 - RNA, 22 nt, Human
ucagggcauguauguuucuuua

SEQ ID NO: 1042364 - RNA, 20 nt, Human
uggcuccugcgguggaacca

SEQ ID NO: 1042365 - RNA, 17 nt, Human
uauguaguacuuauaaa

SEQ ID NO: 1042366 - RNA, 22 nt, Human
gccagcccagcuccaggggaaa

SEQ ID NO: 1042367 - RNA, 22 nt, Human
uggcccugacugauguggaggg

SEQ ID NO: 1042368 - RNA, 22 nt, Human
uaauuauaacaguuacaucuua

SEQ ID NO: 1042369 - RNA, 22 nt, Human
gggcuacauugugagagaaguu

SEQ ID NO: 1042370 - RNA, 22 nt, Human
uuccuucucagcccucgaggau

SEQ ID NO: 1042371 - RNA, 17 nt, Human
gaaagguccuagaaauc

SEQ ID NO: 1042372 - RNA, 22 nt, Human
gccuggagaauuaaaaggaagg

SEQ ID NO: 1042373 - RNA, 22 nt, Human
cccuguccuggaugggagcacu

SEQ ID NO: 1042374 - RNA, 23 nt, Human
gaguguucauagcaggcucuugc

SEQ ID NO: 1042375 - RNA, 19 nt, Human
gugauuucuuuccacaagc

SEQ ID NO: 1042376 - RNA, 22 nt, Human
uuguuacacauaauaacauuuu

SEQ ID NO: 1042377 - RNA, 22 nt, Human
gucugaggaagaugcaggggga

SEQ ID NO: 1042378 - RNA, 22 nt, Human
ugaugggaaaaugaggccuggg

SEQ ID NO: 1042379 - RNA, 22 nt, Human
ugcauuugucuugucucaugaa

SEQ ID NO: 1042380 - RNA, 22 nt, Human
gcucuuccauuucucuugaacu

SEQ ID NO: 1042381 - RNA, 22 nt, Human
gagagugucgggggccccagga

SEQ ID NO: 1042382 - RNA, 18 nt, Human
ucucuuuuccccucauug

SEQ ID NO: 1042383 - RNA, 18 nt, Human
agcuggcccuggcugccg

SEQ ID NO: 1042384 - RNA, 22 nt, Human
caaaugugguuucucagcauuc

SEQ ID NO: 1042385 - RNA, 22 nt, Human
ccagugcaggugagcaccaggu

SEQ ID NO: 1042386 - RNA, 23 nt, Human
uggcuggcagaaacugaagcaug

SEQ ID NO: 1042387 - RNA, 22 nt, Human
aggggccuggacauggacgcgc

SEQ ID NO: 1042388 - RNA, 22 nt, Human
cagggcuguaaauuagugcuga

SEQ ID NO: 1042389 - RNA, 22 nt, Human
ccuggcugcuauagcagcaugu

SEQ ID NO: 1042390 - RNA, 22 nt, Human
aaaugcacagaggccagagagg

SEQ ID NO: 1042391 - RNA, 22 nt, Human
gcagggacaccuuugugaagcu

SEQ ID NO: 1042392 - RNA, 22 nt, Human
cuguccugcaguugggggcagg

SEQ ID NO: 1042393 - RNA, 22 nt, Human
aaucaguuaggguguuaaugag

SEQ ID NO: 1042394 - RNA, 22 nt, Human
gaguguggugaacaggagcacc

SEQ ID NO: 1042395 - RNA, 22 nt, Human
cugccuuugcccuugacacugu

SEQ ID NO: 1042396 - RNA, 22 nt, Human
ugaagcccugugucagcuucca

SEQ ID NO: 1042397 - RNA, 22 nt, Human
cuucucucccuggcacucagac

SEQ ID NO: 1042398 - RNA, 22 nt, Human
ccugagagcagcuuccugcuua

SEQ ID NO: 1042399 - RNA, 22 nt, Human
agcaggaaguagucuguaagca

SEQ ID NO: 1042400 - RNA, 22 nt, Human
cugucaguaggcucccaucauu

SEQ ID NO: 1042401 - RNA, 22 nt, Human
acuuugcacuaaguuacucauu

SEQ ID NO: 1042402 - RNA, 21 nt, Human
aggggacagaguagcuccagg

SEQ ID NO: 1042403 - RNA, 21 nt, Human
aaagugguaaggauuauuuug

SEQ ID NO: 1042404 - RNA, 22 nt, Human
cccagcaggucggugcugccug

SEQ ID NO: 1042405 - RNA, 21 nt, Human
uucaaaguuugccuaaagauu

SEQ ID NO: 1042406 - RNA, 22 nt, Human
agccacaccuguccugccagcu

SEQ ID NO: 1042407 - RNA, 22 nt, Human
ccaggcugggcuacaaguugag

SEQ ID NO: 1042408 - RNA, 22 nt, Human
cucuggagcaccgggcuaucca

SEQ ID NO: 1042409 - RNA, 22 nt, Human
gccugucaauuuuguguacaau

SEQ ID NO: 1042410 - RNA, 22 nt, Human
ggucaggguauaaucaagugag

SEQ ID NO: 1042411 - RNA, 22 nt, Human
cagaaauggagcccaggaaucu

SEQ ID NO: 1042412 - RNA, 20 nt, Human
gccuggaggcagagauaaag

SEQ ID NO: 1042413 - RNA, 22 nt, Human
aauauguucaaaauagaucacu

SEQ ID NO: 1042414 - RNA, 22 nt, Human
gcagccaccucccauggcgggg

SEQ ID NO: 1042415 - RNA, 22 nt, Human
cagacccucgggugaguuggcc

SEQ ID NO: 1042416 - RNA, 22 nt, Human
ugggcagacauugaguuuguuc

SEQ ID NO: 1042417 - RNA, 22 nt, Human
gccaggcagcugggagggugcc

SEQ ID NO: 1042418 - RNA, 22 nt, Human
uccaggagguuuggaggaagca

SEQ ID NO: 1042419 - RNA, 22 nt, Human
cucaggaugaaagucaugguga

SEQ ID NO: 1042420 - RNA, 22 nt, Human
ggaggcucugcuccguguguuc

SEQ ID NO: 1042421 - RNA, 22 nt, Human
cuggcugcgucugcucugacag

SEQ ID NO: 1042422 - RNA, 22 nt, Human
caggccugugacaccgugucug

SEQ ID NO: 1042423 - RNA, 22 nt, Human
ucugagccguauggcuuggcua

SEQ ID NO: 1042424 - RNA, 22 nt, Human
uggcucuggauuaaucuaggaa

SEQ ID NO: 1042425 - RNA, 22 nt, Human
uggcucugcugaaccuagugca

SEQ ID NO: 1042426 - RNA, 22 nt, Human
uggcuuucucccccagcuucuc

SEQ ID NO: 1042427 - RNA, 22 nt, Human
gcugcuucucugauggagucca

SEQ ID NO: 1042428 - RNA, 22 nt, Human
aguggcagagcugugucuugaa

SEQ ID NO: 1042429 - RNA, 22 nt, Human
uggcagaaguucacuaguagcu

SEQ ID NO: 1042430 - RNA, 22 nt, Human
acagcagccugcagcccugugu

SEQ ID NO: 1042431 - RNA, 23 nt, Human
caugccaguuugugcaggcagau

SEQ ID NO: 1042432 - RNA, 22 nt, Human
agcuuccuuggcgcugaggccu

SEQ ID NO: 1042433 - RNA, 22 nt, Human
uagaaaagauaacauucugugc

SEQ ID NO: 1042434 - RNA, 22 nt, Human
ggcuucuuccugugaacauguu

SEQ ID NO: 1042435 - RNA, 22 nt, Human
ccuggagcgcgggucaagcugg

SEQ ID NO: 1042436 - RNA, 22 nt, Human
caguuaaaggcccaauaucugg

SEQ ID NO: 1042437 - RNA, 22 nt, Human
agagccugaggaugucccagcu

SEQ ID NO: 1042438 - RNA, 22 nt, Human
uacuuuuagccuauuugauucu

SEQ ID NO: 1042439 - RNA, 22 nt, Human
agcagccacacgccuccuucuc

SEQ ID NO: 1042440 - RNA, 22 nt, Human
ccuccugggcuccugucugcac

SEQ ID NO: 1042441 - RNA, 22 nt, Human
agucucagccacacagaccuau

SEQ ID NO: 1042442 - RNA, 22 nt, Human
uucaaugagcccggggccauag

SEQ ID NO: 1042443 - RNA, 22 nt, Human
gaaaagggcaagagagagggca

SEQ ID NO: 1042444 - RNA, 22 nt, Human
cuguccucuguccucagcagga

SEQ ID NO: 1042445 - RNA, 22 nt, Human
gcuggcagagacaagaagacua

SEQ ID NO: 1042446 - RNA, 22 nt, Human
uggggcuguggauucucacgaa

SEQ ID NO: 1042447 - RNA, 22 nt, Human
uagagcuggccgggacagcugg

SEQ ID NO: 1042448 - RNA, 22 nt, Human
agccucucugaugugacagcua

SEQ ID NO: 1042449 - RNA, 22 nt, Human
agacccugucaguguuaggaaa

SEQ ID NO: 1042450 - RNA, 22 nt, Human
agcagccaaccuuacauucauc

SEQ ID NO: 1042451 - RNA, 19 nt, Human
gcuggggccugaccagaca

SEQ ID NO: 1042452 - RNA, 22 nt, Human
auaacagagagcuacugaacug

SEQ ID NO: 1042453 - RNA, 22 nt, Human
ccaggccuuccaguacgcagaa

SEQ ID NO: 1042454 - RNA, 22 nt, Human
ugaagcaggugaauggaugucg

SEQ ID NO: 1042455 - RNA, 22 nt, Human
aguggcagaagucacuggguag

SEQ ID NO: 1042456 - RNA, 22 nt, Human
ggcacugggagaggugagacgg

SEQ ID NO: 1042457 - RNA, 20 nt, Human
cacugaagacuucuugcuca

SEQ ID NO: 1042458 - RNA, 22 nt, Human
agcagaugagccucaugacugg

SEQ ID NO: 1042459 - RNA, 22 nt, Human
ucugucacuuauuaagauggau

SEQ ID NO: 1042460 - RNA, 22 nt, Human
ucagagaugcagugccaccuac

SEQ ID NO: 1042461 - RNA, 22 nt, Human
ucuuugcaucccuuccauaguu

SEQ ID NO: 1042462 - RNA, 22 nt, Human
cugugcuggcagaccuggaguu

SEQ ID NO: 1042463 - RNA, 22 nt, Human
guucaaagcuccugguacagua

SEQ ID NO: 1042464 - RNA, 22 nt, Human
gcccugagacugagcauggguu

SEQ ID NO: 1042465 - RNA, 22 nt, Human
cagaagccugccucagaugcac

SEQ ID NO: 1042466 - RNA, 22 nt, Human
uuaugacauaugaguacaagua

SEQ ID NO: 1042467 - RNA, 22 nt, Human
cugcccuguggcucugagucau

SEQ ID NO: 1042468 - RNA, 22 nt, Human
gaggccugcuuuggcacucugg

SEQ ID NO: 1042469 - RNA, 22 nt, Human
gcccagaguucaaggcugcagu

SEQ ID NO: 1042470 - RNA, 22 nt, Human
gaggccuggucuaugagauguu

SEQ ID NO: 1042471 - RNA, 22 nt, Human
agguggggugagcugcagacua

SEQ ID NO: 1042472 - RNA, 22 nt, Human
ggugcuggacacguggcacucc

SEQ ID NO: 1042473 - RNA, 22 nt, Human
gagggcagaaaauuaugcggug

SEQ ID NO: 1042474 - RNA, 22 nt, Human
cccugcagccuugcaugccuuc

SEQ ID NO: 1042475 - RNA, 22 nt, Human
gcagcugccccgacugugaguc

SEQ ID NO: 1042476 - RNA, 22 nt, Human
agcucccagucuccucuccaug

SEQ ID NO: 1042477 - RNA, 22 nt, Human
uggcucagauaauucaaggggc

SEQ ID NO: 1042478 - RNA, 22 nt, Human
gcugagucuugagcacugagca

SEQ ID NO: 1042479 - RNA, 22 nt, Human
cugaggucucuuuccauaguga

SEQ ID NO: 1042480 - RNA, 22 nt, Human
ugucucaggcccaagccaguaa

SEQ ID NO: 1042481 - RNA, 20 nt, Human
agcuggccuguccuaggccu

SEQ ID NO: 1042482 - RNA, 22 nt, Human
auugucuuuggugcuuccagga

SEQ ID NO: 1042483 - RNA, 22 nt, Human
agaugaagacucaggagcaggu

SEQ ID NO: 1042484 - RNA, 22 nt, Human
gcagagcccuggggguauggug

SEQ ID NO: 1042485 - RNA, 22 nt, Human
cacagggcagugcugcccacuc

SEQ ID NO: 1042486 - RNA, 22 nt, Human
aggcacugaagugguaaaugua

SEQ ID NO: 1042487 - RNA, 22 nt, Human
agucccagaucuccauucgguc

SEQ ID NO: 1042488 - RNA, 22 nt, Human
cucccaggcacagggaggagcc

SEQ ID NO: 1042489 - RNA, 22 nt, Human
gcagcaggcacggucucgacau

SEQ ID NO: 1042490 - RNA, 22 nt, Human
aaaagaggagugguuuaugaca

SEQ ID NO: 1042491 - RNA, 22 nt, Human
ggggaggcugaugugggcaaag

SEQ ID NO: 1042492 - RNA, 22 nt, Human
agugauggugagugagaagcuc

SEQ ID NO: 1042493 - RNA, 22 nt, Human
uuucauguuuucuuaaauggca

SEQ ID NO: 1042494 - RNA, 23 nt, Human
aguuuguaaagaaauauuugcac

SEQ ID NO: 1042495 - RNA, 22 nt, Human
uggcucugggcaccguguccac

SEQ ID NO: 1042496 - RNA, 22 nt, Human
cccaggcuggauuucgguggca

SEQ ID NO: 1042497 - RNA, 22 nt, Human
gcaggcaggagcccaacugccu

SEQ ID NO: 1042498 - RNA, 22 nt, Human
gcugcuccgucugagcucuggu

SEQ ID NO: 1042499 - RNA, 22 nt, Human
gugcuuccaucuagagggucac

SEQ ID NO: 1042500 - RNA, 22 nt, Human
cuggugggaggcaagguggaag

SEQ ID NO: 1042501 - RNA, 22 nt, Human
agggcagagauuaauuaagaca

SEQ ID NO: 1042502 - RNA, 22 nt, Human
ugucuguacaaauuuucugugu

SEQ ID NO: 1042503 - RNA, 22 nt, Human
acaaaguuaacaguuggauagu

SEQ ID NO: 1042504 - RNA, 22 nt, Human
aaaguucugggggagaagaacg

SEQ ID NO: 1042505 - RNA, 22 nt, Human
ugcugcucucagccaccaggaa

SEQ ID NO: 1042506 - RNA, 22 nt, Human
ucagaaauacuaucagcuuuug

SEQ ID NO: 1042507 - RNA, 22 nt, Human
ucuaggagaaccaucagggagg

SEQ ID NO: 1042508 - RNA, 22 nt, Human
ggcugcucugccuuccagcugg

SEQ ID NO: 1042509 - RNA, 22 nt, Human
uugaaaggcacaggcaccuggg

SEQ ID NO: 1042510 - RNA, 22 nt, Human
aacagcaugcuggguaacauug

SEQ ID NO: 1042511 - RNA, 22 nt, Human
cugggccuuggauugacacugu

SEQ ID NO: 1042512 - RNA, 22 nt, Human
auacauacguacauacguaugu

SEQ ID NO: 1042513 - RNA, 22 nt, Human
ugcagcuucuccaucuccuugu

SEQ ID NO: 1042514 - RNA, 22 nt, Human
caaaugcauagaaagaugaaac

SEQ ID NO: 1042515 - RNA, 22 nt, Human
ugggggagauuagagcuucuua

SEQ ID NO: 1042516 - RNA, 22 nt, Human
cugucccagauguucucagcac

SEQ ID NO: 1042517 - RNA, 22 nt, Human
ugggcagaucuuugguggcuag

SEQ ID NO: 1042518 - RNA, 20 nt, Human
ccagucccugagcaccaggg

SEQ ID NO: 1042519 - RNA, 22 nt, Human
uuaauaaacaggugcagcugaa

SEQ ID NO: 1042520 - RNA, 22 nt, Human
acaccagggccuagccagggcg

SEQ ID NO: 1042521 - RNA, 22 nt, Human
caggagcugggucuggaagcag

SEQ ID NO: 1042522 - RNA, 21 nt, Human
gagcugggcgaggcuccgggg

SEQ ID NO: 1042523 - RNA, 22 nt, Human
gugcuaggauuacaggcauggg

SEQ ID NO: 1042524 - RNA, 22 nt, Human
aguauuucuaguugguucuacu

SEQ ID NO: 1042525 - RNA, 22 nt, Human
ggacagagcccugguggccuaa

SEQ ID NO: 1042526 - RNA, 21 nt, Human
uccuucaguucugcacuuucu

SEQ ID NO: 1042527 - RNA, 22 nt, Human
gccuucaguagugucagcugua

SEQ ID NO: 1042528 - RNA, 22 nt, Human
cuccagggagcuuggaaagacc

SEQ ID NO: 1042529 - RNA, 22 nt, Human
ggcagcuccuccuagucugccc

SEQ ID NO: 1042530 - RNA, 22 nt, Human
cuuccuguugucacagucugcg

SEQ ID NO: 1042531 - RNA, 22 nt, Human
agggggaggcugugcugcgucu

SEQ ID NO: 1042532 - RNA, 22 nt, Human
guucauuuaugauguaacaugu

SEQ ID NO: 1042533 - RNA, 22 nt, Human
gcucaggacccaggugugaccu

SEQ ID NO: 1042534 - RNA, 22 nt, Human
gcccagcaccucucucaggguu

SEQ ID NO: 1042535 - RNA, 22 nt, Human
ugcugccaccccucaccagagc

SEQ ID NO: 1042536 - RNA, 22 nt, Human
gagcccuggcagucugggaugg

SEQ ID NO: 1042537 - RNA, 22 nt, Human
ggagccagcagggugacacuga

SEQ ID NO: 1042538 - RNA, 22 nt, Human
ucuccuggauggaccuucucuu

SEQ ID NO: 1042539 - RNA, 22 nt, Human
acagcagccuuguugguuucga

SEQ ID NO: 1042540 - RNA, 22 nt, Human
auaaguucagguaaagaaauca

SEQ ID NO: 1042541 - RNA, 22 nt, Human
auuucugauaaacguaagcugc

SEQ ID NO: 1042542 - RNA, 22 nt, Human
cagggcugcuggccgugcccuc

SEQ ID NO: 1042543 - RNA, 22 nt, Human
cagggcccaggccacuggguug

SEQ ID NO: 1042544 - RNA, 22 nt, Human
agccaugcaccuuacucuugcu

SEQ ID NO: 1042545 - RNA, 22 nt, Human
auuauaggcuugagccaccgug

SEQ ID NO: 1042546 - RNA, 22 nt, Human
cugcagccuccugggguacaug

SEQ ID NO: 1042547 - RNA, 22 nt, Human
gacacauagaucuaucucacuc

SEQ ID NO: 1042548 - RNA, 22 nt, Human
agccucugugacucacagguca

SEQ ID NO: 1042549 - RNA, 22 nt, Human
cuggagcccugaaugggcagga

SEQ ID NO: 1042550 - RNA, 22 nt, Human
uauaaaguuucgaaagauguau

SEQ ID NO: 1042551 - RNA, 22 nt, Human
gacagaguuguugauguaugcu

SEQ ID NO: 1042552 - RNA, 21 nt, Human
acaggcuuuagaaaaugacuc

SEQ ID NO: 1042553 - RNA, 19 nt, Human
uccuucagucagaucuggg

SEQ ID NO: 1042554 - RNA, 22 nt, Human
agggcagcacaaggcauggacu

SEQ ID NO: 1042555 - RNA, 22 nt, Human
cugggcugagccugggcugugu

SEQ ID NO: 1042556 - RNA, 22 nt, Human
ugucaugcccaggagcaaggua

SEQ ID NO: 1042557 - RNA, 22 nt, Human
cagagccccccuucugaucaca

SEQ ID NO: 1042558 - RNA, 22 nt, Human
uagaaagugaagguuaauuaau

SEQ ID NO: 1042559 - RNA, 22 nt, Human
uggaggaaaauuacuggggucu

SEQ ID NO: 1042560 - RNA, 22 nt, Human
cuggcucacuagcccugcccug

SEQ ID NO: 1042561 - RNA, 21 nt, Human
agcagcagaucuggugagggc

SEQ ID NO: 1042562 - RNA, 22 nt, Human
cagagcagaagcgguccucaca

SEQ ID NO: 1042563 - RNA, 22 nt, Human
aaguugaaugcguacgugacau

SEQ ID NO: 1042564 - RNA, 22 nt, Human
uggucucugacucugaagaccc

SEQ ID NO: 1042565 - RNA, 22 nt, Human
accugggagucacaccugagaa

SEQ ID NO: 1042566 - RNA, 22 nt, Human
ggagcugggaauuggaucaucu

SEQ ID NO: 1042567 - RNA, 22 nt, Human
uggaggaaguggcuggccagaa

SEQ ID NO: 1042568 - RNA, 18 nt, Human
cauuaugugguuauagaa

SEQ ID NO: 1042569 - RNA, 22 nt, Human
cacaggcuugucagcaugaggc

SEQ ID NO: 1042570 - RNA, 20 nt, Human
aggcagagcgcacuuuuaga

SEQ ID NO: 1042571 - RNA, 22 nt, Human
gaagccaacauuccaaguagaa

SEQ ID NO: 1042572 - RNA, 21 nt, Human
gcaggguccuuuccauuccua

SEQ ID NO: 1042573 - RNA, 22 nt, Human
uucagugugugauaccugcugu

SEQ ID NO: 1042574 - RNA, 22 nt, Human
ccucacuuuccuuucuccuggg

SEQ ID NO: 1042575 - RNA, 22 nt, Human
ccugggagggcaagugcugaug

SEQ ID NO: 1042576 - RNA, 22 nt, Human
aaaguuugcaauuuauguuaau

SEQ ID NO: 1042577 - RNA, 22 nt, Human
gcucccaccuuugcuaucagua

SEQ ID NO: 1042578 - RNA, 22 nt, Human
uagcccagagucccaauuccag

SEQ ID NO: 1042579 - RNA, 22 nt, Human
cacccaggcagguggcugagaa

SEQ ID NO: 1042580 - RNA, 22 nt, Human
agugcugaagacuggcuaggga

SEQ ID NO: 1042581 - RNA, 22 nt, Human
uggcagagagagugcagucgac

SEQ ID NO: 1042582 - RNA, 22 nt, Human
gaacaauagugguaacaaagcc

SEQ ID NO: 1042583 - RNA, 22 nt, Human
ccuggaggagcgcugaccagcu

SEQ ID NO: 1042584 - RNA, 22 nt, Human
uaauacuuuugccuuguauuca

SEQ ID NO: 1042585 - RNA, 20 nt, Human
aagagcauaguacaggaaga

SEQ ID NO: 1042586 - RNA, 20 nt, Human
ugggccuguggcagaagucu

SEQ ID NO: 1042587 - RNA, 22 nt, Human
augaaaacuuuagccucauuag

SEQ ID NO: 1042588 - RNA, 22 nt, Human
ccagcauggcaccugagaugag

SEQ ID NO: 1042589 - RNA, 22 nt, Human
ugaaaucuacccuauucagggu

SEQ ID NO: 1042590 - RNA, 18 nt, Human
uggcagggaggaaauaua

SEQ ID NO: 1042591 - RNA, 22 nt, Human
aagagcuggauugugcugcaga

SEQ ID NO: 1042592 - RNA, 22 nt, Human
agaggagcugggaggcccucgu

SEQ ID NO: 1042593 - RNA, 22 nt, Human
ucaaugauaguacaaucagccu

SEQ ID NO: 1042594 - RNA, 22 nt, Human
gaaaccucuuagccucucuuug

SEQ ID NO: 1042595 - RNA, 22 nt, Human
guggccucuguuggcuccuagg

SEQ ID NO: 1042596 - RNA, 22 nt, Human
cuucagaacuauaaaaaguacu

SEQ ID NO: 1042597 - RNA, 22 nt, Human
gccuggagggcucuagagaggc

SEQ ID NO: 1042598 - RNA, 22 nt, Human
acacaugagaaacaucaguugu

SEQ ID NO: 1042599 - RNA, 22 nt, Human
ucugcucagugcuuaucucuaa

SEQ ID NO: 1042600 - RNA, 22 nt, Human
aaaugcagguaguauuuauuuu

SEQ ID NO: 1042601 - RNA, 22 nt, Human
agaugcugcuccacaggccagg

SEQ ID NO: 1042602 - RNA, 22 nt, Human
gccgaagcugccgucugguccu

SEQ ID NO: 1042603 - RNA, 22 nt, Human
uuucacaaguuucaggauucug

SEQ ID NO: 1042604 - RNA, 22 nt, Human
agcugcccccagggcugugcuu

SEQ ID NO: 1042605 - RNA, 22 nt, Human
uacaguuuguuacauuguuagu

SEQ ID NO: 1042606 - RNA, 21 nt, Human
cugcucugacagugaggccag

SEQ ID NO: 1042607 - RNA, 22 nt, Human
ucacaccuguaaucccaggccu

SEQ ID NO: 1042608 - RNA, 18 nt, Human
ccauuucaugauuauuac

SEQ ID NO: 1042609 - RNA, 22 nt, Human
uuacaaaguucugaguucaaac

SEQ ID NO: 1042610 - RNA, 22 nt, Human
ucccaggacaggccacauggaa

SEQ ID NO: 1042611 - RNA, 22 nt, Human
agaagccagcuucagcugcccg

SEQ ID NO: 1042612 - RNA, 22 nt, Human
augcuuuacaguuuuccaaaca

SEQ ID NO: 1042613 - RNA, 22 nt, Human
aggcaucugaguuugcaagcuu

SEQ ID NO: 1042614 - RNA, 22 nt, Human
ccuggccacucagguguggggc

SEQ ID NO: 1042615 - RNA, 22 nt, Human
gcugccuguggcccuucugggu

SEQ ID NO: 1042616 - RNA, 20 nt, Human
aguaggggaaugcaagagca

SEQ ID NO: 1042617 - RNA, 19 nt, Human
ggcugccuuuccuuaccag

SEQ ID NO: 1042618 - RNA, 22 nt, Human
cccucagcuucucccugcagcu

SEQ ID NO: 1042619 - RNA, 22 nt, Human
gggcacagagggucuugaagaa

SEQ ID NO: 1042620 - RNA, 22 nt, Human
gacagcagggacauguaggaag

SEQ ID NO: 1042621 - RNA, 17 nt, Human
cacaggugugguuugag

SEQ ID NO: 1042622 - RNA, 22 nt, Human
uaguuacagcaggcaggauaua

SEQ ID NO: 1042623 - RNA, 22 nt, Human
ugcauugcaguuaacucaguau

SEQ ID NO: 1042624 - RNA, 18 nt, Human
uucagcagcagacacacu

SEQ ID NO: 1042625 - RNA, 22 nt, Human
ugcuggggauccguaccaaccc

SEQ ID NO: 1042626 - RNA, 22 nt, Human
gagcucugggaaacaaagugua

SEQ ID NO: 1042627 - RNA, 22 nt, Human
caggcugccgugaagcaggccu

SEQ ID NO: 1042628 - RNA, 22 nt, Human
gcuggagcugcagccugggccu

SEQ ID NO: 1042629 - RNA, 22 nt, Human
cucucccccacagcagccuucu

SEQ ID NO: 1042630 - RNA, 22 nt, Human
uguucuugagccuuuagaccua

SEQ ID NO: 1042631 - RNA, 19 nt, Human
ggcagaagguguaggggga

SEQ ID NO: 1042632 - RNA, 17 nt, Human
cauguguaugugggagu

SEQ ID NO: 1042633 - RNA, 18 nt, Human
acagaggcagacauguau

SEQ ID NO: 1042634 - RNA, 22 nt, Human
uggcucaggugugagcugaaga

SEQ ID NO: 1042635 - RNA, 22 nt, Human
ccugugcauccgguggucauug

SEQ ID NO: 1042636 - RNA, 22 nt, Human
ccaggagcuggagggugcagug

SEQ ID NO: 1042637 - RNA, 22 nt, Human
gcacugcagguggguggagagg

SEQ ID NO: 1042638 - RNA, 22 nt, Human
ggcucccugccuguccucaguc

SEQ ID NO: 1042639 - RNA, 19 nt, Human
caguggccuggaggucucu

SEQ ID NO: 1042640 - RNA, 22 nt, Human
aggcagaggaaggguggauuug

SEQ ID NO: 1042641 - RNA, 22 nt, Human
agagauucauguuuacuguagg

SEQ ID NO: 1042642 - RNA, 18 nt, Human
uccugccugcgggcuccc

SEQ ID NO: 1042643 - RNA, 22 nt, Human
ggccauggaccccgagcugacc

SEQ ID NO: 1042644 - RNA, 22 nt, Human
acuuucucccacccacccgucu

SEQ ID NO: 1042645 - RNA, 22 nt, Human
ucugggcuugguuagggcuguu

SEQ ID NO: 1042646 - RNA, 21 nt, Human
agcagaacagucgagcacugc

SEQ ID NO: 1042647 - RNA, 22 nt, Human
cauuucugcagaauugcucuuc

SEQ ID NO: 1042648 - RNA, 20 nt, Human
ugcucaggauggagaggugu

SEQ ID NO: 1042649 - RNA, 22 nt, Human
cagcuggcaaguggagcagggu

SEQ ID NO: 1042650 - RNA, 22 nt, Human
agcagggggaguuagacuagau

SEQ ID NO: 1042651 - RNA, 22 nt, Human
aggagcugcuuaaaugguuggu

SEQ ID NO: 1042652 - RNA, 22 nt, Human
auaugcacauacauacauaggu

SEQ ID NO: 1042653 - RNA, 22 nt, Human
cacauuuaauccuuuauaagua

SEQ ID NO: 1042654 - RNA, 22 nt, Human
ucagggcacaggccuguggguu

SEQ ID NO: 1042655 - RNA, 22 nt, Human
ugcuggaggaguuuacuguggc

SEQ ID NO: 1042656 - RNA, 22 nt, Human
uucaagucaaggaaagaggucu

SEQ ID NO: 1042657 - RNA, 22 nt, Human
cagacuugacggcagcugcuuu

SEQ ID NO: 1042658 - RNA, 22 nt, Human
ugugaaagucaaauuaauugaa

SEQ ID NO: 1042659 - RNA, 22 nt, Human
gcacacaguauaugcucauuaa

SEQ ID NO: 1042660 - RNA, 22 nt, Human
uggagccagcccaggccccucu

SEQ ID NO: 1042661 - RNA, 22 nt, Human
ucagcaauccucccacaggugg

SEQ ID NO: 1042662 - RNA, 22 nt, Human
uucuuuccccauggaguucgga

SEQ ID NO: 1042663 - RNA, 22 nt, Human
ucacaacucuuuccauuuaaua

SEQ ID NO: 1042664 - RNA, 22 nt, Human
ccaggaguuggagguugcagug

SEQ ID NO: 1042665 - RNA, 23 nt, Human
uggcucugagagguucagaugcu

SEQ ID NO: 1042666 - RNA, 22 nt, Human
agggggugcuacuuccagaguu

SEQ ID NO: 1042667 - RNA, 22 nt, Human
ugagccuggggccugggcagcg

SEQ ID NO: 1042668 - RNA, 22 nt, Human
caggaggcccaaagggcgcaga

SEQ ID NO: 1042669 - RNA, 22 nt, Human
ucucucagggggaaggcugaag

SEQ ID NO: 1042670 - RNA, 22 nt, Human
ugucugguggguugacaggcag

SEQ ID NO: 1042671 - RNA, 22 nt, Human
ggguggaguagaaagaugaauu

SEQ ID NO: 1042672 - RNA, 22 nt, Human
ugggauaguggccaggaccccc

SEQ ID NO: 1042673 - RNA, 18 nt, Human
gggcauggaugcagcauc

SEQ ID NO: 1042674 - RNA, 21 nt, Human
ucauuuuuauugcuaccuugc

SEQ ID NO: 1042675 - RNA, 22 nt, Human
uauuuauaaucugccaaagaga

SEQ ID NO: 1042676 - RNA, 22 nt, Human
uugagggucuggaucugcugcu

SEQ ID NO: 1042677 - RNA, 22 nt, Human
ugggcagaauugugguaguuaa

SEQ ID NO: 1042678 - RNA, 22 nt, Human
cagaggcuguguaggcagacug

SEQ ID NO: 1042679 - RNA, 22 nt, Human
caaggaaaacagaugaucaaca

SEQ ID NO: 1042680 - RNA, 22 nt, Human
cagggcaguuugugccuaugag

SEQ ID NO: 1042681 - RNA, 22 nt, Human
gagggggcgugcaaggcuccgc

SEQ ID NO: 1042682 - RNA, 22 nt, Human
gcaggagugacauggaugugga

SEQ ID NO: 1042683 - RNA, 22 nt, Human
cucuccuccaacagcccugccg

SEQ ID NO: 1042684 - RNA, 21 nt, Human
gcucccuggcugugugaccug

SEQ ID NO: 1042685 - RNA, 22 nt, Human
gcucugaggcugggagcacucu

SEQ ID NO: 1042686 - RNA, 22 nt, Human
cagcaaaagccagcauaagcuc

SEQ ID NO: 1042687 - RNA, 22 nt, Human
aggcaguggcugagaccagggg

SEQ ID NO: 1042688 - RNA, 22 nt, Human
ggugaagggccuuaggagacag

SEQ ID NO: 1042689 - RNA, 22 nt, Human
ggggaugguagaccggugacgu

SEQ ID NO: 1042690 - RNA, 21 nt, Human
aggcacuguuugugguuuggg

SEQ ID NO: 1042691 - RNA, 22 nt, Human
ggccucucuccagucagugcag

SEQ ID NO: 1042692 - RNA, 20 nt, Human
ccuaggcaugcugagucucc

SEQ ID NO: 1042693 - RNA, 22 nt, Human
ugggccagcaauugcugcucag

SEQ ID NO: 1042694 - RNA, 22 nt, Human
agcugucuaccugcagaguccu

SEQ ID NO: 1042695 - RNA, 22 nt, Human
ucagguggcuucggggaguggc

SEQ ID NO: 1042696 - RNA, 22 nt, Human
ccuuugggugaauuccucucuu

SEQ ID NO: 1042697 - RNA, 22 nt, Human
gccacccccaaguagguggucu

SEQ ID NO: 1042698 - RNA, 22 nt, Human
ugcacacaaguuggagaaugaa

SEQ ID NO: 1042699 - RNA, 22 nt, Human
acuuaguauuuuucagcuuuga

SEQ ID NO: 1042700 - RNA, 22 nt, Human
aaguucaagucuccugaguaua

SEQ ID NO: 1042701 - RNA, 22 nt, Human
ccagggugugggcgucggcacg

SEQ ID NO: 1042702 - RNA, 22 nt, Human
cagagcugcaaaugccccuccg

SEQ ID NO: 1042703 - RNA, 22 nt, Human
ggcuccugggaugggacugagc

SEQ ID NO: 1042704 - RNA, 22 nt, Human
aaguucaaggcagguccugagg

SEQ ID NO: 1042705 - RNA, 22 nt, Human
ucagaagcauguggggagccug

SEQ ID NO: 1042706 - RNA, 23 nt, Human
gucagggcuggggucagagugac

SEQ ID NO: 1042707 - RNA, 22 nt, Human
gagagcacaugaacauggagga

SEQ ID NO: 1042708 - RNA, 22 nt, Human
ugcuggggucauggggcgcccg

SEQ ID NO: 1042709 - RNA, 22 nt, Human
uagggcaggggaggaaucugaa

SEQ ID NO: 1042710 - RNA, 20 nt, Human
ccaagagcaugcaugaggaa

SEQ ID NO: 1042711 - RNA, 21 nt, Human
aggagcuguguuagcuggucg

SEQ ID NO: 1042712 - RNA, 22 nt, Human
uaagacaugguugaucuagugu

SEQ ID NO: 1042713 - RNA, 22 nt, Human
uuagaaaugauuucaccucuuu

SEQ ID NO: 1042714 - RNA, 22 nt, Human
gucccuggucuaccguggcuuc

SEQ ID NO: 1042715 - RNA, 23 nt, Human
ccacagagcugccaauuccugug

SEQ ID NO: 1042716 - RNA, 22 nt, Human
agccacagagguugaugugguu

SEQ ID NO: 1042717 - RNA, 22 nt, Human
caugggagcuaucuccaucacu

SEQ ID NO: 1042718 - RNA, 22 nt, Human
cagagcuggagaaguggauuua

SEQ ID NO: 1042719 - RNA, 22 nt, Human
aaaguuacuaucacaaugaaau

SEQ ID NO: 1042720 - RNA, 22 nt, Human
gagcuggugaucagcuggagga

SEQ ID NO: 1042721 - RNA, 22 nt, Human
ggccucugggguccugagccca

SEQ ID NO: 1042722 - RNA, 22 nt, Human
ggaaagaggauaguggguaggu

SEQ ID NO: 1042723 - RNA, 22 nt, Human
ugccagugggugugcagagacu

SEQ ID NO: 1042724 - RNA, 22 nt, Human
ccucugggugggaggccgggcg

SEQ ID NO: 1042725 - RNA, 22 nt, Human
uacauuccauguguguguauuc

SEQ ID NO: 1042726 - RNA, 22 nt, Human
gcagcuggcucagagagguggg

SEQ ID NO: 1042727 - RNA, 22 nt, Human
aaaaaaucagaucuuugguuaa

SEQ ID NO: 1042728 - RNA, 22 nt, Human
aggucauuccuugucuucuugc

SEQ ID NO: 1042729 - RNA, 22 nt, Human
uuuuuccuagugcuuucuggua

SEQ ID NO: 1042730 - RNA, 22 nt, Human
ccaaggcuccucagcuggucuu

SEQ ID NO: 1042731 - RNA, 22 nt, Human
aguuuguaucaauuugcuuuau

SEQ ID NO: 1042732 - RNA, 22 nt, Human
uaggcagcugcaaacuucgguc

SEQ ID NO: 1042733 - RNA, 22 nt, Human
agcugggccugagcuggaagcu

SEQ ID NO: 1042734 - RNA, 22 nt, Human
ugauuuccaugaagcugaaggc

SEQ ID NO: 1042735 - RNA, 22 nt, Human
uuagaaaggagcuuauuucuuu

SEQ ID NO: 1042736 - RNA, 22 nt, Human
uccagaggcuccaaagggagau

SEQ ID NO: 1042737 - RNA, 22 nt, Human
gaguggggcguggauccagcgu

SEQ ID NO: 1042738 - RNA, 22 nt, Human
gcugccugggcaggaggcgcug

SEQ ID NO: 1042739 - RNA, 22 nt, Human
uggcagcacaagguggcccaug

SEQ ID NO: 1042740 - RNA, 18 nt, Human
uccagagcuacuguggug

SEQ ID NO: 1042741 - RNA, 22 nt, Human
ccugugugcugaugacgacaga

SEQ ID NO: 1042742 - RNA, 20 nt, Human
cccucugcacauggcugugg

SEQ ID NO: 1042743 - RNA, 22 nt, Human
ggagcagagcugggcuuggcug

SEQ ID NO: 1042744 - RNA, 22 nt, Human
aggucauuaaaguuaaaugagg

SEQ ID NO: 1042745 - RNA, 22 nt, Human
acagagguguuccagaccuagg

SEQ ID NO: 1042746 - RNA, 22 nt, Human
ggcuucucucuucacauggcuu

SEQ ID NO: 1042747 - RNA, 22 nt, Human
ugacaccacaacuagccauuga

SEQ ID NO: 1042748 - RNA, 17 nt, Human
cagacagauauccuggg

SEQ ID NO: 1042749 - RNA, 22 nt, Human
aaauguguguauguacauauau

SEQ ID NO: 1042750 - RNA, 22 nt, Human
agucucagaaaagaagcaugga

SEQ ID NO: 1042751 - RNA, 22 nt, Human
uuugcauuacuugacuuuaguu

SEQ ID NO: 1042752 - RNA, 21 nt, Human
ugccagcauguaggcuaguug

SEQ ID NO: 1042753 - RNA, 22 nt, Human
cccagcccccgagugucuggaa

SEQ ID NO: 1042754 - RNA, 22 nt, Human
aggcucagagaugaguaagcac

SEQ ID NO: 1042755 - RNA, 22 nt, Human
augucccaagauacagcuagag

SEQ ID NO: 1042756 - RNA, 22 nt, Human
ccuucucuacuccugaugcaug

SEQ ID NO: 1042757 - RNA, 19 nt, Human
auuccucaaggacagaaau

SEQ ID NO: 1042758 - RNA, 22 nt, Human
ugucauaaaacacaagcuguug

SEQ ID NO: 1042759 - RNA, 22 nt, Human
gggcuggcucccagguguugaa

SEQ ID NO: 1042760 - RNA, 22 nt, Human
ggagccugggcauuaguaauuu

SEQ ID NO: 1042761 - RNA, 22 nt, Human
caguccuggggaccaggcugag

SEQ ID NO: 1042762 - RNA, 22 nt, Human
ucccacugcuuugcucugcuca

SEQ ID NO: 1042763 - RNA, 22 nt, Human
auucuucacuguuucagaauga

SEQ ID NO: 1042764 - RNA, 22 nt, Human
caaagguaguauauauauuguu

SEQ ID NO: 1042765 - RNA, 18 nt, Human
ugaacagaugaguugaag

SEQ ID NO: 1042766 - RNA, 22 nt, Human
agguggccggugccagccgggc

SEQ ID NO: 1042767 - RNA, 22 nt, Human
gcaagcuggcuguuagaggaug

SEQ ID NO: 1042768 - RNA, 22 nt, Human
uuuccucuaaacgcauuugcuu

SEQ ID NO: 1042769 - RNA, 22 nt, Human
uaccaggcagcugcacagaggc

SEQ ID NO: 1042770 - RNA, 22 nt, Human
ccagagugacgugaagugugaa

SEQ ID NO: 1042771 - RNA, 22 nt, Human
cauuucugggagacaugcuaga

SEQ ID NO: 1042772 - RNA, 22 nt, Human
uguggugagaaacugguagauu

SEQ ID NO: 1042773 - RNA, 21 nt, Human
gauuucacuuaccuucauuua

SEQ ID NO: 1042774 - RNA, 22 nt, Human
ucuuugcaggagcccuuugaac

SEQ ID NO: 1042775 - RNA, 22 nt, Human
auaguaacuggcauguuuauga

SEQ ID NO: 1042776 - RNA, 22 nt, Human
acaggcuuuuuuagaaugacau

SEQ ID NO: 1042777 - RNA, 22 nt, Human
gccagaaacauacacaucacuu

SEQ ID NO: 1042778 - RNA, 22 nt, Human
gcagcuggcccugacacgcaga

SEQ ID NO: 1042779 - RNA, 22 nt, Human
guuauguacuuuuuaaaucuug

SEQ ID NO: 1042780 - RNA, 22 nt, Human
accugagggcccaaacuuggua

SEQ ID NO: 1042781 - RNA, 22 nt, Human
cugggcacacagugacucugca

SEQ ID NO: 1042782 - RNA, 22 nt, Human
acccagcucuuugauggucuug

SEQ ID NO: 1042783 - RNA, 21 nt, Human
cagaaguaaggguaacuucuc

SEQ ID NO: 1042784 - RNA, 22 nt, Human
uauaacacucagaaagaaucau

SEQ ID NO: 1042785 - RNA, 22 nt, Human
ccucuucugagugagacucccu

SEQ ID NO: 1042786 - RNA, 22 nt, Human
agagccagagaccuggguucac

SEQ ID NO: 1042787 - RNA, 22 nt, Human
cuucuggggauggagcccagaa

SEQ ID NO: 1042788 - RNA, 22 nt, Human
aggcagaauguuggaaaggaag

SEQ ID NO: 1042789 - RNA, 22 nt, Human
cacugaaggacaguaggaaggg

SEQ ID NO: 1042790 - RNA, 22 nt, Human
uagcagugccaggauuuugcug

SEQ ID NO: 1042791 - RNA, 22 nt, Human
gccugccucaaaaucccaguuc

SEQ ID NO: 1042792 - RNA, 22 nt, Human
cuuagaaaugcagauucucagg

SEQ ID NO: 1042793 - RNA, 22 nt, Human
guuugcauggaagacagugagu

SEQ ID NO: 1042794 - RNA, 22 nt, Human
agauuucccaaauacuuguuau

SEQ ID NO: 1042795 - RNA, 22 nt, Human
uguccucacaggaaugaacuuu

SEQ ID NO: 1042796 - RNA, 22 nt, Human
ucagcagggccuccuugugcag

SEQ ID NO: 1042797 - RNA, 22 nt, Human
auaucuuuguuuuugccaagau

SEQ ID NO: 1042798 - RNA, 22 nt, Human
ugaaggugucuuugugaacauc

SEQ ID NO: 1042799 - RNA, 22 nt, Human
ucugagcuggagcccaucaccu

SEQ ID NO: 1042800 - RNA, 22 nt, Human
auguuuauguugggcuauauuu

SEQ ID NO: 1042801 - RNA, 22 nt, Human
gggcagcugcagggauggugac

SEQ ID NO: 1042802 - RNA, 22 nt, Human
cuccuucccuucaaguguuccu

SEQ ID NO: 1042803 - RNA, 22 nt, Human
gugcucuccuggcugcccugac

SEQ ID NO: 1042804 - RNA, 22 nt, Human
uccucagggaagaugagccuca

SEQ ID NO: 1042805 - RNA, 22 nt, Human
ccaggcucugcgcuggacaugg

SEQ ID NO: 1042806 - RNA, 22 nt, Human
cugagccaaccacagcaggagc

SEQ ID NO: 1042807 - RNA, 22 nt, Human
ugcauauuauguguaucugucu

SEQ ID NO: 1042808 - RNA, 22 nt, Human
agguaacacuacuuaguauacu

SEQ ID NO: 1042809 - RNA, 22 nt, Human
aucuacaggauuuuacagaguu

SEQ ID NO: 1042810 - RNA, 20 nt, Human
uuccuguauacaaagaguuc

SEQ ID NO: 1042811 - RNA, 22 nt, Human
gcugucugcugggucgcucagg

SEQ ID NO: 1042812 - RNA, 18 nt, Human
gucaccuggaucagauua

SEQ ID NO: 1042813 - RNA, 22 nt, Human
uacauucuacuuuuucacuccc

SEQ ID NO: 1042814 - RNA, 22 nt, Human
gccaggcagauaugugagcuua

SEQ ID NO: 1042815 - RNA, 22 nt, Human
acacagggcugcgccugacccc

SEQ ID NO: 1042816 - RNA, 19 nt, Human
accaggcuuauggucagug

SEQ ID NO: 1042817 - RNA, 22 nt, Human
ccugagagcgaguggccucaug

SEQ ID NO: 1042818 - RNA, 22 nt, Human
ccuggcagcgugccgagcugcg

SEQ ID NO: 1042819 - RNA, 22 nt, Human
ucauugcagacuaacaaucuca

SEQ ID NO: 1042820 - RNA, 22 nt, Human
acauuucuuucuauucaguagc

SEQ ID NO: 1042821 - RNA, 22 nt, Human
acaggcucucagccaguuggca

SEQ ID NO: 1042822 - RNA, 22 nt, Human
aaucaguuguucacucugaaaa

SEQ ID NO: 1042823 - RNA, 22 nt, Human
aguuuuuccguggcuacgauaa

SEQ ID NO: 1042824 - RNA, 22 nt, Human
uccuugaagcuuguaucuaaua

SEQ ID NO: 1042825 - RNA, 22 nt, Human
ccacugucagaggggcugugcc

SEQ ID NO: 1042826 - RNA, 22 nt, Human
caagacaagaucuaagcaugcu

SEQ ID NO: 1042827 - RNA, 22 nt, Human
guaaaguucuauuugaauuuag

SEQ ID NO: 1042828 - RNA, 22 nt, Human
cacccagcagcacuuaagacua

SEQ ID NO: 1042829 - RNA, 21 nt, Human
uuuuuucuugcgugaggccug

SEQ ID NO: 1042830 - RNA, 22 nt, Human
agccacaggaaacagagacagc

SEQ ID NO: 1042831 - RNA, 22 nt, Human
ucauugcacuccagccugggca

SEQ ID NO: 1042832 - RNA, 22 nt, Human
cccaaggcugcagugagcauga

SEQ ID NO: 1042833 - RNA, 22 nt, Human
ccacccuuggguucggaggccg

SEQ ID NO: 1042834 - RNA, 22 nt, Human
aaauuuaagaagugugugcgug

SEQ ID NO: 1042835 - RNA, 22 nt, Human
ugggcagauuaaugcaguggcu

SEQ ID NO: 1042836 - RNA, 22 nt, Human
gagggggagaugugcacacacu

SEQ ID NO: 1042837 - RNA, 23 nt, Human
gugcucugcggucugcuagucug

SEQ ID NO: 1042838 - RNA, 22 nt, Human
uggcucagcauucacuggucuu

SEQ ID NO: 1042839 - RNA, 22 nt, Human
aggagcugggcugcugcuggga

SEQ ID NO: 1042840 - RNA, 22 nt, Human
gggacuguaaauucauauggcc

SEQ ID NO: 1042841 - RNA, 22 nt, Human
ccagagcccgggaccuggacuu

SEQ ID NO: 1042842 - RNA, 22 nt, Human
ucaccuuagcuagaggaagaga

SEQ ID NO: 1042843 - RNA, 22 nt, Human
caguacuucuuggaaacuggau

SEQ ID NO: 1042844 - RNA, 19 nt, Human
gcaggcaguggcauucgga

SEQ ID NO: 1042845 - RNA, 22 nt, Human
gagcugcuucugugugccgggu

SEQ ID NO: 1042846 - RNA, 22 nt, Human
uccagggccaagucauggaacc

SEQ ID NO: 1042847 - RNA, 22 nt, Human
cccagggacagaugggcagcua

SEQ ID NO: 1042848 - RNA, 22 nt, Human
aggaccaacauagcagcagugg

SEQ ID NO: 1042849 - RNA, 22 nt, Human
uuggagcccugaggaucuggau

SEQ ID NO: 1042850 - RNA, 22 nt, Human
aaauguagaccuauagggaccu

SEQ ID NO: 1042851 - RNA, 22 nt, Human
ggaggccuagccagcuccaguu

SEQ ID NO: 1042852 - RNA, 22 nt, Human
agggugcauguuugcaagagug

SEQ ID NO: 1042853 - RNA, 22 nt, Human
gaggcaggcccugaaugaguca

SEQ ID NO: 1042854 - RNA, 22 nt, Human
auguaucaauuaucugucugca

SEQ ID NO: 1042855 - RNA, 22 nt, Human
uggggaagggcacccuggagac

SEQ ID NO: 1042856 - RNA, 22 nt, Human
uuugggaacucuaucauggaaa

SEQ ID NO: 1042857 - RNA, 22 nt, Human
agagugaagguugacacuucac

SEQ ID NO: 1042858 - RNA, 22 nt, Human
agcaauauuuaaagguuugcaa

SEQ ID NO: 1042859 - RNA, 22 nt, Human
cuggagcugucuucacaggccu

SEQ ID NO: 1042860 - RNA, 22 nt, Human
uuauguauggauggcugaaagu

SEQ ID NO: 1042861 - RNA, 22 nt, Human
gggaguguugagcgcccugcca

SEQ ID NO: 1042862 - RNA, 22 nt, Human
gccugccuggagcuugagguga

SEQ ID NO: 1042863 - RNA, 22 nt, Human
gcagagcuaucuucuggauuug

SEQ ID NO: 1042864 - RNA, 22 nt, Human
agggccugggguagcuuacugc

SEQ ID NO: 1042865 - RNA, 22 nt, Human
aagcaaagaguuuaguggguga

SEQ ID NO: 1042866 - RNA, 18 nt, Human
gcccugguggagcuggug

SEQ ID NO: 1042867 - RNA, 21 nt, Human
aaagaacaggcagauguucuu

SEQ ID NO: 1042868 - RNA, 22 nt, Human
gcguaaggccucuggucucgga

SEQ ID NO: 1042869 - RNA, 22 nt, Human
gcaggagcuggaaagugauguu

SEQ ID NO: 1042870 - RNA, 22 nt, Human
aggccuccuggcuccaggccuu

SEQ ID NO: 1042871 - RNA, 20 nt, Human
ugcagcugcaggaggguggg

SEQ ID NO: 1042872 - RNA, 22 nt, Human
gggcucugcgcucagcuccagc

SEQ ID NO: 1042873 - RNA, 22 nt, Human
ucaaugaugcugaagguagcgu

SEQ ID NO: 1042874 - RNA, 18 nt, Human
cacaggcucccagugagg

SEQ ID NO: 1042875 - RNA, 22 nt, Human
ugggccuguugggguugaguua

SEQ ID NO: 1042876 - RNA, 22 nt, Human
ccuggcuccugccucugcaggg

SEQ ID NO: 1042877 - RNA, 22 nt, Human
gcaggccucuguugagggccuu

SEQ ID NO: 1042878 - RNA, 22 nt, Human
caguacuuuucuggcuuucuac

SEQ ID NO: 1042879 - RNA, 22 nt, Human
uacuguauuugauaagugaagu

SEQ ID NO: 1042880 - RNA, 22 nt, Human
guccuggggauuauagaguguu

SEQ ID NO: 1042881 - RNA, 22 nt, Human
aaauaauugaguuggucaauau

SEQ ID NO: 1042882 - RNA, 22 nt, Human
ggguccagacacuccagaggaa

SEQ ID NO: 1042883 - RNA, 22 nt, Human
uuuuuccuuggaugugucucuc

SEQ ID NO: 1042884 - RNA, 22 nt, Human
gaggucaggggagaggcugaug

SEQ ID NO: 1042885 - RNA, 22 nt, Human
aagcugccauagaacgagaggu

SEQ ID NO: 1042886 - RNA, 21 nt, Human
uauacaugugugcauacgugu

SEQ ID NO: 1042887 - RNA, 22 nt, Human
aucuagaaaguguugaagauca

SEQ ID NO: 1042888 - RNA, 22 nt, Human
gugcaggggaucagguugcagc

SEQ ID NO: 1042889 - RNA, 22 nt, Human
ugagcaguaggucugaauagug

SEQ ID NO: 1042890 - RNA, 22 nt, Human
gcagugacagggcugcugccuu

SEQ ID NO: 1042891 - RNA, 17 nt, Human
uguuccauuugaccacc

SEQ ID NO: 1042892 - RNA, 22 nt, Human
cugucucuguugccuguaggug

SEQ ID NO: 1042893 - RNA, 22 nt, Human
aggaaucccgcaccagcugcug

SEQ ID NO: 1042894 - RNA, 22 nt, Human
uuauguaauuuguuugcucuuc

SEQ ID NO: 1042895 - RNA, 22 nt, Human
uguuuuaugagccauauaaccu

SEQ ID NO: 1042896 - RNA, 22 nt, Human
ggccuugggaggagggucagaa

SEQ ID NO: 1042897 - RNA, 22 nt, Human
cagggugccuguccucagcaaa

SEQ ID NO: 1042898 - RNA, 22 nt, Human
ugccugcuaggcccugcugggu

SEQ ID NO: 1042899 - RNA, 22 nt, Human
gucagaggaauggaugagugau

SEQ ID NO: 1042900 - RNA, 22 nt, Human
aguuauauaacuaucuagaugc

SEQ ID NO: 1042901 - RNA, 22 nt, Human
cagccccucccucaggcaggug

SEQ ID NO: 1042902 - RNA, 22 nt, Human
cgggcagaucacacagggcuug

SEQ ID NO: 1042903 - RNA, 22 nt, Human
ucacaugcuugaggaaagaaaa

SEQ ID NO: 1042904 - RNA, 22 nt, Human
agccuguccagaggacagggcu

SEQ ID NO: 1042905 - RNA, 22 nt, Human
ggucccugaagaggccuggggu

SEQ ID NO: 1042906 - RNA, 22 nt, Human
cagcuggcagaaccugcaucca

SEQ ID NO: 1042907 - RNA, 22 nt, Human
ugcccaggaucuggcgaugcuc

SEQ ID NO: 1042908 - RNA, 22 nt, Human
gaguuguucaacgugugugaaa

SEQ ID NO: 1042909 - RNA, 22 nt, Human
uugauacaggccuucuagauga

SEQ ID NO: 1042910 - RNA, 22 nt, Human
uggcagagcccagacuccaguc

SEQ ID NO: 1042911 - RNA, 23 nt, Human
cugucuccugggcuagguggaau

SEQ ID NO: 1042912 - RNA, 22 nt, Human
aagguacaaaguauuauuuaaa

SEQ ID NO: 1042913 - RNA, 22 nt, Human
ugucaugccaccguuucccaga

SEQ ID NO: 1042914 - RNA, 22 nt, Human
acucucucacagcuuggcugau

SEQ ID NO: 1042915 - RNA, 22 nt, Human
agcauuuaugacuaauguaaaa

SEQ ID NO: 1042916 - RNA, 22 nt, Human
gccuggguccacugaucaugcu

SEQ ID NO: 1042917 - RNA, 22 nt, Human
ccugaggcuuaaucugucccaa

SEQ ID NO: 1042918 - RNA, 22 nt, Human
ggagaguggauuccagcuguau

SEQ ID NO: 1042919 - RNA, 22 nt, Human
ugucucugaacagcuuacuaaa

SEQ ID NO: 1042920 - RNA, 22 nt, Human
uaugcacgucuauuuaugaaga

SEQ ID NO: 1042921 - RNA, 22 nt, Human
uaaaucucacuggguauauugg

SEQ ID NO: 1042922 - RNA, 22 nt, Human
ugaagcaggcauugacugauga

SEQ ID NO: 1042923 - RNA, 22 nt, Human
ugggcugcuucuauuggugguc

SEQ ID NO: 1042924 - RNA, 22 nt, Human
ggccucugccccagccacaccu

SEQ ID NO: 1042925 - RNA, 22 nt, Human
agggcugcaccggggcuucgcg

SEQ ID NO: 1042926 - RNA, 22 nt, Human
uggcagcacuagguacugagcu

SEQ ID NO: 1042927 - RNA, 22 nt, Human
guuuuguugcugcagagcucaa

SEQ ID NO: 1042928 - RNA, 22 nt, Human
auguccuuugcuucucuggucc

SEQ ID NO: 1042929 - RNA, 22 nt, Human
gaggggcucuugggcaugaagg

SEQ ID NO: 1042930 - RNA, 22 nt, Human
cccaggaggcagaaguugcagu

SEQ ID NO: 1042931 - RNA, 22 nt, Human
ccagcucuggcuucuugcuggg

SEQ ID NO: 1042932 - RNA, 22 nt, Human
gccaggugcuaucccugcgcug

SEQ ID NO: 1042933 - RNA, 22 nt, Human
cagauaaaggcuuacuaguagu

SEQ ID NO: 1042934 - RNA, 22 nt, Human
cugggaggugaacagaaaaacu

SEQ ID NO: 1042935 - RNA, 22 nt, Human
uuggcugagagaggaaaagggc

SEQ ID NO: 1042936 - RNA, 22 nt, Human
ugagcuuacuucuguacacaga

SEQ ID NO: 1042937 - RNA, 22 nt, Human
aagaauguucauuaaacuguug

SEQ ID NO: 1042938 - RNA, 22 nt, Human
ucccuggacagccuugccuggg

SEQ ID NO: 1042939 - RNA, 22 nt, Human
uggcuuccuggacagaugcggu

SEQ ID NO: 1042940 - RNA, 22 nt, Human
gugccugugccaggggugugcu

SEQ ID NO: 1042941 - RNA, 22 nt, Human
uagaaaucuacuuagacuuucu

SEQ ID NO: 1042942 - RNA, 18 nt, Human
uggcagagugucuguucu

SEQ ID NO: 1042943 - RNA, 22 nt, Human
cucuggaguucuucaagcuacu

SEQ ID NO: 1042944 - RNA, 22 nt, Human
cuccaggccagggaaguggaca

SEQ ID NO: 1042945 - RNA, 22 nt, Human
ucccagccauuccuuuaggugu

SEQ ID NO: 1042946 - RNA, 22 nt, Human
agcagcugagccccagcuguga

SEQ ID NO: 1042947 - RNA, 22 nt, Human
cucagaguccccaguggguuug

SEQ ID NO: 1042948 - RNA, 23 nt, Human
gccuucagcucgggaaggcuccc

SEQ ID NO: 1042949 - RNA, 22 nt, Human
aagggcagaaagggacgcuuug

SEQ ID NO: 1042950 - RNA, 22 nt, Human
ugcccuuggguaacuugcugau

SEQ ID NO: 1042951 - RNA, 23 nt, Human
ugcugggcagagcuggugcugag

SEQ ID NO: 1042952 - RNA, 22 nt, Human
gcccauggcagaacugugagca

SEQ ID NO: 1042953 - RNA, 22 nt, Human
agcucccagaguccucugccca

SEQ ID NO: 1042954 - RNA, 22 nt, Human
acauuucuuuucaucucuauau

SEQ ID NO: 1042955 - RNA, 22 nt, Human
acuggcagagguuggacaccau

SEQ ID NO: 1042956 - RNA, 22 nt, Human
cauucauuuacuuucaacagcu

SEQ ID NO: 1042957 - RNA, 22 nt, Human
cagucacauggaugauggauag

SEQ ID NO: 1042958 - RNA, 21 nt, Human
gcugccaccgcgugcuccagg

SEQ ID NO: 1042959 - RNA, 22 nt, Human
agcagcuggggccugugacgau

SEQ ID NO: 1042960 - RNA, 22 nt, Human
cccagcucucugcucuuagccu

SEQ ID NO: 1042961 - RNA, 17 nt, Human
ggaaaaggaugauacag

SEQ ID NO: 1042962 - RNA, 23 nt, Human
cacaccaggagccgucugggcca

SEQ ID NO: 1042963 - RNA, 22 nt, Human
ggcaguggguggaucucaggga

SEQ ID NO: 1042964 - RNA, 20 nt, Human
ugcucugucuaaaacuuccc

SEQ ID NO: 1042965 - RNA, 23 nt, Human
aaaugcagggucgcagguuacag

SEQ ID NO: 1042966 - RNA, 22 nt, Human
ugcaauaaagugcuauaaaucc

SEQ ID NO: 1042967 - RNA, 22 nt, Human
cuggugcuggagccuagucccu

SEQ ID NO: 1042968 - RNA, 22 nt, Human
gcuggcaggguucucacugaaa

SEQ ID NO: 1042969 - RNA, 22 nt, Human
ugggccuguugccugaguccau

SEQ ID NO: 1042970 - RNA, 22 nt, Human
cagaggcugggaccucaggcau

SEQ ID NO: 1042971 - RNA, 22 nt, Human
augccacugacauggacaauuu

SEQ ID NO: 1042972 - RNA, 22 nt, Human
uggcucuggugcgggcuccugc

SEQ ID NO: 1042973 - RNA, 22 nt, Human
cagccagcuggcacugugagua

SEQ ID NO: 1042974 - RNA, 22 nt, Human
ucagaacauugacauucuuauu

SEQ ID NO: 1042975 - RNA, 22 nt, Human
acauucaugucccacuucuagc

SEQ ID NO: 1042976 - RNA, 22 nt, Human
cugcugucuuuauuucacugcu

SEQ ID NO: 1042977 - RNA, 22 nt, Human
ggcuccagggaguggagagaag

SEQ ID NO: 1042978 - RNA, 22 nt, Human
cugagcugcucccgcugcagcg

SEQ ID NO: 1042979 - RNA, 22 nt, Human
ggaaaaggccacagggacacau

SEQ ID NO: 1042980 - RNA, 17 nt, Human
cugucugcgcaugaggu

SEQ ID NO: 1042981 - RNA, 22 nt, Human
ucucagagggaaacaugaguga

SEQ ID NO: 1042982 - RNA, 22 nt, Human
aaagaauuuguacacccuacua

SEQ ID NO: 1042983 - RNA, 22 nt, Human
cugcccugugaggguccuuggg

SEQ ID NO: 1042984 - RNA, 22 nt, Human
gcacccagaggucagcagugcu

SEQ ID NO: 1042985 - RNA, 22 nt, Human
caaaguuuaaaguagauuucag

SEQ ID NO: 1042986 - RNA, 22 nt, Human
uuagcuaaacuguaacuagaau

SEQ ID NO: 1042987 - RNA, 22 nt, Human
uaggcagggauuaggguugauu

SEQ ID NO: 1042988 - RNA, 22 nt, Human
uggaggcauuuuagguugucac

SEQ ID NO: 1042989 - RNA, 22 nt, Human
cauugcacugcagcccgggcaa

SEQ ID NO: 1042990 - RNA, 22 nt, Human
uuucacauguggaaugccaggu

SEQ ID NO: 1042991 - RNA, 22 nt, Human
ucaggagagaaagaauacaauu

SEQ ID NO: 1042992 - RNA, 22 nt, Human
caggccugacccugagcuucac

SEQ ID NO: 1042993 - RNA, 22 nt, Human
uggaaggcaacggagugagcug

SEQ ID NO: 1042994 - RNA, 22 nt, Human
uggcacugggaugcuacuguua

SEQ ID NO: 1042995 - RNA, 22 nt, Human
uuuguaaauagcaguacucaug

SEQ ID NO: 1042996 - RNA, 22 nt, Human
agcagcaugaugacagagucuc

SEQ ID NO: 1042997 - RNA, 22 nt, Human
aaaaauaggucaaccguguaug

SEQ ID NO: 1042998 - RNA, 22 nt, Human
gagcagaacaggccggguggga

SEQ ID NO: 1042999 - RNA, 22 nt, Human
gggccuguguguucaggagccu

SEQ ID NO: 1043000 - RNA, 22 nt, Human
ucuggcuccacucugugcaugc

SEQ ID NO: 1043001 - RNA, 21 nt, Human
ccucuggcuugugcugugccc

SEQ ID NO: 1043002 - RNA, 18 nt, Human
ugggcugccuggccucug

SEQ ID NO: 1043003 - RNA, 22 nt, Human
gggcugcuuccuggggaaugcu

SEQ ID NO: 1043004 - RNA, 22 nt, Human
gaugagggccugguggcugugc

SEQ ID NO: 1043005 - RNA, 22 nt, Human
agguacagcaauauaagagguc

SEQ ID NO: 1043006 - RNA, 22 nt, Human
ccagaggugcugggagaggucu

SEQ ID NO: 1043007 - RNA, 22 nt, Human
uccuuuccaugcuucuagaggc

SEQ ID NO: 1043008 - RNA, 22 nt, Human
aggagaguaccauugggccgca

SEQ ID NO: 1043009 - RNA, 22 nt, Human
gugcauuucucauacacuaaau

SEQ ID NO: 1043010 - RNA, 22 nt, Human
cagucccagcugcucagaaggc

SEQ ID NO: 1043011 - RNA, 22 nt, Human
gcagcuggagcaucuucucauc

SEQ ID NO: 1043012 - RNA, 22 nt, Human
ccauggccgccgcugcucagga

SEQ ID NO: 1043013 - RNA, 22 nt, Human
cagggccagcgucucgggcuau

SEQ ID NO: 1043014 - RNA, 22 nt, Human
gccuuggcugaugugcgaauga

SEQ ID NO: 1043015 - RNA, 22 nt, Human
ucuggcuccuggcuccacugcc

SEQ ID NO: 1043016 - RNA, 22 nt, Human
cuggccuuggugcuugcagaca

SEQ ID NO: 1043017 - RNA, 22 nt, Human
cagcccuuuccuucucagcuuu

SEQ ID NO: 1043018 - RNA, 22 nt, Human
ugucuucaucuccaugcacaga

SEQ ID NO: 1043019 - RNA, 22 nt, Human
guaaaucccauccuuucucugg

SEQ ID NO: 1043020 - RNA, 22 nt, Human
uaacacugauuuguucucaggg

SEQ ID NO: 1043021 - RNA, 22 nt, Human
uuccaggggcagcagugauggu

SEQ ID NO: 1043022 - RNA, 22 nt, Human
uaggccagaggagcagcuuugg

SEQ ID NO: 1043023 - RNA, 22 nt, Human
auaaggcaagcugucaguuugu

SEQ ID NO: 1043024 - RNA, 22 nt, Human
auaaggcagaaaugauucuagu

SEQ ID NO: 1043025 - RNA, 22 nt, Human
cagucacauugcccugcauuua

SEQ ID NO: 1043026 - RNA, 22 nt, Human
uucacaggugacuggggauaac

SEQ ID NO: 1043027 - RNA, 22 nt, Human
ucuccuggucaccucagaaguc

SEQ ID NO: 1043028 - RNA, 22 nt, Human
uaacacacugaaggugagaugg

SEQ ID NO: 1043029 - RNA, 22 nt, Human
ccuggcucuucagagguuccua

SEQ ID NO: 1043030 - RNA, 22 nt, Human
uugaagcauuguggcuuguauu

SEQ ID NO: 1043031 - RNA, 22 nt, Human
cagcuucucagaaagcugaggu

SEQ ID NO: 1043032 - RNA, 22 nt, Human
cucucaggcuugggucguggca

SEQ ID NO: 1043033 - RNA, 22 nt, Human
uggcucagugaagagauaacuu

SEQ ID NO: 1043034 - RNA, 22 nt, Human
aaauugcaaaaguacuuuuagg

SEQ ID NO: 1043035 - RNA, 22 nt, Human
uccuggagcuuccuucauggua

SEQ ID NO: 1043036 - RNA, 22 nt, Human
agugucugccagcugccaggug

SEQ ID NO: 1043037 - RNA, 22 nt, Human
ccuccagcgcgauccacuccgg

SEQ ID NO: 1043038 - RNA, 21 nt, Human
ugcucaugcaaugcaugucca

SEQ ID NO: 1043039 - RNA, 22 nt, Human
ucuuacauauagcaugaguaca

SEQ ID NO: 1043040 - RNA, 22 nt, Human
guggugcauccuugaguaagcu

SEQ ID NO: 1043041 - RNA, 22 nt, Human
augggugugaaaauggucaucu

SEQ ID NO: 1043042 - RNA, 22 nt, Human
auccagggauaaaaguaagguu

SEQ ID NO: 1043043 - RNA, 22 nt, Human
uguacaaugccagggaacacca

SEQ ID NO: 1043044 - RNA, 23 nt, Human
aggcacugaaugugucagugagu

SEQ ID NO: 1043045 - RNA, 22 nt, Human
aagguacaguuuuaagaauaag

SEQ ID NO: 1043046 - RNA, 22 nt, Human
cccagagcuccgguccugccca

SEQ ID NO: 1043047 - RNA, 22 nt, Human
caggugggccaugaaaaaugac

SEQ ID NO: 1043048 - RNA, 22 nt, Human
agcccuggcccggcugugcuuu

SEQ ID NO: 1043049 - RNA, 22 nt, Human
accagcagaguugaggaggaca

SEQ ID NO: 1043050 - RNA, 19 nt, Human
agcuggggcgguguguguu

SEQ ID NO: 1043051 - RNA, 22 nt, Human
agauguuccagccaaugggaau

SEQ ID NO: 1043052 - RNA, 22 nt, Human
guaauugacucagcucuguuca

SEQ ID NO: 1043053 - RNA, 22 nt, Human
ucugugaacaucacauugacag

SEQ ID NO: 1043054 - RNA, 21 nt, Human
ggcacugagccagauggacuc

SEQ ID NO: 1043055 - RNA, 22 nt, Human
aagcugccaccagcccagggca

SEQ ID NO: 1043056 - RNA, 19 nt, Human
ucaaagucugagucacuuu

SEQ ID NO: 1043057 - RNA, 22 nt, Human
ucaggacagccagggugcagac

SEQ ID NO: 1043058 - RNA, 22 nt, Human
cucacagaugcugugggucagg

SEQ ID NO: 1043059 - RNA, 22 nt, Human
aaaugguaagacaacacauuau

SEQ ID NO: 1043060 - RNA, 22 nt, Human
ugucucugcuuuccuugcaggg

SEQ ID NO: 1043061 - RNA, 22 nt, Human
ugguaucagagccaucuguauu

SEQ ID NO: 1043062 - RNA, 22 nt, Human
cagaggccucacuuccagccag

SEQ ID NO: 1043063 - RNA, 22 nt, Human
ccagccuggacugggucuugug

SEQ ID NO: 1043064 - RNA, 22 nt, Human
ggcugcugguagggguaggaag

SEQ ID NO: 1043065 - RNA, 22 nt, Human
auugaaagcacaaagaacaagu

SEQ ID NO: 1043066 - RNA, 22 nt, Human
ggagaagggacagacucagcuu

SEQ ID NO: 1043067 - RNA, 22 nt, Human
ggggacccucaggacugcgucu

SEQ ID NO: 1043068 - RNA, 21 nt, Human
aguguccuugaucuugccuug

SEQ ID NO: 1043069 - RNA, 22 nt, Human
gucaugccagcggagcucggga

SEQ ID NO: 1043070 - RNA, 22 nt, Human
caagagcuggguggcaagcuag

SEQ ID NO: 1043071 - RNA, 22 nt, Human
ucuguaucuaauuuuacaguag

SEQ ID NO: 1043072 - RNA, 22 nt, Human
ggccuggaagaggacagagaaa

SEQ ID NO: 1043073 - RNA, 22 nt, Human
acagccagggcauugucgccga

SEQ ID NO: 1043074 - RNA, 22 nt, Human
augguuuguaacccaauacucc

SEQ ID NO: 1043075 - RNA, 23 nt, Human
ggcacugaagcuacaauggugag

SEQ ID NO: 1043076 - RNA, 20 nt, Human
gcuuuuucuaauagcagucc

SEQ ID NO: 1043077 - RNA, 22 nt, Human
auguaucaacaaauuguacagu

SEQ ID NO: 1043078 - RNA, 23 nt, Human
gccaggcuccggucuguggccac

SEQ ID NO: 1043079 - RNA, 17 nt, Human
ucagcaaagacaaagga

SEQ ID NO: 1043080 - RNA, 22 nt, Human
aauguguauacuggcaauuaag

SEQ ID NO: 1043081 - RNA, 22 nt, Human
gcaggcagagguggaggagaca

SEQ ID NO: 1043082 - RNA, 22 nt, Human
ugccuguccugaggaugagggu

SEQ ID NO: 1043083 - RNA, 22 nt, Human
ucaaugauuagaguuuagugug

SEQ ID NO: 1043084 - RNA, 22 nt, Human
cagggccaccguguuugcugcu

SEQ ID NO: 1043085 - RNA, 22 nt, Human
ccucccacuucuugcugagguc

SEQ ID NO: 1043086 - RNA, 22 nt, Human
uaaaguucuggugagagguaag

SEQ ID NO: 1043087 - RNA, 22 nt, Human
cccagcaucccagugggcagca

SEQ ID NO: 1043088 - RNA, 20 nt, Human
cuguagggugcagcaggcuc

SEQ ID NO: 1043089 - RNA, 22 nt, Human
caggcuugauuauucagacaau

SEQ ID NO: 1043090 - RNA, 19 nt, Human
uggcugggcgugccuccgu

SEQ ID NO: 1043091 - RNA, 22 nt, Human
cugggcugcaucaaagaggcau

SEQ ID NO: 1043092 - RNA, 22 nt, Human
acagggcagagugaaaugcuau

SEQ ID NO: 1043093 - RNA, 22 nt, Human
ucugcaggaggcuggcugcagg

SEQ ID NO: 1043094 - RNA, 22 nt, Human
uagcaggguccaaugugaggca

SEQ ID NO: 1043095 - RNA, 22 nt, Human
ccugccugucaucgccugcgcc

SEQ ID NO: 1043096 - RNA, 22 nt, Human
cauuuacuguugaaucccuagc

SEQ ID NO: 1043097 - RNA, 22 nt, Human
caguacuugggggguucuaagu

SEQ ID NO: 1043098 - RNA, 22 nt, Human
ggagcauguggggugagcaggg

SEQ ID NO: 1043099 - RNA, 22 nt, Human
ggcagcuccaaaaggaaacacu

SEQ ID NO: 1043100 - RNA, 22 nt, Human
ugcauuguuuagaacucuuugg

SEQ ID NO: 1043101 - RNA, 22 nt, Human
uuuaaauaggacuccugggggu

SEQ ID NO: 1043102 - RNA, 22 nt, Human
ccaguuuuuccagugcuuucug

SEQ ID NO: 1043103 - RNA, 22 nt, Human
gccaguuccuguggagucagag

SEQ ID NO: 1043104 - RNA, 22 nt, Human
aggucacauggauaaugaucag

SEQ ID NO: 1043105 - RNA, 22 nt, Human
ucagcuggagaugagaaccgaa

SEQ ID NO: 1043106 - RNA, 22 nt, Human
gguuugcauucugaaaggcuca

SEQ ID NO: 1043107 - RNA, 22 nt, Human
uuuuccuauaugcaaagaaugc

SEQ ID NO: 1043108 - RNA, 22 nt, Human
ugggcacuggaagccugcugug

SEQ ID NO: 1043109 - RNA, 22 nt, Human
ugccucugguuaucugguaccu

SEQ ID NO: 1043110 - RNA, 22 nt, Human
ugcaguggcgccaucucagcuc

SEQ ID NO: 1043111 - RNA, 19 nt, Human
uccuuugaauaucaguuga

SEQ ID NO: 1043112 - RNA, 22 nt, Human
agcugccaucagccuuuggaug

SEQ ID NO: 1043113 - RNA, 22 nt, Human
cauugucacccaaagcucauag

SEQ ID NO: 1043114 - RNA, 18 nt, Human
aaguaacagaagagcaca

SEQ ID NO: 1043115 - RNA, 21 nt, Human
gcagggacaaagcuucaggag

SEQ ID NO: 1043116 - RNA, 23 nt, Human
uugugggcagauuccauggggag

SEQ ID NO: 1043117 - RNA, 22 nt, Human
cccaccccuggacaggugagug

SEQ ID NO: 1043118 - RNA, 22 nt, Human
acagaauuaucaggaaauguua

SEQ ID NO: 1043119 - RNA, 22 nt, Human
cagggugccucccgcucgccgg

SEQ ID NO: 1043120 - RNA, 22 nt, Human
cccaggagguggagcuugcagu

SEQ ID NO: 1043121 - RNA, 22 nt, Human
uuacauuuggcuauguccucua

SEQ ID NO: 1043122 - RNA, 22 nt, Human
uggcugucagcugccuggugcg

SEQ ID NO: 1043123 - RNA, 22 nt, Human
agcagcuguacuuucaucuguu

SEQ ID NO: 1043124 - RNA, 22 nt, Human
caaaguuaugaaugauaagauu

SEQ ID NO: 1043125 - RNA, 22 nt, Human
uggcuaggcuccaagagcugga

SEQ ID NO: 1043126 - RNA, 22 nt, Human
ugagccuggccugcagagacca

SEQ ID NO: 1043127 - RNA, 22 nt, Human
ggcucagguugggucacaugac

SEQ ID NO: 1043128 - RNA, 22 nt, Human
guggagccaggaucuccgcaca

SEQ ID NO: 1043129 - RNA, 22 nt, Human
cuggaugcuuccucucugcuag

SEQ ID NO: 1043130 - RNA, 22 nt, Human
cagcauuggguuaccuuuguuu

SEQ ID NO: 1043131 - RNA, 20 nt, Human
ucaggcaguggggaaaggca

SEQ ID NO: 1043132 - RNA, 20 nt, Human
uccuggccuucucgggcagu

SEQ ID NO: 1043133 - RNA, 17 nt, Human
ugaaggaaggaugaugu

SEQ ID NO: 1043134 - RNA, 22 nt, Human
cuuucucuguguuucacaugcu

SEQ ID NO: 1043135 - RNA, 22 nt, Human
guggcugcuguccucucugguu

SEQ ID NO: 1043136 - RNA, 22 nt, Human
cugggccugguagggcuugaaa

SEQ ID NO: 1043137 - RNA, 22 nt, Human
cugcuuuguaaaauagacauaa

SEQ ID NO: 1043138 - RNA, 22 nt, Human
gcucccuccaugaggcagaccg

SEQ ID NO: 1043139 - RNA, 22 nt, Human
uccuggagggaggcggugcuac

SEQ ID NO: 1043140 - RNA, 22 nt, Human
ggcugcaggcagaggcugucug

SEQ ID NO: 1043141 - RNA, 17 nt, Human
ggcagcugccacuuuuu

SEQ ID NO: 1043142 - RNA, 22 nt, Human
acuuugcaauacuuaauacaaa

SEQ ID NO: 1043143 - RNA, 20 nt, Human
cugccaugauugauagagug

SEQ ID NO: 1043144 - RNA, 22 nt, Human
cagaauuuuucgaauguacugu

SEQ ID NO: 1043145 - RNA, 22 nt, Human
caaaagcaguucuaucugaguu

SEQ ID NO: 1043146 - RNA, 22 nt, Human
agcugguguccuccuggagcug

SEQ ID NO: 1043147 - RNA, 22 nt, Human
agauuucccacuccauguauug

SEQ ID NO: 1043148 - RNA, 22 nt, Human
agaggcuccaccuucucugucc

SEQ ID NO: 1043149 - RNA, 17 nt, Human
ucuuuccugccaugcuc

SEQ ID NO: 1043150 - RNA, 22 nt, Human
caugagauaauuuuucuccagu

SEQ ID NO: 1043151 - RNA, 22 nt, Human
gcagagcaguacucucuugacu

SEQ ID NO: 1043152 - RNA, 22 nt, Human
acucacauuucaucaggccaag

SEQ ID NO: 1043153 - RNA, 19 nt, Human
ucucacaucagcuccuagc

SEQ ID NO: 1043154 - RNA, 22 nt, Human
uuguuaaaaugcauauucuggu

SEQ ID NO: 1043155 - RNA, 22 nt, Human
ucuggcucacuucaggcuucac

SEQ ID NO: 1043156 - RNA, 22 nt, Human
aggcccugcuuuccagagcuca

SEQ ID NO: 1043157 - RNA, 22 nt, Human
aaagccuuggucaucugguucc

SEQ ID NO: 1043158 - RNA, 22 nt, Human
agcaccugcacaguggaggaaa

SEQ ID NO: 1043159 - RNA, 21 nt, Human
gcagccagacgggauucaguu

SEQ ID NO: 1043160 - RNA, 22 nt, Human
gcagaagggaauaaggagcuuu

SEQ ID NO: 1043161 - RNA, 22 nt, Human
auguagcagauauuugugcaca

SEQ ID NO: 1043162 - RNA, 22 nt, Human
aaaucacuaaguuauagugugg

SEQ ID NO: 1043163 - RNA, 17 nt, Human
gcugccaccuuuggagc

SEQ ID NO: 1043164 - RNA, 22 nt, Human
uuagaaaacauaagugguaaag

SEQ ID NO: 1043165 - RNA, 22 nt, Human
agcugcaggccucuccugggga

SEQ ID NO: 1043166 - RNA, 22 nt, Human
uugugucugggggagugacauc

SEQ ID NO: 1043167 - RNA, 22 nt, Human
ucucuccuuaucauuguguuua

SEQ ID NO: 1043168 - RNA, 22 nt, Human
acucuugucucaacuuuuguau

SEQ ID NO: 1043169 - RNA, 22 nt, Human
uggcuccuaggauggugccugg

SEQ ID NO: 1043170 - RNA, 19 nt, Human
cauaauacaguggaucuga

SEQ ID NO: 1043171 - RNA, 22 nt, Human
caggggcucuaaugcaugauca

SEQ ID NO: 1043172 - RNA, 22 nt, Human
ggaggccaugaggcucuaggug

SEQ ID NO: 1043173 - RNA, 22 nt, Human
cagcaaaauuugaggauugccu

SEQ ID NO: 1043174 - RNA, 22 nt, Human
ggugggugagcccugggagcug

SEQ ID NO: 1043175 - RNA, 22 nt, Human
cagccuucugaaugaacguacu

SEQ ID NO: 1043176 - RNA, 22 nt, Human
gaaugugugacucuauugagca

SEQ ID NO: 1043177 - RNA, 22 nt, Human
guacucucuugaaggccuuucu

SEQ ID NO: 1043178 - RNA, 22 nt, Human
agccagccaguucacuaggaaa

SEQ ID NO: 1043179 - RNA, 22 nt, Human
cugucugucaaguucaucucca

SEQ ID NO: 1043180 - RNA, 22 nt, Human
agccugagagccaagcugugca

SEQ ID NO: 1043181 - RNA, 22 nt, Human
augcaguggcagcuccuggugu

SEQ ID NO: 1043182 - RNA, 22 nt, Human
aggcagcaugcucugcuucuac

SEQ ID NO: 1043183 - RNA, 22 nt, Human
cuggccugcugggugagguccu

SEQ ID NO: 1043184 - RNA, 22 nt, Human
uagaauaugugguaggaucugg

SEQ ID NO: 1043185 - RNA, 22 nt, Human
guccucuggaagaugaguucuu

SEQ ID NO: 1043186 - RNA, 22 nt, Human
ugauuuccaauaaggagaaugu

SEQ ID NO: 1043187 - RNA, 22 nt, Human
caggguggggcuggcuaucaaa

SEQ ID NO: 1043188 - RNA, 22 nt, Human
ugccucugggugaccaaggagc

SEQ ID NO: 1043189 - RNA, 21 nt, Human
auccuugaucagaagagugcu

SEQ ID NO: 1043190 - RNA, 22 nt, Human
cugggcuguucugccccugggu

SEQ ID NO: 1043191 - RNA, 22 nt, Human
agccaacuaggagauuaaggua

SEQ ID NO: 1043192 - RNA, 22 nt, Human
guguggcugauugacaugguca

SEQ ID NO: 1043193 - RNA, 22 nt, Human
ggcacugggcaccggcugaggg

SEQ ID NO: 1043194 - RNA, 20 nt, Human
gggcaguggcgcuaucucag

SEQ ID NO: 1043195 - RNA, 22 nt, Human
uucacauuaucaggauuguuuc

SEQ ID NO: 1043196 - RNA, 22 nt, Human
uaagaacagauaaaguuucccc

SEQ ID NO: 1043197 - RNA, 20 nt, Human
uuccagagaucugcauuuua

SEQ ID NO: 1043198 - RNA, 22 nt, Human
cagagccaacgccaccugccca

SEQ ID NO: 1043199 - RNA, 22 nt, Human
caguaugagaguugaaucaagg

SEQ ID NO: 1043200 - RNA, 22 nt, Human
cuucugggcauucagcugcaca

SEQ ID NO: 1043201 - RNA, 21 nt, Human
ccugagggugguugugaagau

SEQ ID NO: 1043202 - RNA, 22 nt, Human
cccuccagccauggacccaggu

SEQ ID NO: 1043203 - RNA, 23 nt, Human
agcacagacuagaaaggucuuuc

SEQ ID NO: 1043204 - RNA, 22 nt, Human
ccucucuguaagggucccuccc

SEQ ID NO: 1043205 - RNA, 22 nt, Human
ccagcucuuuuggcugagugag

SEQ ID NO: 1043206 - RNA, 22 nt, Human
cagaaauucccauuucagauuc

SEQ ID NO: 1043207 - RNA, 22 nt, Human
aagagguaaccauagcaaccac

SEQ ID NO: 1043208 - RNA, 22 nt, Human
cacagcugcccuacuccaugug

SEQ ID NO: 1043209 - RNA, 22 nt, Human
ugaaaguugcacauaagagaau

SEQ ID NO: 1043210 - RNA, 22 nt, Human
agaguggggaagguguugagaa

SEQ ID NO: 1043211 - RNA, 22 nt, Human
gcaggggcuacucugagcuucc

SEQ ID NO: 1043212 - RNA, 18 nt, Human
aggagccuuugcacugga

SEQ ID NO: 1043213 - RNA, 22 nt, Human
aaaugucuaucuggcauauucc

SEQ ID NO: 1043214 - RNA, 22 nt, Human
cccugggcagucugcacuucag

SEQ ID NO: 1043215 - RNA, 22 nt, Human
agggucugacaaugugacuuag

SEQ ID NO: 1043216 - RNA, 22 nt, Human
agggacuggcucucugagcagg

SEQ ID NO: 1043217 - RNA, 22 nt, Human
gcugaagagagaugcguccagc

SEQ ID NO: 1043218 - RNA, 21 nt, Human
ccuccaggagcagagcccuga

SEQ ID NO: 1043219 - RNA, 22 nt, Human
ugacagggugauuaugagagcu

SEQ ID NO: 1043220 - RNA, 22 nt, Human
cugcuuuggcucagugacauca

SEQ ID NO: 1043221 - RNA, 22 nt, Human
cuggcuggccggaggcaucccu

SEQ ID NO: 1043222 - RNA, 22 nt, Human
agaagccauucccuguaggcuc

SEQ ID NO: 1043223 - RNA, 22 nt, Human
gcucuccaaacccuguggcuuu

SEQ ID NO: 1043224 - RNA, 22 nt, Human
ucauugaacgaagagcuccauu

SEQ ID NO: 1043225 - RNA, 22 nt, Human
agguaaagacagugaaagaggg

SEQ ID NO: 1043226 - RNA, 22 nt, Human
guccugggccugcugaggcuga

SEQ ID NO: 1043227 - RNA, 22 nt, Human
gacuuucucuccucccaggugu

SEQ ID NO: 1043228 - RNA, 22 nt, Human
gcugagggcauguguggcgacu

SEQ ID NO: 1043229 - RNA, 22 nt, Human
uagggcagccuuauagcuccca

SEQ ID NO: 1043230 - RNA, 22 nt, Human
gccauuuagggaggcaagguga

SEQ ID NO: 1043231 - RNA, 22 nt, Human
aaaaauguuaucuacuguccga

SEQ ID NO: 1043232 - RNA, 22 nt, Human
cagcugccuaugaccuagccuc

SEQ ID NO: 1043233 - RNA, 18 nt, Human
cugagggcagccccuggg

SEQ ID NO: 1043234 - RNA, 22 nt, Human
cccagggaaugacucuggccuu

SEQ ID NO: 1043235 - RNA, 22 nt, Human
uuuuaauacugcuauuguagga

SEQ ID NO: 1043236 - RNA, 20 nt, Human
gcccuggagccuuguccugg

SEQ ID NO: 1043237 - RNA, 22 nt, Human
aggucauuguuaagucaccaua

SEQ ID NO: 1043238 - RNA, 22 nt, Human
ucucagagaaaugugucaccau

SEQ ID NO: 1043239 - RNA, 22 nt, Human
gccucugcaauuacauugugcc

SEQ ID NO: 1043240 - RNA, 22 nt, Human
agccuggcccugcugaacucug

SEQ ID NO: 1043241 - RNA, 22 nt, Human
ucaaaguuuguggcaauuuauu

SEQ ID NO: 1043242 - RNA, 22 nt, Human
aaaucaguuaagaugaggccau

SEQ ID NO: 1043243 - RNA, 22 nt, Human
guauucuugguuaucaaaauac

SEQ ID NO: 1043244 - RNA, 20 nt, Human
uccaagggcagcagaaucag

SEQ ID NO: 1043245 - RNA, 22 nt, Human
aucaguuuuuauuaauguagcu

SEQ ID NO: 1043246 - RNA, 22 nt, Human
ucaguuuucucaucugugaaau

SEQ ID NO: 1043247 - RNA, 22 nt, Human
aauuucaaacuaauaggaacca

SEQ ID NO: 1043248 - RNA, 22 nt, Human
aagaggaacugggggcugaguc

SEQ ID NO: 1043249 - RNA, 22 nt, Human
aaggcugauuagacugauagcu

SEQ ID NO: 1043250 - RNA, 20 nt, Human
gacaggagaguuagguaggu

SEQ ID NO: 1043251 - RNA, 22 nt, Human
auaguggugagcugcauuuaug

SEQ ID NO: 1043252 - RNA, 22 nt, Human
gcagcacauauaaacaaagaga

SEQ ID NO: 1043253 - RNA, 22 nt, Human
gaagcagcagcuggggacaguu

SEQ ID NO: 1043254 - RNA, 22 nt, Human
uccuucagaaaaccucagucuu

SEQ ID NO: 1043255 - RNA, 22 nt, Human
aggcagggucuugcuauguugc

SEQ ID NO: 1043256 - RNA, 22 nt, Human
gugccaggugcuaagcugugcu

SEQ ID NO: 1043257 - RNA, 22 nt, Human
gcugucugggaggccuccacuu

SEQ ID NO: 1043258 - RNA, 22 nt, Human
aaguaacaaugcuguugaauug

SEQ ID NO: 1043259 - RNA, 22 nt, Human
ucagagugcagcgggaggcugg

SEQ ID NO: 1043260 - RNA, 22 nt, Human
auacaucuugucagauucaugu

SEQ ID NO: 1043261 - RNA, 18 nt, Human
acauuucuccuucugacc

SEQ ID NO: 1043262 - RNA, 22 nt, Human
gggcuucucccuaaggacucug

SEQ ID NO: 1043263 - RNA, 22 nt, Human
cugccuugaaaaugaagcuuua

SEQ ID NO: 1043264 - RNA, 19 nt, Human
agccuggcuuugcucugcu

SEQ ID NO: 1043265 - RNA, 22 nt, Human
cauuugaugacucaacucauaa

SEQ ID NO: 1043266 - RNA, 22 nt, Human
cucccugguguccccuccagga

SEQ ID NO: 1043267 - RNA, 22 nt, Human
agcacaggaccaaggaagcugu

SEQ ID NO: 1043268 - RNA, 22 nt, Human
guggcagcugguaugcagacag

SEQ ID NO: 1043269 - RNA, 22 nt, Human
gguugccggggcaggacuggaa

SEQ ID NO: 1043270 - RNA, 22 nt, Human
uggcagggaauacagauguuua

SEQ ID NO: 1043271 - RNA, 22 nt, Human
uccugccucuuuucuuauucca

SEQ ID NO: 1043272 - RNA, 22 nt, Human
cuggaagguuccucccagcucc

SEQ ID NO: 1043273 - RNA, 21 nt, Human
caggaaaagcggaagucuagc

SEQ ID NO: 1043274 - RNA, 22 nt, Human
ggccuuggugccauggccaguu

SEQ ID NO: 1043275 - RNA, 18 nt, Human
aaauguacuguccauggc

SEQ ID NO: 1043276 - RNA, 22 nt, Human
uugugcauuucucugagugugu

SEQ ID NO: 1043277 - RNA, 22 nt, Human
ugaugcuucacgcugaauaugc

SEQ ID NO: 1043278 - RNA, 18 nt, Human
ccugccagucuggagcag

SEQ ID NO: 1043279 - RNA, 22 nt, Human
acauuucuccuacuuguuauuu

SEQ ID NO: 1043280 - RNA, 22 nt, Human
ugggcuguccagcaccugggcu

SEQ ID NO: 1043281 - RNA, 22 nt, Human
ccucuggucccagcucugcugc

SEQ ID NO: 1043282 - RNA, 22 nt, Human
auuuccucaugaucauaaugca

SEQ ID NO: 1043283 - RNA, 22 nt, Human
gcuuuauguaaguccaaaggca

SEQ ID NO: 1043284 - RNA, 22 nt, Human
aaguucaagucugcaucuuuuu

SEQ ID NO: 1043285 - RNA, 22 nt, Human
gagggucccgagcccugucaga

SEQ ID NO: 1043286 - RNA, 22 nt, Human
augaagcuaaacccugcagcca

SEQ ID NO: 1043287 - RNA, 22 nt, Human
aaaaugaggucaauauccuuuu

SEQ ID NO: 1043288 - RNA, 22 nt, Human
uccucugcuccaucuuuacugu

SEQ ID NO: 1043289 - RNA, 22 nt, Human
aagaaauauugggccuuauaaa

SEQ ID NO: 1043290 - RNA, 22 nt, Human
uccuucaggguugaggccgacu

SEQ ID NO: 1043291 - RNA, 22 nt, Human
ucccagggacugggcuaggcuu

SEQ ID NO: 1043292 - RNA, 22 nt, Human
ccucuggguaucuguggaagua

SEQ ID NO: 1043293 - RNA, 22 nt, Human
agggguggagaguguugccagu

SEQ ID NO: 1043294 - RNA, 22 nt, Human
agguacaguagacagacaguua

SEQ ID NO: 1043295 - RNA, 22 nt, Human
cacaggcuccggccuugcagcc

SEQ ID NO: 1043296 - RNA, 22 nt, Human
cugaggcuggggaagggaagug

SEQ ID NO: 1043297 - RNA, 22 nt, Human
cugccuggggaaugugaggauu

SEQ ID NO: 1043298 - RNA, 22 nt, Human
gcagccacccucaaggcugaau

SEQ ID NO: 1043299 - RNA, 22 nt, Human
cagccugggcuccagagucccu

SEQ ID NO: 1043300 - RNA, 22 nt, Human
ugacuuccugcacucaggugau

SEQ ID NO: 1043301 - RNA, 22 nt, Human
ccagucacuggaaaaugggaau

SEQ ID NO: 1043302 - RNA, 22 nt, Human
gagucacaaagccuuucuuauu

SEQ ID NO: 1043303 - RNA, 22 nt, Human
uggagggcaugcuguccauggg

SEQ ID NO: 1043304 - RNA, 22 nt, Human
aauguacaaaagucagccaacu

SEQ ID NO: 1043305 - RNA, 22 nt, Human
uugaaggacauccuauuucuag

SEQ ID NO: 1043306 - RNA, 22 nt, Human
ugggccugacucaccugccucc

SEQ ID NO: 1043307 - RNA, 22 nt, Human
caucagcagucacaugaugcug

SEQ ID NO: 1043308 - RNA, 22 nt, Human
ggcucaggagaggggcuaaaag

SEQ ID NO: 1043309 - RNA, 22 nt, Human
uacaugcaugucacagaaugaa

SEQ ID NO: 1043310 - RNA, 22 nt, Human
gacagccaugcacuucugcugu

SEQ ID NO: 1043311 - RNA, 22 nt, Human
ccuggagcacucucccuggcug

SEQ ID NO: 1043312 - RNA, 22 nt, Human
ugcuauugugaacagugccaca

SEQ ID NO: 1043313 - RNA, 22 nt, Human
uagagaaaagcagggaucagga

SEQ ID NO: 1043314 - RNA, 22 nt, Human
gggagcugagcuggaagagaau

SEQ ID NO: 1043315 - RNA, 22 nt, Human
aacagcuuugcuucuggagaca

SEQ ID NO: 1043316 - RNA, 22 nt, Human
ucccagccggugccuggguccc

SEQ ID NO: 1043317 - RNA, 22 nt, Human
caggguuucaccauguuagcag

SEQ ID NO: 1043318 - RNA, 22 nt, Human
cugggaggauucauugagguga

SEQ ID NO: 1043319 - RNA, 22 nt, Human
auggggugaccaugagcauuua

SEQ ID NO: 1043320 - RNA, 22 nt, Human
gaggcugcaggcaaugcugccc

SEQ ID NO: 1043321 - RNA, 22 nt, Human
aucaguuuguauaugaaacacu

SEQ ID NO: 1043322 - RNA, 22 nt, Human
aagggacuuugucagcuuucca

SEQ ID NO: 1043323 - RNA, 22 nt, Human
agaaaucauucccaaacccaua

SEQ ID NO: 1043324 - RNA, 22 nt, Human
uguacauugucacucaucaagu

SEQ ID NO: 1043325 - RNA, 22 nt, Human
aaaugcacaaaguaaguguaau

SEQ ID NO: 1043326 - RNA, 22 nt, Human
cuggagccgcauggagcaggga

SEQ ID NO: 1043327 - RNA, 22 nt, Human
cugauuccugauucaugcucuu

SEQ ID NO: 1043328 - RNA, 20 nt, Human
uggagccaaggugugucugg

SEQ ID NO: 1043329 - RNA, 22 nt, Human
auugaaagcauggauuuggauu

SEQ ID NO: 1043330 - RNA, 21 nt, Human
gcugagagguugggaaguuca

SEQ ID NO: 1043331 - RNA, 22 nt, Human
uggguagaggaauugggcuacc

SEQ ID NO: 1043332 - RNA, 22 nt, Human
cuggccugagcacagcggcugc

SEQ ID NO: 1043333 - RNA, 22 nt, Human
caguggucugugcuucuguaca

SEQ ID NO: 1043334 - RNA, 19 nt, Human
uggcugggugccaauggcc

SEQ ID NO: 1043335 - RNA, 22 nt, Human
gagcugccaguguaugaauucu

SEQ ID NO: 1043336 - RNA, 22 nt, Human
cucaggauuuaaaggggcacuc

SEQ ID NO: 1043337 - RNA, 22 nt, Human
aagagguugucugugaugaguu

SEQ ID NO: 1043338 - RNA, 22 nt, Human
caaggagaguaauugaaugaga

SEQ ID NO: 1043339 - RNA, 22 nt, Human
guauuuucaagagcaguaguau

SEQ ID NO: 1043340 - RNA, 22 nt, Human
gcuuccugagaaacaaucugau

SEQ ID NO: 1043341 - RNA, 19 nt, Human
agcuccugggcucugggcc

SEQ ID NO: 1043342 - RNA, 22 nt, Human
agcacuuuccuggcaaaugugg

SEQ ID NO: 1043343 - RNA, 22 nt, Human
ugagcuguagcagaugcuguug

SEQ ID NO: 1043344 - RNA, 22 nt, Human
uguauguguauguacauaugca

SEQ ID NO: 1043345 - RNA, 22 nt, Human
acaaaugcaaguuuuaugucaa

SEQ ID NO: 1043346 - RNA, 22 nt, Human
ggagggugcauuuuacccugug

SEQ ID NO: 1043347 - RNA, 22 nt, Human
gccaggcuggugucacaacucu

SEQ ID NO: 1043348 - RNA, 22 nt, Human
ugucugucugcaagccagaaag

SEQ ID NO: 1043349 - RNA, 22 nt, Human
ucucuucugaaaccugucuuua

SEQ ID NO: 1043350 - RNA, 22 nt, Human
ggugucccaggccagcugugug

SEQ ID NO: 1043351 - RNA, 22 nt, Human
aacagcaauagcacuauucauu

SEQ ID NO: 1043352 - RNA, 22 nt, Human
accugagaaugggggcaugugu

SEQ ID NO: 1043353 - RNA, 22 nt, Human
uggucaggcugcucugcggcgu

SEQ ID NO: 1043354 - RNA, 18 nt, Human
ugagagugugugcucuug

SEQ ID NO: 1043355 - RNA, 22 nt, Human
gcugagagcaguguggccuuaa

SEQ ID NO: 1043356 - RNA, 22 nt, Human
uggcccugucccuggagccugg

SEQ ID NO: 1043357 - RNA, 23 nt, Human
agggcccaagccuggacagcagg

SEQ ID NO: 1043358 - RNA, 17 nt, Human
uucucuuccuggauagu

SEQ ID NO: 1043359 - RNA, 22 nt, Human
caaaguccuagaacagugcuug

SEQ ID NO: 1043360 - RNA, 22 nt, Human
cacagugcaugaugggcagaag

SEQ ID NO: 1043361 - RNA, 22 nt, Human
cuagaaaaauacuuuauuguga

SEQ ID NO: 1043362 - RNA, 19 nt, Human
caaggguugggucugucau

SEQ ID NO: 1043363 - RNA, 22 nt, Human
agcugccauccgaggugucaga

SEQ ID NO: 1043364 - RNA, 22 nt, Human
cacaggagcuguggggcagugu

SEQ ID NO: 1043365 - RNA, 22 nt, Human
ggcuggcucagggcuugagaga

SEQ ID NO: 1043366 - RNA, 22 nt, Human
ugccugucagggggagugggaa

SEQ ID NO: 1043367 - RNA, 22 nt, Human
gcugcccugucugcagcaggac

SEQ ID NO: 1043368 - RNA, 22 nt, Human
ggugccaggcucccagcucagg

SEQ ID NO: 1043369 - RNA, 22 nt, Human
acuguguccuauuuccuugaca

SEQ ID NO: 1043370 - RNA, 22 nt, Human
uucaaagugcauguuccucaga

SEQ ID NO: 1043371 - RNA, 22 nt, Human
cccagcagccagaaugaggagc

SEQ ID NO: 1043372 - RNA, 22 nt, Human
ggucccagaauugguuagcaca

SEQ ID NO: 1043373 - RNA, 22 nt, Human
agcagggggccacagucacagc

SEQ ID NO: 1043374 - RNA, 22 nt, Human
ugucccucauugacgcugugcc

SEQ ID NO: 1043375 - RNA, 22 nt, Human
ugaaaguuacaggaaaacagau

SEQ ID NO: 1043376 - RNA, 22 nt, Human
acaaggcugaacagugaagccg

SEQ ID NO: 1043377 - RNA, 22 nt, Human
agucccagcucugccacuuacu

SEQ ID NO: 1043378 - RNA, 22 nt, Human
cagugccaugucugagccccua

SEQ ID NO: 1043379 - RNA, 19 nt, Human
gggcagaauggcaucucag

SEQ ID NO: 1043380 - RNA, 22 nt, Human
aggggcuggcuuaucugagagu

SEQ ID NO: 1043381 - RNA, 22 nt, Human
gggugggaacaggaugccagga

SEQ ID NO: 1043382 - RNA, 22 nt, Human
aggcuggguaccugucauaugc

SEQ ID NO: 1043383 - RNA, 22 nt, Human
guggguggaucaccugagguca

SEQ ID NO: 1043384 - RNA, 22 nt, Human
gggucuggcaugcugagaugga

SEQ ID NO: 1043385 - RNA, 22 nt, Human
ugccagaagugcuuuauaagug

SEQ ID NO: 1043386 - RNA, 22 nt, Human
uacaaaguuuucuuggauugag

SEQ ID NO: 1043387 - RNA, 22 nt, Human
gccagagcugagugagguucuu

SEQ ID NO: 1043388 - RNA, 22 nt, Human
auaagguaugaaaaguaaaugg

SEQ ID NO: 1043389 - RNA, 22 nt, Human
cagcagugaugugugaggguuc

SEQ ID NO: 1043390 - RNA, 22 nt, Human
ccgggcgggggcucucgucacc

SEQ ID NO: 1043391 - RNA, 22 nt, Human
uggcucaguuucugcccagcug

SEQ ID NO: 1043392 - RNA, 22 nt, Human
aaaugcagauugucauucagga

SEQ ID NO: 1043393 - RNA, 22 nt, Human
agucucugcaugccugcugugc

SEQ ID NO: 1043394 - RNA, 22 nt, Human
ggccacuccgcugcuacuggaa

SEQ ID NO: 1043395 - RNA, 20 nt, Human
cguaaggcaagugcugcauc

SEQ ID NO: 1043396 - RNA, 22 nt, Human
accugaggcuguuagucuaggu

SEQ ID NO: 1043397 - RNA, 22 nt, Human
cccagccuuugcuuccugguuc

SEQ ID NO: 1043398 - RNA, 22 nt, Human
ugccuggcaaugccagaagcca

SEQ ID NO: 1043399 - RNA, 22 nt, Human
cugugggcugaaagugcucccg

SEQ ID NO: 1043400 - RNA, 22 nt, Human
ucagugucuugaccugggugug

SEQ ID NO: 1043401 - RNA, 22 nt, Human
agccccaguaagggagggccug

SEQ ID NO: 1043402 - RNA, 22 nt, Human
auaucuuuuagagcaagcuugu

SEQ ID NO: 1043403 - RNA, 22 nt, Human
agacuuugagcucuuagagaag

SEQ ID NO: 1043404 - RNA, 22 nt, Human
ugggagcugggguuggacgucu

SEQ ID NO: 1043405 - RNA, 22 nt, Human
caaagaugcugauguuggauca

SEQ ID NO: 1043406 - RNA, 22 nt, Human
gccuggagagcacugugcgcuu

SEQ ID NO: 1043407 - RNA, 22 nt, Human
aguauguauuuuauacuuacag

SEQ ID NO: 1043408 - RNA, 22 nt, Human
ccagaggcauguucaaagcaau

SEQ ID NO: 1043409 - RNA, 22 nt, Human
acuuucuaggucucaguccuuu

SEQ ID NO: 1043410 - RNA, 23 nt, Human
ccagcuccgugagccucgggcuc

SEQ ID NO: 1043411 - RNA, 22 nt, Human
uacacuuuuuacuacagauucu

SEQ ID NO: 1043412 - RNA, 22 nt, Human
uaggggugaggccaggcaucag

SEQ ID NO: 1043413 - RNA, 22 nt, Human
gagagcuggguucaaguagcug

SEQ ID NO: 1043414 - RNA, 22 nt, Human
aauuaacagagggcuuauuacu

SEQ ID NO: 1043415 - RNA, 22 nt, Human
uaacagaaauaguaggugaggg

SEQ ID NO: 1043416 - RNA, 23 nt, Human
ucugggcaccuuguugacaugau

SEQ ID NO: 1043417 - RNA, 22 nt, Human
aagaagaugguuaacuuucagu

SEQ ID NO: 1043418 - RNA, 22 nt, Human
agagaacaaauuaaaggugguu

SEQ ID NO: 1043419 - RNA, 20 nt, Human
ggucccugcccucugucauc

SEQ ID NO: 1043420 - RNA, 20 nt, Human
gccuguccugagugucaugg

SEQ ID NO: 1043421 - RNA, 22 nt, Human
gagagcugucagcguagcaccg

SEQ ID NO: 1043422 - RNA, 22 nt, Human
aacaucuuuuuguuugcugaaa

SEQ ID NO: 1043423 - RNA, 22 nt, Human
uaaaugugagugaugcggugaa

SEQ ID NO: 1043424 - RNA, 22 nt, Human
uguguauucagcaagcgaaaca

SEQ ID NO: 1043425 - RNA, 22 nt, Human
acaggugggcuuaagagucggc

SEQ ID NO: 1043426 - RNA, 22 nt, Human
guggccugggguuuguucugag

SEQ ID NO: 1043427 - RNA, 20 nt, Human
gcugcucuccacggucugca

SEQ ID NO: 1043428 - RNA, 22 nt, Human
aagagcuggaagugaagauaac

SEQ ID NO: 1043429 - RNA, 22 nt, Human
uaugcauagguaucuauacuca

SEQ ID NO: 1043430 - RNA, 22 nt, Human
gcuggccacauugugccguccu

SEQ ID NO: 1043431 - RNA, 22 nt, Human
gagacagcagggccagggccug

SEQ ID NO: 1043432 - RNA, 22 nt, Human
ucauacauaacuuguacaguga

SEQ ID NO: 1043433 - RNA, 22 nt, Human
ugucaccaugccagcuucugcc

SEQ ID NO: 1043434 - RNA, 22 nt, Human
augugugccccuuuuacucuuu

SEQ ID NO: 1043435 - RNA, 22 nt, Human
ugcccaggguggagugcagcgg

SEQ ID NO: 1043436 - RNA, 22 nt, Human
gcuggccaggugcuuugguucu

SEQ ID NO: 1043437 - RNA, 22 nt, Human
ggcuucugaaaucucugugcgu

SEQ ID NO: 1043438 - RNA, 22 nt, Human
acagccagaggagccaggcugg

SEQ ID NO: 1043439 - RNA, 22 nt, Human
gggugcaggcagcccaggcagg

SEQ ID NO: 1043440 - RNA, 22 nt, Human
ugagcuucaaaauaugugaauc

SEQ ID NO: 1043441 - RNA, 22 nt, Human
cuugucugugucggauaaaacu

SEQ ID NO: 1043442 - RNA, 22 nt, Human
ucuggagcaacagagcaggaca

SEQ ID NO: 1043443 - RNA, 22 nt, Human
ugcuggcccaugaagacgcagu

SEQ ID NO: 1043444 - RNA, 22 nt, Human
aguucuuuugugaacauaugcu

SEQ ID NO: 1043445 - RNA, 22 nt, Human
caggagcucucaucgucagggc

SEQ ID NO: 1043446 - RNA, 22 nt, Human
ggcuucugguaaagaccacacc

SEQ ID NO: 1043447 - RNA, 22 nt, Human
ggcccuguccuggcugucuccg

SEQ ID NO: 1043448 - RNA, 22 nt, Human
gugccugcugcagagucgcugu

SEQ ID NO: 1043449 - RNA, 22 nt, Human
ccccagcugcauacuugccaag

SEQ ID NO: 1043450 - RNA, 22 nt, Human
uccacagaauguaagauccaca

SEQ ID NO: 1043451 - RNA, 22 nt, Human
cagaggcugaugugggaugggc

SEQ ID NO: 1043452 - RNA, 22 nt, Human
agcucccugagaugccacagca

SEQ ID NO: 1043453 - RNA, 22 nt, Human
gagggguguggagccaucaguu

SEQ ID NO: 1043454 - RNA, 22 nt, Human
gccuuugccugcgacguggcug

SEQ ID NO: 1043455 - RNA, 22 nt, Human
cagcaguggaacuacccaggga

SEQ ID NO: 1043456 - RNA, 22 nt, Human
cagccugcagggcugccuguug

SEQ ID NO: 1043457 - RNA, 22 nt, Human
aggagagagcugagcuuugcug

SEQ ID NO: 1043458 - RNA, 22 nt, Human
cagaaaaccugacucuagaacu

SEQ ID NO: 1043459 - RNA, 22 nt, Human
gcccccucuuuggagccagcca

SEQ ID NO: 1043460 - RNA, 17 nt, Human
agguggcugcugcgccu

SEQ ID NO: 1043461 - RNA, 22 nt, Human
ucucuggaguauaaccagggau

SEQ ID NO: 1043462 - RNA, 21 nt, Human
ccacaggggcuccccugucag

SEQ ID NO: 1043463 - RNA, 22 nt, Human
ugagccugaguucaaggcugca

SEQ ID NO: 1043464 - RNA, 22 nt, Human
acacugaauauacaaugaauau

SEQ ID NO: 1043465 - RNA, 19 nt, Human
gcacugaagaguuggucac

SEQ ID NO: 1043466 - RNA, 22 nt, Human
ugaaagcucugucaucauuccu

SEQ ID NO: 1043467 - RNA, 22 nt, Human
uggagcccagggugagaaggag

SEQ ID NO: 1043468 - RNA, 22 nt, Human
ccugagccugaguggugcaggg

SEQ ID NO: 1043469 - RNA, 22 nt, Human
ggaguucacugugcaggcucug

SEQ ID NO: 1043470 - RNA, 22 nt, Human
uaaaugcaaugugcuuuaccag

SEQ ID NO: 1043471 - RNA, 19 nt, Human
cagaguccuugaccagucc

SEQ ID NO: 1043472 - RNA, 20 nt, Human
ugacucugcaaccgucucuc

SEQ ID NO: 1043473 - RNA, 22 nt, Human
gggacuggaguagaggccggug

SEQ ID NO: 1043474 - RNA, 22 nt, Human
uaucuauuccaaauaucagcgu

SEQ ID NO: 1043475 - RNA, 22 nt, Human
ugaggggagaagcagcagccug

SEQ ID NO: 1043476 - RNA, 21 nt, Human
gcagacugcccugcugucccc

SEQ ID NO: 1043477 - RNA, 22 nt, Human
gaaaugcagauucugauucugu

SEQ ID NO: 1043478 - RNA, 20 nt, Human
agagaauucccuuuggagau

SEQ ID NO: 1043479 - RNA, 22 nt, Human
agcagccaauuggaggaugaag

SEQ ID NO: 1043480 - RNA, 22 nt, Human
gcagcugaauguccauugcugc

SEQ ID NO: 1043481 - RNA, 22 nt, Human
uggacucagugcugccauuccc

SEQ ID NO: 1043482 - RNA, 22 nt, Human
ucagggcauacucuucaagguc

SEQ ID NO: 1043483 - RNA, 23 nt, Human
uccuccuuuugcuugugcuuccc

SEQ ID NO: 1043484 - RNA, 20 nt, Human
aaaauauguauaacucuucu

SEQ ID NO: 1043485 - RNA, 22 nt, Human
agaaaguucugugaguuguuca

SEQ ID NO: 1043486 - RNA, 20 nt, Human
uccugggguaagccaugguc

SEQ ID NO: 1043487 - RNA, 22 nt, Human
acaugcaugucuaugggcaggu

SEQ ID NO: 1043488 - RNA, 22 nt, Human
uccugagauaaaucucauguga

SEQ ID NO: 1043489 - RNA, 22 nt, Human
agaagcugacagaugcagcagg

SEQ ID NO: 1043490 - RNA, 22 nt, Human
cauggcagaaaccugagcugcu

SEQ ID NO: 1043491 - RNA, 22 nt, Human
caggaggccaacugugggacuu

SEQ ID NO: 1043492 - RNA, 22 nt, Human
gccugagagacccauggggcaa

SEQ ID NO: 1043493 - RNA, 22 nt, Human
cucaggauugugccuagggaga

SEQ ID NO: 1043494 - RNA, 22 nt, Human
uguggcuguguccaccugcugc

SEQ ID NO: 1043495 - RNA, 22 nt, Human
acauugaugaaaagguaucauu

SEQ ID NO: 1043496 - RNA, 19 nt, Human
aggguccagggagcggcuc

SEQ ID NO: 1043497 - RNA, 22 nt, Human
gggagggacacaaagaguuccc

SEQ ID NO: 1043498 - RNA, 22 nt, Human
gugugccaggaacuggcugcug

SEQ ID NO: 1043499 - RNA, 22 nt, Human
agcaggcuuucaagagucuucu

SEQ ID NO: 1043500 - RNA, 21 nt, Human
ucagaacaauuccaugccucc

SEQ ID NO: 1043501 - RNA, 22 nt, Human
gcugucaggaacaugccuuggu

SEQ ID NO: 1043502 - RNA, 22 nt, Human
uuugggcaguagauguaucacu

SEQ ID NO: 1043503 - RNA, 22 nt, Human
ccccagccuuccaugggaauug

SEQ ID NO: 1043504 - RNA, 22 nt, Human
ucaaggaggugcuuggcuucac

SEQ ID NO: 1043505 - RNA, 22 nt, Human
uaaaugcaguacaaauuguucu

SEQ ID NO: 1043506 - RNA, 22 nt, Human
auaauuuacuaagcucuaccuu

SEQ ID NO: 1043507 - RNA, 22 nt, Human
ucuggcucucucaucacccaau

SEQ ID NO: 1043508 - RNA, 22 nt, Human
cuggggcucacuuuggucaggc

SEQ ID NO: 1043509 - RNA, 22 nt, Human
ccacugaaggucaacauagagc

SEQ ID NO: 1043510 - RNA, 22 nt, Human
acugaaggaagcgggcaggggu

SEQ ID NO: 1043511 - RNA, 22 nt, Human
ggcucugggucuguggggagcg

SEQ ID NO: 1043512 - RNA, 22 nt, Human
agcugcuccuuuccugcaggcg

SEQ ID NO: 1043513 - RNA, 22 nt, Human
gggcucugggaugcucuuagag

SEQ ID NO: 1043514 - RNA, 22 nt, Human
ugguuugcccacucgagugauu

SEQ ID NO: 1043515 - RNA, 22 nt, Human
aaagauuugaaauuaggcauca

SEQ ID NO: 1043516 - RNA, 22 nt, Human
uuuuaaucaugcuucuaugucc

SEQ ID NO: 1043517 - RNA, 22 nt, Human
cagcugaacauguagagcaucu

SEQ ID NO: 1043518 - RNA, 22 nt, Human
gagauguacaauguguauuaau

SEQ ID NO: 1043519 - RNA, 22 nt, Human
aauggcugggaguguauuuugg

SEQ ID NO: 1043520 - RNA, 22 nt, Human
uggccagguugggcuuugcagc

SEQ ID NO: 1043521 - RNA, 22 nt, Human
aaagauuuaagaauaauuugug

SEQ ID NO: 1043522 - RNA, 22 nt, Human
aggcuucuacguggucccaggg

SEQ ID NO: 1043523 - RNA, 22 nt, Human
agccaggggauucaucagggac

SEQ ID NO: 1043524 - RNA, 23 nt, Human
gcagacagagcagacuaagacaa

SEQ ID NO: 1043525 - RNA, 22 nt, Human
ucuuuacacaagacaagaauaa

SEQ ID NO: 1043526 - RNA, 22 nt, Human
uggcugcuuguuuuagugaggc

SEQ ID NO: 1043527 - RNA, 22 nt, Human
gcagggccagguacaagaagca

SEQ ID NO: 1043528 - RNA, 22 nt, Human
ucugccuggaugauggcagggc

SEQ ID NO: 1043529 - RNA, 22 nt, Human
aaacaugagcaucucuucaagc

SEQ ID NO: 1043530 - RNA, 22 nt, Human
cugggcugcgggcgccccucca

SEQ ID NO: 1043531 - RNA, 22 nt, Human
cacuguguaagaagaugggcuu

SEQ ID NO: 1043532 - RNA, 22 nt, Human
aaauauguaagauuagcacuag

SEQ ID NO: 1043533 - RNA, 22 nt, Human
cuggagccuucaccaggggaaa

SEQ ID NO: 1043534 - RNA, 22 nt, Human
cagcccagcagggucuggcccu

SEQ ID NO: 1043535 - RNA, 22 nt, Human
agggaugguggagguugcaagu

SEQ ID NO: 1043536 - RNA, 22 nt, Human
ugaggcaguucuuacuuguauu

SEQ ID NO: 1043537 - RNA, 22 nt, Human
uccucuggggcgugguccugga

SEQ ID NO: 1043538 - RNA, 20 nt, Human
acagaaagagagaaugucag

SEQ ID NO: 1043539 - RNA, 22 nt, Human
ucaacacucuuuggcacaguua

SEQ ID NO: 1043540 - RNA, 22 nt, Human
ccaggcugugguuuagauagag

SEQ ID NO: 1043541 - RNA, 22 nt, Human
ucccagcccagauuugugugac

SEQ ID NO: 1043542 - RNA, 22 nt, Human
caggcacugugcaagggucucg

SEQ ID NO: 1043543 - RNA, 22 nt, Human
ugcaccugagaggucucugagg

SEQ ID NO: 1043544 - RNA, 22 nt, Human
ugggaugggaucucgcuguguc

SEQ ID NO: 1043545 - RNA, 22 nt, Human
uggccugacugucaggcuguau

SEQ ID NO: 1043546 - RNA, 22 nt, Human
acauuucuaguuguucaucucc

SEQ ID NO: 1043547 - RNA, 22 nt, Human
gaaugcacacgugugugcaugc

SEQ ID NO: 1043548 - RNA, 22 nt, Human
gcagcagaguuugggagauggu

SEQ ID NO: 1043549 - RNA, 22 nt, Human
uugugucccccuuugagagcca

SEQ ID NO: 1043550 - RNA, 22 nt, Human
gcagagccaggagagacccuug

SEQ ID NO: 1043551 - RNA, 22 nt, Human
gcagagcuucuguccuucagga

SEQ ID NO: 1043552 - RNA, 22 nt, Human
caauaugcaagcuauuaaguau

SEQ ID NO: 1043553 - RNA, 22 nt, Human
acuuugugcccaacagaaagaa

SEQ ID NO: 1043554 - RNA, 22 nt, Human
ucaggcugagaaaaucuggacc

SEQ ID NO: 1043555 - RNA, 22 nt, Human
cugggcuguaauguggcacuga

SEQ ID NO: 1043556 - RNA, 22 nt, Human
cagagcugauuggauccagaga

SEQ ID NO: 1043557 - RNA, 22 nt, Human
uaaaugugucuauggacccgcc

SEQ ID NO: 1043558 - RNA, 22 nt, Human
gaagcagccacggggagacaga

SEQ ID NO: 1043559 - RNA, 22 nt, Human
uauuuugacuauuaaaccaaca

SEQ ID NO: 1043560 - RNA, 22 nt, Human
agugucugaaccaccggggcau

SEQ ID NO: 1043561 - RNA, 23 nt, Human
ucagcugcuuccuccugccugcc

SEQ ID NO: 1043562 - RNA, 22 nt, Human
cccuccccacaaagcuucacac

SEQ ID NO: 1043563 - RNA, 22 nt, Human
ggagagcagggaggcugcucug

SEQ ID NO: 1043564 - RNA, 22 nt, Human
gccagcuggagugagagugggc

SEQ ID NO: 1043565 - RNA, 19 nt, Human
agccagggugagaaggagc

SEQ ID NO: 1043566 - RNA, 22 nt, Human
ggguguccugugccaagcuggg

SEQ ID NO: 1043567 - RNA, 22 nt, Human
uccagggaagagcagaggcuac

SEQ ID NO: 1043568 - RNA, 22 nt, Human
cccuggaggaccccaauguggc

SEQ ID NO: 1043569 - RNA, 22 nt, Human
uugaagcagcucaggaggcuua

SEQ ID NO: 1043570 - RNA, 22 nt, Human
uuucacaucagagguagauuag

SEQ ID NO: 1043571 - RNA, 22 nt, Human
agaaacuucagcuauucuuuug

SEQ ID NO: 1043572 - RNA, 22 nt, Human
uaaagguagugugacauauugu

SEQ ID NO: 1043573 - RNA, 22 nt, Human
ccucagggucugaggagaccgu

SEQ ID NO: 1043574 - RNA, 18 nt, Human
acccucuggcuucugagc

SEQ ID NO: 1043575 - RNA, 22 nt, Human
gcagugcuaaguagcuggccca

SEQ ID NO: 1043576 - RNA, 22 nt, Human
ccaccagcagugugcaaggauu

SEQ ID NO: 1043577 - RNA, 22 nt, Human
agcugagcacauucaaacaggu

SEQ ID NO: 1043578 - RNA, 20 nt, Human
aagggcagagggaacagacu

SEQ ID NO: 1043579 - RNA, 22 nt, Human
agcagcugagaugguaagauuc

SEQ ID NO: 1043580 - RNA, 22 nt, Human
aagacagaccacgugacagggc

SEQ ID NO: 1043581 - RNA, 22 nt, Human
ggcucaggcuggagugcagugg

SEQ ID NO: 1043582 - RNA, 22 nt, Human
gacaaaggaucagagguuggga

SEQ ID NO: 1043583 - RNA, 22 nt, Human
uauuggugggggcagagagaga

SEQ ID NO: 1043584 - RNA, 22 nt, Human
ggagccaggggaccuucacaga

SEQ ID NO: 1043585 - RNA, 18 nt, Human
agcugcagaccaggaggu

SEQ ID NO: 1043586 - RNA, 22 nt, Human
gugcuuucugcaugguuccuac

SEQ ID NO: 1043587 - RNA, 22 nt, Human
gcugccucccccauggcuggaa

SEQ ID NO: 1043588 - RNA, 21 nt, Human
agaugcugugcuccaggagca

SEQ ID NO: 1043589 - RNA, 23 nt, Human
gcagagcugcccuauugccuugg

SEQ ID NO: 1043590 - RNA, 22 nt, Human
auggggcuguucucugcccugc

SEQ ID NO: 1043591 - RNA, 22 nt, Human
uggggguguccuggugcacaca

SEQ ID NO: 1043592 - RNA, 15 nt, Human
aggcacugugggacc

SEQ ID NO: 1043593 - RNA, 22 nt, Human
agagcugaauuuggguggugga

SEQ ID NO: 1043594 - RNA, 22 nt, Human
uguacaauagcuauuaucucca

SEQ ID NO: 1043595 - RNA, 22 nt, Human
uggcucagccauucguguugcc

SEQ ID NO: 1043596 - RNA, 19 nt, Human
agugaaauggaguauucaa

SEQ ID NO: 1043597 - RNA, 22 nt, Human
ugcuggcccaguauggacugca

SEQ ID NO: 1043598 - RNA, 22 nt, Human
aaacuguaaacacagcaguaca

SEQ ID NO: 1043599 - RNA, 22 nt, Human
ugugggcucccccucacucugu

SEQ ID NO: 1043600 - RNA, 22 nt, Human
uugcauguguaauuuuucuaaa

SEQ ID NO: 1043601 - RNA, 22 nt, Human
cucaggauccaucuccugcccu

SEQ ID NO: 1043602 - RNA, 19 nt, Human
ccagcagcuuugauucucu

SEQ ID NO: 1043603 - RNA, 18 nt, Human
augggaggggccaagaga

SEQ ID NO: 1043604 - RNA, 22 nt, Human
ugggcuggcugaggcauucacu

SEQ ID NO: 1043605 - RNA, 22 nt, Human
aaaucugggucaagguggagug

SEQ ID NO: 1043606 - RNA, 22 nt, Human
uuuuugaaggcugaugugauua

SEQ ID NO: 1043607 - RNA, 22 nt, Human
gaaggaagucauuagugcagac

SEQ ID NO: 1043608 - RNA, 22 nt, Human
aggccucacucucagagcuucu

SEQ ID NO: 1043609 - RNA, 22 nt, Human
cagcaggggaacugugggccag

SEQ ID NO: 1043610 - RNA, 22 nt, Human
cccagagccucauucuguuggg

SEQ ID NO: 1043611 - RNA, 22 nt, Human
gcuucauuacugacagucugug

SEQ ID NO: 1043612 - RNA, 22 nt, Human
aaaaaguuucaacugccaacuc

SEQ ID NO: 1043613 - RNA, 22 nt, Human
ggcaccuggagguuuacuggau

SEQ ID NO: 1043614 - RNA, 22 nt, Human
gcucagggaacuuuuugcaggc

SEQ ID NO: 1043615 - RNA, 22 nt, Human
acauacuaugaauacauguguc

SEQ ID NO: 1043616 - RNA, 22 nt, Human
uucagagccacuucaagucuaa

SEQ ID NO: 1043617 - RNA, 22 nt, Human
gucccagggaugcagacaugag

SEQ ID NO: 1043618 - RNA, 22 nt, Human
gcagagccagaauggccaggac

SEQ ID NO: 1043619 - RNA, 18 nt, Human
cauuguacaaugcuuuau

SEQ ID NO: 1043620 - RNA, 22 nt, Human
aacuucuugguccugagcuguu

SEQ ID NO: 1043621 - RNA, 22 nt, Human
gcugagcuagaaaaggaccaca

SEQ ID NO: 1043622 - RNA, 22 nt, Human
guagcuuauuagggauaauagu

SEQ ID NO: 1043623 - RNA, 22 nt, Human
aaauguguuccuuugcuacaga

SEQ ID NO: 1043624 - RNA, 22 nt, Human
uagcagcuuaaguaauuagaau

SEQ ID NO: 1043625 - RNA, 22 nt, Human
gguggagcuguggacaggaagg

SEQ ID NO: 1043626 - RNA, 22 nt, Human
ucauaauacaaagaguucugca

SEQ ID NO: 1043627 - RNA, 22 nt, Human
uccacugcagcuucugauggaa

SEQ ID NO: 1043628 - RNA, 22 nt, Human
uggcagcuacagacagagguga

SEQ ID NO: 1043629 - RNA, 22 nt, Human
aaggcccuggccccagcuucuu

SEQ ID NO: 1043630 - RNA, 22 nt, Human
aaggccauuauucugauauauu

SEQ ID NO: 1043631 - RNA, 22 nt, Human
ucucuuccaguaagagucuuua

SEQ ID NO: 1043632 - RNA, 22 nt, Human
cugguccuccuugccuucagau

SEQ ID NO: 1043633 - RNA, 22 nt, Human
gccuggugaaaggcagagagcg

SEQ ID NO: 1043634 - RNA, 21 nt, Human
uugaagcaaggguggcucuga

SEQ ID NO: 1043635 - RNA, 22 nt, Human
auacaagacucagcacagacgg

SEQ ID NO: 1043636 - RNA, 22 nt, Human
caccagcuacagacuacugugu

SEQ ID NO: 1043637 - RNA, 22 nt, Human
uguccucuaauuggccucuugc

SEQ ID NO: 1043638 - RNA, 18 nt, Human
caaagcucacguuccauc

SEQ ID NO: 1043639 - RNA, 22 nt, Human
caugcacaaagguaagaugcgu

SEQ ID NO: 1043640 - RNA, 22 nt, Human
ccagucccaggcagaaauccag

SEQ ID NO: 1043641 - RNA, 22 nt, Human
ggcagcacugcagcuuguuggg

SEQ ID NO: 1043642 - RNA, 22 nt, Human
ccagggcugagcugugaccaug

SEQ ID NO: 1043643 - RNA, 22 nt, Human
gcagggcaaugaucccgagagg

SEQ ID NO: 1043644 - RNA, 22 nt, Human
gcccauggacacccaagugcca

SEQ ID NO: 1043645 - RNA, 22 nt, Human
uguguuuugaacucaucuacug

SEQ ID NO: 1043646 - RNA, 22 nt, Human
aaagcucacaguaauacaaggc

SEQ ID NO: 1043647 - RNA, 22 nt, Human
ccugggucacucaggcaggcgg

SEQ ID NO: 1043648 - RNA, 22 nt, Human
uccuugaauugugccacuuacc

SEQ ID NO: 1043649 - RNA, 22 nt, Human
caggugaccuuuguccuaaguu

SEQ ID NO: 1043650 - RNA, 22 nt, Human
ucacagaaauaagauaguuauu

SEQ ID NO: 1043651 - RNA, 22 nt, Human
aaucuggcauguaagcuuagag

SEQ ID NO: 1043652 - RNA, 22 nt, Human
ugcauccuuaaccagcaucacu

SEQ ID NO: 1043653 - RNA, 22 nt, Human
uauuucuuucagguauguguug

SEQ ID NO: 1043654 - RNA, 22 nt, Human
agucccagccuaggcugugcug

SEQ ID NO: 1043655 - RNA, 18 nt, Human
uggagccauugccaccau

SEQ ID NO: 1043656 - RNA, 22 nt, Human
ggguccaggucuucaggcagag

SEQ ID NO: 1043657 - RNA, 22 nt, Human
cuccuuccugccccagugauaa

SEQ ID NO: 1043658 - RNA, 22 nt, Human
aggcugggaaauguauuccagc

SEQ ID NO: 1043659 - RNA, 22 nt, Human
ccugccagucacuaugucaccu

SEQ ID NO: 1043660 - RNA, 22 nt, Human
uacuuacagagcuuauaaguua

SEQ ID NO: 1043661 - RNA, 22 nt, Human
uggcccugcagaacuagccugg

SEQ ID NO: 1043662 - RNA, 22 nt, Human
uuccaguuaaggaagcuauucu

SEQ ID NO: 1043663 - RNA, 22 nt, Human
aagagcugauuaagucaugagg

SEQ ID NO: 1043664 - RNA, 22 nt, Human
gcugcugguccucagagcucau

SEQ ID NO: 1043665 - RNA, 22 nt, Human
ccugugugcacacgaggccaug

SEQ ID NO: 1043666 - RNA, 22 nt, Human
ucacgagaggcacagaauagag

SEQ ID NO: 1043667 - RNA, 17 nt, Human
agcugagcuggccaggg

SEQ ID NO: 1043668 - RNA, 22 nt, Human
ggugcucaagagggcauccucu

SEQ ID NO: 1043669 - RNA, 22 nt, Human
uccuggaggcaaaugaagacuc

SEQ ID NO: 1043670 - RNA, 23 nt, Human
cagaagcaccuguugacugcugc

SEQ ID NO: 1043671 - RNA, 22 nt, Human
gagcccucucuguaggcaagua

SEQ ID NO: 1043672 - RNA, 22 nt, Human
agggaaauuaaugugagcaaug

SEQ ID NO: 1043673 - RNA, 22 nt, Human
caggggcugagaaggaacgucc

SEQ ID NO: 1043674 - RNA, 20 nt, Human
ggcugccuccuuccuuuccu

SEQ ID NO: 1043675 - RNA, 22 nt, Human
ucagagucauugcaaguagaag

SEQ ID NO: 1043676 - RNA, 22 nt, Human
gcaguaaaaaaggauaugugca

SEQ ID NO: 1043677 - RNA, 19 nt, Human
ucuggcuccgccucuuagu

SEQ ID NO: 1043678 - RNA, 22 nt, Human
uuauuauaaugagggauaaaaa

SEQ ID NO: 1043679 - RNA, 22 nt, Human
gcaguggggcgcugggaguugg

SEQ ID NO: 1043680 - RNA, 19 nt, Human
ugccuggcaccagcuccac

SEQ ID NO: 1043681 - RNA, 22 nt, Human
uggcccuguggaggucagugag

SEQ ID NO: 1043682 - RNA, 22 nt, Human
gggugggguucaggaaucuuca

SEQ ID NO: 1043683 - RNA, 22 nt, Human
cagucccaguuugagacucugg

SEQ ID NO: 1043684 - RNA, 22 nt, Human
gagaaagcuucuuucccacagg

SEQ ID NO: 1043685 - RNA, 22 nt, Human
gcagaacauuucacaguaucuu

SEQ ID NO: 1043686 - RNA, 17 nt, Human
ccaggugggaggugggg

SEQ ID NO: 1043687 - RNA, 22 nt, Human
aggugcagcugacaccaugugg

SEQ ID NO: 1043688 - RNA, 20 nt, Human
ggaagcagagaacuguuuuc

SEQ ID NO: 1043689 - RNA, 22 nt, Human
cccagcuccuuacagggccgaa

SEQ ID NO: 1043690 - RNA, 22 nt, Human
caguggcugugaccagggaccu

SEQ ID NO: 1043691 - RNA, 22 nt, Human
cagguggggagaguguggagca

SEQ ID NO: 1043692 - RNA, 22 nt, Human
cacugaagccugggaguaagac

SEQ ID NO: 1043693 - RNA, 18 nt, Human
cccagcccaccauuucuc

SEQ ID NO: 1043694 - RNA, 22 nt, Human
guggcugguuuccugcaugcaa

SEQ ID NO: 1043695 - RNA, 22 nt, Human
acagcagcgucaacuuaaaauu

SEQ ID NO: 1043696 - RNA, 22 nt, Human
aaaugcauugguuucuacuugu

SEQ ID NO: 1043697 - RNA, 22 nt, Human
aggugccaauuuucagugaaca

SEQ ID NO: 1043698 - RNA, 22 nt, Human
aguggcaggcggagauguagga

SEQ ID NO: 1043699 - RNA, 22 nt, Human
agcaggcuuguuaugucugaga

SEQ ID NO: 1043700 - RNA, 22 nt, Human
ggucagguuuuuaggagugacc

SEQ ID NO: 1043701 - RNA, 22 nt, Human
aaucagaaaauucaguggaauu

SEQ ID NO: 1043702 - RNA, 22 nt, Human
ggagccugacagugcccagcau

SEQ ID NO: 1043703 - RNA, 22 nt, Human
gcagagcugucuaagucacuuc

SEQ ID NO: 1043704 - RNA, 22 nt, Human
aauuuggcagugucuugaagua

SEQ ID NO: 1043705 - RNA, 22 nt, Human
aagggcugaaagaccuugggca

SEQ ID NO: 1043706 - RNA, 22 nt, Human
agcuguguguuuccacugagcu

SEQ ID NO: 1043707 - RNA, 22 nt, Human
uaucuguuccaggcacucagcu

SEQ ID NO: 1043708 - RNA, 22 nt, Human
uggcucaggaucuaagcagaau

SEQ ID NO: 1043709 - RNA, 22 nt, Human
uuugcauucuagaaaaauuucu

SEQ ID NO: 1043710 - RNA, 22 nt, Human
gcugucaccaaagcaggcacug

SEQ ID NO: 1043711 - RNA, 22 nt, Human
augggcugugagguccggcagg

SEQ ID NO: 1043712 - RNA, 22 nt, Human
ugcugccagggcucugcccaca

SEQ ID NO: 1043713 - RNA, 22 nt, Human
aggcugaggcagguggaucacu

SEQ ID NO: 1043714 - RNA, 22 nt, Human
ucucaccauggugcuugcuuau

SEQ ID NO: 1043715 - RNA, 22 nt, Human
uuucaauguaacauuuccaggc

SEQ ID NO: 1043716 - RNA, 21 nt, Human
agggccugugcucuccagguc

SEQ ID NO: 1043717 - RNA, 22 nt, Human
uuuuagauugggaaauguaaag

SEQ ID NO: 1043718 - RNA, 22 nt, Human
ccugcucugguuuagucagucu

SEQ ID NO: 1043719 - RNA, 22 nt, Human
gccucugcccauccaccaucag

SEQ ID NO: 1043720 - RNA, 22 nt, Human
cuccucccugcgauugcucugc

SEQ ID NO: 1043721 - RNA, 22 nt, Human
gcucccuguucucagccaugau

SEQ ID NO: 1043722 - RNA, 22 nt, Human
agugggcagcccaggaggucuu

SEQ ID NO: 1043723 - RNA, 22 nt, Human
cccucugaccuccugccacagu

SEQ ID NO: 1043724 - RNA, 22 nt, Human
caggggcucugagauugucuaa

SEQ ID NO: 1043725 - RNA, 22 nt, Human
ggagcugcuuugaucugaagaa

SEQ ID NO: 1043726 - RNA, 22 nt, Human
aggcucaggcaggaauggcgga

SEQ ID NO: 1043727 - RNA, 22 nt, Human
ggcccuguuagagcucccacaa

SEQ ID NO: 1043728 - RNA, 22 nt, Human
cagcucuguaaauuccuucauc

SEQ ID NO: 1043729 - RNA, 22 nt, Human
acagaguacauucagagacuau

SEQ ID NO: 1043730 - RNA, 22 nt, Human
ccagagccuggcaucugcauaa

SEQ ID NO: 1043731 - RNA, 22 nt, Human
aggcugucugaccccagagccc

SEQ ID NO: 1043732 - RNA, 22 nt, Human
ccugucuggccaccagggcgau

SEQ ID NO: 1043733 - RNA, 22 nt, Human
gcuggcccagggucaccuagga

SEQ ID NO: 1043734 - RNA, 22 nt, Human
gagccuggauugaagugggugg

SEQ ID NO: 1043735 - RNA, 22 nt, Human
aacaacugaaaagcuuuuucug

SEQ ID NO: 1043736 - RNA, 22 nt, Human
cauguacaguuuuucuguccug

SEQ ID NO: 1043737 - RNA, 19 nt, Human
uggaggagaggaaaaguca

SEQ ID NO: 1043738 - RNA, 22 nt, Human
cucaaguaagaaacagaauugg

SEQ ID NO: 1043739 - RNA, 22 nt, Human
uuguuacagcagugauuucaga

SEQ ID NO: 1043740 - RNA, 22 nt, Human
cuuggcagauccaaaaaugaca

SEQ ID NO: 1043741 - RNA, 22 nt, Human
aggccagguggucaugcuugcu

SEQ ID NO: 1043742 - RNA, 22 nt, Human
gcugccuugaacuuggccuggg

SEQ ID NO: 1043743 - RNA, 22 nt, Human
ccagcuggcacuguggcugccc

SEQ ID NO: 1043744 - RNA, 22 nt, Human
ucaaagcaucagucaauuuagg

SEQ ID NO: 1043745 - RNA, 22 nt, Human
ggcugccacgucgaggguccaa

SEQ ID NO: 1043746 - RNA, 22 nt, Human
agagugaaaagcuagagcagua

SEQ ID NO: 1043747 - RNA, 22 nt, Human
caagagcucaccggagagcauu

SEQ ID NO: 1043748 - RNA, 22 nt, Human
agaauguagucuuggagauuua

SEQ ID NO: 1043749 - RNA, 22 nt, Human
cuguccccgcgaguccagagcu

SEQ ID NO: 1043750 - RNA, 23 nt, Human
uucuuucaagaaguucacagugc

SEQ ID NO: 1043751 - RNA, 22 nt, Human
ugagcuggucuugaguguagcu

SEQ ID NO: 1043752 - RNA, 22 nt, Human
agcagccacagcagaucugagu

SEQ ID NO: 1043753 - RNA, 22 nt, Human
agucccagugacuuggccagaa

SEQ ID NO: 1043754 - RNA, 22 nt, Human
agaacagaggccuuauguuuca

SEQ ID NO: 1043755 - RNA, 22 nt, Human
uauugaguuacagaaaauacuu

SEQ ID NO: 1043756 - RNA, 22 nt, Human
ucucugguggcuccaucaguag

SEQ ID NO: 1043757 - RNA, 22 nt, Human
ucaggggaaaucucucagcgaa

SEQ ID NO: 1043758 - RNA, 21 nt, Human
guuugcaugaacaagucagcc

SEQ ID NO: 1043759 - RNA, 22 nt, Human
cucugagaggugagaagcagca

SEQ ID NO: 1043760 - RNA, 22 nt, Human
uuucuuccuuaccuuacuagag

SEQ ID NO: 1043761 - RNA, 22 nt, Human
cauuucuguacauguuuuggug

SEQ ID NO: 1043762 - RNA, 22 nt, Human
gcaggcagagagggguuuccag

SEQ ID NO: 1043763 - RNA, 22 nt, Human
agcugucagugcugugccugua

SEQ ID NO: 1043764 - RNA, 22 nt, Human
cuggggcccaucgagggcugag

SEQ ID NO: 1043765 - RNA, 21 nt, Human
acagccugucaucucaugguc

SEQ ID NO: 1043766 - RNA, 22 nt, Human
cccucugccugcgcccuggugu

SEQ ID NO: 1043767 - RNA, 22 nt, Human
uucaaugagcccaagaacguga

SEQ ID NO: 1043768 - RNA, 22 nt, Human
agguggggaggagugucucuuu

SEQ ID NO: 1043769 - RNA, 22 nt, Human
acuggacagaggaaauauggag

SEQ ID NO: 1043770 - RNA, 22 nt, Human
guacuuccguggacuaauuguu

SEQ ID NO: 1043771 - RNA, 21 nt, Human
gggcagaggggccuccugggu

SEQ ID NO: 1043772 - RNA, 22 nt, Human
agggcagcacagcugugcuccu

SEQ ID NO: 1043773 - RNA, 22 nt, Human
aaauugugagcuauagaucuag

SEQ ID NO: 1043774 - RNA, 22 nt, Human
caagaugaaacuacagggagga

SEQ ID NO: 1043775 - RNA, 22 nt, Human
uuccucaucugugcaccucacu

SEQ ID NO: 1043776 - RNA, 22 nt, Human
cugcugagguccuugcucagac

SEQ ID NO: 1043777 - RNA, 22 nt, Human
uaaaugugaccuucauuuuaua

SEQ ID NO: 1043778 - RNA, 22 nt, Human
gugauuccuauuaguacaugca

SEQ ID NO: 1043779 - RNA, 22 nt, Human
aaaauggucucagcuggcacca

SEQ ID NO: 1043780 - RNA, 22 nt, Human
gcacagaaguaaaauacaaguc

SEQ ID NO: 1043781 - RNA, 22 nt, Human
acuuguguaacacagaaagaac

SEQ ID NO: 1043782 - RNA, 22 nt, Human
gcucagaggagcaucauaagga

SEQ ID NO: 1043783 - RNA, 22 nt, Human
ccugccuggagcugagugugga

SEQ ID NO: 1043784 - RNA, 22 nt, Human
uugaaaggccuguuuauccagc

SEQ ID NO: 1043785 - RNA, 22 nt, Human
auuguggugucaguuauaggca

SEQ ID NO: 1043786 - RNA, 19 nt, Human
aguagcagaaagugcagug

SEQ ID NO: 1043787 - RNA, 22 nt, Human
gcugccuggcuuuaguccacuu

SEQ ID NO: 1043788 - RNA, 22 nt, Human
uguguacagcaggauuucucaa

SEQ ID NO: 1043789 - RNA, 22 nt, Human
guccucugaaguugugcaaugc

SEQ ID NO: 1043790 - RNA, 22 nt, Human
gcagccacucucauuccacgug

SEQ ID NO: 1043791 - RNA, 22 nt, Human
gagggcugauaaaugcgcaugg

SEQ ID NO: 1043792 - RNA, 22 nt, Human
ucugaggcuauguucaggcuaa

SEQ ID NO: 1043793 - RNA, 22 nt, Human
gggauggggggaagcguccaug

SEQ ID NO: 1043794 - RNA, 22 nt, Human
gcagagccuugcgucaugugcc

SEQ ID NO: 1043795 - RNA, 22 nt, Human
gcugcagcucgccuuccggccu

SEQ ID NO: 1043796 - RNA, 22 nt, Human
gcugagagugagcacuggauau

SEQ ID NO: 1043797 - RNA, 22 nt, Human
agagauaugaguaguugugaca

SEQ ID NO: 1043798 - RNA, 21 nt, Human
uccucugcagugagguggccu

SEQ ID NO: 1043799 - RNA, 22 nt, Human
aaaaccaggcguuuccuauuau

SEQ ID NO: 1043800 - RNA, 22 nt, Human
cacagggcagguacucucagag

SEQ ID NO: 1043801 - RNA, 20 nt, Human
augccucuaauuuugcaaac

SEQ ID NO: 1043802 - RNA, 23 nt, Human
gcaggugguucgaacagaaguuu

SEQ ID NO: 1043803 - RNA, 22 nt, Human
agucccagaugacccagcuacu

SEQ ID NO: 1043804 - RNA, 22 nt, Human
ugugaaaggagccauagacagu

SEQ ID NO: 1043805 - RNA, 22 nt, Human
ugcaagcacucaaugcaaacag

SEQ ID NO: 1043806 - RNA, 22 nt, Human
agggacagucuacuguucacug

SEQ ID NO: 1043807 - RNA, 22 nt, Human
uuagggcuuuucugaauaggcc

SEQ ID NO: 1043808 - RNA, 22 nt, Human
cuuuauguccuugaagaguugu

SEQ ID NO: 1043809 - RNA, 22 nt, Human
uucuugauuucaugcaguuaag

SEQ ID NO: 1043810 - RNA, 22 nt, Human
guaacugaggcagcuuuuaaga

SEQ ID NO: 1043811 - RNA, 22 nt, Human
acuuccuggcguagcugacauu

SEQ ID NO: 1043812 - RNA, 22 nt, Human
ugcccaagcagaggagugauuc

SEQ ID NO: 1043813 - RNA, 18 nt, Human
gcuggcugcacuucugcu

SEQ ID NO: 1043814 - RNA, 22 nt, Human
accccaagacaguagaagagaa

SEQ ID NO: 1043815 - RNA, 22 nt, Human
ucucuuuuauguacacccugac

SEQ ID NO: 1043816 - RNA, 19 nt, Human
uagucuuuauucuuaauuu

SEQ ID NO: 1043817 - RNA, 22 nt, Human
cagcuugcuaauuuugacuuca

SEQ ID NO: 1043818 - RNA, 22 nt, Human
ggcugccuucagacuccagcuu

SEQ ID NO: 1043819 - RNA, 22 nt, Human
uggcccuguguccugcugccag

SEQ ID NO: 1043820 - RNA, 22 nt, Human
ucagcuuggacagcuugguuga

SEQ ID NO: 1043821 - RNA, 23 nt, Human
uuuuaauuuggacauaagaagau

SEQ ID NO: 1043822 - RNA, 21 nt, Human
ucucuggaauuagaccauguu

SEQ ID NO: 1043823 - RNA, 22 nt, Human
agcagccauuuaaaaugaauug

SEQ ID NO: 1043824 - RNA, 22 nt, Human
aaauaauguuaggccuuugcuc

SEQ ID NO: 1043825 - RNA, 22 nt, Human
agagcagauggccagggggccu

SEQ ID NO: 1043826 - RNA, 22 nt, Human
uggcucagcgcggccuggucuu

SEQ ID NO: 1043827 - RNA, 22 nt, Human
ugucucugugagaucugacgau

SEQ ID NO: 1043828 - RNA, 22 nt, Human
ugccaggcgugguggugcgcac

SEQ ID NO: 1043829 - RNA, 22 nt, Human
ucccuggggauguuggccugcc

SEQ ID NO: 1043830 - RNA, 22 nt, Human
agcugcuaugacaacaccagcc

SEQ ID NO: 1043831 - RNA, 19 nt, Human
ucucaauguucagaaagcu

SEQ ID NO: 1043832 - RNA, 22 nt, Human
cugccuggaaugccagcuucuc

SEQ ID NO: 1043833 - RNA, 22 nt, Human
cucagcagugacaagagaguau

SEQ ID NO: 1043834 - RNA, 22 nt, Human
ggucccugguucccucugagcu

SEQ ID NO: 1043835 - RNA, 22 nt, Human
cuggcucccguuguccuugaag

SEQ ID NO: 1043836 - RNA, 22 nt, Human
cacugccugugagcugugugcc

SEQ ID NO: 1043837 - RNA, 22 nt, Human
cuuguggcccauggcuuccugc

SEQ ID NO: 1043838 - RNA, 22 nt, Human
uuguuacaucuuauguaagugg

SEQ ID NO: 1043839 - RNA, 22 nt, Human
gccaggcuccccggaucccugg

SEQ ID NO: 1043840 - RNA, 22 nt, Human
uacacauguuuggcaaguaugu

SEQ ID NO: 1043841 - RNA, 22 nt, Human
uggcugcugagaaggcagcugu

SEQ ID NO: 1043842 - RNA, 19 nt, Human
uacuuuuucaggacagagu

SEQ ID NO: 1043843 - RNA, 22 nt, Human
ggcugcagguugguuggcagcu

SEQ ID NO: 1043844 - RNA, 22 nt, Human
cagagcaguaaaucuggggcac

SEQ ID NO: 1043845 - RNA, 20 nt, Human
cugggcugcccagcuauggg

SEQ ID NO: 1043846 - RNA, 22 nt, Human
caagagcugcaaauagcgugac

SEQ ID NO: 1043847 - RNA, 22 nt, Human
ccucugccugcacaucauccug

SEQ ID NO: 1043848 - RNA, 21 nt, Human
cauugucgacauuuuccccuc

SEQ ID NO: 1043849 - RNA, 22 nt, Human
aaguaaaagcuuuaccaugcgc

SEQ ID NO: 1043850 - RNA, 22 nt, Human
agaaauaugcugauuagaugaa

SEQ ID NO: 1043851 - RNA, 22 nt, Human
agugaaauugcuguaagaggaa

SEQ ID NO: 1043852 - RNA, 22 nt, Human
uccucaggucaaagcaggagaa

SEQ ID NO: 1043853 - RNA, 22 nt, Human
gccuggagccucagcaaggagg

SEQ ID NO: 1043854 - RNA, 22 nt, Human
agagcaggcauaaagcuuugaa

SEQ ID NO: 1043855 - RNA, 22 nt, Human
gagcugugagggacacauugcu

SEQ ID NO: 1043856 - RNA, 22 nt, Human
uaauguguccugaaagcuucug

SEQ ID NO: 1043857 - RNA, 22 nt, Human
gcucagagcacucagacucagc

SEQ ID NO: 1043858 - RNA, 22 nt, Human
caggguggaauggaaugcuggc

SEQ ID NO: 1043859 - RNA, 20 nt, Human
agagccuugaggaagaugau

SEQ ID NO: 1043860 - RNA, 22 nt, Human
agggcccucuggcaggccaggc

SEQ ID NO: 1043861 - RNA, 22 nt, Human
cuggguggcuguccagccagcc

SEQ ID NO: 1043862 - RNA, 22 nt, Human
ugcaggcaggggaugagcagcc

SEQ ID NO: 1043863 - RNA, 22 nt, Human
cagugcagccaaggacaggcac

SEQ ID NO: 1043864 - RNA, 22 nt, Human
gacagaggcaagaccagaagcc

SEQ ID NO: 1043865 - RNA, 22 nt, Human
cuggcugggagcgagcugcuca

SEQ ID NO: 1043866 - RNA, 22 nt, Human
uggcaccugaacuuagaggugu

SEQ ID NO: 1043867 - RNA, 22 nt, Human
ggcugggcaggucugcacaggg

SEQ ID NO: 1043868 - RNA, 22 nt, Human
ggauccuucuuugaccucacag

SEQ ID NO: 1043869 - RNA, 22 nt, Human
caggagugaaaugaggcccagg

SEQ ID NO: 1043870 - RNA, 22 nt, Human
ggcagcugauuagcaucaagga

SEQ ID NO: 1043871 - RNA, 22 nt, Human
ucagggcaaaagggaaaccauu

SEQ ID NO: 1043872 - RNA, 22 nt, Human
cucuguagaaacagggcagaag

SEQ ID NO: 1043873 - RNA, 22 nt, Human
agaggcugaaugaugucaucau

SEQ ID NO: 1043874 - RNA, 22 nt, Human
ccuuucucuaucgacccaucgc

SEQ ID NO: 1043875 - RNA, 22 nt, Human
cuggccuggcaggggaccucua

SEQ ID NO: 1043876 - RNA, 22 nt, Human
agugacucacuagcucucagug

SEQ ID NO: 1043877 - RNA, 20 nt, Human
ucucccaggcucagggaaga

SEQ ID NO: 1043878 - RNA, 22 nt, Human
aggccuggccccaguugcuagg

SEQ ID NO: 1043879 - RNA, 22 nt, Human
uccagugguuugaaaggggugu

SEQ ID NO: 1043880 - RNA, 22 nt, Human
ugguggccaauucacagggcuc

SEQ ID NO: 1043881 - RNA, 22 nt, Human
gauuuccucacuaacauccauc

SEQ ID NO: 1043882 - RNA, 22 nt, Human
ccagcccuugagauggaaggga

SEQ ID NO: 1043883 - RNA, 22 nt, Human
cccuggggcugagggauggccg

SEQ ID NO: 1043884 - RNA, 22 nt, Human
gucuuuauuugagauugucauu

SEQ ID NO: 1043885 - RNA, 22 nt, Human
aguguccaacucagcuugucaa

SEQ ID NO: 1043886 - RNA, 19 nt, Human
cccagcuugaccaccugcu

SEQ ID NO: 1043887 - RNA, 22 nt, Human
cugcuuuguggaaucacacugg

SEQ ID NO: 1043888 - RNA, 22 nt, Human
gaaacuguauguaguuuuuggg

SEQ ID NO: 1043889 - RNA, 22 nt, Human
ucucuggggauggaccugggag

SEQ ID NO: 1043890 - RNA, 22 nt, Human
aagcagaaaaacugagcuccaa

SEQ ID NO: 1043891 - RNA, 22 nt, Human
ugcuucaggagaugucaccaug

SEQ ID NO: 1043892 - RNA, 21 nt, Human
agagcugggacuugccugaga

SEQ ID NO: 1043893 - RNA, 22 nt, Human
uuuccaauaaagugucauuguu

SEQ ID NO: 1043894 - RNA, 22 nt, Human
aggcagcagggccacuggcuga

SEQ ID NO: 1043895 - RNA, 22 nt, Human
uguggcucucaugcacucccag

SEQ ID NO: 1043896 - RNA, 22 nt, Human
uuucacauuuuauacuuaagcc

SEQ ID NO: 1043897 - RNA, 22 nt, Human
cagggcaggacagauacauuac

SEQ ID NO: 1043898 - RNA, 22 nt, Human
aguuggagugaacaugagauug

SEQ ID NO: 1043899 - RNA, 23 nt, Human
cccuguagcccaggacaggcuuu

SEQ ID NO: 1043900 - RNA, 19 nt, Human
ccaggccaucccaguuccc

SEQ ID NO: 1043901 - RNA, 22 nt, Human
cuccuugguguaguacugagca

SEQ ID NO: 1043902 - RNA, 22 nt, Human
agcugucugucuccugaggaga

SEQ ID NO: 1043903 - RNA, 22 nt, Human
ugggcugcggauaggccucgga

SEQ ID NO: 1043904 - RNA, 22 nt, Human
ggaugcaggaguugaagaagga

SEQ ID NO: 1043905 - RNA, 22 nt, Human
gagagcuggauucuggauaggu

SEQ ID NO: 1043906 - RNA, 22 nt, Human
accugccuaguugguucugccc

SEQ ID NO: 1043907 - RNA, 22 nt, Human
gagguacaugaggauacacagg

SEQ ID NO: 1043908 - RNA, 22 nt, Human
uagcagcucugauucugggccc

SEQ ID NO: 1043909 - RNA, 22 nt, Human
ccucugaggucauggacuuggc

SEQ ID NO: 1043910 - RNA, 17 nt, Human
ggccuugggcugcucuu

SEQ ID NO: 1043911 - RNA, 22 nt, Human
caggacagguguucuagaucag

SEQ ID NO: 1043912 - RNA, 22 nt, Human
gagggcugaagauuguggcccc

SEQ ID NO: 1043913 - RNA, 21 nt, Human
gaugaagcaaucuuucuguug

SEQ ID NO: 1043914 - RNA, 22 nt, Human
gagagggccgggggccagcucc

SEQ ID NO: 1043915 - RNA, 22 nt, Human
agcuguguagggaaucagagaa

SEQ ID NO: 1043916 - RNA, 22 nt, Human
uggagccagagcgcagccuggg

SEQ ID NO: 1043917 - RNA, 22 nt, Human
uggcuggcuuguucacugacug

SEQ ID NO: 1043918 - RNA, 18 nt, Human
gcucugcccaggcugccc

SEQ ID NO: 1043919 - RNA, 18 nt, Human
cucugcuaaugggcagcu

SEQ ID NO: 1043920 - RNA, 22 nt, Human
gggcuggaggagauccagaggc

SEQ ID NO: 1043921 - RNA, 22 nt, Human
uucaagaugucuucacaauagu

SEQ ID NO: 1043922 - RNA, 22 nt, Human
ugccugagugauguggcagcca

SEQ ID NO: 1043923 - RNA, 22 nt, Human
uggacucaaguccaaguucacg

SEQ ID NO: 1043924 - RNA, 18 nt, Human
ugcucuggucucacuugg

SEQ ID NO: 1043925 - RNA, 22 nt, Human
ugcucugguccucccucggcgc

SEQ ID NO: 1043926 - RNA, 22 nt, Human
cuggcucagugccuucagaagu

SEQ ID NO: 1043927 - RNA, 22 nt, Human
ggcugccuggaccuccucuuuc

SEQ ID NO: 1043928 - RNA, 22 nt, Human
agagcuggggccagagucaagg

SEQ ID NO: 1043929 - RNA, 22 nt, Human
uacauauacugagugauuugcu

SEQ ID NO: 1043930 - RNA, 22 nt, Human
ggcugcuggggacgugggagag

SEQ ID NO: 1043931 - RNA, 22 nt, Human
accugagccuagggagguugag

SEQ ID NO: 1043932 - RNA, 22 nt, Human
agcccuccucacaucagcgucc

SEQ ID NO: 1043933 - RNA, 22 nt, Human
caagaugaucccugaaggcagc

SEQ ID NO: 1043934 - RNA, 22 nt, Human
cagcagggaagcugugcuguuu

SEQ ID NO: 1043935 - RNA, 22 nt, Human
cugaaggauuagagagcacuua

SEQ ID NO: 1043936 - RNA, 22 nt, Human
cacugcagaucagaggcugaga

SEQ ID NO: 1043937 - RNA, 20 nt, Human
uagaaaucuuauaaaagacu

SEQ ID NO: 1043938 - RNA, 22 nt, Human
ccugccuggcuuccagaagaga

SEQ ID NO: 1043939 - RNA, 22 nt, Human
gauuucaaguaucuugggcgag

SEQ ID NO: 1043940 - RNA, 22 nt, Human
gcucugagcacugugcggcugg

SEQ ID NO: 1043941 - RNA, 22 nt, Human
ucugucaccgagggcauccaaa

SEQ ID NO: 1043942 - RNA, 22 nt, Human
aaaggugacugcagcagcuauu

SEQ ID NO: 1043943 - RNA, 22 nt, Human
gcuuuuucaaaugaaagcuggu

SEQ ID NO: 1043944 - RNA, 22 nt, Human
ucucccagaggaucccagugga

SEQ ID NO: 1043945 - RNA, 22 nt, Human
gagagcugcagccgagaggggg

SEQ ID NO: 1043946 - RNA, 22 nt, Human
uccugccuaccuugcggaggug

SEQ ID NO: 1043947 - RNA, 22 nt, Human
aggagccaggaaaccugcucug

SEQ ID NO: 1043948 - RNA, 22 nt, Human
ccuggccugugaaucugagagc

SEQ ID NO: 1043949 - RNA, 21 nt, Human
uccauuguuuucccaggguuu

SEQ ID NO: 1043950 - RNA, 22 nt, Human
gcucugugccacaugcaguguu

SEQ ID NO: 1043951 - RNA, 19 nt, Human
auaaggcaggaggaaauuu

SEQ ID NO: 1043952 - RNA, 22 nt, Human
cagggccauuggcguggcuguc

SEQ ID NO: 1043953 - RNA, 22 nt, Human
uuuuccucugcaauaaaagcag

SEQ ID NO: 1043954 - RNA, 22 nt, Human
cagagccaaaccucagggcccg

SEQ ID NO: 1043955 - RNA, 22 nt, Human
uggcuuccaaaggaaugggccu

SEQ ID NO: 1043956 - RNA, 22 nt, Human
agcuuuauuugucauucacggc

SEQ ID NO: 1043957 - RNA, 22 nt, Human
ccuuuugcucucccauccagaa

SEQ ID NO: 1043958 - RNA, 22 nt, Human
gcucugaggcugugaggugcug

SEQ ID NO: 1043959 - RNA, 22 nt, Human
aaaugugugcacaaagacagcu

SEQ ID NO: 1043960 - RNA, 22 nt, Human
uucacauuauaaucaguucugc

SEQ ID NO: 1043961 - RNA, 22 nt, Human
cucagagucccuucccucgugg

SEQ ID NO: 1043962 - RNA, 22 nt, Human
uugcuuccucgaggccagcgug

SEQ ID NO: 1043963 - RNA, 22 nt, Human
agucccaggcagccgagccggu

SEQ ID NO: 1043964 - RNA, 22 nt, Human
gagagugagauccuccugggga

SEQ ID NO: 1043965 - RNA, 22 nt, Human
uaaaugugggggccacgggcuu

SEQ ID NO: 1043966 - RNA, 22 nt, Human
uugcuauuuugagagucauagu

SEQ ID NO: 1043967 - RNA, 22 nt, Human
agggaaagguagugaggucaca

SEQ ID NO: 1043968 - RNA, 22 nt, Human
aaggcacucauucaaggagaua

SEQ ID NO: 1043969 - RNA, 22 nt, Human
ccaggcccugcuccucacacca

SEQ ID NO: 1043970 - RNA, 21 nt, Human
gucagcagauccagcacuugu

SEQ ID NO: 1043971 - RNA, 22 nt, Human
aucucagggcuggagcccugga

SEQ ID NO: 1043972 - RNA, 22 nt, Human
gcagugcugaucccauggcaga

SEQ ID NO: 1043973 - RNA, 22 nt, Human
agaagccacuggagguugagau

SEQ ID NO: 1043974 - RNA, 22 nt, Human
ugggcagauguggcucuccuug

SEQ ID NO: 1043975 - RNA, 22 nt, Human
auugaaagauauacuguucuca

SEQ ID NO: 1043976 - RNA, 22 nt, Human
ucaggcaggcagagggcaaaug

SEQ ID NO: 1043977 - RNA, 22 nt, Human
ugccugggagugaccaagacuc

SEQ ID NO: 1043978 - RNA, 22 nt, Human
aaguaugacauuuaagacaauu

SEQ ID NO: 1043979 - RNA, 22 nt, Human
ccaggcagcaaauuuucugaau

SEQ ID NO: 1043980 - RNA, 22 nt, Human
ugggcaggaugcguugauucuu

SEQ ID NO: 1043981 - RNA, 22 nt, Human
gccagacacuccccugggcagg

SEQ ID NO: 1043982 - RNA, 22 nt, Human
gcuggcucagggacuagaguuu

SEQ ID NO: 1043983 - RNA, 22 nt, Human
aggagucauugagagggguccu

SEQ ID NO: 1043984 - RNA, 22 nt, Human
uuucuucucacccaggacagag

SEQ ID NO: 1043985 - RNA, 19 nt, Human
uggccagguacugucugcu

SEQ ID NO: 1043986 - RNA, 22 nt, Human
aagauuucugcuccugagagaa

SEQ ID NO: 1043987 - RNA, 21 nt, Human
ucacaugcccauuacuggagc

SEQ ID NO: 1043988 - RNA, 22 nt, Human
gcaaaugcuaaaguguagagac

SEQ ID NO: 1043989 - RNA, 22 nt, Human
cugaaggauucaaaauggcagg

SEQ ID NO: 1043990 - RNA, 22 nt, Human
ggucagccuuggauuugguagc

SEQ ID NO: 1043991 - RNA, 22 nt, Human
ugcugccaccugguggcugaag

SEQ ID NO: 1043992 - RNA, 22 nt, Human
cagagguacaagcuaaguuggg

SEQ ID NO: 1043993 - RNA, 22 nt, Human
gguaacaguauguagaguaaga

SEQ ID NO: 1043994 - RNA, 22 nt, Human
cuggagccugcaguuuucacuu

SEQ ID NO: 1043995 - RNA, 22 nt, Human
cugggcacuugcucacagcucu

SEQ ID NO: 1043996 - RNA, 22 nt, Human
gaaaugugaccuacuuccuugu

SEQ ID NO: 1043997 - RNA, 22 nt, Human
cauacauaugcauguguguaua

SEQ ID NO: 1043998 - RNA, 22 nt, Human
gcccuggaaucucuccauggga

SEQ ID NO: 1043999 - RNA, 22 nt, Human
uuuuagaaauacugauuuagug

SEQ ID NO: 1044000 - RNA, 22 nt, Human
aggagucauaaaugugaacaaa

SEQ ID NO: 1044001 - RNA, 22 nt, Human
cauugcacaucugagaagagau

SEQ ID NO: 1044002 - RNA, 22 nt, Human
cacauccuucagcugagcccag

SEQ ID NO: 1044003 - RNA, 22 nt, Human
ggucccugcugaagccuuggug

SEQ ID NO: 1044004 - RNA, 19 nt, Human
gcugucugaugcugagguc

SEQ ID NO: 1044005 - RNA, 22 nt, Human
ggugaagggugucauggcauuu

SEQ ID NO: 1044006 - RNA, 20 nt, Human
accuuucaaaugauucagca

SEQ ID NO: 1044007 - RNA, 22 nt, Human
ggcagugaaaaaguauguuucc

SEQ ID NO: 1044008 - RNA, 22 nt, Human
acauuugagaugccuuuuaggu

SEQ ID NO: 1044009 - RNA, 17 nt, Human
ccucacagggaccagac

SEQ ID NO: 1044010 - RNA, 22 nt, Human
cacagguguucuugcagugaaa

SEQ ID NO: 1044011 - RNA, 19 nt, Human
ugaaggagggggauggcca

SEQ ID NO: 1044012 - RNA, 22 nt, Human
agacagcugcucgcagagcuau

SEQ ID NO: 1044013 - RNA, 22 nt, Human
cucagcccagcccaggaccagg

SEQ ID NO: 1044014 - RNA, 22 nt, Human
uaaggucauggugaauaauaag

SEQ ID NO: 1044015 - RNA, 22 nt, Human
uguacacaauucuuaacauaca

SEQ ID NO: 1044016 - RNA, 18 nt, Human
acauacauucugucugca

SEQ ID NO: 1044017 - RNA, 22 nt, Human
gugggcuucuguuagggaggcu

SEQ ID NO: 1044018 - RNA, 19 nt, Human
gcugugccucucuccugcu

SEQ ID NO: 1044019 - RNA, 22 nt, Human
caugcuuucuguccaaauguua

SEQ ID NO: 1044020 - RNA, 23 nt, Human
uuucauaugguguggaugaagaa

SEQ ID NO: 1044021 - RNA, 21 nt, Human
ccuauugaauauaggaagauu

SEQ ID NO: 1044022 - RNA, 19 nt, Human
uggcuuccaucucucucau

SEQ ID NO: 1044023 - RNA, 21 nt, Human
uggccucccacacuuccaugg

SEQ ID NO: 1044024 - RNA, 22 nt, Human
agagaaaacucauugagguguc

SEQ ID NO: 1044025 - RNA, 22 nt, Human
aucauuccacauguaccacuag

SEQ ID NO: 1044026 - RNA, 22 nt, Human
uggcuggggccacaguuuuccu

SEQ ID NO: 1044027 - RNA, 22 nt, Human
guugggaaggcaagaaguagaa

SEQ ID NO: 1044028 - RNA, 22 nt, Human
ucacuuagauggggaucaucac

SEQ ID NO: 1044029 - RNA, 22 nt, Human
uuucucuaaauagggaggcuua

SEQ ID NO: 1044030 - RNA, 22 nt, Human
uccugccucuugccuucuucac

SEQ ID NO: 1044031 - RNA, 22 nt, Human
uccuucaguucaauuaguccgu

SEQ ID NO: 1044032 - RNA, 22 nt, Human
ugggccuggguuccuccugggc

SEQ ID NO: 1044033 - RNA, 22 nt, Human
ccagggcagaaaaagagggaau

SEQ ID NO: 1044034 - RNA, 22 nt, Human
acuggagcccguggaggcgcag

SEQ ID NO: 1044035 - RNA, 22 nt, Human
uccuauugguagacauuucugu

SEQ ID NO: 1044036 - RNA, 22 nt, Human
gacagcauggugucuguucagg

SEQ ID NO: 1044037 - RNA, 22 nt, Human
uugcauguuauuuaaucuguau

SEQ ID NO: 1044038 - RNA, 22 nt, Human
ugcuuaauauugugauguaaua

SEQ ID NO: 1044039 - RNA, 22 nt, Human
ccagcagcuguggcuuugccuc

SEQ ID NO: 1044040 - RNA, 22 nt, Human
cucugagcagaggccguggcua

SEQ ID NO: 1044041 - RNA, 20 nt, Human
agaguaacuggcacauaggg

SEQ ID NO: 1044042 - RNA, 22 nt, Human
ccacucugcugugcuccaugau

SEQ ID NO: 1044043 - RNA, 22 nt, Human
gcaggaugaaggcagaggcuga

SEQ ID NO: 1044044 - RNA, 22 nt, Human
aggagcugcagauucugccuug

SEQ ID NO: 1044045 - RNA, 22 nt, Human
gcugucugcaagccaggaaaug

SEQ ID NO: 1044046 - RNA, 22 nt, Human
gggagagaugcugauugccaau

SEQ ID NO: 1044047 - RNA, 22 nt, Human
uacauuuauaaggcuucucugu

SEQ ID NO: 1044048 - RNA, 18 nt, Human
agccuggaggguugaagu

SEQ ID NO: 1044049 - RNA, 22 nt, Human
gcagagccgugaauggauuuca

SEQ ID NO: 1044050 - RNA, 22 nt, Human
cucugagagcggucuguggcuu

SEQ ID NO: 1044051 - RNA, 21 nt, Human
uggaaagauucaaagaccagg

SEQ ID NO: 1044052 - RNA, 22 nt, Human
agaggcugcacuugcucaugau

SEQ ID NO: 1044053 - RNA, 22 nt, Human
aggccaaguagcuagcauugaa

SEQ ID NO: 1044054 - RNA, 22 nt, Human
cagcaguguggaagcugagggg

SEQ ID NO: 1044055 - RNA, 22 nt, Human
gcuggagcuugagaggacaggg

SEQ ID NO: 1044056 - RNA, 22 nt, Human
cuuguacaggaauccaugguau

SEQ ID NO: 1044057 - RNA, 22 nt, Human
uccuggcccacuaugccagcau

SEQ ID NO: 1044058 - RNA, 22 nt, Human
aggugcugccccgagaaggaug

SEQ ID NO: 1044059 - RNA, 22 nt, Human
cagaguguggcaucuuccaacu

SEQ ID NO: 1044060 - RNA, 22 nt, Human
ggcaaaaaccauaauuacuuuu

SEQ ID NO: 1044061 - RNA, 22 nt, Human
agcagggcaaagucaggcuaac

SEQ ID NO: 1044062 - RNA, 22 nt, Human
aagcugaggcccauggcaaggu

SEQ ID NO: 1044063 - RNA, 19 nt, Human
gcucugugaugcugagggg

SEQ ID NO: 1044064 - RNA, 22 nt, Human
ccuggagcccaaggcagugaga

SEQ ID NO: 1044065 - RNA, 22 nt, Human
ucugucacucuagagauggcag

SEQ ID NO: 1044066 - RNA, 22 nt, Human
cuggaagggucuacuuagcaga

SEQ ID NO: 1044067 - RNA, 22 nt, Human
aguacuuuacuucuuacaguuu

SEQ ID NO: 1044068 - RNA, 22 nt, Human
ccagucccaucucugucgcuua

SEQ ID NO: 1044069 - RNA, 22 nt, Human
augggaggguggaaaggcucug

SEQ ID NO: 1044070 - RNA, 22 nt, Human
cacuuaagcaguuaauuuaucu

SEQ ID NO: 1044071 - RNA, 22 nt, Human
uccaggaggaggaaggcugcca

SEQ ID NO: 1044072 - RNA, 22 nt, Human
ugagaguauuuuggcauuauca

SEQ ID NO: 1044073 - RNA, 22 nt, Human
aguggcagaucucuggucugga

SEQ ID NO: 1044074 - RNA, 22 nt, Human
cuacauuuuucaccgagccucu

SEQ ID NO: 1044075 - RNA, 22 nt, Human
ugagccagaggaggcugugugg

SEQ ID NO: 1044076 - RNA, 22 nt, Human
ugaaaucuuagccauucugccu

SEQ ID NO: 1044077 - RNA, 18 nt, Human
caggagcaggaguugaac

SEQ ID NO: 1044078 - RNA, 22 nt, Human
acagggcagguggcuacugguc

SEQ ID NO: 1044079 - RNA, 19 nt, Human
gcaugcuugguggcuucug

SEQ ID NO: 1044080 - RNA, 22 nt, Human
ucauugcaagcucauuuaucug

SEQ ID NO: 1044081 - RNA, 22 nt, Human
ucaguuuugauuccugguucuc

SEQ ID NO: 1044082 - RNA, 22 nt, Human
cuggcccagucucagaguguca

SEQ ID NO: 1044083 - RNA, 22 nt, Human
ucugcugcacaaauucaucucu

SEQ ID NO: 1044084 - RNA, 22 nt, Human
ugagcuggucacuccuucugaa

SEQ ID NO: 1044085 - RNA, 20 nt, Human
aucuggcucagauccugcag

SEQ ID NO: 1044086 - RNA, 17 nt, Human
uuccaguuuaguauugu

SEQ ID NO: 1044087 - RNA, 22 nt, Human
acugccuugucucuugccuguu

SEQ ID NO: 1044088 - RNA, 22 nt, Human
ccucauggccuugagcugaggg

SEQ ID NO: 1044089 - RNA, 22 nt, Human
ugcaagggcuuagggggcugug

SEQ ID NO: 1044090 - RNA, 22 nt, Human
gcauugucaaaagugguaugac

SEQ ID NO: 1044091 - RNA, 22 nt, Human
agggcagagggugccucaccug

SEQ ID NO: 1044092 - RNA, 19 nt, Human
guggccagggcaggggcug

SEQ ID NO: 1044093 - RNA, 21 nt, Human
gcccucaggggaggauggccu

SEQ ID NO: 1044094 - RNA, 21 nt, Human
ugcagagauaucugaagcaga

SEQ ID NO: 1044095 - RNA, 18 nt, Human
cagucccaaaccuuagga

SEQ ID NO: 1044096 - RNA, 22 nt, Human
uagcugucaccagaaauggcca

SEQ ID NO: 1044097 - RNA, 22 nt, Human
cagcaggcucugaguggcugcc

SEQ ID NO: 1044098 - RNA, 22 nt, Human
guggccuggaugagcuucgaca

SEQ ID NO: 1044099 - RNA, 20 nt, Human
agggcagcuugaggagccgg

SEQ ID NO: 1044100 - RNA, 22 nt, Human
uuaacagacauauauauuugua

SEQ ID NO: 1044101 - RNA, 22 nt, Human
uguaugcaccauuguauuaccu

SEQ ID NO: 1044102 - RNA, 22 nt, Human
gccugucucuuggaacuuggua

SEQ ID NO: 1044103 - RNA, 22 nt, Human
ccaaagucagugcucagucguc

SEQ ID NO: 1044104 - RNA, 22 nt, Human
agaggccaguggcugugcuguc

SEQ ID NO: 1044105 - RNA, 23 nt, Human
agagcuuagggaauucacaugag

SEQ ID NO: 1044106 - RNA, 22 nt, Human
aucagcaagcauuuauugagug

SEQ ID NO: 1044107 - RNA, 20 nt, Human
gagggcaggcacccauuuca

SEQ ID NO: 1044108 - RNA, 22 nt, Human
cauucauuuaugaaauaucuau

SEQ ID NO: 1044109 - RNA, 22 nt, Human
ccuggccuggcacucccucugc

SEQ ID NO: 1044110 - RNA, 22 nt, Human
ggcagcagggucuagauugaug

SEQ ID NO: 1044111 - RNA, 22 nt, Human
ugggcuccucgucacucgcugu

SEQ ID NO: 1044112 - RNA, 22 nt, Human
caaggcaggaagccugucuuau

SEQ ID NO: 1044113 - RNA, 22 nt, Human
ucucaggguuuccugggggcug

SEQ ID NO: 1044114 - RNA, 22 nt, Human
ugaugauguuuaucuugguauu

SEQ ID NO: 1044115 - RNA, 19 nt, Human
ccucuccgcccaccagccc

SEQ ID NO: 1044116 - RNA, 22 nt, Human
uggcccucagucuugcuccugc

SEQ ID NO: 1044117 - RNA, 22 nt, Human
cauguaaaacacucagaacagu

SEQ ID NO: 1044118 - RNA, 22 nt, Human
uaagaacaguagaacaguaggu

SEQ ID NO: 1044119 - RNA, 22 nt, Human
aaggagaguacaggaguuggua

SEQ ID NO: 1044120 - RNA, 20 nt, Human
uggggccuguuucugugguu

SEQ ID NO: 1044121 - RNA, 22 nt, Human
ggucccaggaagugcggcggcg

SEQ ID NO: 1044122 - RNA, 22 nt, Human
gcagguguggaguggggugagc

SEQ ID NO: 1044123 - RNA, 22 nt, Human
cacagggcaggccccaggccuc

SEQ ID NO: 1044124 - RNA, 22 nt, Human
cacugcuuuaaggcugaguaac

SEQ ID NO: 1044125 - RNA, 22 nt, Human
agcauuuauuucuuagaaauug

SEQ ID NO: 1044126 - RNA, 18 nt, Human
ccugcagcccaggaggcc

SEQ ID NO: 1044127 - RNA, 22 nt, Human
aacaugaaguuuucuauaguga

SEQ ID NO: 1044128 - RNA, 22 nt, Human
ugaugcugagccugggacugac

SEQ ID NO: 1044129 - RNA, 22 nt, Human
ccugagggaaggaugcuaccca

SEQ ID NO: 1044130 - RNA, 22 nt, Human
ucaggcugccuaucagacugug

SEQ ID NO: 1044131 - RNA, 22 nt, Human
uucuuucccaguagaugugaaa

SEQ ID NO: 1044132 - RNA, 22 nt, Human
uaacagaaauagaaaugagagu

SEQ ID NO: 1044133 - RNA, 22 nt, Human
ccugucugagccagggugggca

SEQ ID NO: 1044134 - RNA, 22 nt, Human
uggcagagaacacacaugauuc

SEQ ID NO: 1044135 - RNA, 22 nt, Human
uucaagauggcaccagugagug

SEQ ID NO: 1044136 - RNA, 22 nt, Human
ggcuggcacugaggagagcucu

SEQ ID NO: 1044137 - RNA, 22 nt, Human
gagcugccuguugcauagcaac

SEQ ID NO: 1044138 - RNA, 18 nt, Human
cagcugccagcucaugga

SEQ ID NO: 1044139 - RNA, 21 nt, Human
ugcugccauagaccugaggga

SEQ ID NO: 1044140 - RNA, 22 nt, Human
uugucugugaaauggaaauagu

SEQ ID NO: 1044141 - RNA, 22 nt, Human
uccugggcccaggcugccaggg

SEQ ID NO: 1044142 - RNA, 20 nt, Human
cuguaucagguuacaaagua

SEQ ID NO: 1044143 - RNA, 22 nt, Human
gcaggggcaggagaucucaggc

SEQ ID NO: 1044144 - RNA, 22 nt, Human
uuucaagcauaacugggaagag

SEQ ID NO: 1044145 - RNA, 22 nt, Human
aggcacugacaauucuggacug

SEQ ID NO: 1044146 - RNA, 22 nt, Human
uggggcugugagacuacaggau

SEQ ID NO: 1044147 - RNA, 22 nt, Human
uccagugguaguaaagaggucu

SEQ ID NO: 1044148 - RNA, 22 nt, Human
uagaaauguugguauuaacauu

SEQ ID NO: 1044149 - RNA, 22 nt, Human
gccugucugcgucacgcuuauu

SEQ ID NO: 1044150 - RNA, 22 nt, Human
uugcuuuguggugguucuucca

SEQ ID NO: 1044151 - RNA, 22 nt, Human
gaggaaaagagacagguuauug

SEQ ID NO: 1044152 - RNA, 19 nt, Human
gcagccaccgcggcggccg

SEQ ID NO: 1044153 - RNA, 22 nt, Human
caguggggaggccaggauagaa

SEQ ID NO: 1044154 - RNA, 22 nt, Human
uauuuugagguauuuuugagcu

SEQ ID NO: 1044155 - RNA, 22 nt, Human
caggcacagaguuauucauuua

SEQ ID NO: 1044156 - RNA, 22 nt, Human
ucugccugccagucugguccuc

SEQ ID NO: 1044157 - RNA, 22 nt, Human
uugaggaguguuuagggugagg

SEQ ID NO: 1044158 - RNA, 22 nt, Human
gcucagagggaacaaggggcug

SEQ ID NO: 1044159 - RNA, 22 nt, Human
ugcacuggggucccagcgcacg

SEQ ID NO: 1044160 - RNA, 22 nt, Human
uuccauauguauauagcuguua

SEQ ID NO: 1044161 - RNA, 22 nt, Human
cuauuucugccuaaugaccugu

SEQ ID NO: 1044162 - RNA, 22 nt, Human
aagaauguggguggauaugaug

SEQ ID NO: 1044163 - RNA, 22 nt, Human
ggggagugacgcagggccauag

SEQ ID NO: 1044164 - RNA, 22 nt, Human
uggccugguuguugcugccguu

SEQ ID NO: 1044165 - RNA, 22 nt, Human
cuuggccucuucucaggguggg

SEQ ID NO: 1044166 - RNA, 22 nt, Human
gccugccuuuuggaggcacauu

SEQ ID NO: 1044167 - RNA, 22 nt, Human
cagggacaauggcagagccuga

SEQ ID NO: 1044168 - RNA, 22 nt, Human
aaggcaggaugggaaaagauuu

SEQ ID NO: 1044169 - RNA, 22 nt, Human
guauccuuugcggaaauuucua

SEQ ID NO: 1044170 - RNA, 22 nt, Human
agacagcauggagcugauaaca

SEQ ID NO: 1044171 - RNA, 22 nt, Human
guggcccucugauagggucagg

SEQ ID NO: 1044172 - RNA, 22 nt, Human
uccucugcuggaagggcaagag

SEQ ID NO: 1044173 - RNA, 22 nt, Human
aaaggcuccuucucccaugacc

SEQ ID NO: 1044174 - RNA, 22 nt, Human
aucuuucagagcuccaucaggg

SEQ ID NO: 1044175 - RNA, 22 nt, Human
ucagaaaugaucguuauucauu

SEQ ID NO: 1044176 - RNA, 22 nt, Human
gagaggucaucucccaucagca

SEQ ID NO: 1044177 - RNA, 22 nt, Human
acugagcugcuugaagugaacu

SEQ ID NO: 1044178 - RNA, 22 nt, Human
agaaaucagaacccugaaguuc

SEQ ID NO: 1044179 - RNA, 22 nt, Human
auggcccaggccuccuguggcu

SEQ ID NO: 1044180 - RNA, 22 nt, Human
ccugugccauccugagcauccc

SEQ ID NO: 1044181 - RNA, 22 nt, Human
cucugucccagacccaccucuc

SEQ ID NO: 1044182 - RNA, 22 nt, Human
ggugaggggagagugaaagaaa

SEQ ID NO: 1044183 - RNA, 22 nt, Human
uuucuguuaggcaucauuuuaa

SEQ ID NO: 1044184 - RNA, 22 nt, Human
gugaggggaguaaagccauguu

SEQ ID NO: 1044185 - RNA, 22 nt, Human
ucagccuggcaggauggccugg

SEQ ID NO: 1044186 - RNA, 22 nt, Human
agagccagcauuugggcccugc

SEQ ID NO: 1044187 - RNA, 22 nt, Human
ugcugcuccugccuggcuccca

SEQ ID NO: 1044188 - RNA, 23 nt, Human
acagagguccaaacaguauaagc

SEQ ID NO: 1044189 - RNA, 22 nt, Human
ugccaggggaccuagggauguc

SEQ ID NO: 1044190 - RNA, 22 nt, Human
ggagccuggcaaugcugcgucc

SEQ ID NO: 1044191 - RNA, 22 nt, Human
gcaguggcuaggagucuggcgu

SEQ ID NO: 1044192 - RNA, 22 nt, Human
uagaaaguaaaucaguuuuauu

SEQ ID NO: 1044193 - RNA, 22 nt, Human
ucaucuucuauuaauagggaga

SEQ ID NO: 1044194 - RNA, 22 nt, Human
uuucuaaaugguggcugcauug

SEQ ID NO: 1044195 - RNA, 21 nt, Human
acagcagacaggcuuaggacc

SEQ ID NO: 1044196 - RNA, 22 nt, Human
ugggccugggagggcagacgcu

SEQ ID NO: 1044197 - RNA, 22 nt, Human
ggcccagccggcgagucucgcg

SEQ ID NO: 1044198 - RNA, 22 nt, Human
aggguggccaugagggagagau

SEQ ID NO: 1044199 - RNA, 22 nt, Human
uuaaaguucauuaaaugagcca

SEQ ID NO: 1044200 - RNA, 19 nt, Human
ucaaugcaugaaaucagcc

SEQ ID NO: 1044201 - RNA, 22 nt, Human
auaaggcaucucucaguuagca

SEQ ID NO: 1044202 - RNA, 22 nt, Human
accucugccaagaugugcuccc

SEQ ID NO: 1044203 - RNA, 22 nt, Human
ccagcccugccucucagggccc

SEQ ID NO: 1044204 - RNA, 22 nt, Human
aggccugagccccagguuuguu

SEQ ID NO: 1044205 - RNA, 20 nt, Human
agugucugggccucaggccc

SEQ ID NO: 1044206 - RNA, 22 nt, Human
ugucauuuucuaaucuguuguc

SEQ ID NO: 1044207 - RNA, 22 nt, Human
aggcagcccacaggacacagga

SEQ ID NO: 1044208 - RNA, 22 nt, Human
aaugugguuaacccauuuaaga

SEQ ID NO: 1044209 - RNA, 22 nt, Human
uuagcucagaaaauuuaaacuu

SEQ ID NO: 1044210 - RNA, 22 nt, Human
agcagggcagguaaggaucaga

SEQ ID NO: 1044211 - RNA, 22 nt, Human
gaggcaugucuggccuguccca

SEQ ID NO: 1044212 - RNA, 22 nt, Human
uuucuggcagcgggacaggggu

SEQ ID NO: 1044213 - RNA, 22 nt, Human
cauugcacuucugcuuuuccuc

SEQ ID NO: 1044214 - RNA, 22 nt, Human
uaugcacauauaaccugcacug

SEQ ID NO: 1044215 - RNA, 22 nt, Human
ggcuccuguccccucagcugcu

SEQ ID NO: 1044216 - RNA, 22 nt, Human
uacauguaggugacauuuuaau

SEQ ID NO: 1044217 - RNA, 18 nt, Human
acauuucucucugcguga

SEQ ID NO: 1044218 - RNA, 21 nt, Human
uagggcaggcauuggaagaga

SEQ ID NO: 1044219 - RNA, 22 nt, Human
uuuucauuguaaaucaggaaac

SEQ ID NO: 1044220 - RNA, 22 nt, Human
ccugggcuucugucuagauguu

SEQ ID NO: 1044221 - RNA, 22 nt, Human
agggagaaugaccaagguauau

SEQ ID NO: 1044222 - RNA, 22 nt, Human
agggcagaccacgugcaaggau

SEQ ID NO: 1044223 - RNA, 22 nt, Human
ugcucuccggcuuccguggccu

SEQ ID NO: 1044224 - RNA, 22 nt, Human
aaggaagggaaauagugauguc

SEQ ID NO: 1044225 - RNA, 22 nt, Human
agcagagccagaauuggaccag

SEQ ID NO: 1044226 - RNA, 22 nt, Human
uuggcucaggaccccugugacu

SEQ ID NO: 1044227 - RNA, 20 nt, Human
aacagggggcugcagagggc

SEQ ID NO: 1044228 - RNA, 22 nt, Human
gcuggagauaguaggauccaua

SEQ ID NO: 1044229 - RNA, 23 nt, Human
gggagccauggguggucauggag

SEQ ID NO: 1044230 - RNA, 22 nt, Human
uggcccugcuaugauccugcaa

SEQ ID NO: 1044231 - RNA, 19 nt, Human
ccuggcccugcugcgcggg

SEQ ID NO: 1044232 - RNA, 22 nt, Human
aaaacucugcaguuaguuucua

SEQ ID NO: 1044233 - RNA, 22 nt, Human
uaaggcacgcauaagagggggc

SEQ ID NO: 1044234 - RNA, 22 nt, Human
gcugucccaugguugcaagaug

SEQ ID NO: 1044235 - RNA, 18 nt, Human
gugagcagagagcaucac

SEQ ID NO: 1044236 - RNA, 22 nt, Human
uggacucagaaguguucuuuua

SEQ ID NO: 1044237 - RNA, 22 nt, Human
cagggcuguggcuuugugcugu

SEQ ID NO: 1044238 - RNA, 22 nt, Human
ucacugcaaccucugccuuccg

SEQ ID NO: 1044239 - RNA, 22 nt, Human
cugccgagugggucaugaggca

SEQ ID NO: 1044240 - RNA, 22 nt, Human
ucaggcuggaaugcaguggggc

SEQ ID NO: 1044241 - RNA, 22 nt, Human
ccagggccaagagaccucgagg

SEQ ID NO: 1044242 - RNA, 22 nt, Human
cugcaguguucuggaaugcauu

SEQ ID NO: 1044243 - RNA, 22 nt, Human
acaugcauacaagcacauguag

SEQ ID NO: 1044244 - RNA, 22 nt, Human
guggccuggaaaggcuggucug

SEQ ID NO: 1044245 - RNA, 22 nt, Human
ucaguguaaguuauguagaugu

SEQ ID NO: 1044246 - RNA, 22 nt, Human
aauguguauaugaacauacagg

SEQ ID NO: 1044247 - RNA, 22 nt, Human
caggugcccagcuccugcugug

SEQ ID NO: 1044248 - RNA, 22 nt, Human
gcugccaccguggagaugagug

SEQ ID NO: 1044249 - RNA, 22 nt, Human
gccagccugugggggcucugug

SEQ ID NO: 1044250 - RNA, 22 nt, Human
cccaguccuaaagcagacgcca

SEQ ID NO: 1044251 - RNA, 22 nt, Human
cugggcugcaguuccugguccu

SEQ ID NO: 1044252 - RNA, 22 nt, Human
caccagggcucugagcucugaa

SEQ ID NO: 1044253 - RNA, 22 nt, Human
cucucugaggcaggccuguggg

SEQ ID NO: 1044254 - RNA, 22 nt, Human
ggcugccugaggcagugagaga

SEQ ID NO: 1044255 - RNA, 22 nt, Human
caggagaagguuuggagugcag

SEQ ID NO: 1044256 - RNA, 18 nt, Human
cucucuggucuggauccc

SEQ ID NO: 1044257 - RNA, 17 nt, Human
gauuuccugaaguucuu

SEQ ID NO: 1044258 - RNA, 22 nt, Human
cacauugaaaugacccaauaau

SEQ ID NO: 1044259 - RNA, 22 nt, Human
ugcuggcucaguuugcagacuc

SEQ ID NO: 1044260 - RNA, 22 nt, Human
agcagggcucuguggagggugg

SEQ ID NO: 1044261 - RNA, 22 nt, Human
agaaaaggcuugaagagguuuu

SEQ ID NO: 1044262 - RNA, 22 nt, Human
ugcuuccugaggccgucuucuc

SEQ ID NO: 1044263 - RNA, 22 nt, Human
ccugcccuagagaugacacaau

SEQ ID NO: 1044264 - RNA, 22 nt, Human
agcucccaauugacuugaacua

SEQ ID NO: 1044265 - RNA, 21 nt, Human
ucuuguccuugcucucccacu

SEQ ID NO: 1044266 - RNA, 22 nt, Human
agagcuguucagcagccagguu

SEQ ID NO: 1044267 - RNA, 22 nt, Human
uagcagcuuccagagagggcag

SEQ ID NO: 1044268 - RNA, 22 nt, Human
gcuguauuuauuuucuaggguu

SEQ ID NO: 1044269 - RNA, 22 nt, Human
ggagaggugaauggcugcucua

SEQ ID NO: 1044270 - RNA, 22 nt, Human
ccagggcaugggaagaacugaa

SEQ ID NO: 1044271 - RNA, 22 nt, Human
cacugcucgcugcagcauggcc

SEQ ID NO: 1044272 - RNA, 22 nt, Human
cuguauuuucaugccuacguac

SEQ ID NO: 1044273 - RNA, 22 nt, Human
ugccacagaggugaagcccacu

SEQ ID NO: 1044274 - RNA, 22 nt, Human
uaugcacacaggcuuaauucau

SEQ ID NO: 1044275 - RNA, 22 nt, Human
gcagagccccauugcuggcggg

SEQ ID NO: 1044276 - RNA, 18 nt, Human
uacaugcauaaaugaagc

SEQ ID NO: 1044277 - RNA, 20 nt, Human
aauguauauuuuaugccagg

SEQ ID NO: 1044278 - RNA, 22 nt, Human
uguaugcuuuccaaaaaugcug

SEQ ID NO: 1044279 - RNA, 22 nt, Human
gcccucagaggacagcugacuu

SEQ ID NO: 1044280 - RNA, 22 nt, Human
ugggauggagccugaguauagu

SEQ ID NO: 1044281 - RNA, 22 nt, Human
aggauccugcgcuuugggggag

SEQ ID NO: 1044282 - RNA, 22 nt, Human
gauuucaaaaguagauccauca

SEQ ID NO: 1044283 - RNA, 22 nt, Human
caggcugagcucuggccugggc

SEQ ID NO: 1044284 - RNA, 22 nt, Human
aaggcccuaauagagcacauau

SEQ ID NO: 1044285 - RNA, 22 nt, Human
auguacaguggaaacuaacaaa

SEQ ID NO: 1044286 - RNA, 22 nt, Human
cccagacucaucccugggagcu

SEQ ID NO: 1044287 - RNA, 22 nt, Human
cagcauugaucccaggcugugg

SEQ ID NO: 1044288 - RNA, 22 nt, Human
ugcagugguguccagguguacu

SEQ ID NO: 1044289 - RNA, 22 nt, Human
gcagaggccaucaacuuugcca

SEQ ID NO: 1044290 - RNA, 22 nt, Human
ugauuuccacgugcacccaggu

SEQ ID NO: 1044291 - RNA, 22 nt, Human
cccaggaggccaagguugcagu

SEQ ID NO: 1044292 - RNA, 22 nt, Human
agggccagagucuguguagaua

SEQ ID NO: 1044293 - RNA, 22 nt, Human
aaaucugggagcagcucggcca

SEQ ID NO: 1044294 - RNA, 22 nt, Human
uuucuguaauuaaaagggcagg

SEQ ID NO: 1044295 - RNA, 22 nt, Human
cauugacaguucuuuaaguugc

SEQ ID NO: 1044296 - RNA, 22 nt, Human
gagacugcauuguccaaggguu

SEQ ID NO: 1044297 - RNA, 22 nt, Human
cugccucugcgucccacagagu

SEQ ID NO: 1044298 - RNA, 19 nt, Human
ugaagcaggcagagaagau

SEQ ID NO: 1044299 - RNA, 22 nt, Human
acccuggggguggccagugcca

SEQ ID NO: 1044300 - RNA, 22 nt, Human
uguguacaggccuugcuagacu

SEQ ID NO: 1044301 - RNA, 22 nt, Human
ugagaggcagaauggugccugc

SEQ ID NO: 1044302 - RNA, 22 nt, Human
ccuggcuuccuggagcucacaa

SEQ ID NO: 1044303 - RNA, 22 nt, Human
uuccugaugcacacagucauuu

SEQ ID NO: 1044304 - RNA, 22 nt, Human
gggagccaaggagagaggccuu

SEQ ID NO: 1044305 - RNA, 22 nt, Human
caagggaguuacugagggcggg

SEQ ID NO: 1044306 - RNA, 22 nt, Human
ggaggagacccugugucaguuu

SEQ ID NO: 1044307 - RNA, 22 nt, Human
ucuggcucaggucagacaggga

SEQ ID NO: 1044308 - RNA, 17 nt, Human
ggagagugggaauggcc

SEQ ID NO: 1044309 - RNA, 22 nt, Human
caggugcugcguggcggagcug

SEQ ID NO: 1044310 - RNA, 22 nt, Human
ucuggcucggauuugucuagca

SEQ ID NO: 1044311 - RNA, 19 nt, Human
cagaccuguccagccugug

SEQ ID NO: 1044312 - RNA, 22 nt, Human
agccagggauggcagugcccag

SEQ ID NO: 1044313 - RNA, 22 nt, Human
cugccuugaggagguuguggga

SEQ ID NO: 1044314 - RNA, 17 nt, Human
aagauuucauuagcuga

SEQ ID NO: 1044315 - RNA, 22 nt, Human
agcugaguuaauucaucacuua

SEQ ID NO: 1044316 - RNA, 21 nt, Human
ugcaggaaagugcugcgaccc

SEQ ID NO: 1044317 - RNA, 22 nt, Human
gugccucagcaccgccugcagc

SEQ ID NO: 1044318 - RNA, 22 nt, Human
agauacaucuugaacuucuaga

SEQ ID NO: 1044319 - RNA, 22 nt, Human
cuggacagaaaaggccacugga

SEQ ID NO: 1044320 - RNA, 22 nt, Human
acacaguaccccaaggcugggc

SEQ ID NO: 1044321 - RNA, 22 nt, Human
gugucaugggguuuguuauaca

SEQ ID NO: 1044322 - RNA, 22 nt, Human
aaaugaacucuuccugcauccc

SEQ ID NO: 1044323 - RNA, 22 nt, Human
cagggcucaucugugugaccag

SEQ ID NO: 1044324 - RNA, 22 nt, Human
gaugcugagagguggagggaac

SEQ ID NO: 1044325 - RNA, 22 nt, Human
guaaaugugcuucuuuuaacuu

SEQ ID NO: 1044326 - RNA, 22 nt, Human
uuugcauuuugauaagaucacu

SEQ ID NO: 1044327 - RNA, 22 nt, Human
cagggugccaaagaacaaauau

SEQ ID NO: 1044328 - RNA, 22 nt, Human
cugaaggagguagagugacaua

SEQ ID NO: 1044329 - RNA, 22 nt, Human
guacauguugguuguuuccagu

SEQ ID NO: 1044330 - RNA, 22 nt, Human
gcugucacucaccaggccugca

SEQ ID NO: 1044331 - RNA, 22 nt, Human
gcucaggaaggcucaaccagga

SEQ ID NO: 1044332 - RNA, 18 nt, Human
cugccuguugcugagagg

SEQ ID NO: 1044333 - RNA, 21 nt, Human
ugccaggccugagcugggguc

SEQ ID NO: 1044334 - RNA, 22 nt, Human
ggagccuuccagacugcccaca

SEQ ID NO: 1044335 - RNA, 22 nt, Human
ucuaggagcaugaagggaaggc

SEQ ID NO: 1044336 - RNA, 22 nt, Human
ugggcucauggcccagcacugg

SEQ ID NO: 1044337 - RNA, 22 nt, Human
gcuggccugcaaagcccggcug

SEQ ID NO: 1044338 - RNA, 22 nt, Human
aagcgccacgagaagcuggacc

SEQ ID NO: 1044339 - RNA, 20 nt, Human
cugugcuuuggaaccuggaa

SEQ ID NO: 1044340 - RNA, 18 nt, Human
cccacggugcuguagggc

SEQ ID NO: 1044341 - RNA, 22 nt, Human
ccagagccccugagcuucccug

SEQ ID NO: 1044342 - RNA, 22 nt, Human
uaggagaggugaauggcacacu

SEQ ID NO: 1044343 - RNA, 22 nt, Human
uugucuuaaauggauggacaau

SEQ ID NO: 1044344 - RNA, 18 nt, Human
uggacaggguggagaaaa

SEQ ID NO: 1044345 - RNA, 22 nt, Human
cuggccugugggcugucuccgg

SEQ ID NO: 1044346 - RNA, 22 nt, Human
uugugugguagcuucauugaac

SEQ ID NO: 1044347 - RNA, 22 nt, Human
gaaaaugugccuuuggguauug

SEQ ID NO: 1044348 - RNA, 22 nt, Human
ggagcuggcuacagagaacucc

SEQ ID NO: 1044349 - RNA, 22 nt, Human
ggcagcucugaugaugcucugg

SEQ ID NO: 1044350 - RNA, 22 nt, Human
auugaaagauuuugggcucaug

SEQ ID NO: 1044351 - RNA, 22 nt, Human
aaagaacaaauuagcuguuuua

SEQ ID NO: 1044352 - RNA, 22 nt, Human
ccacucugauuuuggcuccacu

SEQ ID NO: 1044353 - RNA, 22 nt, Human
augcaguacauacaaacacuga

SEQ ID NO: 1044354 - RNA, 22 nt, Human
aaaaucaguacacuuuauuuug

SEQ ID NO: 1044355 - RNA, 22 nt, Human
cccaggaggcagagguugcagu

SEQ ID NO: 1044356 - RNA, 22 nt, Human
caggggacaguaugguggauga

SEQ ID NO: 1044357 - RNA, 19 nt, Human
cagcucaguuugauucucu

SEQ ID NO: 1044358 - RNA, 22 nt, Human
gaaggcuugcagcucuguggca

SEQ ID NO: 1044359 - RNA, 21 nt, Human
uggcucugagccucauggcug

SEQ ID NO: 1044360 - RNA, 20 nt, Human
cagucccaauccagggccag

SEQ ID NO: 1044361 - RNA, 22 nt, Human
agauggggcucaguguggaggc

SEQ ID NO: 1044362 - RNA, 22 nt, Human
cucaggaugucggugacuauug

SEQ ID NO: 1044363 - RNA, 22 nt, Human
aucuggcuuaccuagggugccu

SEQ ID NO: 1044364 - RNA, 22 nt, Human
gccagcugguaggcaccuagcc

SEQ ID NO: 1044365 - RNA, 22 nt, Human
guguuccauguuugagguaguu

SEQ ID NO: 1044366 - RNA, 22 nt, Human
ucuucuuccucauuuauacaua

SEQ ID NO: 1044367 - RNA, 22 nt, Human
cucaggauggaagccuacagga

SEQ ID NO: 1044368 - RNA, 22 nt, Human
uggcucaggguccccaaauggu

SEQ ID NO: 1044369 - RNA, 22 nt, Human
aaaaacugcaauuacuuuuguc

SEQ ID NO: 1044370 - RNA, 22 nt, Human
guguuuccaguucagaaagcaa

SEQ ID NO: 1044371 - RNA, 22 nt, Human
ggcucugcccagguggacagca

SEQ ID NO: 1044372 - RNA, 22 nt, Human
cuugcugggguaagucugugcu

SEQ ID NO: 1044373 - RNA, 22 nt, Human
gagggcagagacagugauucac

SEQ ID NO: 1044374 - RNA, 22 nt, Human
uuucauaugggcauuggcaaua

SEQ ID NO: 1044375 - RNA, 22 nt, Human
cuugaaagauuuggccucugug

SEQ ID NO: 1044376 - RNA, 22 nt, Human
gcagcguggggcugagucagcu

SEQ ID NO: 1044377 - RNA, 22 nt, Human
aucuggcucucucauuuacaaa

SEQ ID NO: 1044378 - RNA, 22 nt, Human
uagcacauaacuuagaauaguu

SEQ ID NO: 1044379 - RNA, 22 nt, Human
ccugcugugaaacuggcauaug

SEQ ID NO: 1044380 - RNA, 22 nt, Human
ugcucccagggacucuggcugg

SEQ ID NO: 1044381 - RNA, 22 nt, Human
gcuggccucuacaggccggcca

SEQ ID NO: 1044382 - RNA, 22 nt, Human
ccucagagguguggcaucucug

SEQ ID NO: 1044383 - RNA, 22 nt, Human
aagaggaaaugauugacuauau

SEQ ID NO: 1044384 - RNA, 22 nt, Human
caggugccucaggaugagacaa

SEQ ID NO: 1044385 - RNA, 22 nt, Human
uggccucucuaccaggcagccu

SEQ ID NO: 1044386 - RNA, 22 nt, Human
ugcucuggguccugggccuccu

SEQ ID NO: 1044387 - RNA, 22 nt, Human
aagaauucacugguagagucaa

SEQ ID NO: 1044388 - RNA, 22 nt, Human
ucucuuucuauugcaccaugcu

SEQ ID NO: 1044389 - RNA, 23 nt, Human
uggggcugauggagacggaccag

SEQ ID NO: 1044390 - RNA, 21 nt, Human
cuugaaagguagagucuacag

SEQ ID NO: 1044391 - RNA, 22 nt, Human
uaagaaauuuaguuauagaaug

SEQ ID NO: 1044392 - RNA, 22 nt, Human
aguggcagagguugacugcagu

SEQ ID NO: 1044393 - RNA, 22 nt, Human
cagcuggccugaucccuguggc

SEQ ID NO: 1044394 - RNA, 18 nt, Human
ccuggcuuccaucuuggu

SEQ ID NO: 1044395 - RNA, 18 nt, Human
gggcacuggggacuggag

SEQ ID NO: 1044396 - RNA, 22 nt, Human
gccuugcuuugcuucuggacag

SEQ ID NO: 1044397 - RNA, 22 nt, Human
acuccuggggauccauuccuuu

SEQ ID NO: 1044398 - RNA, 20 nt, Human
aagagcugacucacaguggu

SEQ ID NO: 1044399 - RNA, 22 nt, Human
caggaugugaggaggccauuug

SEQ ID NO: 1044400 - RNA, 22 nt, Human
gugggaugcaguggugaguggc

SEQ ID NO: 1044401 - RNA, 22 nt, Human
aaaaauagcuucucuugucccu

SEQ ID NO: 1044402 - RNA, 22 nt, Human
uggccuggcugcccugucugga

SEQ ID NO: 1044403 - RNA, 17 nt, Human
gcuuccucaugcaguuc

SEQ ID NO: 1044404 - RNA, 17 nt, Human
gagaguguauuggaugc

SEQ ID NO: 1044405 - RNA, 22 nt, Human
aaaguucagauuagacucaaga

SEQ ID NO: 1044406 - RNA, 22 nt, Human
ugucccauggacacaacuucuu

SEQ ID NO: 1044407 - RNA, 22 nt, Human
auacaucucauguaagagauaa

SEQ ID NO: 1044408 - RNA, 22 nt, Human
ccaagggcucugacuugccugc

SEQ ID NO: 1044409 - RNA, 22 nt, Human
agaaaucacaggaggcagaagg

SEQ ID NO: 1044410 - RNA, 20 nt, Human
ugcagaagaacguucugguu

SEQ ID NO: 1044411 - RNA, 22 nt, Human
ucaugcccagagcaguaaauua

SEQ ID NO: 1044412 - RNA, 21 nt, Human
ucaaagcacauauuugcacau

SEQ ID NO: 1044413 - RNA, 22 nt, Human
cccaagggagugccuggucaac

SEQ ID NO: 1044414 - RNA, 22 nt, Human
uaacagaagaaaacauauugga

SEQ ID NO: 1044415 - RNA, 22 nt, Human
gggcugcuuuuuucuuagcaga

SEQ ID NO: 1044416 - RNA, 22 nt, Human
cugucagcacucuacuacagau

SEQ ID NO: 1044417 - RNA, 22 nt, Human
uccagggcugacuugggagagg

SEQ ID NO: 1044418 - RNA, 22 nt, Human
auacuuacuuuucuucagacua

SEQ ID NO: 1044419 - RNA, 22 nt, Human
agccucuggcccuagacugcuu

SEQ ID NO: 1044420 - RNA, 19 nt, Human
cugagagaugcuucacaca

SEQ ID NO: 1044421 - RNA, 23 nt, Human
agacccagagacuggcucugcuc

SEQ ID NO: 1044422 - RNA, 22 nt, Human
gucugucaucugagauggagug

SEQ ID NO: 1044423 - RNA, 22 nt, Human
ucacauuuucuacuacuguacg

SEQ ID NO: 1044424 - RNA, 22 nt, Human
agccccucuguggcucugccuc

SEQ ID NO: 1044425 - RNA, 22 nt, Human
uuugcauuuccagaguagcaga

SEQ ID NO: 1044426 - RNA, 22 nt, Human
uguaugcagcaaaacaauuagu

SEQ ID NO: 1044427 - RNA, 22 nt, Human
uggcagcauuuuuuccagaaca

SEQ ID NO: 1044428 - RNA, 21 nt, Human
aucagcaaaugccugucuccc

SEQ ID NO: 1044429 - RNA, 22 nt, Human
gggagagagagcucauguugaa

SEQ ID NO: 1044430 - RNA, 20 nt, Human
ccagcugagccaaggggaga

SEQ ID NO: 1044431 - RNA, 22 nt, Human
cagagcugacccaaggauugaa

SEQ ID NO: 1044432 - RNA, 22 nt, Human
aagagcuggauggaaucuggga

SEQ ID NO: 1044433 - RNA, 22 nt, Human
aggcaggcucaggcccaugcuu

SEQ ID NO: 1044434 - RNA, 22 nt, Human
caggguccaucuuucaucacug

SEQ ID NO: 1044435 - RNA, 22 nt, Human
cgucccaguuccagccgcgcug

SEQ ID NO: 1044436 - RNA, 22 nt, Human
caaugugugcuuacaggccagu

SEQ ID NO: 1044437 - RNA, 22 nt, Human
ugggcacaggggaauggaugaa

SEQ ID NO: 1044438 - RNA, 22 nt, Human
acacugcucacuucuucccuug

SEQ ID NO: 1044439 - RNA, 22 nt, Human
aucuggcuccuacacuugaaga

SEQ ID NO: 1044440 - RNA, 22 nt, Human
cagggcaguuuuacuucucucu

SEQ ID NO: 1044441 - RNA, 22 nt, Human
ucucagaggugcccuggcaucu

SEQ ID NO: 1044442 - RNA, 22 nt, Human
gccagguggucuggcuccagag

SEQ ID NO: 1044443 - RNA, 22 nt, Human
cagcucugaagaaaggugucua

SEQ ID NO: 1044444 - RNA, 22 nt, Human
gccugguguccagaggcgagug

SEQ ID NO: 1044445 - RNA, 22 nt, Human
aggagcuguuuuguucagcaaa

SEQ ID NO: 1044446 - RNA, 22 nt, Human
ugugcagcuaguccuggacuug

SEQ ID NO: 1044447 - RNA, 22 nt, Human
ccaagggcugcugaggugucca

SEQ ID NO: 1044448 - RNA, 22 nt, Human
agagauguucauucagcauguu

SEQ ID NO: 1044449 - RNA, 22 nt, Human
ucuuggagacucuuguauauuu

SEQ ID NO: 1044450 - RNA, 22 nt, Human
ugaugguuuuauuaauaggacc

SEQ ID NO: 1044451 - RNA, 22 nt, Human
ccuuuuucaauauagaauugca

SEQ ID NO: 1044452 - RNA, 22 nt, Human
ucagaguggugguuuugccuuc

SEQ ID NO: 1044453 - RNA, 22 nt, Human
gagguagcaugcuggaagggac

SEQ ID NO: 1044454 - RNA, 22 nt, Human
gcuguauuccugcacuguauag

SEQ ID NO: 1044455 - RNA, 22 nt, Human
ucaggagcagcaugggugagag

SEQ ID NO: 1044456 - RNA, 19 nt, Human
ucccuuccugucgggcucc

SEQ ID NO: 1044457 - RNA, 22 nt, Human
gguggagcuggaccaggagagg

SEQ ID NO: 1044458 - RNA, 22 nt, Human
uggccuggcccugaggcccugu

SEQ ID NO: 1044459 - RNA, 22 nt, Human
uggagcauauucuggagcuugg

SEQ ID NO: 1044460 - RNA, 22 nt, Human
uccuggagaauccugccaccug

SEQ ID NO: 1044461 - RNA, 20 nt, Human
auugucagccuucagaggag

SEQ ID NO: 1044462 - RNA, 22 nt, Human
gggccuggugcuucugacuccu

SEQ ID NO: 1044463 - RNA, 22 nt, Human
uccagcagcccgaaggcccauc

SEQ ID NO: 1044464 - RNA, 22 nt, Human
gcacagggcaacaggucuguua

SEQ ID NO: 1044465 - RNA, 21 nt, Human
ucuuuccugcccaguugcccu

SEQ ID NO: 1044466 - RNA, 22 nt, Human
agccacgucccugucaggguca

SEQ ID NO: 1044467 - RNA, 22 nt, Human
gccagcaguccugcugugugcc

SEQ ID NO: 1044468 - RNA, 22 nt, Human
cagucccaggguugguucagcu

SEQ ID NO: 1044469 - RNA, 22 nt, Human
gagagcugauagaugagcuacu

SEQ ID NO: 1044470 - RNA, 21 nt, Human
acagaguaguugaaacagaga

SEQ ID NO: 1044471 - RNA, 22 nt, Human
aaggcagcccuggcucagccug

SEQ ID NO: 1044472 - RNA, 18 nt, Human
uacagcuugaguugacug

SEQ ID NO: 1044473 - RNA, 22 nt, Human
uuccuggggacuuaccgucauu

SEQ ID NO: 1044474 - RNA, 21 nt, Human
gccaucaccaagcucuucccc

SEQ ID NO: 1044475 - RNA, 22 nt, Human
cugggguccuugccauguguca

SEQ ID NO: 1044476 - RNA, 22 nt, Human
ucacagcugggguuuuggcagc

SEQ ID NO: 1044477 - RNA, 22 nt, Human
gcuccugggcccugggcuaacu

SEQ ID NO: 1044478 - RNA, 22 nt, Human
auguuugaaauuguaaguauau

SEQ ID NO: 1044479 - RNA, 22 nt, Human
gcaguccuguagcgacuuuuuu

SEQ ID NO: 1044480 - RNA, 22 nt, Human
aaaacuuucagggauacagaaa

SEQ ID NO: 1044481 - RNA, 22 nt, Human
cuucuggguauuccagauaccu

SEQ ID NO: 1044482 - RNA, 18 nt, Human
ucaguccuccauagagcu

SEQ ID NO: 1044483 - RNA, 22 nt, Human
gguggcagaggugcaucagccc

SEQ ID NO: 1044484 - RNA, 22 nt, Human
ccucuuccuucucacuguggaa

SEQ ID NO: 1044485 - RNA, 22 nt, Human
cggggccuagucuaccucggca

SEQ ID NO: 1044486 - RNA, 22 nt, Human
gggcucggcaucuguggacucu

SEQ ID NO: 1044487 - RNA, 22 nt, Human
uucuccucagcaaggcagcuuu

SEQ ID NO: 1044488 - RNA, 22 nt, Human
ucuccucuauuucuguauguau

SEQ ID NO: 1044489 - RNA, 22 nt, Human
gggcuuggcuggggccaccaga

SEQ ID NO: 1044490 - RNA, 22 nt, Human
ucaccucucuggccgucuaccu

SEQ ID NO: 1044491 - RNA, 20 nt, Human
ucucuaacaugaaugcuauc

SEQ ID NO: 1044492 - RNA, 17 nt, Human
ucuccuggcucuaucag

SEQ ID NO: 1044493 - RNA, 22 nt, Human
acaguccuguacaggccauauc

SEQ ID NO: 1044494 - RNA, 20 nt, Human
uccugggguaagccaugguc

SEQ ID NO: 1044495 - RNA, 22 nt, Human
ucaccggcagacguggccugau

SEQ ID NO: 1044496 - RNA, 22 nt, Human
cagggagcuggugccagccgac

SEQ ID NO: 1044497 - RNA, 22 nt, Human
cucccagggucuaggcugcugg

SEQ ID NO: 1044498 - RNA, 22 nt, Human
ggucuccugaccuuuagucccu

SEQ ID NO: 1044499 - RNA, 22 nt, Human
auccugggaaguggccuccucc

SEQ ID NO: 1044500 - RNA, 22 nt, Human
ucuccucuccuuucauguuguu

SEQ ID NO: 1044501 - RNA, 22 nt, Human
ggcggccugugggucggccuca

SEQ ID NO: 1044502 - RNA, 22 nt, Human
cagagcagcagagcuuccaugg

SEQ ID NO: 1044503 - RNA, 19 nt, Human
uccuggggaggggcauggc

SEQ ID NO: 1044504 - RNA, 23 nt, Human
uugguuacuggauuugaggggcc

SEQ ID NO: 1044505 - RNA, 22 nt, Human
cauuuuacgacauagggcaggc

SEQ ID NO: 1044506 - RNA, 22 nt, Human
cacagcuucuccccgcugcggc

SEQ ID NO: 1044507 - RNA, 22 nt, Human
gcagggcugauggcuucccuca

SEQ ID NO: 1044508 - RNA, 22 nt, Human
cugggagggguagccaauccua

SEQ ID NO: 1044509 - RNA, 22 nt, Human
gcaguccuuaggagaggaagua

SEQ ID NO: 1044510 - RNA, 22 nt, Human
ccuccugggccuugcucuguga

SEQ ID NO: 1044511 - RNA, 23 nt, Human
agaagcagcuucuggaguaucgg

SEQ ID NO: 1044512 - RNA, 22 nt, Human
auagucuuagaaucuugagugu

SEQ ID NO: 1044513 - RNA, 22 nt, Human
ucaguccuuaucugguguucag

SEQ ID NO: 1044514 - RNA, 22 nt, Human
ucccggcgcugggagguggguc

SEQ ID NO: 1044515 - RNA, 19 nt, Human
ugggcuuccccagggcaga

SEQ ID NO: 1044516 - RNA, 21 nt, Human
uuccuccucuggagaagaaga

SEQ ID NO: 1044517 - RNA, 22 nt, Human
cccagccuuugcuuccugguuc

SEQ ID NO: 1044518 - RNA, 22 nt, Human
gugccuccaggcucgacuaguc

SEQ ID NO: 1044519 - RNA, 22 nt, Human
auccuggguaaguuccuuuuaa

SEQ ID NO: 1044520 - RNA, 20 nt, Human
guccugggagccacagcaca

SEQ ID NO: 1044521 - RNA, 22 nt, Human
agccuuacauaaacagccuuau

SEQ ID NO: 1044522 - RNA, 22 nt, Human
cucucuccuuagcugcagacca

SEQ ID NO: 1044523 - RNA, 22 nt, Human
gucuccuuguggaucucaagga

SEQ ID NO: 1044524 - RNA, 22 nt, Human
ucacuagugguuucuggugguu

SEQ ID NO: 1044525 - RNA, 19 nt, Human
gggccucacccacaccucc

SEQ ID NO: 1044526 - RNA, 22 nt, Human
agccagucggggccaugcuggg

SEQ ID NO: 1044527 - RNA, 22 nt, Human
ucuccuggcauuugguugagua

SEQ ID NO: 1044528 - RNA, 22 nt, Human
ccucagucuauuuccagcaggu

SEQ ID NO: 1044529 - RNA, 17 nt, Human
gcaggcacugcugccug

SEQ ID NO: 1044530 - RNA, 22 nt, Human
gccuggggaacuugauccuguc

SEQ ID NO: 1044531 - RNA, 22 nt, Human
ugguuacccagucgcuggaguu

SEQ ID NO: 1044532 - RNA, 22 nt, Human
ucccagucuagagccggauugg

SEQ ID NO: 1044533 - RNA, 22 nt, Human
ccuggggaccugccucagcccu

SEQ ID NO: 1044534 - RNA, 20 nt, Human
cucuuuucacucucaguggu

SEQ ID NO: 1044535 - RNA, 20 nt, Human
agcuuugguuaagccagugg

SEQ ID NO: 1044536 - RNA, 22 nt, Human
cagggcucgcucgcucgcucgc

SEQ ID NO: 1044537 - RNA, 22 nt, Human
acuccuggguuccggagauucu

SEQ ID NO: 1044538 - RNA, 18 nt, Human
uucggcagauacgcuugg

SEQ ID NO: 1044539 - RNA, 22 nt, Human
ccuguacuuguauuaaaggucc

SEQ ID NO: 1044540 - RNA, 22 nt, Human
uccuggggaggucgaggcugag

SEQ ID NO: 1044541 - RNA, 22 nt, Human
guccuggggauuauagaguguu

SEQ ID NO: 1044542 - RNA, 21 nt, Human
ccuguggugccagaucgccag

SEQ ID NO: 1044543 - RNA, 22 nt, Human
uguuggcagugcuacagucagu

SEQ ID NO: 1044544 - RNA, 22 nt, Human
aguggcaguagaugagcugguu

SEQ ID NO: 1044545 - RNA, 19 nt, Human
uggcagcauugguaccuug

SEQ ID NO: 1044546 - RNA, 22 nt, Human
aguuuacccacuguugaaauua

SEQ ID NO: 1044547 - RNA, 21 nt, Human
uccuccuguagaggguccugg

SEQ ID NO: 1044548 - RNA, 21 nt, Human
gcuccuggugcugcguggcgc

SEQ ID NO: 1044549 - RNA, 22 nt, Murray Valley encephalitis virus
ugcucauuuuuacgcuugccac

SEQ ID NO: 1044550 - RNA, 22 nt, Murray Valley encephalitis virus
acagcuuggaugguguugcgag

SEQ ID NO: 1044551 - RNA, 22 nt, Murray Valley encephalitis virus
ggggauauucgugcucuuccaa

SEQ ID NO: 1044552 - RNA, 22 nt, Murray Valley encephalitis virus
gggaggcuuuccaaccguggag

SEQ ID NO: 1044553 - RNA, 22 nt, Murray Valley encephalitis virus
uccauuguuggcagggacuccu

SEQ ID NO: 1044554 - RNA, 22 nt, Murray Valley encephalitis virus
uccauuguuggcagggacuccu

SEQ ID NO: 1044555 - RNA, 22 nt, Murray Valley encephalitis virus
gggaggcuuuccaaccguggag

SEQ ID NO: 1044556 - RNA, 22 nt, Human
uagcaauagaaacauauaaagu

SEQ ID NO: 1044557 - RNA, 22 nt, Human
ucugugcauuguaacaacuaaa

SEQ ID NO: 1044558 - RNA, 22 nt, Human
aaguaugaaucaaagacuaucu

SEQ ID NO: 1044559 - RNA, 22 nt, Human
ucuagaauuuugccauauagcu

SEQ ID NO: 1044560 - RNA, 22 nt, Human
acauuuagaguucuuuacucca

SEQ ID NO: 1044561 - RNA, 22 nt, Human
ugucagaugcgauaaacuagug

SEQ ID NO: 1044562 - RNA, 22 nt, Human
auuuagcaaaaaaugaugaagc

SEQ ID NO: 1044563 - RNA, 22 nt, Human
aaucuucauuuugacaagauuc

SEQ ID NO: 1044564 - RNA, 22 nt, Human
gaauaguucuauggcugcaggg

SEQ ID NO: 1044565 - RNA, 22 nt, Human
agucuacaaucuuaaaugaacu

SEQ ID NO: 1044566 - RNA, 22 nt, Human
aauguauggauucaugucugug

SEQ ID NO: 1044567 - RNA, 22 nt, Human
aauuaugagguagauaucacau

SEQ ID NO: 1044568 - RNA, 22 nt, Human
aguaugaauugcuuugccugua

SEQ ID NO: 1044569 - RNA, 21 nt, Human
augugaaaccuuccacgcuga

SEQ ID NO: 1044570 - RNA, 22 nt, Human
gcauaugaucacgugugucggu

SEQ ID NO: 1044571 - RNA, 20 nt, Human
ucugugcaccugcuacaagg

SEQ ID NO: 1044572 - RNA, 22 nt, Human
aauaacuucaguucuuacauua

SEQ ID NO: 1044573 - RNA, 22 nt, Human
uaugaaaugguaguaggaaggg

SEQ ID NO: 1044574 - RNA, 22 nt, Human
uauacaaugaguacauucuggg

SEQ ID NO: 1044575 - RNA, 22 nt, Human
cagcauuuucuuaauguaggug

SEQ ID NO: 1044576 - RNA, 22 nt, Human
aagcacauuguacauuugugcu

SEQ ID NO: 1044577 - RNA, 22 nt, Human
aaacacagauuucuuuguccca

SEQ ID NO: 1044578 - RNA, 22 nt, Human
auauucuuccaaaacaucauuu

SEQ ID NO: 1044579 - RNA, 22 nt, Human
aauugcaacagguagacuuuuc

SEQ ID NO: 1044580 - RNA, 22 nt, Human
uucauacacgaaaaugcaugca

SEQ ID NO: 1044581 - RNA, 22 nt, Human
ugugaaaagcguguguucuagg

SEQ ID NO: 1044582 - RNA, 22 nt, Human
gaacacauuucucugacuguag

SEQ ID NO: 1044583 - RNA, 22 nt, Human
caaauaguaugagcaaugauuc

SEQ ID NO: 1044584 - RNA, 22 nt, Human
uucugucuguaaacuucucaau

SEQ ID NO: 1044585 - RNA, 22 nt, Human
uaacacauuuuccucauacgga

SEQ ID NO: 1044586 - RNA, 22 nt, Human
uuucugaagauacagcuuugcu

SEQ ID NO: 1044587 - RNA, 22 nt, Human
auacacauauguguguauaugu

SEQ ID NO: 1044588 - RNA, 22 nt, Human
uaacuuucacaucacacugacu

SEQ ID NO: 1044589 - RNA, 22 nt, Human
auauaauuguucugaaguguuu

SEQ ID NO: 1044590 - RNA, 22 nt, Human
auauacuuggagacuaucauug

SEQ ID NO: 1044591 - RNA, 22 nt, Human
aucacauugccagugauuaccc

SEQ ID NO: 1044592 - RNA, 22 nt, Human
aguaugaagaauacauagauga

SEQ ID NO: 1044593 - RNA, 22 nt, Human
auguuugacugaguuuggcaga

SEQ ID NO: 1044594 - RNA, 22 nt, Human
augaaacagugaauuagucaag

SEQ ID NO: 1044595 - RNA, 22 nt, Human
aauacugccugugagguaacuc

SEQ ID NO: 1044596 - RNA, 22 nt, Human
aaauauagcaauuaugccuacu

SEQ ID NO: 1044597 - RNA, 22 nt, Human
uguaugaaagaacaagggcuua

SEQ ID NO: 1044598 - RNA, 22 nt, Human
acauacuuaugcuaaaaauaua

SEQ ID NO: 1044599 - RNA, 22 nt, Human
uguaugaaaaggaauagauuga

SEQ ID NO: 1044600 - RNA, 22 nt, Human
uucugucacagugcugguauca

SEQ ID NO: 1044601 - RNA, 22 nt, Human
uaacacauuuuaagccauuuua

SEQ ID NO: 1044602 - RNA, 22 nt, Human
gaacacauguccuccuuggauu

SEQ ID NO: 1044603 - RNA, 22 nt, Human
uuucaaacauagaucugaauau

SEQ ID NO: 1044604 - RNA, 22 nt, Human
gagcauuuuugucugcauuuua

SEQ ID NO: 1044605 - RNA, 22 nt, Human
uauauguaagcuauguaagagu

SEQ ID NO: 1044606 - RNA, 22 nt, Human
caacacauugaagcuaugauga

SEQ ID NO: 1044607 - RNA, 22 nt, Human
gugauaaagacgugucauaauu

SEQ ID NO: 1044608 - RNA, 22 nt, Human
uaauaucuggcauucaaacaug

SEQ ID NO: 1044609 - RNA, 21 nt, Human
auaaaguuuuacaggaaugca

SEQ ID NO: 1044610 - RNA, 22 nt, Human
uguuuauuacaguucuuggaau

SEQ ID NO: 1044611 - RNA, 22 nt, Human
uguucauaucauuuugaaagcu

SEQ ID NO: 1044612 - RNA, 22 nt, Human
gaacacaugauuauaaaugcua

SEQ ID NO: 1044613 - RNA, 22 nt, Human
auaacuuucuucacccuugcug

SEQ ID NO: 1044614 - RNA, 22 nt, Human
uugaauuauaagugugucuacu

SEQ ID NO: 1044615 - RNA, 22 nt, Human
ugaaagauugugauucaauaug

SEQ ID NO: 1044616 - RNA, 22 nt, Human
gaauacauuggaaaucagaaua

SEQ ID NO: 1044617 - RNA, 22 nt, Human
guuuuccugaaacugauggugu

SEQ ID NO: 1044618 - RNA, 22 nt, Human
uuucugaacaaagccauuauca

SEQ ID NO: 1044619 - RNA, 22 nt, Human
cuacaaugacagaauugaguag

SEQ ID NO: 1044620 - RNA, 22 nt, Human
ucugaaauagaagugucuuucu

SEQ ID NO: 1044621 - RNA, 22 nt, Human
aguaugaauacagauuuucucu

SEQ ID NO: 1044622 - RNA, 22 nt, Human
cucauaaugugacuguauuuga

SEQ ID NO: 1044623 - RNA, 22 nt, Human
aaguuucaaauguugauuaugc

SEQ ID NO: 1044624 - RNA, 22 nt, Human
aauacuuuccuauauaaggugc

SEQ ID NO: 1044625 - RNA, 22 nt, Human
cauaauuucacugucguauggc

SEQ ID NO: 1044626 - RNA, 22 nt, Human
uguaugaagguuuaccugcugu

SEQ ID NO: 1044627 - RNA, 22 nt, Human
aauaacuuuuaaaagacccugg

SEQ ID NO: 1044628 - RNA, 22 nt, Human
agauuuauguggucacacucag

SEQ ID NO: 1044629 - RNA, 22 nt, Human
auucucaauggcuacuuucaua

SEQ ID NO: 1044630 - RNA, 22 nt, Human
aaaguuuguugcuuacaaagaa

SEQ ID NO: 1044631 - RNA, 19 nt, Human
uugaaauuguuugauaugg

SEQ ID NO: 1044632 - RNA, 21 nt, Human
augugaaauaucaucagagca

SEQ ID NO: 1044633 - RNA, 22 nt, Human
uuucauugaugggugauagaaa

SEQ ID NO: 1044634 - RNA, 22 nt, Human
uguauaaacuuaagcaggaacc

SEQ ID NO: 1044635 - RNA, 22 nt, Human
uuucauaaccucaagcuacagu

SEQ ID NO: 1044636 - RNA, 22 nt, Human
aacuacauuguccuuucugaag

SEQ ID NO: 1044637 - RNA, 22 nt, Human
gauucacucauauuuuacguuu

SEQ ID NO: 1044638 - RNA, 22 nt, Human
agaauaugaucggaauacagau

SEQ ID NO: 1044639 - RNA, 22 nt, Human
auucugucuaagcuggcuacgu

SEQ ID NO: 1044640 - RNA, 22 nt, Human
cuagguauucauguuucguggc

SEQ ID NO: 1044641 - RNA, 22 nt, Human
uucugucagaagcuagcuccug

SEQ ID NO: 1044642 - RNA, 22 nt, Human
uuucacaaucaaauggugaaau

SEQ ID NO: 1044643 - RNA, 22 nt, Human
uguaugaaguuacugagccucu

SEQ ID NO: 1044644 - RNA, 22 nt, Human
gugcuaaaggguuaugaacaag

SEQ ID NO: 1044645 - RNA, 22 nt, Human
uacauguauguguacgugcaug

SEQ ID NO: 1044646 - RNA, 22 nt, Human
uucugucagcgucagaaauucu

SEQ ID NO: 1044647 - RNA, 22 nt, Human
aucugcuugaguuugaagucag

SEQ ID NO: 1044648 - RNA, 22 nt, Human
cauuuacacuucuaaccacaag

SEQ ID NO: 1044649 - RNA, 22 nt, Human
ucugcucuguggcuucagcuaa

SEQ ID NO: 1044650 - RNA, 21 nt, Human
auucugucaucccagcuacuu

SEQ ID NO: 1044651 - RNA, 22 nt, Human
uuggaaagauuauuauuaugaa

SEQ ID NO: 1044652 - RNA, 22 nt, Human
uacauauguaaacauguauaaa

SEQ ID NO: 1044653 - RNA, 22 nt, Human
auaugagaguaaaugccgaucu

SEQ ID NO: 1044654 - RNA, 22 nt, Human
uucugucacuuaggaggucaua

SEQ ID NO: 1044655 - RNA, 22 nt, Human
uguaggaauguuuuuaaguugg

SEQ ID NO: 1044656 - RNA, 22 nt, Human
aauacauauggaauuccauguu

SEQ ID NO: 1044657 - RNA, 22 nt, Human
gagcauuugguuauaguaauuu

SEQ ID NO: 1044658 - RNA, 22 nt, Human
uagacauuucugguuauugaca

SEQ ID NO: 1044659 - RNA, 22 nt, Human
uagaaacaaugacaugcuugua

SEQ ID NO: 1044660 - RNA, 22 nt, Human
aucugcuuuugagaauuuacuu

SEQ ID NO: 1044661 - RNA, 22 nt, Human
ugcuacaauucacaucuggaua

SEQ ID NO: 1044662 - RNA, 22 nt, Human
gaacaucagucauaauuuaacg

SEQ ID NO: 1044663 - RNA, 22 nt, Human
aaugucauugguaaagauuagg

SEQ ID NO: 1044664 - RNA, 22 nt, Human
augcuacagaguuugaauaugu

SEQ ID NO: 1044665 - RNA, 22 nt, Human
uuagaacuuaagaauacugucu

SEQ ID NO: 1044666 - RNA, 22 nt, Human
cucugaaagaguuuaguauuau

SEQ ID NO: 1044667 - RNA, 22 nt, Human
uacaaaugaguuguaugaacca

SEQ ID NO: 1044668 - RNA, 21 nt, Human
ucuagaauccuguauaagacu

SEQ ID NO: 1044669 - RNA, 22 nt, Human
auacuucuuugauguucacagg

SEQ ID NO: 1044670 - RNA, 22 nt, Human
cuguaugaguugggaauagaau

SEQ ID NO: 1044671 - RNA, 22 nt, Human
uaacacauaagcugagaccaug

SEQ ID NO: 1044672 - RNA, 22 nt, Human
auucugucuuuuuauacaucua

SEQ ID NO: 1044673 - RNA, 22 nt, Human
auuuugcuggucugaauuacuu

SEQ ID NO: 1044674 - RNA, 22 nt, Human
aucugucaggagcaaggacuac

SEQ ID NO: 1044675 - RNA, 22 nt, Human
augucaaacacaacaccagugg

SEQ ID NO: 1044676 - RNA, 22 nt, Human
gauauguauugaaugaucauuu

SEQ ID NO: 1044677 - RNA, 22 nt, Human
augcuacagcaucucucaucag

SEQ ID NO: 1044678 - RNA, 22 nt, Human
uucugucauuuagcauugucau

SEQ ID NO: 1044679 - RNA, 22 nt, Human
uauacaauggcugaaucaucca

SEQ ID NO: 1044680 - RNA, 22 nt, Human
uauguacuaacuuucauucuag

SEQ ID NO: 1044681 - RNA, 22 nt, Human
aaauaguuacuucugcugucuu

SEQ ID NO: 1044682 - RNA, 22 nt, Human
auaaaguuuaaaagucaauagu

SEQ ID NO: 1044683 - RNA, 22 nt, Human
uaucaauugggccaaaugguac

SEQ ID NO: 1044684 - RNA, 20 nt, Human
uuaucugucaaucugucuca

SEQ ID NO: 1044685 - RNA, 22 nt, Human
uggaaauacuugccauaaaacu

SEQ ID NO: 1044686 - RNA, 22 nt, Human
uguaugaaccuuuaauauagug

SEQ ID NO: 1044687 - RNA, 22 nt, Human
uaugacauuggccaaguucugu

SEQ ID NO: 1044688 - RNA, 22 nt, Human
auuacucugucugccucugacc

SEQ ID NO: 1044689 - RNA, 16 nt, Human
uguaugaacgucucca

SEQ ID NO: 1044690 - RNA, 22 nt, Human
aaaaguauuuauggcuauguaa

SEQ ID NO: 1044691 - RNA, 22 nt, Human
gaaaacuauuggccuagaacaa

SEQ ID NO: 1044692 - RNA, 20 nt, Human
aauuuacucacagaaugaau

SEQ ID NO: 1044693 - RNA, 22 nt, Human
auaucauuauguuaugagcaca

SEQ ID NO: 1044694 - RNA, 22 nt, Human
uuaacacaucccugcucuaccc

SEQ ID NO: 1044695 - RNA, 22 nt, Human
cagcauuuaaugcagugcuucc

SEQ ID NO: 1044696 - RNA, 22 nt, Human
aaaaauaggucaaccguguaug

SEQ ID NO: 1044697 - RNA, 22 nt, Human
auguauuucuauguagugaaga

SEQ ID NO: 1044698 - RNA, 22 nt, Human
caauaguucgguccugaaggcc

SEQ ID NO: 1044699 - RNA, 22 nt, Human
uuucacaagacagcuacuguug

SEQ ID NO: 1044700 - RNA, 22 nt, Human
uuuucuuauggugaagcacaaa

SEQ ID NO: 1044701 - RNA, 19 nt, Human
acauuuagaauguacuugc

SEQ ID NO: 1044702 - RNA, 22 nt, Human
uuaacacauauuuaucaauugc

SEQ ID NO: 1044703 - RNA, 22 nt, Human
uacaaaguaauguauaauaucg

SEQ ID NO: 1044704 - RNA, 18 nt, Human
ugucauaauauaucaccu

SEQ ID NO: 1044705 - RNA, 22 nt, Human
agcuagaaguacagccauauga

SEQ ID NO: 1044706 - RNA, 22 nt, Human
guuguuuuuguucucuauagcu

SEQ ID NO: 1044707 - RNA, 17 nt, Human
ugaauucaaucugcacu

SEQ ID NO: 1044708 - RNA, 22 nt, Human
aauacugucuuucacagauauu

SEQ ID NO: 1044709 - RNA, 22 nt, Human
aauaucuucuaaggauagaacu

SEQ ID NO: 1044710 - RNA, 22 nt, Human
uaacuuucuucauaugugaacc

SEQ ID NO: 1044711 - RNA, 22 nt, Human
auguaaacaagguuauugucca

SEQ ID NO: 1044712 - RNA, 22 nt, Human
agauaugugcgucuuagauuga

SEQ ID NO: 1044713 - RNA, 22 nt, Human
uaucaauacauguuaucagugu

SEQ ID NO: 1044714 - RNA, 22 nt, Human
aaaguuugcaauuuauguuaau

SEQ ID NO: 1044715 - RNA, 22 nt, Human
auguaugauauuuccaguauca

SEQ ID NO: 1044716 - RNA, 22 nt, Human
aguaugaaaguuaaucaauuua

SEQ ID NO: 1044717 - RNA, 22 nt, Human
aaacacagggauauauauucca

SEQ ID NO: 1044718 - RNA, 23 nt, Human
uguaugaauaugccacaguuuaa

SEQ ID NO: 1044719 - RNA, 22 nt, Human
aauaacuucauguaacauuuaa

SEQ ID NO: 1044720 - RNA, 22 nt, Human
ugaacacauaaggcuuuccugu

SEQ ID NO: 1044721 - RNA, 22 nt, Human
acauaugauauugaggaucuca

SEQ ID NO: 1044722 - RNA, 22 nt, Human
auuucauacuaaggcucaaaaa

SEQ ID NO: 1044723 - RNA, 22 nt, Human
uaugagaaucugcaguaugcuu

SEQ ID NO: 1044724 - RNA, 22 nt, Human
uagaauucauguuacuguuagc

SEQ ID NO: 1044725 - RNA, 22 nt, Human
uagcauuuauuccagauuugga

SEQ ID NO: 1044726 - RNA, 22 nt, Human
acagauauuuggggaaagacgu

SEQ ID NO: 1044727 - RNA, 22 nt, Human
cugcucuaauaucagauagacu

SEQ ID NO: 1044728 - RNA, 22 nt, Human
augugaaauagcuggauaugaa

SEQ ID NO: 1044729 - RNA, 22 nt, Human
cacaugaagagagucuaguaau

SEQ ID NO: 1044730 - RNA, 22 nt, Human
ucauacaauucaaucucugauu

SEQ ID NO: 1044731 - RNA, 21 nt, Human
caauaaacugcacauugagac

SEQ ID NO: 1044732 - RNA, 22 nt, Human
uuuucucuuguuaauguacuga

SEQ ID NO: 1044733 - RNA, 22 nt, Human
ugugugaaggaauauauacuca

SEQ ID NO: 1044734 - RNA, 22 nt, Human
guaguuuucugaaaauuacuuu

SEQ ID NO: 1044735 - RNA, 22 nt, Human
uuuagacauggcuugcucacuu

SEQ ID NO: 1044736 - RNA, 22 nt, Human
agauauauuuaagguaauaagu

SEQ ID NO: 1044737 - RNA, 22 nt, Human
aguauaaagugguuuucagcac

SEQ ID NO: 1044738 - RNA, 22 nt, Human
aaauacauacacuguacguggc

SEQ ID NO: 1044739 - RNA, 22 nt, Human
uaugaacugugagugugauggg

SEQ ID NO: 1044740 - RNA, 22 nt, Human
augaagcugaaaaaggcauaua

SEQ ID NO: 1044741 - RNA, 22 nt, Human
acaauacuauuuucaguauccu

SEQ ID NO: 1044742 - RNA, 22 nt, Human
uaacacaugguuaguacacaau

SEQ ID NO: 1044743 - RNA, 22 nt, Human
uucaugaaacuuaacuguuggg

SEQ ID NO: 1044744 - RNA, 18 nt, Human
cucugucauaagugucau

SEQ ID NO: 1044745 - RNA, 22 nt, Human
uauaauuuggggaaaguggugu

SEQ ID NO: 1044746 - RNA, 22 nt, Human
aaauaguuguuuggaucaauaa

SEQ ID NO: 1044747 - RNA, 22 nt, Human
cauauguauuucucauaauuag

SEQ ID NO: 1044748 - RNA, 22 nt, Human
ugaaauuaugcauuguuguacc

SEQ ID NO: 1044749 - RNA, 22 nt, Human
uacauucagaagaauggacacg

SEQ ID NO: 1044750 - RNA, 23 nt, Human
ugaaacauuuaggguagaauuuc

SEQ ID NO: 1044751 - RNA, 22 nt, Human
augugaaagagguguucagugg

SEQ ID NO: 1044752 - RNA, 22 nt, Human
acaagguauccacauuaaaugu

SEQ ID NO: 1044753 - RNA, 22 nt, Human
uuagacauguuugcuaaaauga

SEQ ID NO: 1044754 - RNA, 22 nt, Human
aguuagaauauaauuauguuaa

SEQ ID NO: 1044755 - RNA, 22 nt, Human
ugucaagucucugaaugaaaug

SEQ ID NO: 1044756 - RNA, 16 nt, Human
uucugucacguacggc

SEQ ID NO: 1044757 - RNA, 22 nt, Human
agaauccucuucaguaaauucu

SEQ ID NO: 1044758 - RNA, 22 nt, Human
acagauauaaacuauaguagug

SEQ ID NO: 1044759 - RNA, 22 nt, Human
cauucacaucuuguuccaucac

SEQ ID NO: 1044760 - RNA, 19 nt, Human
cccucuugcacaaagcaaa

SEQ ID NO: 1044761 - RNA, 22 nt, Human
acuucacagaaauuuuaugagg

SEQ ID NO: 1044762 - RNA, 22 nt, Human
uuguauuucuccacuuucuguu

SEQ ID NO: 1044763 - RNA, 22 nt, Human
agaaucucuacucaaguacuug

SEQ ID NO: 1044764 - RNA, 22 nt, Human
aagauauagauaaaacuaugca

SEQ ID NO: 1044765 - RNA, 22 nt, Human
gaaagauauuuauuggcaacag

SEQ ID NO: 1044766 - RNA, 22 nt, Human
uaguauuuaaucacuuuugucu

SEQ ID NO: 1044767 - RNA, 22 nt, Human
ucauaaaugcagugucauaaau

SEQ ID NO: 1044768 - RNA, 22 nt, Human
cuuuggaauauuuuauugagaa

SEQ ID NO: 1044769 - RNA, 22 nt, Human
uaaucuguauuccuacuuugca

SEQ ID NO: 1044770 - RNA, 20 nt, Human
uucugucagauuauauggga

SEQ ID NO: 1044771 - RNA, 22 nt, Human
gaacacaucacauuuuacagug

SEQ ID NO: 1044772 - RNA, 22 nt, Human
guaugaaaauuguaaaguucuu

SEQ ID NO: 1044773 - RNA, 22 nt, Human
aaaguuugaaugauauauuagu

SEQ ID NO: 1044774 - RNA, 22 nt, Human
uucugucaaaugccaguagaga

SEQ ID NO: 1044775 - RNA, 22 nt, Human
caaaguuuuaguaaacauauau

SEQ ID NO: 1044776 - RNA, 22 nt, Human
ucacaauauuuaucuuccaauu

SEQ ID NO: 1044777 - RNA, 22 nt, Human
uaacacaugucugggaugugaa

SEQ ID NO: 1044778 - RNA, 22 nt, Human
auaaucuuucuuuuccagauag

SEQ ID NO: 1044779 - RNA, 22 nt, Human
aaguuucaugauguaauuauug

SEQ ID NO: 1044780 - RNA, 22 nt, Human
uauaaaguuucgaaagauguau

SEQ ID NO: 1044781 - RNA, 22 nt, Human
aaacacauuuuaggaaaaucua

SEQ ID NO: 1044782 - RNA, 22 nt, Human
ugagaauuuucaguuucacuuu

SEQ ID NO: 1044783 - RNA, 22 nt, Human
uuugauaagagcugcugaaacu

SEQ ID NO: 1044784 - RNA, 22 nt, Human
aaauacauaaagguuguaccag

SEQ ID NO: 1044785 - RNA, 23 nt, Human
auguaucucauccaaggaagcuc

SEQ ID NO: 1044786 - RNA, 22 nt, Human
agcauucauugcuagaauguaa

SEQ ID NO: 1044787 - RNA, 22 nt, Human
auguagaaaguucauagaugcg

SEQ ID NO: 1044788 - RNA, 22 nt, Human
uguacaaagguacuuugauguu

SEQ ID NO: 1044789 - RNA, 22 nt, Human
acauuuagcuguacaaucuaug

SEQ ID NO: 1044790 - RNA, 22 nt, Human
uagaacauaagucauucauuug

SEQ ID NO: 1044791 - RNA, 22 nt, Human
uucacaauggcaaaccauuaaa

SEQ ID NO: 1044792 - RNA, 22 nt, Human
uuucauaauauccagagauuuu

SEQ ID NO: 1044793 - RNA, 22 nt, Human
guguaugagccuccagcugggc

SEQ ID NO: 1044794 - RNA, 22 nt, Human
agucagugaaaacuagaauguu

SEQ ID NO: 1044795 - RNA, 22 nt, Human
acauauuuugaaagcuuucuaa

SEQ ID NO: 1044796 - RNA, 22 nt, Human
uuaucauugucgcagucuaauu

SEQ ID NO: 1044797 - RNA, 23 nt, Human
uagaaugucauucaaugauaugg

SEQ ID NO: 1044798 - RNA, 22 nt, Human
aucugcuuccugggcuccauga

SEQ ID NO: 1044799 - RNA, 22 nt, Human
uaugaccuuaggaagcaagaag

SEQ ID NO: 1044800 - RNA, 22 nt, Human
aaucuucagugucuaaaaagca

SEQ ID NO: 1044801 - RNA, 22 nt, Human
auucacaguuuccucauauucu

SEQ ID NO: 1044802 - RNA, 22 nt, Human
uuucucuugcgauaugcuacac

SEQ ID NO: 1044803 - RNA, 22 nt, Human
auguuagaaucucugaaugugg

SEQ ID NO: 1044804 - RNA, 20 nt, Human
uuucacaaugaacaugucuc

SEQ ID NO: 1044805 - RNA, 22 nt, Human
aguuagaaaguaaaucauuuga

SEQ ID NO: 1044806 - RNA, 22 nt, Human
aucaaauauaauaauuuucgcu

SEQ ID NO: 1044807 - RNA, 22 nt, Human
ucaguuaacaacuauuuauuga

SEQ ID NO: 1044808 - RNA, 22 nt, Human
aaauauguauggaguucaugaa

SEQ ID NO: 1044809 - RNA, 22 nt, Human
cucugucaggcugcagaugcuc

SEQ ID NO: 1044810 - RNA, 22 nt, Human
uaugaacuguaacccucaccgc

SEQ ID NO: 1044811 - RNA, 22 nt, Human
aauguaugugauuauuccucua

SEQ ID NO: 1044812 - RNA, 22 nt, Human
acaaaguuugugguauuccaag

SEQ ID NO: 1044813 - RNA, 19 nt, Human
auguaugaggucuucugcu

SEQ ID NO: 1044814 - RNA, 22 nt, Human
acaagauagcuuagaagauuca

SEQ ID NO: 1044815 - RNA, 22 nt, Human
uucugucaaacucacaggccga

SEQ ID NO: 1044816 - RNA, 22 nt, Human
uuucacacugcagcaucagaga

SEQ ID NO: 1044817 - RNA, 22 nt, Human
auugcuuaucuaucuuuaaguc

SEQ ID NO: 1044818 - RNA, 22 nt, Human
ugaaacuucuaauaugaauagu

SEQ ID NO: 1044819 - RNA, 22 nt, Human
aaaguuagacagcaucauuucu

SEQ ID NO: 1044820 - RNA, 21 nt, Human
acauucacaggauauuaucau

SEQ ID NO: 1044821 - RNA, 22 nt, Human
cauaauuuuuuuaagucagaac

SEQ ID NO: 1044822 - RNA, 22 nt, Human
ucuucuuaugugccauuaucuc

SEQ ID NO: 1044823 - RNA, 22 nt, Human
uagcauuaucugucuuaucauu

SEQ ID NO: 1044824 - RNA, 22 nt, Human
uucugucaugcucauguaauug

SEQ ID NO: 1044825 - RNA, 22 nt, Human
augcugucgaaaccaaacaucu

SEQ ID NO: 1044826 - RNA, 20 nt, Human
aguguacagacacuagaaau

SEQ ID NO: 1044827 - RNA, 22 nt, Human
cagcauuuggaggagaggcuuu

SEQ ID NO: 1044828 - RNA, 22 nt, Human
uaauaguugugacuuuguaaag

SEQ ID NO: 1044829 - RNA, 22 nt, Human
aaaguucuaaaacucuuuguga

SEQ ID NO: 1044830 - RNA, 22 nt, Human
uaacacauagauauuuuaacuu

SEQ ID NO: 1044831 - RNA, 19 nt, Human
ugcuagaaauucugugacu

SEQ ID NO: 1044832 - RNA, 22 nt, Human
cuauugaauuaacuauuaaagu

SEQ ID NO: 1044833 - RNA, 22 nt, Human
cauaauuugugguaguggggga

SEQ ID NO: 1044834 - RNA, 20 nt, Human
auaaaauaacugccacaaga

SEQ ID NO: 1044835 - RNA, 22 nt, Human
acaauauuguacccagaaguuu

SEQ ID NO: 1044836 - RNA, 22 nt, Human
uuucugaaaucucuuuugagga

SEQ ID NO: 1044837 - RNA, 22 nt, Human
cuaucauuuuacaugguuggug

SEQ ID NO: 1044838 - RNA, 22 nt, Human
uaauacuguauacugcaaauuu

SEQ ID NO: 1044839 - RNA, 22 nt, Human
auaugugaaugauaucacuuug

SEQ ID NO: 1044840 - RNA, 22 nt, Human
cucugauuuccuuauucuguca

SEQ ID NO: 1044841 - RNA, 22 nt, Human
gaaacauacgauuuaggagaaa

SEQ ID NO: 1044842 - RNA, 22 nt, Human
aaacacauuagcccuguggaaa

SEQ ID NO: 1044843 - RNA, 22 nt, Human
uauucacaguugauuuacaguu

SEQ ID NO: 1044844 - RNA, 22 nt, Human
auguagaagcugacagugcugu

SEQ ID NO: 1044845 - RNA, 22 nt, Human
gaaacauauuaauccagugaaa

SEQ ID NO: 1044846 - RNA, 23 nt, Human
aaaguuugaagcaacaguaguug

SEQ ID NO: 1044847 - RNA, 22 nt, Human
aauguaugugcaucauuuacau

SEQ ID NO: 1044848 - RNA, 19 nt, Human
auauauguauacaaugugg

SEQ ID NO: 1044849 - RNA, 22 nt, Human
ugcuagaauuagguuaaacaaa

SEQ ID NO: 1044850 - RNA, 22 nt, Human
ugugaaauauuuauauacucaa

SEQ ID NO: 1044851 - RNA, 20 nt, Human
uaguauuugcauaaggauag

SEQ ID NO: 1044852 - RNA, 22 nt, Human
ugcuauaaguagacauucaaca

SEQ ID NO: 1044853 - RNA, 22 nt, Human
gaaacaauuuuuguugucuaag

SEQ ID NO: 1044854 - RNA, 22 nt, Human
uagcauuucccaaaugcauuug

SEQ ID NO: 1044855 - RNA, 22 nt, Human
agaauccuguuuuacuucauca

SEQ ID NO: 1044856 - RNA, 22 nt, Human
auccugucaucauaguacuuga

SEQ ID NO: 1044857 - RNA, 22 nt, Human
uaaucuguguaccuucaucgga

SEQ ID NO: 1044858 - RNA, 22 nt, Human
agguaugagauaaaucaaugaa

SEQ ID NO: 1044859 - RNA, 22 nt, Human
uguaugaagacuucuucugugu

SEQ ID NO: 1044860 - RNA, 22 nt, Human
ccuacucugagcgccuccgcau

SEQ ID NO: 1044861 - RNA, 22 nt, Human
gaaacauaguugagacacugcu

SEQ ID NO: 1044862 - RNA, 22 nt, Human
uaugaacuagcugauuuaguuu

SEQ ID NO: 1044863 - RNA, 22 nt, Human
uaugaacucuggagucugagug

SEQ ID NO: 1044864 - RNA, 22 nt, Human
uagaauucaagauucaacaggc

SEQ ID NO: 1044865 - RNA, 22 nt, Human
augaaaauguacauguguauaa

SEQ ID NO: 1044866 - RNA, 22 nt, Human
gugugaaagcuuguccucugua

SEQ ID NO: 1044867 - RNA, 22 nt, Human
aaguaugugauacauguuaauu

SEQ ID NO: 1044868 - RNA, 22 nt, Human
acauuucacuguucacagcagg

SEQ ID NO: 1044869 - RNA, 22 nt, Human
auguagaagugggcauuauaga

SEQ ID NO: 1044870 - RNA, 22 nt, Human
uauggaaacuaauucauuuuuc

SEQ ID NO: 1044871 - RNA, 20 nt, Human
cuguuaaaagguaugaauuc

SEQ ID NO: 1044872 - RNA, 22 nt, Human
cagcauuuggugaucaucuuaa

SEQ ID NO: 1044873 - RNA, 22 nt, Human
cagcauuuagaauuugaagugu

SEQ ID NO: 1044874 - RNA, 22 nt, Human
augugaaaaauuucuuauuaca

SEQ ID NO: 1044875 - RNA, 22 nt, Human
uacagcauauacagaaugaaca

SEQ ID NO: 1044876 - RNA, 22 nt, Human
uaacacaugaaagcaccuucuu

SEQ ID NO: 1044877 - RNA, 22 nt, Human
gucugucacucaggggcuggag

SEQ ID NO: 1044878 - RNA, 22 nt, Human
augacacuuggugauacuuugu

SEQ ID NO: 1044879 - RNA, 22 nt, Human
uagaaacauguucuguucuguu

SEQ ID NO: 1044880 - RNA, 23 nt, Human
ucuguacaauugagaagagaaca

SEQ ID NO: 1044881 - RNA, 22 nt, Human
uguuagaaguuaaucacuaauu

SEQ ID NO: 1044882 - RNA, 22 nt, Human
uuuucauuguuacuaugagcua

SEQ ID NO: 1044883 - RNA, 23 nt, Human
ugugaaauuugaggucagugcuu

SEQ ID NO: 1044884 - RNA, 22 nt, Human
uguacuaaggcuguguagaugu

SEQ ID NO: 1044885 - RNA, 22 nt, Human
cauaauuucccaagagauugaa

SEQ ID NO: 1044886 - RNA, 22 nt, Human
auguuugaaauuguaaguauau

SEQ ID NO: 1044887 - RNA, 23 nt, Human
uuucacaaugagcauuacagaau

SEQ ID NO: 1044888 - RNA, 22 nt, Human
gugugaaaaugugcacaauaug

SEQ ID NO: 1044889 - RNA, 22 nt, Human
ugcuagaagauagcuagaagau

SEQ ID NO: 1044890 - RNA, 22 nt, Human
ugugugaaggagccacuguuca

SEQ ID NO: 1044891 - RNA, 22 nt, Human
aguaugaagauuauaauuuuuc

SEQ ID NO: 1044892 - RNA, 22 nt, Human
uguuagaaauuauuaguaauau

SEQ ID NO: 1044893 - RNA, 22 nt, Human
aauuauguagccauaugaaaca

SEQ ID NO: 1044894 - RNA, 22 nt, Human
aucaguuauuuuuaagcuauaa

SEQ ID NO: 1044895 - RNA, 22 nt, Human
guguaugaacgaaagaauggau

SEQ ID NO: 1044896 - RNA, 22 nt, Human
cagcauuuaucuuguagcagga

SEQ ID NO: 1044897 - RNA, 22 nt, Human
gguaugaaaugauuccauguua

SEQ ID NO: 1044898 - RNA, 22 nt, Human
uauguacaugauuucauuugcu

SEQ ID NO: 1044899 - RNA, 22 nt, Human
aguaugaaccuggguucuggau

SEQ ID NO: 1044900 - RNA, 20 nt, Human
auacacauucauagaaaaau

SEQ ID NO: 1044901 - RNA, 22 nt, Human
auucacagaauaguuuuaccag

SEQ ID NO: 1044902 - RNA, 22 nt, Human
aguuagaauagucagauuguag

SEQ ID NO: 1044903 - RNA, 22 nt, Human
aauucuguuacuaaugugaugu

SEQ ID NO: 1044904 - RNA, 22 nt, Human
aauuacuuaagagaaacuuuga

SEQ ID NO: 1044905 - RNA, 22 nt, Human
uacauaugaacuuuauaacuug

SEQ ID NO: 1044906 - RNA, 22 nt, Human
guguaugauuucaaauggcuag

SEQ ID NO: 1044907 - RNA, 22 nt, Human
uaugaacuuuugaugugacaug

SEQ ID NO: 1044908 - RNA, 22 nt, Human
uauuaaauuauggauuuaggag

SEQ ID NO: 1044909 - RNA, 22 nt, Human
gugaaacagaagcuccuggaau

SEQ ID NO: 1044910 - RNA, 22 nt, Human
ugugaaauucuugaaaugcaca

SEQ ID NO: 1044911 - RNA, 22 nt, Human
augaacugcaguauaaacuugg

SEQ ID NO: 1044912 - RNA, 22 nt, Human
aaaguguggucguucauuuugu

SEQ ID NO: 1044913 - RNA, 22 nt, Human
ucacaauacucacucaauggcu

SEQ ID NO: 1044914 - RNA, 22 nt, Human
cucauuaaaggaaaucaccugc

SEQ ID NO: 1044915 - RNA, 22 nt, Human
aauaauuuuagcucagaguugu

SEQ ID NO: 1044916 - RNA, 22 nt, Human
auguagaacagguuaaugacag

SEQ ID NO: 1044917 - RNA, 22 nt, Human
ugacuagaccuauaucuuuuug

SEQ ID NO: 1044918 - RNA, 22 nt, Human
aaaguuguucaguaagaaacuc

SEQ ID NO: 1044919 - RNA, 22 nt, Human
uagucaaaccucagaauacccc

SEQ ID NO: 1044920 - RNA, 21 nt, Human
gaauaguucuguggcagcagu

SEQ ID NO: 1044921 - RNA, 22 nt, Human
auguaugaagcuuuguuuggga

SEQ ID NO: 1044922 - RNA, 23 nt, Human
aaacuacauuuauaguuuuucuc

SEQ ID NO: 1044923 - RNA, 22 nt, Human
ugaccuuauuugaaaauagaga

SEQ ID NO: 1044924 - RNA, 22 nt, Human
aaguuucauuguucauguaaca

SEQ ID NO: 1044925 - RNA, 22 nt, Human
uacaaguaaauuguagauacca

SEQ ID NO: 1044926 - RNA, 22 nt, Human
ucuucauauauaaaguggaaua

SEQ ID NO: 1044927 - RNA, 18 nt, Human
cccucuugcacaaagcaa

SEQ ID NO: 1044928 - RNA, 22 nt, Human
uaugacuuauuucaucaguucu

SEQ ID NO: 1044929 - RNA, 22 nt, Human
uguauaaaccauggacagcuuu

SEQ ID NO: 1044930 - RNA, 22 nt, Human
uauguaaaaauucaucaggcug

SEQ ID NO: 1044931 - RNA, 22 nt, Human
uuagccauguugaagauuuaga

SEQ ID NO: 1044932 - RNA, 22 nt, Human
uuuuacuuaauucuuggucaug

SEQ ID NO: 1044933 - RNA, 22 nt, Human
uaauuucaauagcuugcauaau

SEQ ID NO: 1044934 - RNA, 22 nt, Human
auuacaaucgagagaaacaaau

SEQ ID NO: 1044935 - RNA, 22 nt, Human
aaaguuguaauggaagaaaugc

SEQ ID NO: 1044936 - RNA, 22 nt, Human
agguauaagaagauuauuuaua

SEQ ID NO: 1044937 - RNA, 22 nt, Human
aucucauaacucauuugaagac

SEQ ID NO: 1044938 - RNA, 23 nt, Human
auggaagucacuguuuucuuguc

SEQ ID NO: 1044939 - RNA, 22 nt, Human
aguucacauaucuguuuuauuu

SEQ ID NO: 1044940 - RNA, 22 nt, Human
acuggaaaacacuacuacaugc

SEQ ID NO: 1044941 - RNA, 22 nt, Human
auguagaauuccuucuacuuug

SEQ ID NO: 1044942 - RNA, 22 nt, Human
uuucuugacugcuuaggaaugc

SEQ ID NO: 1044943 - RNA, 22 nt, Human
auaugagaauuggaaaauauca

SEQ ID NO: 1044944 - RNA, 22 nt, Human
aucugucuugccuugcauauuu

SEQ ID NO: 1044945 - RNA, 22 nt, Human
aaaguugugaaaccgaacaugu

SEQ ID NO: 1044946 - RNA, 22 nt, Human
uacuuacagaaggaagcaauug

SEQ ID NO: 1044947 - RNA, 22 nt, Human
ucugauuagagcauucuugagu

SEQ ID NO: 1044948 - RNA, 20 nt, Human
ucuguacacucaucuucugc

SEQ ID NO: 1044949 - RNA, 22 nt, Human
ucaugaacaucucaaauaacca

SEQ ID NO: 1044950 - RNA, 22 nt, Human
aaucacaugugcucaauuuuaa

SEQ ID NO: 1044951 - RNA, 22 nt, Human
uggaaauauacaaugugucucu

SEQ ID NO: 1044952 - RNA, 22 nt, Human
ugaaaucaaugucuucugucuc

SEQ ID NO: 1044953 - RNA, 22 nt, Human
ugucuucaguaaaauacacuau

SEQ ID NO: 1044954 - RNA, 22 nt, Human
cauucacaaagcugauugaugg

SEQ ID NO: 1044955 - RNA, 22 nt, Human
uucuacaauaugaauaaugaag

SEQ ID NO: 1044956 - RNA, 22 nt, Human
uauucacaugaaaacaaauuuu

SEQ ID NO: 1044957 - RNA, 22 nt, Human
ucauauaaguuuaaaacuaucu

SEQ ID NO: 1044958 - RNA, 22 nt, Human
uacuuacacagcuguagaaggu

SEQ ID NO: 1044959 - RNA, 22 nt, Human
gaauauuuguaauuacuguuga

SEQ ID NO: 1044960 - RNA, 22 nt, Human
augcuacauuuugguuuauaaa

SEQ ID NO: 1044961 - RNA, 18 nt, Human
cauaauuuucuuucuuua

SEQ ID NO: 1044962 - RNA, 22 nt, Human
aaaaugacauuccagugauauu

SEQ ID NO: 1044963 - RNA, 20 nt, Human
uaacuuucuaugcuuucagc

SEQ ID NO: 1044964 - RNA, 22 nt, Human
uaacacauuaguucuccuagau

SEQ ID NO: 1044965 - RNA, 22 nt, Human
aaguauuucuggccugugaaag

SEQ ID NO: 1044966 - RNA, 22 nt, Human
uguauaaauuuaaauuccugcu

SEQ ID NO: 1044967 - RNA, 22 nt, Human
auuuuccucaagccucuggaag

SEQ ID NO: 1044968 - RNA, 22 nt, Human
auguagaauggugauuggcagg

SEQ ID NO: 1044969 - RNA, 22 nt, Human
auguagaaauuaggaugauagu

SEQ ID NO: 1044970 - RNA, 21 nt, Human
acagauauuucauugaacauu

SEQ ID NO: 1044971 - RNA, 20 nt, Human
uuuuccuucugaguauguug

SEQ ID NO: 1044972 - RNA, 23 nt, Human
aaauaugucugagggcaaagaau

SEQ ID NO: 1044973 - RNA, 22 nt, Human
uauggaaagcucuuuuugauug

SEQ ID NO: 1044974 - RNA, 22 nt, Human
uucugucaaagacuuuuucagg

SEQ ID NO: 1044975 - RNA, 22 nt, Human
auaucauucugauguauaucuu

SEQ ID NO: 1044976 - RNA, 22 nt, Human
ucaugaacauggaauaucuuuu

SEQ ID NO: 1044977 - RNA, 22 nt, Human
cugcucuaacugcauuaguuuu

SEQ ID NO: 1044978 - RNA, 22 nt, Human
uugugcucuguguuauuuaagg

SEQ ID NO: 1044979 - RNA, 22 nt, Human
uucugucacuuuuuuggaaucu

SEQ ID NO: 1044980 - RNA, 22 nt, Human
uuggaaaaacacgauagugguu

SEQ ID NO: 1044981 - RNA, 22 nt, Human
aaauaguuagcccugcauauau

SEQ ID NO: 1044982 - RNA, 23 nt, Human
acucacaaagcaggaucauguug

SEQ ID NO: 1044983 - RNA, 22 nt, Human
uauugaaauucuucauguccuc

SEQ ID NO: 1044984 - RNA, 22 nt, Human
uuuuccuucuagagcagauuuc

SEQ ID NO: 1044985 - RNA, 22 nt, Human
uaugacauugcuuuuuagaacu

SEQ ID NO: 1044986 - RNA, 22 nt, Human
ucacauuuucuacuacuguacg

SEQ ID NO: 1044987 - RNA, 22 nt, Human
uuagcauuucaguacacauguu

SEQ ID NO: 1044988 - RNA, 22 nt, Human
auuugcuuuuacuauguuaaaa

SEQ ID NO: 1044989 - RNA, 22 nt, Human
aguaugaacggaaggccuggga

SEQ ID NO: 1044990 - RNA, 22 nt, Human
uguuugaauuuugcuaacgugu

SEQ ID NO: 1044991 - RNA, 22 nt, Human
uaauuucaccguugcuagaaau

SEQ ID NO: 1044992 - RNA, 22 nt, Human
aguaugaagcugaaugauuuua

SEQ ID NO: 1044993 - RNA, 22 nt, Human
acaaucauuccguucacaacag

SEQ ID NO: 1044994 - RNA, 22 nt, Human
uucacacacagcuuccuauugu

SEQ ID NO: 1044995 - RNA, 23 nt, Human
aucuguucaucugacacagauuc

SEQ ID NO: 1044996 - RNA, 22 nt, Human
cuguuuaucucuaaccuguuua

SEQ ID NO: 1044997 - RNA, 22 nt, Human
uucugucucuguguuuacauua

SEQ ID NO: 1044998 - RNA, 22 nt, Human
augaacuuauuucugaacuuuu

SEQ ID NO: 1044999 - RNA, 22 nt, Human
aauguauuccucaugcaagagu

SEQ ID NO: 1045000 - RNA, 22 nt, Human
caaugaaaauuuaaguugcagc

SEQ ID NO: 1045001 - RNA, 22 nt, Human
augucaaaucaguuuuaucaga

SEQ ID NO: 1045002 - RNA, 22 nt, Human
cacagucacauaucuaugugug

SEQ ID NO: 1045003 - RNA, 22 nt, Human
caucaaauaggaauauuuggca

SEQ ID NO: 1045004 - RNA, 22 nt, Human
uucacauugugcagauuauggu

SEQ ID NO: 1045005 - RNA, 22 nt, Human
cuagaaauauuuuacagucaag

SEQ ID NO: 1045006 - RNA, 22 nt, Human
uguaugaauauguuggggaggu

SEQ ID NO: 1045007 - RNA, 22 nt, Human
aaaguucuuucucuuauuuggu

SEQ ID NO: 1045008 - RNA, 19 nt, Human
agcaacaccguuuauuucc

SEQ ID NO: 1045009 - RNA, 22 nt, Human
uuuacacaaaagauagcacacc

SEQ ID NO: 1045010 - RNA, 22 nt, Human
cauaauuucuguaucagcacca

SEQ ID NO: 1045011 - RNA, 22 nt, Human
acuuuacaagcuuauagccuag

SEQ ID NO: 1045012 - RNA, 22 nt, Human
aaaguuugagugauuugacaca

SEQ ID NO: 1045013 - RNA, 18 nt, Human
acaaaugugucacaggaa

SEQ ID NO: 1045014 - RNA, 22 nt, Human
gugaaacacccuccaaugcaca

SEQ ID NO: 1045015 - RNA, 22 nt, Human
ugucaaagccugaaucacauag

SEQ ID NO: 1045016 - RNA, 22 nt, Human
cuaauguaucauggcucucagc

SEQ ID NO: 1045017 - RNA, 22 nt, Human
aauguaugaagguuccaguuuc

SEQ ID NO: 1045018 - RNA, 22 nt, Human
uacagcauguccuuagcaaggc

SEQ ID NO: 1045019 - RNA, 22 nt, Human
cucugucagaguguugucccca

SEQ ID NO: 1045020 - RNA, 22 nt, Human
uuucuugaccacuauguugaua

SEQ ID NO: 1045021 - RNA, 22 nt, Human
cuuugaaaggaagccacacagc

SEQ ID NO: 1045022 - RNA, 22 nt, Human
aauucugugcaggcagagcuau

SEQ ID NO: 1045023 - RNA, 17 nt, Human
agguauaaaaugguagc

SEQ ID NO: 1045024 - RNA, 23 nt, Human
acaagauagggauaaaaagauaa

SEQ ID NO: 1045025 - RNA, 22 nt, Human
aacauucaaaacccaguucagu

SEQ ID NO: 1045026 - RNA, 22 nt, Human
ugucauaacuuagugacaaauc

SEQ ID NO: 1045027 - RNA, 22 nt, Human
acuauaaaaggauaaaccagaa

SEQ ID NO: 1045028 - RNA, 22 nt, Human
aaaguaguuagucaugugaaaa

SEQ ID NO: 1045029 - RNA, 22 nt, Human
uaacuacauuucacugcaauua

SEQ ID NO: 1045030 - RNA, 22 nt, Human
acugauuacacgaguucugacu

SEQ ID NO: 1045031 - RNA, 22 nt, Human
uauguacuacacuagaacauuu

SEQ ID NO: 1045032 - RNA, 22 nt, Human
uauacacaaggugugcauuugu

SEQ ID NO: 1045033 - RNA, 22 nt, Human
uguagaaccuguuuauuauaga

SEQ ID NO: 1045034 - RNA, 22 nt, Human
guuaacacaggacucucugccu

SEQ ID NO: 1045035 - RNA, 22 nt, Human
uagcauuucacugaucuucacu

SEQ ID NO: 1045036 - RNA, 22 nt, Human
agcuagaauauugaucugaaau

SEQ ID NO: 1045037 - RNA, 22 nt, Human
ucugucaauauaugugcugcag

SEQ ID NO: 1045038 - RNA, 22 nt, Human
ucuuuauugcuacugguuuguc

SEQ ID NO: 1045039 - RNA, 22 nt, Human
ucagaaagaacacaggcaguag

SEQ ID NO: 1045040 - RNA, 22 nt, Human
acaugauuuuuaaagagauaau

SEQ ID NO: 1045041 - RNA, 22 nt, Human
agguauaagucucauuucuguu

SEQ ID NO: 1045042 - RNA, 22 nt, Human
uaacacauaucuacaacaugug

SEQ ID NO: 1045043 - RNA, 22 nt, Human
uuaauacaagcauaugcacaca

SEQ ID NO: 1045044 - RNA, 22 nt, Human
cuuucauaaaggaaaugaugag

SEQ ID NO: 1045045 - RNA, 22 nt, Human
aaaguucuggggguguuucugg

SEQ ID NO: 1045046 - RNA, 22 nt, Human
uuguaauuugcaaauguauugu

SEQ ID NO: 1045047 - RNA, 22 nt, Human
aauguaugacaguucuaguggu

SEQ ID NO: 1045048 - RNA, 22 nt, Human
uuuucguuuauuugacauguaa

SEQ ID NO: 1045049 - RNA, 22 nt, Human
guuaugaaauaaauauagauca

SEQ ID NO: 1045050 - RNA, 22 nt, Human
uguaggaaaaacaaugaucugc

SEQ ID NO: 1045051 - RNA, 22 nt, Human
uguaugaagccagaaucuguuu

SEQ ID NO: 1045052 - RNA, 22 nt, Human
aaguaugacauuuaagacaauu

SEQ ID NO: 1045053 - RNA, 21 nt, Human
uuucugaaggcaacaucuauc

SEQ ID NO: 1045054 - RNA, 22 nt, Human
uuucauugucuacauaugacau

SEQ ID NO: 1045055 - RNA, 22 nt, Human
uuucaaacuuuacucuugaauc

SEQ ID NO: 1045056 - RNA, 22 nt, Human
uagauauguguuuauuaugcug

SEQ ID NO: 1045057 - RNA, 22 nt, Human
aaaguucuggcauuuucugucu

SEQ ID NO: 1045058 - RNA, 22 nt, Human
cuagaauugcauucuaugaaua

SEQ ID NO: 1045059 - RNA, 22 nt, Human
uugauacaggccuucuagauga

SEQ ID NO: 1045060 - RNA, 22 nt, Human
aauugcaauuuucuuaaggucu

SEQ ID NO: 1045061 - RNA, 22 nt, Human
ugcuagaaaucugaaacuagca

SEQ ID NO: 1045062 - RNA, 22 nt, Human
uaugaaacauucauacaaauaa

SEQ ID NO: 1045063 - RNA, 22 nt, Human
uauugacaauuugugaaacuau

SEQ ID NO: 1045064 - RNA, 23 nt, Human
uuuuccuguggagacaugacugg

SEQ ID NO: 1045065 - RNA, 22 nt, Human
auaacuuagaguaggcaaaagu

SEQ ID NO: 1045066 - RNA, 22 nt, Human
aucauuuuuaagagacucuucu

SEQ ID NO: 1045067 - RNA, 22 nt, Human
aucugucagccugggauuaggg

SEQ ID NO: 1045068 - RNA, 22 nt, Human
uguagaaacuacacaugcaaca

SEQ ID NO: 1045069 - RNA, 22 nt, Human
gucugucaucugagauggagug

SEQ ID NO: 1045070 - RNA, 22 nt, Human
uauucacaggcacgaaauauug

SEQ ID NO: 1045071 - RNA, 22 nt, Human
acugcuuacccggccugacuuc

SEQ ID NO: 1045072 - RNA, 22 nt, Human
acaauguaggauauguacuugu

SEQ ID NO: 1045073 - RNA, 22 nt, Human
uucugucaaauuugccauaugg

SEQ ID NO: 1045074 - RNA, 22 nt, Human
aaucuuucccuauuaaaugugg

SEQ ID NO: 1045075 - RNA, 22 nt, Human
gaaacuuacuuacucacauuuc

SEQ ID NO: 1045076 - RNA, 22 nt, Human
aagaauacguaucaacaauggu

SEQ ID NO: 1045077 - RNA, 22 nt, Human
uguuccaauaaggaguugaaau

SEQ ID NO: 1045078 - RNA, 22 nt, Human
uacauucagcaaaagaaugguu

SEQ ID NO: 1045079 - RNA, 22 nt, Human
aagauaauauucauuaacuaga

SEQ ID NO: 1045080 - RNA, 22 nt, Human
aaagaauagccuuuguccaaau

SEQ ID NO: 1045081 - RNA, 22 nt, Human
uucaaauacauucuuugccacu

SEQ ID NO: 1045082 - RNA, 22 nt, Human
aucuacauaaaacgaauacaua

SEQ ID NO: 1045083 - RNA, 22 nt, Human
uaugaacauguucauugacuua

SEQ ID NO: 1045084 - RNA, 22 nt, Human
caugaaauugcuccuuuggugc

SEQ ID NO: 1045085 - RNA, 22 nt, Human
ugugaaaagggcuuuguacaaa

SEQ ID NO: 1045086 - RNA, 22 nt, Human
uguaugaaugggaaaaggaaac

SEQ ID NO: 1045087 - RNA, 23 nt, Human
aauguauguuaguaucuuagaga

SEQ ID NO: 1045088 - RNA, 22 nt, Human
agauauguuuguauauauuugu

SEQ ID NO: 1045089 - RNA, 22 nt, Human
auguuauggcucaaacauuugg

SEQ ID NO: 1045090 - RNA, 22 nt, Human
uuucaugauuaacuuagugaau

SEQ ID NO: 1045091 - RNA, 22 nt, Human
guuuagaacacggaaauacuga

SEQ ID NO: 1045092 - RNA, 22 nt, Human
augacaugaccugguagagaca

SEQ ID NO: 1045093 - RNA, 22 nt, Human
uucugucagcugcuuugucuca

SEQ ID NO: 1045094 - RNA, 22 nt, Human
cauaauuugauaugcuugaugg

SEQ ID NO: 1045095 - RNA, 22 nt, Human
uuuuucuuaaauguggguuggc

SEQ ID NO: 1045096 - RNA, 22 nt, Human
guguaugaggggagaauguuuu

SEQ ID NO: 1045097 - RNA, 19 nt, Human
uuuuccuucuauauguuuc

SEQ ID NO: 1045098 - RNA, 22 nt, Human
ucugucaaaaguuuucaauaaa

SEQ ID NO: 1045099 - RNA, 22 nt, Human
uaucuguuaugggcugaauugc

SEQ ID NO: 1045100 - RNA, 22 nt, Human
aguaugaaucucuuuauucugc

SEQ ID NO: 1045101 - RNA, 22 nt, Human
uagauauggccgucuguuuuaa

SEQ ID NO: 1045102 - RNA, 22 nt, Human
ucuacuauguuucuuaaauaga

SEQ ID NO: 1045103 - RNA, 22 nt, Human
uuggaaauugcaagugauuugc

SEQ ID NO: 1045104 - RNA, 19 nt, Human
acauauguggauauacaug

SEQ ID NO: 1045105 - RNA, 20 nt, Human
auacacauauucuugcaacu

SEQ ID NO: 1045106 - RNA, 21 nt, Human
uaacacauuuugguacuuugg

SEQ ID NO: 1045107 - RNA, 22 nt, Human
uaugaacuguacuguacuaagc

SEQ ID NO: 1045108 - RNA, 22 nt, Human
ucauuuugggguuugucaucuu

SEQ ID NO: 1045109 - RNA, 22 nt, Human
aaacacaucauucaugucguca

SEQ ID NO: 1045110 - RNA, 22 nt, Human
uacauugcuuucuaauacaucu

SEQ ID NO: 1045111 - RNA, 22 nt, Human
cauaauuuuccaugguuugcua

SEQ ID NO: 1045112 - RNA, 22 nt, Human
aaauuucaguuggaaugagcuc

SEQ ID NO: 1045113 - RNA, 22 nt, Human
auuacaauaagguuuauuugua

SEQ ID NO: 1045114 - RNA, 22 nt, Human
aagcaacucccuccucauuuuu

SEQ ID NO: 1045115 - RNA, 22 nt, Human
ugaaguuguuaagguugccauu

SEQ ID NO: 1045116 - RNA, 22 nt, Human
ucugucaaaugagcaaguaacu

SEQ ID NO: 1045117 - RNA, 19 nt, Human
aaacacagauuucuuacca

SEQ ID NO: 1045118 - RNA, 22 nt, Human
uaauaguuaugguugguucuca

SEQ ID NO: 1045119 - RNA, 22 nt, Human
uauaauguuuuccauggacuga

SEQ ID NO: 1045120 - RNA, 22 nt, Human
aaucacuuuucucuaauguagc

SEQ ID NO: 1045121 - RNA, 22 nt, Human
uuauuuugguaaauguuugccu

SEQ ID NO: 1045122 - RNA, 22 nt, Human
uauauauucuuaaguaguguag

SEQ ID NO: 1045123 - RNA, 22 nt, Human
uucugucacuugcaaucaagag

SEQ ID NO: 1045124 - RNA, 22 nt, Human
ucauauaacuggauauuuucaa

SEQ ID NO: 1045125 - RNA, 22 nt, Human
uguaaaaccaaaucaaucuagu

SEQ ID NO: 1045126 - RNA, 22 nt, Human
cugcucuagagagcauuaguca

SEQ ID NO: 1045127 - RNA, 22 nt, Human
ugugaaaagcaggcuacuuucu

SEQ ID NO: 1045128 - RNA, 17 nt, Human
uauauguaugccucucc

SEQ ID NO: 1045129 - RNA, 22 nt, Human
acuagauaauuauaaaagguag

SEQ ID NO: 1045130 - RNA, 22 nt, Human
augugaaacugaagcauccaua

SEQ ID NO: 1045131 - RNA, 22 nt, Human
ugucuucaucuccaugcacaga

SEQ ID NO: 1045132 - RNA, 22 nt, Human
aaaguuugucacuuggcuagaa

SEQ ID NO: 1045133 - RNA, 21 nt, Human
aauguauguuuaucucacagu

SEQ ID NO: 1045134 - RNA, 21 nt, Human
uaugaacaugaccaauagucc

SEQ ID NO: 1045135 - RNA, 22 nt, Human
cacacucauuagucauuucucu

SEQ ID NO: 1045136 - RNA, 22 nt, Human
cucugucacuucuccagcugag

SEQ ID NO: 1045137 - RNA, 22 nt, Human
aaaguuaguuucuuauaugucu

SEQ ID NO: 1045138 - RNA, 22 nt, Human
cauuuacuuaaaucuuuacaag

SEQ ID NO: 1045139 - RNA, 22 nt, Human
aucugucaucagcaccacaggu

SEQ ID NO: 1045140 - RNA, 22 nt, Human
ugcuagaauuugcagaagcaua

SEQ ID NO: 1045141 - RNA, 22 nt, Human
uuucauaauacuguacaugaaa

SEQ ID NO: 1045142 - RNA, 22 nt, Human
aaucugucguaguaaaaagcag

SEQ ID NO: 1045143 - RNA, 22 nt, Human
ucugcucugggccagcuauuaa

SEQ ID NO: 1045144 - RNA, 22 nt, Human
ucaauaaaauuguuuuccuauc

SEQ ID NO: 1045145 - RNA, 22 nt, Human
uuagaacugaagaagauuaagg

SEQ ID NO: 1045146 - RNA, 22 nt, Human
ucacauuucugauuauaccaaa

SEQ ID NO: 1045147 - RNA, 20 nt, Human
gcaaaauaggcucuguuggu

SEQ ID NO: 1045148 - RNA, 22 nt, Human
aaaguguugauaugugacaucc

SEQ ID NO: 1045149 - RNA, 22 nt, Human
auguaugaugcuaggcucucag

SEQ ID NO: 1045150 - RNA, 22 nt, Human
uuguaugaggauagcaagaagc

SEQ ID NO: 1045151 - RNA, 22 nt, Human
uaaaguuuggcagacaauaaca

SEQ ID NO: 1045152 - RNA, 22 nt, Human
ucaauauauuccauguuuucuc

SEQ ID NO: 1045153 - RNA, 22 nt, Human
aaauauguaagauuagcacuag

SEQ ID NO: 1045154 - RNA, 22 nt, Human
aaauaguuuagcucucauuuca

SEQ ID NO: 1045155 - RNA, 22 nt, Human
acacagccgugaaucugcuucu

SEQ ID NO: 1045156 - RNA, 22 nt, Human
uuguaugaucaaaagaaaugua

SEQ ID NO: 1045157 - RNA, 22 nt, Human
uuagacauagaauauugucuag

SEQ ID NO: 1045158 - RNA, 22 nt, Human
aauguaugcugugguaucuucu

SEQ ID NO: 1045159 - RNA, 22 nt, Human
aaucuuagguuuggcuucaucu

SEQ ID NO: 1045160 - RNA, 23 nt, Human
gaauaguuuuagaaauuggagaa

SEQ ID NO: 1045161 - RNA, 22 nt, Human
ugagaaaugggucugcugaaga

SEQ ID NO: 1045162 - RNA, 22 nt, Human
ugguauaaaacuuuuuauugaa

SEQ ID NO: 1045163 - RNA, 22 nt, Human
acuaaauacacacauuuguuca

SEQ ID NO: 1045164 - RNA, 22 nt, Human
uguuugaaacuuugaucacuaa

SEQ ID NO: 1045165 - RNA, 22 nt, Human
ucugucaucucuaaaauagaaa

SEQ ID NO: 1045166 - RNA, 22 nt, Human
aaauaguucagcuuguaaaccc

SEQ ID NO: 1045167 - RNA, 22 nt, Human
ugagaauuuuuugucaugcauu

SEQ ID NO: 1045168 - RNA, 20 nt, Human
agaaauauugaguucagagg

SEQ ID NO: 1045169 - RNA, 22 nt, Human
ucuuugaugugguuaauuauga

SEQ ID NO: 1045170 - RNA, 22 nt, Human
aauacuauguugugacacauga

SEQ ID NO: 1045171 - RNA, 22 nt, Human
acuucacagauauuuauuuggu

SEQ ID NO: 1045172 - RNA, 22 nt, Human
auucugucauuucaagaaaaac

SEQ ID NO: 1045173 - RNA, 22 nt, Human
uuucaaaccuacuuguauguuu

SEQ ID NO: 1045174 - RNA, 21 nt, Human
uugaccaagggugcgugcucc

SEQ ID NO: 1045175 - RNA, 22 nt, Human
uuggaaauacagcaguuacuuu

SEQ ID NO: 1045176 - RNA, 22 nt, Human
aaacagcaggaacaucuugcca

SEQ ID NO: 1045177 - RNA, 22 nt, Human
uuaacacagggggagacaaagu

SEQ ID NO: 1045178 - RNA, 22 nt, Human
uuccuugaaugagucauggaaa

SEQ ID NO: 1045179 - RNA, 22 nt, Human
aauguauguguauaucaaauca

SEQ ID NO: 1045180 - RNA, 22 nt, Human
uguuagaauauuguaauauucg

SEQ ID NO: 1045181 - RNA, 22 nt, Human
auaugugaaguggguuauuuug

SEQ ID NO: 1045182 - RNA, 22 nt, Human
aauguaugggugagaaaguuga

SEQ ID NO: 1045183 - RNA, 22 nt, Human
uaauuucacugauaugaaguca

SEQ ID NO: 1045184 - RNA, 22 nt, Human
aauucuguaacuuuacugaauu

SEQ ID NO: 1045185 - RNA, 22 nt, Human
ugaaacuuauaagaauaugaau

SEQ ID NO: 1045186 - RNA, 22 nt, Human
acacauauauacauauuugugc

SEQ ID NO: 1045187 - RNA, 22 nt, Human
augugaaaauccaauggcagca

SEQ ID NO: 1045188 - RNA, 22 nt, Human
aucugucaagauagacucugca

SEQ ID NO: 1045189 - RNA, 18 nt, Human
acacugcagcagucugcu

SEQ ID NO: 1045190 - RNA, 22 nt, Human
aucuguuccccuaugcucucua

SEQ ID NO: 1045191 - RNA, 22 nt, Human
uauaauuuaucaugucacaguu

SEQ ID NO: 1045192 - RNA, 22 nt, Human
uacaaaguagaaauucaguaaa

SEQ ID NO: 1045193 - RNA, 22 nt, Human
uuagaacuuaaacuucagaaag

SEQ ID NO: 1045194 - RNA, 22 nt, Human
gaacacauuagucugaguuggc

SEQ ID NO: 1045195 - RNA, 22 nt, Human
ugaaacauugcacuguaugaau

SEQ ID NO: 1045196 - RNA, 22 nt, Human
cacucugaugguuucuguucaa

SEQ ID NO: 1045197 - RNA, 22 nt, Human
gucaaaaaguagucauuucugu

SEQ ID NO: 1045198 - RNA, 22 nt, Human
uuauuuacaacucuucucuucc

SEQ ID NO: 1045199 - RNA, 22 nt, Human
ucaaaguuacuugugguuuucu

SEQ ID NO: 1045200 - RNA, 23 nt, Human
acagaaaguucugcuggacagag

SEQ ID NO: 1045201 - RNA, 22 nt, Human
uaggaaaugcuccauugcauaa

SEQ ID NO: 1045202 - RNA, 22 nt, Human
uuguaugagcuccaggaacuca

SEQ ID NO: 1045203 - RNA, 22 nt, Human
aauaacuuaagaaauuucccca

SEQ ID NO: 1045204 - RNA, 22 nt, Human
uuuuccuguccaggcaauuauu

SEQ ID NO: 1045205 - RNA, 22 nt, Human
auuucauagauuguaaaucccu

SEQ ID NO: 1045206 - RNA, 22 nt, Human
uugugaaacauucauggauuug

SEQ ID NO: 1045207 - RNA, 22 nt, Human
gaaguucuuagucucauuugca

SEQ ID NO: 1045208 - RNA, 22 nt, Human
aacagcauaaguauuuauuuca

SEQ ID NO: 1045209 - RNA, 22 nt, Human
uacaaagucacauugaaaugaa

SEQ ID NO: 1045210 - RNA, 22 nt, Human
uuaugacaggaaaaucacagaa

SEQ ID NO: 1045211 - RNA, 22 nt, Human
gagaacucagacgcaggucaug

SEQ ID NO: 1045212 - RNA, 22 nt, Human
uucauacaaugggauauuauga

SEQ ID NO: 1045213 - RNA, 22 nt, Human
uaauuucuagggacuaaggugc

SEQ ID NO: 1045214 - RNA, 22 nt, Human
ucauaaaucauacuccauuugc

SEQ ID NO: 1045215 - RNA, 22 nt, Human
uaugucaaaguuaagaaauagg

SEQ ID NO: 1045216 - RNA, 17 nt, Human
uuuagaauacaauguuu

SEQ ID NO: 1045217 - RNA, 22 nt, Human
ucugauuagcaguuuagggaaa

SEQ ID NO: 1045218 - RNA, 22 nt, Human
cucaaauauaagcuaaaugugg

SEQ ID NO: 1045219 - RNA, 22 nt, Human
uaugacauuauaaaggauuauu

SEQ ID NO: 1045220 - RNA, 22 nt, Human
acauaugugcuuauauccauga

SEQ ID NO: 1045221 - RNA, 22 nt, Human
uguaugaaucucauuuguuuaa

SEQ ID NO: 1045222 - RNA, 22 nt, Human
aucuagcaguguuauaauugga

SEQ ID NO: 1045223 - RNA, 22 nt, Human
cuguaugaacccauauacuuau

SEQ ID NO: 1045224 - RNA, 22 nt, Human
acuggaaaugagaugauaucag

SEQ ID NO: 1045225 - RNA, 22 nt, Human
uagcuagaaugcuucgugauau

SEQ ID NO: 1045226 - RNA, 22 nt, Human
agaauaugaugguuggagaauu

SEQ ID NO: 1045227 - RNA, 22 nt, Human
aauugucaaacacaaauaagag

SEQ ID NO: 1045228 - RNA, 22 nt, Human
uacacacaugcauuugccuuau

SEQ ID NO: 1045229 - RNA, 22 nt, Human
uaggaaauggcucaguuacugc

SEQ ID NO: 1045230 - RNA, 22 nt, Human
uucugucauccuuucuagaugu

SEQ ID NO: 1045231 - RNA, 22 nt, Human
uaucauuguguuauuucuucca

SEQ ID NO: 1045232 - RNA, 22 nt, Human
gguauaaaugaucagaucgcug

SEQ ID NO: 1045233 - RNA, 22 nt, Human
caagauaagaucauuuacacua

SEQ ID NO: 1045234 - RNA, 22 nt, Human
ucacauuuuauaucucugguuu

SEQ ID NO: 1045235 - RNA, 22 nt, Human
ucucaaaucaaacuuugagcuu

SEQ ID NO: 1045236 - RNA, 22 nt, Human
uaacacaugguucugucaggaa

SEQ ID NO: 1045237 - RNA, 22 nt, Human
aauaaucucccuuuuuguaugu

SEQ ID NO: 1045238 - RNA, 22 nt, Human
ugaacuuagugggaauaucucu

SEQ ID NO: 1045239 - RNA, 22 nt, Human
aaauauacuagaugaugaccca

SEQ ID NO: 1045240 - RNA, 22 nt, Human
uguguaaagcuuguuccagaaa

SEQ ID NO: 1045241 - RNA, 22 nt, Human
cauacaagcguucaauagaugu

SEQ ID NO: 1045242 - RNA, 22 nt, Human
acaauacuuaccaauguuuuug

SEQ ID NO: 1045243 - RNA, 22 nt, Human
gucugucauacggcuuauguaa

SEQ ID NO: 1045244 - RNA, 20 nt, Human
augugaaagaucaguugucu

SEQ ID NO: 1045245 - RNA, 22 nt, Human
uguuugaacugaauaacauagu

SEQ ID NO: 1045246 - RNA, 22 nt, Human
auguaugagagauucuuuuauu

SEQ ID NO: 1045247 - RNA, 22 nt, Human
uguaugaauauguauuuucaua

SEQ ID NO: 1045248 - RNA, 22 nt, Human
augacucuuagcuaaagguaag

SEQ ID NO: 1045249 - RNA, 22 nt, Human
gugauaaaauucaaauagcucu

SEQ ID NO: 1045250 - RNA, 20 nt, Human
uggaaguucuguugcauugg

SEQ ID NO: 1045251 - RNA, 22 nt, Human
ucuggucaguaauaagaagugg

SEQ ID NO: 1045252 - RNA, 22 nt, Human
aauacuauguagccaaaauaau

SEQ ID NO: 1045253 - RNA, 22 nt, Human
aaguauuucguucugaaaaagu

SEQ ID NO: 1045254 - RNA, 22 nt, Human
uugaauuagacuuugcuacagg

SEQ ID NO: 1045255 - RNA, 22 nt, Human
uugugaaauguuucaaaauagu

SEQ ID NO: 1045256 - RNA, 22 nt, Human
cacaugcaucugucauguuugg

SEQ ID NO: 1045257 - RNA, 22 nt, Human
aucucuguaaaccauaaauuga

SEQ ID NO: 1045258 - RNA, 22 nt, Human
aauaguauuuauuuggaaaaag

SEQ ID NO: 1045259 - RNA, 22 nt, Human
auucugucuuuuuaaaauaaua

SEQ ID NO: 1045260 - RNA, 22 nt, Human
uucuugaaucacuuuagagaua

SEQ ID NO: 1045261 - RNA, 22 nt, Human
auguuagaaggaauguuaaaag

SEQ ID NO: 1045262 - RNA, 22 nt, Human
caugaaaucugaguauguuucc

SEQ ID NO: 1045263 - RNA, 22 nt, Human
auuuagacuucccagcacugug

SEQ ID NO: 1045264 - RNA, 22 nt, Human
guguauaaugcuguuuguacau

SEQ ID NO: 1045265 - RNA, 22 nt, Human
uuauuuucuccucagaaagugg

SEQ ID NO: 1045266 - RNA, 22 nt, Human
uauauguaaauaagucuaaugu

SEQ ID NO: 1045267 - RNA, 22 nt, Human
aaaguuuguuauaugauaagga

SEQ ID NO: 1045268 - RNA, 19 nt, Human
cauuuagaaguacauauua

SEQ ID NO: 1045269 - RNA, 22 nt, Human
gaauauuuucaguacagauggu

SEQ ID NO: 1045270 - RNA, 22 nt, Human
aaauaguucagccacggugacu

SEQ ID NO: 1045271 - RNA, 20 nt, Human
aucugcuugccuguccucgg

SEQ ID NO: 1045272 - RNA, 22 nt, Human
uuugacaaauccuucagcaaug

SEQ ID NO: 1045273 - RNA, 22 nt, Human
cauaugaaauaugaguugaaca

SEQ ID NO: 1045274 - RNA, 22 nt, Human
ugaaacaaugugaaguugcuga

SEQ ID NO: 1045275 - RNA, 22 nt, Human
uaacacauauuucaagaguagu

SEQ ID NO: 1045276 - RNA, 22 nt, Human
uuuuucuugugcuggaucuaau

SEQ ID NO: 1045277 - RNA, 22 nt, Human
aauguaugagcgugaaagcacu

SEQ ID NO: 1045278 - RNA, 22 nt, Human
agucuacaaagaaaaguuauug

SEQ ID NO: 1045279 - RNA, 22 nt, Human
uuguaugaauguauccuaauuu

SEQ ID NO: 1045280 - RNA, 22 nt, Human
uacaauauguggccuuuuguga

SEQ ID NO: 1045281 - RNA, 22 nt, Human
ugacaaaacugcaauuacuuuu

SEQ ID NO: 1045282 - RNA, 22 nt, Human
uaacacauauuugcaguaagca

SEQ ID NO: 1045283 - RNA, 22 nt, Human
aagucuguuugagugucacacu

SEQ ID NO: 1045284 - RNA, 22 nt, Human
uuggaaauggcuguaguuauga

SEQ ID NO: 1045285 - RNA, 22 nt, Human
uaauaguuucauaaugugcuuc

SEQ ID NO: 1045286 - RNA, 22 nt, Human
aggacaaaggaccagaucugga

SEQ ID NO: 1045287 - RNA, 22 nt, Human
caagggcagcagccucaagcgg

SEQ ID NO: 1045288 - RNA, 22 nt, Human
ggauugaagggaaccucagaau

SEQ ID NO: 1045289 - RNA, 22 nt, Human
auugagaaggagauuggcaucu

SEQ ID NO: 1045290 - RNA, 22 nt, Human
ggaaacugcuuacacuagaggg

SEQ ID NO: 1045291 - RNA, 22 nt, Human
agggugugcuguugggucuuuc

SEQ ID NO: 1045292 - RNA, 22 nt, Human
ccccagugguugcaacagcaga

SEQ ID NO: 1045293 - RNA, 22 nt, Human
cagcuggcgacucuccucgaug

SEQ ID NO: 1045294 - RNA, 22 nt, Human
uggggugugcucagagcagggg

SEQ ID NO: 1045295 - RNA, 22 nt, Human
gauacuugaggagaucaccaca

SEQ ID NO: 1045296 - RNA, 22 nt, Human
ugggugugagcccgggagccgc

SEQ ID NO: 1045297 - RNA, 20 nt, Human
caauaauuuacuucccuauu

SEQ ID NO: 1045298 - RNA, 22 nt, Human
acagggcaccugagguaggaag

SEQ ID NO: 1045299 - RNA, 22 nt, Human
uggccagaacucagacaugugg

SEQ ID NO: 1045300 - RNA, 22 nt, Human
guggcagcggcccaggccgucu

SEQ ID NO: 1045301 - RNA, 22 nt, Human
augaagcauuacaggaugacag

SEQ ID NO: 1045302 - RNA, 22 nt, Human
ggacauugaagcuggaaaggga

SEQ ID NO: 1045303 - RNA, 22 nt, Human
cauaaauuguacccauuccaac

SEQ ID NO: 1045304 - RNA, 22 nt, Human
agaggcucuuugagcugggaga

SEQ ID NO: 1045305 - RNA, 19 nt, Human
agcagccaucgaccaugga

SEQ ID NO: 1045306 - RNA, 22 nt, Human
aggcaguguggagggcuguugc

SEQ ID NO: 1045307 - RNA, 22 nt, Human
uacuacauacagaauuuagaga

SEQ ID NO: 1045308 - RNA, 22 nt, Human
agggggcuccuuggugugcaga

SEQ ID NO: 1045309 - RNA, 22 nt, Human
auuccaaagccugaauaaugga

SEQ ID NO: 1045310 - RNA, 22 nt, Human
aaaccuguuaauagagcgaugc

SEQ ID NO: 1045311 - RNA, 22 nt, Human
aucacuagaguuacauugccag

SEQ ID NO: 1045312 - RNA, 22 nt, Human
guuaaaugcagauucugacuca

SEQ ID NO: 1045313 - RNA, 22 nt, Human
augauuuguuaacagacuuaau

SEQ ID NO: 1045314 - RNA, 22 nt, Human
uucaaaccuaucuaagaaauag

SEQ ID NO: 1045315 - RNA, 22 nt, Human
ggccuugggauguggcugcagc

SEQ ID NO: 1045316 - RNA, 22 nt, Human
ugcugcccacuguauuucucca

SEQ ID NO: 1045317 - RNA, 21 nt, Human
ccacaauucuaguuacauaug

SEQ ID NO: 1045318 - RNA, 21 nt, Human
uacaucaguuuucuuggcuca

SEQ ID NO: 1045319 - RNA, 22 nt, Human
aggggcuuguggaguugcuggu

SEQ ID NO: 1045320 - RNA, 22 nt, Human
gccaccagccccaugcgcugug

SEQ ID NO: 1045321 - RNA, 21 nt, Human
ggccuuggcgggggccgaauu

SEQ ID NO: 1045322 - RNA, 22 nt, Human
gcagcaaucuucacagugucau

SEQ ID NO: 1045323 - RNA, 22 nt, Human
uggagcagccuuuucuaagcaa

SEQ ID NO: 1045324 - RNA, 22 nt, Human
uggcacaguuaaaguuguagaa

SEQ ID NO: 1045325 - RNA, 22 nt, Human
uggagccagcaggacucagagg

SEQ ID NO: 1045326 - RNA, 22 nt, Human
cagaaccaggaacugauggaga

SEQ ID NO: 1045327 - RNA, 23 nt, Human
auuuccuaaaagauaaucauuac

SEQ ID NO: 1045328 - RNA, 22 nt, Human
aaaguaauugugguucuugcca

SEQ ID NO: 1045329 - RNA, 22 nt, Human
aucuuuggguacaaacuugccu

SEQ ID NO: 1045330 - RNA, 22 nt, Human
aaugaacacuuagccuuucuau

SEQ ID NO: 1045331 - RNA, 22 nt, Human
ucaauuuauguggcuauucauu

SEQ ID NO: 1045332 - RNA, 22 nt, Human
augcacaagguagauuauuauu

SEQ ID NO: 1045333 - RNA, 22 nt, Human
gggaaacuuucacaauguccag

SEQ ID NO: 1045334 - RNA, 22 nt, Human
aguuggcauuuuauuuaaguau

SEQ ID NO: 1045335 - RNA, 22 nt, Human
gugacaugguuugccgucccug

SEQ ID NO: 1045336 - RNA, 22 nt, Human
acuuggucguggugcagcaugg

SEQ ID NO: 1045337 - RNA, 22 nt, Human
ugggagagauaggcuucuggac

SEQ ID NO: 1045338 - RNA, 22 nt, Human
uuggggaagcuuugaaauacuu

SEQ ID NO: 1045339 - RNA, 22 nt, Human
cugaacaucccgcagugcacga

SEQ ID NO: 1045340 - RNA, 22 nt, Human
ugaacaugcuguugauggccug

SEQ ID NO: 1045341 - RNA, 22 nt, Human
ugggugaagaggcuaugcuacu

SEQ ID NO: 1045342 - RNA, 22 nt, Human
uagaaagagcuuugcuuccuuu

SEQ ID NO: 1045343 - RNA, 22 nt, Human
ugcacagagggaggcauaaaau

SEQ ID NO: 1045344 - RNA, 20 nt, Human
ccacaguggagacuggagac

SEQ ID NO: 1045345 - RNA, 22 nt, Human
gccagcuggcugcaggucccag

SEQ ID NO: 1045346 - RNA, 22 nt, Human
agugccaaaucgagggcucuga

SEQ ID NO: 1045347 - RNA, 21 nt, Human
uaccaagaaguuugggaaagc

SEQ ID NO: 1045348 - RNA, 22 nt, Human
cugggaguugacgaggcuugua

SEQ ID NO: 1045349 - RNA, 22 nt, Human
gaggggcucuugggcaugaagg

SEQ ID NO: 1045350 - RNA, 22 nt, Human
cauuuugugcuagacacuaugg

SEQ ID NO: 1045351 - RNA, 18 nt, Human
ucuuccaacacugacacc

SEQ ID NO: 1045352 - RNA, 22 nt, Human
uaucaguagaacaauggacauu

SEQ ID NO: 1045353 - RNA, 22 nt, Human
uaaaccuuauuugaauaccaac

SEQ ID NO: 1045354 - RNA, 22 nt, Human
agcacugugagcaccagcacgc

SEQ ID NO: 1045355 - RNA, 21 nt, Human
acuguauuguuuucaaggauc

SEQ ID NO: 1045356 - RNA, 22 nt, Human
uacugcugagcuggguagaagg

SEQ ID NO: 1045357 - RNA, 22 nt, Human
agaaacaucgcuuaguccucau

SEQ ID NO: 1045358 - RNA, 20 nt, Human
gggugugugcagggccuggu

SEQ ID NO: 1045359 - RNA, 20 nt, Human
aggcccuccccacuguugcu

SEQ ID NO: 1045360 - RNA, 22 nt, Human
cauguguauuauucuuguggaa

SEQ ID NO: 1045361 - RNA, 22 nt, Human
aacacuaaaggucaguuagaag

SEQ ID NO: 1045362 - RNA, 22 nt, Human
uuuaaaccuaucuaagaaauag

SEQ ID NO: 1045363 - RNA, 22 nt, Human
ccacccagccagaugcaggaag

SEQ ID NO: 1045364 - RNA, 22 nt, Human
cagggacucgcuggacauaccg

SEQ ID NO: 1045365 - RNA, 22 nt, Human
cugccaucugagccaaaagugc

SEQ ID NO: 1045366 - RNA, 22 nt, Human
uggaaauaguugugagucaggc

SEQ ID NO: 1045367 - RNA, 22 nt, Human
gcaggguaggugacagguaguc

SEQ ID NO: 1045368 - RNA, 22 nt, Human
gaacugcauugugguauauguu

SEQ ID NO: 1045369 - RNA, 19 nt, Human
gggaaugauggaagacuuc

SEQ ID NO: 1045370 - RNA, 22 nt, Human
gagaugugucagguccuggggg

SEQ ID NO: 1045371 - RNA, 22 nt, Human
acaggauuaauaaaaaauugua

SEQ ID NO: 1045372 - RNA, 22 nt, Human
gaauaauugugaugcuugaagu

SEQ ID NO: 1045373 - RNA, 22 nt, Human
ugaauaugugacuuugauuuca

SEQ ID NO: 1045374 - RNA, 20 nt, Human
acagaugaggaugcggaggc

SEQ ID NO: 1045375 - RNA, 22 nt, Human
aggcaguuguugcugagcagcu

SEQ ID NO: 1045376 - RNA, 19 nt, Human
cauaauacaguggaucuga

SEQ ID NO: 1045377 - RNA, 22 nt, Human
uugcccacuggcuguuggucag

SEQ ID NO: 1045378 - RNA, 22 nt, Human
cggagaggugggggcagcaucu

SEQ ID NO: 1045379 - RNA, 22 nt, Human
uugaggagucaggggcacggaa

SEQ ID NO: 1045380 - RNA, 22 nt, Human
caugugaauuccaaagcuaggu

SEQ ID NO: 1045381 - RNA, 22 nt, Human
augcacacguacccuacaaggc

SEQ ID NO: 1045382 - RNA, 22 nt, Human
gagaugaagaggcccuuggagu

SEQ ID NO: 1045383 - RNA, 22 nt, Human
gcuuccaaugcuucuaucacau

SEQ ID NO: 1045384 - RNA, 22 nt, Human
cugguuuuuagugcuuaggagu

SEQ ID NO: 1045385 - RNA, 22 nt, Human
agauugucauugacgaugagca

SEQ ID NO: 1045386 - RNA, 22 nt, Human
cuggagucggcgccccaacaga

SEQ ID NO: 1045387 - RNA, 22 nt, Human
ucuugccgcgcaggcgcaguuc

SEQ ID NO: 1045388 - RNA, 22 nt, Human
uguucauaucauuuugaaagcu

SEQ ID NO: 1045389 - RNA, 22 nt, Human
ugguaugcuuauuaucuucaac

SEQ ID NO: 1045390 - RNA, 22 nt, Human
gaucucaaagcaguguggguug

SEQ ID NO: 1045391 - RNA, 22 nt, Human
uuuccaaagguggcaggaacaa

SEQ ID NO: 1045392 - RNA, 22 nt, Human
gcaguugcaggauuuguguugu

SEQ ID NO: 1045393 - RNA, 18 nt, Human
aguaaauguuaaauauug

SEQ ID NO: 1045394 - RNA, 22 nt, Human
gaaccuguccugagugaggagu

SEQ ID NO: 1045395 - RNA, 22 nt, Human
agagaauuaacauuccauggcu

SEQ ID NO: 1045396 - RNA, 22 nt, Human
ucugggaguuucugugggagcu

SEQ ID NO: 1045397 - RNA, 22 nt, Human
uaaccuguuaagggcugaccca

SEQ ID NO: 1045398 - RNA, 22 nt, Human
ccagguggacggcgaguacagg

SEQ ID NO: 1045399 - RNA, 22 nt, Human
cugggguaucugccacaacucu

SEQ ID NO: 1045400 - RNA, 22 nt, Human
gggagaguagcuggaagguucu

SEQ ID NO: 1045401 - RNA, 21 nt, Human
uccaggagcacgggacuagga

SEQ ID NO: 1045402 - RNA, 22 nt, Human
aggggcagccucacaauccucu

SEQ ID NO: 1045403 - RNA, 22 nt, Human
aaugaaacuauauuuagagagg

SEQ ID NO: 1045404 - RNA, 22 nt, Human
ggcucagaaaccucuggugucu

SEQ ID NO: 1045405 - RNA, 23 nt, Human
ugagagccuggcagccuggguuc

SEQ ID NO: 1045406 - RNA, 22 nt, Human
augccaucaaugacagaguuag

SEQ ID NO: 1045407 - RNA, 22 nt, Human
uaaaugaaaggguuuaauuuau

SEQ ID NO: 1045408 - RNA, 20 nt, Human
cucaccagguguaggcugag

SEQ ID NO: 1045409 - RNA, 22 nt, Human
cagcaguguacaaggugucaga

SEQ ID NO: 1045410 - RNA, 22 nt, Human
caggcuguguuccuggaacccc

SEQ ID NO: 1045411 - RNA, 22 nt, Human
agggaaauuaaugugagcaaug

SEQ ID NO: 1045412 - RNA, 22 nt, Human
gggaggugauuaggaccaugua

SEQ ID NO: 1045413 - RNA, 22 nt, Human
auuaaauuggacgcugggggaa

SEQ ID NO: 1045414 - RNA, 22 nt, Human
ggcacuggcaaagcaaagucug

SEQ ID NO: 1045415 - RNA, 22 nt, Human
ggagccaguuuagaccucaguu

SEQ ID NO: 1045416 - RNA, 22 nt, Human
auauaugaagaagucuugauua

SEQ ID NO: 1045417 - RNA, 22 nt, Human
gagaugggcgagaagguggacu

SEQ ID NO: 1045418 - RNA, 22 nt, Human
ugcuaauaaacuccaggcugag

SEQ ID NO: 1045419 - RNA, 22 nt, Human
gcagccuccgcacugcgagucc

SEQ ID NO: 1045420 - RNA, 22 nt, Human
aaaugcaugugcuauagaugug

SEQ ID NO: 1045421 - RNA, 22 nt, Human
aaauugaauuugggaaacauug

SEQ ID NO: 1045422 - RNA, 22 nt, Human
aauggcaaaguguuuucauacc

SEQ ID NO: 1045423 - RNA, 22 nt, Human
cagugccagcugcuuggccuac

SEQ ID NO: 1045424 - RNA, 22 nt, Human
uguccagcugaaggcagccuca

SEQ ID NO: 1045425 - RNA, 22 nt, Human
caauaauugcuuuccagaguua

SEQ ID NO: 1045426 - RNA, 22 nt, Human
aucagaagaaauggaugugacu

SEQ ID NO: 1045427 - RNA, 22 nt, Human
aggacugggugcagagggcauc

SEQ ID NO: 1045428 - RNA, 22 nt, Human
caaacuuacuguguuuaaagag

SEQ ID NO: 1045429 - RNA, 22 nt, Human
uuccagaacaauguggacguau

SEQ ID NO: 1045430 - RNA, 22 nt, Human
caacauuucaaggucuuuagga

SEQ ID NO: 1045431 - RNA, 22 nt, Human
gcuguauuuauaugaaggcaug

SEQ ID NO: 1045432 - RNA, 21 nt, Human
uccaaaggagacugagugugu

SEQ ID NO: 1045433 - RNA, 22 nt, Human
cagagccuuaguucuccuagaa

SEQ ID NO: 1045434 - RNA, 22 nt, Human
uugaugagaccauugccgcguc

SEQ ID NO: 1045435 - RNA, 22 nt, Human
gcagcagugugggcugaaccua

SEQ ID NO: 1045436 - RNA, 22 nt, Human
ugcccacaggaagacaccagcg

SEQ ID NO: 1045437 - RNA, 22 nt, Human
aagcuguuagggagugguaggu

SEQ ID NO: 1045438 - RNA, 22 nt, Human
ggcagguguggugaccagagau

SEQ ID NO: 1045439 - RNA, 22 nt, Human
caaccugaugugcaugccacgg

SEQ ID NO: 1045440 - RNA, 22 nt, Human
aagcacuaauauuuuggcaccu

SEQ ID NO: 1045441 - RNA, 22 nt, Human
caacccaagguuaguuggucuu

SEQ ID NO: 1045442 - RNA, 22 nt, Human
ugucacagagcgugcaacagaa

SEQ ID NO: 1045443 - RNA, 22 nt, Human
cuggagcagcagguggccaggg

SEQ ID NO: 1045444 - RNA, 22 nt, Human
augugauacuccuucuagugga

SEQ ID NO: 1045445 - RNA, 22 nt, Human
ccaagcuggacagcagcaagga

SEQ ID NO: 1045446 - RNA, 22 nt, Human
ugaaauguggagaugguaagua

SEQ ID NO: 1045447 - RNA, 22 nt, Human
accauccaaacugcuuucugug

SEQ ID NO: 1045448 - RNA, 22 nt, Human
ugacagugugcccggagguuag

SEQ ID NO: 1045449 - RNA, 22 nt, Human
uguggaagaacuucuugcuugg

SEQ ID NO: 1045450 - RNA, 20 nt, Human
ucauccaggacaggaguggc

SEQ ID NO: 1045451 - RNA, 22 nt, Human
aagucaauuaguaaacuuggaa

SEQ ID NO: 1045452 - RNA, 22 nt, Human
ggcagaggaagcuggaaguggg

SEQ ID NO: 1045453 - RNA, 22 nt, Norwalk virus
uggcaacaugugacaaugaaac

SEQ ID NO: 1045454 - RNA, 22 nt, Norwalk virus
aguaagguugauuacagugcca

SEQ ID NO: 1045455 - RNA, 22 nt, Human
cuccagggggcauccacacagc

SEQ ID NO: 1045456 - RNA, 22 nt, Human
acccagggccacagcccgcagu

SEQ ID NO: 1045457 - RNA, 22 nt, Human
caguccuuggcuucauccgagu

SEQ ID NO: 1045458 - RNA, 22 nt, Human
agccuccaucccaugcacaaag

SEQ ID NO: 1045459 - RNA, 21 nt, Human
agaauucuuaaguauucuaau

SEQ ID NO: 1045460 - RNA, 22 nt, Human
aauaagauccugaagauauguu

SEQ ID NO: 1045461 - RNA, 23 nt, Human
uaauacugcuucagaggcuuaga

SEQ ID NO: 1045462 - RNA, 22 nt, Human
gcccaggaguugaagggcugac

SEQ ID NO: 1045463 - RNA, 22 nt, Human
gauaauaagcacagcaggaugu

SEQ ID NO: 1045464 - RNA, 22 nt, Human
uuuccaaagcugaguugagcaa

SEQ ID NO: 1045465 - RNA, 22 nt, Human
agcccuggcagagccagguagu

SEQ ID NO: 1045466 - RNA, 22 nt, Human
auguauccuuauacacauuuau

SEQ ID NO: 1045467 - RNA, 22 nt, Human
guagaaauguaaccaggagaua

SEQ ID NO: 1045468 - RNA, 22 nt, Human
gggggagagacgagcggcucug

SEQ ID NO: 1045469 - RNA, 16 nt, Human
uuuccaaagggcagcu

SEQ ID NO: 1045470 - RNA, 22 nt, Human
ccagcuccaaguuugggcauca

SEQ ID NO: 1045471 - RNA, 22 nt, Human
agccauuuuccugaaauauaac

SEQ ID NO: 1045472 - RNA, 22 nt, Human
auuacagaaugcaguuccuuau

SEQ ID NO: 1045473 - RNA, 22 nt, Human
aaauaauguuaggccuuugcuc

SEQ ID NO: 1045474 - RNA, 22 nt, Human
augugcuuuauuaaguaaaaau

SEQ ID NO: 1045475 - RNA, 22 nt, Human
uuucauaauacuguacaugaaa

SEQ ID NO: 1045476 - RNA, 22 nt, Human
gugauuuagauguugaaaguga

SEQ ID NO: 1045477 - RNA, 22 nt, Human
agugugggccacgcagcugagc

SEQ ID NO: 1045478 - RNA, 22 nt, Human
cagaauuuuucgaauguacugu

SEQ ID NO: 1045479 - RNA, 22 nt, Human
agggcugcugcuccgggcccag

SEQ ID NO: 1045480 - RNA, 22 nt, Human
cuuuacauccuguuucccguuu

SEQ ID NO: 1045481 - RNA, 22 nt, Human
caaguccucgcuucuagcugug

SEQ ID NO: 1045482 - RNA, 22 nt, Human
auuauccucagaaaacauguga

SEQ ID NO: 1045483 - RNA, 22 nt, Human
ugaagaaucccagggaauuugg

SEQ ID NO: 1045484 - RNA, 22 nt, Human
ucccuccauaacagaggugagc

SEQ ID NO: 1045485 - RNA, 22 nt, Human
ucuggcucuauaacuccuagcu

SEQ ID NO: 1045486 - RNA, 22 nt, Human
aguacaacauuagaguaucuua

SEQ ID NO: 1045487 - RNA, 22 nt, Human
uuucaagaacaacauucauuca

SEQ ID NO: 1045488 - RNA, 18 nt, Human
aguccuuacgaggcuaua

SEQ ID NO: 1045489 - RNA, 22 nt, Human
acuuuagaccaucuuccacagu

SEQ ID NO: 1045490 - RNA, 22 nt, Human
ugggacagguuggagagaagca

SEQ ID NO: 1045491 - RNA, 22 nt, Human
ggacagcauaucagcagggcag

SEQ ID NO: 1045492 - RNA, 22 nt, Human
uaagaaacccaggaauuucuua

SEQ ID NO: 1045493 - RNA, 22 nt, Human
ucuaaacaguuucacucuuaau

SEQ ID NO: 1045494 - RNA, 22 nt, Human
gcugcccaggguggagccggcu

SEQ ID NO: 1045495 - RNA, 22 nt, Human
uuggaucacucugaagccuuac

SEQ ID NO: 1045496 - RNA, 21 nt, Human
uccagcuccugccacuccuua

SEQ ID NO: 1045497 - RNA, 22 nt, Human
aauaauaagauacuaagggagu

SEQ ID NO: 1045498 - RNA, 22 nt, Human
gaaagaggaaggagauguauua

SEQ ID NO: 1045499 - RNA, 22 nt, Human
caccagccagagugacagcucc

SEQ ID NO: 1045500 - RNA, 22 nt, Human
aaaucucaguguucuaagcauu

SEQ ID NO: 1045501 - RNA, 22 nt, Human
uggcauuuucuccuuugaguuu

SEQ ID NO: 1045502 - RNA, 22 nt, Human
gagaugggcgagaagguggacu

SEQ ID NO: 1045503 - RNA, 17 nt, Human
uaaguccuaguuauuuu

SEQ ID NO: 1045504 - RNA, 22 nt, Human
aggauuuauuauaugcccucau

SEQ ID NO: 1045505 - RNA, 22 nt, Human
auuaggcauuauggggauaagg

SEQ ID NO: 1045506 - RNA, 22 nt, Human
aaggaggguucccagguccugg

SEQ ID NO: 1045507 - RNA, 22 nt, Human
auggcauuugaccgcuuugugg

SEQ ID NO: 1045508 - RNA, 22 nt, Human
cauuuacauuuaagguuaauau

SEQ ID NO: 1045509 - RNA, 22 nt, Human
uguacaauagcuauuaucucca

SEQ ID NO: 1045510 - RNA, 22 nt, Human
acuggaucuaauugguuauagu

SEQ ID NO: 1045511 - RNA, 23 nt, Human
uacagaaggaguagucacuaaga

SEQ ID NO: 1045512 - RNA, 22 nt, Human
aaagcagcaacagcuguuagaa

SEQ ID NO: 1045513 - RNA, 22 nt, Human
aaauauaguaaaugcauaguuc

SEQ ID NO: 1045514 - RNA, 22 nt, Human
ugugaauaccuugaauucauca

SEQ ID NO: 1045515 - RNA, 20 nt, Human
aguacaauguaugauucaga

SEQ ID NO: 1045516 - RNA, 22 nt, Human
ugugggccugggaaggugacac

SEQ ID NO: 1045517 - RNA, 22 nt, Human
cagaaacauguauaaaguugua

SEQ ID NO: 1045518 - RNA, 22 nt, Human
agcugcccuuuaugaugcugaa

SEQ ID NO: 1045519 - RNA, 22 nt, Human
auucuacaacccaauaauaauu

SEQ ID NO: 1045520 - RNA, 22 nt, Human
uggauuuauggagaccgaaagu

SEQ ID NO: 1045521 - RNA, 22 nt, Human
agcccagccugauucuacaccc

SEQ ID NO: 1045522 - RNA, 22 nt, Human
aaucagucucauuuagcaggga

SEQ ID NO: 1045523 - RNA, 18 nt, Human
cuuucagauggauaugcu

SEQ ID NO: 1045524 - RNA, 22 nt, Human
cccuccagcucaaagcaaccgg

SEQ ID NO: 1045525 - RNA, 22 nt, Human
aaagaaggggucuacauccaau

SEQ ID NO: 1045526 - RNA, 22 nt, Human
caaguccuccaugugacuaggu

SEQ ID NO: 1045527 - RNA, 22 nt, Human
aagcagagccugagacagggau

SEQ ID NO: 1045528 - RNA, 22 nt, Human
accagcauuugcagaaauggag

SEQ ID NO: 1045529 - RNA, 22 nt, Human
uuauccaaacuggugaaucauu

SEQ ID NO: 1045530 - RNA, 22 nt, Human
gagggcuguggggcaugaccag

SEQ ID NO: 1045531 - RNA, 21 nt, Human
caauuucaugggaagauggga

SEQ ID NO: 1045532 - RNA, 22 nt, Human
auguacaaaauguuuugaaaug

SEQ ID NO: 1045533 - RNA, 22 nt, Human
auggcuuucagauuucuauguu

SEQ ID NO: 1045534 - RNA, 22 nt, Human
auacaugugggucuaaacauau

SEQ ID NO: 1045535 - RNA, 22 nt, Human
gcugcccauuccacuggauggu

SEQ ID NO: 1045536 - RNA, 22 nt, Human
caccacuucauaggcuuuaagg

SEQ ID NO: 1045537 - RNA, 22 nt, Human
uaauuucacugauaugaaguca

SEQ ID NO: 1045538 - RNA, 22 nt, Human
cccuccagccauggacccaggu

SEQ ID NO: 1045539 - RNA, 22 nt, Human
ugucauaaucaguuuugcaugu

SEQ ID NO: 1045540 - RNA, 22 nt, Human
ucagaaaugaucguuauucauu

SEQ ID NO: 1045541 - RNA, 22 nt, Human
ugggcugccggcaggcucugcc

SEQ ID NO: 1045542 - RNA, 22 nt, Human
ugcagugguugagagcccagac

SEQ ID NO: 1045543 - RNA, 22 nt, Human
uccuuguugcugcagucaccug

SEQ ID NO: 1045544 - RNA, 22 nt, Human
guauacagauacuuagacgugc

SEQ ID NO: 1045545 - RNA, 22 nt, Human
uggagaauuuugucaccagaca

SEQ ID NO: 1045546 - RNA, 22 nt, Human
caguccuuauuccuauauuccu

SEQ ID NO: 1045547 - RNA, 22 nt, Human
aggagacauaacuaugaugaga

SEQ ID NO: 1045548 - RNA, 22 nt, Human
ccugcccagcuucaccucaggc

SEQ ID NO: 1045549 - RNA, 22 nt, Human
uacaguaagaugaaauagcaau

SEQ ID NO: 1045550 - RNA, 22 nt, Human
agcagggaauagcggaaagaau

SEQ ID NO: 1045551 - RNA, 22 nt, Human
cuccuuagugccucugcacgag

SEQ ID NO: 1045552 - RNA, 22 nt, Human
aaucccagcuacucaggaaguu

SEQ ID NO: 1045553 - RNA, 22 nt, Human
uacaagaaauuucugcauauau

SEQ ID NO: 1045554 - RNA, 22 nt, Human
gcccagggcgauggucggggcc

SEQ ID NO: 1045555 - RNA, 22 nt, Human
cuccuuccugcagaucugagau

SEQ ID NO: 1045556 - RNA, 22 nt, Human
uuuaggcaugcaguucuauuua

SEQ ID NO: 1045557 - RNA, 22 nt, Human
auggcuuuucacagaggguucu

SEQ ID NO: 1045558 - RNA, 22 nt, Human
guuaaagaagaauaguuccuuu

SEQ ID NO: 1045559 - RNA, 22 nt, Human
ggcauuuaucuaauauaguuua

SEQ ID NO: 1045560 - RNA, 22 nt, Human
cauaaaauggcuuguucuuuaa

SEQ ID NO: 1045561 - RNA, 22 nt, Human
aggagacaucuaacuguagguu

SEQ ID NO: 1045562 - RNA, 22 nt, Human
uguccuuauauuguggaagggg

SEQ ID NO: 1045563 - RNA, 22 nt, Human
agacauggagaaggagccagug

SEQ ID NO: 1045564 - RNA, 22 nt, Human
cauuucaaugccuucaacauag

SEQ ID NO: 1045565 - RNA, 22 nt, Human
caaagccaggcuuucuaaugua

SEQ ID NO: 1045566 - RNA, 22 nt, Human
gcagggaagggaaacagagacc

SEQ ID NO: 1045567 - RNA, 22 nt, Human
aaagcagcaaauacuuuugcac

SEQ ID NO: 1045568 - RNA, 22 nt, Human
gcccuagggggaaccgaggacu

SEQ ID NO: 1045569 - RNA, 22 nt, Human
ucaaaauucuagggagaauggu

SEQ ID NO: 1045570 - RNA, 22 nt, Human
uuuagaaugugacuguauuuga

SEQ ID NO: 1045571 - RNA, 22 nt, Human
uuaaggauguugugauuuauua

SEQ ID NO: 1045572 - RNA, 22 nt, Human
auggcauuugaaucugucuuuu

SEQ ID NO: 1045573 - RNA, 22 nt, Human
ccaggguaccccaagggcaggu

SEQ ID NO: 1045574 - RNA, 22 nt, Human
ccccagggucaguguguggagg

SEQ ID NO: 1045575 - RNA, 22 nt, Human
aauguaaacagcaagagaaggg

SEQ ID NO: 1045576 - RNA, 22 nt, Human
agcgcccaggggcagggcucuc

SEQ ID NO: 1045577 - RNA, 22 nt, Human
ggcugccugugcccaggcacac

SEQ ID NO: 1045578 - RNA, 22 nt, Human
auucauaacggcaaaugucacc

SEQ ID NO: 1045579 - RNA, 22 nt, Human
cuuagaaagaguuuucuccccu

SEQ ID NO: 1045580 - RNA, 19 nt, Human
ccccaggguaggcuagggg

SEQ ID NO: 1045581 - RNA, 22 nt, Human
agaaucugguagaaccaaggau

SEQ ID NO: 1045582 - RNA, 22 nt, Human
ucaauucaauugaacaguuacu

SEQ ID NO: 1045583 - RNA, 22 nt, Human
agucaccaacaugguucccagg

SEQ ID NO: 1045584 - RNA, 22 nt, Human
caagggaguuacugagggcggg

SEQ ID NO: 1045585 - RNA, 22 nt, Human
aguccuuaugugguggagagag

SEQ ID NO: 1045586 - RNA, 22 nt, Human
gaauuucauugcucugcugugu

SEQ ID NO: 1045587 - RNA, 22 nt, Human
aauuucaaacuaauaggaacca

SEQ ID NO: 1045588 - RNA, 22 nt, Human
guuccaaagucucugagcugag

SEQ ID NO: 1045589 - RNA, 22 nt, Human
auccaaaccuggacaugagugg

SEQ ID NO: 1045590 - RNA, 22 nt, Human
gcaaaauuaaacuuagcaucau

SEQ ID NO: 1045591 - RNA, 22 nt, Human
uaaacauggauucugaucacag

SEQ ID NO: 1045592 - RNA, 22 nt, Human
ugggaggcagguaggugaugau

SEQ ID NO: 1045593 - RNA, 22 nt, Human
uaccuugggcuauuaucuuuga

SEQ ID NO: 1045594 - RNA, 22 nt, Human
gguacaaugguucauuuuaugu

SEQ ID NO: 1045595 - RNA, 22 nt, Human
ugaauaauccacagucauucau

SEQ ID NO: 1045596 - RNA, 22 nt, Human
ucaacuuuaguguagcuauuua

SEQ ID NO: 1045597 - RNA, 22 nt, Human
uauggcuuuuaacugucguaug

SEQ ID NO: 1045598 - RNA, 22 nt, Human
cuuagaaaucgaacucagguua

SEQ ID NO: 1045599 - RNA, 22 nt, Human
aauguuuuaaaagagauugaga

SEQ ID NO: 1045600 - RNA, 22 nt, Human
agggcugccauuucuggcccaa

SEQ ID NO: 1045601 - RNA, 22 nt, Human
uaucagaaaugccuuaaauugg

SEQ ID NO: 1045602 - RNA, 22 nt, Human
uaaagucaucuuuacaucuuug

SEQ ID NO: 1045603 - RNA, 22 nt, Human
acaugaaaaauguuugcaguuu

SEQ ID NO: 1045604 - RNA, 22 nt, Human
acugcccaugugcaucaaguag

SEQ ID NO: 1045605 - RNA, 22 nt, Human
aggagacacugagacuucacca

SEQ ID NO: 1045606 - RNA, 22 nt, Human
aagaaaucagaaaagcauucgu

SEQ ID NO: 1045607 - RNA, 22 nt, Human
cuaugacacaggccauuauaua

SEQ ID NO: 1045608 - RNA, 22 nt, Human
cuccaguggugauggggaagaa

SEQ ID NO: 1045609 - RNA, 22 nt, Human
cuauaauuaugcucaaaaugua

SEQ ID NO: 1045610 - RNA, 22 nt, Human
gaggggagacagggaaaucagu

SEQ ID NO: 1045611 - RNA, 22 nt, Human
acuuuaucaggaaucacacagc

SEQ ID NO: 1045612 - RNA, 22 nt, Human
ucccuggcacugcugugauuag

SEQ ID NO: 1045613 - RNA, 22 nt, Human
gauuuccaggucauuaauaaag

SEQ ID NO: 1045614 - RNA, 22 nt, Human
uggggagacuggccgagauccu

SEQ ID NO: 1045615 - RNA, 21 nt, Human
uucaaagacuugaugcugacc

SEQ ID NO: 1045616 - RNA, 19 nt, Human
ugcuuaauuccuaguaggu

SEQ ID NO: 1045617 - RNA, 22 nt, Human
caauuuuuaaacuaugaaguug

SEQ ID NO: 1045618 - RNA, 21 nt, Human
agggccugugcucuccagguc

SEQ ID NO: 1045619 - RNA, 22 nt, Human
cgggcugcucuggaccgacagc

SEQ ID NO: 1045620 - RNA, 22 nt, Human
uugaauaaaugagcagugaauu

SEQ ID NO: 1045621 - RNA, 22 nt, Human
acauucacuauguccaaacucu

SEQ ID NO: 1045622 - RNA, 22 nt, Human
uuguuaaaaauagauuuccagg

SEQ ID NO: 1045623 - RNA, 22 nt, Human
caauuucaauacaaaauacauu

SEQ ID NO: 1045624 - RNA, 22 nt, Human
uaauuucagugcaagcucacgg

SEQ ID NO: 1045625 - RNA, 22 nt, Human
cacaauuuccaagucauguuau

SEQ ID NO: 1045626 - RNA, 22 nt, Human
cucccagguuacaucugagccu

SEQ ID NO: 1045627 - RNA, 22 nt, Human
cuuaaacugaaagcuacaagau

SEQ ID NO: 1045628 - RNA, 22 nt, Human
gcacaauaacagccaagguuau

SEQ ID NO: 1045629 - RNA, 22 nt, Human
uacacaugaucauuuaguagca

SEQ ID NO: 1045630 - RNA, 22 nt, Human
cccaggcagccccagaagcuug

SEQ ID NO: 1045631 - RNA, 21 nt, Human
cauuucaaagagcuggaaauc

SEQ ID NO: 1045632 - RNA, 22 nt, Human
ccagggaaauuaaugaguuaau

SEQ ID NO: 1045633 - RNA, 22 nt, Human
uccuggauaucaaacaaacauu

SEQ ID NO: 1045634 - RNA, 22 nt, Human
ugcuuuaaaauggacuguuuug

SEQ ID NO: 1045635 - RNA, 20 nt, Human
auucuaaagcucugcucuuu

SEQ ID NO: 1045636 - RNA, 22 nt, Human
gcugcccacaaugauuacaugg

SEQ ID NO: 1045637 - RNA, 22 nt, Human
gccaaggguaguggaggccccu

SEQ ID NO: 1045638 - RNA, 22 nt, Human
aucacaaaggucucagagcaca

SEQ ID NO: 1045639 - RNA, 22 nt, Human
aagcagggcuuuaagcgguuuu

SEQ ID NO: 1045640 - RNA, 22 nt, Human
ucuccaggaaccaucaugguaa

SEQ ID NO: 1045641 - RNA, 19 nt, Human
ccagccucucuuccacccc

SEQ ID NO: 1045642 - RNA, 22 nt, Human
uguaaauaguuagcuugccucu

SEQ ID NO: 1045643 - RNA, 20 nt, Human
acuggaucuggcuggagcug

SEQ ID NO: 1045644 - RNA, 18 nt, Human
ccucuaccuaccccuaga

SEQ ID NO: 1045645 - RNA, 19 nt, Human
guuaggcaggguggggagu

SEQ ID NO: 1045646 - RNA, 22 nt, Human
agaggguaugaguggggcuaaa

SEQ ID NO: 1045647 - RNA, 22 nt, Human
cagggauggccuggcgggccac

SEQ ID NO: 1045648 - RNA, 22 nt, Human
agaggaggccaggcccacaccu

SEQ ID NO: 1045649 - RNA, 22 nt, Human
uuccuuaggcuguuugcagugc

SEQ ID NO: 1045650 - RNA, 22 nt, Human
ucagccagaggcuucuugguuu

SEQ ID NO: 1045651 - RNA, 22 nt, Human
uuucaacauauaccauaaugcc

SEQ ID NO: 1045652 - RNA, 22 nt, Human
ucucuuggacauguggcucugc

SEQ ID NO: 1045653 - RNA, 22 nt, Human
gaguccuuggcaucaucaguac

SEQ ID NO: 1045654 - RNA, 22 nt, Human
gcugcaccagcugcacccagua

SEQ ID NO: 1045655 - RNA, 22 nt, Human
uugauuaaucccaugugaguag

SEQ ID NO: 1045656 - RNA, 22 nt, Human
cuggcuuucccuggacaacagc

SEQ ID NO: 1045657 - RNA, 22 nt, Human
ugggagagugcucaaugugcaa

SEQ ID NO: 1045658 - RNA, 22 nt, Human
guggcugcaucggggugaccag

SEQ ID NO: 1045659 - RNA, 22 nt, Human
aaucagaacgcucgaucuucgg

SEQ ID NO: 1045660 - RNA, 22 nt, Human
uucauacuguguuuccaaguuu

SEQ ID NO: 1045661 - RNA, 22 nt, Human
gaggcagcugaagcuucaaaga

SEQ ID NO: 1045662 - RNA, 22 nt, Human
gguggggcccuggcacugguau

SEQ ID NO: 1045663 - RNA, 22 nt, Human
caauuucacuaaugaugugggg

SEQ ID NO: 1045664 - RNA, 22 nt, Human
gccccagcguggcuguguuagg

SEQ ID NO: 1045665 - RNA, 22 nt, Human
ugcuuaauagugcacugguuuc

SEQ ID NO: 1045666 - RNA, 22 nt, Human
gcuccaggcagagccucuuucg

SEQ ID NO: 1045667 - RNA, 22 nt, Human
acauaauagguaccugaauaau

SEQ ID NO: 1045668 - RNA, 22 nt, Human
ugcuuauugcuuucaagacugu

SEQ ID NO: 1045669 - RNA, 22 nt, Human
gagacgggguuugagacggguu

SEQ ID NO: 1045670 - RNA, 22 nt, Human
gggugagacagaaagagcaaaa

SEQ ID NO: 1045671 - RNA, 22 nt, Human
ucuccaggggcagggucuggag

SEQ ID NO: 1045672 - RNA, 22 nt, Human
acauuaccuggcauuugaucuu

SEQ ID NO: 1045673 - RNA, 22 nt, Human
gcagaauuuucuguuuucuaga

SEQ ID NO: 1045674 - RNA, 22 nt, Human
augugcuucauucuacaugaca

SEQ ID NO: 1045675 - RNA, 22 nt, Human
uuaauucuaguuuaacacuuag

SEQ ID NO: 1045676 - RNA, 22 nt, Human
gaguggggaaagccaggacaga

SEQ ID NO: 1045677 - RNA, 22 nt, Human
gaguccuuuucucuguccacug

SEQ ID NO: 1045678 - RNA, 22 nt, Human
acuggauuccauugugcaaaga

SEQ ID NO: 1045679 - RNA, 22 nt, Human
auauacugauagcugcacuucu

SEQ ID NO: 1045680 - RNA, 22 nt, Human
aauaauauuugaagcuucaaag

SEQ ID NO: 1045681 - RNA, 22 nt, Human
uauccaaacauauagucucucu

SEQ ID NO: 1045682 - RNA, 22 nt, Human
gagauggggaauaggagcaagc

SEQ ID NO: 1045683 - RNA, 22 nt, Human
gggagacaguucagauaguuuc

SEQ ID NO: 1045684 - RNA, 22 nt, Human
uccagggacacagaguccuucu

SEQ ID NO: 1045685 - RNA, 22 nt, Human
caacuuucuguuaaauguuagu

SEQ ID NO: 1045686 - RNA, 20 nt, Human
agaagucagcucagaaguga

SEQ ID NO: 1045687 - RNA, 22 nt, Human
ucugcccaaggcugucacuaga

SEQ ID NO: 1045688 - RNA, 22 nt, Human
aguagaauagauggauacuauu

SEQ ID NO: 1045689 - RNA, 22 nt, Human
aggcagcagccacaaggccuga

SEQ ID NO: 1045690 - RNA, 22 nt, Human
ucagggaaaggggagagucauu

SEQ ID NO: 1045691 - RNA, 21 nt, Human
gcugcccaacccugcaucucc

SEQ ID NO: 1045692 - RNA, 23 nt, Human
aggauuuaaaggcaaugcauuuu

SEQ ID NO: 1045693 - RNA, 22 nt, Human
uccaaaaaacguuugaauaguu

SEQ ID NO: 1045694 - RNA, 22 nt, Human
gaguccuugucauaauucagug

SEQ ID NO: 1045695 - RNA, 22 nt, Human
agggcugcuauguugauucaga

SEQ ID NO: 1045696 - RNA, 22 nt, Human
gccuaauaacuagcuguguaac

SEQ ID NO: 1045697 - RNA, 22 nt, Human
gacagccaggcauagggaguau

SEQ ID NO: 1045698 - RNA, 22 nt, Human
uugaagaaagucauauauaaug

SEQ ID NO: 1045699 - RNA, 22 nt, Human
caaagcaccacaaaccagguga

SEQ ID NO: 1045700 - RNA, 22 nt, Human
auggauuugcuuauacacaugu

SEQ ID NO: 1045701 - RNA, 22 nt, Human
aggcagcaaaugucuggaacag

SEQ ID NO: 1045702 - RNA, 22 nt, Human
gaucagaaugggacauauccug

SEQ ID NO: 1045703 - RNA, 22 nt, Human
ugucaccaaguugaugaaugca

SEQ ID NO: 1045704 - RNA, 22 nt, Human
ccaaagcaagucacaugaucaa

SEQ ID NO: 1045705 - RNA, 22 nt, Human
aaacuuuguagagaaugcuggc

SEQ ID NO: 1045706 - RNA, 22 nt, Human
aggcagcagagguugaggaaag

SEQ ID NO: 1045707 - RNA, 22 nt, Human
cuggauuuuagaaggcuuccua

SEQ ID NO: 1045708 - RNA, 22 nt, Human
aagucacaagcauauaugcauu

SEQ ID NO: 1045709 - RNA, 23 nt, Human
cagggcccugcucaauuucucca

SEQ ID NO: 1045710 - RNA, 22 nt, Human
caucagucuagauucuaguacc

SEQ ID NO: 1045711 - RNA, 22 nt, Human
ugcuucccucacuucaccuggc

SEQ ID NO: 1045712 - RNA, 22 nt, Human
uggauuaguuaagaaauguuag

SEQ ID NO: 1045713 - RNA, 22 nt, Human
ccagcugucagugugaaaauaa

SEQ ID NO: 1045714 - RNA, 22 nt, Human
uugauggcugugauuuacucag

SEQ ID NO: 1045715 - RNA, 22 nt, Human
ucuccagggacugaggcuggag

SEQ ID NO: 1045716 - RNA, 22 nt, Human
ccaugggaauugggagguccca

SEQ ID NO: 1045717 - RNA, 22 nt, Human
cuccagggaggagcacggguuc

SEQ ID NO: 1045718 - RNA, 22 nt, Human
uaggagggcccugaaaauggca

SEQ ID NO: 1045719 - RNA, 22 nt, Human
aaggacagggaugguugauugu

SEQ ID NO: 1045720 - RNA, 22 nt, Human
aggagaggcucuaacucugugu

SEQ ID NO: 1045721 - RNA, 22 nt, Human
caucagaaucugagucucugcc

SEQ ID NO: 1045722 - RNA, 22 nt, Human
uucaacucuucaagaucacauc

SEQ ID NO: 1045723 - RNA, 22 nt, Human
gcagccucugcaguucaggagg

SEQ ID NO: 1045724 - RNA, 22 nt, Human
agaauucauaggaaguuuccua

SEQ ID NO: 1045725 - RNA, 20 nt, Human
ugaggcaggagaauggcaug

SEQ ID NO: 1045726 - RNA, 22 nt, Human
auacagaagccuguauuucugg

SEQ ID NO: 1045727 - RNA, 22 nt, Human
uacagaaaaacuggcauugaag

SEQ ID NO: 1045728 - RNA, 22 nt, Human
cuggcagugcccagucacuguu

SEQ ID NO: 1045729 - RNA, 22 nt, Human
ucugcccaguuugugcucaggu

SEQ ID NO: 1045730 - RNA, 21 nt, Human
ugccagggauuuacagagccu

SEQ ID NO: 1045731 - RNA, 22 nt, Human
uaggcagaauuguugaaugaag

SEQ ID NO: 1045732 - RNA, 21 nt, Human
uuuaaagaauaggaagggagg

SEQ ID NO: 1045733 - RNA, 22 nt, Human
auuaugcugguuuacacauuuu

SEQ ID NO: 1045734 - RNA, 22 nt, Human
uuccuccacgugacaggagcca

SEQ ID NO: 1045735 - RNA, 22 nt, Human
uaucugagaaagaagcaccaga

SEQ ID NO: 1045736 - RNA, 22 nt, Human
gacaagacagcuugcagacaac

SEQ ID NO: 1045737 - RNA, 22 nt, Human
guacagaaaugugaugacgcaa

SEQ ID NO: 1045738 - RNA, 22 nt, Human
cuuaaagaguauuuaauauaau

SEQ ID NO: 1045739 - RNA, 22 nt, Human
ccaaaauuaagccucuuauguu

SEQ ID NO: 1045740 - RNA, 22 nt, Human
gaggagggagcuggaagcucuu

SEQ ID NO: 1045741 - RNA, 22 nt, Human
cagaaaauaaaguuucuacgca

SEQ ID NO: 1045742 - RNA, 22 nt, Human
cuuacagagaagaaaauguagu

SEQ ID NO: 1045743 - RNA, 22 nt, Human
cuccagggaggucugcaggacu

SEQ ID NO: 1045744 - RNA, 22 nt, Human
ggcugcccugggaggcaagggu

SEQ ID NO: 1045745 - RNA, 22 nt, Human
uacuuugaagacaauaucugga

SEQ ID NO: 1045746 - RNA, 22 nt, Human
uaugcuguggaaaauacaaaga

SEQ ID NO: 1045747 - RNA, 22 nt, Human
uauccuuguacuauaguauuua

SEQ ID NO: 1045748 - RNA, 22 nt, Human
uagcaucuguucuuucauuaaa

SEQ ID NO: 1045749 - RNA, 22 nt, Human
uuagacaagggcuccuuaaaag

SEQ ID NO: 1045750 - RNA, 22 nt, Human
gcacagccggaccgaggaaaag

SEQ ID NO: 1045751 - RNA, 22 nt, Human
ccagauuugagcgucuuaaacc

SEQ ID NO: 1045752 - RNA, 22 nt, Human
uuaaagauucugaggcugauua

SEQ ID NO: 1045753 - RNA, 22 nt, Human
aauuaaaugacaggggaagaug

SEQ ID NO: 1045754 - RNA, 22 nt, Human
uuuaggcagaacauggacuuug

SEQ ID NO: 1045755 - RNA, 22 nt, Human
agagaugaacauaaaacaagga

SEQ ID NO: 1045756 - RNA, 23 nt, Human
cagaaaucugaaaucuagaaaug

SEQ ID NO: 1045757 - RNA, 22 nt, Human
uuuaggcagaagcccugcugau

SEQ ID NO: 1045758 - RNA, 22 nt, Human
auauauaaccuggauaaggcuu

SEQ ID NO: 1045759 - RNA, 22 nt, Human
uucagccugucugcagaccccu

SEQ ID NO: 1045760 - RNA, 22 nt, Human
ucuccaggacugagcuccagcc

SEQ ID NO: 1045761 - RNA, 22 nt, Human
agggagugguuaagaaggugca

SEQ ID NO: 1045762 - RNA, 22 nt, Human
cuuaauuacuguccaauaugca

SEQ ID NO: 1045763 - RNA, 22 nt, Human
uagcaucuggagaaacaagucc

SEQ ID NO: 1045764 - RNA, 21 nt, Human
caaguccuuugccaaagugcu

SEQ ID NO: 1045765 - RNA, 22 nt, Human
uaaaauugcggugaauauuucc

SEQ ID NO: 1045766 - RNA, 22 nt, Human
acagaauuaaugaaaauuacaa

SEQ ID NO: 1045767 - RNA, 22 nt, Human
ucagccucucugaguccagacc

SEQ ID NO: 1045768 - RNA, 22 nt, Human
aauauuucugcagaaugguuuu

SEQ ID NO: 1045769 - RNA, 23 nt, Human
uuaagacuggcugaacuuaguag

SEQ ID NO: 1045770 - RNA, 22 nt, Human
aucuccucccgcgccgagcucg

SEQ ID NO: 1045771 - RNA, 22 nt, Human
ccaguuugagguuucaagaugu

SEQ ID NO: 1045772 - RNA, 22 nt, Human
uggggagaguuacaaggaaucu

SEQ ID NO: 1045773 - RNA, 22 nt, Human
cagcccugcucuuagugucucc

SEQ ID NO: 1045774 - RNA, 22 nt, Human
cagggacagccuugggguggcg

SEQ ID NO: 1045775 - RNA, 22 nt, Human
gcuccaggccacggcuucuugg

SEQ ID NO: 1045776 - RNA, 22 nt, Human
ucuccaggcacuaccuggguaa

SEQ ID NO: 1045777 - RNA, 22 nt, Human
aguaaacauagaauguucuucc

SEQ ID NO: 1045778 - RNA, 19 nt, Human
uccagccugcuguuucucu

SEQ ID NO: 1045779 - RNA, 22 nt, Human
agugggaggcggcugacgggcg

SEQ ID NO: 1045780 - RNA, 22 nt, Human
gagggggcuagcgcagugccca

SEQ ID NO: 1045781 - RNA, 22 nt, Human
caggguagggcaagggaaccug

SEQ ID NO: 1045782 - RNA, 22 nt, Human
gagccucguggcggccacugcg

SEQ ID NO: 1045783 - RNA, 21 nt, Human
uaaauaauaaguugcugagau

SEQ ID NO: 1045784 - RNA, 22 nt, Human
acaaagucacaauaauuaaccu

SEQ ID NO: 1045785 - RNA, 22 nt, Human
cagaaaucauugugaugacagg

SEQ ID NO: 1045786 - RNA, 22 nt, Human
aaaaagguugauccagauuagg

SEQ ID NO: 1045787 - RNA, 22 nt, Human
uccagggagagccgcugcucca

SEQ ID NO: 1045788 - RNA, 22 nt, Human
ugucauaacuuagugacaaauc

SEQ ID NO: 1045789 - RNA, 21 nt, Human
ugggccaguagaaaggaaggc

SEQ ID NO: 1045790 - RNA, 22 nt, Human
uuuaggcacagaguugagggac

SEQ ID NO: 1045791 - RNA, 17 nt, Human
ucuccaggacgagcuca

SEQ ID NO: 1045792 - RNA, 22 nt, Human
cauagaaaucaggugagaaucu

SEQ ID NO: 1045793 - RNA, 17 nt, Human
ugaaaucagcacccagg

SEQ ID NO: 1045794 - RNA, 22 nt, Human
aaagcagcagaaucucucaggg

SEQ ID NO: 1045795 - RNA, 22 nt, Human
auaacaugaccugugcuucaca

SEQ ID NO: 1045796 - RNA, 22 nt, Human
uguacaaugccgagacuaacuc

SEQ ID NO: 1045797 - RNA, 22 nt, Human
agcugcccaaggucacagagcu

SEQ ID NO: 1045798 - RNA, 22 nt, Human
agaugcugggaggcugagugca

SEQ ID NO: 1045799 - RNA, 21 nt, Human
aaauggauagggcaauggaag

SEQ ID NO: 1045800 - RNA, 22 nt, Human
acaaagucaaauugcagccgcc

SEQ ID NO: 1045801 - RNA, 22 nt, Human
ugggagagucuaaaaccgaggu

SEQ ID NO: 1045802 - RNA, 22 nt, Human
uuagaaauauggugcugccgcc

SEQ ID NO: 1045803 - RNA, 22 nt, Human
ucagggaaugggcccagucccu

SEQ ID NO: 1045804 - RNA, 22 nt, Human
ucacauuucgcaucaguccgau

SEQ ID NO: 1045805 - RNA, 22 nt, Human
uuugaauagcauaggauuacau

SEQ ID NO: 1045806 - RNA, 22 nt, Human
auggcuuugcucaaguuuagcc

SEQ ID NO: 1045807 - RNA, 22 nt, Human
aaaauugaggcucauguuaaau

SEQ ID NO: 1045808 - RNA, 22 nt, Human
gcugcccaggaagccugggguu

SEQ ID NO: 1045809 - RNA, 18 nt, Human
agggcccugguggccauu

SEQ ID NO: 1045810 - RNA, 22 nt, Human
uuccuuagcugucccuggaaau

SEQ ID NO: 1045811 - RNA, 22 nt, Human
auuucaggagcaguuucagugg

SEQ ID NO: 1045812 - RNA, 22 nt, Human
ucauacacaagagcauguaaca

SEQ ID NO: 1045813 - RNA, 22 nt, Human
uguguacacagauaguaauggc

SEQ ID NO: 1045814 - RNA, 22 nt, Human
uugcacaugauagaugauuucu

SEQ ID NO: 1045815 - RNA, 22 nt, Human
auagaauucuuugaaauuuaug

SEQ ID NO: 1045816 - RNA, 22 nt, Human
uuaauuaugcaaaaggccccau

SEQ ID NO: 1045817 - RNA, 22 nt, Human
uacagagauacucuagaucaaa

SEQ ID NO: 1045818 - RNA, 22 nt, Human
uaauuucaauagcuugcauaau

SEQ ID NO: 1045819 - RNA, 23 nt, Human
ccagggagugcuacuaucaagcc

SEQ ID NO: 1045820 - RNA, 22 nt, Human
uaaucuacuguuuauaugaaau

SEQ ID NO: 1045821 - RNA, 22 nt, Human
ucagggaacaucguuaaacuag

SEQ ID NO: 1045822 - RNA, 22 nt, Human
ccagucccgcaugguccagaau

SEQ ID NO: 1045823 - RNA, 22 nt, Human
uggagacaugggcgaaucuaag

SEQ ID NO: 1045824 - RNA, 22 nt, Human
cuaacuuuagcuuagauuauca

SEQ ID NO: 1045825 - RNA, 22 nt, Human
uggcaauuuuaggugguuuagu

SEQ ID NO: 1045826 - RNA, 22 nt, Human
gagucaccacacggugcugacu

SEQ ID NO: 1045827 - RNA, 22 nt, Human
aucagaauaauuagauuucaga

SEQ ID NO: 1045828 - RNA, 22 nt, Human
cuagaaaucucuguuuacauca

SEQ ID NO: 1045829 - RNA, 22 nt, Human
ucuccaggaagcccucccugac

SEQ ID NO: 1045830 - RNA, 22 nt, Human
ggcaguggugggaggcucgcuc

SEQ ID NO: 1045831 - RNA, 22 nt, Human
aguggcuucauuucugccagaa

SEQ ID NO: 1045832 - RNA, 22 nt, Human
caacuuuaugauugguuuguca

SEQ ID NO: 1045833 - RNA, 22 nt, Human
aggcaacuguuugauaauguug

SEQ ID NO: 1045834 - RNA, 22 nt, Human
ccagaucuaguguuguaaagcu

SEQ ID NO: 1045835 - RNA, 22 nt, Human
augcuuuaaacuauaaauccac

SEQ ID NO: 1045836 - RNA, 22 nt, Human
uggggagauuguuaaauuuaga

SEQ ID NO: 1045837 - RNA, 22 nt, Human
cccagggauguggcagauguua

SEQ ID NO: 1045838 - RNA, 22 nt, Human
ggcugccuucccugagccccgg

SEQ ID NO: 1045839 - RNA, 22 nt, Human
ggcccagcaucuugugaaguuu

SEQ ID NO: 1045840 - RNA, 22 nt, Human
agcagugggugacagagcugag

SEQ ID NO: 1045841 - RNA, 22 nt, Human
auagaauagcauagaaaauuga

SEQ ID NO: 1045842 - RNA, 21 nt, Human
gaaaaccauuugcaucaugag

SEQ ID NO: 1045843 - RNA, 22 nt, Human
aaguccaugaucaagauguggc

SEQ ID NO: 1045844 - RNA, 22 nt, Human
uaucagaaggaagugccuuuaa

SEQ ID NO: 1045845 - RNA, 22 nt, Human
uacaugaaguugucuaaacugg

SEQ ID NO: 1045846 - RNA, 20 nt, Human
ugugggcccuuggcuggcaa

SEQ ID NO: 1045847 - RNA, 22 nt, Human
acugcccagugauuggugguua

SEQ ID NO: 1045848 - RNA, 22 nt, Human
aacaugucuggguauucacaag

SEQ ID NO: 1045849 - RNA, 22 nt, Human
agggagagacauuuccuucuug

SEQ ID NO: 1045850 - RNA, 22 nt, Human
cagaaucagcccuugcuauuaa

SEQ ID NO: 1045851 - RNA, 22 nt, Human
gccagccugugcuuggccaggc

SEQ ID NO: 1045852 - RNA, 22 nt, Human
uaauuguagcuuuguaaucagc

SEQ ID NO: 1045853 - RNA, 22 nt, Human
auuucaacacuuuuggaauuag

SEQ ID NO: 1045854 - RNA, 20 nt, Human
cccagcccgggccgcgcucg

SEQ ID NO: 1045855 - RNA, 20 nt, Human
cuccaguguucaggggagug

SEQ ID NO: 1045856 - RNA, 19 nt, Human
agggcugcucuggccuggg

SEQ ID NO: 1045857 - RNA, 22 nt, Human
gagauuuaauuggauuaacuua

SEQ ID NO: 1045858 - RNA, 22 nt, Human
aagucacccacaggcagcagaa

SEQ ID NO: 1045859 - RNA, 22 nt, Human
cagcccugugcuaagcacccuc

SEQ ID NO: 1045860 - RNA, 19 nt, Human
acagggaauuuccacagaa

SEQ ID NO: 1045861 - RNA, 22 nt, Human
agaaaucauugaauuauuugcu

SEQ ID NO: 1045862 - RNA, 22 nt, Human
guuaggcaaauaacuguggagc

SEQ ID NO: 1045863 - RNA, 22 nt, Human
uccccacucugggccaccacaa

SEQ ID NO: 1045864 - RNA, 22 nt, Human
uucacagauuucccugcacaug

SEQ ID NO: 1045865 - RNA, 22 nt, Human
aggcagcaugggcccagagucc

SEQ ID NO: 1045866 - RNA, 22 nt, Human
augggagaggguaggaauuacu

SEQ ID NO: 1045867 - RNA, 22 nt, Human
acaacuuuguagcaauuccacg

SEQ ID NO: 1045868 - RNA, 22 nt, Human
gaugggauuuuuuauguguuca

SEQ ID NO: 1045869 - RNA, 22 nt, Human
gcagggcaaacccagguguuca

SEQ ID NO: 1045870 - RNA, 22 nt, Human
aaaugaaaugagugccuggagg

SEQ ID NO: 1045871 - RNA, 22 nt, Human
guuaggcaugaguguguauuaa

SEQ ID NO: 1045872 - RNA, 22 nt, Human
aauauuaucaaaagcuuuuuca

SEQ ID NO: 1045873 - RNA, 22 nt, Human
auauacaguuuuacaggguuuc

SEQ ID NO: 1045874 - RNA, 22 nt, Human
acccagggcagccagcggggag

SEQ ID NO: 1045875 - RNA, 22 nt, Human
cagaucuagagcuuuuccaucu

SEQ ID NO: 1045876 - RNA, 22 nt, Human
uuuauccagcagcuauucaaaa

SEQ ID NO: 1045877 - RNA, 22 nt, Human
cuuccaaagcacuuuauggacc

SEQ ID NO: 1045878 - RNA, 22 nt, Human
agggagaguuugauguuuccuc

SEQ ID NO: 1045879 - RNA, 22 nt, Human
uuuaggcaagaacucacugaga

SEQ ID NO: 1045880 - RNA, 22 nt, Human
gaugaaaaaagacgagcauaua

SEQ ID NO: 1045881 - RNA, 21 nt, Human
uaucagaagagaaagaaugau

SEQ ID NO: 1045882 - RNA, 22 nt, Human
uuauacaguuuauacuuagaau

SEQ ID NO: 1045883 - RNA, 22 nt, Human
uugauacuauuaagcacugggc

SEQ ID NO: 1045884 - RNA, 22 nt, Human
gaggagguuccggguggagaag

SEQ ID NO: 1045885 - RNA, 22 nt, Human
aaauacuguagauaauagaguu

SEQ ID NO: 1045886 - RNA, 18 nt, Human
cuggcuuucuuauccauc

SEQ ID NO: 1045887 - RNA, 22 nt, Human
cagagauuauuauaacuaauua

SEQ ID NO: 1045888 - RNA, 22 nt, Human
ccaccaggcacucacagggaag

SEQ ID NO: 1045889 - RNA, 22 nt, Human
caaguccucugguuucaaauag

SEQ ID NO: 1045890 - RNA, 22 nt, Human
auuaggcacuagaaugucaauu

SEQ ID NO: 1045891 - RNA, 22 nt, Human
auccuuaguuaagaacaggagu

SEQ ID NO: 1045892 - RNA, 23 nt, Human
cagaaauaaacugguuuguagau

SEQ ID NO: 1045893 - RNA, 22 nt, Human
uccagggagauacuggcugcca

SEQ ID NO: 1045894 - RNA, 18 nt, Human
caagaaucucuaaagaag

SEQ ID NO: 1045895 - RNA, 22 nt, Human
gcagggaaguuguaauguaaug

SEQ ID NO: 1045896 - RNA, 22 nt, Human
uaugucaaaguuaagaaauagg

SEQ ID NO: 1045897 - RNA, 22 nt, Human
aaucagaacuccuaccacagag

SEQ ID NO: 1045898 - RNA, 22 nt, Human
aagagggguggucugugaggau

SEQ ID NO: 1045899 - RNA, 22 nt, Human
acuauacaguauguacgugcac

SEQ ID NO: 1045900 - RNA, 23 nt, Human
gcugccuccuacaaaagcccagc

SEQ ID NO: 1045901 - RNA, 22 nt, Human
auacagaauuugcccuuuucau

SEQ ID NO: 1045902 - RNA, 22 nt, Human
uggcugccugaucgagcaggug

SEQ ID NO: 1045903 - RNA, 22 nt, Human
acacagauuuuacauguuaugc

SEQ ID NO: 1045904 - RNA, 22 nt, Human
uccagggagucaaaugaacuac

SEQ ID NO: 1045905 - RNA, 22 nt, Human
acuuuaauuaaugaacuguggc

SEQ ID NO: 1045906 - RNA, 22 nt, Human
aaaugcauggcuguuuuaaagc

SEQ ID NO: 1045907 - RNA, 22 nt, Human
gaggcugcccacaccugcgccg

SEQ ID NO: 1045908 - RNA, 22 nt, Human
acaaaaagggagaugagguaga

SEQ ID NO: 1045909 - RNA, 22 nt, Human
gcuagggacuagggaaggagca

SEQ ID NO: 1045910 - RNA, 22 nt, Human
aaaacauguccauacagaaacu

SEQ ID NO: 1045911 - RNA, 22 nt, Human
aaucuagucuccuuaagucuuu

SEQ ID NO: 1045912 - RNA, 22 nt, Human
ucuccagguggggucaccuuuu

SEQ ID NO: 1045913 - RNA, 22 nt, Human
agaggggaggcgaaccagaguc

SEQ ID NO: 1045914 - RNA, 22 nt, Human
auggccuuagugaugauuaaua

SEQ ID NO: 1045915 - RNA, 22 nt, Human
augcuuaauacacuguuaaagg

SEQ ID NO: 1045916 - RNA, 22 nt, Human
augaaauaucuugaagaaauuc

SEQ ID NO: 1045917 - RNA, 22 nt, Human
acauucacgcucucaaagcuga

SEQ ID NO: 1045918 - RNA, 22 nt, Human
caguaaaugcagauauagauac

SEQ ID NO: 1045919 - RNA, 22 nt, Human
aaagcagccacucucucugccu

SEQ ID NO: 1045920 - RNA, 22 nt, Human
aagagagggguugcauggaaau

SEQ ID NO: 1045921 - RNA, 22 nt, Human
ccagggagcggggcugggucuc

SEQ ID NO: 1045922 - RNA, 22 nt, Human
gugagcaggauuucauggugua

SEQ ID NO: 1045923 - RNA, 22 nt, Human
uuacagaaguauugagagaucc

SEQ ID NO: 1045924 - RNA, 17 nt, Human
agcagggagucaaggga

SEQ ID NO: 1045925 - RNA, 22 nt, Human
uggggagaaaugucuuuguucc

SEQ ID NO: 1045926 - RNA, 22 nt, Human
augaaaauguacauguguauaa

SEQ ID NO: 1045927 - RNA, 22 nt, Human
gcacaauaauucuuguuuugcu

SEQ ID NO: 1045928 - RNA, 22 nt, Human
auauacugaggagacuuuauau

SEQ ID NO: 1045929 - RNA, 22 nt, Human
aaucaagucaaccaucaugugc

SEQ ID NO: 1045930 - RNA, 22 nt, Human
gugagcagggcaggacugggga

SEQ ID NO: 1045931 - RNA, 22 nt, Human
uaguaucuauuaguaacaagag

SEQ ID NO: 1045932 - RNA, 22 nt, Human
ugaaacaagauccacagacuug

SEQ ID NO: 1045933 - RNA, 22 nt, Human
gcguggggcagcccagggcuuc

SEQ ID NO: 1045934 - RNA, 22 nt, Human
uccauacauugaaauaccauuc

SEQ ID NO: 1045935 - RNA, 22 nt, Human
gagucaccacugugauagucga

SEQ ID NO: 1045936 - RNA, 22 nt, Human
ugaucugagagcagaucaccau

SEQ ID NO: 1045937 - RNA, 20 nt, Human
uucuauacauaucacugaaa

SEQ ID NO: 1045938 - RNA, 22 nt, Human
agcagggacugagccaguggga

SEQ ID NO: 1045939 - RNA, 19 nt, Human
aggauuuauuaugugcuca

SEQ ID NO: 1045940 - RNA, 22 nt, Human
uuguuucagcuguaugcuaugu

SEQ ID NO: 1045941 - RNA, 22 nt, Human
ucuguucuauuggucuaugugu

SEQ ID NO: 1045942 - RNA, 22 nt, Human
agaggaaguaaucaggaccugc

SEQ ID NO: 1045943 - RNA, 22 nt, Human
agggcugcugaggaagccuugc

SEQ ID NO: 1045944 - RNA, 22 nt, Human
uuugaacaugcugcaugauaau

SEQ ID NO: 1045945 - RNA, 22 nt, Human
ugagauggggagggcugcagaa

SEQ ID NO: 1045946 - RNA, 22 nt, Human
acuccagguuuuuucacugaag

SEQ ID NO: 1045947 - RNA, 22 nt, Human
acuaaacugaagcaugaaaagg

SEQ ID NO: 1045948 - RNA, 22 nt, Human
guccuccauggucuugaaguaa

SEQ ID NO: 1045949 - RNA, 22 nt, Human
uuaauauguugaaauuuauuag

SEQ ID NO: 1045950 - RNA, 22 nt, Human
agccauucauugugcucucaga

SEQ ID NO: 1045951 - RNA, 22 nt, Human
ggagaaugauauauagcucagu

SEQ ID NO: 1045952 - RNA, 23 nt, Human
gaggcagcuccugcagugcccug

SEQ ID NO: 1045953 - RNA, 22 nt, Human
ucuuuaauuguggaagagcagc

SEQ ID NO: 1045954 - RNA, 22 nt, Human
cauacuuucuuuuucacgcaua

SEQ ID NO: 1045955 - RNA, 22 nt, Human
auuuagccucauuuuugacaua

SEQ ID NO: 1045956 - RNA, 22 nt, Human
ccuuuaauuuacaauguuaauu

SEQ ID NO: 1045957 - RNA, 22 nt, Human
gcauggcugguguccugaggga

SEQ ID NO: 1045958 - RNA, 22 nt, Human
auuuaucucuggaaacuaagca

SEQ ID NO: 1045959 - RNA, 22 nt, Human
uuuuaguuuggauuucuaaagc

SEQ ID NO: 1045960 - RNA, 22 nt, Human
caggcagccugagggaucuggg

SEQ ID NO: 1045961 - RNA, 22 nt, Human
ccugcccacugcccggucagcc

SEQ ID NO: 1045962 - RNA, 22 nt, Human
ucacagaagagauauugacaga

SEQ ID NO: 1045963 - RNA, 22 nt, Human
uuacagaaaggaaggacugacu

SEQ ID NO: 1045964 - RNA, 22 nt, Human
cuaaaauuaucaagauaauucc

SEQ ID NO: 1045965 - RNA, 22 nt, Human
gucacagaguuauuaauugugu

SEQ ID NO: 1045966 - RNA, 22 nt, Human
caaauuccucagaaucagaaaa

SEQ ID NO: 1045967 - RNA, 21 nt, Human
caagccagaccaauagcagcc

SEQ ID NO: 1045968 - RNA, 19 nt, Human
ucagggaaguucaaagcuc

SEQ ID NO: 1045969 - RNA, 22 nt, Human
ucuuuaauucagcaugaugcgg

SEQ ID NO: 1045970 - RNA, 20 nt, Human
uggagggauuguuggcaaau

SEQ ID NO: 1045971 - RNA, 22 nt, Human
auuccaaaaggauguuagaaug

SEQ ID NO: 1045972 - RNA, 22 nt, Human
agggaaguccaugggggcggug

SEQ ID NO: 1045973 - RNA, 22 nt, Human
agggaagaaucacugggauguu

SEQ ID NO: 1045974 - RNA, 22 nt, Human
gauagaaagguguugaaaucca

SEQ ID NO: 1045975 - RNA, 20 nt, Human
uuacagaaaugauguuauuu

SEQ ID NO: 1045976 - RNA, 22 nt, Human
caguccuuggcaaguucucagu

SEQ ID NO: 1045977 - RNA, 22 nt, Human
uaagaaucugcauuuuaacaag

SEQ ID NO: 1045978 - RNA, 18 nt, Human
ucagggaaucuuggccuu

SEQ ID NO: 1045979 - RNA, 21 nt, Human
uccagaaaagaggucauuagc

SEQ ID NO: 1045980 - RNA, 22 nt, Human
aaaucagugcucauuugaaagg

SEQ ID NO: 1045981 - RNA, 22 nt, Human
gggcugcuuuuuucuuagcaga

SEQ ID NO: 1045982 - RNA, 22 nt, Human
caauuucaagauucuguucuuu

SEQ ID NO: 1045983 - RNA, 22 nt, Human
auaucagacagaaagcauugac

SEQ ID NO: 1045984 - RNA, 22 nt, Human
aggcaggggagcuggaagggua

SEQ ID NO: 1045985 - RNA, 22 nt, Human
uuuacagagaauguacauaaag

SEQ ID NO: 1045986 - RNA, 22 nt, Human
agggcugcuuaccuggaauggc

SEQ ID NO: 1045987 - RNA, 22 nt, Human
gcuucaagcuguucagaacuau

SEQ ID NO: 1045988 - RNA, 22 nt, Human
uuuccaaaggaggaaccaguuu

SEQ ID NO: 1045989 - RNA, 22 nt, Human
uuagaaaugcacccaagaccua

SEQ ID NO: 1045990 - RNA, 22 nt, Human
aguacaaugucugacacaguag

SEQ ID NO: 1045991 - RNA, 18 nt, Human
uaaauauauuucccccuu

SEQ ID NO: 1045992 - RNA, 19 nt, Human
aucugagauuauaaacaga

SEQ ID NO: 1045993 - RNA, 23 nt, Human
augguuuaugucacacuuuugau

SEQ ID NO: 1045994 - RNA, 22 nt, Human
uaaacauguugacaucuuaccu

SEQ ID NO: 1045995 - RNA, 21 nt, Human
gggagggauggaaaugauguu

SEQ ID NO: 1045996 - RNA, 22 nt, Human
aggggagaauuucaacucaggu

SEQ ID NO: 1045997 - RNA, 22 nt, Human
guucuaauauuuuaaaagccaa

SEQ ID NO: 1045998 - RNA, 22 nt, Human
cagaucuguuugccagaucagc

SEQ ID NO: 1045999 - RNA, 20 nt, Human
uuccuuaggcauuggaagaa

SEQ ID NO: 1046000 - RNA, 18 nt, Human
cagccucugauugguugc

SEQ ID NO: 1046001 - RNA, 22 nt, Human
gcccuggccuccuggaacaggc

SEQ ID NO: 1046002 - RNA, 22 nt, Human
gaauuacaugacccugaguaga

SEQ ID NO: 1046003 - RNA, 22 nt, Human
uuccagggcuagguaaugggua

SEQ ID NO: 1046004 - RNA, 22 nt, Human
aggagggaauaagaaagaguca

SEQ ID NO: 1046005 - RNA, 22 nt, Human
aauuucaaugcacucaugguug

SEQ ID NO: 1046006 - RNA, 22 nt, Human
aaaagccaugcauaccuaagag

SEQ ID NO: 1046007 - RNA, 22 nt, Human
gaagaaucaagcaguaauuugu

SEQ ID NO: 1046008 - RNA, 19 nt, Human
agauuuaccucauauaguu

SEQ ID NO: 1046009 - RNA, 22 nt, Human
uggaauaaagugcuuugaucag

SEQ ID NO: 1046010 - RNA, 22 nt, Human
cccagggaagccauuucugacu

SEQ ID NO: 1046011 - RNA, 22 nt, Human
uggcuuuaggagcuauauaccu

SEQ ID NO: 1046012 - RNA, 18 nt, Human
caauuucaauggucugaa

SEQ ID NO: 1046013 - RNA, 22 nt, Human
gggagacacgcugcaggcauaa

SEQ ID NO: 1046014 - RNA, 22 nt, Human
ugucaccacuggcugaaacacc

SEQ ID NO: 1046015 - RNA, 22 nt, Human
acaaagaucuugcuuuccuacu

SEQ ID NO: 1046016 - RNA, 22 nt, Human
aaguccuugaagaaacaguucu

SEQ ID NO: 1046017 - RNA, 22 nt, Human
uuuaggcagcacgggcagcccu

SEQ ID NO: 1046018 - RNA, 22 nt, Human
gcugcccugugguccagcaggu

SEQ ID NO: 1046019 - RNA, 22 nt, Human
ucaguaaaguucuuucuugcug

SEQ ID NO: 1046020 - RNA, 22 nt, Human
agacagcauuucccggaaccgc

SEQ ID NO: 1046021 - RNA, 22 nt, Human
uuccuuaguguuagauucugug

SEQ ID NO: 1046022 - RNA, 22 nt, Human
agaaagcaucuccauuguaggu

SEQ ID NO: 1046023 - RNA, 22 nt, Human
uggauuuaauggaugaggggca

SEQ ID NO: 1046024 - RNA, 22 nt, Human
ugguuuaaccugucucuuauua

SEQ ID NO: 1046025 - RNA, 19 nt, Human
ucuccagcuuugggcuuuu

SEQ ID NO: 1046026 - RNA, 22 nt, Human
agaggaggcucugggaucgucc

SEQ ID NO: 1046027 - RNA, 22 nt, Human
gcagccucagggcacucagaug

SEQ ID NO: 1046028 - RNA, 22 nt, Human
acaacuuugacccuuguucuua

SEQ ID NO: 1046029 - RNA, 22 nt, Human
uuuucuuaggugcuccaaguag

SEQ ID NO: 1046030 - RNA, 23 nt, Human
agaauuccaguuucuuaugucac

SEQ ID NO: 1046031 - RNA, 18 nt, Human
agaugaaagcaaaugaca

SEQ ID NO: 1046032 - RNA, 22 nt, Human
uauuccaacugucauagucaua

SEQ ID NO: 1046033 - RNA, 22 nt, Human
auucaacggguagaagggucuu

SEQ ID NO: 1046034 - RNA, 17 nt, Human
agagggaaaaugcgguu

SEQ ID NO: 1046035 - RNA, 21 nt, Human
agagagggagaugaaacaucc

SEQ ID NO: 1046036 - RNA, 22 nt, Human
aaguccuuuccaguccugugau

SEQ ID NO: 1046037 - RNA, 22 nt, Human
ucuaaacacuaagucuugaugc

SEQ ID NO: 1046038 - RNA, 22 nt, Human
uuucuaguaaucaauauaaagu

SEQ ID NO: 1046039 - RNA, 22 nt, Human
uaauuuacuugcaaauaacaau

SEQ ID NO: 1046040 - RNA, 22 nt, Human
cauuuaguuauacuaaaacauu

SEQ ID NO: 1046041 - RNA, 21 nt, Human
ugcccaggggccaaccgcugc

SEQ ID NO: 1046042 - RNA, 22 nt, Human
caguaaauuugagggaucuaau

SEQ ID NO: 1046043 - RNA, 22 nt, Human
acaaaauuuuuagacaaggcuu

SEQ ID NO: 1046044 - RNA, 19 nt, Human
uauuucaaagugccgucua

SEQ ID NO: 1046045 - RNA, 22 nt, Human
acagggaaguucugcaacagga

SEQ ID NO: 1046046 - RNA, 23 nt, Human
ccagggaaggccaucuucaacug

SEQ ID NO: 1046047 - RNA, 22 nt, Human
ucucuuccuagugaugggcuuu

SEQ ID NO: 1046048 - RNA, 22 nt, Human
uggcugcccccucccguggaca

SEQ ID NO: 1046049 - RNA, 22 nt, Human
ucccaagcccuggaugccucag

SEQ ID NO: 1046050 - RNA, 22 nt, Human
uucuuucacucaagaaggaucu

SEQ ID NO: 1046051 - RNA, 22 nt, Human
acagggaaggacaugacuuggc

SEQ ID NO: 1046052 - RNA, 22 nt, Human
uuuauuauguacaggcacuaua

SEQ ID NO: 1046053 - RNA, 22 nt, Human
gacuugggggcuuuggauaggc

SEQ ID NO: 1046054 - RNA, 22 nt, Human
gggagagaagggcauguacacu

SEQ ID NO: 1046055 - RNA, 22 nt, Human
ccauuucacucuuccugaagga

SEQ ID NO: 1046056 - RNA, 22 nt, Human
cauagaaaguauuauggaauuu

SEQ ID NO: 1046057 - RNA, 22 nt, Human
acagaguucccacuccagaagc

SEQ ID NO: 1046058 - RNA, 22 nt, Human
auaaaugccucagaaucauccc

SEQ ID NO: 1046059 - RNA, 22 nt, Human
uaucagaaaucaacacacagug

SEQ ID NO: 1046060 - RNA, 22 nt, Human
uccaaaguguugggauuauagg

SEQ ID NO: 1046061 - RNA, 22 nt, Human
auuugugcauaucccauccacc

SEQ ID NO: 1046062 - RNA, 22 nt, Human
gcaacuuucaagcaccaugggg

SEQ ID NO: 1046063 - RNA, 22 nt, Human
gaagaauccuguccucuuuagg

SEQ ID NO: 1046064 - RNA, 22 nt, Human
aaagcagccgguucccuggucu

SEQ ID NO: 1046065 - RNA, 22 nt, Human
uuuccaaaaguuuguucugugc

SEQ ID NO: 1046066 - RNA, 22 nt, Human
ggcagugagcuggagggaagga

SEQ ID NO: 1046067 - RNA, 22 nt, Human
gcagggaaguuugaucuuuuuc

SEQ ID NO: 1046068 - RNA, 17 nt, Human
gcccgugggcuacggua

SEQ ID NO: 1046069 - RNA, 22 nt, Human
augggaagguuuugagagcggg

SEQ ID NO: 1046070 - RNA, 22 nt, Human
uaccagccucuguugggggugg

SEQ ID NO: 1046071 - RNA, 22 nt, Human
aucuucccaggcuggggagagg

SEQ ID NO: 1046072 - RNA, 22 nt, Human
uauuccaaaauaguuaagcacu

SEQ ID NO: 1046073 - RNA, 22 nt, Human
ucccagccaggcucuaccacuu

SEQ ID NO: 1046074 - RNA, 21 nt, Human
uuguucuuccagaagcaaagu

SEQ ID NO: 1046075 - RNA, 17 nt, Human
cgggcauggagggcagg

SEQ ID NO: 1046076 - RNA, 22 nt, Human
uagaugcuacaauuuuguacuc

SEQ ID NO: 1046077 - RNA, 22 nt, Human
gacaguccuugcccaguaucua

SEQ ID NO: 1046078 - RNA, 20 nt, Human
aggagggaccuggauuggcg

SEQ ID NO: 1046079 - RNA, 22 nt, Human
caccagcccccucacgcuguca

SEQ ID NO: 1046080 - RNA, 22 nt, Human
ccauggcucuuaccuuguuaua

SEQ ID NO: 1046081 - RNA, 22 nt, Human
aaauuccagaaacucaguauau

SEQ ID NO: 1046082 - RNA, 22 nt, Human
aauggcuucugaagcacacuuu

SEQ ID NO: 1046083 - RNA, 22 nt, Human
auagaaauguauuuuggacuag

SEQ ID NO: 1046084 - RNA, 22 nt, Human
caauuucagguggauagguuuu

SEQ ID NO: 1046085 - RNA, 22 nt, Human
uccuccagcuucucuuuugggg

SEQ ID NO: 1046086 - RNA, 22 nt, Human
ucccagggacuggaugaugcag

SEQ ID NO: 1046087 - RNA, 22 nt, Human
ccagagaggggaagggcuugcc

SEQ ID NO: 1046088 - RNA, 22 nt, Human
aaacauguuuucugaauauuuu

SEQ ID NO: 1046089 - RNA, 22 nt, Human
aacaggggcugguugaaagagc

SEQ ID NO: 1046090 - RNA, 22 nt, Human
augcuuaaccuugguguacaau

SEQ ID NO: 1046091 - RNA, 22 nt, Human
agcaguggcuggauggugugcu

SEQ ID NO: 1046092 - RNA, 17 nt, Human
ccugcccagagacagau

SEQ ID NO: 1046093 - RNA, 22 nt, Human
gcuuuuauugucuuuacgacga

SEQ ID NO: 1046094 - RNA, 22 nt, Human
ucccaagcuuagggcucucagu

SEQ ID NO: 1046095 - RNA, 21 nt, Human
auuuccaaauaaggucacauu

SEQ ID NO: 1046096 - RNA, 22 nt, Human
aauugcaauuuucuuaaggucu

SEQ ID NO: 1046097 - RNA, 22 nt, Human
gggagacaaaggugagguucuu

SEQ ID NO: 1046098 - RNA, 22 nt, Human
ggcaccagccaccuauuucuag

SEQ ID NO: 1046099 - RNA, 22 nt, Human
uguaacaaaauaccuuggauug

SEQ ID NO: 1046100 - RNA, 22 nt, Human
uucacagaauggcaaguuaugg

SEQ ID NO: 1046101 - RNA, 22 nt, Human
uacuuguagcagguggcauuua

SEQ ID NO: 1046102 - RNA, 22 nt, Human
aagcaagacagaaguuacugcc

SEQ ID NO: 1046103 - RNA, 22 nt, Human
gagggauggugugagaggcuca

SEQ ID NO: 1046104 - RNA, 22 nt, Human
ucagccucagguguucagauuu

SEQ ID NO: 1046105 - RNA, 20 nt, Human
gauuucaaagcagaguggcc

SEQ ID NO: 1046106 - RNA, 22 nt, Human
ggggagaccaucugaaggugau

SEQ ID NO: 1046107 - RNA, 22 nt, Human
cauuugugugggaacccaucag

SEQ ID NO: 1046108 - RNA, 22 nt, Human
uggcauuucuggccauuugugu

SEQ ID NO: 1046109 - RNA, 22 nt, Human
ucuggaucccaccgccacacac

SEQ ID NO: 1046110 - RNA, 22 nt, Human
ugaaaagacugcaagagagcau

SEQ ID NO: 1046111 - RNA, 22 nt, Human
caggcagcugcgacaagagagc

SEQ ID NO: 1046112 - RNA, 22 nt, Human
aguauaauuagauaucaaaagu

SEQ ID NO: 1046113 - RNA, 22 nt, Human
gaggaggguuggccuuagguag

SEQ ID NO: 1046114 - RNA, 22 nt, Human
ugggagacacuggugggagcuu

SEQ ID NO: 1046115 - RNA, 22 nt, Human
gagggcuggggcuuaggcuuag

SEQ ID NO: 1046116 - RNA, 22 nt, Human
cugaauaauauuccauuaugag

SEQ ID NO: 1046117 - RNA, 22 nt, Human
uccagggcagugacuacagcgg

SEQ ID NO: 1046118 - RNA, 22 nt, Human
agccaugggcucccaguccuuu

SEQ ID NO: 1046119 - RNA, 22 nt, Human
gccagucugcucccacaaguuc

SEQ ID NO: 1046120 - RNA, 22 nt, Human
auuaaagacagcagauggaugg

SEQ ID NO: 1046121 - RNA, 22 nt, Human
guaaauuauuucaagaucaucu

SEQ ID NO: 1046122 - RNA, 22 nt, Human
ucuccagggcagagaauagcaa

SEQ ID NO: 1046123 - RNA, 21 nt, Human
uguccuuaaugcaauguccuu

SEQ ID NO: 1046124 - RNA, 23 nt, Human
accaguccauuccccucaugauu

SEQ ID NO: 1046125 - RNA, 22 nt, Human
ccagggaagaauaggugugguu

SEQ ID NO: 1046126 - RNA, 22 nt, Human
caauuucagucucagagaguuc

SEQ ID NO: 1046127 - RNA, 22 nt, Human
uauaaaauucucaguuuggggu

SEQ ID NO: 1046128 - RNA, 22 nt, Human
auuaggcauucugaaugagguc

SEQ ID NO: 1046129 - RNA, 22 nt, Human
gccuccaggguagaggaggaag

SEQ ID NO: 1046130 - RNA, 22 nt, Human
cuuaggcaguuuaggaaagaga

SEQ ID NO: 1046131 - RNA, 22 nt, Human
ggcugccuacuuucccagaguu

SEQ ID NO: 1046132 - RNA, 22 nt, Human
gcagaauugauggagaacuuaa

SEQ ID NO: 1046133 - RNA, 17 nt, Human
aggggagagugggaaga

SEQ ID NO: 1046134 - RNA, 22 nt, Human
aaucagaaaauucaguggaauu

SEQ ID NO: 1046135 - RNA, 18 nt, Human
ucagggaagagaauauga

SEQ ID NO: 1046136 - RNA, 22 nt, Human
uacauauacugagugauuugcu

SEQ ID NO: 1046137 - RNA, 22 nt, Human
uagaauucauguuacuguuagc

SEQ ID NO: 1046138 - RNA, 22 nt, Human
uaauuucaaguuuagggcucua

SEQ ID NO: 1046139 - RNA, 22 nt, Human
auuccaaacuuaccccagagga

SEQ ID NO: 1046140 - RNA, 22 nt, Human
aucagaaaguucaucauguuug

SEQ ID NO: 1046141 - RNA, 22 nt, Human
uaccuugggguuuuguugcucu

SEQ ID NO: 1046142 - RNA, 22 nt, Human
gacagccaacuggggagggcau

SEQ ID NO: 1046143 - RNA, 22 nt, Human
uagcagaagaacaacaugaucu

SEQ ID NO: 1046144 - RNA, 22 nt, Human
gugcauuugacgaauacucacu

SEQ ID NO: 1046145 - RNA, 22 nt, Human
cuggaucaugggaaagggauca

SEQ ID NO: 1046146 - RNA, 22 nt, Human
ugaucccaaucuuuccugcucc

SEQ ID NO: 1046147 - RNA, 22 nt, Human
ucuuuacaucacaauuguaugg

SEQ ID NO: 1046148 - RNA, 22 nt, Human
auauaugcauguguacuuaugu

SEQ ID NO: 1046149 - RNA, 21 nt, Human
cccagggaagccgcagucacc

SEQ ID NO: 1046150 - RNA, 22 nt, Human
cacaauuuggugcuaaagaaag

SEQ ID NO: 1046151 - RNA, 22 nt, Human
uuauuuauggcccucaccugau

SEQ ID NO: 1046152 - RNA, 18 nt, Human
caauuucauccuuaagcc

SEQ ID NO: 1046153 - RNA, 22 nt, Human
uuuacagaauguugaauuuggg

SEQ ID NO: 1046154 - RNA, 22 nt, Human
ucccagggacucucugccuucc

SEQ ID NO: 1046155 - RNA, 22 nt, Human
caaaggcaggcccccugugcag

SEQ ID NO: 1046156 - RNA, 22 nt, Human
auuaggcauauaugcuuuuaau

SEQ ID NO: 1046157 - RNA, 22 nt, Human
aaggcuaugaucuuuuucauga

SEQ ID NO: 1046158 - RNA, 22 nt, Human
gcagggaagacccggagcagcg

SEQ ID NO: 1046159 - RNA, 22 nt, Human
agaagggagagaaaguugguua

SEQ ID NO: 1046160 - RNA, 19 nt, Human
uacuaaacaugcauauugg

SEQ ID NO: 1046161 - RNA, 22 nt, Human
uucacauaaugauacaaagcuu

SEQ ID NO: 1046162 - RNA, 22 nt, Human
uccuccagugguacuggccaau

SEQ ID NO: 1046163 - RNA, 22 nt, Human
uuccaaaguuaguuauuagaaa

SEQ ID NO: 1046164 - RNA, 22 nt, Human
ucuaaacagccucuuaccaacu

SEQ ID NO: 1046165 - RNA, 19 nt, Human
accaggcuuauggucagug

SEQ ID NO: 1046166 - RNA, 22 nt, Human
uuccugggacuggagcagccca

SEQ ID NO: 1046167 - RNA, 22 nt, Human
aaacuuuguucgucugaugugg

SEQ ID NO: 1046168 - RNA, 22 nt, Human
cuuagaaaugcagauucucagg

SEQ ID NO: 1046169 - RNA, 22 nt, Human
ugggcugcacccucagccucug

SEQ ID NO: 1046170 - RNA, 22 nt, Human
aucuaucccaguuuaacucauu

SEQ ID NO: 1046171 - RNA, 22 nt, Human
aucagaaaucuaggauucagaa

SEQ ID NO: 1046172 - RNA, 22 nt, Human
uuauuauugugguugcauuauc

SEQ ID NO: 1046173 - RNA, 22 nt, Human
uagaauaaguugaugauauaug

SEQ ID NO: 1046174 - RNA, 22 nt, Human
ggggaagaauggcagaaaacau

SEQ ID NO: 1046175 - RNA, 22 nt, Human
cucuccaggagcucagagucua

SEQ ID NO: 1046176 - RNA, 22 nt, Human
ucagggaaaagucacacugggu

SEQ ID NO: 1046177 - RNA, 22 nt, Human
acaagccaauuacugugccagg

SEQ ID NO: 1046178 - RNA, 22 nt, Human
ugcagggcccucauuccugucc

SEQ ID NO: 1046179 - RNA, 22 nt, Human
aauuaaauugguuuagagagga

SEQ ID NO: 1046180 - RNA, 22 nt, Human
augaaaauacugugguugauag

SEQ ID NO: 1046181 - RNA, 22 nt, Human
cucuccagccacagaagcugcu

SEQ ID NO: 1046182 - RNA, 22 nt, Human
ugcccaggcuggaaugcagugg

SEQ ID NO: 1046183 - RNA, 22 nt, Human
auggauuuggaugagauuacuu

SEQ ID NO: 1046184 - RNA, 22 nt, Human
gcuuuaaugaagucacgcaaag

SEQ ID NO: 1046185 - RNA, 22 nt, Human
uguauacaauucacacuuccca

SEQ ID NO: 1046186 - RNA, 22 nt, Human
ucuccagguagauaugucagga

SEQ ID NO: 1046187 - RNA, 22 nt, Human
caucagaaagaguccuggacuu

SEQ ID NO: 1046188 - RNA, 22 nt, Human
acaugcuucauauuauaaccaa

SEQ ID NO: 1046189 - RNA, 22 nt, Human
aaaacugaaauacgauccaaug

SEQ ID NO: 1046190 - RNA, 22 nt, Human
uaauaaacugcuacgcuuaguu

SEQ ID NO: 1046191 - RNA, 22 nt, Human
gaaaaaggauaaauacaguguu

SEQ ID NO: 1046192 - RNA, 22 nt, Human
aaugaacagauacacauaggca

SEQ ID NO: 1046193 - RNA, 22 nt, Human
guuuaauaauguugaauuacua

SEQ ID NO: 1046194 - RNA, 22 nt, Human
cagccucucuguaucucaggau

SEQ ID NO: 1046195 - RNA, 22 nt, Human
gguacaaugucuuacagaccca

SEQ ID NO: 1046196 - RNA, 22 nt, Human
ugggaagggccgauggagccuc

SEQ ID NO: 1046197 - RNA, 23 nt, Human
uuuaacuuuccaauaauucauug

SEQ ID NO: 1046198 - RNA, 22 nt, Human
uggauuuauuagguuggugaaa

SEQ ID NO: 1046199 - RNA, 22 nt, Human
auggcuuuccugggacaugggc

SEQ ID NO: 1046200 - RNA, 22 nt, Human
aauuucaauuacuuuugcacca

SEQ ID NO: 1046201 - RNA, 19 nt, Human
ugcugaaguugucagucug

SEQ ID NO: 1046202 - RNA, 22 nt, Human
gcaaggagacuguagggccaag

SEQ ID NO: 1046203 - RNA, 22 nt, Human
aucuaaaaggagcucuuuaucu

SEQ ID NO: 1046204 - RNA, 22 nt, Human
cuuucacagcugugcuuaugau

SEQ ID NO: 1046205 - RNA, 22 nt, Human
ugaauaauuccuuuuugucaag

SEQ ID NO: 1046206 - RNA, 22 nt, Human
cuggcuuuaacccuacaaaccu

SEQ ID NO: 1046207 - RNA, 22 nt, Human
uuccauaauaggcuuaagugaa

SEQ ID NO: 1046208 - RNA, 22 nt, Human
aaacaugaauagauauuaaaca

SEQ ID NO: 1046209 - RNA, 22 nt, Human
aauuuacacuucauuuggaggg

SEQ ID NO: 1046210 - RNA, 22 nt, Human
ccaggcaggcgauggugcagug

SEQ ID NO: 1046211 - RNA, 22 nt, Human
caaauucaaugaacauguuuaa

SEQ ID NO: 1046212 - RNA, 22 nt, Human
uuauuauuccccaagucauuau

SEQ ID NO: 1046213 - RNA, 22 nt, Human
uguccuuagggauauaaaauau

SEQ ID NO: 1046214 - RNA, 22 nt, Human
ccaucuccaguuuauucuuccu

SEQ ID NO: 1046215 - RNA, 22 nt, Human
cagcccugcagagggcgcuccu

SEQ ID NO: 1046216 - RNA, 17 nt, Human
ugggccaguagaaggga

SEQ ID NO: 1046217 - RNA, 22 nt, Human
uuccacggggcuccccgcucuu

SEQ ID NO: 1046218 - RNA, 22 nt, Human
aaagaaucagaagucucaaaca

SEQ ID NO: 1046219 - RNA, 22 nt, Human
gcugccucccagagcccugcag

SEQ ID NO: 1046220 - RNA, 22 nt, Human
caucagaagaaagacaaaugau

SEQ ID NO: 1046221 - RNA, 22 nt, Human
guacaauagucccuguuuggau

SEQ ID NO: 1046222 - RNA, 22 nt, Human
aggagggagaugcccauccugg

SEQ ID NO: 1046223 - RNA, 22 nt, Human
aggggagaaaaaugccuucugu

SEQ ID NO: 1046224 - RNA, 22 nt, Human
gcauaauauacaugcuugaucc

SEQ ID NO: 1046225 - RNA, 22 nt, Human
auaaacucaugccaagaaauga

SEQ ID NO: 1046226 - RNA, 22 nt, Human
uacugaaauacuaagaaguuaa

SEQ ID NO: 1046227 - RNA, 19 nt, Human
ccagucccauacaggagau

SEQ ID NO: 1046228 - RNA, 22 nt, Human
aguaaaauuucugcugaggaga

SEQ ID NO: 1046229 - RNA, 22 nt, Human
caacauuugaguaaagaaaugg

SEQ ID NO: 1046230 - RNA, 22 nt, Human
ucccugggcuucuccagacuug

SEQ ID NO: 1046231 - RNA, 22 nt, Human
uucagaaaaagaccauugcaau

SEQ ID NO: 1046232 - RNA, 22 nt, Human
ugggcugcuucucaaaugucuc

SEQ ID NO: 1046233 - RNA, 22 nt, Human
ucagggaagagagaucuccuag

SEQ ID NO: 1046234 - RNA, 23 nt, Human
auauggcuguuguguguuaacau

SEQ ID NO: 1046235 - RNA, 22 nt, Human
cauggggaugaggcugagacuu

SEQ ID NO: 1046236 - RNA, 22 nt, Human
auauccaagaaacaauuaauuc

SEQ ID NO: 1046237 - RNA, 22 nt, Human
uggcuuuacaucaaauugagua

SEQ ID NO: 1046238 - RNA, 22 nt, Human
uagauuuaagacccugaauuug

SEQ ID NO: 1046239 - RNA, 22 nt, Human
uugaauaauaugcuucguucuc

SEQ ID NO: 1046240 - RNA, 22 nt, Human
agaucugaccuaaccccaccac

SEQ ID NO: 1046241 - RNA, 22 nt, Human
gccagggagucugggccacaga

SEQ ID NO: 1046242 - RNA, 22 nt, Human
cuacagaaucuaccucaagcca

SEQ ID NO: 1046243 - RNA, 22 nt, Human
gugaauaaagggaguuuucaaa

SEQ ID NO: 1046244 - RNA, 21 nt, Human
aaagcagcccauggcacaguc

SEQ ID NO: 1046245 - RNA, 22 nt, Human
uuuaggcauacuuuugggagaa

SEQ ID NO: 1046246 - RNA, 22 nt, Human
uaaguaaauuuauaaugugauu

SEQ ID NO: 1046247 - RNA, 23 nt, Human
ggagaggggugugggcaucuuua

SEQ ID NO: 1046248 - RNA, 22 nt, Human
auggcauuauagcaaugguuug

SEQ ID NO: 1046249 - RNA, 22 nt, Human
ccauggcuuucuuucauuguaa

SEQ ID NO: 1046250 - RNA, 22 nt, Human
ucagccaguuuguuuauuccgg

SEQ ID NO: 1046251 - RNA, 22 nt, Human
ucauaaaaauagacucuaaagu

SEQ ID NO: 1046252 - RNA, 22 nt, Human
cuagaaauucugauucaguagg

SEQ ID NO: 1046253 - RNA, 22 nt, Human
ugagacaguuuuucuauuucca

SEQ ID NO: 1046254 - RNA, 22 nt, Human
gccuuaauuuuuuauaaucucu

SEQ ID NO: 1046255 - RNA, 22 nt, Human
auuuccaagaaagcuuuaggau

SEQ ID NO: 1046256 - RNA, 18 nt, Human
ucauagaagugaaucaga

SEQ ID NO: 1046257 - RNA, 22 nt, Human
gggagacaaggagaaccaaaga

SEQ ID NO: 1046258 - RNA, 19 nt, Human
gaaguccucuaguaaauuu

SEQ ID NO: 1046259 - RNA, 22 nt, Human
uuucaacguguaaucuuauuua

SEQ ID NO: 1046260 - RNA, 22 nt, Human
uucucuuagcuguaaagucaau

SEQ ID NO: 1046261 - RNA, 22 nt, Human
caucagaacgugagcuccuugu

SEQ ID NO: 1046262 - RNA, 22 nt, Human
ggcagccccaucagagacgcug

SEQ ID NO: 1046263 - RNA, 19 nt, Human
cauguuaugcuguaguauc

SEQ ID NO: 1046264 - RNA, 22 nt, Human
agggagacaaaagcagcugcca

SEQ ID NO: 1046265 - RNA, 22 nt, Human
uggcccaggaggccagagggca

SEQ ID NO: 1046266 - RNA, 22 nt, Human
uggagaggagcaccauggccau

SEQ ID NO: 1046267 - RNA, 20 nt, Human
ggggcugcaugcagagaaga

SEQ ID NO: 1046268 - RNA, 21 nt, Human
auacagaacauugauccaaga

SEQ ID NO: 1046269 - RNA, 22 nt, Human
aggcagcaugcucugcuucuac

SEQ ID NO: 1046270 - RNA, 22 nt, Human
uuuaauauucugcauucuccuu

SEQ ID NO: 1046271 - RNA, 22 nt, Human
cagcccugagagaaccaucuau

SEQ ID NO: 1046272 - RNA, 22 nt, Human
cuagaaauacaggcacgugcca

SEQ ID NO: 1046273 - RNA, 22 nt, Human
caucagaauguuauggggggcu

SEQ ID NO: 1046274 - RNA, 22 nt, Human
guccagggccccgagcaccagg

SEQ ID NO: 1046275 - RNA, 22 nt, Human
uuccuuaggggacagggggaua

SEQ ID NO: 1046276 - RNA, 22 nt, Human
auggguuucccucugaaauuau

SEQ ID NO: 1046277 - RNA, 22 nt, Human
gcccaggaguucaaggcugcag

SEQ ID NO: 1046278 - RNA, 22 nt, Human
gaauuucagggucugguaggaa

SEQ ID NO: 1046279 - RNA, 22 nt, Human
aaucagaaauugagggucuggu

SEQ ID NO: 1046280 - RNA, 22 nt, Human
cggggcuguagcacagcugagc

SEQ ID NO: 1046281 - RNA, 19 nt, Human
uggagaggaaaugcugcuc

SEQ ID NO: 1046282 - RNA, 22 nt, Human
cccgggaacauaaagcagugag

SEQ ID NO: 1046283 - RNA, 22 nt, Human
uguacaauguggccaguguuaa

SEQ ID NO: 1046284 - RNA, 22 nt, Human
caagaauccuguucuugaagau

SEQ ID NO: 1046285 - RNA, 22 nt, Human
uaguccuugcugggcacagagu

SEQ ID NO: 1046286 - RNA, 22 nt, Human
ggacauggagcauguagagaaa

SEQ ID NO: 1046287 - RNA, 22 nt, Human
uaagagaacuggauagauagga

SEQ ID NO: 1046288 - RNA, 22 nt, Human
ccugcccagggucaccacagag

SEQ ID NO: 1046289 - RNA, 22 nt, Human
uggcccagcaguucugccccag

SEQ ID NO: 1046290 - RNA, 22 nt, Human
gagggagagugauggaccauug

SEQ ID NO: 1046291 - RNA, 22 nt, Human
auacagaagaacuauagccacu

SEQ ID NO: 1046292 - RNA, 22 nt, Human
agggcuccgggccaccggccug

SEQ ID NO: 1046293 - RNA, 22 nt, Human
auccaggguguggagagagcuc

SEQ ID NO: 1046294 - RNA, 22 nt, Human
gcuccagcucguggcucccagc

SEQ ID NO: 1046295 - RNA, 22 nt, Human
ccuggaucccgauggcugugag

SEQ ID NO: 1046296 - RNA, 22 nt, Human
ugggcugcacuccauuuucugc

SEQ ID NO: 1046297 - RNA, 22 nt, Human
ucagccucauuuucugcucugu

SEQ ID NO: 1046298 - RNA, 22 nt, Human
agccaggggauucaucagggac

SEQ ID NO: 1046299 - RNA, 22 nt, Human
cauuucaaacaguuacagcugc

SEQ ID NO: 1046300 - RNA, 22 nt, Human
cucuacucuuaacacagcuagg

SEQ ID NO: 1046301 - RNA, 22 nt, Human
cuggcuuucauuucaagcacgu

SEQ ID NO: 1046302 - RNA, 22 nt, Human
agggaagaggaccagagucucu

SEQ ID NO: 1046303 - RNA, 22 nt, Human
ucagccaguuugauucuauuug

SEQ ID NO: 1046304 - RNA, 22 nt, Human
uccuccagugucuggggccuug

SEQ ID NO: 1046305 - RNA, 22 nt, Human
ccagaggacuugggggcugaau

SEQ ID NO: 1046306 - RNA, 22 nt, Human
uuccuuagaguuuccagaaagc

SEQ ID NO: 1046307 - RNA, 22 nt, Human
uguauacauuuaacuagauaga

SEQ ID NO: 1046308 - RNA, 22 nt, Human
gaguaggguuuccagguuagag

SEQ ID NO: 1046309 - RNA, 22 nt, Human
auguuaaaugguuuauuauuaa

SEQ ID NO: 1046310 - RNA, 22 nt, Human
uaacagaagaugaaacuucuuu

SEQ ID NO: 1046311 - RNA, 22 nt, Human
ugcccaggcuccucgcagccuu

SEQ ID NO: 1046312 - RNA, 22 nt, Human
uguaaauaauuccuaggcuuuu

SEQ ID NO: 1046313 - RNA, 22 nt, Human
uggcuucaggagcaccuggcuu

SEQ ID NO: 1046314 - RNA, 22 nt, Human
cuuccaaacccaggguaugggc

SEQ ID NO: 1046315 - RNA, 22 nt, Human
ccaccacugaggcacaggagcc

SEQ ID NO: 1046316 - RNA, 22 nt, Human
cuuccaaauguaaauaaguuuc

SEQ ID NO: 1046317 - RNA, 22 nt, Human
ccagccuggguguuagaagaca

SEQ ID NO: 1046318 - RNA, 22 nt, Human
uccagggauguccuguagcacu

SEQ ID NO: 1046319 - RNA, 20 nt, Human
ugugggccugugaagcggcg

SEQ ID NO: 1046320 - RNA, 22 nt, Human
ugcuuaauacguauuugcugga

SEQ ID NO: 1046321 - RNA, 22 nt, Human
gauuucaaggauguuagaggug

SEQ ID NO: 1046322 - RNA, 22 nt, Human
gcugcccaggcaacauugacuu

SEQ ID NO: 1046323 - RNA, 22 nt, Human
ccagggaaggacucucuuuccc

SEQ ID NO: 1046324 - RNA, 22 nt, Human
uuccaggguuaauuuauauggu

SEQ ID NO: 1046325 - RNA, 22 nt, Human
gagauuuagagagacuuaaaca

SEQ ID NO: 1046326 - RNA, 22 nt, Human
ggagagacccuggagaaggucc

SEQ ID NO: 1046327 - RNA, 22 nt, Human
ccaugggagaugauggggagug

SEQ ID NO: 1046328 - RNA, 22 nt, Human
acuauacagaagaggauaggaa

SEQ ID NO: 1046329 - RNA, 22 nt, Human
uucagaaacccauugggucucu

SEQ ID NO: 1046330 - RNA, 22 nt, Human
uuagaaaugucacagaucugau

SEQ ID NO: 1046331 - RNA, 22 nt, Human
aaucaguguggugacuugucug

SEQ ID NO: 1046332 - RNA, 21 nt, Human
gcuauacagaauggccagagg

SEQ ID NO: 1046333 - RNA, 22 nt, Human
uugaacauuagaauaaguaauu

SEQ ID NO: 1046334 - RNA, 22 nt, Human
cagauacuguaaaauuucagua

SEQ ID NO: 1046335 - RNA, 22 nt, Human
aaguuucauuguucauguaaca

SEQ ID NO: 1046336 - RNA, 22 nt, Human
agagaugggaaggcagacuuca

SEQ ID NO: 1046337 - RNA, 22 nt, Human
ugcccaggguggagugcagcgg

SEQ ID NO: 1046338 - RNA, 22 nt, Human
uuccagggcuaauuccugugga

SEQ ID NO: 1046339 - RNA, 22 nt, Human
gcccagagugaguccugggccc

SEQ ID NO: 1046340 - RNA, 22 nt, Human
acuucacacagcaaauuuaucu

SEQ ID NO: 1046341 - RNA, 22 nt, Human
auagacauagccguaauuuauu

SEQ ID NO: 1046342 - RNA, 22 nt, Human
aguucacauaucuguuuuauuu

SEQ ID NO: 1046343 - RNA, 22 nt, Human
uaauuucaccguugcuagaaau

SEQ ID NO: 1046344 - RNA, 22 nt, Human
cucccaggcagggcugcccacu

SEQ ID NO: 1046345 - RNA, 22 nt, Human
ugggcugcagggguugagagcu

SEQ ID NO: 1046346 - RNA, 22 nt, Human
gggcugcugcugccagcgacac

SEQ ID NO: 1046347 - RNA, 22 nt, Human
ucagggaaugaugcacacaguu

SEQ ID NO: 1046348 - RNA, 22 nt, Human
auuccaaagcacaucagaacua

SEQ ID NO: 1046349 - RNA, 22 nt, Human
ucaguguauggagugcuggauu

SEQ ID NO: 1046350 - RNA, 22 nt, Human
ccagagaggccuuggcaagaca

SEQ ID NO: 1046351 - RNA, 22 nt, Human
acagaacugggggcacagauag

SEQ ID NO: 1046352 - RNA, 22 nt, Human
cccaggcacacugaagugacau

SEQ ID NO: 1046353 - RNA, 22 nt, Human
gauuuucauuugcacucuagaa

SEQ ID NO: 1046354 - RNA, 22 nt, Human
ucccagggacaccaagcuguuu

SEQ ID NO: 1046355 - RNA, 22 nt, Human
uauggcuugucuuuauaccagg

SEQ ID NO: 1046356 - RNA, 22 nt, Human
uacuuuuagccuauuugauucu

SEQ ID NO: 1046357 - RNA, 22 nt, Human
cagccuccugggacacucaccg

SEQ ID NO: 1046358 - RNA, 22 nt, Human
ucaaguuuaauugagauguuua

SEQ ID NO: 1046359 - RNA, 22 nt, Human
caugcuuuuuucuaguauaaau

SEQ ID NO: 1046360 - RNA, 22 nt, Human
uuuaaagaaauuccucaucuuu

SEQ ID NO: 1046361 - RNA, 22 nt, Human
ugacaggcacugcuguagugcu

SEQ ID NO: 1046362 - RNA, 22 nt, Human
ggcgcacaaugugcagguuugu

SEQ ID NO: 1046363 - RNA, 22 nt, Human
uuugguccugagcaaaacuaug

SEQ ID NO: 1046364 - RNA, 22 nt, Human
gguagacaauggaauguggccu

SEQ ID NO: 1046365 - RNA, 22 nt, Human
auauacaggugguauguguaaa

SEQ ID NO: 1046366 - RNA, 22 nt, Human
aauguuaauguguuugcuuaug

SEQ ID NO: 1046367 - RNA, 22 nt, Human
gcguuaauaacauuaauaaugc

SEQ ID NO: 1046368 - RNA, 22 nt, Human
uucauacucacuccaauaacug

SEQ ID NO: 1046369 - RNA, 22 nt, Human
auauuauucuaguaacagugau

SEQ ID NO: 1046370 - RNA, 22 nt, Human
acuagaaacuaauggauuauua

SEQ ID NO: 1046371 - RNA, 22 nt, Human
ccaggcuccgcauagaccccac

SEQ ID NO: 1046372 - RNA, 22 nt, Human
caguccuucauuccuccuuuga

SEQ ID NO: 1046373 - RNA, 22 nt, Human
ucaggcugaggucaucugcauc

SEQ ID NO: 1046374 - RNA, 22 nt, Human
cucacaguguaauauugaaccc

SEQ ID NO: 1046375 - RNA, 22 nt, Human
aauaauuagugggacagagaac

SEQ ID NO: 1046376 - RNA, 22 nt, Human
ccacgcucccugaucccugcuu

SEQ ID NO: 1046377 - RNA, 20 nt, Human
cuguaucagguuacaaagua

SEQ ID NO: 1046378 - RNA, 22 nt, Human
uugaauaauguguauguuguua

SEQ ID NO: 1046379 - RNA, 22 nt, Human
cccaggcaguagaaagaagagg

SEQ ID NO: 1046380 - RNA, 22 nt, Human
uauuucaacguaugaaaagcug

SEQ ID NO: 1046381 - RNA, 22 nt, Human
gcagggaggaagagaugcuucc

SEQ ID NO: 1046382 - RNA, 22 nt, Human
cauggcuuuuuagcauauucaa

SEQ ID NO: 1046383 - RNA, 22 nt, Human
auuuacugagguaaauaaacug

SEQ ID NO: 1046384 - RNA, 22 nt, Human
gcuagaucucucauaaauucca

SEQ ID NO: 1046385 - RNA, 22 nt, Human
cuggcagucugguggaaggccu

SEQ ID NO: 1046386 - RNA, 20 nt, Human
ggccacagggugcuggugga

SEQ ID NO: 1046387 - RNA, 22 nt, Human
aucacaaaggguuuucucugag

SEQ ID NO: 1046388 - RNA, 22 nt, Human
aaagcaguauauugguaguugu

SEQ ID NO: 1046389 - RNA, 22 nt, Human
ucagggaaaccuaaggaagcca

SEQ ID NO: 1046390 - RNA, 22 nt, Human
cugcccacaccugagcugggcc

SEQ ID NO: 1046391 - RNA, 22 nt, Human
uuacagaagagaaagaauucag

SEQ ID NO: 1046392 - RNA, 22 nt, Human
uaucagaaacucuggggcaggg

SEQ ID NO: 1046393 - RNA, 20 nt, Human
caaggcagaccagagugagu

SEQ ID NO: 1046394 - RNA, 18 nt, Human
gccuccaccauggagggu

SEQ ID NO: 1046395 - RNA, 22 nt, Human
uugguccacugugaaauuggga

SEQ ID NO: 1046396 - RNA, 18 nt, Human
cugcccagagcacuugug

SEQ ID NO: 1046397 - RNA, 22 nt, Human
uuuacagagagagaacuggacu

SEQ ID NO: 1046398 - RNA, 22 nt, Human
uuagaaauacaagugagguuga

SEQ ID NO: 1046399 - RNA, 19 nt, Human
gggagacagcucugggcug

SEQ ID NO: 1046400 - RNA, 22 nt, Human
caucagaaggaaggacgauuau

SEQ ID NO: 1046401 - RNA, 22 nt, Human
uuuauccaguguuggaauuuuu

SEQ ID NO: 1046402 - RNA, 22 nt, Human
cuacagaauggagggucagaga

SEQ ID NO: 1046403 - RNA, 22 nt, Human
aagacuuucaaaccuauguuug

SEQ ID NO: 1046404 - RNA, 20 nt, Human
agaaaucagaccacacacua

SEQ ID NO: 1046405 - RNA, 22 nt, Human
ucugcccauucuuagagucuag

SEQ ID NO: 1046406 - RNA, 22 nt, Human
uuuccauauuuaaucaaaauaa

SEQ ID NO: 1046407 - RNA, 22 nt, Human
agucaccauuuucaccugccuc

SEQ ID NO: 1046408 - RNA, 22 nt, Human
acagauuuuugguaaauaauuu

SEQ ID NO: 1046409 - RNA, 22 nt, Human
auagacauuuugcauucaagca

SEQ ID NO: 1046410 - RNA, 22 nt, Human
ucccuggcugguguagagggau

SEQ ID NO: 1046411 - RNA, 22 nt, Human
ggagauggccaaaaacacaaau

SEQ ID NO: 1046412 - RNA, 22 nt, Human
caucagaauuacuuggggagcu

SEQ ID NO: 1046413 - RNA, 22 nt, Human
ucagaaaagagaaaaucuuaua

SEQ ID NO: 1046414 - RNA, 22 nt, Human
aggcuucugcugauauuucauu

SEQ ID NO: 1046415 - RNA, 22 nt, Human
ugccauuuugagauguuaauga

SEQ ID NO: 1046416 - RNA, 22 nt, Human
gaagugaagagauuagaaauca

SEQ ID NO: 1046417 - RNA, 22 nt, Human
aauacauguuuucuacuauucu

SEQ ID NO: 1046418 - RNA, 22 nt, Human
ccuggaucuuucugacugacaa

SEQ ID NO: 1046419 - RNA, 22 nt, Human
auacagaauacuaauuccugag

SEQ ID NO: 1046420 - RNA, 22 nt, Human
uuacagaaugugccauuugguc

SEQ ID NO: 1046421 - RNA, 22 nt, Human
auuaaagaaacccagcauguga

SEQ ID NO: 1046422 - RNA, 19 nt, Human
agcaguggagccaugccug

SEQ ID NO: 1046423 - RNA, 22 nt, Human
ggcauuuacauaaucuuauuua

SEQ ID NO: 1046424 - RNA, 22 nt, Human
uuacagaaggaacacuacucag

SEQ ID NO: 1046425 - RNA, 22 nt, Human
uccagccuuucuacucacugag

SEQ ID NO: 1046426 - RNA, 22 nt, Human
gaauuucaaagagguuaagagg

SEQ ID NO: 1046427 - RNA, 22 nt, Human
cugaauaauuuucuguuguaug

SEQ ID NO: 1046428 - RNA, 22 nt, Human
agacugaauaacaagcaaauaa

SEQ ID NO: 1046429 - RNA, 22 nt, Human
aaggagggaaagcagugcuucu

SEQ ID NO: 1046430 - RNA, 22 nt, Human
aaauacugggcucaaaaggguu

SEQ ID NO: 1046431 - RNA, 22 nt, Human
gaucugaagagcaaugaaauau

SEQ ID NO: 1046432 - RNA, 22 nt, Human
aaucagaaucaguugacacagc

SEQ ID NO: 1046433 - RNA, 22 nt, Human
gauuuccauuuucaacuccugc

SEQ ID NO: 1046434 - RNA, 22 nt, Human
uggcauuuuguucaguauaugg

SEQ ID NO: 1046435 - RNA, 22 nt, Human
uuacagaaguuucagcguuuua

SEQ ID NO: 1046436 - RNA, 22 nt, Human
agggagagaaguuauacaagau

SEQ ID NO: 1046437 - RNA, 22 nt, Human
auuacacuuguucaucaucacc

SEQ ID NO: 1046438 - RNA, 22 nt, Human
augcugaauugaugcgagggag

SEQ ID NO: 1046439 - RNA, 22 nt, Human
aguggagacaggacagucgaua

SEQ ID NO: 1046440 - RNA, 22 nt, Human
acuuugaaacuaaaauucauua

SEQ ID NO: 1046441 - RNA, 22 nt, Human
cuacagaaaccuuuuucauaca

SEQ ID NO: 1046442 - RNA, 22 nt, Human
uaacauguuaagaaauuagaua

SEQ ID NO: 1046443 - RNA, 22 nt, Human
gcuggaucccugugggaguggu

SEQ ID NO: 1046444 - RNA, 22 nt, Human
ucagggaagacuucuuagagga

SEQ ID NO: 1046445 - RNA, 22 nt, Human
uccugcagagacagaggccuca

SEQ ID NO: 1046446 - RNA, 22 nt, Human
gcugccucaggcaccuccuggc

SEQ ID NO: 1046447 - RNA, 22 nt, Human
cugaauaauacagacuagcuuc

SEQ ID NO: 1046448 - RNA, 22 nt, Human
uaauauauuucugcuaagcuca

SEQ ID NO: 1046449 - RNA, 22 nt, Human
acaaaauuguguuaaacuuuau

SEQ ID NO: 1046450 - RNA, 22 nt, Human
uccagcuccacagccucccugu

SEQ ID NO: 1046451 - RNA, 19 nt, Human
caguggagauuggaggagg

SEQ ID NO: 1046452 - RNA, 22 nt, Human
agugggaggaaguggugauauu

SEQ ID NO: 1046453 - RNA, 17 nt, Human
gccagggagaggaagcc

SEQ ID NO: 1046454 - RNA, 22 nt, Human
uguaagaaucagucuuuaaugu

SEQ ID NO: 1046455 - RNA, 22 nt, Human
agcauauaaauggacauauuug

SEQ ID NO: 1046456 - RNA, 19 nt, Human
guccagccuuugggucuua

SEQ ID NO: 1046457 - RNA, 21 nt, Human
gaguccuuccaauguccucag

SEQ ID NO: 1046458 - RNA, 22 nt, Human
acccgggaggcaggagucauag

SEQ ID NO: 1046459 - RNA, 22 nt, Human
uacuaaacaucuggcauuaaau

SEQ ID NO: 1046460 - RNA, 22 nt, Human
agggcaccuguuuuagcuuggu

SEQ ID NO: 1046461 - RNA, 22 nt, Human
cagcccuggcccaggugccuua

SEQ ID NO: 1046462 - RNA, 22 nt, Human
acacacucaauugcauaagcac

SEQ ID NO: 1046463 - RNA, 22 nt, Human
cuuucacaguccugacugagcg

SEQ ID NO: 1046464 - RNA, 22 nt, Human
agcaaaguagcugcuguucuua

SEQ ID NO: 1046465 - RNA, 22 nt, Human
uaucaagugacuaucacagaac

SEQ ID NO: 1046466 - RNA, 22 nt, Human
caaugaaagcaacugccuauaa

SEQ ID NO: 1046467 - RNA, 22 nt, Human
uuugaauaucacaaacuuucaa

SEQ ID NO: 1046468 - RNA, 22 nt, Human
gucauaaagcuuguugcauuua

SEQ ID NO: 1046469 - RNA, 22 nt, Human
ugaauagauuuuuaacauauaa

SEQ ID NO: 1046470 - RNA, 22 nt, Human
acugguuuuccagguuacuucu

SEQ ID NO: 1046471 - RNA, 22 nt, Human
agugaggggauucaggcaaggu

SEQ ID NO: 1046472 - RNA, 22 nt, Human
uuacagaauguucuuccaacag

SEQ ID NO: 1046473 - RNA, 22 nt, Human
uaaaacuuaacuauccagauua

SEQ ID NO: 1046474 - RNA, 20 nt, Human
caccagucaugagucaauac

SEQ ID NO: 1046475 - RNA, 22 nt, Human
acagggaaggauuuagugggaa

SEQ ID NO: 1046476 - RNA, 22 nt, Human
accuccaggaagcucuugguac

SEQ ID NO: 1046477 - RNA, 22 nt, Human
uuugaagauaaauauggagaaa

SEQ ID NO: 1046478 - RNA, 22 nt, Human
cuagaaaugcucaagagaaagu

SEQ ID NO: 1046479 - RNA, 21 nt, Human
uccagggaauuucaacuuuua

SEQ ID NO: 1046480 - RNA, 22 nt, Human
acagggaaagggacagcagcag

SEQ ID NO: 1046481 - RNA, 22 nt, Human
cagcuuggauuuuggcacgugu

SEQ ID NO: 1046482 - RNA, 22 nt, Human
cuuucacauaauugaccuugaa

SEQ ID NO: 1046483 - RNA, 22 nt, Human
gcagggcucauugccaggcauu

SEQ ID NO: 1046484 - RNA, 22 nt, Human
aaaguccuugcaguuuccucuu

SEQ ID NO: 1046485 - RNA, 22 nt, Human
uuccaaaccucaaauaauuaau

SEQ ID NO: 1046486 - RNA, 22 nt, Human
aucuaacacuguaaacugucuu

SEQ ID NO: 1046487 - RNA, 22 nt, Human
caucagaacaaaucgguuaaga

SEQ ID NO: 1046488 - RNA, 22 nt, Human
ugaaugaauccuaacaaagaca

SEQ ID NO: 1046489 - RNA, 22 nt, Human
uuuauccaaggguuuuaacugu

SEQ ID NO: 1046490 - RNA, 22 nt, Human
cggggagaacacuguguccuuc

SEQ ID NO: 1046491 - RNA, 22 nt, Human
ugcuuuaagagauuguuaguac

SEQ ID NO: 1046492 - RNA, 22 nt, Human
auaaagucauuaugaagaucua

SEQ ID NO: 1046493 - RNA, 22 nt, Human
ucuauacaaguuucacuuugac

SEQ ID NO: 1046494 - RNA, 22 nt, Human
ucuuuaauaucugccccagagc

SEQ ID NO: 1046495 - RNA, 22 nt, Human
gcuauacacauuucuugguagu

SEQ ID NO: 1046496 - RNA, 22 nt, Human
gagcccagguucugcuuccagc

SEQ ID NO: 1046497 - RNA, 22 nt, Human
acagaauucuaguauguggcuu

SEQ ID NO: 1046498 - RNA, 22 nt, Human
aggaguggugcaggaccugcca

SEQ ID NO: 1046499 - RNA, 22 nt, Human
uugaagaaauuauuuuauauag

SEQ ID NO: 1046500 - RNA, 22 nt, Human
gcauguuauguaucugcccagc

SEQ ID NO: 1046501 - RNA, 22 nt, Human
agaaacauccugcuuuccauuu

SEQ ID NO: 1046502 - RNA, 22 nt, Human
augguuuaagggagaauauuga

SEQ ID NO: 1046503 - RNA, 22 nt, Human
uccuccagaaacugaggcagaa

SEQ ID NO: 1046504 - RNA, 22 nt, Human
uuaaaauuauggcccauuugga

SEQ ID NO: 1046505 - RNA, 22 nt, Human
ucaaguuucucucagauuaugg

SEQ ID NO: 1046506 - RNA, 20 nt, Human
aaguuacauuguauuguacc

SEQ ID NO: 1046507 - RNA, 22 nt, Human
aaggcagcuucaccacagcauu

SEQ ID NO: 1046508 - RNA, 22 nt, Human
uucacagagagaacucaaacca

SEQ ID NO: 1046509 - RNA, 22 nt, Human
ucaauaaauagcuuggcucagc

SEQ ID NO: 1046510 - RNA, 22 nt, Human
ugggggagaguuuagaugauuu

SEQ ID NO: 1046511 - RNA, 22 nt, Human
acaugaaacuguugcauuagaa

SEQ ID NO: 1046512 - RNA, 22 nt, Human
acaugcuuuaacuuauuuugau

SEQ ID NO: 1046513 - RNA, 22 nt, Human
gcuccaggagagggaagcagau

SEQ ID NO: 1046514 - RNA, 22 nt, Human
aaauugcaaaaguacuuuuagg

SEQ ID NO: 1046515 - RNA, 22 nt, Human
ucuuuaauauaaaggaaugaau

SEQ ID NO: 1046516 - RNA, 22 nt, Human
uauguuaagugggauaaucaaa

SEQ ID NO: 1046517 - RNA, 22 nt, Human
augaaacaugcuuuguggauga

SEQ ID NO: 1046518 - RNA, 21 nt, Human
ucccagggccaggugccauca

SEQ ID NO: 1046519 - RNA, 22 nt, Human
ucuccaggcacuuggcugcuac

SEQ ID NO: 1046520 - RNA, 22 nt, Human
gaguccuuccagcaggcauuua

SEQ ID NO: 1046521 - RNA, 22 nt, Human
aaugaaacuguauauagacugu

SEQ ID NO: 1046522 - RNA, 22 nt, Human
auuucacaaaccauccugauuu

SEQ ID NO: 1046523 - RNA, 23 nt, Human
ccagccucugggucuucauccag

SEQ ID NO: 1046524 - RNA, 22 nt, Human
uggagacauuucucauuaaaaa

SEQ ID NO: 1046525 - RNA, 21 nt, Human
gagauuuagaaggaucaauuu

SEQ ID NO: 1046526 - RNA, 22 nt, Human
gaggcagcugggauacaaggga

SEQ ID NO: 1046527 - RNA, 22 nt, Human
ucagccaggccaggcauucaca

SEQ ID NO: 1046528 - RNA, 22 nt, Human
ucugaaaguaucuggaucuuuu

SEQ ID NO: 1046529 - RNA, 22 nt, Human
aaggcagcaccgccuccugaaa

SEQ ID NO: 1046530 - RNA, 22 nt, Human
ugcuuuaacauaagauaucuuu

SEQ ID NO: 1046531 - RNA, 22 nt, Human
auaaaacuuggguaugaucccu

SEQ ID NO: 1046532 - RNA, 22 nt, Human
aaucagaauuuauugaaucuuu

SEQ ID NO: 1046533 - RNA, 20 nt, Human
ucuaauuaaaauugucuagu

SEQ ID NO: 1046534 - RNA, 22 nt, Human
agggcugccccaguccagccgg

SEQ ID NO: 1046535 - RNA, 19 nt, Human
uuccaaaaucaggauuuga

SEQ ID NO: 1046536 - RNA, 21 nt, Human
aagggagauaggaaucaggcc

SEQ ID NO: 1046537 - RNA, 22 nt, Human
ugggcugcuguuacaggggcug

SEQ ID NO: 1046538 - RNA, 22 nt, Human
gcccaagccgccuuccagagac

SEQ ID NO: 1046539 - RNA, 22 nt, Human
ugagacaaccuaauuaaacacc

SEQ ID NO: 1046540 - RNA, 22 nt, Human
agaauaucguagcauauuaucu

SEQ ID NO: 1046541 - RNA, 22 nt, Human
ucuagacacuacuaguaaccgg

SEQ ID NO: 1046542 - RNA, 22 nt, Human
uggcuuaagauuuaugcuuuua

SEQ ID NO: 1046543 - RNA, 22 nt, Human
ugcaguggaaucuggagagcag

SEQ ID NO: 1046544 - RNA, 20 nt, Human
ugagacaaggcuggagagac

SEQ ID NO: 1046545 - RNA, 22 nt, Human
auggcuuuuuagacuuugguac

SEQ ID NO: 1046546 - RNA, 22 nt, Human
uuuaaugaauaauucaaaucug

SEQ ID NO: 1046547 - RNA, 22 nt, Human
gcagggaaggggcaugcuggag

SEQ ID NO: 1046548 - RNA, 22 nt, Human
ggcugccccaugggcugggcug

SEQ ID NO: 1046549 - RNA, 20 nt, Human
uuccaacucacaucucuaca

SEQ ID NO: 1046550 - RNA, 22 nt, Human
uuucaaguguccugauuaaugg

SEQ ID NO: 1046551 - RNA, 22 nt, Human
ugugaauagugccgcaauaaac

SEQ ID NO: 1046552 - RNA, 22 nt, Human
uccagggcaugcucagacucag

SEQ ID NO: 1046553 - RNA, 22 nt, Human
gauuuacaaagcucucuagugu

SEQ ID NO: 1046554 - RNA, 22 nt, Human
uccagccuuccuuuucacucuc

SEQ ID NO: 1046555 - RNA, 22 nt, Human
ugaaauaauaucuggaucaauc

SEQ ID NO: 1046556 - RNA, 22 nt, Human
ccuccaggaacuugagagacac

SEQ ID NO: 1046557 - RNA, 22 nt, Human
acagaauugaaaguauaaucug

SEQ ID NO: 1046558 - RNA, 22 nt, Human
caucagaaugaauguucuggag

SEQ ID NO: 1046559 - RNA, 22 nt, Human
cauggucuacaauuucauuuua

SEQ ID NO: 1046560 - RNA, 22 nt, Human
ccagggaaggcugcuggcugug

SEQ ID NO: 1046561 - RNA, 22 nt, Human
agaauaauacugaaaugcugaa

SEQ ID NO: 1046562 - RNA, 22 nt, Human
agauaucaccaguuuuacauac

SEQ ID NO: 1046563 - RNA, 22 nt, Human
cugcaccauccuucaugcucug

SEQ ID NO: 1046564 - RNA, 22 nt, Human
ccagauaaggcuuuuuaaaagc

SEQ ID NO: 1046565 - RNA, 22 nt, Human
ugcccaggguuucuaagagcag

SEQ ID NO: 1046566 - RNA, 22 nt, Human
agauauaauaauuuacaagugu

SEQ ID NO: 1046567 - RNA, 22 nt, Human
uauacagauggaaagauacaca

SEQ ID NO: 1046568 - RNA, 22 nt, Human
uaagaaucuauuaggaauaugu

SEQ ID NO: 1046569 - RNA, 22 nt, Human
aaguccuuauguggaggggcua

SEQ ID NO: 1046570 - RNA, 22 nt, Human
aaagccauuacaaaauuucaua

SEQ ID NO: 1046571 - RNA, 22 nt, Human
uaauuuuaugacaguguauuuu

SEQ ID NO: 1046572 - RNA, 22 nt, Human
uuuuaagaugcuaguauuucag

SEQ ID NO: 1046573 - RNA, 22 nt, Human
uaaguccuagaugauucacaga

SEQ ID NO: 1046574 - RNA, 23 nt, Human
gaggagggucgugcuguguuccu

SEQ ID NO: 1046575 - RNA, 22 nt, Human
cagucaccugaagacuugacca

SEQ ID NO: 1046576 - RNA, 22 nt, Human
ccuggauccaugaaaaggcuac

SEQ ID NO: 1046577 - RNA, 22 nt, Human
acccuggcagccuucuguccug

SEQ ID NO: 1046578 - RNA, 22 nt, Human
guauagaaacccagaaagauag

SEQ ID NO: 1046579 - RNA, 22 nt, Human
caagaaucuugcagcuuagacu

SEQ ID NO: 1046580 - RNA, 22 nt, Human
cagcccugugcggagggcccug

SEQ ID NO: 1046581 - RNA, 22 nt, Human
aaauggaucuguggaauacauu

SEQ ID NO: 1046582 - RNA, 22 nt, Human
uauggcuuuucauuccuaugug

SEQ ID NO: 1046583 - RNA, 22 nt, Human
uuauccaacaugacuuaugucc

SEQ ID NO: 1046584 - RNA, 22 nt, Human
ucugcccaggaggucccauggg

SEQ ID NO: 1046585 - RNA, 22 nt, Human
agaauuuccuaugagagauucc

SEQ ID NO: 1046586 - RNA, 22 nt, Human
ugggcugcccugaugguccuca

SEQ ID NO: 1046587 - RNA, 22 nt, Human
uucacacacagcuuccuauugu

SEQ ID NO: 1046588 - RNA, 22 nt, Human
ccaauacacuuuauagaagaaa

SEQ ID NO: 1046589 - RNA, 22 nt, Human
ugaagaauaagauagauggagc

SEQ ID NO: 1046590 - RNA, 22 nt, Human
uggggagaagcaauagacucua

SEQ ID NO: 1046591 - RNA, 22 nt, Human
aaagcagguugcaauuacagug

SEQ ID NO: 1046592 - RNA, 22 nt, Human
aaacggauauaacagcaaacgc

SEQ ID NO: 1046593 - RNA, 20 nt, Human
uggagacaauugcccuuuuu

SEQ ID NO: 1046594 - RNA, 22 nt, Human
cagcugacccagugaggaggca

SEQ ID NO: 1046595 - RNA, 22 nt, Human
caaucaguaaccggaucauggu

SEQ ID NO: 1046596 - RNA, 22 nt, Human
acaauuccacauggcaugcagg

SEQ ID NO: 1046597 - RNA, 22 nt, Human
uuauagaacagccuccucuaga

SEQ ID NO: 1046598 - RNA, 22 nt, Human
aauuccaggaugcaggaggugc

SEQ ID NO: 1046599 - RNA, 22 nt, Human
guuuaaucagaggaauuauaga

SEQ ID NO: 1046600 - RNA, 22 nt, Human
aucauaaagugcuaucugauug

SEQ ID NO: 1046601 - RNA, 22 nt, Human
aguccuuacucgggggcccaga

SEQ ID NO: 1046602 - RNA, 22 nt, Human
agcacauaccagaaccacaggu

SEQ ID NO: 1046603 - RNA, 22 nt, Human
agagauggcgucucagagccug

SEQ ID NO: 1046604 - RNA, 22 nt, Human
acugcccaggaaucucaaagaa

SEQ ID NO: 1046605 - RNA, 22 nt, Human
aaguccuuaggaagcagucguu

SEQ ID NO: 1046606 - RNA, 20 nt, Human
ggcugcccacuccagaguac

SEQ ID NO: 1046607 - RNA, 22 nt, Human
gauuucaaggaguuuucacagu

SEQ ID NO: 1046608 - RNA, 22 nt, Human
gagcagcacuugaggcauguca

SEQ ID NO: 1046609 - RNA, 22 nt, Human
gcaaggagccuggaggugagug

SEQ ID NO: 1046610 - RNA, 22 nt, Human
agcagggcugcggccccaccac

SEQ ID NO: 1046611 - RNA, 22 nt, Human
uuacagaaaguuucccaugccg

SEQ ID NO: 1046612 - RNA, 22 nt, Human
agcacaauagagcaguuaaaaa

SEQ ID NO: 1046613 - RNA, 22 nt, Human
aaauaucauuuauaacuuuuaa

SEQ ID NO: 1046614 - RNA, 22 nt, Human
cucuccagcagauguagucugu

SEQ ID NO: 1046615 - RNA, 22 nt, Human
ggggagaauuaccaaaagcgcu

SEQ ID NO: 1046616 - RNA, 22 nt, Human
uacagaauuagauuauuagaga

SEQ ID NO: 1046617 - RNA, 22 nt, Human
aacauguugcuuuaauaauauu

SEQ ID NO: 1046618 - RNA, 22 nt, Human
aagcaauagcaacaacuuuaca

SEQ ID NO: 1046619 - RNA, 22 nt, Human
ugcuauacggagcaucuucagg

SEQ ID NO: 1046620 - RNA, 22 nt, Human
cagaauuuagcacaauguaugg

SEQ ID NO: 1046621 - RNA, 22 nt, Human
acaggcagauuaaggguaggca

SEQ ID NO: 1046622 - RNA, 22 nt, Human
cagcccuggcgcccccagaucu

SEQ ID NO: 1046623 - RNA, 22 nt, Human
cguccuuacagagggucacagc

SEQ ID NO: 1046624 - RNA, 22 nt, Human
gauuuacagcuauacccaaugg

SEQ ID NO: 1046625 - RNA, 22 nt, Human
uacugaaaguggucaacagugg

SEQ ID NO: 1046626 - RNA, 22 nt, Human
gagagggagccagccaggaacc

SEQ ID NO: 1046627 - RNA, 22 nt, Human
aagauauagauggugguauaaa

SEQ ID NO: 1046628 - RNA, 22 nt, Human
ccugcccauacugaccucuaau

SEQ ID NO: 1046629 - RNA, 22 nt, Human
caaucaguuucuguuguauaau

SEQ ID NO: 1046630 - RNA, 22 nt, Human
uugcuuuugucucggguuugga

SEQ ID NO: 1046631 - RNA, 22 nt, Human
uuuccaaacccagcgagcuaca

SEQ ID NO: 1046632 - RNA, 22 nt, Human
ucuggaucgccggcgccugggc

SEQ ID NO: 1046633 - RNA, 22 nt, Human
agggaauggaugauggcagguu

SEQ ID NO: 1046634 - RNA, 22 nt, Human
auuccaaacucuuucccugucg

SEQ ID NO: 1046635 - RNA, 22 nt, Human
cagccucuuuccacaucaggca

SEQ ID NO: 1046636 - RNA, 22 nt, Human
ugucaccaugcgaggcuaauuu

SEQ ID NO: 1046637 - RNA, 22 nt, Human
gugcccaggugucccugagaag

SEQ ID NO: 1046638 - RNA, 22 nt, Human
aucagcuuuucucaucagaaau

SEQ ID NO: 1046639 - RNA, 22 nt, Human
cagauuucagcucauauauuau

SEQ ID NO: 1046640 - RNA, 22 nt, Human
aggcagcagacuguuaaucaga

SEQ ID NO: 1046641 - RNA, 22 nt, Human
ccagggaaaaucaacuucuacu

SEQ ID NO: 1046642 - RNA, 22 nt, Human
ugcuuuaaauaugaauuagcau

SEQ ID NO: 1046643 - RNA, 22 nt, Human
caacagucugguuuauauaaua

SEQ ID NO: 1046644 - RNA, 17 nt, Human
uaaagccagucaaguca

SEQ ID NO: 1046645 - RNA, 22 nt, Human
agaauuucuggaagauugcaag

SEQ ID NO: 1046646 - RNA, 22 nt, Human
uggagacagagauagccaauug

SEQ ID NO: 1046647 - RNA, 22 nt, Human
auuuccaggagaaaggauuuua

SEQ ID NO: 1046648 - RNA, 22 nt, Human
uaucagaaagauauuacugggg

SEQ ID NO: 1046649 - RNA, 22 nt, Human
caaagaagagauuuacagagcu

SEQ ID NO: 1046650 - RNA, 22 nt, Human
ugggcugcugcggugcucuugg

SEQ ID NO: 1046651 - RNA, 22 nt, Human
auuuccagacuuuuuccaggaa

SEQ ID NO: 1046652 - RNA, 21 nt, Human
ugggagagcguugcuguccuc

SEQ ID NO: 1046653 - RNA, 23 nt, Human
caauuucauaugauucuaccuaa

SEQ ID NO: 1046654 - RNA, 22 nt, Human
aggaggaggcuggaguacaccc

SEQ ID NO: 1046655 - RNA, 22 nt, Human
gcaaaauuuacacuccuucuuc

SEQ ID NO: 1046656 - RNA, 22 nt, Human
accagcugcugauugcuaaaug

SEQ ID NO: 1046657 - RNA, 22 nt, Human
gccaaggagacacgguguugua

SEQ ID NO: 1046658 - RNA, 22 nt, Human
cuacagaaaaucagccacaggc

SEQ ID NO: 1046659 - RNA, 22 nt, Human
cauuucaauuauuugcucuucu

SEQ ID NO: 1046660 - RNA, 22 nt, Human
aaaaucugcuuccuuuuacaga

SEQ ID NO: 1046661 - RNA, 23 nt, Human
uccagccucuugcucucacaugc

SEQ ID NO: 1046662 - RNA, 22 nt, Human
auguucaaacuuuuuacacacc

SEQ ID NO: 1046663 - RNA, 22 nt, Human
uaaagaucuuaggaagauuuuc

SEQ ID NO: 1046664 - RNA, 22 nt, Human
aacacuuugggcauggccuucc

SEQ ID NO: 1046665 - RNA, 22 nt, Human
gcuggaucaaguccuucaccca

SEQ ID NO: 1046666 - RNA, 22 nt, Human
aaaggaggccacauggcuagga

SEQ ID NO: 1046667 - RNA, 22 nt, Human
ucagggaaugugauacaggaag

SEQ ID NO: 1046668 - RNA, 22 nt, Human
caguccuuucaauggugaccuu

SEQ ID NO: 1046669 - RNA, 22 nt, Human
acaguccuuguguggaacauua

SEQ ID NO: 1046670 - RNA, 22 nt, Human
caggagggcccgagacucuucc

SEQ ID NO: 1046671 - RNA, 22 nt, Human
ugcacauucacuuagguauugu

SEQ ID NO: 1046672 - RNA, 22 nt, Human
uagaaacagauguuuuugaaga

SEQ ID NO: 1046673 - RNA, 22 nt, Human
aauuccagaggaggacaguccu

SEQ ID NO: 1046674 - RNA, 22 nt, Human
uacgacacaucugaucucaaaa

SEQ ID NO: 1046675 - RNA, 22 nt, Human
guacagaaugcuugguaaggca

SEQ ID NO: 1046676 - RNA, 22 nt, Human
ugcuuauucuuuccacaauuca

SEQ ID NO: 1046677 - RNA, 22 nt, Human
auggcuuaugguaaauauuucu

SEQ ID NO: 1046678 - RNA, 22 nt, Human
ugggagaguaaccaauuccuuc

SEQ ID NO: 1046679 - RNA, 22 nt, Human
ggcuuaaugguucuuuuucuca

SEQ ID NO: 1046680 - RNA, 22 nt, Human
auagcuuucuuaaauauauaaa

SEQ ID NO: 1046681 - RNA, 22 nt, Human
gcaacuuuagaaaaaucuauaa

SEQ ID NO: 1046682 - RNA, 22 nt, Human
ugcccagggauaagccuagaga

SEQ ID NO: 1046683 - RNA, 22 nt, Human
aaguccuuguauacagaaucaa

SEQ ID NO: 1046684 - RNA, 20 nt, Human
caggagggacauuucagcau

SEQ ID NO: 1046685 - RNA, 22 nt, Human
gacagccuggcuuaaucugucu

SEQ ID NO: 1046686 - RNA, 21 nt, Human
cuacagaaucgagcauucugg

SEQ ID NO: 1046687 - RNA, 22 nt, Human
aggagggacaccaauauauguu

SEQ ID NO: 1046688 - RNA, 22 nt, Human
uaauuccaccuuuuuccaacuu

SEQ ID NO: 1046689 - RNA, 22 nt, Human
aucagaaaaacauaauguuauu

SEQ ID NO: 1046690 - RNA, 22 nt, Human
uuaauaaacaggugcagcugaa

SEQ ID NO: 1046691 - RNA, 22 nt, Human
uaucagaagacuuacaguaucg

SEQ ID NO: 1046692 - RNA, 22 nt, Human
cucacaguuggcucauuaauga

SEQ ID NO: 1046693 - RNA, 22 nt, Human
acuuugaaagccuuggccccgg

SEQ ID NO: 1046694 - RNA, 19 nt, Human
uggcauuuggaggcaaccu

SEQ ID NO: 1046695 - RNA, 22 nt, Human
uuaauucugccuuucauguaac

SEQ ID NO: 1046696 - RNA, 22 nt, Human
gguggggcuaggaccucaggau

SEQ ID NO: 1046697 - RNA, 22 nt, Human
uaacagaaauuuuaguuagggg

SEQ ID NO: 1046698 - RNA, 22 nt, Human
ggauucuaacugaacagaauau

SEQ ID NO: 1046699 - RNA, 22 nt, Human
uacagacaguuuuucagauauu

SEQ ID NO: 1046700 - RNA, 22 nt, Human
aggagauggagcucagugggca

SEQ ID NO: 1046701 - RNA, 19 nt, Human
ugagacagagaccaguucu

SEQ ID NO: 1046702 - RNA, 22 nt, Human
aaugguuuucuagaacaugaaa

SEQ ID NO: 1046703 - RNA, 22 nt, Human
ucuccaggugaaacuugcaggg

SEQ ID NO: 1046704 - RNA, 22 nt, Human
gauuuagagcaggaaugcaugg

SEQ ID NO: 1046705 - RNA, 23 nt, Human
ucccagggaaggugagcgaggcu

SEQ ID NO: 1046706 - RNA, 22 nt, Human
aucagaaauagucauguuacuu

SEQ ID NO: 1046707 - RNA, 22 nt, Human
acaauauuguacccagaaguuu

SEQ ID NO: 1046708 - RNA, 22 nt, Human
auuaaacugagcaaauuaacau

SEQ ID NO: 1046709 - RNA, 20 nt, Human
cuccagggaacagacuggag

SEQ ID NO: 1046710 - RNA, 22 nt, Human
uguccuuagaagaagugaaaga

SEQ ID NO: 1046711 - RNA, 22 nt, Human
gccuccaccccuggggagugga

SEQ ID NO: 1046712 - RNA, 22 nt, Human
aagugaggccuaggcacugggu

SEQ ID NO: 1046713 - RNA, 22 nt, Human
ugcccaggcuucacccucagag

SEQ ID NO: 1046714 - RNA, 22 nt, Human
caagaaucagaccugucagggu

SEQ ID NO: 1046715 - RNA, 22 nt, Human
gcugcccagggcugaguguccu

SEQ ID NO: 1046716 - RNA, 17 nt, Human
uccauacaauucucucu

SEQ ID NO: 1046717 - RNA, 22 nt, Human
cuccagugcacccagaggauuu

SEQ ID NO: 1046718 - RNA, 20 nt, Human
guaaugaauguaaacaguaa

SEQ ID NO: 1046719 - RNA, 19 nt, Human
aaucagaaauaucgaggcc

SEQ ID NO: 1046720 - RNA, 22 nt, Human
ggggcagaaagcccacagagug

SEQ ID NO: 1046721 - RNA, 22 nt, Human
ugagacaauauuaaccuaucuu

SEQ ID NO: 1046722 - RNA, 19 nt, Human
acuccagggaugacagaag

SEQ ID NO: 1046723 - RNA, 22 nt, Human
ugucaccaugccagcuucugcc

SEQ ID NO: 1046724 - RNA, 22 nt, Human
guggacagcuucuaggugccag

SEQ ID NO: 1046725 - RNA, 22 nt, Human
ccugcccagcuucccgagugca

SEQ ID NO: 1046726 - RNA, 17 nt, Human
accaccucucaccagca

SEQ ID NO: 1046727 - RNA, 22 nt, Human
aagaaugagcucaaagaucuua

SEQ ID NO: 1046728 - RNA, 22 nt, Human
uuaauaaaguaugaauuggaaa

SEQ ID NO: 1046729 - RNA, 22 nt, Human
gguacaauggaccauaaaagcu

SEQ ID NO: 1046730 - RNA, 22 nt, Human
ugccugcagcgucuccagcagg

SEQ ID NO: 1046731 - RNA, 22 nt, Human
ugugaauacagcaugugcuucu

SEQ ID NO: 1046732 - RNA, 22 nt, Human
cuccagggaugagacagaguag

SEQ ID NO: 1046733 - RNA, 22 nt, Human
gugauuuaguguuaaguauguu

SEQ ID NO: 1046734 - RNA, 21 nt, Human
ccagggaagaaaugagggcag

SEQ ID NO: 1046735 - RNA, 22 nt, Human
uuuccaaaggcuaaacucaguu

SEQ ID NO: 1046736 - RNA, 22 nt, Human
ugaagaauaaaugguugagacu

SEQ ID NO: 1046737 - RNA, 22 nt, Human
uuaauuacaaaacacauagguu

SEQ ID NO: 1046738 - RNA, 22 nt, Human
ccagggaaugugggaugacucu

SEQ ID NO: 1046739 - RNA, 22 nt, Human
ccagggaaaggagguugacuug

SEQ ID NO: 1046740 - RNA, 22 nt, Human
agggaagagcuugcaagaaacc

SEQ ID NO: 1046741 - RNA, 22 nt, Human
ucagggaacuacuucucccuau

SEQ ID NO: 1046742 - RNA, 22 nt, Human
ucagggaaauuuccauguguuu

SEQ ID NO: 1046743 - RNA, 22 nt, Human
acagggaagcucaggggcucug

SEQ ID NO: 1046744 - RNA, 22 nt, Human
caucagaagauggcucuggaaa

SEQ ID NO: 1046745 - RNA, 21 nt, Human
uccagggaacuucucaggaau

SEQ ID NO: 1046746 - RNA, 22 nt, Human
uuuauccagaaucaggauuuuu

SEQ ID NO: 1046747 - RNA, 22 nt, Human
uuggaucauggaaugucugcuu

SEQ ID NO: 1046748 - RNA, 22 nt, Human
cacagccuccuucagagagcau

SEQ ID NO: 1046749 - RNA, 22 nt, Human
aguaaacacugucuuuauauau

SEQ ID NO: 1046750 - RNA, 22 nt, Human
gagauuuagcugcuuaacuccu

SEQ ID NO: 1046751 - RNA, 22 nt, Human
uuaagcaacacacauuaauuau

SEQ ID NO: 1046752 - RNA, 20 nt, Human
caucagaaauccugacccac

SEQ ID NO: 1046753 - RNA, 22 nt, Human
cuuaggcagacugcugaugcag

SEQ ID NO: 1046754 - RNA, 22 nt, Human
aaaucaguuguuauauuaaaga

SEQ ID NO: 1046755 - RNA, 18 nt, Human
uccagcucugccacuuac

SEQ ID NO: 1046756 - RNA, 22 nt, Human
uccuccagcaggacugaggccc

SEQ ID NO: 1046757 - RNA, 22 nt, Human
agucaaagcuacaggcauuuga

SEQ ID NO: 1046758 - RNA, 22 nt, Human
uuuccaaauaaggucacacuca

SEQ ID NO: 1046759 - RNA, 22 nt, Human
uacaggaaguaaguaaugaaau

SEQ ID NO: 1046760 - RNA, 22 nt, Human
acacaauacagggcucaaaaua

SEQ ID NO: 1046761 - RNA, 22 nt, Human
gcagggauugucaaugcugcuc

SEQ ID NO: 1046762 - RNA, 22 nt, Human
ugcaaacuauugguagagaugg

SEQ ID NO: 1046763 - RNA, 22 nt, Human
ugaucugaaggacaugggaccc

SEQ ID NO: 1046764 - RNA, 22 nt, Human
auaauaaaccaggaugggucug

SEQ ID NO: 1046765 - RNA, 22 nt, Human
cuuucaacuacauacaggcgau

SEQ ID NO: 1046766 - RNA, 22 nt, Human
ccaagggaaaccgagaggcugg

SEQ ID NO: 1046767 - RNA, 22 nt, Human
uuagaaaugauuucaccucuuu

SEQ ID NO: 1046768 - RNA, 22 nt, Human
caaagucagcugccagucccaa

SEQ ID NO: 1046769 - RNA, 22 nt, Human
uuccuuagcuccucauggccug

SEQ ID NO: 1046770 - RNA, 22 nt, Human
ccagaauucagaaagggcauaa

SEQ ID NO: 1046771 - RNA, 22 nt, Human
agaggagguccuuuucugaugu

SEQ ID NO: 1046772 - RNA, 22 nt, Human
uucauagaucucaauuuugagg

SEQ ID NO: 1046773 - RNA, 22 nt, Human
uaagaaguacaaaaauuuucug

SEQ ID NO: 1046774 - RNA, 22 nt, Human
aagguucuaagggaagccaugc

SEQ ID NO: 1046775 - RNA, 22 nt, Human
uuuaggcaaacucauugucaga

SEQ ID NO: 1046776 - RNA, 22 nt, Human
guaaacaucagccacucuauuu

SEQ ID NO: 1046777 - RNA, 23 nt, Human
agaucugauguuaccaagaauug

SEQ ID NO: 1046778 - RNA, 22 nt, Human
auggcuuugaaguaauguaauu

SEQ ID NO: 1046779 - RNA, 22 nt, Human
caggaggugcccucuaguggca

SEQ ID NO: 1046780 - RNA, 22 nt, Human
aauuauccuuaaugcaguaagc

SEQ ID NO: 1046781 - RNA, 22 nt, Human
ccagaucuucuuuucagugucu

SEQ ID NO: 1046782 - RNA, 22 nt, Human
gucagucuccugccuuuuggac

SEQ ID NO: 1046783 - RNA, 22 nt, Human
auuccaaaggcuggccuggagg

SEQ ID NO: 1046784 - RNA, 22 nt, Human
aagggagaggagggucuuguug

SEQ ID NO: 1046785 - RNA, 23 nt, Human
aggagacagggaagugccuggcu

SEQ ID NO: 1046786 - RNA, 22 nt, Human
agcccugggucccaguccuggc

SEQ ID NO: 1046787 - RNA, 23 nt, Human
gggcugcuccaggccaaggcugg

SEQ ID NO: 1046788 - RNA, 22 nt, Human
cuuaggcauccaggguucuucc

SEQ ID NO: 1046789 - RNA, 22 nt, Human
ggcugcccuagagcuggcaagg

SEQ ID NO: 1046790 - RNA, 22 nt, Human
uccagggcagggugcgcauggg

SEQ ID NO: 1046791 - RNA, 22 nt, Human
ccuccuagaggaaccccagggc

SEQ ID NO: 1046792 - RNA, 22 nt, Human
uucagaaaaaacuucaauaagu

SEQ ID NO: 1046793 - RNA, 22 nt, Human
cauuuacacacagaggugugcu

SEQ ID NO: 1046794 - RNA, 22 nt, Human
augaacaagagagggaagauuc

SEQ ID NO: 1046795 - RNA, 22 nt, Human
gaaagccauagcccagcuuuac

SEQ ID NO: 1046796 - RNA, 20 nt, Human
gugcccaguuggugacagac

SEQ ID NO: 1046797 - RNA, 22 nt, Human
cacagccuugagcgaggacaag

SEQ ID NO: 1046798 - RNA, 22 nt, Human
ggggcugcucccaccccugagg

SEQ ID NO: 1046799 - RNA, 22 nt, Human
aguccuuaugagaugcugccuu

SEQ ID NO: 1046800 - RNA, 22 nt, Human
aaucagaacuucucaggguggg

SEQ ID NO: 1046801 - RNA, 22 nt, Human
auaauucaugggccuuucaccu

SEQ ID NO: 1046802 - RNA, 22 nt, Human
ccuggaucuaaggaagcuggga

SEQ ID NO: 1046803 - RNA, 22 nt, Human
ugcagugggccggaggccaggg

SEQ ID NO: 1046804 - RNA, 22 nt, Human
gauggcuucagucuccuugggu

SEQ ID NO: 1046805 - RNA, 22 nt, Human
uagaaacagcauauauuagccc

SEQ ID NO: 1046806 - RNA, 19 nt, Human
ugcccaggccucccaaaag

SEQ ID NO: 1046807 - RNA, 22 nt, Human
caaguccaucagauaagcaaga

SEQ ID NO: 1046808 - RNA, 22 nt, Human
ucauaauacaaagaguucugca

SEQ ID NO: 1046809 - RNA, 22 nt, Human
caaagaggugagaggagccuuu

SEQ ID NO: 1046810 - RNA, 22 nt, Human
uaugcccagcuuaaaguacaca

SEQ ID NO: 1046811 - RNA, 22 nt, Human
cuuaggcaagcagagcccaucc

SEQ ID NO: 1046812 - RNA, 22 nt, Human
augcuuaacucuguacauaguu

SEQ ID NO: 1046813 - RNA, 22 nt, Human
ugucaccaccggaagaaacugc

SEQ ID NO: 1046814 - RNA, 22 nt, Human
aggauuuaccuccagcuaggcu

SEQ ID NO: 1046815 - RNA, 22 nt, Human
uauaauuaguaaauggcagauu

SEQ ID NO: 1046816 - RNA, 22 nt, Human
uuauagugggcccaacauggcg

SEQ ID NO: 1046817 - RNA, 22 nt, Human
cuccagggaaaggggcguccgc

SEQ ID NO: 1046818 - RNA, 21 nt, Human
ccagccucagaucagggagcu

SEQ ID NO: 1046819 - RNA, 22 nt, Human
auuucaacguuagauguaauag

SEQ ID NO: 1046820 - RNA, 22 nt, Human
cccugggauggauuggcaggaa

SEQ ID NO: 1046821 - RNA, 21 nt, Human
auacagaagguggcaaaguac

SEQ ID NO: 1046822 - RNA, 22 nt, Human
uaaagccauacugaaagccacu

SEQ ID NO: 1046823 - RNA, 22 nt, Human
ccugggaagagcugacaggagg

SEQ ID NO: 1046824 - RNA, 22 nt, Human
gcagaauucuacagaugauaaa

SEQ ID NO: 1046825 - RNA, 22 nt, Human
uaucagaacacagccacagcca

SEQ ID NO: 1046826 - RNA, 22 nt, Human
gaggagggccuggugucccuuc

SEQ ID NO: 1046827 - RNA, 22 nt, Human
gaucagaauucuuguguguuuc

SEQ ID NO: 1046828 - RNA, 22 nt, Human
guccagggcuaaaucagguucc

SEQ ID NO: 1046829 - RNA, 22 nt, Human
uccagccuugccacuuuucugu

SEQ ID NO: 1046830 - RNA, 22 nt, Human
cuuugaagauggcaaauuuaga

SEQ ID NO: 1046831 - RNA, 22 nt, Human
ucuucccucuucugccaaauac

SEQ ID NO: 1046832 - RNA, 22 nt, Human
cuggacucugcagagaaaagua

SEQ ID NO: 1046833 - RNA, 22 nt, Human
agggagccuuccuggcuguggu

SEQ ID NO: 1046834 - RNA, 22 nt, Human
gaauuucaagcagugcaauguu

SEQ ID NO: 1046835 - RNA, 22 nt, Human
gcuggauccugauucgucuuug

SEQ ID NO: 1046836 - RNA, 22 nt, Human
uacaguauguucuugaauuugg

SEQ ID NO: 1046837 - RNA, 22 nt, Human
aacagaauaguugauguacagu

SEQ ID NO: 1046838 - RNA, 22 nt, Human
cagggaugugaugagcugagcc

SEQ ID NO: 1046839 - RNA, 22 nt, Human
uaauacuuuugccuuguauuca

SEQ ID NO: 1046840 - RNA, 18 nt, Human
agggagagaccgcggguc

SEQ ID NO: 1046841 - RNA, 18 nt, Human
ccuccaaguccccagccu

SEQ ID NO: 1046842 - RNA, 21 nt, Human
uccaaaaaggagcguccuucu

SEQ ID NO: 1046843 - RNA, 22 nt, Human
ggggcccuuguggcugcaggcc

SEQ ID NO: 1046844 - RNA, 22 nt, Human
gaaauauacauugcaggaagag

SEQ ID NO: 1046845 - RNA, 21 nt, Human
agggcacccccgcugccuacc

SEQ ID NO: 1046846 - RNA, 22 nt, Human
ugggagaggcugccaucuugca

SEQ ID NO: 1046847 - RNA, 22 nt, Human
aacacuuucuauuauuaugguu

SEQ ID NO: 1046848 - RNA, 22 nt, Human
agaucccaaaucaccugcuuau

SEQ ID NO: 1046849 - RNA, 22 nt, Human
uccagcucaggguuggcucaag

SEQ ID NO: 1046850 - RNA, 22 nt, Human
ggagcaagucccaggcacuagu

SEQ ID NO: 1046851 - RNA, 22 nt, Human
agacaggcagaggcugcagagg

SEQ ID NO: 1046852 - RNA, 22 nt, Human
ucugcccagggacccacaggga

SEQ ID NO: 1046853 - RNA, 22 nt, Human
gacuaugugaagugugaauagg

SEQ ID NO: 1046854 - RNA, 22 nt, Human
acuuuuaucaaggaagugaucu

SEQ ID NO: 1046855 - RNA, 21 nt, Human
uuucagaccuaucuuugaagg

SEQ ID NO: 1046856 - RNA, 22 nt, Human
ugcuggaggauuaaacaaguca

SEQ ID NO: 1046857 - RNA, 22 nt, Human
ggaguuggugagcaccaggcuu

SEQ ID NO: 1046858 - RNA, 22 nt, Human
caugcuuuucaaucuaucuuaa

SEQ ID NO: 1046859 - RNA, 22 nt, Human
ccugcccacagagagggugcau

SEQ ID NO: 1046860 - RNA, 22 nt, Human
uagauauaagguccuuagaaca

SEQ ID NO: 1046861 - RNA, 22 nt, Human
acuuugaaucucagauaaccaa

SEQ ID NO: 1046862 - RNA, 22 nt, Human
uugcacauuuccuagaauuuca

SEQ ID NO: 1046863 - RNA, 20 nt, Human
caauuucaucauuuccugug

SEQ ID NO: 1046864 - RNA, 22 nt, Human
uuugaagacauauuguuacaua

SEQ ID NO: 1046865 - RNA, 22 nt, Human
uuauccaagcagaagcugcaca

SEQ ID NO: 1046866 - RNA, 22 nt, Human
gauaaaauucuuauuuuacccg

SEQ ID NO: 1046867 - RNA, 22 nt, Human
uuacagaacugucuugaaauuu

SEQ ID NO: 1046868 - RNA, 22 nt, Human
acagggaauggagggaucagua

SEQ ID NO: 1046869 - RNA, 22 nt, Human
cucauacauaugccauuccugc

SEQ ID NO: 1046870 - RNA, 22 nt, Human
cacagcagggaugaauggagug

SEQ ID NO: 1046871 - RNA, 22 nt, Human
cuuugaauugccguuucaucug

SEQ ID NO: 1046872 - RNA, 22 nt, Human
uacaaaaaauugauacugacga

SEQ ID NO: 1046873 - RNA, 22 nt, Human
auuucauacuaaggcucaaaaa

SEQ ID NO: 1046874 - RNA, 23 nt, Human
ucuauacauacugcagccucugg

SEQ ID NO: 1046875 - RNA, 22 nt, Human
augguuuuccucugcugcuuaa

SEQ ID NO: 1046876 - RNA, 22 nt, Human
agaugaaaagauaagcagcaau

SEQ ID NO: 1046877 - RNA, 22 nt, Human
ugagacaaaauugacagacaaa

SEQ ID NO: 1046878 - RNA, 22 nt, Human
ccauggcuuacagauggagcau

SEQ ID NO: 1046879 - RNA, 20 nt, Human
auacuuguuuucaggcuuuu

SEQ ID NO: 1046880 - RNA, 22 nt, Human
cagggccccagggaugucugcu

SEQ ID NO: 1046881 - RNA, 22 nt, Human
aauuccaaauguuuucaaucca

SEQ ID NO: 1046882 - RNA, 22 nt, Human
aagaaacaaccacugcucuccu

SEQ ID NO: 1046883 - RNA, 22 nt, Human
aaugguauuugucaagcauagu

SEQ ID NO: 1046884 - RNA, 22 nt, Human
agggcuccuaugaugcucugcc

SEQ ID NO: 1046885 - RNA, 22 nt, Human
aggauuuaggagcuggcuaacg

SEQ ID NO: 1046886 - RNA, 22 nt, Human
aggcuucugugagcucauacaa

SEQ ID NO: 1046887 - RNA, 22 nt, Human
aaguccuucuuuauaugagagu

SEQ ID NO: 1046888 - RNA, 22 nt, Human
ggaggaggcaaguaccagaugc

SEQ ID NO: 1046889 - RNA, 22 nt, Human
aggauuuauuggugggaaguua

SEQ ID NO: 1046890 - RNA, 22 nt, Human
ucugcgugggacugaggaggcu

SEQ ID NO: 1046891 - RNA, 22 nt, Human
gauuucaagcccccagagauuc

SEQ ID NO: 1046892 - RNA, 22 nt, Human
cagucaccauagaauaaaacau

SEQ ID NO: 1046893 - RNA, 22 nt, Human
gaaauauacaugaagucggcug

SEQ ID NO: 1046894 - RNA, 22 nt, Human
uugaauaauauguucaggagga

SEQ ID NO: 1046895 - RNA, 22 nt, Human
gaagagagccgcgggacaucag

SEQ ID NO: 1046896 - RNA, 22 nt, Human
gcagggauugugcagggggcua

SEQ ID NO: 1046897 - RNA, 22 nt, Human
uagucaccuuuggcaccugcaa

SEQ ID NO: 1046898 - RNA, 22 nt, Human
guuccaaaguuagaguguauug

SEQ ID NO: 1046899 - RNA, 18 nt, Human
aauuuccauaugaauugc

SEQ ID NO: 1046900 - RNA, 22 nt, Human
aaagaaucuauauaucaccacc

SEQ ID NO: 1046901 - RNA, 22 nt, Human
acagaauugauggaaaucucag

SEQ ID NO: 1046902 - RNA, 22 nt, Human
cuggcuuccugaguccauuacc

SEQ ID NO: 1046903 - RNA, 22 nt, Human
gaugaaaaauugcugugucaua

SEQ ID NO: 1046904 - RNA, 22 nt, Human
uuaaagaauagugccccuauug

SEQ ID NO: 1046905 - RNA, 22 nt, Human
gaccaccagagguccgugggua

SEQ ID NO: 1046906 - RNA, 22 nt, Human
ccuggaucagucacuguugcug

SEQ ID NO: 1046907 - RNA, 22 nt, Human
ggaggaggggugacugaaugcu

SEQ ID NO: 1046908 - RNA, 22 nt, Human
cagaucuguaguaaaagaucuc

SEQ ID NO: 1046909 - RNA, 22 nt, Human
guucuaauaggagaaaagacag

SEQ ID NO: 1046910 - RNA, 22 nt, Human
uuauuaaugaguacaaguuauu

SEQ ID NO: 1046911 - RNA, 22 nt, Human
aauacugucuuucacagauauu

SEQ ID NO: 1046912 - RNA, 22 nt, Human
uucauaaucaccaaaaacugga

SEQ ID NO: 1046913 - RNA, 22 nt, Human
uaaagccacgcuggaaaucagg

SEQ ID NO: 1046914 - RNA, 20 nt, Human
gggagacagggccagugucc

SEQ ID NO: 1046915 - RNA, 19 nt, Human
cugcuuccuucccucacug

SEQ ID NO: 1046916 - RNA, 22 nt, Human
aaagcagccacagagagagcgu

SEQ ID NO: 1046917 - RNA, 22 nt, Human
guacauaaaggaggcucuuugc

SEQ ID NO: 1046918 - RNA, 22 nt, Human
aggggcugcuggguccgccccu

SEQ ID NO: 1046919 - RNA, 22 nt, Human
acauaaguuauggauaaaaugu

SEQ ID NO: 1046920 - RNA, 22 nt, Human
ucacacauucuagguauguuga

SEQ ID NO: 1046921 - RNA, 20 nt, Human
ugcagggcugccucccagcu

SEQ ID NO: 1046922 - RNA, 22 nt, Human
aaaggaggaauggagagaugcu

SEQ ID NO: 1046923 - RNA, 22 nt, Human
aagucaccccacacucuuggga

SEQ ID NO: 1046924 - RNA, 22 nt, Human
ucagggaggugucugccagaga

SEQ ID NO: 1046925 - RNA, 22 nt, Human
aaacaaacaauuaguugugugg

SEQ ID NO: 1046926 - RNA, 22 nt, Human
uguacaauguguuuguuggcuu

SEQ ID NO: 1046927 - RNA, 22 nt, Human
gaguccuuaauacacuggugga

SEQ ID NO: 1046928 - RNA, 22 nt, Human
agucuucuagcuggguuugguu

SEQ ID NO: 1046929 - RNA, 22 nt, Human
uaggaggguuagagggaaauau

SEQ ID NO: 1046930 - RNA, 22 nt, Human
uaaguccuaauggcagaagucu

SEQ ID NO: 1046931 - RNA, 22 nt, Human
ugaauaaucuuggguauuaaua

SEQ ID NO: 1046932 - RNA, 22 nt, Human
aaugguuugauggacaaaauga

SEQ ID NO: 1046933 - RNA, 22 nt, Human
aauuauauuguggugugaaugu

SEQ ID NO: 1046934 - RNA, 23 nt, Human
ucuaauacaugaaaccuagaugu

SEQ ID NO: 1046935 - RNA, 22 nt, Human
aguaaacaguaucuuuaguguc

SEQ ID NO: 1046936 - RNA, 22 nt, Human
agacauggauuucuuacauaaa

SEQ ID NO: 1046937 - RNA, 22 nt, Human
uuggaucagaugauaucuuugu

SEQ ID NO: 1046938 - RNA, 22 nt, Human
accagccagccacaguggcucc

SEQ ID NO: 1046939 - RNA, 22 nt, Human
uaugaaaagguggccaauguag

SEQ ID NO: 1046940 - RNA, 22 nt, Human
caauuucagaccuuuccuugga

SEQ ID NO: 1046941 - RNA, 22 nt, Human
cagggaugaccagagggaugug

SEQ ID NO: 1046942 - RNA, 22 nt, Human
aauuuacaggugcacucgccau

SEQ ID NO: 1046943 - RNA, 22 nt, Human
guacagaaauggggccccaggu

SEQ ID NO: 1046944 - RNA, 22 nt, Human
cuauagaaaauuguaucacacg

SEQ ID NO: 1046945 - RNA, 22 nt, Human
ccagggcagugggagaaggugc

SEQ ID NO: 1046946 - RNA, 22 nt, Human
augguuuuucaaguauucagaa

SEQ ID NO: 1046947 - RNA, 22 nt, Human
gaaauagacacuuucuaugaau

SEQ ID NO: 1046948 - RNA, 22 nt, Human
agaauuucaaauggaaguuuua

SEQ ID NO: 1046949 - RNA, 22 nt, Human
ugagacaacauugggcaagucc

SEQ ID NO: 1046950 - RNA, 22 nt, Human
ugggcugcccaagguggccaug

SEQ ID NO: 1046951 - RNA, 20 nt, Human
aggauuuacuacuaccugcu

SEQ ID NO: 1046952 - RNA, 22 nt, Human
guaaacaacacaaaucauuuga

SEQ ID NO: 1046953 - RNA, 22 nt, Human
ugggagagcacugcagccccgg

SEQ ID NO: 1046954 - RNA, 22 nt, Human
acagaaauaacuuuuuauguuu

SEQ ID NO: 1046955 - RNA, 22 nt, Human
gagggaagaaagaauugaugcg

SEQ ID NO: 1046956 - RNA, 22 nt, Human
ucagccagcaucagcuaagugc

SEQ ID NO: 1046957 - RNA, 22 nt, Human
gaauuucaggacaacuggaagg

SEQ ID NO: 1046958 - RNA, 22 nt, Human
cugccugccuuggccuccagga

SEQ ID NO: 1046959 - RNA, 22 nt, Human
uaauuuuuccacguacacuggg

SEQ ID NO: 1046960 - RNA, 22 nt, Human
ccagccucacuggcaucaccua

SEQ ID NO: 1046961 - RNA, 22 nt, Human
uccagggaucuuuagagucuuu

SEQ ID NO: 1046962 - RNA, 22 nt, Human
aguaaacauuuucauauuuucu

SEQ ID NO: 1046963 - RNA, 22 nt, Human
ucccuggcagcuguccuuucag

SEQ ID NO: 1046964 - RNA, 21 nt, Human
agucccauccgguaagcaagc

SEQ ID NO: 1046965 - RNA, 22 nt, Human
aaguaaauaucuguuuauagca

SEQ ID NO: 1046966 - RNA, 22 nt, Human
acagaaugggauuugaauauuu

SEQ ID NO: 1046967 - RNA, 22 nt, Human
aauauaugagggagcuauuuga

SEQ ID NO: 1046968 - RNA, 22 nt, Human
cugugcagcuggcuuccuggaa

SEQ ID NO: 1046969 - RNA, 21 nt, Human
ugggagagggcucagcuaccc

SEQ ID NO: 1046970 - RNA, 22 nt, Human
cucuccagccuuuagcccacgc

SEQ ID NO: 1046971 - RNA, 22 nt, Human
gugaauaauuuuuuaguauaag

SEQ ID NO: 1046972 - RNA, 22 nt, Human
agucaaaugaguaaauauauaa

SEQ ID NO: 1046973 - RNA, 22 nt, Human
ucagaauugcagggagggcagg

SEQ ID NO: 1046974 - RNA, 22 nt, Human
ugucaccacauuugucaauauc

SEQ ID NO: 1046975 - RNA, 22 nt, Human
gagcccaggaaguggaggcuga

SEQ ID NO: 1046976 - RNA, 22 nt, Human
caaagcaaggcucaguuugaac

SEQ ID NO: 1046977 - RNA, 22 nt, Human
agggagaguagauaucaggugu

SEQ ID NO: 1046978 - RNA, 16 nt, Human
gcaacuuugggguuga

SEQ ID NO: 1046979 - RNA, 22 nt, Human
uuuauccaccuuacccuguucc

SEQ ID NO: 1046980 - RNA, 22 nt, Human
aggggagagaacauaaggaagu

SEQ ID NO: 1046981 - RNA, 22 nt, Human
gaauuucagaucagagaccauu

SEQ ID NO: 1046982 - RNA, 22 nt, Human
acaacuuucuggguuaucugau

SEQ ID NO: 1046983 - RNA, 22 nt, Human
aaguuacacauuuucauuguaa

SEQ ID NO: 1046984 - RNA, 22 nt, Human
auuucaacauucucaguuguag

SEQ ID NO: 1046985 - RNA, 22 nt, Human
auauaauacaaccugcuaagug

SEQ ID NO: 1046986 - RNA, 22 nt, Human
ucuccaggaaagacacuggacu

SEQ ID NO: 1046987 - RNA, 22 nt, Human
aucagaaauugcccagcuguuu

SEQ ID NO: 1046988 - RNA, 19 nt, Human
uacauacuuauucuaaaag

SEQ ID NO: 1046989 - RNA, 22 nt, Human
acaaaguccugguguauggcca

SEQ ID NO: 1046990 - RNA, 22 nt, Human
ugagauuuguuuuauaaaauag

SEQ ID NO: 1046991 - RNA, 22 nt, Human
ucugcccagcuaaaaaugggag

SEQ ID NO: 1046992 - RNA, 22 nt, Human
auccuuagguggugcaucaggg

SEQ ID NO: 1046993 - RNA, 22 nt, Human
aagggcccauucucucagaaaa

SEQ ID NO: 1046994 - RNA, 22 nt, Human
agcaguggccuggggcucugug

SEQ ID NO: 1046995 - RNA, 22 nt, Human
guaaacauuuucaucugugccc

SEQ ID NO: 1046996 - RNA, 22 nt, Human
auucuaacacaugcucuaagaa

SEQ ID NO: 1046997 - RNA, 23 nt, Human
uuccacaaugaaaauaaagcagg

SEQ ID NO: 1046998 - RNA, 22 nt, Human
agaggaggcagcuuaacucagu

SEQ ID NO: 1046999 - RNA, 22 nt, Human
aggcagcauuugaauccagguc

SEQ ID NO: 1047000 - RNA, 20 nt, Human
ucugcccaccccggcuccca

SEQ ID NO: 1047001 - RNA, 22 nt, Human
acaacuuuucuaucauguggaa

SEQ ID NO: 1047002 - RNA, 22 nt, Human
aaucagcuaaauaaacuaguca

SEQ ID NO: 1047003 - RNA, 22 nt, Human
ggagaggggcaaguuuaucuag

SEQ ID NO: 1047004 - RNA, 22 nt, Human
gacuuuuagaauggugaggaau

SEQ ID NO: 1047005 - RNA, 22 nt, Human
acaugcuuugcacuuacaucau

SEQ ID NO: 1047006 - RNA, 22 nt, Human
gaguccuuuucauagcaguggg

SEQ ID NO: 1047007 - RNA, 22 nt, Human
aauguuaauuuacugucuucau

SEQ ID NO: 1047008 - RNA, 22 nt, Human
aggaggguucucuggacagagg

SEQ ID NO: 1047009 - RNA, 22 nt, Human
ucucuuggaacacuugcucuua

SEQ ID NO: 1047010 - RNA, 22 nt, Human
caugguuuugagccuauuaugc

SEQ ID NO: 1047011 - RNA, 22 nt, Human
cagucaccuagacagaacuuac

SEQ ID NO: 1047012 - RNA, 19 nt, Human
cuauacagccucugaggaa

SEQ ID NO: 1047013 - RNA, 22 nt, Human
ccagccucaucauauuccugcu

SEQ ID NO: 1047014 - RNA, 20 nt, Human
uacagacaugacaauaaugg

SEQ ID NO: 1047015 - RNA, 22 nt, Human
uuucagaaccgcuaaaauaaau

SEQ ID NO: 1047016 - RNA, 21 nt, Human
ugaaagaaggugcagucugaa

SEQ ID NO: 1047017 - RNA, 20 nt, Human
uggcccagcacgacgaggac

SEQ ID NO: 1047018 - RNA, 22 nt, Human
gcagggcucagccgcucccacc

SEQ ID NO: 1047019 - RNA, 20 nt, Human
uacaauacacaugcauauga

SEQ ID NO: 1047020 - RNA, 22 nt, Human
uguccuuauaagaaaaggaaau

SEQ ID NO: 1047021 - RNA, 22 nt, Human
uacuaaacccucgauggaucuu

SEQ ID NO: 1047022 - RNA, 22 nt, Human
acaugcuuuucccacaauuaua

SEQ ID NO: 1047023 - RNA, 22 nt, Human
gaaguucaaaagacagauuuga

SEQ ID NO: 1047024 - RNA, 22 nt, Human
gacaauacagaaagggacaugc

SEQ ID NO: 1047025 - RNA, 19 nt, Human
uuccuuagaggaggcggug

SEQ ID NO: 1047026 - RNA, 22 nt, Human
uccagggacaguauagaggauc

SEQ ID NO: 1047027 - RNA, 22 nt, Human
gagaaggggugauguggguaau

SEQ ID NO: 1047028 - RNA, 22 nt, Human
ucaccagucuuucuuaccauug

SEQ ID NO: 1047029 - RNA, 22 nt, Human
cauuuacacuucuaaccacaag

SEQ ID NO: 1047030 - RNA, 21 nt, Human
ucugcccacacuggccacugc

SEQ ID NO: 1047031 - RNA, 17 nt, Human
uccagcuccucauuguu

SEQ ID NO: 1047032 - RNA, 23 nt, Human
acaggaggggacagguggccgug

SEQ ID NO: 1047033 - RNA, 19 nt, Human
uggauuuauauucuuuauc

SEQ ID NO: 1047034 - RNA, 22 nt, Human
uagaaaucagcaggcauaugua

SEQ ID NO: 1047035 - RNA, 22 nt, Human
uuaacacuaucugucauaauua

SEQ ID NO: 1047036 - RNA, 22 nt, Human
augaaauauuucagagcagagu

SEQ ID NO: 1047037 - RNA, 22 nt, Human
ccaguggaaauguggucaggau

SEQ ID NO: 1047038 - RNA, 22 nt, Human
ucauaaaaugcuccugauauug

SEQ ID NO: 1047039 - RNA, 22 nt, Human
cagggcuuuuuauuagcugccu

SEQ ID NO: 1047040 - RNA, 22 nt, Human
aggggagacuggaaucuaacau

SEQ ID NO: 1047041 - RNA, 22 nt, Human
uuacagaaucuacucgugguga

SEQ ID NO: 1047042 - RNA, 22 nt, Human
ugcccaggaucuggcgaugcuc

SEQ ID NO: 1047043 - RNA, 22 nt, Human
uccagggaguuggcuggauagu

SEQ ID NO: 1047044 - RNA, 22 nt, Human
aacaaacaaacauuuugucauc

SEQ ID NO: 1047045 - RNA, 20 nt, Human
agacaugguagugauucagg

SEQ ID NO: 1047046 - RNA, 22 nt, Human
acaugcuuugauguauuuugca

SEQ ID NO: 1047047 - RNA, 22 nt, Human
aggauuuaucaggaacucucuu

SEQ ID NO: 1047048 - RNA, 22 nt, Human
aagaaaucauaucauuucuugg

SEQ ID NO: 1047049 - RNA, 22 nt, Human
gaaguccugguccucucauuca

SEQ ID NO: 1047050 - RNA, 16 nt, Human
ccuggauccccugugg

SEQ ID NO: 1047051 - RNA, 22 nt, Human
acauaauaggugccugaauauu

SEQ ID NO: 1047052 - RNA, 22 nt, Human
uuccuuagauccuucaaucacg

SEQ ID NO: 1047053 - RNA, 22 nt, Human
uggagagguuuaaacaaaaguu

SEQ ID NO: 1047054 - RNA, 22 nt, Human
gucaacuuuaagaugaucuuuu

SEQ ID NO: 1047055 - RNA, 21 nt, Human
auggauuuaaacaggccacaa

SEQ ID NO: 1047056 - RNA, 22 nt, Human
aggugcccaugagcuccauggc

SEQ ID NO: 1047057 - RNA, 19 nt, Human
aggcagcaggccagggaug

SEQ ID NO: 1047058 - RNA, 22 nt, Human
caaugaaaauuuaaguugcagc

SEQ ID NO: 1047059 - RNA, 22 nt, Human
uuucacacaacgugaauauacu

SEQ ID NO: 1047060 - RNA, 22 nt, Human
gaugauaacagcauuucaacug

SEQ ID NO: 1047061 - RNA, 22 nt, Human
uacacauguauuuauguguaca

SEQ ID NO: 1047062 - RNA, 22 nt, Human
cagaaaaggaagagcuauguaa

SEQ ID NO: 1047063 - RNA, 22 nt, Human
cacgagggcacacgugggaggg

SEQ ID NO: 1047064 - RNA, 22 nt, Human
aacuuuguguguuuaauauggc

SEQ ID NO: 1047065 - RNA, 22 nt, Human
gccagggaggcuguaggguccu

SEQ ID NO: 1047066 - RNA, 22 nt, Human
uuucaauguaugucuuucugag

SEQ ID NO: 1047067 - RNA, 22 nt, Human
auacagaagaccccuccgucau

SEQ ID NO: 1047068 - RNA, 20 nt, Human
gcagccucaacaggcacagc

SEQ ID NO: 1047069 - RNA, 22 nt, Human
uauccaaaggaacaaucacagc

SEQ ID NO: 1047070 - RNA, 22 nt, Human
agaucaguuagauagcuugaug

SEQ ID NO: 1047071 - RNA, 22 nt, Human
acugcccauuaugguagucacu

SEQ ID NO: 1047072 - RNA, 20 nt, Human
cccagggaccugagcuccau

SEQ ID NO: 1047073 - RNA, 22 nt, Human
aagccagauuucacucuuaauu

SEQ ID NO: 1047074 - RNA, 22 nt, Human
aggagggauagaaaaauacuug

SEQ ID NO: 1047075 - RNA, 22 nt, Human
cagggaaggcugcaaauguuaa

SEQ ID NO: 1047076 - RNA, 22 nt, Human
uggggagagguaucauugagau

SEQ ID NO: 1047077 - RNA, 17 nt, Human
ggcaguggaggaagaga

SEQ ID NO: 1047078 - RNA, 22 nt, Human
auacagaauucacuacaguuuc

SEQ ID NO: 1047079 - RNA, 22 nt, Human
augcuuuaaaugucuuuugcuu

SEQ ID NO: 1047080 - RNA, 22 nt, Human
ucagaauugucuggggaauguu

SEQ ID NO: 1047081 - RNA, 22 nt, Human
caugauaauuguuaacaaagua

SEQ ID NO: 1047082 - RNA, 22 nt, Human
uaaucuaccacuauugcaauau

SEQ ID NO: 1047083 - RNA, 22 nt, Human
gaaaaccaccucccaucaagca

SEQ ID NO: 1047084 - RNA, 22 nt, Human
auuaggcagggcaugguggcuc

SEQ ID NO: 1047085 - RNA, 22 nt, Human
auucauaaguaaaugauuaccu

SEQ ID NO: 1047086 - RNA, 22 nt, Human
uuacagaaaagggcuuuaagag

SEQ ID NO: 1047087 - RNA, 22 nt, Human
cagaaagcuuaggcaaguugga

SEQ ID NO: 1047088 - RNA, 22 nt, Human
ucagggaaaacaucccgccuaa

SEQ ID NO: 1047089 - RNA, 22 nt, Human
uuacagauggaucuagcaaaau

SEQ ID NO: 1047090 - RNA, 22 nt, Human
aauuccaaguagcaucccauca

SEQ ID NO: 1047091 - RNA, 22 nt, Human
aaauagcagccuuuaguuaaca

SEQ ID NO: 1047092 - RNA, 22 nt, Human
augcacaagcaagagauaaugg

SEQ ID NO: 1047093 - RNA, 22 nt, Human
ugggagagagaauucccagugg

SEQ ID NO: 1047094 - RNA, 22 nt, Human
uaaauaugcauguauccuuauc

SEQ ID NO: 1047095 - RNA, 22 nt, Human
ccagcuccugggucuuagucag

SEQ ID NO: 1047096 - RNA, 22 nt, Human
uucaccagaccugugagcuucc

SEQ ID NO: 1047097 - RNA, 22 nt, Human
auuaggcagugccauuguacgg

SEQ ID NO: 1047098 - RNA, 22 nt, Human
agggagaggcugaacuauccua

SEQ ID NO: 1047099 - RNA, 22 nt, Human
uauacuuuccugcaacuuugau

SEQ ID NO: 1047100 - RNA, 22 nt, Human
ccugcccacacagcaauuuuaa

SEQ ID NO: 1047101 - RNA, 22 nt, Human
acccagggcucaagcguaggca

SEQ ID NO: 1047102 - RNA, 22 nt, Human
ugcccaggcuggagugcagagg

SEQ ID NO: 1047103 - RNA, 22 nt, Human
uuugaagauuaugccagaguga

SEQ ID NO: 1047104 - RNA, 22 nt, Human
ugaaauagacacagugcuauac

SEQ ID NO: 1047105 - RNA, 22 nt, Human
acugcccacagugaaugguugg

SEQ ID NO: 1047106 - RNA, 22 nt, Human
ucuccacgugauggaguccagg

SEQ ID NO: 1047107 - RNA, 22 nt, Human
auuagaaaccaagaggcaggcu

SEQ ID NO: 1047108 - RNA, 22 nt, Human
ggauuugaauuguugaaaugau

SEQ ID NO: 1047109 - RNA, 22 nt, Human
agaugcugaauuauugugcuuu

SEQ ID NO: 1047110 - RNA, 22 nt, Human
cagaggcaggauaagaacugcg

SEQ ID NO: 1047111 - RNA, 23 nt, Human
uccaggagcaugcuggcuggcga

SEQ ID NO: 1047112 - RNA, 22 nt, Human
uaauuauagccgcuauuuugcu

SEQ ID NO: 1047113 - RNA, 22 nt, Human
auagaaauggcagcuggugcua

SEQ ID NO: 1047114 - RNA, 21 nt, Human
acuuuaauauacaugaggagg

SEQ ID NO: 1047115 - RNA, 22 nt, Human
acagguuugucugauguaauga

SEQ ID NO: 1047116 - RNA, 22 nt, Human
cuccagggagcuguggagguuu

SEQ ID NO: 1047117 - RNA, 22 nt, Human
uauacagaacugcacgugcacg

SEQ ID NO: 1047118 - RNA, 22 nt, Human
agauuucagaugcucggcaguu

SEQ ID NO: 1047119 - RNA, 22 nt, Human
ccagggcuggugggagaugcug

SEQ ID NO: 1047120 - RNA, 22 nt, Human
uuugaaguguuauuucuaucac

SEQ ID NO: 1047121 - RNA, 22 nt, Human
cauuaauauuguucuucuuuag

SEQ ID NO: 1047122 - RNA, 22 nt, Human
uccaaauacauuuacuguauuu

SEQ ID NO: 1047123 - RNA, 22 nt, Human
gaucugaaucaauagaauaacu

SEQ ID NO: 1047124 - RNA, 22 nt, Human
uccagggaagagcagaggcuac

SEQ ID NO: 1047125 - RNA, 22 nt, Human
guccaaauuuuucacauguaga

SEQ ID NO: 1047126 - RNA, 21 nt, Human
gaagacaaaugggaauagcug

SEQ ID NO: 1047127 - RNA, 22 nt, Human
aggagaggcaucaagaaaaucg

SEQ ID NO: 1047128 - RNA, 22 nt, Human
uccaauauggauaaaaggggcc

SEQ ID NO: 1047129 - RNA, 22 nt, Human
uuaauuacuaagcacaaugcaa

SEQ ID NO: 1047130 - RNA, 22 nt, Human
caagaucagggugccagaaugg

SEQ ID NO: 1047131 - RNA, 22 nt, Human
gcugcaccagcuccaccagggc

SEQ ID NO: 1047132 - RNA, 15 nt, Human
aaucagaaguguggc

SEQ ID NO: 1047133 - RNA, 22 nt, Human
caguccuuagucuggauggcuu

SEQ ID NO: 1047134 - RNA, 22 nt, Human
aagccucuggggccucaucugu

SEQ ID NO: 1047135 - RNA, 22 nt, Human
caaauucaaauuucaucagugu

SEQ ID NO: 1047136 - RNA, 22 nt, Human
guucuaauuuggggcuccuuag

SEQ ID NO: 1047137 - RNA, 22 nt, Human
agggcugcuuugcuaaauaugg

SEQ ID NO: 1047138 - RNA, 22 nt, Human
ggcauuaagaauaucauuaaaa

SEQ ID NO: 1047139 - RNA, 22 nt, Human
uuccuuagggaaagggauaagg

SEQ ID NO: 1047140 - RNA, 22 nt, Human
agcugcccagcuaggaagaagg

SEQ ID NO: 1047141 - RNA, 23 nt, Human
gaggagggucugacaaguguagc

SEQ ID NO: 1047142 - RNA, 23 nt, Human
gagauuuagcagacaaagcucuu

SEQ ID NO: 1047143 - RNA, 19 nt, Human
acuguaaggcauuuuuuuc

SEQ ID NO: 1047144 - RNA, 22 nt, Human
ugggagacuccagaacugaucc

SEQ ID NO: 1047145 - RNA, 22 nt, Human
ggggcugcucgccgcgcguuuc

SEQ ID NO: 1047146 - RNA, 20 nt, Human
gaaguccuuucacucuuccc

SEQ ID NO: 1047147 - RNA, 23 nt, Human
gaaucaguggcuaacaaggaaac

SEQ ID NO: 1047148 - RNA, 22 nt, Human
cuggcuuuggucaugugaucau

SEQ ID NO: 1047149 - RNA, 22 nt, Human
acaccaccgucccagccuccug

SEQ ID NO: 1047150 - RNA, 22 nt, Human
guuaggcaguuuucuucauucu

SEQ ID NO: 1047151 - RNA, 20 nt, Human
gaguccuuaugggcugaggu

SEQ ID NO: 1047152 - RNA, 22 nt, Human
acauaauaccuaggacaguuug

SEQ ID NO: 1047153 - RNA, 22 nt, Human
aagccaagaguuaacuauuugu

SEQ ID NO: 1047154 - RNA, 22 nt, Human
auauaauuguucugaaguguuu

SEQ ID NO: 1047155 - RNA, 18 nt, Human
auauguuaauuagguagg

SEQ ID NO: 1047156 - RNA, 20 nt, Human
cuccaggggaagagccuucc

SEQ ID NO: 1047157 - RNA, 23 nt, Human
uccagggauuaaugaagucaguc

SEQ ID NO: 1047158 - RNA, 22 nt, Human
aguaaacauuucagauuuauuu

SEQ ID NO: 1047159 - RNA, 22 nt, Human
aaucaugugggauagucugcuc

SEQ ID NO: 1047160 - RNA, 22 nt, Human
aggugaaguugaggaggcagaa

SEQ ID NO: 1047161 - RNA, 22 nt, Human
cagguucuggguccuggguccu

SEQ ID NO: 1047162 - RNA, 21 nt, Human
auggcuuuuuuaaagcuugug

SEQ ID NO: 1047163 - RNA, 22 nt, Human
ugcuuuaaccaucuuguuugga

SEQ ID NO: 1047164 - RNA, 17 nt, Human
gggaaguggagaaagcu

SEQ ID NO: 1047165 - RNA, 22 nt, Human
ccagggcucugcuucugccaug

SEQ ID NO: 1047166 - RNA, 22 nt, Human
aacauuggauauuuauuaaaag

SEQ ID NO: 1047167 - RNA, 22 nt, Human
agucaccaggguuugcuggguu

SEQ ID NO: 1047168 - RNA, 22 nt, Human
aauucucagguaaaaguuaagu

SEQ ID NO: 1047169 - RNA, 21 nt, Human
gccuccagccagauggccucc

SEQ ID NO: 1047170 - RNA, 17 nt, Human
caauuucauagguuuug

SEQ ID NO: 1047171 - RNA, 22 nt, Human
uuugaagaccuuaucucuaaau

SEQ ID NO: 1047172 - RNA, 22 nt, Human
gggggaggugaaugcaauaagg

SEQ ID NO: 1047173 - RNA, 22 nt, Human
agguacaaaagaguauaugaga

SEQ ID NO: 1047174 - RNA, 22 nt, Human
ugggcugcuucuauuggugguc

SEQ ID NO: 1047175 - RNA, 22 nt, Human
auccagggauaaaaguaagguu

SEQ ID NO: 1047176 - RNA, 22 nt, Human
acuauacauugaauguuaaggu

SEQ ID NO: 1047177 - RNA, 22 nt, Human
gauuuacagguuagguccugua

SEQ ID NO: 1047178 - RNA, 22 nt, Human
ugaaaauggccugaagaagcaa

SEQ ID NO: 1047179 - RNA, 22 nt, Human
cagggacaaagugagaaaggaa

SEQ ID NO: 1047180 - RNA, 22 nt, Human
aagcagcugugugacauaaucu

SEQ ID NO: 1047181 - RNA, 22 nt, Human
uuuaggcauugaauuagaauag

SEQ ID NO: 1047182 - RNA, 22 nt, Human
agcauuuagucuuuauugcagc

SEQ ID NO: 1047183 - RNA, 22 nt, Human
gcaggcuccaaggccugggaga

SEQ ID NO: 1047184 - RNA, 22 nt, Human
gaugaaaaucuugagaugucga

SEQ ID NO: 1047185 - RNA, 22 nt, Human
aaauacugucucugagagagcc

SEQ ID NO: 1047186 - RNA, 22 nt, Human
ucugcccagggacaggacacag

SEQ ID NO: 1047187 - RNA, 22 nt, Human
gcuccaggagcucacagcucgc

SEQ ID NO: 1047188 - RNA, 22 nt, Human
uaccagccucaguugugagccc

SEQ ID NO: 1047189 - RNA, 22 nt, Human
ucagcauaucuugagcuucaug

SEQ ID NO: 1047190 - RNA, 22 nt, Human
aggcagcaugggccccagcucc

SEQ ID NO: 1047191 - RNA, 22 nt, Human
gcuuuaaugcaauuucaccuca

SEQ ID NO: 1047192 - RNA, 22 nt, Human
uaagagaauguuguggcuaggu

SEQ ID NO: 1047193 - RNA, 22 nt, Human
uccagggaaggugugaggcugg

SEQ ID NO: 1047194 - RNA, 20 nt, Human
uggccuuuaaauaguauucc

SEQ ID NO: 1047195 - RNA, 18 nt, Human
uuccuccacagagcgcug

SEQ ID NO: 1047196 - RNA, 22 nt, Human
cagggacaaacaagguugggga

SEQ ID NO: 1047197 - RNA, 21 nt, Human
auacagaaggcagacucucuc

SEQ ID NO: 1047198 - RNA, 22 nt, Human
augaaacagugaauuagucaag

SEQ ID NO: 1047199 - RNA, 22 nt, Human
uccuccagggggaucuucagcc

SEQ ID NO: 1047200 - RNA, 22 nt, Human
cuagauccgcagguuuucagug

SEQ ID NO: 1047201 - RNA, 22 nt, Human
ugggcugcagagcccggccuuc

SEQ ID NO: 1047202 - RNA, 22 nt, Human
agccagggacgcugcaggcuac

SEQ ID NO: 1047203 - RNA, 22 nt, Human
acaacuuuaauggguuucagcu

SEQ ID NO: 1047204 - RNA, 22 nt, Human
uuaguacugauagggucaauca

SEQ ID NO: 1047205 - RNA, 22 nt, Human
cauagaaacugagacaaggauu

SEQ ID NO: 1047206 - RNA, 22 nt, Human
gaggcagcgggucaggaccgug

SEQ ID NO: 1047207 - RNA, 22 nt, Human
uuucagacagauucuucucagu

SEQ ID NO: 1047208 - RNA, 22 nt, Human
uuccuuagugacuucuagcuac

SEQ ID NO: 1047209 - RNA, 22 nt, Human
uucuuuuacauuaagauuucag

SEQ ID NO: 1047210 - RNA, 22 nt, Human
uuuaacuuaaucugcuugauga

SEQ ID NO: 1047211 - RNA, 22 nt, Human
gcugcccauugcucucccacuc

SEQ ID NO: 1047212 - RNA, 23 nt, Human
ccugcccaggaauccggcggcgu

SEQ ID NO: 1047213 - RNA, 22 nt, Human
ugggcccagguccugggagaag

SEQ ID NO: 1047214 - RNA, 22 nt, Human
gaauuucauuuguuuccuacca

SEQ ID NO: 1047215 - RNA, 22 nt, Human
cugcccaccacaccugcuccug

SEQ ID NO: 1047216 - RNA, 22 nt, Human
ggagacaauggaggccaaaaga

SEQ ID NO: 1047217 - RNA, 22 nt, Human
cuggcuuucuauuuggugcuau

SEQ ID NO: 1047218 - RNA, 22 nt, Human
cuacagaagaaacuaucacuau

SEQ ID NO: 1047219 - RNA, 22 nt, Human
uggcauuucuguuagacucuca

SEQ ID NO: 1047220 - RNA, 22 nt, Human
uaaguccuagcuuugguaggaa

SEQ ID NO: 1047221 - RNA, 22 nt, Human
cuggauuugccuauggugcuuu

SEQ ID NO: 1047222 - RNA, 22 nt, Human
accagggaccgccacacugcaa

SEQ ID NO: 1047223 - RNA, 22 nt, Human
uggcuuuagguugcauguuucu

SEQ ID NO: 1047224 - RNA, 22 nt, Human
uggcuuuauaaauccacugguu

SEQ ID NO: 1047225 - RNA, 22 nt, Human
cccagggagagcgcggaggcgg

SEQ ID NO: 1047226 - RNA, 22 nt, Human
ccagagagcuacaaggcauaaa

SEQ ID NO: 1047227 - RNA, 23 nt, Human
caggagggaaugaaguuagacaa

SEQ ID NO: 1047228 - RNA, 22 nt, Human
acuuugaaggggaacauuuuaa

SEQ ID NO: 1047229 - RNA, 22 nt, Human
caccuucagaaugcuccaggca

SEQ ID NO: 1047230 - RNA, 22 nt, Human
aaaucaguaaauguucauuaac

SEQ ID NO: 1047231 - RNA, 22 nt, Human
ugcaacuuguuuggagagaaag

SEQ ID NO: 1047232 - RNA, 22 nt, Human
acuuauuagcugugugaccuug

SEQ ID NO: 1047233 - RNA, 22 nt, Human
gcagggaaggggacggaaccag

SEQ ID NO: 1047234 - RNA, 22 nt, Human
agggaggauaguagucaguuua

SEQ ID NO: 1047235 - RNA, 22 nt, Human
agacaugguugagaauaaagug

SEQ ID NO: 1047236 - RNA, 22 nt, Human
gauggcuuugugcaccaugauu

SEQ ID NO: 1047237 - RNA, 22 nt, Human
cucuccagaucugcugagccag

SEQ ID NO: 1047238 - RNA, 22 nt, Human
cccagggacucgggauucuagg

SEQ ID NO: 1047239 - RNA, 22 nt, Human
cuccagguagcuaaguccuggg

SEQ ID NO: 1047240 - RNA, 22 nt, Human
uuuacagaugaggauacugagg

SEQ ID NO: 1047241 - RNA, 22 nt, Human
auauacaaagggcaaccucgcu

SEQ ID NO: 1047242 - RNA, 23 nt, Human
ccagcccuccaccagcucuaggc

SEQ ID NO: 1047243 - RNA, 22 nt, Human
ugguuuaauuuccauuuccuug

SEQ ID NO: 1047244 - RNA, 22 nt, Human
cagccucugacaccacagucgu

SEQ ID NO: 1047245 - RNA, 22 nt, Human
accagcuccaggccccugcuga

SEQ ID NO: 1047246 - RNA, 23 nt, Human
uggggagaguuacccuggaagcg

SEQ ID NO: 1047247 - RNA, 22 nt, Human
uccuccuccucacagucaccug

SEQ ID NO: 1047248 - RNA, 22 nt, Human
aguuacagugaccauuuauuua

SEQ ID NO: 1047249 - RNA, 22 nt, Human
agaucugaggguccaagggagg

SEQ ID NO: 1047250 - RNA, 22 nt, Human
gcugcccaggagagguggggcu

SEQ ID NO: 1047251 - RNA, 22 nt, Human
ucacauaaauuauacaauuuca

SEQ ID NO: 1047252 - RNA, 23 nt, Human
uccaagggcuacaaacacagacc

SEQ ID NO: 1047253 - RNA, 22 nt, Human
cccagggauuauaaaggugaaa

SEQ ID NO: 1047254 - RNA, 22 nt, Human
cagggaagagccgaugcugcag

SEQ ID NO: 1047255 - RNA, 22 nt, Human
gcccaggaaguugaggcugccg

SEQ ID NO: 1047256 - RNA, 22 nt, Human
uagcagaaacuguuacagaagg

SEQ ID NO: 1047257 - RNA, 22 nt, Human
uacaauacuuaaccuauuuugc

SEQ ID NO: 1047258 - RNA, 22 nt, Human
cugggcccaggcggcucucgga

SEQ ID NO: 1047259 - RNA, 22 nt, Human
acugcccagaagagaugaaagu

SEQ ID NO: 1047260 - RNA, 22 nt, Human
auagaauuugcacuaaaucugc

SEQ ID NO: 1047261 - RNA, 23 nt, Human
cauaaaauauuaguaugguagca

SEQ ID NO: 1047262 - RNA, 22 nt, Human
ugcaguggaggccgugagacag

SEQ ID NO: 1047263 - RNA, 21 nt, Human
gccagggaguuaaagagucuu

SEQ ID NO: 1047264 - RNA, 20 nt, Human
uuuaggcauuacucuuuugu

SEQ ID NO: 1047265 - RNA, 22 nt, Human
gcugcccugacuccagcagccu

SEQ ID NO: 1047266 - RNA, 22 nt, Human
agggcccuccccgcucagggca

SEQ ID NO: 1047267 - RNA, 22 nt, Human
agcccuggagcaaaggugucuu

SEQ ID NO: 1047268 - RNA, 22 nt, Human
ccagaauuuggaucaugauuuu

SEQ ID NO: 1047269 - RNA, 22 nt, Human
acaggauuagcaaguaaucagg

SEQ ID NO: 1047270 - RNA, 22 nt, Human
acaugucuuuuaaagucuaaua

SEQ ID NO: 1047271 - RNA, 22 nt, Human
ugcagucuccaccuccugggug

SEQ ID NO: 1047272 - RNA, 22 nt, Human
agggcugcuaccuuaaucaguu

SEQ ID NO: 1047273 - RNA, 22 nt, Human
gggaggagggugcuggcuaaac

SEQ ID NO: 1047274 - RNA, 22 nt, Human
aggaucugugagugcugcagac

SEQ ID NO: 1047275 - RNA, 22 nt, Human
gugaauaaaacaccugccaaga

SEQ ID NO: 1047276 - RNA, 22 nt, Human
gaaugaaaaccuuggcucaaau

SEQ ID NO: 1047277 - RNA, 22 nt, Human
cuagaaauguagauucuuagug

SEQ ID NO: 1047278 - RNA, 22 nt, Human
auaaaauuugcuacuguuaaau

SEQ ID NO: 1047279 - RNA, 22 nt, Human
uccagguagauuuauuccagcc

SEQ ID NO: 1047280 - RNA, 22 nt, Human
ugcauaauacguuuccuauaac

SEQ ID NO: 1047281 - RNA, 22 nt, Human
ccacguccagcuaauuuucgua

SEQ ID NO: 1047282 - RNA, 22 nt, Human
guagaaauuccauuuacuuuga

SEQ ID NO: 1047283 - RNA, 22 nt, Human
uaagacuucauuaguaauaugg

SEQ ID NO: 1047284 - RNA, 22 nt, Human
ucauagaaugaguuaaugaacu

SEQ ID NO: 1047285 - RNA, 22 nt, Human
ccguagcacaugcuccuggggc

SEQ ID NO: 1047286 - RNA, 22 nt, Human
ugggagagaauaaucaauaggu

SEQ ID NO: 1047287 - RNA, 22 nt, Human
caggcagcgcucguggccuggc

SEQ ID NO: 1047288 - RNA, 22 nt, Human
auuaggcagacaacguagccgg

SEQ ID NO: 1047289 - RNA, 22 nt, Human
gacauaauccuccucaccuacu

SEQ ID NO: 1047290 - RNA, 22 nt, Human
gcugccuccacuggcucccagu

SEQ ID NO: 1047291 - RNA, 22 nt, Human
ugggagagauaggcuucuggac

SEQ ID NO: 1047292 - RNA, 22 nt, Human
ggggaggagccauguaacuagu

SEQ ID NO: 1047293 - RNA, 21 nt, Human
ucuauucauuacaguuauuug

SEQ ID NO: 1047294 - RNA, 22 nt, Human
auaaagucuaccguauuaaaga

SEQ ID NO: 1047295 - RNA, 22 nt, Human
cagaagucacccucagaauaac

SEQ ID NO: 1047296 - RNA, 22 nt, Human
ucagccuccgaaagugcuggga

SEQ ID NO: 1047297 - RNA, 22 nt, Human
gaggagggcaguuccucuuuua

SEQ ID NO: 1047298 - RNA, 22 nt, Human
gcuggauccacaaauaacuuug

SEQ ID NO: 1047299 - RNA, 22 nt, Human
cccagggagcuuggagaacggg

SEQ ID NO: 1047300 - RNA, 22 nt, Human
aagauauagauaaaacuaugca

SEQ ID NO: 1047301 - RNA, 18 nt, Human
ucugcccaggacuuggac

SEQ ID NO: 1047302 - RNA, 22 nt, Human
ugucaccagcugcuccucagga

SEQ ID NO: 1047303 - RNA, 22 nt, Human
cccaggaaaagcagugccagca

SEQ ID NO: 1047304 - RNA, 22 nt, Human
ucagcacugaaauucuucacau

SEQ ID NO: 1047305 - RNA, 19 nt, Human
uaccagccuccugccugau

SEQ ID NO: 1047306 - RNA, 22 nt, Human
uuacagaaaagggguuguccuu

SEQ ID NO: 1047307 - RNA, 22 nt, Human
ggcccugucugucugcccagcu

SEQ ID NO: 1047308 - RNA, 22 nt, Human
uguacaaucugaugauguaugg

SEQ ID NO: 1047309 - RNA, 22 nt, Human
aaauagauugcugaggcauuac

SEQ ID NO: 1047310 - RNA, 22 nt, Human
aaaggugacugcagcagcuauu

SEQ ID NO: 1047311 - RNA, 22 nt, Human
uaucagaacacauguuuugcag

SEQ ID NO: 1047312 - RNA, 22 nt, Human
aaaguucaugguguuauagaaa

SEQ ID NO: 1047313 - RNA, 22 nt, Human
aaguuucaaauauaaaauuaca

SEQ ID NO: 1047314 - RNA, 22 nt, Human
acagaauuuaaagcucuagacu

SEQ ID NO: 1047315 - RNA, 22 nt, Human
cucuucccagcuccacgagagg

SEQ ID NO: 1047316 - RNA, 22 nt, Human
acuagaaauuacucagaauaaa

SEQ ID NO: 1047317 - RNA, 22 nt, Human
ggcccagcugggcggggacacg

SEQ ID NO: 1047318 - RNA, 22 nt, Human
uauuuaucgagugucuacuaug

SEQ ID NO: 1047319 - RNA, 22 nt, Human
ggggagaguccuuuccaguucc

SEQ ID NO: 1047320 - RNA, 23 nt, Human
gggagccauggguggucauggag

SEQ ID NO: 1047321 - RNA, 22 nt, Human
accagcucagaagccagaaaga

SEQ ID NO: 1047322 - RNA, 22 nt, Human
aaaagcaguuaucugggaggaa

SEQ ID NO: 1047323 - RNA, 22 nt, Human
cuggauuuaggacuaguccaag

SEQ ID NO: 1047324 - RNA, 22 nt, Human
auaacaugagccagauugaaag

SEQ ID NO: 1047325 - RNA, 22 nt, Human
ugaggcaggacugagcgggaug

SEQ ID NO: 1047326 - RNA, 22 nt, Human
uuugaagacagaucaauauaag

SEQ ID NO: 1047327 - RNA, 22 nt, Human
gcagccucaaacuccccagcuc

SEQ ID NO: 1047328 - RNA, 22 nt, Human
gcaacuuuagggccagcaagua

SEQ ID NO: 1047329 - RNA, 22 nt, Human
uuuaggcaagggcaagauuauc

SEQ ID NO: 1047330 - RNA, 22 nt, Human
gcaggucuaucaggcugcaggu

SEQ ID NO: 1047331 - RNA, 22 nt, Human
ucagaaaauaacuguuaguuug

SEQ ID NO: 1047332 - RNA, 23 nt, Human
guaaaauacgcagugcaguguga

SEQ ID NO: 1047333 - RNA, 22 nt, Human
gaaguccuccuaucuugcucuu

SEQ ID NO: 1047334 - RNA, 22 nt, Human
ccuauacagccucagcugagau

SEQ ID NO: 1047335 - RNA, 22 nt, Human
ccaaacaaauccccauucuuag

SEQ ID NO: 1047336 - RNA, 22 nt, Human
cuaagacaugcccugcaugaua

SEQ ID NO: 1047337 - RNA, 22 nt, Human
gguggagagcuggaugagaggu

SEQ ID NO: 1047338 - RNA, 22 nt, Human
caguccuugcucaaagucuaca

SEQ ID NO: 1047339 - RNA, 23 nt, Human
agccucuuuucuccugcccugca

SEQ ID NO: 1047340 - RNA, 21 nt, Human
cauuuacaugacagauugguu

SEQ ID NO: 1047341 - RNA, 22 nt, Human
uuuaggcagcuacauacuaacu

SEQ ID NO: 1047342 - RNA, 23 nt, Human
aguacaauaaguauaauucuuuc

SEQ ID NO: 1047343 - RNA, 22 nt, Human
aaaagcagagacucuggagcua

SEQ ID NO: 1047344 - RNA, 22 nt, Human
cccagggaaggcagauggagga

SEQ ID NO: 1047345 - RNA, 22 nt, Human
caaagccauagaguagauaaga

SEQ ID NO: 1047346 - RNA, 22 nt, Human
cuuaggcagggcuggaagaucu

SEQ ID NO: 1047347 - RNA, 22 nt, Human
ccagcccugauuagagaauguc

SEQ ID NO: 1047348 - RNA, 22 nt, Human
aucuaaacagguguucuuuaga

SEQ ID NO: 1047349 - RNA, 20 nt, Human
acaauacagguugugucuga

SEQ ID NO: 1047350 - RNA, 22 nt, Human
ccagcccuguuuaugugucacu

SEQ ID NO: 1047351 - RNA, 22 nt, Human
aaucagaaauucuacaucacaa

SEQ ID NO: 1047352 - RNA, 22 nt, Human
gcugcucugggucugcccagcu

SEQ ID NO: 1047353 - RNA, 21 nt, Human
caaucaguuggcauuugagca

SEQ ID NO: 1047354 - RNA, 22 nt, Human
aaaguccugacugcaggggaug

SEQ ID NO: 1047355 - RNA, 22 nt, Human
gaucagaauuuacuuauaauug

SEQ ID NO: 1047356 - RNA, 22 nt, Human
agccaacuaggagauuaaggua

SEQ ID NO: 1047357 - RNA, 22 nt, Human
uaaaaccauuccugcuuucaug

SEQ ID NO: 1047358 - RNA, 22 nt, Human
cagcacagggacaauagcagau

SEQ ID NO: 1047359 - RNA, 22 nt, Human
ucagggaguguuggcaggauca

SEQ ID NO: 1047360 - RNA, 22 nt, Human
aaaguccuguuugaaggaccug

SEQ ID NO: 1047361 - RNA, 22 nt, Human
uaaagcaguguugggucggacg

SEQ ID NO: 1047362 - RNA, 22 nt, Human
guggggaggccuaagcaaguug

SEQ ID NO: 1047363 - RNA, 23 nt, Human
aauaucaaggugauguucccaga

SEQ ID NO: 1047364 - RNA, 22 nt, Human
cugcccuguaucuucucccaau

SEQ ID NO: 1047365 - RNA, 22 nt, Human
gcccaggaguuggaggcugcag

SEQ ID NO: 1047366 - RNA, 22 nt, Human
ccagggaaucucugaguguguu

SEQ ID NO: 1047367 - RNA, 22 nt, Human
aagaaaagaaaccugaggcuuu

SEQ ID NO: 1047368 - RNA, 22 nt, Human
cggagaggaccugcaacucgcu

SEQ ID NO: 1047369 - RNA, 22 nt, Human
aauucuaaauguaauuuagaau

SEQ ID NO: 1047370 - RNA, 19 nt, Human
aacuguaauuaauacccua

SEQ ID NO: 1047371 - RNA, 22 nt, Human
accagcucagagcaggcuccug

SEQ ID NO: 1047372 - RNA, 22 nt, Human
ucugcccagccagacccaaggu

SEQ ID NO: 1047373 - RNA, 22 nt, Human
agaaaagaggcuuucuaagcau

SEQ ID NO: 1047374 - RNA, 22 nt, Human
uggcuauugagugaucucuaga

SEQ ID NO: 1047375 - RNA, 22 nt, Human
gggagagguuacccgagcaacu

SEQ ID NO: 1047376 - RNA, 22 nt, Human
gcccaggaaagauagggccuca

SEQ ID NO: 1047377 - RNA, 22 nt, Human
cagggacauugguggccagguu

SEQ ID NO: 1047378 - RNA, 22 nt, Human
uaguccuuacuuacuagaauaa

SEQ ID NO: 1047379 - RNA, 22 nt, Human
aagagagggauuugguuuauug

SEQ ID NO: 1047380 - RNA, 20 nt, Human
uccaagggcagcagaaucag

SEQ ID NO: 1047381 - RNA, 22 nt, Human
aggagggagcuuaagccaggca

SEQ ID NO: 1047382 - RNA, 22 nt, Human
augcuuaacuuccuagucuaua

SEQ ID NO: 1047383 - RNA, 22 nt, Human
agauaaaaugguucaaaggcua

SEQ ID NO: 1047384 - RNA, 19 nt, Human
ggagaggcuggagggaugc

SEQ ID NO: 1047385 - RNA, 22 nt, Human
augcaaaauaaggcagaaacau

SEQ ID NO: 1047386 - RNA, 22 nt, Human
agauuuacugagaacugauuac

SEQ ID NO: 1047387 - RNA, 22 nt, Human
uuacuacugcuuuacuacuggg

SEQ ID NO: 1047388 - RNA, 22 nt, Human
gaguccuucuggcuggcaggau

SEQ ID NO: 1047389 - RNA, 18 nt, Human
caggcccugucuggccuc

SEQ ID NO: 1047390 - RNA, 22 nt, Human
uuuacagaaugucaauuucuau

SEQ ID NO: 1047391 - RNA, 22 nt, Human
cuuaauuacccaaugugguagg

SEQ ID NO: 1047392 - RNA, 22 nt, Human
cuaauuauguuguuauaaucaa

SEQ ID NO: 1047393 - RNA, 22 nt, Human
uucuauacaaagauuucucaca

SEQ ID NO: 1047394 - RNA, 21 nt, Human
uuuuauugaugaauggccacu

SEQ ID NO: 1047395 - RNA, 22 nt, Human
ggggcagauggaacagagcaca

SEQ ID NO: 1047396 - RNA, 23 nt, Human
uacuuaggguuuagaucugacug

SEQ ID NO: 1047397 - RNA, 20 nt, Human
uacuggauuagggcucaccc

SEQ ID NO: 1047398 - RNA, 22 nt, Human
auuaggcauucaugcagcuccu

SEQ ID NO: 1047399 - RNA, 22 nt, Human
ucagggaacaauguuauggcuu

SEQ ID NO: 1047400 - RNA, 22 nt, Human
ggggaggaagcuggaacacggg

SEQ ID NO: 1047401 - RNA, 22 nt, Human
caaagcagagccagagcuuguc

SEQ ID NO: 1047402 - RNA, 22 nt, Human
aauaaaauggucaguuuucuca

SEQ ID NO: 1047403 - RNA, 22 nt, Human
ggagauggcuggcagguagaug

SEQ ID NO: 1047404 - RNA, 22 nt, Human
gaaaauagcagauagaccaaug

SEQ ID NO: 1047405 - RNA, 22 nt, Human
auacagaacaagccucaccucc

SEQ ID NO: 1047406 - RNA, 22 nt, Human
cuggaucaugcauugcuugucc

SEQ ID NO: 1047407 - RNA, 22 nt, Human
ccagcuauugcuguguaacagu

SEQ ID NO: 1047408 - RNA, 23 nt, Human
ggagacaagguaccacguuaaca

SEQ ID NO: 1047409 - RNA, 22 nt, Human
uggauuuaguucuucacaggcc

SEQ ID NO: 1047410 - RNA, 22 nt, Human
cagggagaagucuggucagucc

SEQ ID NO: 1047411 - RNA, 22 nt, Human
ggagaggggaacuuguugcuug

SEQ ID NO: 1047412 - RNA, 22 nt, Human
gaggagggagaauuaggcuuaa

SEQ ID NO: 1047413 - RNA, 23 nt, Human
ggggaaguggcagugagugaggc

SEQ ID NO: 1047414 - RNA, 22 nt, Human
agaaaugcucaggucaacuuaa

SEQ ID NO: 1047415 - RNA, 17 nt, Human
gcagccucuugguagug

SEQ ID NO: 1047416 - RNA, 22 nt, Human
aaaguccuuuuugccaugcaag

SEQ ID NO: 1047417 - RNA, 22 nt, Human
ugaauaauuaugggaguccuaa

SEQ ID NO: 1047418 - RNA, 22 nt, Human
agagauucauguuuacuguagg

SEQ ID NO: 1047419 - RNA, 22 nt, Human
uccugcagccacugcaggcaga

SEQ ID NO: 1047420 - RNA, 22 nt, Human
cucuaacacuguaaugcuuucu

SEQ ID NO: 1047421 - RNA, 22 nt, Human
uuuucauuuuuguagaugcaag

SEQ ID NO: 1047422 - RNA, 22 nt, Human
cuugacauuaguuaugcagaua

SEQ ID NO: 1047423 - RNA, 22 nt, Human
aaguccauucuuccagccagcu

SEQ ID NO: 1047424 - RNA, 22 nt, Human
caauuucacuaauaauauuuac

SEQ ID NO: 1047425 - RNA, 22 nt, Human
cauuucaagcauugacuucuau

SEQ ID NO: 1047426 - RNA, 22 nt, Human
ucaauaaaucccucugacccug

SEQ ID NO: 1047427 - RNA, 22 nt, Human
aggauuuagauuuggaggaacu

SEQ ID NO: 1047428 - RNA, 22 nt, Human
uuacagaagugaaggccuuuaa

SEQ ID NO: 1047429 - RNA, 22 nt, Human
ugaggcagugcugggaagccug

SEQ ID NO: 1047430 - RNA, 21 nt, Human
aaagaaucauggguaauuuca

SEQ ID NO: 1047431 - RNA, 22 nt, Human
uacuauaccauguaagauauga

SEQ ID NO: 1047432 - RNA, 22 nt, Human
ugggagagaauucuggugacug

SEQ ID NO: 1047433 - RNA, 22 nt, Human
ucccagggucaguggugaggcc

SEQ ID NO: 1047434 - RNA, 22 nt, Human
ucuggaucggguuccucagguc

SEQ ID NO: 1047435 - RNA, 22 nt, Human
ccagagagaaaauggagggcca

SEQ ID NO: 1047436 - RNA, 22 nt, Human
gaguccuugacacauaguaggu

SEQ ID NO: 1047437 - RNA, 17 nt, Human
agaugcuggccacaugu

SEQ ID NO: 1047438 - RNA, 23 nt, Human
ucagccucuuaggacuucucacc

SEQ ID NO: 1047439 - RNA, 22 nt, Human
gcugcccacagcggguguuucg

SEQ ID NO: 1047440 - RNA, 22 nt, Human
ucuccaggcuuaaucucagcuu

SEQ ID NO: 1047441 - RNA, 22 nt, Human
cagggagaggcugguggaguaa

SEQ ID NO: 1047442 - RNA, 22 nt, Human
auggcuuaagaaugcuuuugug

SEQ ID NO: 1047443 - RNA, 22 nt, Human
ugggcccaucauugcugugggc

SEQ ID NO: 1047444 - RNA, 22 nt, Human
ccugcccaggcccuaaguuagg

SEQ ID NO: 1047445 - RNA, 22 nt, Human
gauuucaaagguucugcaugcc

SEQ ID NO: 1047446 - RNA, 22 nt, Human
augcaccugaacuccaucagcu

SEQ ID NO: 1047447 - RNA, 22 nt, Human
uuuuauguuccucuuuaugcga

SEQ ID NO: 1047448 - RNA, 22 nt, Human
ugcccuggcucuccacuaguuu

SEQ ID NO: 1047449 - RNA, 22 nt, Human
agguguggcuggggcagaggcc

SEQ ID NO: 1047450 - RNA, 22 nt, Human
agggcccagcccuugcuggucu

SEQ ID NO: 1047451 - RNA, 22 nt, Human
gcugcccucccagggcaagcuu

SEQ ID NO: 1047452 - RNA, 22 nt, Human
ucagggaaacagguuuucccuu

SEQ ID NO: 1047453 - RNA, 22 nt, Human
uccagccuccuauuuacccuaa

SEQ ID NO: 1047454 - RNA, 22 nt, Human
agacaacaucacuaaagcugag

SEQ ID NO: 1047455 - RNA, 22 nt, Human
uccagggaugguaaugagcagu

SEQ ID NO: 1047456 - RNA, 22 nt, Human
caagauuugccaguggccaacu

SEQ ID NO: 1047457 - RNA, 22 nt, Human
uuauacuuuauacuacaucauu

SEQ ID NO: 1047458 - RNA, 22 nt, Human
ggggcugcugguauuuccaguu

SEQ ID NO: 1047459 - RNA, 22 nt, Human
caugguuuauuagagcuuauuu

SEQ ID NO: 1047460 - RNA, 22 nt, Human
uucagaaagguuaaucuggauu

SEQ ID NO: 1047461 - RNA, 22 nt, Human
cagagacauucaguaaauuauc

SEQ ID NO: 1047462 - RNA, 17 nt, Human
uuuucuccugcccauuc

SEQ ID NO: 1047463 - RNA, 22 nt, Human
gggcccagcacuggcugggauc

SEQ ID NO: 1047464 - RNA, 22 nt, Human
uugguacaaugugcuagguagg

SEQ ID NO: 1047465 - RNA, 22 nt, Human
aaguccuuucucauggaggaau

SEQ ID NO: 1047466 - RNA, 22 nt, Human
cauuuacagcagacugaugaaa

SEQ ID NO: 1047467 - RNA, 22 nt, Human
cagcucugaggaacacuccuuu

SEQ ID NO: 1047468 - RNA, 22 nt, Human
cuggcaguauuaagagaaguga

SEQ ID NO: 1047469 - RNA, 22 nt, Human
auugauggcggccucuccauau

SEQ ID NO: 1047470 - RNA, 22 nt, Human
cccagggaggcccaggcucugc

SEQ ID NO: 1047471 - RNA, 22 nt, Human
cacagggaguuacagaagcacu

SEQ ID NO: 1047472 - RNA, 22 nt, Human
ugaaauagaaaaacaggcuucu

SEQ ID NO: 1047473 - RNA, 22 nt, Human
uugcacauguugguucuugaaa

SEQ ID NO: 1047474 - RNA, 22 nt, Human
aaguucuaauuuugcauucagg

SEQ ID NO: 1047475 - RNA, 22 nt, Human
gaagaauccaugcuaauuuacc

SEQ ID NO: 1047476 - RNA, 20 nt, Human
uccagggcaacuagagugug

SEQ ID NO: 1047477 - RNA, 20 nt, Human
auucuacaagaauaagcaug

SEQ ID NO: 1047478 - RNA, 22 nt, Human
ucuuuaaugugauuguaauuau

SEQ ID NO: 1047479 - RNA, 22 nt, Human
uauauacuuucuuccuggguag

SEQ ID NO: 1047480 - RNA, 22 nt, Human
uagauauaucugucauacuggu

SEQ ID NO: 1047481 - RNA, 22 nt, Human
caaugucaugauuuuccauuag

SEQ ID NO: 1047482 - RNA, 22 nt, Human
ugcaguggaagagguggagauc

SEQ ID NO: 1047483 - RNA, 22 nt, Human
ggacagagcagacgagcagcgg

SEQ ID NO: 1047484 - RNA, 22 nt, Human
agcccuggaccuuagcccccac

SEQ ID NO: 1047485 - RNA, 22 nt, Human
gcagggaaacaggugcuaagga

SEQ ID NO: 1047486 - RNA, 22 nt, Human
augccaaauucucagccucuuu

SEQ ID NO: 1047487 - RNA, 22 nt, Human
auuuaguguauucuaauaugug

SEQ ID NO: 1047488 - RNA, 22 nt, Human
gccagccugugggggcucugug

SEQ ID NO: 1047489 - RNA, 22 nt, Human
aucagaaaauacccaguguuua

SEQ ID NO: 1047490 - RNA, 22 nt, Human
ugcugcccguaccugugcacuu

SEQ ID NO: 1047491 - RNA, 22 nt, Human
gaggcugcuguuagcccugggc

SEQ ID NO: 1047492 - RNA, 22 nt, Human
cugaauaauguucucuuguaug

SEQ ID NO: 1047493 - RNA, 22 nt, Human
aaucagaauuuguccccugagu

SEQ ID NO: 1047494 - RNA, 23 nt, Human
uguaggucugccuuaucugcugc

SEQ ID NO: 1047495 - RNA, 22 nt, Human
cucuccagggguagaugccuuc

SEQ ID NO: 1047496 - RNA, 22 nt, Human
cagucaccuugaggacucagac

SEQ ID NO: 1047497 - RNA, 19 nt, Human
uuucagacucaucuccagc

SEQ ID NO: 1047498 - RNA, 17 nt, Human
aagacaagacaaaugca

SEQ ID NO: 1047499 - RNA, 22 nt, Human
gggagacaagaaguagccugcu

SEQ ID NO: 1047500 - RNA, 22 nt, Human
aggaagugggaagggucugcca

SEQ ID NO: 1047501 - RNA, 22 nt, Human
cugcccggagcuggcaaaggcu

SEQ ID NO: 1047502 - RNA, 22 nt, Human
agagucugccuuuuucuccugc

SEQ ID NO: 1047503 - RNA, 22 nt, Human
cuagaaauauuuuacagucaag

SEQ ID NO: 1047504 - RNA, 22 nt, Human
gcuucacacuaaaaauguuaaa

SEQ ID NO: 1047505 - RNA, 22 nt, Human
cucuccagguuagagcacuuau

SEQ ID NO: 1047506 - RNA, 22 nt, Human
ccagggaagucacauugucuag

SEQ ID NO: 1047507 - RNA, 22 nt, Human
uuccauaauaaccugagagaaa

SEQ ID NO: 1047508 - RNA, 20 nt, Human
ggucagccuggggcuccagg

SEQ ID NO: 1047509 - RNA, 22 nt, Human
caacuuugugugaccuagauag

SEQ ID NO: 1047510 - RNA, 20 nt, Human
ucuuauacagaaaacauuuu

SEQ ID NO: 1047511 - RNA, 22 nt, Human
cagaaauaaacuucucacaucg

SEQ ID NO: 1047512 - RNA, 22 nt, Human
aauuaauggaaaguaaggaagg

SEQ ID NO: 1047513 - RNA, 22 nt, Human
cuuuacagaauaagaauacugg

SEQ ID NO: 1047514 - RNA, 22 nt, Human
acagggaaggcauccgcgaaug

SEQ ID NO: 1047515 - RNA, 22 nt, Human
gcagccuccgcacugcgagucc

SEQ ID NO: 1047516 - RNA, 22 nt, Human
augguuuuagaaucaggaaaaa

SEQ ID NO: 1047517 - RNA, 22 nt, Human
agaagugagugugacucagcag

SEQ ID NO: 1047518 - RNA, 22 nt, Human
caguccuuaaggaaacauuugu

SEQ ID NO: 1047519 - RNA, 18 nt, Human
aagaggaggagcagguug

SEQ ID NO: 1047520 - RNA, 22 nt, Human
aaucagaaaggcuaaggaagca

SEQ ID NO: 1047521 - RNA, 22 nt, Human
ugggacaguuguccuccacucu

SEQ ID NO: 1047522 - RNA, 22 nt, Human
caucagaaccagcugggugagg

SEQ ID NO: 1047523 - RNA, 22 nt, Human
ggaggugaggccguagggugug

SEQ ID NO: 1047524 - RNA, 22 nt, Human
guuuacauguacucauuauacu

SEQ ID NO: 1047525 - RNA, 17 nt, Human
aaucagauuucugagga

SEQ ID NO: 1047526 - RNA, 22 nt, Human
cauggcuuuguucauauaauuu

SEQ ID NO: 1047527 - RNA, 22 nt, Human
ugcuuaauguacgugaguguac

SEQ ID NO: 1047528 - RNA, 22 nt, Human
caaguccuaggucugauugaac

SEQ ID NO: 1047529 - RNA, 22 nt, Human
ggcugccccagugcucauggcu

SEQ ID NO: 1047530 - RNA, 22 nt, Human
auuccaaagccugaauaaugga

SEQ ID NO: 1047531 - RNA, 22 nt, Human
guuaggcagugugguauagcag

SEQ ID NO: 1047532 - RNA, 22 nt, Human
gauaaaauauguggccuuuagu

SEQ ID NO: 1047533 - RNA, 22 nt, Human
agcauaaaggcacuagaaagag

SEQ ID NO: 1047534 - RNA, 22 nt, Human
aggauuuauuccagaaaugcaa

SEQ ID NO: 1047535 - RNA, 22 nt, Human
uaguccuugguaaaauucuaug

SEQ ID NO: 1047536 - RNA, 22 nt, Human
uuuaggcaauagauggcagugu

SEQ ID NO: 1047537 - RNA, 22 nt, Human
uuuaggcaaauuucagaugugc

SEQ ID NO: 1047538 - RNA, 21 nt, Human
aggcagcaggauccagggaca

SEQ ID NO: 1047539 - RNA, 22 nt, Human
ccagaucuaaguccaaaguacu

SEQ ID NO: 1047540 - RNA, 22 nt, Human
ucucacuuuguugcccagacuu

SEQ ID NO: 1047541 - RNA, 22 nt, Human
acuucacagaaauuuuaugagg

SEQ ID NO: 1047542 - RNA, 22 nt, Human
guagaaaugguguguuucuucu

SEQ ID NO: 1047543 - RNA, 22 nt, Human
aaauuucaguuggaaugagcuc

SEQ ID NO: 1047544 - RNA, 22 nt, Human
uaaacauggcuguuucaguuau

SEQ ID NO: 1047545 - RNA, 23 nt, Human
ggccauuucauuugguucaaacu

SEQ ID NO: 1047546 - RNA, 22 nt, Human
acaggcagagaguggcggacuc

SEQ ID NO: 1047547 - RNA, 22 nt, Human
ucugauaacucuggccccaggc

SEQ ID NO: 1047548 - RNA, 22 nt, Human
gggagggaucugcuaggcaaug

SEQ ID NO: 1047549 - RNA, 22 nt, Human
ugcacauuuguuauuuugaggu

SEQ ID NO: 1047550 - RNA, 22 nt, Human
guuaggcaauaccucuuacacc

SEQ ID NO: 1047551 - RNA, 22 nt, Human
uuuauuaugauggacaccuucg

SEQ ID NO: 1047552 - RNA, 22 nt, Human
uaguccuuuccggcugcuauaa

SEQ ID NO: 1047553 - RNA, 22 nt, Human
auuccaaagguuaaugcccauu

SEQ ID NO: 1047554 - RNA, 22 nt, Human
caauuucauggauaaaagaugu

SEQ ID NO: 1047555 - RNA, 22 nt, Human
aauacugagaucccacaaagca

SEQ ID NO: 1047556 - RNA, 22 nt, Human
uuucaacuugaagaauugauac

SEQ ID NO: 1047557 - RNA, 22 nt, Human
ccagggcuucccacgugcccug

SEQ ID NO: 1047558 - RNA, 22 nt, Human
cuuauacacccucuucccaggc

SEQ ID NO: 1047559 - RNA, 22 nt, Human
uuccucuagcuucucacuaaca

SEQ ID NO: 1047560 - RNA, 22 nt, Human
aagccaaugagagaggccucag

SEQ ID NO: 1047561 - RNA, 22 nt, Human
gugaauaagaccuaaggaugaa

SEQ ID NO: 1047562 - RNA, 22 nt, Human
cacacuuugugcuaaucuauuu

SEQ ID NO: 1047563 - RNA, 22 nt, Human
uuccacaauguaugaauaagau

SEQ ID NO: 1047564 - RNA, 22 nt, Human
cuuccaaaauuuauauguugaa

SEQ ID NO: 1047565 - RNA, 22 nt, Human
aaaucucacuguagucaaagug

SEQ ID NO: 1047566 - RNA, 22 nt, Human
aggagacauggaauagugaggc

SEQ ID NO: 1047567 - RNA, 22 nt, Human
aaagaaggaugggagaaauccu

SEQ ID NO: 1047568 - RNA, 22 nt, Human
ugaaugaaugaauuaauagagu

SEQ ID NO: 1047569 - RNA, 22 nt, Human
auggcuuaugaauaacaguagg

SEQ ID NO: 1047570 - RNA, 22 nt, Human
agcuugggcaacacagcaagac

SEQ ID NO: 1047571 - RNA, 22 nt, Human
cuuagaaauaaugguuucaguu

SEQ ID NO: 1047572 - RNA, 19 nt, Human
uccuucagucagaucuggg

SEQ ID NO: 1047573 - RNA, 22 nt, Human
ggcagcccuguggagaggccca

SEQ ID NO: 1047574 - RNA, 22 nt, Human
gagcccugcggagccccgaggc

SEQ ID NO: 1047575 - RNA, 22 nt, Human
cguauacaugaagacauugcug

SEQ ID NO: 1047576 - RNA, 22 nt, Human
agcccugggaggccagcuugua

SEQ ID NO: 1047577 - RNA, 22 nt, Human
acaggggauugauuggaagucu

SEQ ID NO: 1047578 - RNA, 22 nt, Human
cagaauaaagguacaauugagu

SEQ ID NO: 1047579 - RNA, 22 nt, Human
uacuagaaccucacaacaaucc

SEQ ID NO: 1047580 - RNA, 22 nt, Human
cagccuguggcagaggucuaau

SEQ ID NO: 1047581 - RNA, 22 nt, Human
gcuccagcuccggcuccgaagc

SEQ ID NO: 1047582 - RNA, 22 nt, Human
uggcccaggcgaggugggcaga

SEQ ID NO: 1047583 - RNA, 18 nt, Human
gcacuucacccagcuagu

SEQ ID NO: 1047584 - RNA, 22 nt, Human
uuuauacauggagaauuuuugc

SEQ ID NO: 1047585 - RNA, 21 nt, Human
ucccaagcugcuggcucagcu

SEQ ID NO: 1047586 - RNA, 22 nt, Human
uaaaaguauacuuucaaaggag

SEQ ID NO: 1047587 - RNA, 20 nt, Human
uauggcuuggcaaagcuuca

SEQ ID NO: 1047588 - RNA, 22 nt, Human
guuucacagaugguguucauau

SEQ ID NO: 1047589 - RNA, 22 nt, Human
auagucacugccuuccauuugu

SEQ ID NO: 1047590 - RNA, 22 nt, Human
ucaaaauuuuauuucucaagga

SEQ ID NO: 1047591 - RNA, 22 nt, Human
ugugggccaggaggccucagug

SEQ ID NO: 1047592 - RNA, 19 nt, Human
agcaaauacaucaaaauug

SEQ ID NO: 1047593 - RNA, 19 nt, Human
cagaaauagcgaaguguaa

SEQ ID NO: 1047594 - RNA, 22 nt, Human
auguaaaucaagcagugcuggu

SEQ ID NO: 1047595 - RNA, 22 nt, Human
uuuccaaaggaguaccacgcau

SEQ ID NO: 1047596 - RNA, 22 nt, Human
caguggggaggccaggauagaa

SEQ ID NO: 1047597 - RNA, 22 nt, Human
aggauuuauuacaagccauggu

SEQ ID NO: 1047598 - RNA, 22 nt, Human
aagaaaucugauauuuguuuca

SEQ ID NO: 1047599 - RNA, 22 nt, Human
gcuccaggugaauccucucacc

SEQ ID NO: 1047600 - RNA, 22 nt, Human
agcagagaccauauagcccaga

SEQ ID NO: 1047601 - RNA, 22 nt, Human
guagaaauauuuaucucugaga

SEQ ID NO: 1047602 - RNA, 22 nt, Human
caccagacagguguaugcauau

SEQ ID NO: 1047603 - RNA, 22 nt, Human
ggaucugagagcaagcaggacc

SEQ ID NO: 1047604 - RNA, 22 nt, Human
ucagaaauagucuuuaaaauga

SEQ ID NO: 1047605 - RNA, 22 nt, Human
ccagcuccucuugucucuagca

SEQ ID NO: 1047606 - RNA, 20 nt, Human
agaggaggauuauuuuauuc

SEQ ID NO: 1047607 - RNA, 22 nt, Human
uuccagggaagagcaaggcagu

SEQ ID NO: 1047608 - RNA, 22 nt, Human
aaugaaaauuggacccuagaac

SEQ ID NO: 1047609 - RNA, 22 nt, Human
caauauauaaugaguacuuucc

SEQ ID NO: 1047610 - RNA, 22 nt, Human
ggauuuccucuugacucuaaag

SEQ ID NO: 1047611 - RNA, 22 nt, Human
ggcaauuucaugugguuuaaac

SEQ ID NO: 1047612 - RNA, 22 nt, Human
ccuggaucagagccagagaagc

SEQ ID NO: 1047613 - RNA, 22 nt, Human
uccagggagauggcagaggcug

SEQ ID NO: 1047614 - RNA, 22 nt, Human
auucaagagcccauguuuccug

SEQ ID NO: 1047615 - RNA, 22 nt, Human
caguaaauacauaucagagaag

SEQ ID NO: 1047616 - RNA, 22 nt, Human
aguccuuagaacacuguaucug

SEQ ID NO: 1047617 - RNA, 22 nt, Human
gcuccaggaggaugaccuuccu

SEQ ID NO: 1047618 - RNA, 22 nt, Human
gaaagccaucuggcugcuggga

SEQ ID NO: 1047619 - RNA, 22 nt, Human
cccagccugugacagccguccu

SEQ ID NO: 1047620 - RNA, 22 nt, Human
uggcauuuggcuuacuuauguu

SEQ ID NO: 1047621 - RNA, 22 nt, Human
guggauggacaugggcaagagg

SEQ ID NO: 1047622 - RNA, 22 nt, Human
gagcugccugaacaagcagcag

SEQ ID NO: 1047623 - RNA, 22 nt, Human
agaucuauuagcaaacugccau

SEQ ID NO: 1047624 - RNA, 22 nt, Human
aggaggaggugggacacaguga

SEQ ID NO: 1047625 - RNA, 22 nt, Human
cucccuccaaauaagacucggg

SEQ ID NO: 1047626 - RNA, 22 nt, Human
ccuggaucgaugccgagggaaa

SEQ ID NO: 1047627 - RNA, 22 nt, Human
aaauauagcaauuaugccuacu

SEQ ID NO: 1047628 - RNA, 22 nt, Human
guaaugaaugaaagaaacuggg

SEQ ID NO: 1047629 - RNA, 22 nt, Human
aaucagaaagaggucauguugc

SEQ ID NO: 1047630 - RNA, 22 nt, Human
gaauuucacaaggugaggauaa

SEQ ID NO: 1047631 - RNA, 22 nt, Human
cagugggaaugaaguggaggcc

SEQ ID NO: 1047632 - RNA, 22 nt, Human
uaaagccaacacuuuacugcuc

SEQ ID NO: 1047633 - RNA, 22 nt, Human
gcagggaugcugaggcucagug

SEQ ID NO: 1047634 - RNA, 17 nt, Human
aggagggaaauagcuug

SEQ ID NO: 1047635 - RNA, 22 nt, Human
auaugcuugggacugauacagu

SEQ ID NO: 1047636 - RNA, 22 nt, Human
ucauagaagcaccagaagauau

SEQ ID NO: 1047637 - RNA, 22 nt, Human
acagggaacaggaauauacaaa

SEQ ID NO: 1047638 - RNA, 22 nt, Human
cuaaagaagcuagcaaucuaua

SEQ ID NO: 1047639 - RNA, 22 nt, Human
aauaauuuuagcucagaguugu

SEQ ID NO: 1047640 - RNA, 22 nt, Human
ggaugagguagaugaacaaggg

SEQ ID NO: 1047641 - RNA, 22 nt, Human
uguuuaauaauucuaugauagu

SEQ ID NO: 1047642 - RNA, 22 nt, Human
uuuuccaaaguaccaugucccu

SEQ ID NO: 1047643 - RNA, 22 nt, Human
aacauaauguggccaaagucac

SEQ ID NO: 1047644 - RNA, 22 nt, Human
auggaucacagugccgugggug

SEQ ID NO: 1047645 - RNA, 22 nt, Human
agggcccaccuuggugcugagg

SEQ ID NO: 1047646 - RNA, 22 nt, Human
aagggcugcuguagaagcagag

SEQ ID NO: 1047647 - RNA, 22 nt, Human
agaguggguuauaggcagacuu

SEQ ID NO: 1047648 - RNA, 22 nt, Human
gggaggacgguccagggcaaag

SEQ ID NO: 1047649 - RNA, 22 nt, Human
cagccucuugcacuuugaaggc

SEQ ID NO: 1047650 - RNA, 22 nt, Human
gggcugccaagccugccugccu

SEQ ID NO: 1047651 - RNA, 22 nt, Human
uggagagguugaauaacuuguc

SEQ ID NO: 1047652 - RNA, 22 nt, Human
aaagaaucguguguaguuugaa

SEQ ID NO: 1047653 - RNA, 22 nt, Human
caccagcuacuccagggccgug

SEQ ID NO: 1047654 - RNA, 22 nt, Human
ugaggaggucagagucuggcug

SEQ ID NO: 1047655 - RNA, 23 nt, Human
augaaugaauaaggcaggaaagc

SEQ ID NO: 1047656 - RNA, 22 nt, Human
uuucaacuagccccuaaguccu

SEQ ID NO: 1047657 - RNA, 22 nt, Human
uguuccaagcugcuggauaagc

SEQ ID NO: 1047658 - RNA, 22 nt, Human
agggcugcccagugugagagcu

SEQ ID NO: 1047659 - RNA, 22 nt, Human
ccagccuccauguagauagcug

SEQ ID NO: 1047660 - RNA, 22 nt, Human
uaauuucacaguucaacgcaca

SEQ ID NO: 1047661 - RNA, 22 nt, Human
agagagggcauagaaaaaggga

SEQ ID NO: 1047662 - RNA, 22 nt, Human
gauaaaauaacuauggaauacu

SEQ ID NO: 1047663 - RNA, 22 nt, Human
cuauacaguaaccacagugauu

SEQ ID NO: 1047664 - RNA, 22 nt, Human
aaauuucaguuaccuuuacguu

SEQ ID NO: 1047665 - RNA, 22 nt, Human
acaacaaagacacuugaaauga

SEQ ID NO: 1047666 - RNA, 22 nt, Human
uuauauuaguuagacuugcugu

SEQ ID NO: 1047667 - RNA, 22 nt, Human
uuucacaauuuuaaggagcaaa

SEQ ID NO: 1047668 - RNA, 22 nt, Human
uccagggaugccagccauguug

SEQ ID NO: 1047669 - RNA, 22 nt, Human
ucagccagugccuugaucuugc

SEQ ID NO: 1047670 - RNA, 22 nt, Human
guuccaaagcaaaggaggugag

SEQ ID NO: 1047671 - RNA, 20 nt, Human
gggugagauguaggagaggg

SEQ ID NO: 1047672 - RNA, 22 nt, Human
ugcuggcuacauuauugcuguc

SEQ ID NO: 1047673 - RNA, 22 nt, Human
uuacauaacgguaugaaaaaug

SEQ ID NO: 1047674 - RNA, 22 nt, Human
uaacaagucauuuuaaauuaug

SEQ ID NO: 1047675 - RNA, 22 nt, Human
cuccucccacggucucaggaag

SEQ ID NO: 1047676 - RNA, 22 nt, Human
aauuccaggcagaaaugugagu

SEQ ID NO: 1047677 - RNA, 22 nt, Human
aaaagccaagguccucuucaga

SEQ ID NO: 1047678 - RNA, 22 nt, Human
uuacagaaaauguguuuuaacu

SEQ ID NO: 1047679 - RNA, 22 nt, Human
cccaccagaccugcaccggcac

SEQ ID NO: 1047680 - RNA, 22 nt, Human
aaguccuuuaauaucacauagu

SEQ ID NO: 1047681 - RNA, 22 nt, Human
agcagcaaggaagcgaggaugg

SEQ ID NO: 1047682 - RNA, 22 nt, Human
caaguccuuagaugguucuuug

SEQ ID NO: 1047683 - RNA, 22 nt, Human
caggaggguguggaaaacuggg

SEQ ID NO: 1047684 - RNA, 19 nt, Human
cucuccagcuccaguagcu

SEQ ID NO: 1047685 - RNA, 22 nt, Human
uuuaggcagucauugaacaagu

SEQ ID NO: 1047686 - RNA, 22 nt, Human
ucuauacaugugcacacacauc

SEQ ID NO: 1047687 - RNA, 22 nt, Human
ucuccaggcuuuuugugaauug

SEQ ID NO: 1047688 - RNA, 22 nt, Human
uucagaaaggauaauuggaagg

SEQ ID NO: 1047689 - RNA, 22 nt, Human
aauuuacaguugcugaugguac

SEQ ID NO: 1047690 - RNA, 22 nt, Human
aucagaaaggugggcaagcaga

SEQ ID NO: 1047691 - RNA, 22 nt, Human
ugggagagcuucaugccuucag

SEQ ID NO: 1047692 - RNA, 18 nt, Human
cagggccccagaauuauc

SEQ ID NO: 1047693 - RNA, 22 nt, Human
aguucacagccauguucaugug

SEQ ID NO: 1047694 - RNA, 22 nt, Human
ccacuucaucagugcuccauuu

SEQ ID NO: 1047695 - RNA, 22 nt, Human
ucugcccaggacaccugccacu

SEQ ID NO: 1047696 - RNA, 22 nt, Human
ucuauacugaugggauacuauu

SEQ ID NO: 1047697 - RNA, 22 nt, Human
gccuccagcuggggcauuucag

SEQ ID NO: 1047698 - RNA, 22 nt, Human
ucuccagggugagcuaggccag

SEQ ID NO: 1047699 - RNA, 23 nt, Human
uuaaacuucagugcagaacacuc

SEQ ID NO: 1047700 - RNA, 22 nt, Human
ugaaauaggaaacagauguuuc

SEQ ID NO: 1047701 - RNA, 22 nt, Human
aggcuucuucuuccuauuuagu

SEQ ID NO: 1047702 - RNA, 22 nt, Human
ucuauacacacaaagaaugcuu

SEQ ID NO: 1047703 - RNA, 22 nt, Human
aaaugucagaggaacauauuga

SEQ ID NO: 1047704 - RNA, 22 nt, Human
ugaggcaggacuugcauaaagu

SEQ ID NO: 1047705 - RNA, 22 nt, Human
aggauuuacuagcaaggauucu

SEQ ID NO: 1047706 - RNA, 22 nt, Human
accauguuggccaagcuggucu

SEQ ID NO: 1047707 - RNA, 22 nt, Human
uucaacccaaguucuccauuuu

SEQ ID NO: 1047708 - RNA, 22 nt, Human
uggcuuuacacauccacugccu

SEQ ID NO: 1047709 - RNA, 22 nt, Human
cuuugaauuccaguacaauaac

SEQ ID NO: 1047710 - RNA, 22 nt, Human
aggagcccuccguugcuucauc

SEQ ID NO: 1047711 - RNA, 22 nt, Human
cugcucacgccaccguucauca

SEQ ID NO: 1047712 - RNA, 22 nt, Human
gaggcagcagaacauggaagag

SEQ ID NO: 1047713 - RNA, 22 nt, Human
uccaggagaggccugaccaggu

SEQ ID NO: 1047714 - RNA, 22 nt, Human
ucaguaaaugagcaaaaauuuc

SEQ ID NO: 1047715 - RNA, 22 nt, Human
auggcuuucagauggugaaaga

SEQ ID NO: 1047716 - RNA, 22 nt, Human
cagggacaauggcagagccuga

SEQ ID NO: 1047717 - RNA, 22 nt, Human
augguauugcaacaacugucau

SEQ ID NO: 1047718 - RNA, 22 nt, Human
uaauuucagugggcucugggcu

SEQ ID NO: 1047719 - RNA, 22 nt, Human
ucuuuaaucauaaccaagaugg

SEQ ID NO: 1047720 - RNA, 20 nt, Human
acauggcauucccacguggu

SEQ ID NO: 1047721 - RNA, 19 nt, Human
ccagagagcuagguacaga

SEQ ID NO: 1047722 - RNA, 22 nt, Human
cuuagaaauuguuacucauuca

SEQ ID NO: 1047723 - RNA, 22 nt, Human
acaacaaaaucacuagucuucc

SEQ ID NO: 1047724 - RNA, 22 nt, Human
gccagccuucuguggccugcaa

SEQ ID NO: 1047725 - RNA, 22 nt, Human
aagauauacuauuaaguaccau

SEQ ID NO: 1047726 - RNA, 22 nt, Human
ucugcgcccugucgccugcucc

SEQ ID NO: 1047727 - RNA, 22 nt, Human
uggggagagaccggaauguuuc

SEQ ID NO: 1047728 - RNA, 22 nt, Human
ccgggagacuuugagcaccaug

SEQ ID NO: 1047729 - RNA, 22 nt, Human
auucacuggcagacagaacuca

SEQ ID NO: 1047730 - RNA, 22 nt, Human
ccagggaagaccacuuccugga

SEQ ID NO: 1047731 - RNA, 22 nt, Human
gcuauacagcaggagaauggaa

SEQ ID NO: 1047732 - RNA, 22 nt, Human
uaauauguguuacugacuuuuu

SEQ ID NO: 1047733 - RNA, 22 nt, Human
agacagcauuucuagcaccagg

SEQ ID NO: 1047734 - RNA, 22 nt, Human
caugcuuauucauucugcuaac

SEQ ID NO: 1047735 - RNA, 22 nt, Human
cccagccucugggcucacccaa

SEQ ID NO: 1047736 - RNA, 22 nt, Human
auggaucagaaucccgggaggg

SEQ ID NO: 1047737 - RNA, 22 nt, Human
auauaggcuaacaacuauugag

SEQ ID NO: 1047738 - RNA, 22 nt, Human
ugggagagcagagaacccucuu

SEQ ID NO: 1047739 - RNA, 22 nt, Human
ucacagaacaauguuuaguucu

SEQ ID NO: 1047740 - RNA, 22 nt, Human
aguggggacaaugagagcaggu

SEQ ID NO: 1047741 - RNA, 23 nt, Human
uauggcuuacagugcuuuaggua

SEQ ID NO: 1047742 - RNA, 22 nt, Human
caguccuugcucugggaugaug

SEQ ID NO: 1047743 - RNA, 17 nt, Human
ugcuuaauuuugacugg

SEQ ID NO: 1047744 - RNA, 23 nt, Human
uggaauaauaagguacauuaaca

SEQ ID NO: 1047745 - RNA, 22 nt, Human
ccuccagggcagacggggagca

SEQ ID NO: 1047746 - RNA, 22 nt, Human
aaauuauaggugccaccuugga

SEQ ID NO: 1047747 - RNA, 22 nt, Human
gcuuuaaugcuucguggggcca

SEQ ID NO: 1047748 - RNA, 22 nt, Human
ccagggcaugggaagaacugaa

SEQ ID NO: 1047749 - RNA, 22 nt, Human
uuuuaugugcuggacuggcagu

SEQ ID NO: 1047750 - RNA, 22 nt, Human
aggagggaccuaggaauauugc

SEQ ID NO: 1047751 - RNA, 23 nt, Human
ugguucuaggccuauaauuauau

SEQ ID NO: 1047752 - RNA, 22 nt, Human
gagacaggauuuaaccaaagcu

SEQ ID NO: 1047753 - RNA, 22 nt, Human
agggcugcaccggggcuucgcg

SEQ ID NO: 1047754 - RNA, 22 nt, Human
uggauuagguacuaugaauaua

SEQ ID NO: 1047755 - RNA, 22 nt, Human
cugcccaggaaccagaggggca

SEQ ID NO: 1047756 - RNA, 20 nt, Human
uauuuacaacuuagagccuc

SEQ ID NO: 1047757 - RNA, 22 nt, Human
gggcugucacgccccugcaccu

SEQ ID NO: 1047758 - RNA, 23 nt, Human
cauuucaacgaauuuuccuucug

SEQ ID NO: 1047759 - RNA, 22 nt, Human
uuagaaaucugcugccaugcaa

SEQ ID NO: 1047760 - RNA, 22 nt, Human
gucuaacaagcauuaggaaccc

SEQ ID NO: 1047761 - RNA, 22 nt, Human
gccagggaacccaagggccuca

SEQ ID NO: 1047762 - RNA, 22 nt, Human
cucagggaagcuauggugaggg

SEQ ID NO: 1047763 - RNA, 22 nt, Human
aaugcaaagcaagcagagauuu

SEQ ID NO: 1047764 - RNA, 22 nt, Human
ugucuaguuuuagcuuuuggag

SEQ ID NO: 1047765 - RNA, 22 nt, Human
aagggagacaguugugugagga

SEQ ID NO: 1047766 - RNA, 19 nt, Human
acagaaauuaguuauuuuc

SEQ ID NO: 1047767 - RNA, 22 nt, Human
gauuucaaccuaacaguaugac

SEQ ID NO: 1047768 - RNA, 22 nt, Human
aauaaugucuuuggcuugacca

SEQ ID NO: 1047769 - RNA, 22 nt, Human
agcccuggauucugagguccaa

SEQ ID NO: 1047770 - RNA, 22 nt, Human
ccugcccaucccguccuuggcc

SEQ ID NO: 1047771 - RNA, 22 nt, Human
aucuagaacuuaaagucaguca

SEQ ID NO: 1047772 - RNA, 22 nt, Human
ugcugcucaaugagaugccauc

SEQ ID NO: 1047773 - RNA, 22 nt, Human
ugcuuaauaggaguugaacauu

SEQ ID NO: 1047774 - RNA, 22 nt, Human
uugaauaauuaauuacacucag

SEQ ID NO: 1047775 - RNA, 22 nt, Human
uagaugcuguagaaauacuuau

SEQ ID NO: 1047776 - RNA, 17 nt, Human
gggagaugaagggauau

SEQ ID NO: 1047777 - RNA, 22 nt, Human
caucagaauagcucuguggaua

SEQ ID NO: 1047778 - RNA, 22 nt, Human
aaaucaguuagugguaggauug

SEQ ID NO: 1047779 - RNA, 22 nt, Human
auacaaauuuauagaugcauuu

SEQ ID NO: 1047780 - RNA, 22 nt, Human
ccugggaagucagccaaggacg

SEQ ID NO: 1047781 - RNA, 22 nt, Human
gauggcuucacuuacauggcug

SEQ ID NO: 1047782 - RNA, 22 nt, Human
gggugagagucaggcagagauu

SEQ ID NO: 1047783 - RNA, 22 nt, Human
ccugcccacuccaggagcaacu

SEQ ID NO: 1047784 - RNA, 22 nt, Human
aauaacuggcacauaucacaua

SEQ ID NO: 1047785 - RNA, 21 nt, Human
auccuuagcacuuagaagagu

SEQ ID NO: 1047786 - RNA, 22 nt, Human
caguccuuucugaaauccuaua

SEQ ID NO: 1047787 - RNA, 22 nt, Human
cauugcaacuucaaacuccugg

SEQ ID NO: 1047788 - RNA, 22 nt, Human
augaauaaguaaacuccuuugg

SEQ ID NO: 1047789 - RNA, 22 nt, Human
uuguuucaugaguguaaaggga

SEQ ID NO: 1047790 - RNA, 22 nt, Human
augguuuuguccucuuugguuc

SEQ ID NO: 1047791 - RNA, 22 nt, Human
acuauacauaaaacauuugggu

SEQ ID NO: 1047792 - RNA, 22 nt, Human
aaagcagcugaucucagagccu

SEQ ID NO: 1047793 - RNA, 22 nt, Human
ggaguuggaggcuccagggaac

SEQ ID NO: 1047794 - RNA, 22 nt, Human
ugcaguggugguaaagaugcuc

SEQ ID NO: 1047795 - RNA, 22 nt, Human
cagcucuggccagaucuauccu

SEQ ID NO: 1047796 - RNA, 16 nt, Human
aaggagggaagagaau

SEQ ID NO: 1047797 - RNA, 22 nt, Human
gagggaaggucacccuuguagc

SEQ ID NO: 1047798 - RNA, 22 nt, Human
cauagaaacuugcagcaagcac

SEQ ID NO: 1047799 - RNA, 22 nt, Human
ccagcuccagguagaugggcag

SEQ ID NO: 1047800 - RNA, 19 nt, Human
aggucugcagcugcaguuu

SEQ ID NO: 1047801 - RNA, 22 nt, Human
cuguuaauugugaauuuuacau

SEQ ID NO: 1047802 - RNA, 22 nt, Human
cuacagaaacacuggacaugug

SEQ ID NO: 1047803 - RNA, 22 nt, Human
auacagaaguuuuccacuuauu

SEQ ID NO: 1047804 - RNA, 22 nt, Human
uaccuuggguugaguucauucu

SEQ ID NO: 1047805 - RNA, 22 nt, Human
aaucagaaccuugggucauaac

SEQ ID NO: 1047806 - RNA, 22 nt, Human
auacagaaaaugaugcagaguu

SEQ ID NO: 1047807 - RNA, 22 nt, Human
agcccuggcucccagcagcgcu

SEQ ID NO: 1047808 - RNA, 22 nt, Human
cacauacuuguguguacauaug

SEQ ID NO: 1047809 - RNA, 22 nt, Human
ucaauaauggcaggauaaauuu

SEQ ID NO: 1047810 - RNA, 22 nt, Human
aguaaaauuaauggaucagaag

SEQ ID NO: 1047811 - RNA, 20 nt, Human
caguccacuggaguuccuac

SEQ ID NO: 1047812 - RNA, 22 nt, Human
aguacaauuauauuuagauggu

SEQ ID NO: 1047813 - RNA, 22 nt, Human
uuccuuaguuauuugguccccu

SEQ ID NO: 1047814 - RNA, 22 nt, Human
ggauuuacaaguuuaacucuca

SEQ ID NO: 1047815 - RNA, 22 nt, Human
gaggaggggcacuugucuccua

SEQ ID NO: 1047816 - RNA, 22 nt, Human
agauuuacuggagucuuuggug

SEQ ID NO: 1047817 - RNA, 22 nt, Human
uccagccugaacuuuguccaga

SEQ ID NO: 1047818 - RNA, 22 nt, Human
aaugugaucgcuuuagaagcuu

SEQ ID NO: 1047819 - RNA, 22 nt, Human
cucccaggacucagaggagaag

SEQ ID NO: 1047820 - RNA, 22 nt, Human
ccauaauauuaaaugcuuuugu

SEQ ID NO: 1047821 - RNA, 22 nt, Human
gcagaauuuggggguaaccuuu

SEQ ID NO: 1047822 - RNA, 22 nt, Human
augaacaauaaaauagaucaca

SEQ ID NO: 1047823 - RNA, 22 nt, Human
auacauaauuacuuccgauguu

SEQ ID NO: 1047824 - RNA, 22 nt, Human
ucagaauuuugguuugguuggu

SEQ ID NO: 1047825 - RNA, 22 nt, Human
aaucaguguguaaaguggcugc

SEQ ID NO: 1047826 - RNA, 22 nt, Human
aagaauucacugguagagucaa

SEQ ID NO: 1047827 - RNA, 21 nt, Human
agccagucuguuuucuagugc

SEQ ID NO: 1047828 - RNA, 22 nt, Human
ggcccagcacagugcuuggggg

SEQ ID NO: 1047829 - RNA, 22 nt, Human
ugcuuauuuauagucaauagag

SEQ ID NO: 1047830 - RNA, 22 nt, Human
auagaauuauggaaagcaucuu

SEQ ID NO: 1047831 - RNA, 22 nt, Human
cggggcuggcacaggugaccac

SEQ ID NO: 1047832 - RNA, 22 nt, Human
agacaugguuuauuuuaauggu

SEQ ID NO: 1047833 - RNA, 22 nt, Human
cagagacagccugggagggaca

SEQ ID NO: 1047834 - RNA, 22 nt, Human
augcuuaaugaggguauauaug

SEQ ID NO: 1047835 - RNA, 19 nt, Human
ucagggaguuuacagcaug

SEQ ID NO: 1047836 - RNA, 22 nt, Human
uaacagaagaaaacauauugga

SEQ ID NO: 1047837 - RNA, 21 nt, Human
ucccagggucuuaugggaugu

SEQ ID NO: 1047838 - RNA, 22 nt, Human
gcugcccaauuacagggccgug

SEQ ID NO: 1047839 - RNA, 22 nt, Human
ggaucugauuaauaagguggac

SEQ ID NO: 1047840 - RNA, 22 nt, Human
ccaggggaaacagggagcacuc

SEQ ID NO: 1047841 - RNA, 22 nt, Human
ugugccuuaugaauucuuucug

SEQ ID NO: 1047842 - RNA, 22 nt, Human
guuaauauuuaccugucaagaa

SEQ ID NO: 1047843 - RNA, 22 nt, Human
ccagggaaguaguugugagagc

SEQ ID NO: 1047844 - RNA, 22 nt, Human
cuccagggagcugcgggagcca

SEQ ID NO: 1047845 - RNA, 21 nt, Human
gauuugcagaaacuagacagg

SEQ ID NO: 1047846 - RNA, 22 nt, Human
gauaucauaucagacaaccucu

SEQ ID NO: 1047847 - RNA, 20 nt, Human
uguaacaaucuggauguugc

SEQ ID NO: 1047848 - RNA, 22 nt, Human
uagucaccuguugugugaugcc

SEQ ID NO: 1047849 - RNA, 22 nt, Human
ugguuuuagaugccuuuacugc

SEQ ID NO: 1047850 - RNA, 22 nt, Human
uauuucaagaacuucuauccau

SEQ ID NO: 1047851 - RNA, 23 nt, Human
aggcagcagguuguccaggguga

SEQ ID NO: 1047852 - RNA, 22 nt, Human
agaggaggaagagcuuuaaaau

SEQ ID NO: 1047853 - RNA, 22 nt, Human
uggcccaggugcaagagacaga

SEQ ID NO: 1047854 - RNA, 17 nt, Human
uaucagaauguguuuac

SEQ ID NO: 1047855 - RNA, 22 nt, Human
gcugcccaguucugcugcugcc

SEQ ID NO: 1047856 - RNA, 22 nt, Human
ugaaguaacuguccaggaucca

SEQ ID NO: 1047857 - RNA, 22 nt, Human
uuucagacaggacuucauaugu

SEQ ID NO: 1047858 - RNA, 22 nt, Human
gcagugacauaccuggagggca

SEQ ID NO: 1047859 - RNA, 22 nt, Human
agggcugcaguccuaaggugcu

SEQ ID NO: 1047860 - RNA, 22 nt, Human
cagucaccaccagguggcagua

SEQ ID NO: 1047861 - RNA, 22 nt, Human
gaagaaucugaggacagucauu

SEQ ID NO: 1047862 - RNA, 22 nt, Human
cauucacagcaggucagcugaa

SEQ ID NO: 1047863 - RNA, 21 nt, Human
auuauuauaaagaccacaggg

SEQ ID NO: 1047864 - RNA, 22 nt, Human
aaaucaguuggaacacaagcag

SEQ ID NO: 1047865 - RNA, 22 nt, Human
uuugaagugcaaugaggauucu

SEQ ID NO: 1047866 - RNA, 22 nt, Human
uuaccuaaaauagcucaauuua

SEQ ID NO: 1047867 - RNA, 22 nt, Human
acuucccugugggcagguagug

SEQ ID NO: 1047868 - RNA, 22 nt, Human
uaucagaaugcagccaugugca

SEQ ID NO: 1047869 - RNA, 22 nt, Human
uccagaauauuugggaaagaug

SEQ ID NO: 1047870 - RNA, 22 nt, Human
uguacaauggcuauaauacccu

SEQ ID NO: 1047871 - RNA, 22 nt, Human
ucagcccugggcuuccucaugg

SEQ ID NO: 1047872 - RNA, 22 nt, Human
gcugcccagugugcucaugcag

SEQ ID NO: 1047873 - RNA, 22 nt, Human
ccuucccuaaagcgucgcuuag

SEQ ID NO: 1047874 - RNA, 22 nt, Human
ucagaauucuacaauagaucag

SEQ ID NO: 1047875 - RNA, 22 nt, Human
ccagggcagaaaaagagggaau

SEQ ID NO: 1047876 - RNA, 22 nt, Human
ucuggaucuccagcacuuauca

SEQ ID NO: 1047877 - RNA, 22 nt, Human
uccagggaccucccugagagcu

SEQ ID NO: 1047878 - RNA, 18 nt, Human
gcagggcugcacacgcau

SEQ ID NO: 1047879 - RNA, 22 nt, Human
uguaaauaaugcauguaaauca

SEQ ID NO: 1047880 - RNA, 22 nt, Human
cagauauuaggagcucaauaau

SEQ ID NO: 1047881 - RNA, 22 nt, Human
uauacagucuuuugcuauauuc

SEQ ID NO: 1047882 - RNA, 22 nt, Human
aguaaaauuguauuggaaaaca

SEQ ID NO: 1047883 - RNA, 22 nt, Human
cccagggacagcuagguggggc

SEQ ID NO: 1047884 - RNA, 22 nt, Human
aaauucaauuaacuuucaugcu

SEQ ID NO: 1047885 - RNA, 22 nt, Human
uuccuuagacagagguggucau

SEQ ID NO: 1047886 - RNA, 21 nt, Human
uuacagaauccaugggaaguc

SEQ ID NO: 1047887 - RNA, 22 nt, Human
uaagaaucgauguuuauuuaga

SEQ ID NO: 1047888 - RNA, 22 nt, Human
aggaggguuucaaugggaugag

SEQ ID NO: 1047889 - RNA, 22 nt, Human
caaagucauggggaugcagguc

SEQ ID NO: 1047890 - RNA, 22 nt, Human
aaagccuuugucucaggcucug

SEQ ID NO: 1047891 - RNA, 22 nt, Human
acagaauuuacacaucucuaaa

SEQ ID NO: 1047892 - RNA, 18 nt, Human
ucucaaucgcugcagucu

SEQ ID NO: 1047893 - RNA, 22 nt, Human
augguuuacugaucuuuuuggu

SEQ ID NO: 1047894 - RNA, 22 nt, Human
augaacaaguauuugcaugagc

SEQ ID NO: 1047895 - RNA, 22 nt, Human
augguuuauugcuuuaaugaaa

SEQ ID NO: 1047896 - RNA, 22 nt, Human
aaugaacauauaaagagaucuu

SEQ ID NO: 1047897 - RNA, 22 nt, Human
ggaggagggguuuacauuggaa

SEQ ID NO: 1047898 - RNA, 23 nt, Human
ucuguacacaucagcaucuccca

SEQ ID NO: 1047899 - RNA, 22 nt, Human
aaaagcaguuuauagucaguug

SEQ ID NO: 1047900 - RNA, 22 nt, Human
gcccagggcuucaaagagagaa

SEQ ID NO: 1047901 - RNA, 21 nt, Human
aacugguucaauucaacuaga

SEQ ID NO: 1047902 - RNA, 22 nt, Human
gggaagugaaguguagcugucu

SEQ ID NO: 1047903 - RNA, 21 nt, Human
cuacagaagcucuccuaucca

SEQ ID NO: 1047904 - RNA, 22 nt, Human
agggcagcaaaguuugaccuca

SEQ ID NO: 1047905 - RNA, 20 nt, Human
aaucagaaagugugagcucu

SEQ ID NO: 1047906 - RNA, 22 nt, Human
auacagaaaaguggauagccag

SEQ ID NO: 1047907 - RNA, 22 nt, Human
agaagggaacucagagaugauu

SEQ ID NO: 1047908 - RNA, 22 nt, Human
gagggaagauuccccauauggg

SEQ ID NO: 1047909 - RNA, 22 nt, Human
ggcauuuaauccaucugauuga

SEQ ID NO: 1047910 - RNA, 20 nt, Human
ccagucccugagcaccaggg

SEQ ID NO: 1047911 - RNA, 22 nt, Human
aggcagcagucaugaggaaaga

SEQ ID NO: 1047912 - RNA, 22 nt, Human
ggcauuuagagggcuuuucuga

SEQ ID NO: 1047913 - RNA, 22 nt, Human
agccagucggggccaugcuggg

SEQ ID NO: 1047914 - RNA, 22 nt, Human
aacaugcuuugauaaauaaaag

SEQ ID NO: 1047915 - RNA, 22 nt, Human
caguccuuccuugccccuuggg

SEQ ID NO: 1047916 - RNA, 22 nt, Human
guuaaagaguuuggcuuucuuc

SEQ ID NO: 1047917 - RNA, 22 nt, Human
ucagaauucagagggagugggg

SEQ ID NO: 1047918 - RNA, 23 nt, Human
acaacuuuacagauacauuuugu

SEQ ID NO: 1047919 - RNA, 22 nt, Human
guagaaauagugguugacagga

SEQ ID NO: 1047920 - RNA, 22 nt, Human
acaaaauuaccuaguuauuuuc

SEQ ID NO: 1047921 - RNA, 22 nt, Human
aaaauugagagucuugugcaag

SEQ ID NO: 1047922 - RNA, 22 nt, Human
agcugcccuggcggagcugcuc

SEQ ID NO: 1047923 - RNA, 19 nt, Human
gcagggcucucccagaugc

SEQ ID NO: 1047924 - RNA, 22 nt, Human
aaauggauggaaagcaauuuuu

SEQ ID NO: 1047925 - RNA, 22 nt, Human
aaugccaacuuggauauacauu

SEQ ID NO: 1047926 - RNA, 22 nt, Human
cccagccuuccacccuggacua

SEQ ID NO: 1047927 - RNA, 22 nt, Human
ucuccagguucagucgauggaa

SEQ ID NO: 1047928 - RNA, 22 nt, Human
gaggagggcuuuguugauguua

SEQ ID NO: 1047929 - RNA, 22 nt, Human
cagagagaaucuuggcagcuga

SEQ ID NO: 1047930 - RNA, 22 nt, Human
ucaguaaacagguuuaaguccu

SEQ ID NO: 1047931 - RNA, 22 nt, Human
gggcccaguacccucugccaag

SEQ ID NO: 1047932 - RNA, 22 nt, Human
uccagggccacagaggaugcua

SEQ ID NO: 1047933 - RNA, 22 nt, Human
uauuacaauuuacauugcacuu

SEQ ID NO: 1047934 - RNA, 22 nt, Human
uggcccaggugcacccagaggc

SEQ ID NO: 1047935 - RNA, 22 nt, Human
acagcauucaauaaauaauaac

SEQ ID NO: 1047936 - RNA, 22 nt, Human
cuacagaagccguggucaggaa

SEQ ID NO: 1047937 - RNA, 23 nt, Human
acagggaaaagucaucaguguga

SEQ ID NO: 1047938 - RNA, 22 nt, Human
uuuacagaugaggaaacugaga

SEQ ID NO: 1047939 - RNA, 22 nt, Human
auccuuagaagggagugaggac

SEQ ID NO: 1047940 - RNA, 22 nt, Human
ccaguacugucuccaauauucc

SEQ ID NO: 1047941 - RNA, 22 nt, Human
cagggauggcugucaggaugua

SEQ ID NO: 1047942 - RNA, 22 nt, Human
cauuucaaaagaauugccagaa

SEQ ID NO: 1047943 - RNA, 23 nt, Human
cccagggacacgaugacaccucc

SEQ ID NO: 1047944 - RNA, 22 nt, Human
aaacaaacauagguuugaaagu

SEQ ID NO: 1047945 - RNA, 22 nt, Human
augguuuaaagaguaugacuuu

SEQ ID NO: 1047946 - RNA, 19 nt, Human
ucuccaggcaggugagcga

SEQ ID NO: 1047947 - RNA, 22 nt, Human
caguccuugauccaauaguggg

SEQ ID NO: 1047948 - RNA, 22 nt, Human
agagacaaugccaaugcacacg

SEQ ID NO: 1047949 - RNA, 22 nt, Human
aucuauacucagaguuaauauc

SEQ ID NO: 1047950 - RNA, 19 nt, Human
agccagggugagaaggagc

SEQ ID NO: 1047951 - RNA, 22 nt, Human
gugaacuauuggguaucauaaa

SEQ ID NO: 1047952 - RNA, 22 nt, Human
ggacauggaaguauggagugga

SEQ ID NO: 1047953 - RNA, 22 nt, Human
gcacaauaauuuuuuuaagagg

SEQ ID NO: 1047954 - RNA, 22 nt, Human
ccaggcucaccuggagccccug

SEQ ID NO: 1047955 - RNA, 22 nt, Human
agaucccaggauacuggccuau

SEQ ID NO: 1047956 - RNA, 21 nt, Human
caaagccaggcaacucucucc

SEQ ID NO: 1047957 - RNA, 22 nt, Human
aaauugcagaugcuaaaugacu

SEQ ID NO: 1047958 - RNA, 22 nt, Human
aacuuugaggucacugaauucc

SEQ ID NO: 1047959 - RNA, 19 nt, Human
aacuggauaauggccacau

SEQ ID NO: 1047960 - RNA, 22 nt, Human
accagcccucaggucagauacu

SEQ ID NO: 1047961 - RNA, 22 nt, Human
ucagggaagaaaugggacuuua

SEQ ID NO: 1047962 - RNA, 22 nt, Human
gggcaugccugagccugccacu

SEQ ID NO: 1047963 - RNA, 22 nt, Human
uucagaaacaucaguggaugga

SEQ ID NO: 1047964 - RNA, 22 nt, Human
auugaaaauaaggccagaaaca

SEQ ID NO: 1047965 - RNA, 22 nt, Human
gccugcagccccucugcaguag

SEQ ID NO: 1047966 - RNA, 22 nt, Human
gagggagaaggacuaucaggcu

SEQ ID NO: 1047967 - RNA, 22 nt, Human
ggagauggcucugcaaggucua

SEQ ID NO: 1047968 - RNA, 22 nt, Human
uaguccuuuaucaaacauuuau

SEQ ID NO: 1047969 - RNA, 23 nt, Human
cagcccugaaaucgaggugacac

SEQ ID NO: 1047970 - RNA, 22 nt, Human
gugcauuuaggucacaugaugu

SEQ ID NO: 1047971 - RNA, 22 nt, Human
gggagacacuugcuuuagaggg

SEQ ID NO: 1047972 - RNA, 22 nt, Human
auccauuugaaagaacagucca

SEQ ID NO: 1047973 - RNA, 22 nt, Human
uauuaaagggaaguuaugcaug

SEQ ID NO: 1047974 - RNA, 22 nt, Human
aucuauacuacaaauggcuggu

SEQ ID NO: 1047975 - RNA, 22 nt, Human
gauuucaaguaucuugggcgag

SEQ ID NO: 1047976 - RNA, 22 nt, Human
guuaggcauuugccuuaauuuu

SEQ ID NO: 1047977 - RNA, 22 nt, Human
cuuaggcaaccaggucaaugcu

SEQ ID NO: 1047978 - RNA, 22 nt, Human
uuuaggcacaacuacucagcua

SEQ ID NO: 1047979 - RNA, 19 nt, Human
ucucuacacuacauuucua

SEQ ID NO: 1047980 - RNA, 22 nt, Human
augaauaaacaggugccucuuc

SEQ ID NO: 1047981 - RNA, 22 nt, Human
auaaaaguucaagagaguacag

SEQ ID NO: 1047982 - RNA, 22 nt, Human
agacaguggcucagccccaguc

SEQ ID NO: 1047983 - RNA, 22 nt, Human
ucagccaggccaccuucagcuu

SEQ ID NO: 1047984 - RNA, 22 nt, Human
cucuaacaccacagugugguuu

SEQ ID NO: 1047985 - RNA, 22 nt, Human
uauggcuuuuuauucaucuuac

SEQ ID NO: 1047986 - RNA, 22 nt, Human
acagcauugagagcuaaauuua

SEQ ID NO: 1047987 - RNA, 22 nt, Human
uaccugcacagccagccaugug

SEQ ID NO: 1047988 - RNA, 22 nt, Human
cguggggacccacgugcagcac

SEQ ID NO: 1047989 - RNA, 22 nt, Human
auuccaaacagugcugcagacu

SEQ ID NO: 1047990 - RNA, 22 nt, Human
ugaaacuaggccaaucaaauua

SEQ ID NO: 1047991 - RNA, 22 nt, Human
ugugaauaaugccgcaauaaac

SEQ ID NO: 1047992 - RNA, 22 nt, Human
agcccuggggugcagaaccaug

SEQ ID NO: 1047993 - RNA, 22 nt, Human
guccagggggcuuaagcaaacu

SEQ ID NO: 1047994 - RNA, 22 nt, Human
agggaauguagcaagaugccaa

SEQ ID NO: 1047995 - RNA, 22 nt, Human
cauuucaauacaguuuguaaau

SEQ ID NO: 1047996 - RNA, 19 nt, Human
aaaauugcguauuuugagg

SEQ ID NO: 1047997 - RNA, 22 nt, Human
uaguccuuuaauaguuaaugug

SEQ ID NO: 1047998 - RNA, 22 nt, Human
uugguacagaugagguauucuc

SEQ ID NO: 1047999 - RNA, 23 nt, Human
uagaauucaaucuguuccacauc

SEQ ID NO: 1048000 - RNA, 22 nt, Human
cuauacagagcauccuuaacuu

SEQ ID NO: 1048001 - RNA, 22 nt, Human
auagaauucguguuuguaauuc

SEQ ID NO: 1048002 - RNA, 18 nt, Human
uacagauuauagauacau

SEQ ID NO: 1048003 - RNA, 22 nt, Human
caauauauaggaacaacuuagg

SEQ ID NO: 1048004 - RNA, 22 nt, Human
gguacaauucugggguaugcuc

SEQ ID NO: 1048005 - RNA, 22 nt, Human
auaaagauuuuuaggcauuucu

SEQ ID NO: 1048006 - RNA, 22 nt, Human
ucuccaggagcaagucacccag

SEQ ID NO: 1048007 - RNA, 22 nt, Human
uguauguugggucaaaguacau

SEQ ID NO: 1048008 - RNA, 22 nt, Human
ugaagaaucagauuggccugcg

SEQ ID NO: 1048009 - RNA, 22 nt, Human
gccacaggugggcucugggaaa

SEQ ID NO: 1048010 - RNA, 18 nt, Human
gcaggcuuuuccuggguc

SEQ ID NO: 1048011 - RNA, 22 nt, Human
uucauacuaaaguguaagaugu

SEQ ID NO: 1048012 - RNA, 22 nt, Human
uuuaggaaugugguuuuugagc

SEQ ID NO: 1048013 - RNA, 22 nt, Human
gugaauaaucacccuucuggau

SEQ ID NO: 1048014 - RNA, 20 nt, Human
uacagaaugcaauaaaaugg

SEQ ID NO: 1048015 - RNA, 22 nt, Human
uggagggaacccaggcugcucu

SEQ ID NO: 1048016 - RNA, 22 nt, Human
auuaggcaauucugggcaucuc

SEQ ID NO: 1048017 - RNA, 22 nt, Human
aaauuucaagcaaaguagcuau

SEQ ID NO: 1048018 - RNA, 22 nt, Human
ucaguucaguauacacuauucu

SEQ ID NO: 1048019 - RNA, 22 nt, Human
augguuuaguuagggcuuuuca

SEQ ID NO: 1048020 - RNA, 22 nt, Human
uaggagggggaacaaggcauac

SEQ ID NO: 1048021 - RNA, 22 nt, Human
acaugcuuccaaauuauguugg

SEQ ID NO: 1048022 - RNA, 22 nt, Human
uucuuucagaacacaagugauu

SEQ ID NO: 1048023 - RNA, 22 nt, Human
cugaauaaagcccucgcgcgcu

SEQ ID NO: 1048024 - RNA, 22 nt, Human
cccagggacagaugggcagcua

SEQ ID NO: 1048025 - RNA, 22 nt, Human
gagggcaagaguuggaaacggu

SEQ ID NO: 1048026 - RNA, 22 nt, Human
uggggccagagcugcagggagc

SEQ ID NO: 1048027 - RNA, 22 nt, Human
agccaacuaauuaaacaacuuu

SEQ ID NO: 1048028 - RNA, 22 nt, Human
ucuggaucucccucauccuggg

SEQ ID NO: 1048029 - RNA, 18 nt, Human
ugggcugccuggccucug

SEQ ID NO: 1048030 - RNA, 22 nt, Human
ccaagggagacugugagaccuc

SEQ ID NO: 1048031 - RNA, 20 nt, Human
agggcagcuugaggagccgg

SEQ ID NO: 1048032 - RNA, 22 nt, Human
augguuuacaauguuuucaguu

SEQ ID NO: 1048033 - RNA, 22 nt, Human
uuacagaagaguaacuuggcaa

SEQ ID NO: 1048034 - RNA, 22 nt, Human
auggcauuccaagucuucuuuu

SEQ ID NO: 1048035 - RNA, 22 nt, Human
ucacagaagaugcuggauguug

SEQ ID NO: 1048036 - RNA, 22 nt, Human
uauccaaaguuucucagaaacu

SEQ ID NO: 1048037 - RNA, 22 nt, Human
ucagaauuagagcucuucuuga

SEQ ID NO: 1048038 - RNA, 22 nt, Human
uagucaccucuuuaaauguccu

SEQ ID NO: 1048039 - RNA, 22 nt, Human
cauaauuacugauaugcugauu

SEQ ID NO: 1048040 - RNA, 22 nt, Human
guuagaaaugcagaaacuugac

SEQ ID NO: 1048041 - RNA, 22 nt, Human
gaaaggcaguacagcugagccu

SEQ ID NO: 1048042 - RNA, 22 nt, Human
ugggcugcacugcucuuuaucg

SEQ ID NO: 1048043 - RNA, 22 nt, Human
uccugcagccaagggucaucga

SEQ ID NO: 1048044 - RNA, 22 nt, Human
uggggagaggaauuugaaugau

SEQ ID NO: 1048045 - RNA, 22 nt, Human
uacagaaguaaauaccaaaagc

SEQ ID NO: 1048046 - RNA, 22 nt, Human
agaauuccucuaggaucugccc

SEQ ID NO: 1048047 - RNA, 21 nt, Human
gauaaaaugggccuugguccu

SEQ ID NO: 1048048 - RNA, 22 nt, Human
uccccucucugcgcucccaggu

SEQ ID NO: 1048049 - RNA, 22 nt, Human
uguauacaggcauaagagauac

SEQ ID NO: 1048050 - RNA, 22 nt, Human
agggcugccugcucugcauuga

SEQ ID NO: 1048051 - RNA, 22 nt, Human
uguacaaugcugagguuugggg

SEQ ID NO: 1048052 - RNA, 22 nt, Human
ccauggcucuagagauugaaaa

SEQ ID NO: 1048053 - RNA, 22 nt, Human
auggcuuucucuaaugugguau

SEQ ID NO: 1048054 - RNA, 22 nt, Human
caaguccuuuucuuggcucagg

SEQ ID NO: 1048055 - RNA, 22 nt, Human
gaucagaaucuucauuuucagu

SEQ ID NO: 1048056 - RNA, 22 nt, Human
auguuacacauaggcauaaaug

SEQ ID NO: 1048057 - RNA, 22 nt, Human
uuuaaagagaaugugaaggagu

SEQ ID NO: 1048058 - RNA, 22 nt, Human
guuccaaauuuggaucuuuagg

SEQ ID NO: 1048059 - RNA, 23 nt, Human
uaucagugugaugaggcugcugc

SEQ ID NO: 1048060 - RNA, 22 nt, Human
uggcugccugaaugcaagacag

SEQ ID NO: 1048061 - RNA, 22 nt, Human
uuugaacaggaguaucuauagu

SEQ ID NO: 1048062 - RNA, 22 nt, Human
uucagaaaucgaguuucauguc

SEQ ID NO: 1048063 - RNA, 22 nt, Human
ggccuuuaagcaauugaaaaga

SEQ ID NO: 1048064 - RNA, 22 nt, Human
agucaccaucuguggcagccug

SEQ ID NO: 1048065 - RNA, 22 nt, Human
gcccagcaaggaccaagggccg

SEQ ID NO: 1048066 - RNA, 22 nt, Human
aauagaaaggaggggcucuugu

SEQ ID NO: 1048067 - RNA, 22 nt, Human
ccagggaggguccuguggcuuc

SEQ ID NO: 1048068 - RNA, 22 nt, Human
cuccagggagcuuggaaagacc

SEQ ID NO: 1048069 - RNA, 22 nt, Human
ucuggauccuaugcacuggacu

SEQ ID NO: 1048070 - RNA, 22 nt, Human
caauuuuuuccaugcucuuaca

SEQ ID NO: 1048071 - RNA, 22 nt, Human
ccagggagccuggugugucagc

SEQ ID NO: 1048072 - RNA, 22 nt, Human
caucagaaggccagaggguagc

SEQ ID NO: 1048073 - RNA, 22 nt, Human
gcugcccaaugguagugucuuu

SEQ ID NO: 1048074 - RNA, 22 nt, Human
cagaauguagaucaucaucaag

SEQ ID NO: 1048075 - RNA, 22 nt, Human
aacuggauuaacuggcucaaau

SEQ ID NO: 1048076 - RNA, 20 nt, Human
agggaggugcugggccugag

SEQ ID NO: 1048077 - RNA, 22 nt, Human
uagggaagcuccugauuccccu

SEQ ID NO: 1048078 - RNA, 22 nt, Human
agcagggaggcccagggcacug

SEQ ID NO: 1048079 - RNA, 22 nt, Human
cauuucaaguaacagauugcuu

SEQ ID NO: 1048080 - RNA, 22 nt, Human
aguagggagaccggaggccgcc

SEQ ID NO: 1048081 - RNA, 22 nt, Human
uaaguccuauuccaggucucuc

SEQ ID NO: 1048082 - RNA, 22 nt, Human
ugacuucaagguucagcaccuu

SEQ ID NO: 1048083 - RNA, 23 nt, Human
uguaacaauucccagccuuugcc

SEQ ID NO: 1048084 - RNA, 22 nt, Human
agggaggucuuugaggggcuua

SEQ ID NO: 1048085 - RNA, 22 nt, Human
ugggcugcggauaggccucgga

SEQ ID NO: 1048086 - RNA, 22 nt, Human
uaaucugaagaaacaggacuug

SEQ ID NO: 1048087 - RNA, 22 nt, Human
cauagaaaagaguagguaaugu

SEQ ID NO: 1048088 - RNA, 22 nt, Human
uuuauccauaucauuaaaaucu

SEQ ID NO: 1048089 - RNA, 22 nt, Human
uguacaaugccagggaacacca

SEQ ID NO: 1048090 - RNA, 22 nt, Human
uguucuugggaaucuuacaguu

SEQ ID NO: 1048091 - RNA, 22 nt, Human
ccagggaaggcucugccugcuu

SEQ ID NO: 1048092 - RNA, 22 nt, Human
agucaccagguuuuagagaccu

SEQ ID NO: 1048093 - RNA, 22 nt, Human
uuuccaaauaaggucacauucu

SEQ ID NO: 1048094 - RNA, 22 nt, Human
agaggagguggugaugcuuuaa

SEQ ID NO: 1048095 - RNA, 20 nt, Human
uccagcucaguuuuuuuguc

SEQ ID NO: 1048096 - RNA, 22 nt, Human
acuauacaagauuagggauuug

SEQ ID NO: 1048097 - RNA, 22 nt, Human
uucaccgugaaccgauuccuca

SEQ ID NO: 1048098 - RNA, 22 nt, Human
auaugaaaagaagucaccauug

SEQ ID NO: 1048099 - RNA, 22 nt, Human
uacugaaaagccacaaggacca

SEQ ID NO: 1048100 - RNA, 22 nt, Human
uuacagaaagguugugggauag

SEQ ID NO: 1048101 - RNA, 22 nt, Human
aucaguuaguuacugcuaagau

SEQ ID NO: 1048102 - RNA, 22 nt, Human
guacagaaggagcuuuggauuc

SEQ ID NO: 1048103 - RNA, 22 nt, Human
agggagaggagggucuuguuga

SEQ ID NO: 1048104 - RNA, 22 nt, Human
ucugcccacugcucugcugccc

SEQ ID NO: 1048105 - RNA, 22 nt, Human
agaucugaaucucauccgagga

SEQ ID NO: 1048106 - RNA, 22 nt, Human
gaauuucaaaagccagaacggg

SEQ ID NO: 1048107 - RNA, 22 nt, Human
ucugcccagggcagggcuugca

SEQ ID NO: 1048108 - RNA, 22 nt, Human
ggagacaacaaucaugugugaa

SEQ ID NO: 1048109 - RNA, 22 nt, Human
augaaaacggaccagagcuauu

SEQ ID NO: 1048110 - RNA, 22 nt, Human
uuaaaaucuaaagcaguugucu

SEQ ID NO: 1048111 - RNA, 21 nt, Human
ugaaacaaucagacagagucu

SEQ ID NO: 1048112 - RNA, 22 nt, Human
ucaguaaaugguugcuguuauu

SEQ ID NO: 1048113 - RNA, 22 nt, Human
gauuucaauccagcuuucuucu

SEQ ID NO: 1048114 - RNA, 22 nt, Human
uuuacagauguggaaagugagc

SEQ ID NO: 1048115 - RNA, 22 nt, Human
gccuuaauuuaugucuaacaua

SEQ ID NO: 1048116 - RNA, 22 nt, Human
gaaagccagagagaaagggcuc

SEQ ID NO: 1048117 - RNA, 23 nt, Human
aucagucuugguagcugugccca

SEQ ID NO: 1048118 - RNA, 22 nt, Human
uuccuuagggucagccagaucu

SEQ ID NO: 1048119 - RNA, 22 nt, Human
auuucaacagaguuugaaggca

SEQ ID NO: 1048120 - RNA, 22 nt, Human
aggagaggguggcauuaaguuu

SEQ ID NO: 1048121 - RNA, 22 nt, Human
cuuuaacaaaugacucuugucu

SEQ ID NO: 1048122 - RNA, 22 nt, Human
aaagccagguugugugcaggaa

SEQ ID NO: 1048123 - RNA, 22 nt, Human
aaaguguacuaugucaugaaca

SEQ ID NO: 1048124 - RNA, 22 nt, Human
uuaacagagugccuggcaugua

SEQ ID NO: 1048125 - RNA, 23 nt, Human
uauuacaauuggucuuauuaaga

SEQ ID NO: 1048126 - RNA, 22 nt, Human
agggcugcaggcaagauauggc

SEQ ID NO: 1048127 - RNA, 22 nt, Human
augugcuuguaauguuaaaugu

SEQ ID NO: 1048128 - RNA, 22 nt, Human
gcuccagguauuugcccuuuua

SEQ ID NO: 1048129 - RNA, 22 nt, Human
uuaacacuccuaacuacagucu

SEQ ID NO: 1048130 - RNA, 22 nt, Human
caugcuuaugauuugcuaagcc

SEQ ID NO: 1048131 - RNA, 22 nt, Human
aaacuuugguauguagcaaaac

SEQ ID NO: 1048132 - RNA, 21 nt, Human
acugcccaccaguuaacgcug

SEQ ID NO: 1048133 - RNA, 23 nt, Human
agggagaugccacaaagaugccc

SEQ ID NO: 1048134 - RNA, 22 nt, Human
ccagggaaacagcccaguguga

SEQ ID NO: 1048135 - RNA, 22 nt, Human
ucagccuccuaauuuccuguga

SEQ ID NO: 1048136 - RNA, 22 nt, Human
auuucaggauagccuaguuuug

SEQ ID NO: 1048137 - RNA, 22 nt, Human
gggaagugauggagccaggauu

SEQ ID NO: 1048138 - RNA, 22 nt, Human
aauauaaugcuguuuuaugcca

SEQ ID NO: 1048139 - RNA, 22 nt, Human
ucuccaggggcugcugugccac

SEQ ID NO: 1048140 - RNA, 22 nt, Human
uaauuacagguccaaaacaauc

SEQ ID NO: 1048141 - RNA, 22 nt, Human
ucagccaguugccccaguuagu

SEQ ID NO: 1048142 - RNA, 22 nt, Human
acaaaauuaugaagaggccuug

SEQ ID NO: 1048143 - RNA, 20 nt, Human
gaaguccuguuauauccuuu

SEQ ID NO: 1048144 - RNA, 22 nt, Human
uaggcaacaugucgaauacugu

SEQ ID NO: 1048145 - RNA, 22 nt, Human
auaucagaaauaguaagcagag

SEQ ID NO: 1048146 - RNA, 22 nt, Human
agggagagguugaaaccucagu

SEQ ID NO: 1048147 - RNA, 22 nt, Human
ugcccagguuugagugcccaag

SEQ ID NO: 1048148 - RNA, 22 nt, Human
uggcauuucaguauuuucauaa

SEQ ID NO: 1048149 - RNA, 20 nt, Human
aauaaacuacugagagaugu

SEQ ID NO: 1048150 - RNA, 22 nt, Human
gagggcccuggcuggcuccagc

SEQ ID NO: 1048151 - RNA, 22 nt, Human
acaggcaguugagguuugugug

SEQ ID NO: 1048152 - RNA, 21 nt, Human
agaauaaugguaucauuugcu

SEQ ID NO: 1048153 - RNA, 22 nt, Human
ccagggaaacuuuggaguggag

SEQ ID NO: 1048154 - RNA, 22 nt, Human
caaacuggcuaugggaaucuug

SEQ ID NO: 1048155 - RNA, 22 nt, Human
agggcugcaucugccuggugaa

SEQ ID NO: 1048156 - RNA, 22 nt, Human
cccagggaagggcuaccugagg

SEQ ID NO: 1048157 - RNA, 23 nt, Human
ggauuuaguggaugagcugagug

SEQ ID NO: 1048158 - RNA, 22 nt, Human
acagaaguuggaauuagauacu

SEQ ID NO: 1048159 - RNA, 22 nt, Human
uuuccaaaaugaaucuaaugca

SEQ ID NO: 1048160 - RNA, 19 nt, Human
caguccuuuccgcuuucuc

SEQ ID NO: 1048161 - RNA, 22 nt, Human
acagaauuugcuugggcaaugg

SEQ ID NO: 1048162 - RNA, 22 nt, Human
cugaccagcccugcccagggaa

SEQ ID NO: 1048163 - RNA, 22 nt, Human
gcugccucacuccagcccaaua

SEQ ID NO: 1048164 - RNA, 22 nt, Human
gcccagggcagggcaagaguga

SEQ ID NO: 1048165 - RNA, 22 nt, Human
ggaggcagaauagagugugggu

SEQ ID NO: 1048166 - RNA, 22 nt, Human
ggcccaaggcccaggucgagcu

SEQ ID NO: 1048167 - RNA, 22 nt, Human
ugcccaggauugugaggucagg

SEQ ID NO: 1048168 - RNA, 22 nt, Human
uaacagaaaggggacagaaaua

SEQ ID NO: 1048169 - RNA, 22 nt, Human
ccacagcuccucagccucuuuc

SEQ ID NO: 1048170 - RNA, 22 nt, Human
uuuuuugucuugaagaaauggu

SEQ ID NO: 1048171 - RNA, 22 nt, Human
uaaguccuggcugguuugaagc

SEQ ID NO: 1048172 - RNA, 22 nt, Human
gggccccacuggggcugccugc

SEQ ID NO: 1048173 - RNA, 22 nt, Human
aaucagaaagaucuugaugaga

SEQ ID NO: 1048174 - RNA, 22 nt, Human
uuccuuagcagaccugguaucc

SEQ ID NO: 1048175 - RNA, 22 nt, Human
uugauccaguugaaagugauga

SEQ ID NO: 1048176 - RNA, 22 nt, Human
acaggcagagucagguuggguu

SEQ ID NO: 1048177 - RNA, 22 nt, Human
uagggaaggagaccaagccaca

SEQ ID NO: 1048178 - RNA, 22 nt, Human
auguguaugcaugcacuaagau

SEQ ID NO: 1048179 - RNA, 17 nt, Human
ucagggaaugagguugu

SEQ ID NO: 1048180 - RNA, 22 nt, Human
gggaauguugacugagagcagg

SEQ ID NO: 1048181 - RNA, 22 nt, Human
guccuuaguuacuuuucauguc

SEQ ID NO: 1048182 - RNA, 22 nt, Human
auguucaaacaaguuaaugcca

SEQ ID NO: 1048183 - RNA, 22 nt, Human
aaaugcaguuuccugagaccca

SEQ ID NO: 1048184 - RNA, 22 nt, Human
ucaauaaaauuguuuuccuauc

SEQ ID NO: 1048185 - RNA, 20 nt, Human
agaaucugacccagagagac

SEQ ID NO: 1048186 - RNA, 22 nt, Human
uagucaccugugagcugcguag

SEQ ID NO: 1048187 - RNA, 22 nt, Human
uggggagagauugaggaguuuu

SEQ ID NO: 1048188 - RNA, 22 nt, Human
agaugccagcuuacacugggaa

SEQ ID NO: 1048189 - RNA, 22 nt, Human
accagccuccuagcugcuccug

SEQ ID NO: 1048190 - RNA, 22 nt, Human
ccagagaguaggaggcauuauu

SEQ ID NO: 1048191 - RNA, 22 nt, Human
cagggaugagagauggcacaga

SEQ ID NO: 1048192 - RNA, 19 nt, Human
caccacuucuuuuugcauc

SEQ ID NO: 1048193 - RNA, 22 nt, Human
cauggcuucuaagugauaacgu

SEQ ID NO: 1048194 - RNA, 22 nt, Human
agcaucuggcagaaagucagaa

SEQ ID NO: 1048195 - RNA, 22 nt, Human
ugcuuaauauugugauguaaua

SEQ ID NO: 1048196 - RNA, 22 nt, Human
ccuagggauacagcagaguaca

SEQ ID NO: 1048197 - RNA, 22 nt, Human
cugauacauaguagcaugucau

SEQ ID NO: 1048198 - RNA, 22 nt, Human
uguuucagucccuguguucaau

SEQ ID NO: 1048199 - RNA, 22 nt, Human
uggcauuugggcuggcuuuucu

SEQ ID NO: 1048200 - RNA, 22 nt, Human
agauuuccuaugguaauuauag

SEQ ID NO: 1048201 - RNA, 22 nt, Human
aaaacuuucagggauacagaaa

SEQ ID NO: 1048202 - RNA, 22 nt, Human
cuauuacauuucuggacauuca

SEQ ID NO: 1048203 - RNA, 22 nt, Human
ucaacuuugaaaccauagugaa

SEQ ID NO: 1048204 - RNA, 22 nt, Human
ccuauacaggcuucuuuacaug

SEQ ID NO: 1048205 - RNA, 22 nt, Human
aauuccagcuaggaaaagcuuc

SEQ ID NO: 1048206 - RNA, 22 nt, Human
aaaucaguuaagaugaggccau

SEQ ID NO: 1048207 - RNA, 22 nt, Human
caaguccuaaauguauuuguug

SEQ ID NO: 1048208 - RNA, 22 nt, Human
aaagcagcagcaccugcauuuc

SEQ ID NO: 1048209 - RNA, 22 nt, Human
ggcagugaaucugagagccugg

SEQ ID NO: 1048210 - RNA, 22 nt, Human
caggcgagggcccugaggagcc

SEQ ID NO: 1048211 - RNA, 22 nt, Human
gaauuucaacaguccucaaaug

SEQ ID NO: 1048212 - RNA, 22 nt, Human
agcugcccuucucuugcccuug

SEQ ID NO: 1048213 - RNA, 22 nt, Human
cagccucuaagcacagccucuc

SEQ ID NO: 1048214 - RNA, 22 nt, Human
acacagggcggaaagcaugaga

SEQ ID NO: 1048215 - RNA, 19 nt, Human
uccauaaugaagauagagg

SEQ ID NO: 1048216 - RNA, 22 nt, Human
gugaauaauauuguuuauaaaa

SEQ ID NO: 1048217 - RNA, 22 nt, Human
ggccacagagggcgggaugcug

SEQ ID NO: 1048218 - RNA, 22 nt, Human
aaucagugguucccagcccagg

SEQ ID NO: 1048219 - RNA, 22 nt, Human
ggcauuuauuugucucauucuu

SEQ ID NO: 1048220 - RNA, 22 nt, Human
caaagauuuuagaauuugcaau

SEQ ID NO: 1048221 - RNA, 22 nt, Human
caguccuuagauuuuacugcca

SEQ ID NO: 1048222 - RNA, 22 nt, Human
ugggcugccagcucuccagaug

SEQ ID NO: 1048223 - RNA, 22 nt, Human
aauaaaaugaacugguagaguu

SEQ ID NO: 1048224 - RNA, 18 nt, Human
auagaaaccuuuaaucag

SEQ ID NO: 1048225 - RNA, 22 nt, Human
gaaacaacuacuauugauuucu

SEQ ID NO: 1048226 - RNA, 22 nt, Human
auauuaaauggauuuugggagc

SEQ ID NO: 1048227 - RNA, 22 nt, Human
uacaugaaccuuuaugugugau

SEQ ID NO: 1048228 - RNA, 22 nt, Human
uguccuuaucuccaaacaauca

SEQ ID NO: 1048229 - RNA, 17 nt, Human
gagcagggaugcgguuc

SEQ ID NO: 1048230 - RNA, 22 nt, Human
caauuucaaugaggccacaggg

SEQ ID NO: 1048231 - RNA, 22 nt, Human
gaggaggaaacccuguuccucu

SEQ ID NO: 1048232 - RNA, 22 nt, Human
augaaaauugacagcggaagua

SEQ ID NO: 1048233 - RNA, 22 nt, Human
caggugaguaacaaugggugau

SEQ ID NO: 1048234 - RNA, 22 nt, Human
ccugcccaggagucucucugug

SEQ ID NO: 1048235 - RNA, 22 nt, Human
agaucauaugaaaaauuucaag

SEQ ID NO: 1048236 - RNA, 22 nt, Human
uaccagccuuuuaacaugggcc

SEQ ID NO: 1048237 - RNA, 22 nt, Human
cuccaggccccuggccuucugc

SEQ ID NO: 1048238 - RNA, 22 nt, Human
gcagccucugaugauggccgua

SEQ ID NO: 1048239 - RNA, 17 nt, Human
cccagggaccacugcuu

SEQ ID NO: 1048240 - RNA, 22 nt, Human
gaggcagcaggcugaggaggau

SEQ ID NO: 1048241 - RNA, 22 nt, Human
cagaauaaaagucccaaggcau

SEQ ID NO: 1048242 - RNA, 22 nt, Human
uauacagauuaacagauuuaaa

SEQ ID NO: 1048243 - RNA, 22 nt, Human
aggauuuaccgucauuuagucu

SEQ ID NO: 1048244 - RNA, 22 nt, Human
aguccuuacaccuggaaccuau

SEQ ID NO: 1048245 - RNA, 22 nt, Human
aaguccuuggagaauagaaagg

SEQ ID NO: 1048246 - RNA, 20 nt, Human
uguuccaagcuaaugaauga

SEQ ID NO: 1048247 - RNA, 22 nt, Human
cccugggaggcuuccaggcaga

SEQ ID NO: 1048248 - RNA, 22 nt, Human
uuuaggcacagggaguugguuu

SEQ ID NO: 1048249 - RNA, 22 nt, Human
aagcagcugauuucacagcuca

SEQ ID NO: 1048250 - RNA, 22 nt, Human
cauuuacauaacaguaacgcug

SEQ ID NO: 1048251 - RNA, 18 nt, Human
gaaagccaugcagcagug

SEQ ID NO: 1048252 - RNA, 22 nt, Human
ucuggaucaccacuucugccuc

SEQ ID NO: 1048253 - RNA, 22 nt, Human
caauuucauuaauagauauaga

SEQ ID NO: 1048254 - RNA, 22 nt, Human
uuugaauaaucacugggcauua

SEQ ID NO: 1048255 - RNA, 22 nt, Human
cauuucaauacuaucugagaau

SEQ ID NO: 1048256 - RNA, 22 nt, Human
gugaauaaccuacuccaggccu

SEQ ID NO: 1048257 - RNA, 22 nt, Human
cuccaggggccagaagccuggc

SEQ ID NO: 1048258 - RNA, 22 nt, Human
gaggaggggacaguacuugugc

SEQ ID NO: 1048259 - RNA, 22 nt, Human
gugaauaacuuucuauguuaau

SEQ ID NO: 1048260 - RNA, 22 nt, Human
caguccuucuccauuaaggcuc

SEQ ID NO: 1048261 - RNA, 22 nt, Human
ucuccagggacauguuucugga

SEQ ID NO: 1048262 - RNA, 22 nt, Human
ggcauuuagauugaauuucugu

SEQ ID NO: 1048263 - RNA, 22 nt, Human
acaugucuguaauuauuuuagg

SEQ ID NO: 1048264 - RNA, 22 nt, Human
uaaagccaauauaccuagcaua

SEQ ID NO: 1048265 - RNA, 22 nt, Human
ucagaauucugaccuuggguca

SEQ ID NO: 1048266 - RNA, 22 nt, Human
aucagcaucuuuaacaauuacc

SEQ ID NO: 1048267 - RNA, 22 nt, Human
aacuggauuuaggaacagagaa

SEQ ID NO: 1048268 - RNA, 22 nt, Human
aucugacuucacgcccaugcca

SEQ ID NO: 1048269 - RNA, 22 nt, Human
augacaaaagaagacaugaggu

SEQ ID NO: 1048270 - RNA, 22 nt, Human
ucaaaauuaaaccaacguccag

SEQ ID NO: 1048271 - RNA, 22 nt, Human
aggauuuaaauccuuaaccacu

SEQ ID NO: 1048272 - RNA, 22 nt, Human
uuucauaaggguuucuagacuu

SEQ ID NO: 1048273 - RNA, 22 nt, Human
cuucuuuccuuccuccaguggc

SEQ ID NO: 1048274 - RNA, 22 nt, Human
agaaaucaauaucuauauguug

SEQ ID NO: 1048275 - RNA, 22 nt, Human
agggcugccugacuccagagcc

SEQ ID NO: 1048276 - RNA, 22 nt, Human
aaaaauugcugagaacggaauu

SEQ ID NO: 1048277 - RNA, 22 nt, Human
caauuuuuguacuuauaguacu

SEQ ID NO: 1048278 - RNA, 22 nt, Human
ccuccugguaauuagcgaaagg

SEQ ID NO: 1048279 - RNA, 22 nt, Human
cuccuccagcucucccuggggg

SEQ ID NO: 1048280 - RNA, 22 nt, Human
ccugcccagagccccuuucacu

SEQ ID NO: 1048281 - RNA, 22 nt, Human
uggcccagcacuccaaguaggg

SEQ ID NO: 1048282 - RNA, 22 nt, Human
auagcuuuacagaagaguuuag

SEQ ID NO: 1048283 - RNA, 22 nt, Human
augcuuaagcucaguuauauau

SEQ ID NO: 1048284 - RNA, 22 nt, Human
caauuucaucuugugcuucaau

SEQ ID NO: 1048285 - RNA, 22 nt, Human
auuuccaauuucauccaugucc

SEQ ID NO: 1048286 - RNA, 17 nt, Human
aaggugagagcuguucu

SEQ ID NO: 1048287 - RNA, 22 nt, Human
aauuucaaguggcaucuuugau

SEQ ID NO: 1048288 - RNA, 22 nt, Human
uuuaggcauugggugcucaagu

SEQ ID NO: 1048289 - RNA, 20 nt, Human
cagccuccacucacucagcu

SEQ ID NO: 1048290 - RNA, 22 nt, Human
gagggcugauguugccaccuca

SEQ ID NO: 1048291 - RNA, 22 nt, Human
uccuuucaccaaaaaguguugu

SEQ ID NO: 1048292 - RNA, 22 nt, Human
uccuaggguuggagacagugac

SEQ ID NO: 1048293 - RNA, 22 nt, Human
uuccuuagugccucuuccgcug

SEQ ID NO: 1048294 - RNA, 22 nt, Human
guacagaauuaugccaugaggg

SEQ ID NO: 1048295 - RNA, 22 nt, Human
cuacagaaguuucccuugcuua

SEQ ID NO: 1048296 - RNA, 22 nt, Human
aguauuuagcauagugguuagu

SEQ ID NO: 1048297 - RNA, 22 nt, Human
ugagacaaagcagcugacagaa

SEQ ID NO: 1048298 - RNA, 22 nt, Human
gaccuccagcggcccugcagag

SEQ ID NO: 1048299 - RNA, 22 nt, Human
ccugcaccugagcagccugacu

SEQ ID NO: 1048300 - RNA, 22 nt, Human
agggcagcuaaggugcugacug

SEQ ID NO: 1048301 - RNA, 22 nt, Human
auuuagcaaaaaaugaugaagc

SEQ ID NO: 1048302 - RNA, 22 nt, Human
uccaacuuucuccuccggcuug

SEQ ID NO: 1048303 - RNA, 22 nt, Human
acagguuuuuguggauauaugu

SEQ ID NO: 1048304 - RNA, 22 nt, Human
augccaaagcccaaguucauca

SEQ ID NO: 1048305 - RNA, 22 nt, Human
gaauuucagagguaacaucauc

SEQ ID NO: 1048306 - RNA, 23 nt, Human
aagucaccaagaggaaggcggag

SEQ ID NO: 1048307 - RNA, 22 nt, Human
uuuggacaaguuacugguuucc

SEQ ID NO: 1048308 - RNA, 22 nt, Human
uaaaauguuugcaagagaccag

SEQ ID NO: 1048309 - RNA, 22 nt, Human
ugggcugcuuccucagcugaga

SEQ ID NO: 1048310 - RNA, 22 nt, Human
uucucuucaucucaguaaaugu

SEQ ID NO: 1048311 - RNA, 22 nt, Human
agagggaacggaucccagcgcg

SEQ ID NO: 1048312 - RNA, 22 nt, Human
uggcauuuagaaaacaacaugu

SEQ ID NO: 1048313 - RNA, 22 nt, Human
cauagcuuagggguuaaacuca

SEQ ID NO: 1048314 - RNA, 22 nt, Human
gggcagagacucagaaacagaa

SEQ ID NO: 1048315 - RNA, 22 nt, Human
gaguccuuuguuccuugccaca

SEQ ID NO: 1048316 - RNA, 19 nt, Human
ucugcccaguugucugccc

SEQ ID NO: 1048317 - RNA, 22 nt, Human
gcugcccagacauugaaucagg

SEQ ID NO: 1048318 - RNA, 22 nt, Human
ugauaauauuuugaaucauaag

SEQ ID NO: 1048319 - RNA, 22 nt, Human
ggcugcccucugcugacugcaa

SEQ ID NO: 1048320 - RNA, 23 nt, Human
uuacagaaaguaugcuuuuguuu

SEQ ID NO: 1048321 - RNA, 22 nt, Human
ccaaaauuauuacauuuguagg

SEQ ID NO: 1048322 - RNA, 22 nt, Human
guuccaaacaagucauaaagua

SEQ ID NO: 1048323 - RNA, 22 nt, Human
acugcccacaucucuuuccgcu

SEQ ID NO: 1048324 - RNA, 22 nt, Human
ucaaaauuagugaccaaaggca

SEQ ID NO: 1048325 - RNA, 22 nt, Human
agauaaugaaugccaugacauu

SEQ ID NO: 1048326 - RNA, 22 nt, Human
ugaggcagcauucuucaagaca

SEQ ID NO: 1048327 - RNA, 22 nt, Human
acaacuuuagucuggagggaaa

SEQ ID NO: 1048328 - RNA, 19 nt, Human
augcuuuauguuauuucuu

SEQ ID NO: 1048329 - RNA, 22 nt, Human
uggauuagugcugaaaugaugg

SEQ ID NO: 1048330 - RNA, 22 nt, Human
aucuaacagcaacaccagaaua

SEQ ID NO: 1048331 - RNA, 22 nt, Human
acuauacaccaaaauauuaagg

SEQ ID NO: 1048332 - RNA, 22 nt, Human
uagucaccagcuacaggacagc

SEQ ID NO: 1048333 - RNA, 22 nt, Human
ugaaugaacuaaaucauaguuc

SEQ ID NO: 1048334 - RNA, 22 nt, Human
cccaagggugcccagcagagga

SEQ ID NO: 1048335 - RNA, 22 nt, Human
gaaguccucaaugcauugucuu

SEQ ID NO: 1048336 - RNA, 22 nt, Human
uagaaacagaaaacuguaauag

SEQ ID NO: 1048337 - RNA, 22 nt, Human
cauggcuuuguucuguuagaug

SEQ ID NO: 1048338 - RNA, 22 nt, Human
gcugcaggcauuuuccugggca

SEQ ID NO: 1048339 - RNA, 22 nt, Human
uucagaaaugaauauugguauu

SEQ ID NO: 1048340 - RNA, 22 nt, Human
gcagggaagaucuuggagcugc

SEQ ID NO: 1048341 - RNA, 22 nt, Human
ucccagggcucuagagugcugg

SEQ ID NO: 1048342 - RNA, 22 nt, Human
caucauaaaauugagauaacug

SEQ ID NO: 1048343 - RNA, 22 nt, Human
caugaggauccaggugacaggc

SEQ ID NO: 1048344 - RNA, 22 nt, Human
acacaaacugcuagaaaauugg

SEQ ID NO: 1048345 - RNA, 22 nt, Human
gcugcccacaaccccgugucua

SEQ ID NO: 1048346 - RNA, 21 nt, Human
gcccagaguuaagcccaccca

SEQ ID NO: 1048347 - RNA, 22 nt, Human
ccagggaaucaggcagaaguca

SEQ ID NO: 1048348 - RNA, 22 nt, Human
ugaaauagucuaaaaaaccaga

SEQ ID NO: 1048349 - RNA, 22 nt, Human
cauuuacagugagaguuuuuac

SEQ ID NO: 1048350 - RNA, 22 nt, Human
gaccacagaggugugggagaga

SEQ ID NO: 1048351 - RNA, 22 nt, Human
ccagccucaucgccugccuguc

SEQ ID NO: 1048352 - RNA, 19 nt, Human
ucugcccacaagaaaggga

SEQ ID NO: 1048353 - RNA, 22 nt, Human
ucugcccaccagcgguugcaua

SEQ ID NO: 1048354 - RNA, 22 nt, Human
aguggaaggucaggggacagug

SEQ ID NO: 1048355 - RNA, 22 nt, Human
uuaaugauaccuauguuaauuu

SEQ ID NO: 1048356 - RNA, 22 nt, Human
ucagaauaugcuaaugacauuu

SEQ ID NO: 1048357 - RNA, 22 nt, Human
auacagaacucucaguuguaua

SEQ ID NO: 1048358 - RNA, 17 nt, Human
cuuuuaauuuacuuccc

SEQ ID NO: 1048359 - RNA, 22 nt, Human
uggagcaggacggggaguggua

SEQ ID NO: 1048360 - RNA, 17 nt, Human
cccugccaccaggaagc

SEQ ID NO: 1048361 - RNA, 22 nt, Human
ucuccagguggcuugggcuucu

SEQ ID NO: 1048362 - RNA, 17 nt, Human
guggagacagaugccuc

SEQ ID NO: 1048363 - RNA, 22 nt, Human
gauuuacagaucuaagggucac

SEQ ID NO: 1048364 - RNA, 22 nt, Human
ucuuuacaaucuaagcauaguu

SEQ ID NO: 1048365 - RNA, 22 nt, Human
caauuucaugccauguauugcu

SEQ ID NO: 1048366 - RNA, 22 nt, Human
aaaucucaauuugaauuguagc

SEQ ID NO: 1048367 - RNA, 22 nt, Human
caagaaucaacauuauuuagug

SEQ ID NO: 1048368 - RNA, 22 nt, Human
gggagccaaggagagaggccuu

SEQ ID NO: 1048369 - RNA, 22 nt, Human
ucuuuaauguacuuucuuucac

SEQ ID NO: 1048370 - RNA, 22 nt, Human
gaauuuuucuggaagcaauuau

SEQ ID NO: 1048371 - RNA, 22 nt, Human
gccagggaaacugcagaccagc

SEQ ID NO: 1048372 - RNA, 22 nt, Human
aagucacccuagggccuggacu

SEQ ID NO: 1048373 - RNA, 22 nt, Human
gggucugcuccaccugcagccc

SEQ ID NO: 1048374 - RNA, 22 nt, Human
aaguuucaugauguaauuauug

SEQ ID NO: 1048375 - RNA, 22 nt, Human
uguucuuucaguuagacacagu

SEQ ID NO: 1048376 - RNA, 22 nt, Human
gggagaaggaggacugugcugu

SEQ ID NO: 1048377 - RNA, 22 nt, Human
ggugagacuuuagaagagccag

SEQ ID NO: 1048378 - RNA, 21 nt, Human
gccagggaagagaguuggcug

SEQ ID NO: 1048379 - RNA, 22 nt, Human
agaauaaucacugaaguucaaa

SEQ ID NO: 1048380 - RNA, 22 nt, Human
agccuguguccucaucugcagc

SEQ ID NO: 1048381 - RNA, 19 nt, Human
uccagcccuguucccuuuu

SEQ ID NO: 1048382 - RNA, 22 nt, Human
cagggcccugcucaauuucucc

SEQ ID NO: 1048383 - RNA, 22 nt, Human
uaaaguuuguagcaauugauau

SEQ ID NO: 1048384 - RNA, 22 nt, Human
uaagaaucggucgcaacagagg

SEQ ID NO: 1048385 - RNA, 22 nt, Human
caaguccaggucaauuuaaagc

SEQ ID NO: 1048386 - RNA, 22 nt, Human
uagaacauaagucauucauuug

SEQ ID NO: 1048387 - RNA, 22 nt, Human
cuccagugucucagagcagaug

SEQ ID NO: 1048388 - RNA, 22 nt, Human
ccagggaagcuggucacgcagg

SEQ ID NO: 1048389 - RNA, 22 nt, Human
ucagaauuuuuguuacccuuga

SEQ ID NO: 1048390 - RNA, 21 nt, Human
aggauuuacuauuaacugugu

SEQ ID NO: 1048391 - RNA, 22 nt, Human
aaaucaguucucccuuucuuca

SEQ ID NO: 1048392 - RNA, 22 nt, Human
uucagaaagguaaauggauuuc

SEQ ID NO: 1048393 - RNA, 22 nt, Human
gauaaugaugacaaugacaacc

SEQ ID NO: 1048394 - RNA, 21 nt, Human
ccaagacucccaucuaguggu

SEQ ID NO: 1048395 - RNA, 22 nt, Human
gcagcccaggaggcgggagccc

SEQ ID NO: 1048396 - RNA, 22 nt, Human
uuucaacuuguuugcuuccaua

SEQ ID NO: 1048397 - RNA, 22 nt, Human
acugcccauuaaaggugcuuug

SEQ ID NO: 1048398 - RNA, 22 nt, Human
ucagggagaggugagagccugu

SEQ ID NO: 1048399 - RNA, 22 nt, Human
cagcccugcagcuggaucucac

SEQ ID NO: 1048400 - RNA, 22 nt, Human
ccagggaggagcauuucauggu

SEQ ID NO: 1048401 - RNA, 20 nt, Human
agaaaaaguguggaaauuuc

SEQ ID NO: 1048402 - RNA, 22 nt, Human
acauaauaaaaauaacagcuca

SEQ ID NO: 1048403 - RNA, 22 nt, Human
ugggcugcugagaaugagagag

SEQ ID NO: 1048404 - RNA, 22 nt, Human
uggcuuuacugucauucuuaug

SEQ ID NO: 1048405 - RNA, 22 nt, Human
uuguccaaaguaacacaucuag

SEQ ID NO: 1048406 - RNA, 22 nt, Human
uaucuaaauggaauauuccaga

SEQ ID NO: 1048407 - RNA, 19 nt, Human
ugggagaggcaacagagua

SEQ ID NO: 1048408 - RNA, 22 nt, Human
ggauucagugucuguuaauagu

SEQ ID NO: 1048409 - RNA, 22 nt, Human
aggcagcauuucugcuuaucca

SEQ ID NO: 1048410 - RNA, 22 nt, Human
gacagggaggaaagagacugcu

SEQ ID NO: 1048411 - RNA, 22 nt, Human
aaguccuucccaagcauguacc

SEQ ID NO: 1048412 - RNA, 22 nt, Human
aagggagacccaccguccugga

SEQ ID NO: 1048413 - RNA, 22 nt, Human
caaagcagccugcaguguggac

SEQ ID NO: 1048414 - RNA, 22 nt, Human
agggcccuagggaaugagacau

SEQ ID NO: 1048415 - RNA, 22 nt, Human
cggagaggugggggcagcaucu

SEQ ID NO: 1048416 - RNA, 22 nt, Human
aaaguccuguuaacuguuaaca

SEQ ID NO: 1048417 - RNA, 22 nt, Human
aaagggagcauggcugcaggga

SEQ ID NO: 1048418 - RNA, 22 nt, Human
ggggcugcuucaccuuuuuacg

SEQ ID NO: 1048419 - RNA, 22 nt, Human
ucugaagauuaccagcuaaaug

SEQ ID NO: 1048420 - RNA, 22 nt, Human
ucugcccacagccuccugucca

SEQ ID NO: 1048421 - RNA, 22 nt, Human
aaauugaaugauuaagugguga

SEQ ID NO: 1048422 - RNA, 22 nt, Human
gaguccuuuugugccacaggga

SEQ ID NO: 1048423 - RNA, 22 nt, Human
caauuucagugcuguggagagg

SEQ ID NO: 1048424 - RNA, 23 nt, Human
aggagccccuaauucugggcagc

SEQ ID NO: 1048425 - RNA, 19 nt, Human
aagggcugggcaccucacu

SEQ ID NO: 1048426 - RNA, 22 nt, Human
uaaagccacuucauucuagucu

SEQ ID NO: 1048427 - RNA, 22 nt, Human
aaaucagucccucuuggaauuu

SEQ ID NO: 1048428 - RNA, 22 nt, Human
ucugaagaacugaguaaacaug

SEQ ID NO: 1048429 - RNA, 22 nt, Human
caaguccucaaagggcucugcu

SEQ ID NO: 1048430 - RNA, 21 nt, Human
ucauucacaggguauuguaua

SEQ ID NO: 1048431 - RNA, 21 nt, Human
acaugucuggucauuuuuagc

SEQ ID NO: 1048432 - RNA, 22 nt, Human
uggcuuuaaaucuguauucaua

SEQ ID NO: 1048433 - RNA, 22 nt, Human
ccuggaucuccucuauucauau

SEQ ID NO: 1048434 - RNA, 22 nt, Human
uucccaauauucugcuuuuaug

SEQ ID NO: 1048435 - RNA, 22 nt, Human
guuaggcagcccaagaugucag

SEQ ID NO: 1048436 - RNA, 22 nt, Human
gcugcccagcaggccccagggg

SEQ ID NO: 1048437 - RNA, 22 nt, Human
cugaauaauuuuauaguugcug

SEQ ID NO: 1048438 - RNA, 22 nt, Human
uccagggagcaagucaggccgg

SEQ ID NO: 1048439 - RNA, 22 nt, Human
gucaacuugcaagaugcugggc

SEQ ID NO: 1048440 - RNA, 22 nt, Human
ucaguaaaugaaugaauauaug

SEQ ID NO: 1048441 - RNA, 22 nt, Human
gagucaccuuggccgcuguccc

SEQ ID NO: 1048442 - RNA, 23 nt, Human
ugcugcccacucuuccagcccuc

SEQ ID NO: 1048443 - RNA, 22 nt, Human
uaggauuuaggcuuuaacaucu

SEQ ID NO: 1048444 - RNA, 22 nt, Human
gcucuaauugaaaaauacugca

SEQ ID NO: 1048445 - RNA, 22 nt, Human
ccagcccuuugugguucacuga

SEQ ID NO: 1048446 - RNA, 21 nt, Human
auagaacaccaggcauauaua

SEQ ID NO: 1048447 - RNA, 22 nt, Human
caguccuugcuaugacccugag

SEQ ID NO: 1048448 - RNA, 22 nt, Human
caguaaauuaucucaucucugu

SEQ ID NO: 1048449 - RNA, 22 nt, Human
uagaauucaagauucaacaggc

SEQ ID NO: 1048450 - RNA, 22 nt, Human
aaugggauaauuguucauggga

SEQ ID NO: 1048451 - RNA, 22 nt, Human
augaauaaaacauuuuaaucag

SEQ ID NO: 1048452 - RNA, 22 nt, Human
agugggaaacuggagagacuuc

SEQ ID NO: 1048453 - RNA, 22 nt, Human
gcuucacaggcaaguuaagccu

SEQ ID NO: 1048454 - RNA, 22 nt, Human
cuuaaagaaauugaggagagga

SEQ ID NO: 1048455 - RNA, 22 nt, Human
aagagggaggugcgggugcaga

SEQ ID NO: 1048456 - RNA, 22 nt, Human
gggacacagagaaacuggagaa

SEQ ID NO: 1048457 - RNA, 22 nt, Human
auuucacaucuaucucagauuu

SEQ ID NO: 1048458 - RNA, 22 nt, Human
agggcugcaaugggagauaacu

SEQ ID NO: 1048459 - RNA, 22 nt, Human
cuugucaguguacuuucuuuug

SEQ ID NO: 1048460 - RNA, 22 nt, Human
gauuucaaaaguagauccauca

SEQ ID NO: 1048461 - RNA, 22 nt, Human
ugcuuuaagacacuaaguuuga

SEQ ID NO: 1048462 - RNA, 22 nt, Human
gaauaaucaugaaauucaguga

SEQ ID NO: 1048463 - RNA, 22 nt, Human
agcagggccuggcacuccuggg

SEQ ID NO: 1048464 - RNA, 22 nt, Human
agagugaaguuuuugaaaguga

SEQ ID NO: 1048465 - RNA, 22 nt, Human
uuagaaaucaccucugaagauc

SEQ ID NO: 1048466 - RNA, 22 nt, Human
ugucaccaguuccaggaaauaa

SEQ ID NO: 1048467 - RNA, 22 nt, Human
uucagaaacagagugagugagu

SEQ ID NO: 1048468 - RNA, 22 nt, Human
cagccucuguggcugccacacc

SEQ ID NO: 1048469 - RNA, 18 nt, Human
aagucaccccugcucccu

SEQ ID NO: 1048470 - RNA, 22 nt, Human
aggauuuacaaugauucuaggu

SEQ ID NO: 1048471 - RNA, 19 nt, Human
guuccaaaggccagaccuu

SEQ ID NO: 1048472 - RNA, 22 nt, Human
uuccaaacugccaauucagaag

SEQ ID NO: 1048473 - RNA, 22 nt, Human
acagggaaggagcauagaaaaa

SEQ ID NO: 1048474 - RNA, 23 nt, Human
aaucuauacuuaggcugguaaua

SEQ ID NO: 1048475 - RNA, 22 nt, Human
caggaggggguggaguuucgcc

SEQ ID NO: 1048476 - RNA, 22 nt, Human
augcuuuagugucaaguuuggg

SEQ ID NO: 1048477 - RNA, 22 nt, Human
uuacaaaguguuaugauaaaca

SEQ ID NO: 1048478 - RNA, 22 nt, Human
cuccuuccccuacucagcaucc

SEQ ID NO: 1048479 - RNA, 22 nt, Human
aaaucauguuggcacaauaaaa

SEQ ID NO: 1048480 - RNA, 21 nt, Human
aggagggcacaaggccaggaa

SEQ ID NO: 1048481 - RNA, 22 nt, Human
augguuuugaagggaggucaaa

SEQ ID NO: 1048482 - RNA, 22 nt, Human
uucacagaguuauuuuuaugcu

SEQ ID NO: 1048483 - RNA, 22 nt, Human
agugggagaaugaauaagggcc

SEQ ID NO: 1048484 - RNA, 22 nt, Human
aagacuuucaaguaugcaugca

SEQ ID NO: 1048485 - RNA, 22 nt, Human
aagacaugacugcacagccaaa

SEQ ID NO: 1048486 - RNA, 23 nt, Human
agacauggcaggaauacagcuuc

SEQ ID NO: 1048487 - RNA, 22 nt, Human
uuuuugcugauaagcagaauuc

SEQ ID NO: 1048488 - RNA, 22 nt, Human
gaauauauuggugaaaauaguu

SEQ ID NO: 1048489 - RNA, 22 nt, Human
ggaggagguggguuaaguugua

SEQ ID NO: 1048490 - RNA, 22 nt, Human
caauuucacugacacccuggaa

SEQ ID NO: 1048491 - RNA, 22 nt, Human
aauaauuacccaucuuuuugua

SEQ ID NO: 1048492 - RNA, 23 nt, Human
ucuccaggccuuacuccaggccu

SEQ ID NO: 1048493 - RNA, 22 nt, Human
ccauggcuuuugagucucaaga

SEQ ID NO: 1048494 - RNA, 22 nt, Human
auaggcuuauauaaaaacaucu

SEQ ID NO: 1048495 - RNA, 22 nt, Human
aaagcagucacuccagugugau

SEQ ID NO: 1048496 - RNA, 18 nt, Human
ugagacagcuaccacuug

SEQ ID NO: 1048497 - RNA, 22 nt, Human
gagagggcucuguguggguacu

SEQ ID NO: 1048498 - RNA, 22 nt, Human
agaauuccuccucugggacacu

SEQ ID NO: 1048499 - RNA, 22 nt, Human
ugcuauacauguacauauuagu

SEQ ID NO: 1048500 - RNA, 22 nt, Human
uccagaauacucugaaaucauu

SEQ ID NO: 1048501 - RNA, 22 nt, Human
cuccaggguuccccgauccacu

SEQ ID NO: 1048502 - RNA, 22 nt, Human
ugaggaggugggcacacagagu

SEQ ID NO: 1048503 - RNA, 22 nt, Human
cucaccacagagccuguccagc

SEQ ID NO: 1048504 - RNA, 22 nt, Human
uaaucauggccucaaauuuuau

SEQ ID NO: 1048505 - RNA, 22 nt, Human
uacagauauagagauuuauaga

SEQ ID NO: 1048506 - RNA, 22 nt, Human
cuacagaauucaacaaaugguu

SEQ ID NO: 1048507 - RNA, 23 nt, Human
uguaacaauuucauauacaugca

SEQ ID NO: 1048508 - RNA, 22 nt, Human
aggcagcauccagaggagaaug

SEQ ID NO: 1048509 - RNA, 22 nt, Human
gguuuaauggagauauuucaga

SEQ ID NO: 1048510 - RNA, 22 nt, Human
uuggaucaaauuucaugcuguc

SEQ ID NO: 1048511 - RNA, 22 nt, Human
ucuccaggcccacugauuuaua

SEQ ID NO: 1048512 - RNA, 22 nt, Human
ucagaauuugauuccugggaua

SEQ ID NO: 1048513 - RNA, 22 nt, Human
uugguacaaaaguaacuguggu

SEQ ID NO: 1048514 - RNA, 22 nt, Human
ucagggaaauucaagggagauu

SEQ ID NO: 1048515 - RNA, 22 nt, Human
gaguucuaaaggcagaacauaa

SEQ ID NO: 1048516 - RNA, 22 nt, Human
ucagggaaucagacucugcagc

SEQ ID NO: 1048517 - RNA, 22 nt, Human
agaugcugauugaauagauuuc

SEQ ID NO: 1048518 - RNA, 22 nt, Human
gcccuggcaccucguugcccag

SEQ ID NO: 1048519 - RNA, 22 nt, Human
ucagggaaccucuccuguuucu

SEQ ID NO: 1048520 - RNA, 20 nt, Human
guggagaggcuggcgggacu

SEQ ID NO: 1048521 - RNA, 22 nt, Human
aaugggauaggucuucaggaau

SEQ ID NO: 1048522 - RNA, 22 nt, Human
uggguuuaaacucaacucuaaa

SEQ ID NO: 1048523 - RNA, 22 nt, Human
gcaaacaagcugccugaagauu

SEQ ID NO: 1048524 - RNA, 22 nt, Human
ucagggagauuuggggacucaa

SEQ ID NO: 1048525 - RNA, 22 nt, Human
cauggcuuguaauaaauuuaua

SEQ ID NO: 1048526 - RNA, 22 nt, Human
ucaaaauuucagcacuagcccu

SEQ ID NO: 1048527 - RNA, 22 nt, Human
caguaucugucaguaaucaggu

SEQ ID NO: 1048528 - RNA, 22 nt, Human
cuacagaaggagaaauggguaa

SEQ ID NO: 1048529 - RNA, 22 nt, Human
acuuuuaugauaaucaauguuc

SEQ ID NO: 1048530 - RNA, 22 nt, Human
gggccugccauugcugccccag

SEQ ID NO: 1048531 - RNA, 22 nt, Human
uagaacuacaagcauuaaaagu

SEQ ID NO: 1048532 - RNA, 22 nt, Human
ucugcccacaguccaauaguug

SEQ ID NO: 1048533 - RNA, 22 nt, Human
uuccuuaguugacugucuuagu

SEQ ID NO: 1048534 - RNA, 22 nt, Human
acaucugaccauuacaagacau

SEQ ID NO: 1048535 - RNA, 22 nt, Human
uucaccacagucucaucuacgc

SEQ ID NO: 1048536 - RNA, 22 nt, Human
caucagaauguuagagaaggga

SEQ ID NO: 1048537 - RNA, 22 nt, Human
gcuggaucauauggugguucua

SEQ ID NO: 1048538 - RNA, 16 nt, Human
ccaccugcagcucuca

SEQ ID NO: 1048539 - RNA, 22 nt, Human
aguuauccgaaggcacugagau

SEQ ID NO: 1048540 - RNA, 22 nt, Human
ggccagggaggagaggccccug

SEQ ID NO: 1048541 - RNA, 22 nt, Human
cauggcuuuccaguccuccacu

SEQ ID NO: 1048542 - RNA, 22 nt, Human
ugucagccuugcuuuagcgguu

SEQ ID NO: 1048543 - RNA, 22 nt, Human
uuccuuagccugccuuccaggg

SEQ ID NO: 1048544 - RNA, 22 nt, Human
augagggaggcaaggagaugcu

SEQ ID NO: 1048545 - RNA, 22 nt, Human
auuccaaacgccucgcggacuu

SEQ ID NO: 1048546 - RNA, 22 nt, Human
agcccagcuuucaccccucugg

SEQ ID NO: 1048547 - RNA, 22 nt, Human
gcuccagguggcuuauuuguau

SEQ ID NO: 1048548 - RNA, 22 nt, Human
aaacuuuggauugugauugugc

SEQ ID NO: 1048549 - RNA, 22 nt, Human
gauggcaaacugggaccagagg

SEQ ID NO: 1048550 - RNA, 22 nt, Human
uuccaggggcagcagugauggu

SEQ ID NO: 1048551 - RNA, 22 nt, Human
uucaaguuuugccuccccaucc

SEQ ID NO: 1048552 - RNA, 21 nt, Human
ucagggaagugugcagaaggg

SEQ ID NO: 1048553 - RNA, 22 nt, Human
uccagcucaaagugcuccuguc

SEQ ID NO: 1048554 - RNA, 22 nt, Human
ucagggaaauagcagggcugaa

SEQ ID NO: 1048555 - RNA, 22 nt, Human
uaagaaucaguagauauagauu

SEQ ID NO: 1048556 - RNA, 21 nt, Human
uccagccuuucccucacuucc

SEQ ID NO: 1048557 - RNA, 22 nt, Human
ugggaccagauaaagggagguc

SEQ ID NO: 1048558 - RNA, 21 nt, Human
ucaguaaaccuaaagauugua

SEQ ID NO: 1048559 - RNA, 22 nt, Human
aaguccuuuauccuaaaagguc

SEQ ID NO: 1048560 - RNA, 22 nt, Human
aucagaaauugcuaccagugga

SEQ ID NO: 1048561 - RNA, 22 nt, Human
ccuccuggugacaaggcaaagc

SEQ ID NO: 1048562 - RNA, 22 nt, Human
acauggggcccaaagagagguc

SEQ ID NO: 1048563 - RNA, 21 nt, Human
ccuccaggagcagagcccuga

SEQ ID NO: 1048564 - RNA, 22 nt, Human
agaaaucaugucuuauuucuau

SEQ ID NO: 1048565 - RNA, 22 nt, Human
cauucacauucuucuuacuguu

SEQ ID NO: 1048566 - RNA, 22 nt, Human
agcugccccaugagaggcaggu

SEQ ID NO: 1048567 - RNA, 22 nt, Human
ccagggaagaaagaugaagugc

SEQ ID NO: 1048568 - RNA, 22 nt, Human
acagaugauuuuuaugaaaaca

SEQ ID NO: 1048569 - RNA, 22 nt, Human
gggauuuaguaggauaguauac

SEQ ID NO: 1048570 - RNA, 21 nt, Human
ccagagagagggaaguggguu

SEQ ID NO: 1048571 - RNA, 22 nt, Human
ccagucacucugugagagcuac

SEQ ID NO: 1048572 - RNA, 22 nt, Human
uguccuuacaaggucccuuucg

SEQ ID NO: 1048573 - RNA, 22 nt, Human
gguacaauccacuguggguuag

SEQ ID NO: 1048574 - RNA, 22 nt, Human
cuuaaagaugucaaggcuguuu

SEQ ID NO: 1048575 - RNA, 22 nt, Human
uccagggcuugacagggugccu

SEQ ID NO: 1048576 - RNA, 22 nt, Human
uuccaaagugcuggaauuacau

SEQ ID NO: 1048577 - RNA, 22 nt, Human
aaagcagcugcucuggccuuga

SEQ ID NO: 1048578 - RNA, 22 nt, Human
uuacagaacugcccuaguuggc

SEQ ID NO: 1048579 - RNA, 22 nt, Human
caucagaaccaguggggacauu

SEQ ID NO: 1048580 - RNA, 22 nt, Human
uccagccuaauguucuucccac

SEQ ID NO: 1048581 - RNA, 22 nt, Human
uggcauuugcucccuuguguuc

SEQ ID NO: 1048582 - RNA, 22 nt, Human
ggcagugagucccggagaggcc

SEQ ID NO: 1048583 - RNA, 19 nt, Human
agaggcagucuccaacagg

SEQ ID NO: 1048584 - RNA, 22 nt, Human
cagggaagaauaguuagcaaag

SEQ ID NO: 1048585 - RNA, 22 nt, Human
agaggaggauuuguaaaggucu

SEQ ID NO: 1048586 - RNA, 22 nt, Human
uuuaauauuucuuuccugaagc

SEQ ID NO: 1048587 - RNA, 22 nt, Human
aaaucaguucacguucugaggu

SEQ ID NO: 1048588 - RNA, 22 nt, Human
gagauggccagugccaggacaa

SEQ ID NO: 1048589 - RNA, 22 nt, Human
ggggagcagaagcagcaacaac

SEQ ID NO: 1048590 - RNA, 22 nt, Human
caguggaggccuugggaccuuu

SEQ ID NO: 1048591 - RNA, 22 nt, Human
uguaacaauuucuuacuauugu

SEQ ID NO: 1048592 - RNA, 22 nt, Human
aguccagugaacuguaaauagg

SEQ ID NO: 1048593 - RNA, 22 nt, Human
cagaauuuaaguggauuauucu

SEQ ID NO: 1048594 - RNA, 22 nt, Human
ccuggaucuuuguuguaaauau

SEQ ID NO: 1048595 - RNA, 22 nt, Human
aaaguccagagggcacacugaa

SEQ ID NO: 1048596 - RNA, 22 nt, Human
ugcacaaacuugugucccaggg

SEQ ID NO: 1048597 - RNA, 22 nt, Human
augaaacaguguguauagcaaa

SEQ ID NO: 1048598 - RNA, 22 nt, Human
accagcuccaggccccugcugg

SEQ ID NO: 1048599 - RNA, 22 nt, Human
acagcauugcuccaucucaaga

SEQ ID NO: 1048600 - RNA, 22 nt, Human
uccagggacagcgcuggagcua

SEQ ID NO: 1048601 - RNA, 22 nt, Human
auuauccagcaccaaugucaga

SEQ ID NO: 1048602 - RNA, 20 nt, Human
uauuccaaggguagagaaaa

SEQ ID NO: 1048603 - RNA, 22 nt, Human
guaaacauuacugugcuguaua

SEQ ID NO: 1048604 - RNA, 22 nt, Human
cauauaauguuugaagaugugg

SEQ ID NO: 1048605 - RNA, 22 nt, Human
gcagggcagaccuccagccuau

SEQ ID NO: 1048606 - RNA, 21 nt, Human
uuucugucucugccacuaguu

SEQ ID NO: 1048607 - RNA, 22 nt, Human
uauaaaauggcaucagcuccaa

SEQ ID NO: 1048608 - RNA, 22 nt, Human
auuacaagaugcauccauauuu

SEQ ID NO: 1048609 - RNA, 22 nt, Human
ggcauuuaguuuucauauucug

SEQ ID NO: 1048610 - RNA, 22 nt, Human
ccaucuccaaauaccaucacau

SEQ ID NO: 1048611 - RNA, 22 nt, Human
gcagaauuggauaguugugaua

SEQ ID NO: 1048612 - RNA, 22 nt, Human
augaaaauucuaugcaggccag

SEQ ID NO: 1048613 - RNA, 22 nt, Human
uuuaggcagcagugaggaugaa

SEQ ID NO: 1048614 - RNA, 22 nt, Human
cuggcuuucuguuauaaagaca

SEQ ID NO: 1048615 - RNA, 22 nt, Human
auuccaaagacagaagcagcug

SEQ ID NO: 1048616 - RNA, 22 nt, Human
acagggccagccugggaccugg

SEQ ID NO: 1048617 - RNA, 22 nt, Human
ugaauaaucauguccauagugu

SEQ ID NO: 1048618 - RNA, 22 nt, Human
uaucagaaggcacauggagucu

SEQ ID NO: 1048619 - RNA, 22 nt, Human
agaggaggcuggguccagauaa

SEQ ID NO: 1048620 - RNA, 22 nt, Human
aggcagaccaugaaucaugacc

SEQ ID NO: 1048621 - RNA, 22 nt, Human
ucagaaauacaaaacacuuacu

SEQ ID NO: 1048622 - RNA, 22 nt, Human
cuuuacauaaggauaaaccugg

SEQ ID NO: 1048623 - RNA, 22 nt, Human
uuauuccauucaguucaacaag

SEQ ID NO: 1048624 - RNA, 22 nt, Human
cauuuacaauguacagguugug

SEQ ID NO: 1048625 - RNA, 22 nt, Human
acuggaucagaaucugauuuuu

SEQ ID NO: 1048626 - RNA, 22 nt, Human
auccaaacauguaccacacuaa

SEQ ID NO: 1048627 - RNA, 22 nt, Human
gcccagggcugcaaguggacgc

SEQ ID NO: 1048628 - RNA, 22 nt, Human
agggcugcuccuccuucaggcc

SEQ ID NO: 1048629 - RNA, 22 nt, Human
gucagcauaguucacacacagu

SEQ ID NO: 1048630 - RNA, 22 nt, Human
auggcuuuguuccaauaaaacu

SEQ ID NO: 1048631 - RNA, 22 nt, Human
augaaacacacacgcgcauacu

SEQ ID NO: 1048632 - RNA, 22 nt, Human
aaagaaucacauccuucagcaa

SEQ ID NO: 1048633 - RNA, 22 nt, Human
uaaguccuaacagacugggggc

SEQ ID NO: 1048634 - RNA, 22 nt, Human
ugcugagaucugccaguagaug

SEQ ID NO: 1048635 - RNA, 22 nt, Human
ucccagggugcgccugcccucg

SEQ ID NO: 1048636 - RNA, 22 nt, Human
cauuuggccauuccagucacau

SEQ ID NO: 1048637 - RNA, 22 nt, Human
uacacauguuuggcaaguaugu

SEQ ID NO: 1048638 - RNA, 22 nt, Human
uggggccagcggggaggacuca

SEQ ID NO: 1048639 - RNA, 22 nt, Human
caggcagcugggucaccguccc

SEQ ID NO: 1048640 - RNA, 22 nt, Human
uaauuauaacaguuacaucuua

SEQ ID NO: 1048641 - RNA, 22 nt, Human
uucuaacaaguggcuuguuagu

SEQ ID NO: 1048642 - RNA, 22 nt, Human
aaucauaauucaaauaagcuua

SEQ ID NO: 1048643 - RNA, 22 nt, Human
uaauuucaaauuucuuagcgug

SEQ ID NO: 1048644 - RNA, 22 nt, Human
gagggcccuggcuucuugcugg

SEQ ID NO: 1048645 - RNA, 22 nt, Human
uccuccagagauuugaguuauu

SEQ ID NO: 1048646 - RNA, 22 nt, Human
uuuccaaaguugccauaagcuu

SEQ ID NO: 1048647 - RNA, 22 nt, Human
ccagggaaugauauuuuugccu

SEQ ID NO: 1048648 - RNA, 22 nt, Human
uauacagaaagaauucaagucu

SEQ ID NO: 1048649 - RNA, 22 nt, Human
acagccaggaggaacucaguga

SEQ ID NO: 1048650 - RNA, 22 nt, Human
uaugaaaauuuagcugaagcau

SEQ ID NO: 1048651 - RNA, 22 nt, Human
ggacauggaaaucggcuugcuc

SEQ ID NO: 1048652 - RNA, 22 nt, Human
uuucuagugguuaagauuuaca

SEQ ID NO: 1048653 - RNA, 22 nt, Human
cauacuuugggauaagagugga

SEQ ID NO: 1048654 - RNA, 20 nt, Human
ggucagccccaccuggcagc

SEQ ID NO: 1048655 - RNA, 22 nt, Human
ucuccaggugcuaagugugccu

SEQ ID NO: 1048656 - RNA, 22 nt, Human
gauagaaagaauauagauucca

SEQ ID NO: 1048657 - RNA, 22 nt, Human
ucaccgucgggggucgcugucu

SEQ ID NO: 1048658 - RNA, 22 nt, Human
agacaagacuaggcaguuguug

SEQ ID NO: 1048659 - RNA, 22 nt, Human
cagauaaaggcuuacuaguagu

SEQ ID NO: 1048660 - RNA, 18 nt, Human
aaguccuuccuuugcuuu

SEQ ID NO: 1048661 - RNA, 22 nt, Human
gaguggggcuuuaaaggcucag

SEQ ID NO: 1048662 - RNA, 22 nt, Human
cacaauacuauuuuuaggucuu

SEQ ID NO: 1048663 - RNA, 22 nt, Human
aauucacaaaaguuagauccau

SEQ ID NO: 1048664 - RNA, 22 nt, Human
uuugaagucaaagauugauucc

SEQ ID NO: 1048665 - RNA, 22 nt, Human
gcuauacaaguguagaauagag

SEQ ID NO: 1048666 - RNA, 22 nt, Human
aagaaugauuacaaagcaacga

SEQ ID NO: 1048667 - RNA, 22 nt, Human
ccaccaggacagcccugagggg

SEQ ID NO: 1048668 - RNA, 22 nt, Human
agcaggaggguuuuguagaguc

SEQ ID NO: 1048669 - RNA, 22 nt, Human
aauuucaaacucuugcccucag

SEQ ID NO: 1048670 - RNA, 22 nt, Human
uguccuuaaggagcuuaauguc

SEQ ID NO: 1048671 - RNA, 22 nt, Human
ugggcugcaccuuuguaaaucu

SEQ ID NO: 1048672 - RNA, 22 nt, Human
cauggauugaauauaaauuaga

SEQ ID NO: 1048673 - RNA, 22 nt, Human
uucaacuuuaugcauauguauu

SEQ ID NO: 1048674 - RNA, 22 nt, Human
uagaauaugauuaauuuucuua

SEQ ID NO: 1048675 - RNA, 22 nt, Human
acaugcuuguuuuucacaaccu

SEQ ID NO: 1048676 - RNA, 22 nt, Human
caacuuuucugugaauuuaagu

SEQ ID NO: 1048677 - RNA, 22 nt, Human
cauuucaaggaccacccuggga

SEQ ID NO: 1048678 - RNA, 22 nt, Human
cuagauccauuuucugucucug

SEQ ID NO: 1048679 - RNA, 22 nt, Human
uggcuuaauauuucauauuuaa

SEQ ID NO: 1048680 - RNA, 19 nt, Human
accagcccacucccaguuu

SEQ ID NO: 1048681 - RNA, 22 nt, Human
cccaggaaauagccaggaggug

SEQ ID NO: 1048682 - RNA, 22 nt, Human
uuguuucauggggauguuuauu

SEQ ID NO: 1048683 - RNA, 22 nt, Human
aucuauacccaucaugauuuaa

SEQ ID NO: 1048684 - RNA, 22 nt, Human
aguccuuagaacagugccuggg

SEQ ID NO: 1048685 - RNA, 22 nt, Human
caucagaaaccuugaggaaacu

SEQ ID NO: 1048686 - RNA, 22 nt, Human
aaagucaucagaaccuuccaga

SEQ ID NO: 1048687 - RNA, 22 nt, Human
gaguggggcccacugcugggug

SEQ ID NO: 1048688 - RNA, 22 nt, Human
uguacaaucuuggucccuuuau

SEQ ID NO: 1048689 - RNA, 21 nt, Human
agcugcccagaguagggaagg

SEQ ID NO: 1048690 - RNA, 22 nt, Human
gggccaugagagguucaucaac

SEQ ID NO: 1048691 - RNA, 22 nt, Human
aauuucaagucuugaagaagua

SEQ ID NO: 1048692 - RNA, 22 nt, Human
uaguacaguuuaaauauuaaua

SEQ ID NO: 1048693 - RNA, 22 nt, Human
gcugcccauugcacguuguggc

SEQ ID NO: 1048694 - RNA, 22 nt, Human
ugggagaguuuguuuagaguga

SEQ ID NO: 1048695 - RNA, 18 nt, Human
ugaaacaagaauggugca

SEQ ID NO: 1048696 - RNA, 22 nt, Human
aaucaaaaccuacagagguaau

SEQ ID NO: 1048697 - RNA, 23 nt, Human
uugcacauuggagcuggucuucu

SEQ ID NO: 1048698 - RNA, 22 nt, Human
ugaaacaaauuuggaaaaucua

SEQ ID NO: 1048699 - RNA, 22 nt, Human
auccuuggaugugucuuuuugu

SEQ ID NO: 1048700 - RNA, 22 nt, Human
caaugaaauugagauccagaga

SEQ ID NO: 1048701 - RNA, 22 nt, Human
cuccuccaguccuccaaggaca

SEQ ID NO: 1048702 - RNA, 22 nt, Human
acagaauuaucaggaaauguua

SEQ ID NO: 1048703 - RNA, 22 nt, Human
gauagaaagagugguucuuuuu

SEQ ID NO: 1048704 - RNA, 22 nt, Human
uaaguccuucaccuaauccuca

SEQ ID NO: 1048705 - RNA, 22 nt, Human
uauggcuuuaaacaacuuaggu

SEQ ID NO: 1048706 - RNA, 22 nt, Human
uuuaucuguuguacauuuaugc

SEQ ID NO: 1048707 - RNA, 22 nt, Human
uggcuuaagcgcaacucugucu

SEQ ID NO: 1048708 - RNA, 22 nt, Human
guacagaaaguacccauagaag

SEQ ID NO: 1048709 - RNA, 22 nt, Human
ccaugcacaccagcaggcagac

SEQ ID NO: 1048710 - RNA, 22 nt, Human
gaaugaauucagcacauggaau

SEQ ID NO: 1048711 - RNA, 23 nt, Human
acuuuauccuauaucuuuguucu

SEQ ID NO: 1048712 - RNA, 22 nt, Human
uggauuuaccacagggccacag

SEQ ID NO: 1048713 - RNA, 22 nt, Human
ugaaacaaugugaaguugcuga

SEQ ID NO: 1048714 - RNA, 22 nt, Human
aggagggagcacuauaugggga

SEQ ID NO: 1048715 - RNA, 22 nt, Human
agauucuacucuagauccaugg

SEQ ID NO: 1048716 - RNA, 22 nt, Human
aggauuuagcaugaaaugugaa

SEQ ID NO: 1048717 - RNA, 22 nt, Human
uccugcagcugcagaccugggg

SEQ ID NO: 1048718 - RNA, 22 nt, Human
uuaacacuugaacucuacaugu

SEQ ID NO: 1048719 - RNA, 22 nt, Human
gaagugaagguuacucuagauu

SEQ ID NO: 1048720 - RNA, 22 nt, Human
cccagggaaugacucuggccuu

SEQ ID NO: 1048721 - RNA, 17 nt, Human
cuguuaauucauuuccc

SEQ ID NO: 1048722 - RNA, 22 nt, Human
uaugcugugcuagauacaauau

SEQ ID NO: 1048723 - RNA, 22 nt, Human
uaucauaaguuaauuaaacagu

SEQ ID NO: 1048724 - RNA, 22 nt, Human
uuuccaaagguggcaggaacaa

SEQ ID NO: 1048725 - RNA, 22 nt, Human
ccagggaagauuagaagccacu

SEQ ID NO: 1048726 - RNA, 22 nt, Human
aauaauuuccagccaacuggaa

SEQ ID NO: 1048727 - RNA, 22 nt, Human
cagauuucuauuucaaauacau

SEQ ID NO: 1048728 - RNA, 22 nt, Human
agcaaagcacuuugcauacaua

SEQ ID NO: 1048729 - RNA, 22 nt, Human
aaaaggcauggagguugauagu

SEQ ID NO: 1048730 - RNA, 22 nt, Human
aguacaauuuaaugaagauagc

SEQ ID NO: 1048731 - RNA, 22 nt, Human
uucauuaauucauucagugacu

SEQ ID NO: 1048732 - RNA, 22 nt, Human
caaggcaguuccccagagggcu

SEQ ID NO: 1048733 - RNA, 22 nt, Human
cccagggagguagcaggagaaa

SEQ ID NO: 1048734 - RNA, 22 nt, Human
gagucaccuugggucagcgaua

SEQ ID NO: 1048735 - RNA, 23 nt, Human
ccaaagucgaagucuaguccaga

SEQ ID NO: 1048736 - RNA, 22 nt, Human
cagagagggcggcccuggcuuc

SEQ ID NO: 1048737 - RNA, 22 nt, Human
uuccagggcagcaagugaaugg

SEQ ID NO: 1048738 - RNA, 22 nt, Human
guacagaaggauuucuaguagu

SEQ ID NO: 1048739 - RNA, 22 nt, Human
aaaguccuagcgauccacagaa

SEQ ID NO: 1048740 - RNA, 22 nt, Human
agcugcccuuaauaggcauuca

SEQ ID NO: 1048741 - RNA, 22 nt, Human
gcaaacaaggacauacauccug

SEQ ID NO: 1048742 - RNA, 22 nt, Human
caguucacacugugcuaucugc

SEQ ID NO: 1048743 - RNA, 22 nt, Human
gcagggcuugcagcagcuagac

SEQ ID NO: 1048744 - RNA, 22 nt, Human
ugagacaauaaggcugagaagc

SEQ ID NO: 1048745 - RNA, 22 nt, Human
uauaagaaacaaggcaaauuuu

SEQ ID NO: 1048746 - RNA, 22 nt, Human
ugccagggagcccugcugacca

SEQ ID NO: 1048747 - RNA, 22 nt, Human
uuuaaugauagcuguuucacau

SEQ ID NO: 1048748 - RNA, 22 nt, Human
agagggaaauccaggagugcuu

SEQ ID NO: 1048749 - RNA, 22 nt, Human
aauuucaaagcucacuggcaua

SEQ ID NO: 1048750 - RNA, 22 nt, Human
uuugaaguggaaaaggauuuaa

SEQ ID NO: 1048751 - RNA, 22 nt, Human
uucaacuuuggagauuuaauaa

SEQ ID NO: 1048752 - RNA, 22 nt, Human
cucuaauccuuugucccugggu

SEQ ID NO: 1048753 - RNA, 22 nt, Human
ucagggaauaaguagaugagug

SEQ ID NO: 1048754 - RNA, 22 nt, Human
ugggcugcugucugcacaugcu

SEQ ID NO: 1048755 - RNA, 22 nt, Human
caaacauucaaguacaagucuu

SEQ ID NO: 1048756 - RNA, 22 nt, Human
gcagggagguuugcugaccugg

SEQ ID NO: 1048757 - RNA, 22 nt, Human
ggggugggcgugcagggacacc

SEQ ID NO: 1048758 - RNA, 22 nt, Human
caguccagcccccugcuaaaag

SEQ ID NO: 1048759 - RNA, 22 nt, Human
agggagaggagcguuucacauc

SEQ ID NO: 1048760 - RNA, 22 nt, Human
aggggagcuaacaccagagccc

SEQ ID NO: 1048761 - RNA, 22 nt, Human
acauuccaaaaacuagcagaua

SEQ ID NO: 1048762 - RNA, 22 nt, Human
uugcccagagcugccuguuaca

SEQ ID NO: 1048763 - RNA, 22 nt, Human
acauaauagcauuucuaauuug

SEQ ID NO: 1048764 - RNA, 22 nt, Human
gaaugaaagauuugcauucuau

SEQ ID NO: 1048765 - RNA, 18 nt, Human
acccuggcaugcucuucc

SEQ ID NO: 1048766 - RNA, 22 nt, Human
ucacagaaauaagauaguuauu

SEQ ID NO: 1048767 - RNA, 20 nt, Human
guaaaauauggucuuugggu

SEQ ID NO: 1048768 - RNA, 22 nt, Human
acaaugaacacacaaggaauuc

SEQ ID NO: 1048769 - RNA, 22 nt, Poliovirus
cagcccugcuugguucgaggca

SEQ ID NO: 1048770 - RNA, 22 nt, Poliovirus
caccuccugggagucaacugcu

SEQ ID NO: 1048771 - RNA, 22 nt, Poliovirus
ggcccuguaagcguggcagggu

SEQ ID NO: 1048772 - RNA, 22 nt, Poliovirus
cuuuaagagaugcuguccuuua

SEQ ID NO: 1048773 - RNA, 22 nt, Human
cccugagcucaggcccuugggg

SEQ ID NO: 1048774 - RNA, 22 nt, Human
uuccuggccccaccccuggaga

SEQ ID NO: 1048775 - RNA, 22 nt, Human
uacugacacaaagccaaucccu

SEQ ID NO: 1048776 - RNA, 22 nt, Human
gcuggcaggauaacuucuaagc

SEQ ID NO: 1048777 - RNA, 22 nt, Human
ccuggcaggccccuccuggauu

SEQ ID NO: 1048778 - RNA, 22 nt, Human
agacacagcugcaggagguggg

SEQ ID NO: 1048779 - RNA, 21 nt, Human
agagucugagugugcaagggc

SEQ ID NO: 1048780 - RNA, 22 nt, Human
uugggaagaaacauguccauca

SEQ ID NO: 1048781 - RNA, 22 nt, Human
gcuggcagggacagcugcgugu

SEQ ID NO: 1048782 - RNA, 22 nt, Human
cagcccaggucucucuuccagu

SEQ ID NO: 1048783 - RNA, 22 nt, Human
cuaugagaagaaaacaagauua

SEQ ID NO: 1048784 - RNA, 22 nt, Human
guggcagucgcugacagauaca

SEQ ID NO: 1048785 - RNA, 22 nt, Human
gccacauagaggaggauauuaa

SEQ ID NO: 1048786 - RNA, 18 nt, Human
ggcagggaaaagauaggg

SEQ ID NO: 1048787 - RNA, 22 nt, Human
gagacacacauucuggagagaa

SEQ ID NO: 1048788 - RNA, 22 nt, Human
ggcaaggggucaggcugagaca

SEQ ID NO: 1048789 - RNA, 22 nt, Human
uggcagagagagugcagucgac

SEQ ID NO: 1048790 - RNA, 22 nt, Human
cugccugccuuggccuccagga

SEQ ID NO: 1048791 - RNA, 19 nt, Human
acacauuugcacaauccac

SEQ ID NO: 1048792 - RNA, 22 nt, Human
ucacacaugaguaaauacaggg

SEQ ID NO: 1048793 - RNA, 20 nt, Human
auacacaugcagacagaugc

SEQ ID NO: 1048794 - RNA, 22 nt, Human
uuccaggcaugucagacauagg

SEQ ID NO: 1048795 - RNA, 22 nt, Human
acauacacaagcguacaugaac

SEQ ID NO: 1048796 - RNA, 22 nt, Human
cacauacauacguauguauaca

SEQ ID NO: 1048797 - RNA, 22 nt, Human
gcccacacaccagcucaggagg

SEQ ID NO: 1048798 - RNA, 22 nt, Human
aguugggaguuauagacucuau

SEQ ID NO: 1048799 - RNA, 22 nt, Human
ucuggcagugagcaacuugaca

SEQ ID NO: 1048800 - RNA, 22 nt, Human
cagggacaauggcagagccuga

SEQ ID NO: 1048801 - RNA, 22 nt, Human
gacacauagaucuaucucacuc

SEQ ID NO: 1048802 - RNA, 22 nt, Human
aacacagaucaaaauauuuccu

SEQ ID NO: 1048803 - RNA, 22 nt, Human
ggugccaggcuguagucagggu

SEQ ID NO: 1048804 - RNA, 22 nt, Human
cagccaagaaccacagacccag

SEQ ID NO: 1048805 - RNA, 22 nt, Human
cucuccagccuuuagcccacgc

SEQ ID NO: 1048806 - RNA, 22 nt, Human
acacacaugccuuuccuaagua

SEQ ID NO: 1048807 - RNA, 22 nt, Human
ggccucagagaaggcugugcgg

SEQ ID NO: 1048808 - RNA, 23 nt, Human
ggacacauuuauuucagaauuca

SEQ ID NO: 1048809 - RNA, 22 nt, Human
aggcaggggagcuggaagggua

SEQ ID NO: 1048810 - RNA, 22 nt, Human
ugguccuggaagguccugaggg

SEQ ID NO: 1048811 - RNA, 22 nt, Human
uuccuggcauagagagggcaca

SEQ ID NO: 1048812 - RNA, 22 nt, Human
gccuggcacaguagggacccaa

SEQ ID NO: 1048813 - RNA, 22 nt, Human
uccccacaucucugcaucaggc

SEQ ID NO: 1048814 - RNA, 22 nt, Human
uggccucugugggagcugagca

SEQ ID NO: 1048815 - RNA, 22 nt, Human
gguggcauaagaacacuaaaga

SEQ ID NO: 1048816 - RNA, 22 nt, Human
ccucuccuugcacccgucccgc

SEQ ID NO: 1048817 - RNA, 22 nt, Human
cacauacuuguguguacauaug

SEQ ID NO: 1048818 - RNA, 22 nt, Human
aagaggucauaccagauaaggg

SEQ ID NO: 1048819 - RNA, 21 nt, Human
uucucuccauaugcccagccc

SEQ ID NO: 1048820 - RNA, 22 nt, Human
cuuacacagucuggcacuucuu

SEQ ID NO: 1048821 - RNA, 22 nt, Human
gggccccuuguaucucuggcuc

SEQ ID NO: 1048822 - RNA, 19 nt, Human
guccuggcgccgccacacc

SEQ ID NO: 1048823 - RNA, 22 nt, Human
guccucugucccuggggcacgg

SEQ ID NO: 1048824 - RNA, 22 nt, Human
uccugagccugacaaucaccau

SEQ ID NO: 1048825 - RNA, 22 nt, Human
agggcugacaaauggcagugac

SEQ ID NO: 1048826 - RNA, 22 nt, Human
ccuggcagcuaagugcuuugag

SEQ ID NO: 1048827 - RNA, 21 nt, Human
agugccaguagguauggagga

SEQ ID NO: 1048828 - RNA, 22 nt, Human
guccuggcugguucuguggggc

SEQ ID NO: 1048829 - RNA, 22 nt, Human
aaagaaucagaagucucaaaca

SEQ ID NO: 1048830 - RNA, 22 nt, Human
ucuggcagagugauaggauaag

SEQ ID NO: 1048831 - RNA, 22 nt, Human
gcacauaaagggcaugggaggu

SEQ ID NO: 1048832 - RNA, 21 nt, Human
uccccacauuucuaaacagac

SEQ ID NO: 1048833 - RNA, 22 nt, Human
ucccagccuuucuuuucugcug

SEQ ID NO: 1048834 - RNA, 22 nt, Human
cagguuggucggcaaguacaca

SEQ ID NO: 1048835 - RNA, 18 nt, Human
uccuggcagucagagagg

SEQ ID NO: 1048836 - RNA, 22 nt, Human
ccaucacaguccccaucgugau

SEQ ID NO: 1048837 - RNA, 22 nt, Human
cacauacugagaaucacaccca

SEQ ID NO: 1048838 - RNA, 22 nt, Human
auacauucaaaggaaggauaga

SEQ ID NO: 1048839 - RNA, 22 nt, Human
cccaggccuggucugggccagu

SEQ ID NO: 1048840 - RNA, 22 nt, Human
ucuccugggaggacaaggaagg

SEQ ID NO: 1048841 - RNA, 22 nt, Human
gcuccaggcagcauaguggaug

SEQ ID NO: 1048842 - RNA, 22 nt, Human
aaaagagugacugauaaguaua

SEQ ID NO: 1048843 - RNA, 22 nt, Human
guacacacuauuuaaaguguuu

SEQ ID NO: 1048844 - RNA, 22 nt, Human
uccuggcagagggcggccucga

SEQ ID NO: 1048845 - RNA, 20 nt, Human
cugcuccacccggcucucag

SEQ ID NO: 1048846 - RNA, 22 nt, Human
ccucagcugcuucccuggagcc

SEQ ID NO: 1048847 - RNA, 22 nt, Human
agugccccaugggugccugggg

SEQ ID NO: 1048848 - RNA, 22 nt, Human
gaggacucugggcguguauggg

SEQ ID NO: 1048849 - RNA, 22 nt, Human
ucacauacugaaaguccaguga

SEQ ID NO: 1048850 - RNA, 19 nt, Human
guccucucaacaacccggg

SEQ ID NO: 1048851 - RNA, 22 nt, Human
cauacauuuauacacaucuaug

SEQ ID NO: 1048852 - RNA, 22 nt, Human
cuccuggcuuucccagaccagg

SEQ ID NO: 1048853 - RNA, 22 nt, Human
ccuggcagguuacaaccaguua

SEQ ID NO: 1048854 - RNA, 22 nt, Human
uccuggcaaagauguugguguu

SEQ ID NO: 1048855 - RNA, 22 nt, Human
cccugccuugggguccacaccg

SEQ ID NO: 1048856 - RNA, 22 nt, Human
agggccccauagucacugcccg

SEQ ID NO: 1048857 - RNA, 22 nt, Human
ccauucauacaauuuuguucua

SEQ ID NO: 1048858 - RNA, 22 nt, Human
aggacaagcuaaaggacuuccu

SEQ ID NO: 1048859 - RNA, 22 nt, Human
gcacacaguauaugcucauuaa

SEQ ID NO: 1048860 - RNA, 22 nt, Human
uacacauccauguuuugacuuu

SEQ ID NO: 1048861 - RNA, 22 nt, Human
cggcuggugucgggcacagcaa

SEQ ID NO: 1048862 - RNA, 18 nt, Human
cccacacagcaguagcuc

SEQ ID NO: 1048863 - RNA, 22 nt, Human
uacacagauuucaguaucauca

SEQ ID NO: 1048864 - RNA, 22 nt, Human
cacacacugacaccuuaucuug

SEQ ID NO: 1048865 - RNA, 22 nt, Human
gucuggaaggaggagauggagc

SEQ ID NO: 1048866 - RNA, 22 nt, Human
ccaggcugggcggggaaccugg

SEQ ID NO: 1048867 - RNA, 22 nt, Human
cuggcaguuggcauuggcaucu

SEQ ID NO: 1048868 - RNA, 22 nt, Human
gggccccuugcugcucugcugg

SEQ ID NO: 1048869 - RNA, 22 nt, Human
gcuggcaggguucucacugaaa

SEQ ID NO: 1048870 - RNA, 22 nt, Human
gcuggcagcauuagacccuggg

SEQ ID NO: 1048871 - RNA, 22 nt, Human
ccacacagucaguuuccaagaa

SEQ ID NO: 1048872 - RNA, 22 nt, Human
gccuggcaauggccucaggaag

SEQ ID NO: 1048873 - RNA, 22 nt, Human
cagguuggggacuuaggaugac

SEQ ID NO: 1048874 - RNA, 22 nt, Human
ucuggcagagucagugcacaca

SEQ ID NO: 1048875 - RNA, 22 nt, Human
gagaaagauuguccuucagggg

SEQ ID NO: 1048876 - RNA, 22 nt, Human
guccacagagggcugggcaggc

SEQ ID NO: 1048877 - RNA, 22 nt, Human
auccccacgauauagccaaagc

SEQ ID NO: 1048878 - RNA, 22 nt, Human
uauucccauuccacuuaucaag

SEQ ID NO: 1048879 - RNA, 22 nt, Human
cccugagcgugaggaggaagua

SEQ ID NO: 1048880 - RNA, 22 nt, Human
gcuggcaggagaccauacccua

SEQ ID NO: 1048881 - RNA, 22 nt, Human
aggaaagauggaaggaggauaa

SEQ ID NO: 1048882 - RNA, 22 nt, Human
ucuggcagugaagucaugaggu

SEQ ID NO: 1048883 - RNA, 22 nt, Human
uacacacaugcauuugccuuau

SEQ ID NO: 1048884 - RNA, 22 nt, Human
gcuggcaguguauuguuagcug

SEQ ID NO: 1048885 - RNA, 22 nt, Human
uggcaguggauaggggagcggu

SEQ ID NO: 1048886 - RNA, 22 nt, Human
uguuggaauuaggauacagagg

SEQ ID NO: 1048887 - RNA, 22 nt, Human
aaagagucguguuccagguuug

SEQ ID NO: 1048888 - RNA, 22 nt, Human
gucacaggcaguaacuaggacc

SEQ ID NO: 1048889 - RNA, 22 nt, Human
uggcaggaaaguaacagagcac

SEQ ID NO: 1048890 - RNA, 22 nt, Human
uccugagcacagagacaaggaa

SEQ ID NO: 1048891 - RNA, 22 nt, Human
acacacacaagcagguugugga

SEQ ID NO: 1048892 - RNA, 22 nt, Human
cuccuggcaguuccccuuguca

SEQ ID NO: 1048893 - RNA, 22 nt, Human
auggccugcagugcugccacag

SEQ ID NO: 1048894 - RNA, 22 nt, Human
cacccacauuccaucacucugc

SEQ ID NO: 1048895 - RNA, 22 nt, Human
ucccacacagcccgcucaccgg

SEQ ID NO: 1048896 - RNA, 20 nt, Human
cccacacccuucccacuugg

SEQ ID NO: 1048897 - RNA, 22 nt, Human
cccagcccccgagugucuggaa

SEQ ID NO: 1048898 - RNA, 22 nt, Human
acauacacaugaauauauuuuu

SEQ ID NO: 1048899 - RNA, 22 nt, Human
ggagucugcucccagacaugau

SEQ ID NO: 1048900 - RNA, 22 nt, Human
auacacacugcuauccuuuuuu

SEQ ID NO: 1048901 - RNA, 22 nt, Human
ucccacacuugaaacaaggcug

SEQ ID NO: 1048902 - RNA, 22 nt, Human
gcugcgccggaucccacguucc

SEQ ID NO: 1048903 - RNA, 22 nt, Human
gcccagccuccaagcuccaagg

SEQ ID NO: 1048904 - RNA, 22 nt, Human
guccucuguuuccaucugacuu

SEQ ID NO: 1048905 - RNA, 22 nt, Human
ucacacaugcuaagccagagau

SEQ ID NO: 1048906 - RNA, 22 nt, Human
acaggugguaaaauggacuguc

SEQ ID NO: 1048907 - RNA, 22 nt, Human
gccuggcaggggccugggagug

SEQ ID NO: 1048908 - RNA, 22 nt, Human
gcuggcagagacaagaagacua

SEQ ID NO: 1048909 - RNA, 22 nt, Human
uugggaagaauggaggugguua

SEQ ID NO: 1048910 - RNA, 19 nt, Human
cugagagaugcuucacaca

SEQ ID NO: 1048911 - RNA, 22 nt, Human
ccuggcagguggcgcccucggc

SEQ ID NO: 1048912 - RNA, 22 nt, Human
agaaagaggaugcagaucucau

SEQ ID NO: 1048913 - RNA, 18 nt, Human
acaggcugugggaauggu

SEQ ID NO: 1048914 - RNA, 21 nt, Human
ccuggcagaagccugauaugc

SEQ ID NO: 1048915 - RNA, 22 nt, Human
acacaucuuagacugaaauaug

SEQ ID NO: 1048916 - RNA, 22 nt, Human
gcuggcagaagagcugguucaa

SEQ ID NO: 1048917 - RNA, 22 nt, Human
agaggccugugugcuccagugg

SEQ ID NO: 1048918 - RNA, 22 nt, Human
agcccagcuuugaaccauauca

SEQ ID NO: 1048919 - RNA, 22 nt, Human
ucacacacauggauaguauuuu

SEQ ID NO: 1048920 - RNA, 22 nt, Human
ucccaccccggucaagggcuga

SEQ ID NO: 1048921 - RNA, 22 nt, Human
ugcucuguauucuauggcaguu

SEQ ID NO: 1048922 - RNA, 22 nt, Human
gagaaagacguaggcugggagg

SEQ ID NO: 1048923 - RNA, 22 nt, Human
gguguugggcucacugguccuu

SEQ ID NO: 1048924 - RNA, 21 nt, Human
agaugcugaugcugcaggucc

SEQ ID NO: 1048925 - RNA, 20 nt, Human
aaagagcccuuggagcaggc

SEQ ID NO: 1048926 - RNA, 22 nt, Human
gcacacaugcaugcacaggagu

SEQ ID NO: 1048927 - RNA, 22 nt, Human
guccuggcaccucacuggcuac

SEQ ID NO: 1048928 - RNA, 22 nt, Human
gcuggcaggagccuuucccuuu

SEQ ID NO: 1048929 - RNA, 22 nt, Human
uggcaguggcucagagugcaga

SEQ ID NO: 1048930 - RNA, 22 nt, Human
cuccuggcucgcccccagcuga

SEQ ID NO: 1048931 - RNA, 21 nt, Human
cccuugccugcacuccucggc

SEQ ID NO: 1048932 - RNA, 22 nt, Human
ucuggcaggcaaucggcucugg

SEQ ID NO: 1048933 - RNA, 22 nt, Human
guccucugagggggcugcacgc

SEQ ID NO: 1048934 - RNA, 22 nt, Human
ggaggacacuggcucugccuuc

SEQ ID NO: 1048935 - RNA, 23 nt, Human
uaaauuaccuuuccagugcaggg

SEQ ID NO: 1048936 - RNA, 22 nt, Human
ccugccuguacuagagacccag

SEQ ID NO: 1048937 - RNA, 22 nt, Human
ccuggcagacugugagggcagg

SEQ ID NO: 1048938 - RNA, 22 nt, Human
gaugccuggcacccagcaagga

SEQ ID NO: 1048939 - RNA, 22 nt, Human
acacauuugcauaauaccucau

SEQ ID NO: 1048940 - RNA, 22 nt, Human
gagaggcuggcagugccagguu

SEQ ID NO: 1048941 - RNA, 22 nt, Human
ucccuccuggccgucaccgcug

SEQ ID NO: 1048942 - RNA, 22 nt, Human
ggaggacaggggcugcagcaca

SEQ ID NO: 1048943 - RNA, 22 nt, Human
ccccacccucgcuccauuucgg

SEQ ID NO: 1048944 - RNA, 22 nt, Human
ucuggcaggccuugucaaucug

SEQ ID NO: 1048945 - RNA, 22 nt, Human
cagccaggauggagaacuguug

SEQ ID NO: 1048946 - RNA, 22 nt, Human
ggcagugagaggucuccugguc

SEQ ID NO: 1048947 - RNA, 22 nt, Human
cacacaguaggcacucauuaau

SEQ ID NO: 1048948 - RNA, 22 nt, Human
ucuggcagcuauccucuggcca

SEQ ID NO: 1048949 - RNA, 22 nt, Human
gcacacagcuagauuaccauuc

SEQ ID NO: 1048950 - RNA, 22 nt, Human
gugugggaaggcuaggaugcug

SEQ ID NO: 1048951 - RNA, 22 nt, Human
cacacacucuuccuggcaccua

SEQ ID NO: 1048952 - RNA, 22 nt, Human
ucacacauuucucaaguguagg

SEQ ID NO: 1048953 - RNA, 22 nt, Human
cugcaggagcaaagccucugcu

SEQ ID NO: 1048954 - RNA, 22 nt, Human
cugagccagggccacacaugga

SEQ ID NO: 1048955 - RNA, 22 nt, Human
ggcaagagggcagauggagugc

SEQ ID NO: 1048956 - RNA, 19 nt, Human
uccuggcacaguggaacca

SEQ ID NO: 1048957 - RNA, 22 nt, Human
uccccacacagauacagaguag

SEQ ID NO: 1048958 - RNA, 18 nt, Human
aggaaagaaaggcaggug

SEQ ID NO: 1048959 - RNA, 22 nt, Human
aggagcugcagauucugccuug

SEQ ID NO: 1048960 - RNA, 22 nt, Human
ggugccagugggucucaggaua

SEQ ID NO: 1048961 - RNA, 22 nt, Human
gacacagaauuuacucccgaua

SEQ ID NO: 1048962 - RNA, 22 nt, Human
aagagcacuaacagagcugaua

SEQ ID NO: 1048963 - RNA, 20 nt, Human
accccacagaguccauugca

SEQ ID NO: 1048964 - RNA, 22 nt, Human
ccuccuggcuuuucccauugaa

SEQ ID NO: 1048965 - RNA, 22 nt, Human
gcagccucaaacuccccagcuc

SEQ ID NO: 1048966 - RNA, 22 nt, Human
cuuggcaguuucggaaggauga

SEQ ID NO: 1048967 - RNA, 22 nt, Human
cuccucuguauugauugggacu

SEQ ID NO: 1048968 - RNA, 22 nt, Human
acaagagcauugcagguguguu

SEQ ID NO: 1048969 - RNA, 22 nt, Human
uccacccugcuuucuuaucucc

SEQ ID NO: 1048970 - RNA, 22 nt, Human
guacacacuauguauuguacac

SEQ ID NO: 1048971 - RNA, 22 nt, Human
uagacacaucuucauccacaau

SEQ ID NO: 1048972 - RNA, 22 nt, Human
acaucugaggagaccagccucu

SEQ ID NO: 1048973 - RNA, 22 nt, Human
acagguggccccgagggagugg

SEQ ID NO: 1048974 - RNA, 22 nt, Human
uggcagugggaauggacaaaca

SEQ ID NO: 1048975 - RNA, 20 nt, Human
uucaugggagcaaagaggcc

SEQ ID NO: 1048976 - RNA, 22 nt, Human
ucccagccacaguuuccaccug

SEQ ID NO: 1048977 - RNA, 22 nt, Human
cacacugucagguaaauaacac

SEQ ID NO: 1048978 - RNA, 21 nt, Human
acacagaggcaucaucacuuu

SEQ ID NO: 1048979 - RNA, 23 nt, Human
ugagggacaugguggcuucugag

SEQ ID NO: 1048980 - RNA, 21 nt, Human
uccacccucucugcucccagu

SEQ ID NO: 1048981 - RNA, 22 nt, Human
cacaucccuggaguuacccagu

SEQ ID NO: 1048982 - RNA, 23 nt, Human
uguaaacaucacccccuggaguu

SEQ ID NO: 1048983 - RNA, 22 nt, Human
cacacagaugguaagggaggga

SEQ ID NO: 1048984 - RNA, 22 nt, Human
cacaaaaguaggaggcaggcgg

SEQ ID NO: 1048985 - RNA, 22 nt, Human
cuccugaggaaaagcuugguca

SEQ ID NO: 1048986 - RNA, 22 nt, Human
acaggugguagaguggaaagag

SEQ ID NO: 1048987 - RNA, 22 nt, Human
gccgggaccaaggccacggagc

SEQ ID NO: 1048988 - RNA, 22 nt, Human
gcuggcagguaaagccccgggg

SEQ ID NO: 1048989 - RNA, 21 nt, Human
ucuggcagcaguuuguugagu

SEQ ID NO: 1048990 - RNA, 22 nt, Human
ccuggcagccucagccaauucu

SEQ ID NO: 1048991 - RNA, 22 nt, Human
acagaguccuagcugcaaagaa

SEQ ID NO: 1048992 - RNA, 23 nt, Human
uugggaaauaguuaagacaugag

SEQ ID NO: 1048993 - RNA, 22 nt, Human
agggcugaagggaggugcucau

SEQ ID NO: 1048994 - RNA, 22 nt, Human
cacccacauggaaauucacagu

SEQ ID NO: 1048995 - RNA, 22 nt, Human
gcuggcagacugggggcagaac

SEQ ID NO: 1048996 - RNA, 22 nt, Human
uggcagagcccagacuccaguc

SEQ ID NO: 1048997 - RNA, 22 nt, Human
cccuuccuugauuuuaacugga

SEQ ID NO: 1048998 - RNA, 22 nt, Human
gcuggcagccaagugaagaggg

SEQ ID NO: 1048999 - RNA, 22 nt, Human
cccagcccaucucaaaggucua

SEQ ID NO: 1049000 - RNA, 22 nt, Human
ucuggcaggacaugcugaccau

SEQ ID NO: 1049001 - RNA, 22 nt, Human
agucacaguuucccugagagag

SEQ ID NO: 1049002 - RNA, 22 nt, Human
guccucugaaagaugaaccaug

SEQ ID NO: 1049003 - RNA, 22 nt, Human
acaugacuuuucucuuccagag

SEQ ID NO: 1049004 - RNA, 22 nt, Human
cccuuccucccaggcuucugug

SEQ ID NO: 1049005 - RNA, 22 nt, Human
acuggcagaauugaauaguugu

SEQ ID NO: 1049006 - RNA, 22 nt, Human
ugguccugccccgugcacagag

SEQ ID NO: 1049007 - RNA, 20 nt, Human
uggccucugagaugccacgg

SEQ ID NO: 1049008 - RNA, 22 nt, Human
guccucugauuucuagguauau

SEQ ID NO: 1049009 - RNA, 23 nt, Human
gcccacccucagcguccucacgg

SEQ ID NO: 1049010 - RNA, 20 nt, Human
uuccacaucuuugcacaugc

SEQ ID NO: 1049011 - RNA, 22 nt, Human
agaggccuccgaaaggugggcu

SEQ ID NO: 1049012 - RNA, 22 nt, Human
ccucugccaccucccacgaggc

SEQ ID NO: 1049013 - RNA, 22 nt, Human
acugccaaugguaguuugaugg

SEQ ID NO: 1049014 - RNA, 17 nt, Human
cccaggccgccgggagc

SEQ ID NO: 1049015 - RNA, 22 nt, Human
cucugagcagaggccguggcua

SEQ ID NO: 1049016 - RNA, 22 nt, Human
ggcccagccucagacaugcccu

SEQ ID NO: 1049017 - RNA, 22 nt, Human
aggaggcuuuugcaggugccac

SEQ ID NO: 1049018 - RNA, 22 nt, Human
ucuggcagaucuucccacguuu

SEQ ID NO: 1049019 - RNA, 17 nt, Human
uugggagagaaagguau

SEQ ID NO: 1049020 - RNA, 22 nt, Human
agcagguugugauacacucaga

SEQ ID NO: 1049021 - RNA, 22 nt, Human
ccuucuucuguguggcccaaga

SEQ ID NO: 1049022 - RNA, 22 nt, Human
cagcccagccuugucucuuuau

SEQ ID NO: 1049023 - RNA, 23 nt, Human
uccaggagcaugcuggcuggcga

SEQ ID NO: 1049024 - RNA, 22 nt, Human
cagcacagugaccagacccacu

SEQ ID NO: 1049025 - RNA, 22 nt, Human
auccuggcccagguguggaggg

SEQ ID NO: 1049026 - RNA, 22 nt, Human
uccaaggcuccggcccuggcgu

SEQ ID NO: 1049027 - RNA, 22 nt, Human
uggaaagagguagaggaucugg

SEQ ID NO: 1049028 - RNA, 22 nt, Human
ccacauacaaauggggugcugu

SEQ ID NO: 1049029 - RNA, 22 nt, Human
ucccacauaugcaauccugaau

SEQ ID NO: 1049030 - RNA, 22 nt, Human
uccccacagcagaagaucugag

SEQ ID NO: 1049031 - RNA, 22 nt, Human
gguucccggaucuccgaguccc

SEQ ID NO: 1049032 - RNA, 22 nt, Human
ccacacagggggaugaguuauu

SEQ ID NO: 1049033 - RNA, 22 nt, Human
cccagccucuguuugcuccucu

SEQ ID NO: 1049034 - RNA, 22 nt, Human
uuccuggccuaagguaggugac

SEQ ID NO: 1049035 - RNA, 22 nt, Human
ucauggcacuuagcacaguccu

SEQ ID NO: 1049036 - RNA, 22 nt, Human
aggggugugcauccuggaggau

SEQ ID NO: 1049037 - RNA, 22 nt, Human
aacacauaggcagagcaugaca

SEQ ID NO: 1049038 - RNA, 22 nt, Human
gacacuucaccuuucccagccu

SEQ ID NO: 1049039 - RNA, 22 nt, Human
acaucacagagcccagauaaag

SEQ ID NO: 1049040 - RNA, 22 nt, Human
auacaugacucacacauucugc

SEQ ID NO: 1049041 - RNA, 22 nt, Human
ccuggcuccugccucugcaggg

SEQ ID NO: 1049042 - RNA, 22 nt, Human
uggcagagaacacggcugaucu

SEQ ID NO: 1049043 - RNA, 22 nt, Human
caggauggucucgaucuccuga

SEQ ID NO: 1049044 - RNA, 22 nt, Human
agggacucccugggccgacacg

SEQ ID NO: 1049045 - RNA, 22 nt, Human
uuccuggccaagcagaguggaa

SEQ ID NO: 1049046 - RNA, 22 nt, Human
gacacagagcucacagucuccu

SEQ ID NO: 1049047 - RNA, 22 nt, Human
ccuggcagcaggugggcccgug

SEQ ID NO: 1049048 - RNA, 22 nt, Human
acuggcaguggcagcagaaaga

SEQ ID NO: 1049049 - RNA, 22 nt, Human
gacacagagggcaccagauaug

SEQ ID NO: 1049050 - RNA, 22 nt, Human
uggcagagucaucacaucugga

SEQ ID NO: 1049051 - RNA, 22 nt, Human
ugccagccagggaagcucaccc

SEQ ID NO: 1049052 - RNA, 22 nt, Human
gagaccucuugguaucgcuagg

SEQ ID NO: 1049053 - RNA, 22 nt, Human
ugccugccaugcagaaagcuga

SEQ ID NO: 1049054 - RNA, 22 nt, Human
ccacacagauaaguguuuucua

SEQ ID NO: 1049055 - RNA, 17 nt, Human
gcccacccuuaggagcu

SEQ ID NO: 1049056 - RNA, 22 nt, Human
ugcagagagauccucaggguuu

SEQ ID NO: 1049057 - RNA, 22 nt, Human
uccaggccauugacugcauccu

SEQ ID NO: 1049058 - RNA, 22 nt, Human
ccauacacacaccaaauuugua

SEQ ID NO: 1049059 - RNA, 22 nt, Human
ucuggcaguuugagaaaggcua

SEQ ID NO: 1049060 - RNA, 22 nt, Human
ucuugggauagugucucauggc

SEQ ID NO: 1049061 - RNA, 22 nt, Human
uuguaaacugcugcaggagugc

SEQ ID NO: 1049062 - RNA, 22 nt, Human
cacacauuucagaugcuacaau

SEQ ID NO: 1049063 - RNA, 22 nt, Human
guuaggaacacuggagccuaaa

SEQ ID NO: 1049064 - RNA, 22 nt, Human
cccugccucugaagcugcucag

SEQ ID NO: 1049065 - RNA, 22 nt, Human
ucuggcagaagugcugucagua

SEQ ID NO: 1049066 - RNA, 22 nt, Human
uacacacagaggccaugggauu

SEQ ID NO: 1049067 - RNA, 22 nt, Human
uucccacagagauuacauugaa

SEQ ID NO: 1049068 - RNA, 22 nt, Human
ucuggcaggucaaucauucuuu

SEQ ID NO: 1049069 - RNA, 19 nt, Human
gcuggcagauguggccgug

SEQ ID NO: 1049070 - RNA, 22 nt, Human
aagagagaacucccuucgccag

SEQ ID NO: 1049071 - RNA, 22 nt, Human
gaggagcugagccacguccugg

SEQ ID NO: 1049072 - RNA, 22 nt, Human
ucccagccaggcucuaccacuu

SEQ ID NO: 1049073 - RNA, 22 nt, Human
uuccuggcgccacggagccggu

SEQ ID NO: 1049074 - RNA, 22 nt, Human
cagguugguauucaucuccaca

SEQ ID NO: 1049075 - RNA, 22 nt, Human
uccaggcuuuuucaugcugucu

SEQ ID NO: 1049076 - RNA, 22 nt, Human
auuccacacaguaauacucaau

SEQ ID NO: 1049077 - RNA, 22 nt, Human
auggcagacgaggcagcagggg

SEQ ID NO: 1049078 - RNA, 23 nt, Human
acauacauggagauaaagugaug

SEQ ID NO: 1049079 - RNA, 22 nt, Human
cagucacauagguauacacaua

SEQ ID NO: 1049080 - RNA, 22 nt, Human
uacaaaaggaagagggaucuua

SEQ ID NO: 1049081 - RNA, 22 nt, Human
uccaggcaagggaggagcaugg

SEQ ID NO: 1049082 - RNA, 23 nt, Human
ucacauaauccuucauccacagg

SEQ ID NO: 1049083 - RNA, 22 nt, Human
guccucugggcuuugagcaguc

SEQ ID NO: 1049084 - RNA, 22 nt, Human
ggagcugaggcugaggccucac

SEQ ID NO: 1049085 - RNA, 22 nt, Human
gaaagaagcuuuagauggcuau

SEQ ID NO: 1049086 - RNA, 22 nt, Human
aaaagagucuuaggcagucaua

SEQ ID NO: 1049087 - RNA, 22 nt, Human
aaauuacagaucaccaaugcau

SEQ ID NO: 1049088 - RNA, 22 nt, Human
acacacagaaggaagccccacu

SEQ ID NO: 1049089 - RNA, 22 nt, Human
uguaaacagccccauggagagc

SEQ ID NO: 1049090 - RNA, 22 nt, Human
uacacagacucuucaauucaga

SEQ ID NO: 1049091 - RNA, 22 nt, Human
gagagaaaagggggaauugauu

SEQ ID NO: 1049092 - RNA, 22 nt, Human
uggcagagagacucuccuugau

SEQ ID NO: 1049093 - RNA, 22 nt, Human
guccucuggugaaagcauuccc

SEQ ID NO: 1049094 - RNA, 22 nt, Human
ucuggcagggguucugcacuug

SEQ ID NO: 1049095 - RNA, 21 nt, Human
aggcugcuggcucaggguccu

SEQ ID NO: 1049096 - RNA, 22 nt, Human
uuccuggcagaggccccgacag

SEQ ID NO: 1049097 - RNA, 22 nt, Human
ccacaucauggauacaguuaug

SEQ ID NO: 1049098 - RNA, 22 nt, Human
ccuggcaguuuugcccaggauu

SEQ ID NO: 1049099 - RNA, 18 nt, Human
gacacauccccaggccuc

SEQ ID NO: 1049100 - RNA, 22 nt, Human
guccuggcccaggaguacacau

SEQ ID NO: 1049101 - RNA, 23 nt, Human
acacugucucauggauagacugc

SEQ ID NO: 1049102 - RNA, 22 nt, Human
ucaucacauguguagucauccc

SEQ ID NO: 1049103 - RNA, 22 nt, Human
auggcagagggauugaacagcu

SEQ ID NO: 1049104 - RNA, 22 nt, Human
aucccacaccccuacaacauau

SEQ ID NO: 1049105 - RNA, 18 nt, Human
acacacacaccuguguau

SEQ ID NO: 1049106 - RNA, 22 nt, Human
uccuggcacuuugggggcucgc

SEQ ID NO: 1049107 - RNA, 22 nt, Human
gccuggcacucaaucaucugcu

SEQ ID NO: 1049108 - RNA, 22 nt, Human
gcccacacagcagauccuuugg

SEQ ID NO: 1049109 - RNA, 22 nt, Human
ugagagucuguuccucuugcag

SEQ ID NO: 1049110 - RNA, 22 nt, Human
aggcaguggagcuggaauaggc

SEQ ID NO: 1049111 - RNA, 22 nt, Human
gcuccaggugucccagguaaaa

SEQ ID NO: 1049112 - RNA, 22 nt, Human
uauucccagccucuuucuaucu

SEQ ID NO: 1049113 - RNA, 22 nt, Human
ggcagagguagcuggaaccagg

SEQ ID NO: 1049114 - RNA, 22 nt, Human
acuccugggugcugaccagcgu

SEQ ID NO: 1049115 - RNA, 22 nt, Human
ccuucucucugaagaccccaaa

SEQ ID NO: 1049116 - RNA, 22 nt, Human
ugggagaaacugucucucccac

SEQ ID NO: 1049117 - RNA, 22 nt, Human
gacuguggggggcggacacaag

SEQ ID NO: 1049118 - RNA, 22 nt, Human
ucccacccauccugcaucucuu

SEQ ID NO: 1049119 - RNA, 21 nt, Human
ccuagccucuuacccagcuuu

SEQ ID NO: 1049120 - RNA, 18 nt, Human
uccugccugugccccagg

SEQ ID NO: 1049121 - RNA, 22 nt, Human
uccugccuguuuaccuguacuu

SEQ ID NO: 1049122 - RNA, 22 nt, Human
agacacauaggaccacacugug

SEQ ID NO: 1049123 - RNA, 22 nt, Human
guccucuguagggcugggccac

SEQ ID NO: 1049124 - RNA, 22 nt, Human
caucacagguccugaugacauu

SEQ ID NO: 1049125 - RNA, 22 nt, Human
cagguggguguaugaaugcaaa

SEQ ID NO: 1049126 - RNA, 19 nt, Human
ccagcccacagugacuuuc

SEQ ID NO: 1049127 - RNA, 23 nt, Human
cauccaggagcugagucugacug

SEQ ID NO: 1049128 - RNA, 19 nt, Human
gggagcugaggucuuuggu

SEQ ID NO: 1049129 - RNA, 22 nt, Human
cagucccaugagcccagaacau

SEQ ID NO: 1049130 - RNA, 22 nt, Human
aacacauauuuauauaugcaca

SEQ ID NO: 1049131 - RNA, 19 nt, Human
ccuuccuccccagggccau

SEQ ID NO: 1049132 - RNA, 20 nt, Human
gcuccaggucagagaggacg

SEQ ID NO: 1049133 - RNA, 22 nt, Human
ccuggcagaauauuaaagugca

SEQ ID NO: 1049134 - RNA, 22 nt, Human
cuccuggcacucaguguggaag

SEQ ID NO: 1049135 - RNA, 22 nt, Human
acacacucaauugcauaagcac

SEQ ID NO: 1049136 - RNA, 22 nt, Human
ucuggcaggguguguauuuaca

SEQ ID NO: 1049137 - RNA, 22 nt, Human
cuggccuggggggacacauccc

SEQ ID NO: 1049138 - RNA, 22 nt, Human
cuccaggccccuggccuucugc

SEQ ID NO: 1049139 - RNA, 22 nt, Human
acuggcaguuugagaaugcauu

SEQ ID NO: 1049140 - RNA, 22 nt, Human
ccuggcagguagcauugaggag

SEQ ID NO: 1049141 - RNA, 22 nt, Human
cuggccucuguguucaccauag

SEQ ID NO: 1049142 - RNA, 22 nt, Human
gccuggcaggccuguuggggcu

SEQ ID NO: 1049143 - RNA, 22 nt, Human
ucccacauuacccugacugaca

SEQ ID NO: 1049144 - RNA, 19 nt, Human
gugggacagacauuacaua

SEQ ID NO: 1049145 - RNA, 22 nt, Human
cacacaucuuaucccaguuauu

SEQ ID NO: 1049146 - RNA, 22 nt, Human
acuggcagaacuggugauuguc

SEQ ID NO: 1049147 - RNA, 22 nt, Human
ggagagaauuccauggacaugu

SEQ ID NO: 1049148 - RNA, 22 nt, Human
cucucugggcccaguuggcacc

SEQ ID NO: 1049149 - RNA, 22 nt, Human
ccuggcagcauugguagagauu

SEQ ID NO: 1049150 - RNA, 22 nt, Human
cugccugcuuaccaugcaucag

SEQ ID NO: 1049151 - RNA, 22 nt, Human
ggccucucugagagcagacguu

SEQ ID NO: 1049152 - RNA, 22 nt, Human
acacacaugguauuguucagaa

SEQ ID NO: 1049153 - RNA, 22 nt, Human
ccagguccuguuuucaccacag

SEQ ID NO: 1049154 - RNA, 22 nt, Human
uccucuccaugucucacgccac

SEQ ID NO: 1049155 - RNA, 22 nt, Human
gaggagcucaugaaagcggugu

SEQ ID NO: 1049156 - RNA, 22 nt, Human
gauggcagguaguggucucauc

SEQ ID NO: 1049157 - RNA, 22 nt, Human
uggcagagaacacacaugauuc

SEQ ID NO: 1049158 - RNA, 22 nt, Human
uggcacucacucucagagucug

SEQ ID NO: 1049159 - RNA, 22 nt, Human
ccuggcagaaagaguuacaccu

SEQ ID NO: 1049160 - RNA, 22 nt, Human
acacauaagccuaaucaucucc

SEQ ID NO: 1049161 - RNA, 22 nt, Human
gagaaagaugaagaguggcguu

SEQ ID NO: 1049162 - RNA, 22 nt, Human
cacaauguauauguauaucaaa

SEQ ID NO: 1049163 - RNA, 21 nt, Human
ucuggcaggaagacggauggg

SEQ ID NO: 1049164 - RNA, 22 nt, Human
ugcuccagugccugccccacag

SEQ ID NO: 1049165 - RNA, 22 nt, Human
ccacaaaacugugugucaaaga

SEQ ID NO: 1049166 - RNA, 22 nt, Human
acuggcagagggaaaaccauuc

SEQ ID NO: 1049167 - RNA, 22 nt, Human
aggcuggauuuauggggacuuc

SEQ ID NO: 1049168 - RNA, 22 nt, Human
agcacaggaccaaggaagcugu

SEQ ID NO: 1049169 - RNA, 22 nt, Human
uugggaaguuuaaugacagacu

SEQ ID NO: 1049170 - RNA, 22 nt, Human
aguguugggucuuuagaauuua

SEQ ID NO: 1049171 - RNA, 22 nt, Human
ugccugccucuggcagcccugc

SEQ ID NO: 1049172 - RNA, 22 nt, Human
cuggccucauagccaagcugug

SEQ ID NO: 1049173 - RNA, 22 nt, Human
uauguaaaguagauggcaggua

SEQ ID NO: 1049174 - RNA, 22 nt, Human
gagccugaugaaacaggcagac

SEQ ID NO: 1049175 - RNA, 22 nt, Human
cuucccacuaguaucacagagc

SEQ ID NO: 1049176 - RNA, 22 nt, Human
gaggcugcuuugaugacaggag

SEQ ID NO: 1049177 - RNA, 22 nt, Human
cccacccugggcuacacaucca

SEQ ID NO: 1049178 - RNA, 22 nt, Human
agagucccagggacacuccaga

SEQ ID NO: 1049179 - RNA, 22 nt, Human
auggccugaugcaccuguccca

SEQ ID NO: 1049180 - RNA, 20 nt, Human
ccuggcaggcggguuacuua

SEQ ID NO: 1049181 - RNA, 22 nt, Human
ccaggcccugcuccucacacca

SEQ ID NO: 1049182 - RNA, 22 nt, Human
ccucucccgggugccgcugggc

SEQ ID NO: 1049183 - RNA, 21 nt, Human
gggcagaggggccuccugggu

SEQ ID NO: 1049184 - RNA, 21 nt, Human
uccuguaagcuuggguggcuc

SEQ ID NO: 1049185 - RNA, 21 nt, Human
acacacucugagucuucuauu

SEQ ID NO: 1049186 - RNA, 22 nt, Human
ucuggcaggaccaugaagcgua

SEQ ID NO: 1049187 - RNA, 22 nt, Human
aagagagagugcgcucacagaa

SEQ ID NO: 1049188 - RNA, 22 nt, Human
aggguagggcccggagacagac

SEQ ID NO: 1049189 - RNA, 22 nt, Human
uggcaguagauccagucucucu

SEQ ID NO: 1049190 - RNA, 22 nt, Human
aggaagaaccuaagaaagucuc

SEQ ID NO: 1049191 - RNA, 22 nt, Human
acacacagcgccuaccaugugc

SEQ ID NO: 1049192 - RNA, 22 nt, Human
aacaaaagccgaaguagguguc

SEQ ID NO: 1049193 - RNA, 22 nt, Human
ccacagaccuuggcuuccaccu

SEQ ID NO: 1049194 - RNA, 22 nt, Human
guccucugacucagccuuggga

SEQ ID NO: 1049195 - RNA, 22 nt, Human
uagauacaggcucucugagccu

SEQ ID NO: 1049196 - RNA, 22 nt, Human
uccacacacauuucuaugugca

SEQ ID NO: 1049197 - RNA, 20 nt, Human
ugccuggccuuucucugccc

SEQ ID NO: 1049198 - RNA, 21 nt, Human
cagcccagcccauugacagug

SEQ ID NO: 1049199 - RNA, 22 nt, Human
ucuggcagagauauccauccca

SEQ ID NO: 1049200 - RNA, 22 nt, Human
cuccuggcacugucuugaccca

SEQ ID NO: 1049201 - RNA, 22 nt, Human
ccuggcagcgugccgagcugcg

SEQ ID NO: 1049202 - RNA, 22 nt, Human
ccagcccuuagauaaaccuggc

SEQ ID NO: 1049203 - RNA, 22 nt, Human
cccuuccugggugucccggagu

SEQ ID NO: 1049204 - RNA, 22 nt, Human
aagagccagcuagugaagaggc

SEQ ID NO: 1049205 - RNA, 22 nt, Human
uccaggcaaaaaccaacuacag

SEQ ID NO: 1049206 - RNA, 22 nt, Human
cuguccagcuuggcuccugggg

SEQ ID NO: 1049207 - RNA, 22 nt, Human
ccccacacucuuuacauucaua

SEQ ID NO: 1049208 - RNA, 22 nt, Human
aggccccaaagcagugcaagua

SEQ ID NO: 1049209 - RNA, 22 nt, Human
ccugccuucagcccugaagucu

SEQ ID NO: 1049210 - RNA, 19 nt, Human
ugccuggcaccagcuccac

SEQ ID NO: 1049211 - RNA, 22 nt, Human
acccacacaucucuaauucagu

SEQ ID NO: 1049212 - RNA, 22 nt, Human
guacacacaaucucuggucagu

SEQ ID NO: 1049213 - RNA, 21 nt, Human
uccugccuuaguccagagcag

SEQ ID NO: 1049214 - RNA, 20 nt, Human
gauacacagcacagagggcc

SEQ ID NO: 1049215 - RNA, 22 nt, Human
aagugccaucauagcauggcug

SEQ ID NO: 1049216 - RNA, 22 nt, Human
ccuggcagcagcacaugccuuc

SEQ ID NO: 1049217 - RNA, 22 nt, Human
guccucuggaagaugaguucuu

SEQ ID NO: 1049218 - RNA, 20 nt, Human
ccccacacuauugagcacuu

SEQ ID NO: 1049219 - RNA, 21 nt, Human
aaagagcccgcugagagguuc

SEQ ID NO: 1049220 - RNA, 22 nt, Human
cagaaagaccugggcucaagag

SEQ ID NO: 1049221 - RNA, 22 nt, Human
cucucuccuuagcugcagacca

SEQ ID NO: 1049222 - RNA, 22 nt, Human
acuggcagccacaacuggcagg

SEQ ID NO: 1049223 - RNA, 22 nt, Human
aaagaucaauagauaaagcuac

SEQ ID NO: 1049224 - RNA, 22 nt, Human
accugccuauggagccacaugg

SEQ ID NO: 1049225 - RNA, 22 nt, Human
uucauugcaguucuucagguua

SEQ ID NO: 1049226 - RNA, 22 nt, Human
acacaucagaaauaugaaugag

SEQ ID NO: 1049227 - RNA, 22 nt, Human
cacugucccuguuuccuggaaa

SEQ ID NO: 1049228 - RNA, 22 nt, Human
cgcauacauagaaacacacaga

SEQ ID NO: 1049229 - RNA, 22 nt, Human
uggcagugucuuaucaggagug

SEQ ID NO: 1049230 - RNA, 22 nt, Human
uacacacuuacuggagaugaag

SEQ ID NO: 1049231 - RNA, 21 nt, Human
acauacauaccuuaccaccuu

SEQ ID NO: 1049232 - RNA, 22 nt, Human
guccucuggccuuucccaggac

SEQ ID NO: 1049233 - RNA, 22 nt, Human
gccucaggccgcccugcugcuc

SEQ ID NO: 1049234 - RNA, 22 nt, Human
ccuggcagcccagagcgccgcu

SEQ ID NO: 1049235 - RNA, 22 nt, Human
aguguggcaggaaugacuagaa

SEQ ID NO: 1049236 - RNA, 22 nt, Human
aucacaauguacguuaaaaugu

SEQ ID NO: 1049237 - RNA, 22 nt, Human
aaagagucaaaggcaugucucu

SEQ ID NO: 1049238 - RNA, 22 nt, Human
ucuggcaguaauaggggagaga

SEQ ID NO: 1049239 - RNA, 22 nt, Human
aggacacacagaauacaaaucc

SEQ ID NO: 1049240 - RNA, 22 nt, Human
uggcaucuccgacagucuugau

SEQ ID NO: 1049241 - RNA, 22 nt, Human
acccacaccuccguauaucacu

SEQ ID NO: 1049242 - RNA, 18 nt, Human
uguagagccagguuugcc

SEQ ID NO: 1049243 - RNA, 22 nt, Human
agaggccggccgagcccauggg

SEQ ID NO: 1049244 - RNA, 22 nt, Human
ucacacacauuugcugucugau

SEQ ID NO: 1049245 - RNA, 19 nt, Human
acuggcaguuucugcaugg

SEQ ID NO: 1049246 - RNA, 17 nt, Human
ccauacugacauauuga

SEQ ID NO: 1049247 - RNA, 19 nt, Human
ccuugccugucccugcagc

SEQ ID NO: 1049248 - RNA, 22 nt, Human
gcuggcagguccaagauagagc

SEQ ID NO: 1049249 - RNA, 22 nt, Human
uggucucugcaggccaggcuca

SEQ ID NO: 1049250 - RNA, 18 nt, Human
ccuagccuccaagcucau

SEQ ID NO: 1049251 - RNA, 22 nt, Human
ccuugcucaagcuagugacggg

SEQ ID NO: 1049252 - RNA, 22 nt, Human
acacagaugcauuacacaucua

SEQ ID NO: 1049253 - RNA, 22 nt, Human
gacacagauaucucugagauua

SEQ ID NO: 1049254 - RNA, 22 nt, Human
auggcagauggcuggagcaggu

SEQ ID NO: 1049255 - RNA, 22 nt, Human
aggaggcuguggagcacuccau

SEQ ID NO: 1049256 - RNA, 22 nt, Human
acacaucaugccaaguuucacc

SEQ ID NO: 1049257 - RNA, 22 nt, Human
agccagggucucucgcucuguu

SEQ ID NO: 1049258 - RNA, 22 nt, Human
ugacaggaggcuugaggccagg

SEQ ID NO: 1049259 - RNA, 22 nt, Human
caggacaaagcccuuugagaaa

SEQ ID NO: 1049260 - RNA, 22 nt, Human
gacccggcuccaggcccagcag

SEQ ID NO: 1049261 - RNA, 22 nt, Human
ccucucagcgauuccucuugga

SEQ ID NO: 1049262 - RNA, 23 nt, Human
uuggagagggugaguagugucag

SEQ ID NO: 1049263 - RNA, 22 nt, Human
agggagacacaugaggaaguca

SEQ ID NO: 1049264 - RNA, 22 nt, Human
guugggaaggcaagaaguagaa

SEQ ID NO: 1049265 - RNA, 22 nt, Human
accugccuaucagcugccugcu

SEQ ID NO: 1049266 - RNA, 22 nt, Human
aggaggcugggcacaguggccu

SEQ ID NO: 1049267 - RNA, 22 nt, Human
gccuggcacaggaauuaggagg

SEQ ID NO: 1049268 - RNA, 22 nt, Human
ggccucucagggcagagacccu

SEQ ID NO: 1049269 - RNA, 22 nt, Human
aggccacaguacuuugcagacc

SEQ ID NO: 1049270 - RNA, 22 nt, Human
gucaggacucugacccgucccg

SEQ ID NO: 1049271 - RNA, 22 nt, Human
gauggccuuguuuucucccuuc

SEQ ID NO: 1049272 - RNA, 22 nt, Human
acacacuguugcucauccaggc

SEQ ID NO: 1049273 - RNA, 22 nt, Human
gaggagcuggcagcgucuccgc

SEQ ID NO: 1049274 - RNA, 22 nt, Human
ggugccagaguggcccaggggc

SEQ ID NO: 1049275 - RNA, 21 nt, Human
acacacugaguuuuccacugu

SEQ ID NO: 1049276 - RNA, 22 nt, Human
cacacacuguuaauguaggagu

SEQ ID NO: 1049277 - RNA, 22 nt, Human
gcuggcagcuggaaguugggcu

SEQ ID NO: 1049278 - RNA, 22 nt, Human
acaucacacgccuuccaggagg

SEQ ID NO: 1049279 - RNA, 22 nt, Human
ccaggcuguaagagugauguug

SEQ ID NO: 1049280 - RNA, 22 nt, Human
uuccaggcuucucuggggcguc

SEQ ID NO: 1049281 - RNA, 22 nt, Human
acacaucucaggggacacucuc

SEQ ID NO: 1049282 - RNA, 20 nt, Human
agggcugagaagggacuagc

SEQ ID NO: 1049283 - RNA, 22 nt, Human
aucucccagccacagcauucuu

SEQ ID NO: 1049284 - RNA, 22 nt, Human
acauaaugagcucuuuauaaau

SEQ ID NO: 1049285 - RNA, 21 nt, Human
guacacacagguggaugggcu

SEQ ID NO: 1049286 - RNA, 22 nt, Human
ccaggcccaggguacugaccaa

SEQ ID NO: 1049287 - RNA, 22 nt, Human
aucacagagauugcuuuuaaaa

SEQ ID NO: 1049288 - RNA, 18 nt, Human
gacaaaaguacagacaga

SEQ ID NO: 1049289 - RNA, 22 nt, Human
uggcagugguaccggcucucag

SEQ ID NO: 1049290 - RNA, 22 nt, Human
uccaggcuaauuuugcauuguu

SEQ ID NO: 1049291 - RNA, 22 nt, Human
cccagcaugcacgcugacacuc

SEQ ID NO: 1049292 - RNA, 22 nt, Human
ucccacaugugaauccucaggu

SEQ ID NO: 1049293 - RNA, 22 nt, Human
cugcaggacgaccgccucaucu

SEQ ID NO: 1049294 - RNA, 22 nt, Human
uccugagcccuguaggacccug

SEQ ID NO: 1049295 - RNA, 22 nt, Human
acacauaagaaacuacaaagag

SEQ ID NO: 1049296 - RNA, 20 nt, Human
ucacacaugguaagcuauga

SEQ ID NO: 1049297 - RNA, 22 nt, Human
cagcccaaagccccaggcuaga

SEQ ID NO: 1049298 - RNA, 22 nt, Human
cacauuccuggugcucagcagc

SEQ ID NO: 1049299 - RNA, 22 nt, Human
uucccacauucuuuacauucau

SEQ ID NO: 1049300 - RNA, 22 nt, Human
auaauggccgggggcugaaugc

SEQ ID NO: 1049301 - RNA, 22 nt, Human
acaucacaguaguuaagccaga

SEQ ID NO: 1049302 - RNA, 22 nt, Human
cugccugcucuauccaggccug

SEQ ID NO: 1049303 - RNA, 22 nt, Human
uggccugccacugccacgccac

SEQ ID NO: 1049304 - RNA, 22 nt, Human
guggcagugaaggucauagcau

SEQ ID NO: 1049305 - RNA, 22 nt, Human
uccaggaggaggaaggcugcca

SEQ ID NO: 1049306 - RNA, 22 nt, Human
auagggccuaaaaaguauugcu

SEQ ID NO: 1049307 - RNA, 20 nt, Human
acuggcagccugccugcugu

SEQ ID NO: 1049308 - RNA, 22 nt, Human
gcccucucuucugcagccucca

SEQ ID NO: 1049309 - RNA, 22 nt, Human
ucuggcaggauaucgaagugaa

SEQ ID NO: 1049310 - RNA, 22 nt, Human
uggcagggugccaguugcgagu

SEQ ID NO: 1049311 - RNA, 22 nt, Human
gcuggcaguuuccucaccgagg

SEQ ID NO: 1049312 - RNA, 22 nt, Human
acagguggggcacuuggagccu

SEQ ID NO: 1049313 - RNA, 22 nt, Human
ugcagagaaaacuccuggguac

SEQ ID NO: 1049314 - RNA, 22 nt, Human
ucccacacuacacgguuguugg

SEQ ID NO: 1049315 - RNA, 22 nt, Human
ugcacaggaggcuguggagaag

SEQ ID NO: 1049316 - RNA, 22 nt, Human
ucuggcagguucccauguuaug

SEQ ID NO: 1049317 - RNA, 22 nt, Human
agguagggaagaaggcaugaaa

SEQ ID NO: 1049318 - RNA, 22 nt, Human
guccucugcuucaugcccugau

SEQ ID NO: 1049319 - RNA, 22 nt, Human
acuggcagagacccugauggcc

SEQ ID NO: 1049320 - RNA, 22 nt, Human
cccagccugugacagccguccu

SEQ ID NO: 1049321 - RNA, 22 nt, Human
cauuacaaccccaaauuacaaa

SEQ ID NO: 1049322 - RNA, 22 nt, Human
cuuccucuagccuaguaaugcc

SEQ ID NO: 1049323 - RNA, 22 nt, Human
gccuccuggaagucacauguuu

SEQ ID NO: 1049324 - RNA, 22 nt, Human
uuggaaaguuuuuacugaagac

SEQ ID NO: 1049325 - RNA, 19 nt, Human
gcuggcagaauuuugaacc

SEQ ID NO: 1049326 - RNA, 22 nt, Human
gcacacacaugugaguacaugc

SEQ ID NO: 1049327 - RNA, 22 nt, Human
gcacauacccacugucaagcac

SEQ ID NO: 1049328 - RNA, 22 nt, Human
uuccaggccgggcaggaaacac

SEQ ID NO: 1049329 - RNA, 22 nt, Human
ccuggcagcuccuccccggcgg

SEQ ID NO: 1049330 - RNA, 22 nt, Human
cagcccaggccgacaguuccuc

SEQ ID NO: 1049331 - RNA, 22 nt, Human
gcuggcagagcucugggcuggg

SEQ ID NO: 1049332 - RNA, 22 nt, Human
aggcacaggaggugguaagaag

SEQ ID NO: 1049333 - RNA, 21 nt, Human
ucacacacguuuccaagggca

SEQ ID NO: 1049334 - RNA, 22 nt, Human
auuccacagcuacaucaaucua

SEQ ID NO: 1049335 - RNA, 22 nt, Human
cuccugaggacuucuauugggu

SEQ ID NO: 1049336 - RNA, 22 nt, Human
caggaguggugugagggacucc

SEQ ID NO: 1049337 - RNA, 22 nt, Human
cuguccuccagacgacaguccc

SEQ ID NO: 1049338 - RNA, 22 nt, Human
cccacacucugagaaaugcuga

SEQ ID NO: 1049339 - RNA, 23 nt, Human
guccucuggagagaaaggcagua

SEQ ID NO: 1049340 - RNA, 20 nt, Human
gcuggcagaugucuugagau

SEQ ID NO: 1049341 - RNA, 22 nt, Human
ucccugccugacagcacccacc

SEQ ID NO: 1049342 - RNA, 18 nt, Human
acucugcggaggccccag

SEQ ID NO: 1049343 - RNA, 22 nt, Human
uuccuggcucacagcagugggg

SEQ ID NO: 1049344 - RNA, 22 nt, Human
cuggcagguuuggugucuggug

SEQ ID NO: 1049345 - RNA, 22 nt, Human
gccuccggagucacagugucuu

SEQ ID NO: 1049346 - RNA, 22 nt, Human
ugcuggcacguggaccaggaga

SEQ ID NO: 1049347 - RNA, 22 nt, Human
cuggcaguauuaagagaaguga

SEQ ID NO: 1049348 - RNA, 22 nt, Human
acacacuggcccccaguacuga

SEQ ID NO: 1049349 - RNA, 22 nt, Human
gcuggcagugugaaugacaagc

SEQ ID NO: 1049350 - RNA, 22 nt, Human
accugccucagugcagcuggau

SEQ ID NO: 1049351 - RNA, 22 nt, Human
guccucugcccaggucaagguu

SEQ ID NO: 1049352 - RNA, 22 nt, Human
ucuggcagugauuucugugauc

SEQ ID NO: 1049353 - RNA, 17 nt, Human
agccugccccaugcugc

SEQ ID NO: 1049354 - RNA, 22 nt, Human
cuccaggcucguccaagaucga

SEQ ID NO: 1049355 - RNA, 22 nt, Human
gcacacauucggauucuuaacc

SEQ ID NO: 1049356 - RNA, 22 nt, Human
gacaaaaguguuuugaacaagg

SEQ ID NO: 1049357 - RNA, 22 nt, Human
gcugcuaagcguuucuguucca

SEQ ID NO: 1049358 - RNA, 22 nt, Human
acugagagucaagauagcaugg

SEQ ID NO: 1049359 - RNA, 22 nt, Human
cugccucuauaggaguccacca

SEQ ID NO: 1049360 - RNA, 22 nt, Human
aggcugcuucagcugcagggag

SEQ ID NO: 1049361 - RNA, 22 nt, Human
caucacagaaauaaacauaccu

SEQ ID NO: 1049362 - RNA, 22 nt, Human
uccugcagccacugcaggcaga

SEQ ID NO: 1049363 - RNA, 22 nt, Human
gcuccaggaggaugaccuuccu

SEQ ID NO: 1049364 - RNA, 19 nt, Human
acauucccaucagcaaugu

SEQ ID NO: 1049365 - RNA, 22 nt, Human
uuccaggcugaugggccacagg

SEQ ID NO: 1049366 - RNA, 22 nt, Human
ucacacacauaaucuaagauua

SEQ ID NO: 1049367 - RNA, 22 nt, Human
guccucugggcagcugccccac

SEQ ID NO: 1049368 - RNA, 19 nt, Human
ccagucccauacaggagau

SEQ ID NO: 1049369 - RNA, 18 nt, Human
gccugcucugcucucccc

SEQ ID NO: 1049370 - RNA, 22 nt, Human
acacacagguaaaggagccugg

SEQ ID NO: 1049371 - RNA, 22 nt, Human
ucuggcagcaagauaacaaugg

SEQ ID NO: 1049372 - RNA, 22 nt, Human
ucuggcagcucaguucaggucu

SEQ ID NO: 1049373 - RNA, 22 nt, Human
uccuucccaggugucgccgccu

SEQ ID NO: 1049374 - RNA, 22 nt, Human
gaggggcuggguagggcaaccc

SEQ ID NO: 1049375 - RNA, 16 nt, Human
ucacauacuuccuugc

SEQ ID NO: 1049376 - RNA, 22 nt, Human
acuggcagguccaucgcccuuu

SEQ ID NO: 1049377 - RNA, 22 nt, Human
acaucccacagaaacauacaua

SEQ ID NO: 1049378 - RNA, 18 nt, Human
cuccuccacagccccugc

SEQ ID NO: 1049379 - RNA, 22 nt, Human
acacacaugcaugcuugccauu

SEQ ID NO: 1049380 - RNA, 22 nt, Human
uucccacaguguugaauccucu

SEQ ID NO: 1049381 - RNA, 22 nt, Human
ucacacagcuccuuuccuuagu

SEQ ID NO: 1049382 - RNA, 22 nt, Human
agaggcuucucggauggggcag

SEQ ID NO: 1049383 - RNA, 22 nt, Human
gcacacacuguuuuccucacau

SEQ ID NO: 1049384 - RNA, 22 nt, Human
uccaggcucuaggcugcucucc

SEQ ID NO: 1049385 - RNA, 22 nt, Human
cacacacuggagcaaggagaug

SEQ ID NO: 1049386 - RNA, 22 nt, Human
uccugugccaucucuagagacu

SEQ ID NO: 1049387 - RNA, 22 nt, Human
gcuggcagggugguugagagag

SEQ ID NO: 1049388 - RNA, 22 nt, Human
uccccacacuuucacuccuggc

SEQ ID NO: 1049389 - RNA, 22 nt, Human
aaagaucacgucccaggacucg

SEQ ID NO: 1049390 - RNA, 22 nt, Human
uccugagcuacaguaguaugau

SEQ ID NO: 1049391 - RNA, 22 nt, Human
uuccaggcuauccggugaaggg

SEQ ID NO: 1049392 - RNA, 18 nt, Human
ccuggcagccaugcgcgc

SEQ ID NO: 1049393 - RNA, 22 nt, Human
gccuccuguuaugccaugugcc

SEQ ID NO: 1049394 - RNA, 22 nt, Human
aggcaguguguagcuggaagag

SEQ ID NO: 1049395 - RNA, 22 nt, Human
cccagccuuugcuuccugguuc

SEQ ID NO: 1049396 - RNA, 23 nt, Human
uccuuccuuugagaggcuccauc

SEQ ID NO: 1049397 - RNA, 22 nt, Human
ugcacaggugagacucaggaag

SEQ ID NO: 1049398 - RNA, 22 nt, Human
gacccauauaggacccuccaaa

SEQ ID NO: 1049399 - RNA, 22 nt, Human
gcuggcagucccaucagcuggg

SEQ ID NO: 1049400 - RNA, 22 nt, Human
gucacacagggccuccaaauca

SEQ ID NO: 1049401 - RNA, 22 nt, Human
gguuccuucugaggucccugua

SEQ ID NO: 1049402 - RNA, 22 nt, Human
uacacaacugacaaccauucug

SEQ ID NO: 1049403 - RNA, 22 nt, Human
gccagguugcugacgacgaucu

SEQ ID NO: 1049404 - RNA, 22 nt, Human
gcacucuccuggcugccacagu

SEQ ID NO: 1049405 - RNA, 22 nt, Human
gacacagaaggucacauguuca

SEQ ID NO: 1049406 - RNA, 22 nt, Human
gccuccggaguugcagugucuu

SEQ ID NO: 1049407 - RNA, 22 nt, Human
aucacagagcucccuuccacug

SEQ ID NO: 1049408 - RNA, 22 nt, Human
cuggccucagagggucauggug

SEQ ID NO: 1049409 - RNA, 22 nt, Human
gcacacaguagggauucaauga

SEQ ID NO: 1049410 - RNA, 22 nt, Human
cuggcaggagcauucacagagg

SEQ ID NO: 1049411 - RNA, 22 nt, Human
cuggcagucugguggaaggccu

SEQ ID NO: 1049412 - RNA, 22 nt, Human
guccucuggagguuuuuaggug

SEQ ID NO: 1049413 - RNA, 22 nt, Human
acacacuguaaggacuaucacu

SEQ ID NO: 1049414 - RNA, 22 nt, Human
uccuggcaguaauuugauguug

SEQ ID NO: 1049415 - RNA, 22 nt, Human
aagucguggcaggcuugcacga

SEQ ID NO: 1049416 - RNA, 22 nt, Human
cacauaagaaaugaauaugaga

SEQ ID NO: 1049417 - RNA, 22 nt, Human
cccacacacauuuaugauagga

SEQ ID NO: 1049418 - RNA, 22 nt, Human
acuggcagagguuggacaccau

SEQ ID NO: 1049419 - RNA, 22 nt, Human
uggcacaguccugggugccugc

SEQ ID NO: 1049420 - RNA, 22 nt, Human
gcacaggaugauggguugaggg

SEQ ID NO: 1049421 - RNA, 22 nt, Human
cccacacacuggcugcugccaa

SEQ ID NO: 1049422 - RNA, 22 nt, Human
ccuggcagcuccguggccuucc

SEQ ID NO: 1049423 - RNA, 22 nt, Human
uguaaacauaccagagccaagu

SEQ ID NO: 1049424 - RNA, 22 nt, Human
guggcaguuuugacaucacaaa

SEQ ID NO: 1049425 - RNA, 22 nt, Human
ccuggcagcuguuuggcuuggc

SEQ ID NO: 1049426 - RNA, 23 nt, Human
ccuggcagcaaacgaggagguua

SEQ ID NO: 1049427 - RNA, 22 nt, Human
uccaggcuagguuuacaggaca

SEQ ID NO: 1049428 - RNA, 22 nt, Human
ucaucacauaugucaugauuug

SEQ ID NO: 1049429 - RNA, 22 nt, Human
uacaaaaguaauuacgguuuuu

SEQ ID NO: 1049430 - RNA, 21 nt, Human
ccacucaugacuccacucacc

SEQ ID NO: 1049431 - RNA, 22 nt, Human
gcuggcaggagaaacggggugc

SEQ ID NO: 1049432 - RNA, 22 nt, Human
gccccaccuugagagcagaaac

SEQ ID NO: 1049433 - RNA, 22 nt, Human
gagggugucugcguaacuggca

SEQ ID NO: 1049434 - RNA, 20 nt, Human
aaaagagugcuucaacugcu

SEQ ID NO: 1049435 - RNA, 22 nt, Human
ggggcugagucagugggaagag

SEQ ID NO: 1049436 - RNA, 22 nt, Human
uccuggcauugugcagggugug

SEQ ID NO: 1049437 - RNA, 22 nt, Human
acacacagaguuuauacaggca

SEQ ID NO: 1049438 - RNA, 22 nt, Human
agcacaggaacauggagauggg

SEQ ID NO: 1049439 - RNA, 22 nt, Human
aaagaucaaguaggcauggccu

SEQ ID NO: 1049440 - RNA, 22 nt, Human
gcuggcagaauuucuucuugcu

SEQ ID NO: 1049441 - RNA, 17 nt, Human
ugccagccugucccagg

SEQ ID NO: 1049442 - RNA, 22 nt, Human
guccucugaaguugugcaaugc

SEQ ID NO: 1049443 - RNA, 22 nt, Human
ucaucacaauuuuaugacccuc

SEQ ID NO: 1049444 - RNA, 22 nt, Human
gccuggcaaggcccuguugacu

SEQ ID NO: 1049445 - RNA, 22 nt, Human
ucaggagcucuucccuggugug

SEQ ID NO: 1049446 - RNA, 22 nt, Human
ucccacaccugucuauuccuag

SEQ ID NO: 1049447 - RNA, 22 nt, Human
ccccacaccugccgggcagcag

SEQ ID NO: 1049448 - RNA, 22 nt, Human
ugccucucuaacccaugcccaa

SEQ ID NO: 1049449 - RNA, 18 nt, Human
ggccucuggacuggcagc

SEQ ID NO: 1049450 - RNA, 22 nt, Human
uauuacagaaucaggcauaacu

SEQ ID NO: 1049451 - RNA, 22 nt, Human
caggcuggagugcaauggcaca

SEQ ID NO: 1049452 - RNA, 22 nt, Human
uacacagaaccugguguacagu

SEQ ID NO: 1049453 - RNA, 21 nt, Human
ucuggcaggcacgggcccagc

SEQ ID NO: 1049454 - RNA, 22 nt, Human
ucuggcaguuccuuguugauau

SEQ ID NO: 1049455 - RNA, 22 nt, Human
caugagauaauuuuucuccagu

SEQ ID NO: 1049456 - RNA, 22 nt, Human
ugagagucucagaccuccuggu

SEQ ID NO: 1049457 - RNA, 22 nt, Human
cugccugccacguucagcugua

SEQ ID NO: 1049458 - RNA, 22 nt, Human
uccuggcagggucuaggucuag

SEQ ID NO: 1049459 - RNA, 22 nt, Human
gaggagcuguucccucaccucu

SEQ ID NO: 1049460 - RNA, 22 nt, Human
ccuccccaugacccggugcugg

SEQ ID NO: 1049461 - RNA, 22 nt, Human
ccuggcagguggagguugcagu

SEQ ID NO: 1049462 - RNA, 22 nt, Human
gagaaagauguaggcugggagg

SEQ ID NO: 1049463 - RNA, 22 nt, Human
cacuguccaauagauacauaau

SEQ ID NO: 1049464 - RNA, 22 nt, Human
acuggcagaggauagcacuaau

SEQ ID NO: 1049465 - RNA, 22 nt, Human
aggccuccagccacaugccagu

SEQ ID NO: 1049466 - RNA, 22 nt, Human
ucuggcagcaagucuguuucuc

SEQ ID NO: 1049467 - RNA, 19 nt, Human
acuggcagcuguagucugu

SEQ ID NO: 1049468 - RNA, 22 nt, Human
acacagaguuugacacauggga

SEQ ID NO: 1049469 - RNA, 22 nt, Human
aaagagucuggcacuguaccag

SEQ ID NO: 1049470 - RNA, 17 nt, Human
uccaggcagcaacugag

SEQ ID NO: 1049471 - RNA, 22 nt, Human
aggaggcugaacuagggucugg

SEQ ID NO: 1049472 - RNA, 17 nt, Human
gcaucacagauaacacg

SEQ ID NO: 1049473 - RNA, 22 nt, Human
gucacaggccuggaugaggggc

SEQ ID NO: 1049474 - RNA, 22 nt, Human
uacacaucccagacucccagga

SEQ ID NO: 1049475 - RNA, 22 nt, Human
ccacccuaacaauccuuacugu

SEQ ID NO: 1049476 - RNA, 22 nt, Human
uacauuccuguuagcaucuaag

SEQ ID NO: 1049477 - RNA, 22 nt, Human
ucuuuuucugcacacguguccc

SEQ ID NO: 1049478 - RNA, 22 nt, Human
uuccagcccgcgacuuguucag

SEQ ID NO: 1049479 - RNA, 22 nt, Human
cuccucuggguccugguggcca

SEQ ID NO: 1049480 - RNA, 22 nt, Human
gcuggcagagagcuggugagga

SEQ ID NO: 1049481 - RNA, 22 nt, Human
uccacccugcuuuugucuuuga

SEQ ID NO: 1049482 - RNA, 22 nt, Human
cuugggaaugcuaacagaugac

SEQ ID NO: 1049483 - RNA, 22 nt, Human
uacacaucacuguaucuuucag

SEQ ID NO: 1049484 - RNA, 22 nt, Human
uacacaucucugucaguaguga

SEQ ID NO: 1049485 - RNA, 22 nt, Human
cuggcacgcccacguaggcacu

SEQ ID NO: 1049486 - RNA, 22 nt, Human
gaggagcugcagggggagucua

SEQ ID NO: 1049487 - RNA, 22 nt, Human
cccagccuacucugccauagca

SEQ ID NO: 1049488 - RNA, 22 nt, Human
cuuggcagagggcugggcucag

SEQ ID NO: 1049489 - RNA, 17 nt, Human
gccuucucugcccucac

SEQ ID NO: 1049490 - RNA, 22 nt, Human
ggagaagaggagcuggaagccu

SEQ ID NO: 1049491 - RNA, 22 nt, Human
cccacacaaaucauggggagaa

SEQ ID NO: 1049492 - RNA, 22 nt, Human
ucuggcaguggaugagggcagc

SEQ ID NO: 1049493 - RNA, 22 nt, Human
caaauacuacgauucuugcagu

SEQ ID NO: 1049494 - RNA, 22 nt, Human
acacacuuuaaauuaaaccucu

SEQ ID NO: 1049495 - RNA, 21 nt, Human
aacacauccagaguauuugac

SEQ ID NO: 1049496 - RNA, 22 nt, Human
ggagcugaaccccaucgugcug

SEQ ID NO: 1049497 - RNA, 22 nt, Human
ggccucucaugcccagagccaa

SEQ ID NO: 1049498 - RNA, 22 nt, Human
cacacacaguuuuguauucugu

SEQ ID NO: 1049499 - RNA, 22 nt, Human
agucuagggugggguccacagg

SEQ ID NO: 1049500 - RNA, 22 nt, Human
ccagcccugccagagagagcug

SEQ ID NO: 1049501 - RNA, 22 nt, Human
ggcugaguugagaggauuacuu

SEQ ID NO: 1049502 - RNA, 22 nt, Human
guccucuguguaggcugcagac

SEQ ID NO: 1049503 - RNA, 17 nt, Human
uuaagguggaucagcac

SEQ ID NO: 1049504 - RNA, 22 nt, Human
aauggcagaggcaaagauggua

SEQ ID NO: 1049505 - RNA, 22 nt, Human
uguaaacauauguauguaugua

SEQ ID NO: 1049506 - RNA, 22 nt, Human
gccuggcauauaguaguugugc

SEQ ID NO: 1049507 - RNA, 22 nt, Human
cuuacaaauacacuuaggagag

SEQ ID NO: 1049508 - RNA, 22 nt, Human
uaaaggguagguuuuacuguaa

SEQ ID NO: 1049509 - RNA, 22 nt, Human
gcacauacugcaaagauuacua

SEQ ID NO: 1049510 - RNA, 20 nt, Human
gagucacagaagaagcugaa

SEQ ID NO: 1049511 - RNA, 22 nt, Human
gcacacaggcaguuuccagcca

SEQ ID NO: 1049512 - RNA, 23 nt, Human
aguguugguugggaagccaagca

SEQ ID NO: 1049513 - RNA, 22 nt, Human
ccagugcccagcugcccaggca

SEQ ID NO: 1049514 - RNA, 22 nt, Human
augacugcucugggcucccaug

SEQ ID NO: 1049515 - RNA, 22 nt, Human
acaguucccgucuugcacagcu

SEQ ID NO: 1049516 - RNA, 22 nt, Human
ccacacuaaacugcucaaacca

SEQ ID NO: 1049517 - RNA, 15 nt, Human
cacacagacagcuug

SEQ ID NO: 1049518 - RNA, 22 nt, Human
ugaccaggauacugcagggaug

SEQ ID NO: 1049519 - RNA, 22 nt, Human
acuggcaguagagggagcgcau

SEQ ID NO: 1049520 - RNA, 20 nt, Human
cccagccccuaccuguugcc

SEQ ID NO: 1049521 - RNA, 22 nt, Human
ccuccagcgcgauccacuccgg

SEQ ID NO: 1049522 - RNA, 22 nt, Human
cugagagaucaagccacaggau

SEQ ID NO: 1049523 - RNA, 22 nt, Human
uggcacagggcuuggucgcuca

SEQ ID NO: 1049524 - RNA, 22 nt, Human
acacucacccucccacugccug

SEQ ID NO: 1049525 - RNA, 22 nt, Human
agcccaggucuggcccagccug

SEQ ID NO: 1049526 - RNA, 22 nt, Human
ccuggcaguggugaagaagagg

SEQ ID NO: 1049527 - RNA, 22 nt, Human
acccacccuacuagcagugucc

SEQ ID NO: 1049528 - RNA, 22 nt, Human
gggacaauggaggccucucucc

SEQ ID NO: 1049529 - RNA, 22 nt, Human
ccuggcaggacuguuguaagaa

SEQ ID NO: 1049530 - RNA, 22 nt, Human
cugccugcucaccagggcucug

SEQ ID NO: 1049531 - RNA, 22 nt, Human
gaaagacuuccuuugagaguac

SEQ ID NO: 1049532 - RNA, 22 nt, Human
uggccucugggaaagcagauuc

SEQ ID NO: 1049533 - RNA, 22 nt, Human
cacacaucaaccuagacauugu

SEQ ID NO: 1049534 - RNA, 22 nt, Human
cacacagacagcucucugaaga

SEQ ID NO: 1049535 - RNA, 22 nt, Human
auccaggccccaagaccccgac

SEQ ID NO: 1049536 - RNA, 22 nt, Human
gcuggcaguaaaggguuuggca

SEQ ID NO: 1049537 - RNA, 22 nt, Human
gcccacaccauuuauucuuugu

SEQ ID NO: 1049538 - RNA, 22 nt, Human
cacuguccaugcuugcuaaccc

SEQ ID NO: 1049539 - RNA, 22 nt, Human
cauucccacguguucuuugcuu

SEQ ID NO: 1049540 - RNA, 22 nt, Human
auggccuggggauuccugagca

SEQ ID NO: 1049541 - RNA, 22 nt, Human
ucccuccccacuucugagcuuu

SEQ ID NO: 1049542 - RNA, 20 nt, Human
cacaacuguccacaugcucc

SEQ ID NO: 1049543 - RNA, 19 nt, Human
agaggccucagcagcuggc

SEQ ID NO: 1049544 - RNA, 22 nt, Human
auggcagaccuccuggccacaa

SEQ ID NO: 1049545 - RNA, 22 nt, Human
agacacagucugucuggaggag

SEQ ID NO: 1049546 - RNA, 20 nt, Human
acaaagacuggaaaagcaag

SEQ ID NO: 1049547 - RNA, 22 nt, Human
gguggcagaggugcaucagccc

SEQ ID NO: 1049548 - RNA, 22 nt, Human
ccuggcaguucaucaaauggca

SEQ ID NO: 1049549 - RNA, 22 nt, Human
caccagggccccaggcugugcc

SEQ ID NO: 1049550 - RNA, 22 nt, Human
ccagcccuugcugaaggguggc

SEQ ID NO: 1049551 - RNA, 18 nt, Human
cuccuggcugauggugag

SEQ ID NO: 1049552 - RNA, 22 nt, Human
cccacccucaagggugucuaua

SEQ ID NO: 1049553 - RNA, 23 nt, Human
uuccaggcagagcagggauuaga

SEQ ID NO: 1049554 - RNA, 22 nt, Human
gacacagacaguuagagguaau

SEQ ID NO: 1049555 - RNA, 22 nt, Human
acagguggaggcuuuaggaggu

SEQ ID NO: 1049556 - RNA, 22 nt, Human
gacugccucaguuucccugcag

SEQ ID NO: 1049557 - RNA, 22 nt, Human
ccuggcagggcugcaguaaugg

SEQ ID NO: 1049558 - RNA, 22 nt, Human
ccagccucacuggcaucaccua

SEQ ID NO: 1049559 - RNA, 22 nt, Human
ccccacccaccuaagagaaacu

SEQ ID NO: 1049560 - RNA, 22 nt, Human
gugggagaaauuagcucuaguu

SEQ ID NO: 1049561 - RNA, 19 nt, Human
uggcagguagugagcaguc

SEQ ID NO: 1049562 - RNA, 22 nt, Human
ccugaccuauuuuucucagcug

SEQ ID NO: 1049563 - RNA, 22 nt, Human
guugggaaggugaacaugaugc

SEQ ID NO: 1049564 - RNA, 17 nt, Human
ugcuggcaacauacaaa

SEQ ID NO: 1049565 - RNA, 22 nt, Human
cugccugcaggacaccucgcua

SEQ ID NO: 1049566 - RNA, 22 nt, Human
uccccaccuaagauacccaucu

SEQ ID NO: 1049567 - RNA, 22 nt, Human
ucaggcccuucucccaggacuc

SEQ ID NO: 1049568 - RNA, 22 nt, Human
gaggagcucugcuccauccuuc

SEQ ID NO: 1049569 - RNA, 22 nt, Human
ucacacagcugacagagccuuu

SEQ ID NO: 1049570 - RNA, 22 nt, Human
agggcugacagugaggagucaa

SEQ ID NO: 1049571 - RNA, 20 nt, Human
ucccucccuccagcucuggg

SEQ ID NO: 1049572 - RNA, 22 nt, Human
cacaauuuuaauacacagucaa

SEQ ID NO: 1049573 - RNA, 22 nt, Human
ugccugacugcugccaccacua

SEQ ID NO: 1049574 - RNA, 22 nt, Human
ucaggauggagggaagcacaga

SEQ ID NO: 1049575 - RNA, 22 nt, Human
agaggcuuggaggugcaagguu

SEQ ID NO: 1049576 - RNA, 22 nt, Human
acuggcagugucguuuacauga

SEQ ID NO: 1049577 - RNA, 22 nt, Human
ggagcugaguucuucagccggg

SEQ ID NO: 1049578 - RNA, 22 nt, Human
uccuggcauccgugggucugug

SEQ ID NO: 1049579 - RNA, 19 nt, Human
acuggcagggcugcggugg

SEQ ID NO: 1049580 - RNA, 22 nt, Human
ucccugccuccuggcagugcca

SEQ ID NO: 1049581 - RNA, 22 nt, Human
cugccugcugcccuccagagcc

SEQ ID NO: 1049582 - RNA, 22 nt, Human
uccugagcaacacagcuaagug

SEQ ID NO: 1049583 - RNA, 22 nt, Human
aggaagaacagauaauggacgc

SEQ ID NO: 1049584 - RNA, 22 nt, Human
ggagcugaaggggugggcucag

SEQ ID NO: 1049585 - RNA, 21 nt, Human
ucuggcaguggucuuucaaau

SEQ ID NO: 1049586 - RNA, 22 nt, Human
cacacagaaccgcucgccacuu

SEQ ID NO: 1049587 - RNA, 22 nt, Human
cuugccucccucagcucacagc

SEQ ID NO: 1049588 - RNA, 22 nt, Human
acagacuggccugucucgcacc

SEQ ID NO: 1049589 - RNA, 22 nt, Human
gcaguguuuguguucucacaug

SEQ ID NO: 1049590 - RNA, 22 nt, Human
gagacaucauaaugaaguuucc

SEQ ID NO: 1049591 - RNA, 22 nt, Human
cucaccccacuaccccuuggug

SEQ ID NO: 1049592 - RNA, 22 nt, Human
guacacacuguuugaucauuuc

SEQ ID NO: 1049593 - RNA, 22 nt, Human
ccuggcaggcaagaggaaggga

SEQ ID NO: 1049594 - RNA, 22 nt, Human
ugggacucacucuuuuggccag

SEQ ID NO: 1049595 - RNA, 20 nt, Human
ucuggcaggugaacgagcug

SEQ ID NO: 1049596 - RNA, 22 nt, Human
gcacauaacugaccacaucuaa

SEQ ID NO: 1049597 - RNA, 22 nt, Human
cccuggcagagggggcaggugc

SEQ ID NO: 1049598 - RNA, 22 nt, Human
uuggaacaugccgggguccagg

SEQ ID NO: 1049599 - RNA, 22 nt, Human
cucaucaccacauauaacaaag

SEQ ID NO: 1049600 - RNA, 22 nt, Human
guccucuguuagaaaugugcuu

SEQ ID NO: 1049601 - RNA, 22 nt, Human
ggcccagcgaggccaccuacag

SEQ ID NO: 1049602 - RNA, 22 nt, Human
cucagccccaauucuccccauu

SEQ ID NO: 1049603 - RNA, 22 nt, Human
cacauacauucauguuacucua

SEQ ID NO: 1049604 - RNA, 22 nt, Human
ucccaccccuugacucuuuaag

SEQ ID NO: 1049605 - RNA, 22 nt, Human
uucaguuccauuucaggugggu

SEQ ID NO: 1049606 - RNA, 22 nt, Human
cccacccugggaagcuaggcag

SEQ ID NO: 1049607 - RNA, 22 nt, Human
gaggcugcggggaggagccugc

SEQ ID NO: 1049608 - RNA, 22 nt, Human
acacucuguaaugucacacucc

SEQ ID NO: 1049609 - RNA, 22 nt, Human
agcacugugauuuauaacauuu

SEQ ID NO: 1049610 - RNA, 22 nt, Human
gaggagcugggacccugucauc

SEQ ID NO: 1049611 - RNA, 22 nt, Human
aaauacugcugcuauuccuuuu

SEQ ID NO: 1049612 - RNA, 22 nt, Human
cccagcccacgguccugggugg

SEQ ID NO: 1049613 - RNA, 22 nt, Human
uccaggcuugagaccaggcucu

SEQ ID NO: 1049614 - RNA, 22 nt, Human
ccucccuucaguagagcccaau

SEQ ID NO: 1049615 - RNA, 22 nt, Human
ucuggcaguugccgcuucaguc

SEQ ID NO: 1049616 - RNA, 22 nt, Human
ucuggcagggucagggcccagg

SEQ ID NO: 1049617 - RNA, 22 nt, Human
caauacugaguuuacauucauc

SEQ ID NO: 1049618 - RNA, 21 nt, Human
cacacagugaucuauccacau

SEQ ID NO: 1049619 - RNA, 22 nt, Human
guugggaagcagauggaugagc

SEQ ID NO: 1049620 - RNA, 22 nt, Human
uuccaggcucccuuggaggugu

SEQ ID NO: 1049621 - RNA, 22 nt, Human
cccagccuuccacccuggacua

SEQ ID NO: 1049622 - RNA, 22 nt, Human
uccuggcagaaauggggcugug

SEQ ID NO: 1049623 - RNA, 22 nt, Human
cugagggucaacuugauuguau

SEQ ID NO: 1049624 - RNA, 22 nt, Human
ugcagagaagaggacaguucua

SEQ ID NO: 1049625 - RNA, 22 nt, Human
aaaaagucugcaaaggagguug

SEQ ID NO: 1049626 - RNA, 21 nt, Human
gggagggauggaaaugauguu

SEQ ID NO: 1049627 - RNA, 22 nt, Human
gaggcuguuaggagggacucug

SEQ ID NO: 1049628 - RNA, 22 nt, Human
uuggagagauuuaggucucagu

SEQ ID NO: 1049629 - RNA, 22 nt, Human
ucuccacacuuucucucccagg

SEQ ID NO: 1049630 - RNA, 22 nt, Human
ucuggcagcagcaucaguggcu

SEQ ID NO: 1049631 - RNA, 22 nt, Human
acaaauccagugaacuccagug

SEQ ID NO: 1049632 - RNA, 22 nt, Human
cccacacauuuuucacuuaccg

SEQ ID NO: 1049633 - RNA, 22 nt, Human
ucccagccuggacccugccagu

SEQ ID NO: 1049634 - RNA, 23 nt, Human
acuccccagucucuucuugccaa

SEQ ID NO: 1049635 - RNA, 22 nt, Human
ucuggcagaggaaggaggccug

SEQ ID NO: 1049636 - RNA, 22 nt, Human
guccucugggagccuugagccu

SEQ ID NO: 1049637 - RNA, 22 nt, Human
gccacagguacuaugggagaga

SEQ ID NO: 1049638 - RNA, 22 nt, Human
ugcagagagaccccugggccag

SEQ ID NO: 1049639 - RNA, 22 nt, Human
cacagagacagaagcacuuaug

SEQ ID NO: 1049640 - RNA, 22 nt, Human
uucuuucaauagcuggcauaug

SEQ ID NO: 1049641 - RNA, 22 nt, Human
uuuaaauuuagaagaaacacug

SEQ ID NO: 1049642 - RNA, 22 nt, Human
ugagggacucccggcccugcca

SEQ ID NO: 1049643 - RNA, 22 nt, Human
cuggcaugaaauggcaucucau

SEQ ID NO: 1049644 - RNA, 22 nt, Human
accugccuucucaaggacauga

SEQ ID NO: 1049645 - RNA, 22 nt, Human
gaaaagaguccugugugaggag

SEQ ID NO: 1049646 - RNA, 22 nt, Human
uccccaccccagaacuacuagg

SEQ ID NO: 1049647 - RNA, 22 nt, Human
ccaggccucuggcugcuuaguc

SEQ ID NO: 1049648 - RNA, 22 nt, Human
agacaagaaacugggagucucu

SEQ ID NO: 1049649 - RNA, 22 nt, Human
ccaccccaaaugaagaccucuc

SEQ ID NO: 1049650 - RNA, 22 nt, Human
ggcacagggggcugaggacuag

SEQ ID NO: 1049651 - RNA, 22 nt, Human
cccgagugucuacucacuccca

SEQ ID NO: 1049652 - RNA, 22 nt, Human
uugggaucucaaauccagcuau

SEQ ID NO: 1049653 - RNA, 22 nt, Human
cacauacaaggcacacuggagg

SEQ ID NO: 1049654 - RNA, 22 nt, Human
gcagggacagggcagggccuuu

SEQ ID NO: 1049655 - RNA, 19 nt, Human
uccuggcauuuguaggaaa

SEQ ID NO: 1049656 - RNA, 22 nt, Human
acacauacauggggaagaugag

SEQ ID NO: 1049657 - RNA, 22 nt, Human
gccccacagccugcggucucag

SEQ ID NO: 1049658 - RNA, 22 nt, Human
cagacagagucuucccaucagu

SEQ ID NO: 1049659 - RNA, 22 nt, Human
cuggcaguuugccaggagcucg

SEQ ID NO: 1049660 - RNA, 22 nt, Human
uccuggcagugcuuguuuugga

SEQ ID NO: 1049661 - RNA, 22 nt, Human
ccuggcagcgccgaagcuggcc

SEQ ID NO: 1049662 - RNA, 19 nt, Human
cagcccucuuaccacugug

SEQ ID NO: 1049663 - RNA, 22 nt, Human
gaccugccugagcugccucugc

SEQ ID NO: 1049664 - RNA, 22 nt, Human
ucaggcccagagucacggaucc

SEQ ID NO: 1049665 - RNA, 22 nt, Human
ccuggcugguggcagcgacaag

SEQ ID NO: 1049666 - RNA, 22 nt, Human
ucccacaggaaaguagacauug

SEQ ID NO: 1049667 - RNA, 22 nt, Human
guccuggcccacuggcaggcug

SEQ ID NO: 1049668 - RNA, 22 nt, Human
uguaaagaaagacgcagaguua

SEQ ID NO: 1049669 - RNA, 22 nt, Human
uggccuccccuaacagccucuu

SEQ ID NO: 1049670 - RNA, 22 nt, Human
cucuccagaauaugccgccgug

SEQ ID NO: 1049671 - RNA, 22 nt, Human
agagcacagaagaauaggugcu

SEQ ID NO: 1049672 - RNA, 22 nt, Human
ucuggcagcucuccucggcgga

SEQ ID NO: 1049673 - RNA, 22 nt, Human
auccaggcgaaugcagaaggcc

SEQ ID NO: 1049674 - RNA, 22 nt, Human
ccagcccugucaccaacuggag

SEQ ID NO: 1049675 - RNA, 22 nt, Human
acuggcaggcugcuggccggcg

SEQ ID NO: 1049676 - RNA, 22 nt, Human
ccuggcagacagcacugaagcu

SEQ ID NO: 1049677 - RNA, 22 nt, Human
gaagagaaaggcaaggaguuuu

SEQ ID NO: 1049678 - RNA, 22 nt, Human
ucacauaaauuuaccagaugau

SEQ ID NO: 1049679 - RNA, 19 nt, Human
ccacacagugugcaauuua

SEQ ID NO: 1049680 - RNA, 22 nt, Human
acagguggcuuauuggcugauu

SEQ ID NO: 1049681 - RNA, 22 nt, Human
cgcugauaaacgucacguuccc

SEQ ID NO: 1049682 - RNA, 22 nt, Human
uaagaacaguagaacaguaggu

SEQ ID NO: 1049683 - RNA, 22 nt, Human
gacacauaugcguauaguuuag

SEQ ID NO: 1049684 - RNA, 22 nt, Human
ucccacccccuccaaggaggaa

SEQ ID NO: 1049685 - RNA, 22 nt, Human
ccuggcaggcuggggacagugc

SEQ ID NO: 1049686 - RNA, 22 nt, Human
ucuggcagcgaagcguguacuu

SEQ ID NO: 1049687 - RNA, 22 nt, Human
cuuggcaggguggaggaugcag

SEQ ID NO: 1049688 - RNA, 21 nt, Human
ucacguggucacaugagcuuu

SEQ ID NO: 1049689 - RNA, 22 nt, Human
agcacagggacaaugccaggug

SEQ ID NO: 1049690 - RNA, 21 nt, Human
ugacugaggcuucuucacaca

SEQ ID NO: 1049691 - RNA, 22 nt, Human
ccugccucccagagguccucua

SEQ ID NO: 1049692 - RNA, 22 nt, Human
cuccaggccauggcugcggagg

SEQ ID NO: 1049693 - RNA, 22 nt, Human
uacacagauaugugaucaauca

SEQ ID NO: 1049694 - RNA, 22 nt, Human
cugagcagugguucuugagcgc

SEQ ID NO: 1049695 - RNA, 22 nt, Human
guggcagugggaugcuaucagg

SEQ ID NO: 1049696 - RNA, 22 nt, Human
uggcgucucucauaaguaugug

SEQ ID NO: 1049697 - RNA, 22 nt, Human
caggucccugcgccccggccuc

SEQ ID NO: 1049698 - RNA, 22 nt, Human
ugaguagagaauucagcuaagg

SEQ ID NO: 1049699 - RNA, 22 nt, Human
ucaggcccuuugcugcugcccc

SEQ ID NO: 1049700 - RNA, 22 nt, Human
gcuggcaggauagaagucuaau

SEQ ID NO: 1049701 - RNA, 22 nt, Human
uccaggcucccucaggaugcac

SEQ ID NO: 1049702 - RNA, 22 nt, Human
cacaacuuuaggaaccacauuc

SEQ ID NO: 1049703 - RNA, 21 nt, Human
ccagcccagcugugucccagc

SEQ ID NO: 1049704 - RNA, 22 nt, Human
ggcacagagcuuugucccaguu

SEQ ID NO: 1049705 - RNA, 22 nt, Human
agagggugcuggagagacauug

SEQ ID NO: 1049706 - RNA, 22 nt, Human
gagauggccagugccaggacaa

SEQ ID NO: 1049707 - RNA, 22 nt, Human
uuccagccaugguuucccuaug

SEQ ID NO: 1049708 - RNA, 22 nt, Human
ucacauacacuaggauauuuuu

SEQ ID NO: 1049709 - RNA, 22 nt, Human
ucccagccuuccagucugguuu

SEQ ID NO: 1049710 - RNA, 22 nt, Human
auccucuguggauuacaccuag

SEQ ID NO: 1049711 - RNA, 22 nt, Human
ucuggcagaaggcagaaauuca

SEQ ID NO: 1049712 - RNA, 22 nt, Human
uccuggcacccuuggguuggag

SEQ ID NO: 1049713 - RNA, 22 nt, Human
ugguaagaacccaucagagaag

SEQ ID NO: 1049714 - RNA, 22 nt, Human
auguuggagucguaaggcaugg

SEQ ID NO: 1049715 - RNA, 22 nt, Human
uggaaagaggaagugcccagca

SEQ ID NO: 1049716 - RNA, 22 nt, Human
cccuuccuugugacuggugggg

SEQ ID NO: 1049717 - RNA, 22 nt, Human
gcuugggaagggcccuguguac

SEQ ID NO: 1049718 - RNA, 22 nt, Human
ggagacucggguucuagccuug

SEQ ID NO: 1049719 - RNA, 22 nt, Human
cccaggccagaacuugguugcu

SEQ ID NO: 1049720 - RNA, 22 nt, Human
uccugagcugccgcaucagcag

SEQ ID NO: 1049721 - RNA, 22 nt, Human
uuccacauuccuuacauucaua

SEQ ID NO: 1049722 - RNA, 22 nt, Human
cuccuggcaggcugagugaaau

SEQ ID NO: 1049723 - RNA, 22 nt, Human
acagguccucaagucagcuggg

SEQ ID NO: 1049724 - RNA, 22 nt, Human
gaggcacagucccgaggcaagg

SEQ ID NO: 1049725 - RNA, 22 nt, Human
gauggccuggguccccuuccgg

SEQ ID NO: 1049726 - RNA, 22 nt, Human
uguggggaagaguaugacuugg

SEQ ID NO: 1049727 - RNA, 22 nt, Human
aggaggcugcaacccugaggcc

SEQ ID NO: 1049728 - RNA, 22 nt, Human
cccccaaaguuugcacggauaa

SEQ ID NO: 1049729 - RNA, 22 nt, Human
uccuggcagcccgcaggugcug

SEQ ID NO: 1049730 - RNA, 22 nt, Human
agcacaggcuuuggugugaggg

SEQ ID NO: 1049731 - RNA, 22 nt, Human
ucccugcccucagugcacccgg

SEQ ID NO: 1049732 - RNA, 20 nt, Human
agaggcuuccuugggaggag

SEQ ID NO: 1049733 - RNA, 22 nt, Human
acaauucugaugguuucccagu

SEQ ID NO: 1049734 - RNA, 22 nt, Human
cagugggggggccaugcugcag

SEQ ID NO: 1049735 - RNA, 22 nt, Human
gcuccaggagagggaagcagau

SEQ ID NO: 1049736 - RNA, 22 nt, Human
uuccugccccugagagcuccca

SEQ ID NO: 1049737 - RNA, 22 nt, Human
gaggcacauauauacagagccc

SEQ ID NO: 1049738 - RNA, 16 nt, Human
gcacacacaucaauga

SEQ ID NO: 1049739 - RNA, 22 nt, Human
acuggcagcuguaggaugcaug

SEQ ID NO: 1049740 - RNA, 22 nt, Human
caggagggcccgagacucuucc

SEQ ID NO: 1049741 - RNA, 22 nt, Human
gcacacaggggaguucucagaa

SEQ ID NO: 1049742 - RNA, 22 nt, Human
ccuggcagucaggggaguccuu

SEQ ID NO: 1049743 - RNA, 19 nt, Human
ucuggcagguaauuaggga

SEQ ID NO: 1049744 - RNA, 22 nt, Human
ggagccugaaaagucugcauuu

SEQ ID NO: 1049745 - RNA, 22 nt, Human
acuggcagggggagccccgaga

SEQ ID NO: 1049746 - RNA, 22 nt, Human
uccaggcuccccugcgugcucc

SEQ ID NO: 1049747 - RNA, 22 nt, Human
gacucugggcugagccagggcc

SEQ ID NO: 1049748 - RNA, 20 nt, Human
aagagucuuuacugagcuaa

SEQ ID NO: 1049749 - RNA, 22 nt, Human
acuggcagcagcagcccuuggg

SEQ ID NO: 1049750 - RNA, 22 nt, Human
agggaagaagcugguaguaggu

SEQ ID NO: 1049751 - RNA, 22 nt, Human
acuggcagaacgugaugcgggu

SEQ ID NO: 1049752 - RNA, 22 nt, Human
ccuccuggggugaaggauggga

SEQ ID NO: 1049753 - RNA, 19 nt, Human
agcuuccauauucucuagu

SEQ ID NO: 1049754 - RNA, 22 nt, Human
uuugaaaguucuucugacacua

SEQ ID NO: 1049755 - RNA, 22 nt, Human
cuguuucaagugaagucagaca

SEQ ID NO: 1049756 - RNA, 22 nt, Human
uggccaagaaugauaugugaag

SEQ ID NO: 1049757 - RNA, 23 nt, Human
ccuccugggcacaggccugaugg

SEQ ID NO: 1049758 - RNA, 22 nt, Human
gagggagggaaaguuuaacacu

SEQ ID NO: 1049759 - RNA, 17 nt, Human
ucugaggugaggaugca

SEQ ID NO: 1049760 - RNA, 22 nt, Human
ggaagaggcugaggccaugcug

SEQ ID NO: 1049761 - RNA, 22 nt, Human
agcugagggcaggaugggguga

SEQ ID NO: 1049762 - RNA, 22 nt, Human
uagaaagacuguccagauuuca

SEQ ID NO: 1049763 - RNA, 22 nt, Human
ggcagcuauuccaagcagcacu

SEQ ID NO: 1049764 - RNA, 21 nt, Human
ccugagguuucuggccucugu

SEQ ID NO: 1049765 - RNA, 22 nt, Human
aacuggaucaguugagggaggc

SEQ ID NO: 1049766 - RNA, 22 nt, Human
uaguaaucagagguaaacuuua

SEQ ID NO: 1049767 - RNA, 22 nt, Human
agugauggugagugagaagcuc

SEQ ID NO: 1049768 - RNA, 22 nt, Human
gugguccaucaugcagagcucc

SEQ ID NO: 1049769 - RNA, 22 nt, Human
acucagaaccauuuacucugag

SEQ ID NO: 1049770 - RNA, 22 nt, Human
aggcuggagcaagggggcauau

SEQ ID NO: 1049771 - RNA, 22 nt, Human
uuauugagcacauaguaugugg

SEQ ID NO: 1049772 - RNA, 22 nt, Human
uacaugaagaaaauuaagcagu

SEQ ID NO: 1049773 - RNA, 20 nt, Human
ucacaucuggcagcugauga

SEQ ID NO: 1049774 - RNA, 22 nt, Human
ccugccucaucaacuugucgug

SEQ ID NO: 1049775 - RNA, 22 nt, Human
ggaggggaggauuaaugacaaa

SEQ ID NO: 1049776 - RNA, 22 nt, Human
agggcagccauugagggauucu

SEQ ID NO: 1049777 - RNA, 22 nt, Human
gugguaaucggauucuuaccgg

SEQ ID NO: 1049778 - RNA, 19 nt, Human
auuagcaugcuugaggaug

SEQ ID NO: 1049779 - RNA, 22 nt, Human
cccaggaacagcacagaacagc

SEQ ID NO: 1049780 - RNA, 22 nt, Human
cccaggaggaggaaaaagcucg

SEQ ID NO: 1049781 - RNA, 22 nt, Human
uggcagcugaggggaggcuuug

SEQ ID NO: 1049782 - RNA, 22 nt, Human
uaacugguauaucaguguacac

SEQ ID NO: 1049783 - RNA, 22 nt, Human
ugcuggcugcagugcugucaaa

SEQ ID NO: 1049784 - RNA, 22 nt, Human
uccaggagcucauccacgucaa

SEQ ID NO: 1049785 - RNA, 22 nt, Human
auggagggugguaagacagaga

SEQ ID NO: 1049786 - RNA, 22 nt, Human
ugugaaagcaagucuaguucuc

SEQ ID NO: 1049787 - RNA, 22 nt, Human
ucugggaaguccucugucaugc

SEQ ID NO: 1049788 - RNA, 22 nt, Human
ggggugggcgugcagggacacc

SEQ ID NO: 1049789 - RNA, 22 nt, Human
gacuuucucuccucccaggugu

SEQ ID NO: 1049790 - RNA, 22 nt, Human
uagaacuggcggcuagaccacu

SEQ ID NO: 1049791 - RNA, 22 nt, Human
cauguuuacuaccaggagaaug

SEQ ID NO: 1049792 - RNA, 22 nt, Human
uaaacagcuacugugucaaagg

SEQ ID NO: 1049793 - RNA, 22 nt, Human
ugcaggcugcuggcaguagcuu

SEQ ID NO: 1049794 - RNA, 22 nt, Human
acaaguuaccaaaaaagauuca

SEQ ID NO: 1049795 - RNA, 22 nt, Human
uuagauaaauugcaacuugauu

SEQ ID NO: 1049796 - RNA, 22 nt, Human
auggagacgcaagggaccuagg

SEQ ID NO: 1049797 - RNA, 22 nt, Human
cuuaauaaaugguagcuguuau

SEQ ID NO: 1049798 - RNA, 22 nt, Human
acuuuaaggaggcacucaucuc

SEQ ID NO: 1049799 - RNA, 22 nt, Human
uagaaagagcuuugcuuccuuu

SEQ ID NO: 1049800 - RNA, 19 nt, Human
caaggccaccauuucuccg

SEQ ID NO: 1049801 - RNA, 18 nt, Human
gcaggagauggguggggu

SEQ ID NO: 1049802 - RNA, 22 nt, Human
aguaacucauguaaaccucaca

SEQ ID NO: 1049803 - RNA, 22 nt, Human
gccucugcccuccugggacugc

SEQ ID NO: 1049804 - RNA, 22 nt, Human
aggagggacaccaauauauguu

SEQ ID NO: 1049805 - RNA, 22 nt, Human
uggcagcuggaucccaaggcag

SEQ ID NO: 1049806 - RNA, 22 nt, Human
ugcugcuguauccuuaguguca

SEQ ID NO: 1049807 - RNA, 22 nt, Human
auguuguuuuuucauaaaguau

SEQ ID NO: 1049808 - RNA, 22 nt, Human
uuuuaucuaccuaugcucauuu

SEQ ID NO: 1049809 - RNA, 22 nt, Human
agcccaggugagggguucgaaa

SEQ ID NO: 1049810 - RNA, 22 nt, Human
uaaaugagggcugacaugauug

SEQ ID NO: 1049811 - RNA, 22 nt, Human
cagaaccaggaacugauggaga

SEQ ID NO: 1049812 - RNA, 22 nt, Human
agucucugccagcuuguccucu

SEQ ID NO: 1049813 - RNA, 22 nt, Human
ugacauuauuaucaugucacca

SEQ ID NO: 1049814 - RNA, 22 nt, Human
gugagguccauguuaauggguu

SEQ ID NO: 1049815 - RNA, 22 nt, Human
aacaugaaaacuaccugugauu

SEQ ID NO: 1049816 - RNA, 21 nt, Human
ccagugcuacagcugccugac

SEQ ID NO: 1049817 - RNA, 22 nt, Human
accgaaggaaacuggaaccguu

SEQ ID NO: 1049818 - RNA, 22 nt, Human
cuugccucccucagcucacagc

SEQ ID NO: 1049819 - RNA, 22 nt, Human
auuggcaguuagugacgaggcu

SEQ ID NO: 1049820 - RNA, 22 nt, Human
cuucagaaugggacuguguuug

SEQ ID NO: 1049821 - RNA, 22 nt, Human
uccaggagugcugguuagagua

SEQ ID NO: 1049822 - RNA, 22 nt, Human
guucacagaaauuguguaccuc

SEQ ID NO: 1049823 - RNA, 22 nt, Human
cugagauggaguuuugcucuug

SEQ ID NO: 1049824 - RNA, 22 nt, Human
caggacagagcccagacugugu

SEQ ID NO: 1049825 - RNA, 22 nt, Human
ucucagucuuugcaaggaugcu

SEQ ID NO: 1049826 - RNA, 18 nt, Human
ccugaggugggaggaagg

SEQ ID NO: 1049827 - RNA, 21 nt, Human
ugcuggcugaaaggcacagag

SEQ ID NO: 1049828 - RNA, 22 nt, Human
ucugagccacagauguccuguu

SEQ ID NO: 1049829 - RNA, 22 nt, Human
ugcugagguuucgucugcuugc

SEQ ID NO: 1049830 - RNA, 22 nt, Human
agaggcggagguugcagugagc

SEQ ID NO: 1049831 - RNA, 21 nt, Human
ggcugcugucaccgcugucac

SEQ ID NO: 1049832 - RNA, 22 nt, Human
ucuccuggauggaccuucucuu

SEQ ID NO: 1049833 - RNA, 22 nt, Human
ccuggccacccagccuuggcca

SEQ ID NO: 1049834 - RNA, 20 nt, Human
agagcagcaguuggugaggu

SEQ ID NO: 1049835 - RNA, 22 nt, Human
ggcugcugaguuggccaggaga

SEQ ID NO: 1049836 - RNA, 22 nt, Human
uugaacauuggcaauuucauau

SEQ ID NO: 1049837 - RNA, 22 nt, Human
guuuuauaggcuguugcuauau

SEQ ID NO: 1049838 - RNA, 22 nt, Human
acaccuuugugaagugaugaug

SEQ ID NO: 1049839 - RNA, 22 nt, Human
auuucccaugugaaucaauugg

SEQ ID NO: 1049840 - RNA, 22 nt, Human
aucaggaugacaacugcugggu

SEQ ID NO: 1049841 - RNA, 22 nt, Human
gaacuggugaagugaagggcag

SEQ ID NO: 1049842 - RNA, 19 nt, Human
ucauuguugguuugucggg

SEQ ID NO: 1049843 - RNA, 22 nt, Human
cugccaccaaauagcugcauga

SEQ ID NO: 1049844 - RNA, 22 nt, Human
acugaggucagggguaugugau

SEQ ID NO: 1049845 - RNA, 22 nt, Human
cucagaauuuagggcucugagg

SEQ ID NO: 1049846 - RNA, 22 nt, Human
auucuucaucagagaugcacua

SEQ ID NO: 1049847 - RNA, 22 nt, Human
agcugcccagcuaggaagaagg

SEQ ID NO: 1049848 - RNA, 22 nt, Human
agcugguaaguggcagagauuc

SEQ ID NO: 1049849 - RNA, 21 nt, Human
ucuuccuccacagcgugccac

SEQ ID NO: 1049850 - RNA, 22 nt, Human
ucaaucacguguuccauguucu

SEQ ID NO: 1049851 - RNA, 22 nt, Human
caucucaugggcaugccaagcu

SEQ ID NO: 1049852 - RNA, 22 nt, Human
uaaguaaaacauucaagaaguc

SEQ ID NO: 1049853 - RNA, 20 nt, Human
uuuauucacagagaagaguu

SEQ ID NO: 1049854 - RNA, 21 nt, Human
gauuuuaaagagacugccaca

SEQ ID NO: 1049855 - RNA, 22 nt, Human
ucagggacuuacaaaccagaag

SEQ ID NO: 1049856 - RNA, 22 nt, Human
uaccacaguuuaucuauucagc

SEQ ID NO: 1049857 - RNA, 22 nt, Human
cuguccugaaagggagauuggg

SEQ ID NO: 1049858 - RNA, 22 nt, Human
uacauguaagacaugagacucu

SEQ ID NO: 1049859 - RNA, 18 nt, Human
ucaggcugggccuccuuc

SEQ ID NO: 1049860 - RNA, 21 nt, Human
cuccugggcuaagauauagug

SEQ ID NO: 1049861 - RNA, 22 nt, Human
gagagaaaggcuugcaggcugu

SEQ ID NO: 1049862 - RNA, 22 nt, Human
auacaacagaaaaugauuauuc

SEQ ID NO: 1049863 - RNA, 22 nt, Human
uuccuggccucucucugagcag

SEQ ID NO: 1049864 - RNA, 22 nt, Human
uaauuauuaugacaacaauugc

SEQ ID NO: 1049865 - RNA, 22 nt, Human
aggcagcuucugauuagcagcg

SEQ ID NO: 1049866 - RNA, 22 nt, Human
cuggcaguguccagcucgugau

SEQ ID NO: 1049867 - RNA, 22 nt, Human
uccaggagacacaagguacaua

SEQ ID NO: 1049868 - RNA, 22 nt, Human
ggcugaaggaugaaagcugcag

SEQ ID NO: 1049869 - RNA, 21 nt, Human
cuugaaagguagagucuacag

SEQ ID NO: 1049870 - RNA, 22 nt, Human
uuggaaauacgaguaguaucau

SEQ ID NO: 1049871 - RNA, 22 nt, Human
gaccauuuguugaaaagauuau

SEQ ID NO: 1049872 - RNA, 21 nt, Human
uuccagaaaucucuuucuuca

SEQ ID NO: 1049873 - RNA, 22 nt, Human
uguauuuuuagaccuuuagacc

SEQ ID NO: 1049874 - RNA, 22 nt, Human
uccaggaguuugaccugugggc

SEQ ID NO: 1049875 - RNA, 21 nt, Human
ucacuagugccuucugucauu

SEQ ID NO: 1049876 - RNA, 22 nt, Human
agcaccugucacaagcagaagg

SEQ ID NO: 1049877 - RNA, 22 nt, Human
ccuggagcacauggcaggaggc

SEQ ID NO: 1049878 - RNA, 22 nt, Human
agaagucauuuauguuagauga

SEQ ID NO: 1049879 - RNA, 19 nt, Human
ugccuggacaaaugugggg

SEQ ID NO: 1049880 - RNA, 21 nt, Human
ggcugcuggggguuggcacag

SEQ ID NO: 1049881 - RNA, 22 nt, Human
acugagguagggcacaccuagg

SEQ ID NO: 1049882 - RNA, 22 nt, Human
ucagucuucccuccagugcaac

SEQ ID NO: 1049883 - RNA, 19 nt, Human
cuggcugcaaugccagggu

SEQ ID NO: 1049884 - RNA, 22 nt, Human
cuuaacagagagaaguguugcu

SEQ ID NO: 1049885 - RNA, 22 nt, Human
gagagaggccuccauguacuga

SEQ ID NO: 1049886 - RNA, 22 nt, Human
auucauaacggcaaaugucacc

SEQ ID NO: 1049887 - RNA, 22 nt, Human
uuccuggcugaacugaacuccu

SEQ ID NO: 1049888 - RNA, 22 nt, Human
uaaggccaggcuguggucggca

SEQ ID NO: 1049889 - RNA, 22 nt, Human
auuauuauauagggaaaguccc

SEQ ID NO: 1049890 - RNA, 22 nt, Human
cugcgcagggguggcgccagaa

SEQ ID NO: 1049891 - RNA, 22 nt, Human
uuccaugacaccgagggaaguc

SEQ ID NO: 1049892 - RNA, 22 nt, Human
ggccacaacuugcuccuagccc

SEQ ID NO: 1049893 - RNA, 22 nt, Human
ugaggcagguggauuacaaggu

SEQ ID NO: 1049894 - RNA, 22 nt, Human
uuacacaacaucuguauuauua

SEQ ID NO: 1049895 - RNA, 22 nt, Human
cuguggucaccaggcuggggcc

SEQ ID NO: 1049896 - RNA, 19 nt, Human
gaggagcuaucggagacag

SEQ ID NO: 1049897 - RNA, 22 nt, Human
cuuuggcaaggguuuuaauugu

SEQ ID NO: 1049898 - RNA, 22 nt, Human
uuucuuauacuauauugucauc

SEQ ID NO: 1049899 - RNA, 22 nt, Human
ugccuguguugauuacuuuguc

SEQ ID NO: 1049900 - RNA, 22 nt, Human
gaaggccacaaaaaaugucaua

SEQ ID NO: 1049901 - RNA, 22 nt, Human
auuaggauuugguauggucaua

SEQ ID NO: 1049902 - RNA, 22 nt, Human
acuaaaguaucuccuauuucau

SEQ ID NO: 1049903 - RNA, 22 nt, Human
uccccagaggugaggcagcuuu

SEQ ID NO: 1049904 - RNA, 22 nt, Human
ugaaggcccagccacagaaugg

SEQ ID NO: 1049905 - RNA, 22 nt, Human
ucccaggacaugggcucugcuc

SEQ ID NO: 1049906 - RNA, 22 nt, Human
acuccuggggcugccaucacag

SEQ ID NO: 1049907 - RNA, 22 nt, Human
gcagacagcauguugggcuauu

SEQ ID NO: 1049908 - RNA, 22 nt, Human
aggcugagccugggcguggugg

SEQ ID NO: 1049909 - RNA, 21 nt, Human
aggcagcucaggcccagagag

SEQ ID NO: 1049910 - RNA, 22 nt, Human
uuugaaguggaaaaggauuuaa

SEQ ID NO: 1049911 - RNA, 22 nt, Human
cugcagagcaaguaacauccuc

SEQ ID NO: 1049912 - RNA, 22 nt, Human
uacaaaguaauguauaauaucg

SEQ ID NO: 1049913 - RNA, 22 nt, Human
auuaaaauuccaagguaugcca

SEQ ID NO: 1049914 - RNA, 22 nt, Human
ggagcggagggagggccacugu

SEQ ID NO: 1049915 - RNA, 17 nt, Human
uuugguaauauauuaag

SEQ ID NO: 1049916 - RNA, 22 nt, Human
ccagugcuaagguagccucugc

SEQ ID NO: 1049917 - RNA, 22 nt, Human
ucacuguugaccuggaaguggg

SEQ ID NO: 1049918 - RNA, 22 nt, Human
aaaguaacaauaagguucuauu

SEQ ID NO: 1049919 - RNA, 22 nt, Human
gauggcagguaguggucucauc

SEQ ID NO: 1049920 - RNA, 22 nt, Human
uugaagagugccuuccagacau

SEQ ID NO: 1049921 - RNA, 22 nt, Human
gagguccaggguggggccugag

SEQ ID NO: 1049922 - RNA, 22 nt, Human
gauacacuggccaaguggagga

SEQ ID NO: 1049923 - RNA, 22 nt, Human
ugcugagggcuguuaaggaagc

SEQ ID NO: 1049924 - RNA, 22 nt, Human
uccuggccgcuggccccugaga

SEQ ID NO: 1049925 - RNA, 22 nt, Human
ggagaagggacagacucagcuu

SEQ ID NO: 1049926 - RNA, 17 nt, Human
ggaaaaggaugauacag

SEQ ID NO: 1049927 - RNA, 22 nt, Human
gagcagcugagcuggaaugaga

SEQ ID NO: 1049928 - RNA, 22 nt, Human
aaugagacacgugaagcagaug

SEQ ID NO: 1049929 - RNA, 22 nt, Human
uacagagaauaauaggacaggu

SEQ ID NO: 1049930 - RNA, 22 nt, Human
uugaggucugugauaaaaguca

SEQ ID NO: 1049931 - RNA, 22 nt, Human
cagggcugcuggccgugcccuc

SEQ ID NO: 1049932 - RNA, 22 nt, Human
augaggucauucuuggauuaca

SEQ ID NO: 1049933 - RNA, 22 nt, Human
gagagaagaacaaugucauuca

SEQ ID NO: 1049934 - RNA, 22 nt, Human
augaguucaauuguuucaguca

SEQ ID NO: 1049935 - RNA, 22 nt, Human
ggaaaagacagguuaacuguga

SEQ ID NO: 1049936 - RNA, 22 nt, Human
ggacugaggacaugugaggcau

SEQ ID NO: 1049937 - RNA, 22 nt, Human
uggcugaggagagggcggaagu

SEQ ID NO: 1049938 - RNA, 21 nt, Human
ucucugguuggaguugugcca

SEQ ID NO: 1049939 - RNA, 22 nt, Human
uucaacuauuaugaauaaaauu

SEQ ID NO: 1049940 - RNA, 22 nt, Human
acaggcugagcguccaucuuca

SEQ ID NO: 1049941 - RNA, 22 nt, Human
uugcuuuguuacugcaguuucc

SEQ ID NO: 1049942 - RNA, 22 nt, Human
uugaauaguuuuggauagcaua

SEQ ID NO: 1049943 - RNA, 19 nt, Human
ugcugaggaugcaagaucc

SEQ ID NO: 1049944 - RNA, 22 nt, Human
gcugcagguuugucuagucugg

SEQ ID NO: 1049945 - RNA, 22 nt, Human
auagcuguuagauuggggucga

SEQ ID NO: 1049946 - RNA, 22 nt, Human
gccugccugcugucaucugccu

SEQ ID NO: 1049947 - RNA, 22 nt, Human
acuuuugguucuguaacuguga

SEQ ID NO: 1049948 - RNA, 22 nt, Human
ugcugcuguaucaugccuucau

SEQ ID NO: 1049949 - RNA, 17 nt, Human
ugaaggccaugaccacg

SEQ ID NO: 1049950 - RNA, 22 nt, Human
uuuguuuagaaagagauuggug

SEQ ID NO: 1049951 - RNA, 21 nt, Human
ugaggcaggggugcuuuuguc

SEQ ID NO: 1049952 - RNA, 22 nt, Human
uucauuaguucugaagaugucu

SEQ ID NO: 1049953 - RNA, 22 nt, Human
gacacuuuauuaagcuguuguu

SEQ ID NO: 1049954 - RNA, 22 nt, Human
ucucacuuuccagacuuuucaa

SEQ ID NO: 1049955 - RNA, 22 nt, Human
agguaaauucagcagugacauu

SEQ ID NO: 1049956 - RNA, 21 nt, Human
gugcuuuuccuuaauguucuu

SEQ ID NO: 1049957 - RNA, 22 nt, Human
aaaaugaauaaguuaacccagg

SEQ ID NO: 1049958 - RNA, 22 nt, Human
uacagccucacauuuacuuaca

SEQ ID NO: 1049959 - RNA, 22 nt, Human
ucugugccuccguaacacacca

SEQ ID NO: 1049960 - RNA, 22 nt, Human
auuucaaggcuauuaauauaaa

SEQ ID NO: 1049961 - RNA, 22 nt, Human
aaguuugcauagauuaagcauu

SEQ ID NO: 1049962 - RNA, 22 nt, Human
agcaagaugaaggauucaagac

SEQ ID NO: 1049963 - RNA, 22 nt, Human
ggcagcuggggcagugcccugu

SEQ ID NO: 1049964 - RNA, 22 nt, Human
gcuggccauggggagugaggag

SEQ ID NO: 1049965 - RNA, 22 nt, Human
ggcuggaggagaauggguguga

SEQ ID NO: 1049966 - RNA, 22 nt, Human
cucaggauugugccuagggaga

SEQ ID NO: 1049967 - RNA, 22 nt, Human
ucagucuuugcuuaugacaaua

SEQ ID NO: 1049968 - RNA, 22 nt, Human
uaaggccagcaugaaugcagca

SEQ ID NO: 1049969 - RNA, 22 nt, Human
ugucaccaaguugaugaaugca

SEQ ID NO: 1049970 - RNA, 22 nt, Human
uauacacuguuguugggagucu

SEQ ID NO: 1049971 - RNA, 22 nt, Human
cggcagcucgagggccacccgu

SEQ ID NO: 1049972 - RNA, 22 nt, Human
aaaauuaagugucugggaagcc

SEQ ID NO: 1049973 - RNA, 22 nt, Human
aggcaggcccucuggaaaggua

SEQ ID NO: 1049974 - RNA, 19 nt, Human
uggagggguuugaaugugg

SEQ ID NO: 1049975 - RNA, 22 nt, Human
caccaggcuggagugcagaggu

SEQ ID NO: 1049976 - RNA, 22 nt, Human
uuuaaaauuuagaccucuccac

SEQ ID NO: 1049977 - RNA, 22 nt, Human
aguuuucacacucaccaaaagg

SEQ ID NO: 1049978 - RNA, 23 nt, Human
cuucucagaagucugugccagga

SEQ ID NO: 1049979 - RNA, 22 nt, Human
aacugguagcugauuaaguaua

SEQ ID NO: 1049980 - RNA, 22 nt, Human
ggcuaggcgggcacauggugga

SEQ ID NO: 1049981 - RNA, 22 nt, Human
uuuaacagguaaaguaaaugug

SEQ ID NO: 1049982 - RNA, 22 nt, Human
gggcagcugccacuccgcuugc

SEQ ID NO: 1049983 - RNA, 22 nt, Human
cuuaaagaaauugaggagagga

SEQ ID NO: 1049984 - RNA, 22 nt, Human
uaacugguacucugguagccug

SEQ ID NO: 1049985 - RNA, 21 nt, Human
cgcagagcgaacuugcggcgc

SEQ ID NO: 1049986 - RNA, 22 nt, Human
cucaguuugagggguagguguu

SEQ ID NO: 1049987 - RNA, 22 nt, Human
gggcugagcuaagcuggguuga

SEQ ID NO: 1049988 - RNA, 22 nt, Human
aagggcagccugacucacgguc

SEQ ID NO: 1049989 - RNA, 22 nt, Human
cagcuccugaggacugcuggga

SEQ ID NO: 1049990 - RNA, 22 nt, Human
gcccaggaggucaaguagcuau

SEQ ID NO: 1049991 - RNA, 22 nt, Human
ggcagaggaaggaugaauucac

SEQ ID NO: 1049992 - RNA, 22 nt, Human
ugcauaaagugccauaguauua

SEQ ID NO: 1049993 - RNA, 22 nt, Human
gucugcugcagucguggcucua

SEQ ID NO: 1049994 - RNA, 22 nt, Human
uucuuugaguuaguacagucca

SEQ ID NO: 1049995 - RNA, 22 nt, Human
aaggcaguuugggccaccaucu

SEQ ID NO: 1049996 - RNA, 22 nt, Human
cacaauuuccuugcuucacuuu

SEQ ID NO: 1049997 - RNA, 22 nt, Human
uuucacaacugcuuauuugaga

SEQ ID NO: 1049998 - RNA, 22 nt, Human
ucaggcugcccguucagggcuc

SEQ ID NO: 1049999 - RNA, 22 nt, Human
ugcuggguuaccuaagccuaaa

SEQ ID NO: 1050000 - RNA, 18 nt, Human
gcagaugaguaguguacc

SEQ ID NO: 1050001 - RNA, 22 nt, Human
agucaguuucccuggaaagcag

SEQ ID NO: 1050002 - RNA, 22 nt, Human
uaaggccaauuacauauguuca

SEQ ID NO: 1050003 - RNA, 22 nt, Human
ggaggaugagcuacgaggagcu

SEQ ID NO: 1050004 - RNA, 22 nt, Human
cacaggcuuccaguccccagcu

SEQ ID NO: 1050005 - RNA, 22 nt, Human
uaucuguuccaggcacucagcu

SEQ ID NO: 1050006 - RNA, 22 nt, Human
guuuuaguggguggccacugau

SEQ ID NO: 1050007 - RNA, 22 nt, Human
uuaaaguauagaggacaaaaac

SEQ ID NO: 1050008 - RNA, 22 nt, Human
ccuggguggcagagguugcagu

SEQ ID NO: 1050009 - RNA, 22 nt, Human
agcagcuggaacauaugaagaa

SEQ ID NO: 1050010 - RNA, 22 nt, Human
caggauggucuucauuuggcuc

SEQ ID NO: 1050011 - RNA, 22 nt, Human
cccaugagguggagguugcagu

SEQ ID NO: 1050012 - RNA, 22 nt, Human
uuucuuuguuguuaucacauca

SEQ ID NO: 1050013 - RNA, 22 nt, Human
agugcuuucccugaaaccuucc

SEQ ID NO: 1050014 - RNA, 22 nt, Human
auuuucaucauggguuuaacau

SEQ ID NO: 1050015 - RNA, 22 nt, Human
ccagagcugauuccugggacuu

SEQ ID NO: 1050016 - RNA, 22 nt, Human
ccuggcaggcaagaggaaggga

SEQ ID NO: 1050017 - RNA, 22 nt, Human
uaggcagcagugcuaugauucu

SEQ ID NO: 1050018 - RNA, 22 nt, Human
cacaaaugguuguagacauuaa

SEQ ID NO: 1050019 - RNA, 22 nt, Human
uagcaagaucgugucucuaaaa

SEQ ID NO: 1050020 - RNA, 23 nt, Human
gauacacucccugcugggcacug

SEQ ID NO: 1050021 - RNA, 22 nt, Human
aaaggccaauaaagacaagcug

SEQ ID NO: 1050022 - RNA, 22 nt, Human
acucaggaaaaauguagugaua

SEQ ID NO: 1050023 - RNA, 22 nt, Human
ucauuguuauguuuugcugucu

SEQ ID NO: 1050024 - RNA, 22 nt, Human
uuucacagcuggguggcagagu

SEQ ID NO: 1050025 - RNA, 22 nt, Human
acacuuuuguguauauccaguu

SEQ ID NO: 1050026 - RNA, 21 nt, Human
gucaaacuugcaccagugccc

SEQ ID NO: 1050027 - RNA, 22 nt, Human
ggccagcucuuguccacggagg

SEQ ID NO: 1050028 - RNA, 22 nt, Human
ugaggggagacagaguggacuc

SEQ ID NO: 1050029 - RNA, 22 nt, Human
ugacaguuaagguauacauuca

SEQ ID NO: 1050030 - RNA, 22 nt, Human
cugcuguguuagcagguuuagu

SEQ ID NO: 1050031 - RNA, 21 nt, Human
uucuucaugaugauuaauggc

SEQ ID NO: 1050032 - RNA, 22 nt, Human
ccuccuuuccuguuuuccugag

SEQ ID NO: 1050033 - RNA, 21 nt, Human
uaaggccaagucuauuucugu

SEQ ID NO: 1050034 - RNA, 22 nt, Human
aacacuuucuauuauuaugguu

SEQ ID NO: 1050035 - RNA, 22 nt, Human
gaaaauuauugaaaauggcucu

SEQ ID NO: 1050036 - RNA, 22 nt, Human
gacuuucuaaugcucuguagau

SEQ ID NO: 1050037 - RNA, 22 nt, Human
ugguaaauauguccauucucuu

SEQ ID NO: 1050038 - RNA, 22 nt, Human
uccaggagguugagugaguucc

SEQ ID NO: 1050039 - RNA, 22 nt, Human
uaggaaaugcuccauugcauaa

SEQ ID NO: 1050040 - RNA, 22 nt, Human
uggcuucuugucuaauuuguua

SEQ ID NO: 1050041 - RNA, 22 nt, Human
auguggaggaaaugaguguaca

SEQ ID NO: 1050042 - RNA, 22 nt, Human
aggcagcuggcagcacccaggg

SEQ ID NO: 1050043 - RNA, 22 nt, Human
ucaggagagaaagaauacaauu

SEQ ID NO: 1050044 - RNA, 17 nt, Human
uagauuaaacacggcca

SEQ ID NO: 1050045 - RNA, 22 nt, Human
aagggcuggucuagaaagggag

SEQ ID NO: 1050046 - RNA, 22 nt, Human
uuagagccccagaaaacagugg

SEQ ID NO: 1050047 - RNA, 23 nt, Human
uugcauagacauccucauagauu

SEQ ID NO: 1050048 - RNA, 22 nt, Human
aaagaaauagauggcauuuaaa

SEQ ID NO: 1050049 - RNA, 22 nt, Human
cuggcuugcagcucaucauaaa

SEQ ID NO: 1050050 - RNA, 22 nt, Human
acuuucugcaguguuggaaaug

SEQ ID NO: 1050051 - RNA, 22 nt, Human
uucucuuuucaccaguugcuaa

SEQ ID NO: 1050052 - RNA, 19 nt, Human
aaggcagcaguagcaucca

SEQ ID NO: 1050053 - RNA, 22 nt, Human
ucaggaggccaccaggaccugu

SEQ ID NO: 1050054 - RNA, 22 nt, Human
uacaaaguagaaauucaguaaa

SEQ ID NO: 1050055 - RNA, 21 nt, Human
acagaacuguauagugauaaa

SEQ ID NO: 1050056 - RNA, 22 nt, Human
uggcagcucuguucaacaugag

SEQ ID NO: 1050057 - RNA, 22 nt, Human
cugaggaagacagcagcugugu

SEQ ID NO: 1050058 - RNA, 22 nt, Human
cacuggugccagagaacagaau

SEQ ID NO: 1050059 - RNA, 22 nt, Human
uucaaauacauucuuugccacu

SEQ ID NO: 1050060 - RNA, 18 nt, Human
gcucaggcccuagucagu

SEQ ID NO: 1050061 - RNA, 22 nt, Human
cuacccagauccaggauggcua

SEQ ID NO: 1050062 - RNA, 22 nt, Human
uagcaagaugucacuccaaguu

SEQ ID NO: 1050063 - RNA, 22 nt, Human
agcagagguuuguuggaaaccu

SEQ ID NO: 1050064 - RNA, 22 nt, Human
ugaggcagccugcauuaaagag

SEQ ID NO: 1050065 - RNA, 22 nt, Human
ucgcugugguuucuguacaugg

SEQ ID NO: 1050066 - RNA, 22 nt, Human
aagcaccucuaugauugcuuuu

SEQ ID NO: 1050067 - RNA, 22 nt, Human
ugcacauucacuuagguauugu

SEQ ID NO: 1050068 - RNA, 22 nt, Human
gucuuuaugguaugaaaacuga

SEQ ID NO: 1050069 - RNA, 20 nt, Human
cugcugugguccuuuauuuu

SEQ ID NO: 1050070 - RNA, 22 nt, Human
auguggcacagcacaguaagag

SEQ ID NO: 1050071 - RNA, 22 nt, Human
acuggcaguagagggagcgcau

SEQ ID NO: 1050072 - RNA, 22 nt, Human
auugcuguaaauuaucuuauua

SEQ ID NO: 1050073 - RNA, 20 nt, Human
gagcugaguguggucauggg

SEQ ID NO: 1050074 - RNA, 22 nt, Human
gaggcaguuccugagugacaag

SEQ ID NO: 1050075 - RNA, 22 nt, Human
agaaguuaauuccugaaauucu

SEQ ID NO: 1050076 - RNA, 22 nt, Human
ugcaugugcccacucuggcuua

SEQ ID NO: 1050077 - RNA, 22 nt, Human
cucaggauagcugcgcagccug

SEQ ID NO: 1050078 - RNA, 22 nt, Human
gagggcuccucacauucucuau

SEQ ID NO: 1050079 - RNA, 22 nt, Human
uuccaucuuucagcuuuguugg

SEQ ID NO: 1050080 - RNA, 22 nt, Human
uuuuagauaguuuaacugcacu

SEQ ID NO: 1050081 - RNA, 22 nt, Human
cugagccaguagucagggacaa

SEQ ID NO: 1050082 - RNA, 22 nt, Human
guauuagggccaaaggcaggaa

SEQ ID NO: 1050083 - RNA, 22 nt, Human
ucacugcugcugccaugaugga

SEQ ID NO: 1050084 - RNA, 20 nt, Human
uucacagaggacucagguca

SEQ ID NO: 1050085 - RNA, 23 nt, Human
uggccaagauaaucucaguuuuc

SEQ ID NO: 1050086 - RNA, 22 nt, Human
uuucaaacauaucuucauuacu

SEQ ID NO: 1050087 - RNA, 22 nt, Human
auugcuguggaaauauaagaug

SEQ ID NO: 1050088 - RNA, 22 nt, Human
gaggcagcaugguaccuuggag

SEQ ID NO: 1050089 - RNA, 22 nt, Human
aggccaaauagcagguuugcua

SEQ ID NO: 1050090 - RNA, 22 nt, Human
uuuaaauggcauuuucccagau

SEQ ID NO: 1050091 - RNA, 22 nt, Human
uuuuccagagcugucucuugca

SEQ ID NO: 1050092 - RNA, 19 nt, Human
uugaaagauuagcuuucua

SEQ ID NO: 1050093 - RNA, 22 nt, Human
gagcugagauuugaagcaaguu

SEQ ID NO: 1050094 - RNA, 22 nt, Human
ugccugugucacagugauguuu

SEQ ID NO: 1050095 - RNA, 22 nt, Human
cuuaagauuugagauaccuaau

SEQ ID NO: 1050096 - RNA, 22 nt, Human
gcagcauacagggagaguacuc

SEQ ID NO: 1050097 - RNA, 22 nt, Human
accuacaucaagggagugguag

SEQ ID NO: 1050098 - RNA, 22 nt, Human
cagggcuguaaauuagugcuga

SEQ ID NO: 1050099 - RNA, 22 nt, Human
acaccauacucauguugguucc

SEQ ID NO: 1050100 - RNA, 22 nt, Human
agaauaaaauagucugaagaug

SEQ ID NO: 1050101 - RNA, 22 nt, Human
acauauauuacuaguaaagaca

SEQ ID NO: 1050102 - RNA, 22 nt, Human
gcugcucugugacagccuccgg

SEQ ID NO: 1050103 - RNA, 21 nt, Human
acugccugucuccauagucua

SEQ ID NO: 1050104 - RNA, 22 nt, Human
uuuaggauauuaauguucagag

SEQ ID NO: 1050105 - RNA, 22 nt, Human
ggagaggauguuuuaguaacuu

SEQ ID NO: 1050106 - RNA, 22 nt, Human
aaaacuccugaaauuguuuccc

SEQ ID NO: 1050107 - RNA, 22 nt, Human
uaacaugauuugcuauuuagau

SEQ ID NO: 1050108 - RNA, 22 nt, Human
cauuuccugucuggaggucaaa

SEQ ID NO: 1050109 - RNA, 22 nt, Human
uggcagcugauuagauggugcc

SEQ ID NO: 1050110 - RNA, 22 nt, Human
uggcaaggccacaggugcaguu

SEQ ID NO: 1050111 - RNA, 22 nt, Human
cucugcaugccuugcucagaca

SEQ ID NO: 1050112 - RNA, 21 nt, Human
gacaaagugaagcaggcagga

SEQ ID NO: 1050113 - RNA, 22 nt, Human
acccagagcugggcuuggcaaa

SEQ ID NO: 1050114 - RNA, 22 nt, Human
uccuggcccuguggccugcagu

SEQ ID NO: 1050115 - RNA, 22 nt, Human
uucuucuuuaucucaguauccu

SEQ ID NO: 1050116 - RNA, 22 nt, Human
aaggaaccauuugugugcaugg

SEQ ID NO: 1050117 - RNA, 22 nt, Human
aucaggaucugggagccugaaa

SEQ ID NO: 1050118 - RNA, 22 nt, Human
agcuggaagcugaugagcacag

SEQ ID NO: 1050119 - RNA, 22 nt, Human
agucagauuuagauguagcaag

SEQ ID NO: 1050120 - RNA, 22 nt, Human
cccuugcaucccauguguggcc

SEQ ID NO: 1050121 - RNA, 22 nt, Human
ucuuuccaaggacucuguagca

SEQ ID NO: 1050122 - RNA, 22 nt, Human
accaggagccauagagucaggc

SEQ ID NO: 1050123 - RNA, 19 nt, Human
ccuggcugugaagccugca

SEQ ID NO: 1050124 - RNA, 22 nt, Human
ugcaggucuccauuggcagacu

SEQ ID NO: 1050125 - RNA, 22 nt, Human
ugccugggcucaccgccucuuu

SEQ ID NO: 1050126 - RNA, 22 nt, Human
uuucaaaccuacuuguauguuu

SEQ ID NO: 1050127 - RNA, 23 nt, Human
auugaugacuugauuacacuuuu

SEQ ID NO: 1050128 - RNA, 22 nt, Human
agacaggaugcauacucuuggu

SEQ ID NO: 1050129 - RNA, 22 nt, Human
ugaaggccacuuccugugagcu

SEQ ID NO: 1050130 - RNA, 22 nt, Human
aggcaagcauuuaaccacucau

SEQ ID NO: 1050131 - RNA, 22 nt, Human
gggcugagaauucagcuuuccu

SEQ ID NO: 1050132 - RNA, 22 nt, Human
agggccugucagcgguguccug

SEQ ID NO: 1050133 - RNA, 22 nt, Human
uugguuuaggaacuggcuugga

SEQ ID NO: 1050134 - RNA, 23 nt, Human
uccaggagaauuccagggcccgg

SEQ ID NO: 1050135 - RNA, 22 nt, Human
uggaggaaaaaaccaggcagag

SEQ ID NO: 1050136 - RNA, 23 nt, Human
uggcugagauccuacuguuugcu

SEQ ID NO: 1050137 - RNA, 22 nt, Human
aguucuuuugugaacauaugcu

SEQ ID NO: 1050138 - RNA, 21 nt, Human
uagaagcacauagguucaaag

SEQ ID NO: 1050139 - RNA, 23 nt, Human
cugaggucugcaauucuaguagu

SEQ ID NO: 1050140 - RNA, 22 nt, Human
uggcagcagcuaacuuaggcag

SEQ ID NO: 1050141 - RNA, 23 nt, Human
aggucagcaggcaaggaaauggc

SEQ ID NO: 1050142 - RNA, 22 nt, Human
gggcagcucggaagugggaaag

SEQ ID NO: 1050143 - RNA, 22 nt, Human
uuucuucaauugcuaacaagga

SEQ ID NO: 1050144 - RNA, 22 nt, Human
uuuauucaucaucuguucauau

SEQ ID NO: 1050145 - RNA, 22 nt, Human
uggcuucugggacuugugagca

SEQ ID NO: 1050146 - RNA, 22 nt, Human
auuuggcauaggcagaggccca

SEQ ID NO: 1050147 - RNA, 22 nt, Human
agucugggagaaggugagauua

SEQ ID NO: 1050148 - RNA, 21 nt, Human
cuggccgaccccucugugcuc

SEQ ID NO: 1050149 - RNA, 20 nt, Human
gcagcuacucugucucgcuc

SEQ ID NO: 1050150 - RNA, 22 nt, Human
cccaggaagaaauucugauuug

SEQ ID NO: 1050151 - RNA, 19 nt, Human
ggcugcagagccccggcgc

SEQ ID NO: 1050152 - RNA, 22 nt, Human
caggacagcucaacaccuccuc

SEQ ID NO: 1050153 - RNA, 22 nt, Human
ggucuaaaaugagucuuccuag

SEQ ID NO: 1050154 - RNA, 22 nt, Human
uggcagcugucuguggggucuc

SEQ ID NO: 1050155 - RNA, 22 nt, Human
uggcagcugguacagugggucu

SEQ ID NO: 1050156 - RNA, 22 nt, Human
cugcccagaagccagaugggca

SEQ ID NO: 1050157 - RNA, 22 nt, Human
ggauguugauugaauggccauu

SEQ ID NO: 1050158 - RNA, 22 nt, Human
gacccaggguggucaccugaaa

SEQ ID NO: 1050159 - RNA, 22 nt, Human
ccugggauuugcgccagaccuu

SEQ ID NO: 1050160 - RNA, 22 nt, Human
uggcagcucccagagcuuccaa

SEQ ID NO: 1050161 - RNA, 17 nt, Human
caaggccagcaucuuca

SEQ ID NO: 1050162 - RNA, 22 nt, Human
caggcugauuaggccucgucca

SEQ ID NO: 1050163 - RNA, 22 nt, Human
cuuaagauuugcgauaccuaau

SEQ ID NO: 1050164 - RNA, 22 nt, Human
cuggguccuggugcugaguucu

SEQ ID NO: 1050165 - RNA, 22 nt, Human
acuaagugauucuaagcaucuu

SEQ ID NO: 1050166 - RNA, 22 nt, Human
ccugggugacagagugagaccu

SEQ ID NO: 1050167 - RNA, 21 nt, Human
auuuggcaaaggcgaugcaca

SEQ ID NO: 1050168 - RNA, 22 nt, Human
gggugaggcccauuugaggcca

SEQ ID NO: 1050169 - RNA, 22 nt, Human
gcugcuggccccacaugcucca

SEQ ID NO: 1050170 - RNA, 22 nt, Human
guuaggaauuuguuacugugua

SEQ ID NO: 1050171 - RNA, 22 nt, Human
uggcuucuugaucuuggacuug

SEQ ID NO: 1050172 - RNA, 22 nt, Human
aaaggccauuacuugcuuuuag

SEQ ID NO: 1050173 - RNA, 22 nt, Human
cagcaggagcagucagacuccu

SEQ ID NO: 1050174 - RNA, 22 nt, Human
cccaggaggcggagguuguggu

SEQ ID NO: 1050175 - RNA, 22 nt, Human
gauggcaggcaggugaguagag

SEQ ID NO: 1050176 - RNA, 22 nt, Human
gcauguguuauuuuauguauga

SEQ ID NO: 1050177 - RNA, 20 nt, Human
ccuuuauuauuuguaugaug

SEQ ID NO: 1050178 - RNA, 22 nt, Human
aggucugaguauggccugagaa

SEQ ID NO: 1050179 - RNA, 22 nt, Human
uuaggaaauuccaccuguauuc

SEQ ID NO: 1050180 - RNA, 22 nt, Human
uuugaaaggagcuuuauccaga

SEQ ID NO: 1050181 - RNA, 22 nt, Human
uugaggucaauucuguuuccug

SEQ ID NO: 1050182 - RNA, 22 nt, Human
gcccaggagguugggcugugca

SEQ ID NO: 1050183 - RNA, 22 nt, Human
aagggcugaucucacuuucuuu

SEQ ID NO: 1050184 - RNA, 22 nt, Human
gagcuguccgccccugggccga

SEQ ID NO: 1050185 - RNA, 22 nt, Human
cuucccagaccuuagagugcag

SEQ ID NO: 1050186 - RNA, 22 nt, Human
auaagugacugcagggaauuca

SEQ ID NO: 1050187 - RNA, 22 nt, Human
aggaggggcauagaaauguaau

SEQ ID NO: 1050188 - RNA, 22 nt, Human
ucucaggaagauuagggcuaag

SEQ ID NO: 1050189 - RNA, 22 nt, Human
cugaggucucuuuccauaguga

SEQ ID NO: 1050190 - RNA, 22 nt, Human
gcugaagcugcagcaggaggaa

SEQ ID NO: 1050191 - RNA, 22 nt, Human
uaaauacuuuuacuccacugau

SEQ ID NO: 1050192 - RNA, 22 nt, Human
augcugugaaaaagaaggcuga

SEQ ID NO: 1050193 - RNA, 22 nt, Human
uagugcuuggcccuaccagaua

SEQ ID NO: 1050194 - RNA, 22 nt, Human
acccagagucauggcacuuagc

SEQ ID NO: 1050195 - RNA, 22 nt, Human
ugcaggcuccaugaggacaggc

SEQ ID NO: 1050196 - RNA, 22 nt, Human
acucucugguauuggcaaguuu

SEQ ID NO: 1050197 - RNA, 22 nt, Human
gcuguucucuguaacaugcauu

SEQ ID NO: 1050198 - RNA, 22 nt, Human
cugguggcaucuugagaugguu

SEQ ID NO: 1050199 - RNA, 22 nt, Human
uucauucuugggaucagagagu

SEQ ID NO: 1050200 - RNA, 22 nt, Human
gcaggcugaguauuacccuagu

SEQ ID NO: 1050201 - RNA, 19 nt, Human
uagaggagaagggaagugg

SEQ ID NO: 1050202 - RNA, 22 nt, Human
gggcugagucaucuggggccuc

SEQ ID NO: 1050203 - RNA, 19 nt, Human
guugaaaguaggugagggu

SEQ ID NO: 1050204 - RNA, 22 nt, Human
gcauugaguccacucugucuuu

SEQ ID NO: 1050205 - RNA, 22 nt, Human
uuauuagggugguuuauguucu

SEQ ID NO: 1050206 - RNA, 22 nt, Human
ucucugcuugguguaugugagu

SEQ ID NO: 1050207 - RNA, 22 nt, Human
ggagccuggucagguuggcucc

SEQ ID NO: 1050208 - RNA, 22 nt, Human
ccaggcugccgaggaaagaaag

SEQ ID NO: 1050209 - RNA, 22 nt, Human
auauacaugggaauauguggag

SEQ ID NO: 1050210 - RNA, 22 nt, Human
gcugccagcuuuccuuggcuga

SEQ ID NO: 1050211 - RNA, 22 nt, Human
gcuggagccuucugcucuguug

SEQ ID NO: 1050212 - RNA, 23 nt, Human
cugcuguuuucuguaccugaagc

SEQ ID NO: 1050213 - RNA, 22 nt, Human
ucaggagauguaaccuuagcug

SEQ ID NO: 1050214 - RNA, 18 nt, Human
aagaggaggagcagguug

SEQ ID NO: 1050215 - RNA, 22 nt, Human
gaagcacauggcuauagcuauu

SEQ ID NO: 1050216 - RNA, 22 nt, Human
uggcaacaccuggaagacaugg

SEQ ID NO: 1050217 - RNA, 22 nt, Human
gaaauacugcacacccuguaag

SEQ ID NO: 1050218 - RNA, 22 nt, Human
auuagggaaggauuuggccuga

SEQ ID NO: 1050219 - RNA, 20 nt, Human
agcugccccugggcacugcc

SEQ ID NO: 1050220 - RNA, 22 nt, Human
cagugcagguggcagaggacag

SEQ ID NO: 1050221 - RNA, 22 nt, Human
cugagccauccauaccagcuua

SEQ ID NO: 1050222 - RNA, 22 nt, Human
agagaagagcaaugauaaauuu

SEQ ID NO: 1050223 - RNA, 22 nt, Human
aggcaguuguugcugagcagcu

SEQ ID NO: 1050224 - RNA, 20 nt, Human
uuuuccagaaaguaucauug

SEQ ID NO: 1050225 - RNA, 22 nt, Human
ggcugaggcucaugccaucuug

SEQ ID NO: 1050226 - RNA, 22 nt, Human
cugcuguguggugaaacucagu

SEQ ID NO: 1050227 - RNA, 23 nt, Human
acugagguacugagguugugaca

SEQ ID NO: 1050228 - RNA, 22 nt, Human
caaggcugucuccagcuuccaa

SEQ ID NO: 1050229 - RNA, 22 nt, Human
ugcugcuggaucuuacucaucu

SEQ ID NO: 1050230 - RNA, 22 nt, Human
gcccugggcucccugcuccaca

SEQ ID NO: 1050231 - RNA, 22 nt, Human
gaacuauaugucuuaaagcuuu

SEQ ID NO: 1050232 - RNA, 22 nt, Human
aauuuguuaaaagugagugaca

SEQ ID NO: 1050233 - RNA, 22 nt, Human
aucauacauguaacuaaguaaa

SEQ ID NO: 1050234 - RNA, 22 nt, Human
ucacaucucccuggaggacaca

SEQ ID NO: 1050235 - RNA, 22 nt, Human
aggcuggagagugcaguggcgu

SEQ ID NO: 1050236 - RNA, 22 nt, Human
uggcuucuucauaugugaucuu

SEQ ID NO: 1050237 - RNA, 22 nt, Human
uaacaguaaaguaaguuagcuu

SEQ ID NO: 1050238 - RNA, 20 nt, Human
ucaccuuuguugguauucau

SEQ ID NO: 1050239 - RNA, 22 nt, Human
uaaucguauguguaucaaauca

SEQ ID NO: 1050240 - RNA, 22 nt, Human
gauaaugaugacaaugacaacc

SEQ ID NO: 1050241 - RNA, 22 nt, Human
uaaccuuuggugaaauauuaac

SEQ ID NO: 1050242 - RNA, 22 nt, Human
uacaucuauacugaucuacauu

SEQ ID NO: 1050243 - RNA, 19 nt, Human
ugaggggaggagaggccug

SEQ ID NO: 1050244 - RNA, 22 nt, Human
gugagguccuaauagacaucga

SEQ ID NO: 1050245 - RNA, 22 nt, Human
uggcugaggcacagcugccgcc

SEQ ID NO: 1050246 - RNA, 22 nt, Human
agaaaugaagagagucaagguu

SEQ ID NO: 1050247 - RNA, 22 nt, Human
gagggcuccauuccccgugccc

SEQ ID NO: 1050248 - RNA, 22 nt, Human
gacuuucugaaggucucgcagu

SEQ ID NO: 1050249 - RNA, 22 nt, Human
gcuggccagggcugcucgcgga

SEQ ID NO: 1050250 - RNA, 22 nt, Human
uucuucuuaauguccugggaac

SEQ ID NO: 1050251 - RNA, 21 nt, Human
uggcugcacuguggcuuucau

SEQ ID NO: 1050252 - RNA, 22 nt, Human
cuaggcaguccugacgguacua

SEQ ID NO: 1050253 - RNA, 21 nt, Human
ugcugcugaucgggguuggcu

SEQ ID NO: 1050254 - RNA, 22 nt, Human
uggaaggaagccaaggaagguu

SEQ ID NO: 1050255 - RNA, 22 nt, Human
uggcagcuggcucugcgcaggc

SEQ ID NO: 1050256 - RNA, 22 nt, Human
ugaggggagguuggggcacauc

SEQ ID NO: 1050257 - RNA, 22 nt, Human
uaguaacugguugaacaacugu

SEQ ID NO: 1050258 - RNA, 22 nt, Human
auuggaaauacaguagaaaaau

SEQ ID NO: 1050259 - RNA, 22 nt, Human
uuuuaauacugcuauuguagga

SEQ ID NO: 1050260 - RNA, 22 nt, Human
cucuggcuucuaccuugcaguu

SEQ ID NO: 1050261 - RNA, 17 nt, Human
aacugcuuuuuuuagcc

SEQ ID NO: 1050262 - RNA, 22 nt, Human
aacuggugagauaaauuauuua

SEQ ID NO: 1050263 - RNA, 22 nt, Human
gaagaaguauuuuuguccuguu

SEQ ID NO: 1050264 - RNA, 22 nt, Human
gcacugugcuagaagccagggg

SEQ ID NO: 1050265 - RNA, 22 nt, Human
uugcaggauuuuagagaugaca

SEQ ID NO: 1050266 - RNA, 22 nt, Human
ggccugagaaccauggggccaa

SEQ ID NO: 1050267 - RNA, 22 nt, Human
agauaagauaguccagcacaau

SEQ ID NO: 1050268 - RNA, 22 nt, Human
gagcaagauccuguuuuucuau

SEQ ID NO: 1050269 - RNA, 22 nt, Human
agucccuguacuuuccacugcc

SEQ ID NO: 1050270 - RNA, 22 nt, Human
agaccuggauuccaauccuacc

SEQ ID NO: 1050271 - RNA, 22 nt, Human
gugguaauuuaauccuacacug

SEQ ID NO: 1050272 - RNA, 22 nt, Human
cugggaaauggcuucgagcuca

SEQ ID NO: 1050273 - RNA, 22 nt, Human
uggcucagccauucguguugcc

SEQ ID NO: 1050274 - RNA, 20 nt, Human
cccaggaguuugcucuuacu

SEQ ID NO: 1050275 - RNA, 22 nt, Human
gccugccuuuguaugacccuga

SEQ ID NO: 1050276 - RNA, 22 nt, Human
cagccuuugugaacaucaggug

SEQ ID NO: 1050277 - RNA, 22 nt, Human
aucacuguguauguauaugcag

SEQ ID NO: 1050278 - RNA, 22 nt, Human
gcugccugcucggcuccuggga

SEQ ID NO: 1050279 - RNA, 21 nt, Human
uccaggagcacgggacuagga

SEQ ID NO: 1050280 - RNA, 22 nt, Human
cagaacuguuauaacagcuguu

SEQ ID NO: 1050281 - RNA, 22 nt, Human
acauuuuuauucaucaaagcag

SEQ ID NO: 1050282 - RNA, 22 nt, Human
gaggccacuuccuacuggagga

SEQ ID NO: 1050283 - RNA, 19 nt, Human
uucaggauugacccuacug

SEQ ID NO: 1050284 - RNA, 22 nt, Human
uggcugagaaaaaagagcuaua

SEQ ID NO: 1050285 - RNA, 22 nt, Human
gugugcaggggcuugguggagc

SEQ ID NO: 1050286 - RNA, 22 nt, Human
ugguccacagggaguccgugcu

SEQ ID NO: 1050287 - RNA, 22 nt, Human
uggcugagaccaucagggugua

SEQ ID NO: 1050288 - RNA, 22 nt, Human
ucuccuggcaugugggucaucu

SEQ ID NO: 1050289 - RNA, 22 nt, Human
aucaggaucaugcuggguggga

SEQ ID NO: 1050290 - RNA, 22 nt, Human
uaggaaauuagaacuuggaaac

SEQ ID NO: 1050291 - RNA, 22 nt, Human
agugcuuuagagaaauggugcu

SEQ ID NO: 1050292 - RNA, 22 nt, Human
caccuuguggcccagucagguu

SEQ ID NO: 1050293 - RNA, 22 nt, Human
caggcugaucagggcugggaug

SEQ ID NO: 1050294 - RNA, 22 nt, Human
aaagauuaggcggcaacugggc

SEQ ID NO: 1050295 - RNA, 22 nt, Human
auagaaaacagauguccuuaaa

SEQ ID NO: 1050296 - RNA, 19 nt, Human
uagugucaaggaggagggu

SEQ ID NO: 1050297 - RNA, 22 nt, Human
augaggcaguacacacaaagcc

SEQ ID NO: 1050298 - RNA, 17 nt, Human
agcaaaaguaucaaagc

SEQ ID NO: 1050299 - RNA, 22 nt, Human
uaaauacuuaguuuugugucua

SEQ ID NO: 1050300 - RNA, 22 nt, Human
gagggaugguaguugacacuga

SEQ ID NO: 1050301 - RNA, 22 nt, Human
ucuuagcauuucauaacaacug

SEQ ID NO: 1050302 - RNA, 22 nt, Human
cugagggcagugaugaagguga

SEQ ID NO: 1050303 - RNA, 23 nt, Human
uccugaggguuucccagccuugg

SEQ ID NO: 1050304 - RNA, 22 nt, Human
uuugcaaagaaauuauugcugu

SEQ ID NO: 1050305 - RNA, 22 nt, Human
uugcaucuagggcaacccagag

SEQ ID NO: 1050306 - RNA, 22 nt, Human
auuaguaaaacauuguauaugu

SEQ ID NO: 1050307 - RNA, 22 nt, Human
guccacugcugugugcuucacc

SEQ ID NO: 1050308 - RNA, 22 nt, Human
ucucuguacaguacaugccgug

SEQ ID NO: 1050309 - RNA, 22 nt, Human
cugccaggcagcagagggagaa

SEQ ID NO: 1050310 - RNA, 22 nt, Human
auuuugaugcuaucuaaugaau

SEQ ID NO: 1050311 - RNA, 22 nt, Human
guaacucuggguagaacucaug

SEQ ID NO: 1050312 - RNA, 20 nt, Human
accuacauguauagugaggg

SEQ ID NO: 1050313 - RNA, 22 nt, Human
cagucugaacacugggcuacuc

SEQ ID NO: 1050314 - RNA, 22 nt, Human
uagggcaggugaagaaaagcua

SEQ ID NO: 1050315 - RNA, 22 nt, Human
gacuccugccuccucuguuugc

SEQ ID NO: 1050316 - RNA, 22 nt, Human
uuauuagagugcuuugagaaag

SEQ ID NO: 1050317 - RNA, 22 nt, Human
uggagacucugcaucugugaca

SEQ ID NO: 1050318 - RNA, 22 nt, Human
gaaggccauuuuuagguagaau

SEQ ID NO: 1050319 - RNA, 22 nt, Human
cugaagucagauggcacaaggu

SEQ ID NO: 1050320 - RNA, 22 nt, Human
uucaggauaguggugaguggca

SEQ ID NO: 1050321 - RNA, 22 nt, Human
gcccaggagaggccagggcuga

SEQ ID NO: 1050322 - RNA, 22 nt, Human
ugaggcucagagcaccugcucc

SEQ ID NO: 1050323 - RNA, 22 nt, Human
uugcauuuuuagaugcuucugu

SEQ ID NO: 1050324 - RNA, 22 nt, Human
aaaugauugucaaaguucuguu

SEQ ID NO: 1050325 - RNA, 22 nt, Human
ucagggaccaccacucacccag

SEQ ID NO: 1050326 - RNA, 22 nt, Human
aaaaaugaaacggcugguuggc

SEQ ID NO: 1050327 - RNA, 22 nt, Human
uggggcucaccuaggcuggaag

SEQ ID NO: 1050328 - RNA, 22 nt, Human
uccaggagaggccugaccaggu

SEQ ID NO: 1050329 - RNA, 22 nt, Human
gaggagaaauuuggggaccuga

SEQ ID NO: 1050330 - RNA, 22 nt, Human
uccuugacugugaggaacuagc

SEQ ID NO: 1050331 - RNA, 22 nt, Human
aguggcagagguugacugcagu

SEQ ID NO: 1050332 - RNA, 22 nt, Human
uauauuaguggaaugauaugaa

SEQ ID NO: 1050333 - RNA, 22 nt, Human
caggauggucagaugcauuguc

SEQ ID NO: 1050334 - RNA, 22 nt, Human
aaugucugagucucuguauccc

SEQ ID NO: 1050335 - RNA, 22 nt, Human
cugcugucauagccaucccucc

SEQ ID NO: 1050336 - RNA, 17 nt, Human
agagggaaaaugcgguu

SEQ ID NO: 1050337 - RNA, 22 nt, Human
gggugggacugaagucugaggg

SEQ ID NO: 1050338 - RNA, 22 nt, Human
ugaggcagaaaauagcaguuca

SEQ ID NO: 1050339 - RNA, 22 nt, Human
uuucccaguucccugcucuaua

SEQ ID NO: 1050340 - RNA, 22 nt, Human
ugcccugggaacacagaugcca

SEQ ID NO: 1050341 - RNA, 22 nt, Human
aaggcagccgugugacugcaug

SEQ ID NO: 1050342 - RNA, 20 nt, Human
aggcagcuggccaggcaggu

SEQ ID NO: 1050343 - RNA, 22 nt, Human
agugcuuugaacgaaaggcuga

SEQ ID NO: 1050344 - RNA, 20 nt, Human
cccagugaagcauggaagag

SEQ ID NO: 1050345 - RNA, 20 nt, Human
ucucuucuggggagauaaaa

SEQ ID NO: 1050346 - RNA, 22 nt, Human
uuucaaagaguuguaaauuacu

SEQ ID NO: 1050347 - RNA, 22 nt, Human
caaugugguggcagaugucagu

SEQ ID NO: 1050348 - RNA, 22 nt, Human
acaaugaacgcuuuuuaacugu

SEQ ID NO: 1050349 - RNA, 22 nt, Human
uggcagcacuagguacugagcu

SEQ ID NO: 1050350 - RNA, 21 nt, Human
cagaggucauccugaggacaa

SEQ ID NO: 1050351 - RNA, 22 nt, Human
agggcugagacuaaggccagau

SEQ ID NO: 1050352 - RNA, 22 nt, Human
cagcugacuucauaggaagaca

SEQ ID NO: 1050353 - RNA, 22 nt, Human
cagcugacagugaggugggggc

SEQ ID NO: 1050354 - RNA, 21 nt, Human
aggcagcaucugauuuauaug

SEQ ID NO: 1050355 - RNA, 22 nt, Human
gcuguguuggugaagcuguagc

SEQ ID NO: 1050356 - RNA, 22 nt, Human
cuagccaugggcauuaaaggua

SEQ ID NO: 1050357 - RNA, 22 nt, Human
aaguauuucguucugaaaaagu

SEQ ID NO: 1050358 - RNA, 22 nt, Human
ccauuguaaauucuguggaagu

SEQ ID NO: 1050359 - RNA, 22 nt, Human
uuaaagggccgauuuccaggcc

SEQ ID NO: 1050360 - RNA, 22 nt, Human
agcggcugcucuuuucagaucc

SEQ ID NO: 1050361 - RNA, 22 nt, Human
aguucucaagacaauuaccugu

SEQ ID NO: 1050362 - RNA, 22 nt, Human
cccauugugguuguugaggaua

SEQ ID NO: 1050363 - RNA, 22 nt, Human
gcagaggacagggauuuagauu

SEQ ID NO: 1050364 - RNA, 22 nt, Human
uugcuuugccaccagaagucua

SEQ ID NO: 1050365 - RNA, 20 nt, Human
agcaagaguaaggacagcga

SEQ ID NO: 1050366 - RNA, 22 nt, Human
uuccaugagcucugaguucaca

SEQ ID NO: 1050367 - RNA, 20 nt, Human
cagagccaagagcagcaucu

SEQ ID NO: 1050368 - RNA, 21 nt, Human
ggacagcugcgcgcagggcuc

SEQ ID NO: 1050369 - RNA, 22 nt, Human
auacuguuucucuucuacauga

SEQ ID NO: 1050370 - RNA, 22 nt, Human
ccugaggucaugcauuuccaac

SEQ ID NO: 1050371 - RNA, 22 nt, Human
acaucuagaagaucugggagau

SEQ ID NO: 1050372 - RNA, 22 nt, Human
ucugcugugggucuauauuuua

SEQ ID NO: 1050373 - RNA, 22 nt, Human
ucucuucuaacacuagaaauuc

SEQ ID NO: 1050374 - RNA, 22 nt, Human
cuaacauuuauugagcacuuag

SEQ ID NO: 1050375 - RNA, 22 nt, Human
gucuucuguaagaugagguccc

SEQ ID NO: 1050376 - RNA, 22 nt, Human
ucaggagaacuuccuucuaccc

SEQ ID NO: 1050377 - RNA, 22 nt, Human
cugggucccacagccugcuggg

SEQ ID NO: 1050378 - RNA, 23 nt, Human
guaacuggggaauuugagcuaug

SEQ ID NO: 1050379 - RNA, 22 nt, Human
cucuucuugccugaugaggcag

SEQ ID NO: 1050380 - RNA, 22 nt, Human
auacaacuuuaucuguaaugag

SEQ ID NO: 1050381 - RNA, 20 nt, Human
uguccccaccaaaauuucau

SEQ ID NO: 1050382 - RNA, 23 nt, Human
ucucaggacacacaugucuauca

SEQ ID NO: 1050383 - RNA, 18 nt, Human
agggagagaccgcggguc

SEQ ID NO: 1050384 - RNA, 19 nt, Human
gcccugaguaagcuaggag

SEQ ID NO: 1050385 - RNA, 22 nt, Human
agacaggccacucuggucuggu

SEQ ID NO: 1050386 - RNA, 22 nt, Human
caaggccaguccauuuuggaag

SEQ ID NO: 1050387 - RNA, 22 nt, Human
ggaagaggaggagccaggcuuu

SEQ ID NO: 1050388 - RNA, 22 nt, Human
caugcugugcaucuugaugacc

SEQ ID NO: 1050389 - RNA, 22 nt, Human
ugcuuggccuacuuguccuuug

SEQ ID NO: 1050390 - RNA, 22 nt, Human
aaauagcagccuuuaguuaaca

SEQ ID NO: 1050391 - RNA, 20 nt, Human
ugccccaggccugcaccugc

SEQ ID NO: 1050392 - RNA, 22 nt, Human
gaaauaagaguccaugccaggu

SEQ ID NO: 1050393 - RNA, 22 nt, Human
gaagcagccacggggagacaga

SEQ ID NO: 1050394 - RNA, 18 nt, Human
acaggcugugggaauggu

SEQ ID NO: 1050395 - RNA, 18 nt, Human
ugaggcagucagugaugg

SEQ ID NO: 1050396 - RNA, 22 nt, Human
aguuguaagagacagauauaaa

SEQ ID NO: 1050397 - RNA, 22 nt, Human
acuaacuugcugagugaccaug

SEQ ID NO: 1050398 - RNA, 22 nt, Human
uucaggaucauuuguuuuaucu

SEQ ID NO: 1050399 - RNA, 22 nt, Human
ccuggcugcccauggacccucu

SEQ ID NO: 1050400 - RNA, 22 nt, Human
ucccagagccaagcuauggaug

SEQ ID NO: 1050401 - RNA, 22 nt, Human
gcccaggaagugacucagaugu

SEQ ID NO: 1050402 - RNA, 22 nt, Human
acacauauucauauguacuuac

SEQ ID NO: 1050403 - RNA, 22 nt, Human
uuauuagagauauuugguuagg

SEQ ID NO: 1050404 - RNA, 22 nt, Human
cuggccuagcucucugcuugaa

SEQ ID NO: 1050405 - RNA, 22 nt, Human
gauggcagcauauugacagcau

SEQ ID NO: 1050406 - RNA, 22 nt, Human
cuucuucauaggcaguccuguu

SEQ ID NO: 1050407 - RNA, 19 nt, Human
agcauuuggaauucuacac

SEQ ID NO: 1050408 - RNA, 22 nt, Human
ccaggcuggaaucaauauucug

SEQ ID NO: 1050409 - RNA, 22 nt, Human
caagauggacauaaggagagaa

SEQ ID NO: 1050410 - RNA, 22 nt, Human
gagguggugguggaggcauagc

SEQ ID NO: 1050411 - RNA, 22 nt, Human
gggaggugauggcaagcagcgg

SEQ ID NO: 1050412 - RNA, 22 nt, Human
aguggcagagccaaguagagcc

SEQ ID NO: 1050413 - RNA, 22 nt, Human
agucagugaaugguguaugcua

SEQ ID NO: 1050414 - RNA, 19 nt, Human
gcuggccacgccccaguug

SEQ ID NO: 1050415 - RNA, 22 nt, Human
gcagaggccaggccaccagcaa

SEQ ID NO: 1050416 - RNA, 22 nt, Human
uucugagacaauugagagucua

SEQ ID NO: 1050417 - RNA, 22 nt, Human
cagucagggacaccagcuagga

SEQ ID NO: 1050418 - RNA, 21 nt, Human
gcuggagagccaggcaggggc

SEQ ID NO: 1050419 - RNA, 22 nt, Human
uuauuacaaugcagaaaauaga

SEQ ID NO: 1050420 - RNA, 22 nt, Human
cucuggccugcagauccaugcu

SEQ ID NO: 1050421 - RNA, 22 nt, Human
gucuggccugccagcucuggug

SEQ ID NO: 1050422 - RNA, 17 nt, Human
ucccaggaacagggaau

SEQ ID NO: 1050423 - RNA, 22 nt, Human
gaggcagcugaagcuucaaaga

SEQ ID NO: 1050424 - RNA, 22 nt, Human
gucugaggguugugcuggagga

SEQ ID NO: 1050425 - RNA, 23 nt, Human
ggcuugagcuggaacagcuuggu

SEQ ID NO: 1050426 - RNA, 22 nt, Human
uccauuuucaucucauguauaa

SEQ ID NO: 1050427 - RNA, 22 nt, Human
caggagaggcuguacguuucuc

SEQ ID NO: 1050428 - RNA, 22 nt, Human
aaggcagcaacuaauggaucuc

SEQ ID NO: 1050429 - RNA, 22 nt, Human
uugcugugaaaccaugggaagu

SEQ ID NO: 1050430 - RNA, 22 nt, Human
uugcagcuucuaccacuguuuc

SEQ ID NO: 1050431 - RNA, 21 nt, Human
ugaaaugagaaugcugagcac

SEQ ID NO: 1050432 - RNA, 22 nt, Human
caggagagauaugaguccccac

SEQ ID NO: 1050433 - RNA, 22 nt, Human
cagggcugguuugucgaagaaa

SEQ ID NO: 1050434 - RNA, 22 nt, Human
uuuuaaaucuccaguugacccc

SEQ ID NO: 1050435 - RNA, 22 nt, Human
uuugcagugucagcuucugugu

SEQ ID NO: 1050436 - RNA, 22 nt, Human
cccaggagguggagcuugcagu

SEQ ID NO: 1050437 - RNA, 21 nt, Human
gagaacugaaccagagcagcu

SEQ ID NO: 1050438 - RNA, 22 nt, Human
uggcagcugcaggccuccugag

SEQ ID NO: 1050439 - RNA, 22 nt, Human
agccacaggccaugagauacca

SEQ ID NO: 1050440 - RNA, 22 nt, Human
cccagcaggaggagguugcagu

SEQ ID NO: 1050441 - RNA, 22 nt, Human
uccaggaggcucugguugacgu

SEQ ID NO: 1050442 - RNA, 22 nt, Human
ggcugagcaauuuugaugacau

SEQ ID NO: 1050443 - RNA, 22 nt, Human
cuugaaagcacuuaguaaauua

SEQ ID NO: 1050444 - RNA, 22 nt, Human
gcugagguggcugccuuaguaa

SEQ ID NO: 1050445 - RNA, 22 nt, Human
gucuauauauugcuugaauaau

SEQ ID NO: 1050446 - RNA, 22 nt, Human
ggaggggagucucccaaagccg

SEQ ID NO: 1050447 - RNA, 22 nt, Human
uagaaaguaaaucaguuuuauu

SEQ ID NO: 1050448 - RNA, 22 nt, Human
cugagggccuucuaugcugagc

SEQ ID NO: 1050449 - RNA, 22 nt, Human
uuagccauugucagcacauggc

SEQ ID NO: 1050450 - RNA, 22 nt, Human
agcagcugguaggaguggccac

SEQ ID NO: 1050451 - RNA, 22 nt, Human
acagcauugcuccaucucaaga

SEQ ID NO: 1050452 - RNA, 22 nt, Human
cagugauguuucugcaucagag

SEQ ID NO: 1050453 - RNA, 22 nt, Human
ucuggccaggggucccugaagg

SEQ ID NO: 1050454 - RNA, 22 nt, Human
uugagggucuggaucugcugcu

SEQ ID NO: 1050455 - RNA, 22 nt, Human
ccuccugguugcaaugaaaugg

SEQ ID NO: 1050456 - RNA, 22 nt, Human
augaggcauuccacucaaacuc

SEQ ID NO: 1050457 - RNA, 22 nt, Human
gcucugggcugaaucauuuauc

SEQ ID NO: 1050458 - RNA, 22 nt, Human
gcugccuguccugaggaguccg

SEQ ID NO: 1050459 - RNA, 22 nt, Human
aucuuucuccauauacaucuuu

SEQ ID NO: 1050460 - RNA, 22 nt, Human
guuuauuauacaacaaaagcua

SEQ ID NO: 1050461 - RNA, 20 nt, Human
ccuccuggucaggugugcag

SEQ ID NO: 1050462 - RNA, 22 nt, Human
gccaggagccagcuucuuagca

SEQ ID NO: 1050463 - RNA, 22 nt, Human
cagugccaaggagaaggacagc

SEQ ID NO: 1050464 - RNA, 22 nt, Human
gugcagcugugguggagccagg

SEQ ID NO: 1050465 - RNA, 22 nt, Human
ggcaugagagguccuggggauu

SEQ ID NO: 1050466 - RNA, 22 nt, Human
uuugaaaggaaguuaauacuuu

SEQ ID NO: 1050467 - RNA, 22 nt, Human
ucuacagacagagcagguggga

SEQ ID NO: 1050468 - RNA, 22 nt, Human
ucucucuucaacccuuaacuag

SEQ ID NO: 1050469 - RNA, 22 nt, Human
ccaggagaagcaucugagugua

SEQ ID NO: 1050470 - RNA, 22 nt, Human
uucaugugaauauauuugucuu

SEQ ID NO: 1050471 - RNA, 22 nt, Human
auguuuccagguucuuccuaug

SEQ ID NO: 1050472 - RNA, 22 nt, Human
acaggagaaaucuggucaaaag

SEQ ID NO: 1050473 - RNA, 22 nt, Human
gucaggauuuacaaacuucagu

SEQ ID NO: 1050474 - RNA, 22 nt, Human
auguucuuccaaaucuguaaca

SEQ ID NO: 1050475 - RNA, 22 nt, Human
agucucugcugguugugccuau

SEQ ID NO: 1050476 - RNA, 22 nt, Human
uaucuguuaugggcugaauugc

SEQ ID NO: 1050477 - RNA, 22 nt, Human
cucaggaugcaggucacaggac

SEQ ID NO: 1050478 - RNA, 22 nt, Human
cuccugggaauuuaguugugag

SEQ ID NO: 1050479 - RNA, 22 nt, Human
uuggaaagcaagcuggacauac

SEQ ID NO: 1050480 - RNA, 22 nt, Human
guggccaaggcagagaaagagc

SEQ ID NO: 1050481 - RNA, 22 nt, Human
uggcugcugcagacagacagga

SEQ ID NO: 1050482 - RNA, 22 nt, Human
acaguaacucuuuuacccuccu

SEQ ID NO: 1050483 - RNA, 22 nt, Human
acagagcuguacaugugccaug

SEQ ID NO: 1050484 - RNA, 22 nt, Human
cucaugucuucacccauucuaa

SEQ ID NO: 1050485 - RNA, 22 nt, Human
cauuguuaauugguaucuuaca

SEQ ID NO: 1050486 - RNA, 22 nt, Human
guauuagguuggugcaaaagua

SEQ ID NO: 1050487 - RNA, 22 nt, Human
gcaggcugccaccuucugaguu

SEQ ID NO: 1050488 - RNA, 22 nt, Human
aagcaagaggaaauguggaccu

SEQ ID NO: 1050489 - RNA, 22 nt, Human
aaggcagccauagcaccaucca

SEQ ID NO: 1050490 - RNA, 22 nt, Human
agacaaauggaguaugagcaac

SEQ ID NO: 1050491 - RNA, 22 nt, Human
uuggaugaagucuagcuuuagu

SEQ ID NO: 1050492 - RNA, 22 nt, Human
ucaggcugaccagguuuugcuc

SEQ ID NO: 1050493 - RNA, 22 nt, Human
cauuuuauccucugggaagcua

SEQ ID NO: 1050494 - RNA, 22 nt, Human
uuucucaguuacuagcuguggu

SEQ ID NO: 1050495 - RNA, 22 nt, Human
caggaugagaggcccagggaag

SEQ ID NO: 1050496 - RNA, 20 nt, Human
ggaggguggaagaaagcaag

SEQ ID NO: 1050497 - RNA, 22 nt, Human
agucucugggcaugguugugac

SEQ ID NO: 1050498 - RNA, 18 nt, Human
cauuguacaaugcuuuau

SEQ ID NO: 1050499 - RNA, 22 nt, Human
uuuccaaauaaggucacacuca

SEQ ID NO: 1050500 - RNA, 22 nt, Human
cucucuggcacuucauugcugu

SEQ ID NO: 1050501 - RNA, 21 nt, Human
aaugcauuaacauaaagcuga

SEQ ID NO: 1050502 - RNA, 22 nt, Human
cugaguccuugggcuuagagug

SEQ ID NO: 1050503 - RNA, 22 nt, Human
uuuauuauguacaggcacuaua

SEQ ID NO: 1050504 - RNA, 22 nt, Human
agcuacccgaggacaggcuaag

SEQ ID NO: 1050505 - RNA, 22 nt, Human
ccugugccagcugggcccugcc

SEQ ID NO: 1050506 - RNA, 22 nt, Human
ccacuuucugagggaacagcag

SEQ ID NO: 1050507 - RNA, 22 nt, Human
cagggcuguggcuuugugcugu

SEQ ID NO: 1050508 - RNA, 22 nt, Human
uuggcagugucugcaaaaugga

SEQ ID NO: 1050509 - RNA, 22 nt, Human
caugucuguguacacaugcaca

SEQ ID NO: 1050510 - RNA, 22 nt, Human
aaugauuuccccuacacagaag

SEQ ID NO: 1050511 - RNA, 22 nt, Human
uuugacauugccaauuugcuca

SEQ ID NO: 1050512 - RNA, 22 nt, Human
augaggcaaucaugguccaguu

SEQ ID NO: 1050513 - RNA, 22 nt, Human
acaugcauaggagaagucuuua

SEQ ID NO: 1050514 - RNA, 22 nt, Human
auggcugggucaccaucagggu

SEQ ID NO: 1050515 - RNA, 22 nt, Human
gauacacuggagcuuccugaca

SEQ ID NO: 1050516 - RNA, 17 nt, Human
aaucuguuuacagucag

SEQ ID NO: 1050517 - RNA, 22 nt, Human
cuuugcaaacgauuaccacaug

SEQ ID NO: 1050518 - RNA, 22 nt, Human
cagauggaacacagaaaggaga

SEQ ID NO: 1050519 - RNA, 22 nt, Human
ggcagacaccuuuaugucuaau

SEQ ID NO: 1050520 - RNA, 22 nt, Human
auaucacaguaguuguuuaguu

SEQ ID NO: 1050521 - RNA, 22 nt, Human
gucuucuuuucagucugcuugu

SEQ ID NO: 1050522 - RNA, 22 nt, Human
ugcuuuggccacuagaauucag

SEQ ID NO: 1050523 - RNA, 16 nt, Human
ucccaggaggcggaac

SEQ ID NO: 1050524 - RNA, 22 nt, Human
acauucuuaacaguuaaaaacu

SEQ ID NO: 1050525 - RNA, 22 nt, Human
gaggcugaacagguucucauga

SEQ ID NO: 1050526 - RNA, 22 nt, Human
cacagccuuacugagauccacu

SEQ ID NO: 1050527 - RNA, 22 nt, Human
uacuuucuuucccaagaggugg

SEQ ID NO: 1050528 - RNA, 22 nt, Human
acacuuuuagcuaugaguuaau

SEQ ID NO: 1050529 - RNA, 22 nt, Human
ggagaggguguggaaaguuauc

SEQ ID NO: 1050530 - RNA, 22 nt, Human
ccuccugggacaggcuggcaca

SEQ ID NO: 1050531 - RNA, 22 nt, Human
aucaaugacaguugaauucuac

SEQ ID NO: 1050532 - RNA, 22 nt, Human
cuguuuaucccuuuggucagca

SEQ ID NO: 1050533 - RNA, 22 nt, Human
ugaggcucuccaagcagaugag

SEQ ID NO: 1050534 - RNA, 22 nt, Human
cauacauuaccuaacuuaaugc

SEQ ID NO: 1050535 - RNA, 22 nt, Human
acccucccauuuccauguagca

SEQ ID NO: 1050536 - RNA, 18 nt, Human
ggagaagaacagaugugg

SEQ ID NO: 1050537 - RNA, 22 nt, Human
uggcagcuacagacagagguga

SEQ ID NO: 1050538 - RNA, 19 nt, Human
ccugaggugggguggaagg

SEQ ID NO: 1050539 - RNA, 22 nt, Human
uccaaauauacagaaucuccuc

SEQ ID NO: 1050540 - RNA, 22 nt, Human
uuucauggcuaggacuagagug

SEQ ID NO: 1050541 - RNA, 21 nt, Human
ccaggcugggagggcaguucc

SEQ ID NO: 1050542 - RNA, 21 nt, Human
caugcaggauuuaaccuagaa

SEQ ID NO: 1050543 - RNA, 22 nt, Human
ucuuugaacuuggcugaucucu

SEQ ID NO: 1050544 - RNA, 22 nt, Human
acaggcuguugggguccagggu

SEQ ID NO: 1050545 - RNA, 22 nt, Human
ucugucaccccuguuucuggcu

SEQ ID NO: 1050546 - RNA, 19 nt, Human
ggcagcuggacgcuguuca

SEQ ID NO: 1050547 - RNA, 23 nt, Human
ggacccuguggagggugagaguc

SEQ ID NO: 1050548 - RNA, 22 nt, Human
cuggggucagggaucagagagc

SEQ ID NO: 1050549 - RNA, 19 nt, Human
aauacaguguuauagaauu

SEQ ID NO: 1050550 - RNA, 22 nt, Human
ucucaggaagugauauugagac

SEQ ID NO: 1050551 - RNA, 19 nt, Human
cugcucuccuugacuugga

SEQ ID NO: 1050552 - RNA, 21 nt, Human
cagcaagacauguuuaucaag

SEQ ID NO: 1050553 - RNA, 22 nt, Human
aaugaaacuaguagaaucuuug

SEQ ID NO: 1050554 - RNA, 22 nt, Human
aaggcagcaagaauuccagguu

SEQ ID NO: 1050555 - RNA, 22 nt, Human
uuauuucauugauuucuaagac

SEQ ID NO: 1050556 - RNA, 16 nt, Human
cuuccucuucacuggc

SEQ ID NO: 1050557 - RNA, 22 nt, Human
ucccugcccucagugcacccgg

SEQ ID NO: 1050558 - RNA, 23 nt, Human
uacuuaggaauggggacggcaag

SEQ ID NO: 1050559 - RNA, 22 nt, Human
gcugagcugggacaguccuggg

SEQ ID NO: 1050560 - RNA, 22 nt, Human
agcugcuacugcucugccagag

SEQ ID NO: 1050561 - RNA, 22 nt, Human
cuucaugcugauauccucgaug

SEQ ID NO: 1050562 - RNA, 22 nt, Human
uccaggagggguaggcaguaug

SEQ ID NO: 1050563 - RNA, 22 nt, Human
ggcucaggcuggagugcagugg

SEQ ID NO: 1050564 - RNA, 22 nt, Human
uggucaaauuuagucucuggaa

SEQ ID NO: 1050565 - RNA, 22 nt, Human
ugcccuggggagcccagccagg

SEQ ID NO: 1050566 - RNA, 22 nt, Human
auuagagcaguaauuguggcag

SEQ ID NO: 1050567 - RNA, 23 nt, Human
cccagggacacgaugacaccucc

SEQ ID NO: 1050568 - RNA, 22 nt, Human
aaauuauucucauguguuucuu

SEQ ID NO: 1050569 - RNA, 20 nt, Human
ugcugaggccugaggccugg

SEQ ID NO: 1050570 - RNA, 22 nt, Human
gucacuguauccagguuccagc

SEQ ID NO: 1050571 - RNA, 22 nt, Human
uucaggaugacaccauguccag

SEQ ID NO: 1050572 - RNA, 22 nt, Human
augauugguggucagcaguaug

SEQ ID NO: 1050573 - RNA, 19 nt, Human
aagggcugggcaccucacu

SEQ ID NO: 1050574 - RNA, 22 nt, Human
cuggccagaguuggagggugug

SEQ ID NO: 1050575 - RNA, 22 nt, Human
guggaauguccuugaucauaag

SEQ ID NO: 1050576 - RNA, 22 nt, Human
aggggaugauccucccgcagcg

SEQ ID NO: 1050577 - RNA, 19 nt, Human
uaucuguuuccugcuuguc

SEQ ID NO: 1050578 - RNA, 22 nt, Human
gaccaaggaagaggggagccag

SEQ ID NO: 1050579 - RNA, 22 nt, Human
uuagccauuuuauacaagugua

SEQ ID NO: 1050580 - RNA, 17 nt, Human
agcugaaauugcugaag

SEQ ID NO: 1050581 - RNA, 22 nt, Human
agccuuguuggucugaguuugg

SEQ ID NO: 1050582 - RNA, 22 nt, Human
cuccugggcucauaucauucag

SEQ ID NO: 1050583 - RNA, 22 nt, Human
uuucacauuagauaugucauuu

SEQ ID NO: 1050584 - RNA, 18 nt, Human
uaggagagaauuuauuua

SEQ ID NO: 1050585 - RNA, 22 nt, Human
cccuggagugugacgaggcauu

SEQ ID NO: 1050586 - RNA, 22 nt, Human
aguggcagagugcacucaggca

SEQ ID NO: 1050587 - RNA, 22 nt, Human
cuggccaauauagggaaaucuu

SEQ ID NO: 1050588 - RNA, 21 nt, Human
aaugaaguggcuauuuugagg

SEQ ID NO: 1050589 - RNA, 19 nt, Human
agacagagcucaguggguu

SEQ ID NO: 1050590 - RNA, 22 nt, Human
agagggauaauauguauuguaa

SEQ ID NO: 1050591 - RNA, 22 nt, Human
ggaggggaugguuugacccugg

SEQ ID NO: 1050592 - RNA, 19 nt, Human
uggagacugagagugagca

SEQ ID NO: 1050593 - RNA, 22 nt, Human
agucucuuuaaucacagugucu

SEQ ID NO: 1050594 - RNA, 20 nt, Human
cacaggcuauaugagagcca

SEQ ID NO: 1050595 - RNA, 22 nt, Human
gccaggagugucccacucauuu

SEQ ID NO: 1050596 - RNA, 22 nt, Human
auucucuuuguauaacaucuug

SEQ ID NO: 1050597 - RNA, 22 nt, Human
gauuaaguaacugaacacuuug

SEQ ID NO: 1050598 - RNA, 22 nt, Human
caaaugauagagccgauuauca

SEQ ID NO: 1050599 - RNA, 20 nt, Human
uuucaguugguuaauggcau

SEQ ID NO: 1050600 - RNA, 22 nt, Human
acaggacuguggaaggaucucu

SEQ ID NO: 1050601 - RNA, 20 nt, Human
gggcaguucaaugccacucu

SEQ ID NO: 1050602 - RNA, 22 nt, Human
gugcugaggauacagcugugaa

SEQ ID NO: 1050603 - RNA, 22 nt, Human
agugcuuuccuucuugugacau

SEQ ID NO: 1050604 - RNA, 22 nt, Human
ucuggagaagcagugagaguca

SEQ ID NO: 1050605 - RNA, 22 nt, Human
uuuuguuguaauauaccuaucc

SEQ ID NO: 1050606 - RNA, 22 nt, Human
uuggccaagacucauguccuau

SEQ ID NO: 1050607 - RNA, 22 nt, Human
agaaguuauccaccuuagaugc

SEQ ID NO: 1050608 - RNA, 22 nt, Human
cccagggaagggcuaccugagg

SEQ ID NO: 1050609 - RNA, 22 nt, Human
ucauucacuuugaaauaaacga

SEQ ID NO: 1050610 - RNA, 22 nt, Human
uugcagcugcaguaaauguuca

SEQ ID NO: 1050611 - RNA, 22 nt, Human
uucucaaagaaagcugucauua

SEQ ID NO: 1050612 - RNA, 22 nt, Human
guugaaagagcauggacuugaa

SEQ ID NO: 1050613 - RNA, 22 nt, Human
uauuucagcacaugggauaggu

SEQ ID NO: 1050614 - RNA, 22 nt, Human
cccaggagacagaaacagaggu

SEQ ID NO: 1050615 - RNA, 22 nt, Human
agucaauuaucucuaggucauc

SEQ ID NO: 1050616 - RNA, 22 nt, Human
auggccaaggggccuaggcagg

SEQ ID NO: 1050617 - RNA, 22 nt, Human
ggccugagucccaccuggcugu

SEQ ID NO: 1050618 - RNA, 22 nt, Human
cccaguuucaacuuuccagugg

SEQ ID NO: 1050619 - RNA, 22 nt, Human
agagugucugguagcugcucug

SEQ ID NO: 1050620 - RNA, 22 nt, Human
ccaugagacagcaacugaaagu

SEQ ID NO: 1050621 - RNA, 22 nt, Human
augaggucuuauugcaguaguu

SEQ ID NO: 1050622 - RNA, 22 nt, Human
ucugaacuccagcccugcucuc

SEQ ID NO: 1050623 - RNA, 22 nt, Human
uaggcagcuuagguuagaagug

SEQ ID NO: 1050624 - RNA, 22 nt, Human
cucaggauagauuguccucuca

SEQ ID NO: 1050625 - RNA, 22 nt, Human
cugagacuuucaugugcuuuua

SEQ ID NO: 1050626 - RNA, 22 nt, Human
aguaaguuccaguuucauuaug

SEQ ID NO: 1050627 - RNA, 22 nt, Human
uagaaauguugguauuaacauu

SEQ ID NO: 1050628 - RNA, 22 nt, Human
gaagcagcgaaguggaagggac

SEQ ID NO: 1050629 - RNA, 22 nt, Human
cugggccacaagccugugugau

SEQ ID NO: 1050630 - RNA, 22 nt, Human
ucacaagacugagcuugcuuga

SEQ ID NO: 1050631 - RNA, 22 nt, Human
ucuucagauggccaguuguccc

SEQ ID NO: 1050632 - RNA, 22 nt, Human
ccucaggaaccacauugcugcu

SEQ ID NO: 1050633 - RNA, 22 nt, Human
cagggcugucuccaaaggcccc

SEQ ID NO: 1050634 - RNA, 22 nt, Human
uuaugauuugccacagauuggu

SEQ ID NO: 1050635 - RNA, 22 nt, Human
cuucugccccuguagccugagu

SEQ ID NO: 1050636 - RNA, 22 nt, Human
gaggccaaguuggagaccaggu

SEQ ID NO: 1050637 - RNA, 20 nt, Human
cagaggcauuuucagacucu

SEQ ID NO: 1050638 - RNA, 22 nt, Human
auucugauaucuuauucuagcu

SEQ ID NO: 1050639 - RNA, 22 nt, Human
ugcugccuccuuccugccagga

SEQ ID NO: 1050640 - RNA, 22 nt, Human
gcuagaaaucgacuucagaauu

SEQ ID NO: 1050641 - RNA, 22 nt, Human
ucagagaguuggaaagaauuaa

SEQ ID NO: 1050642 - RNA, 22 nt, Human
uaauuauucuagucacauagca

SEQ ID NO: 1050643 - RNA, 22 nt, Human
auccaugauuaguaggauaaag

SEQ ID NO: 1050644 - RNA, 22 nt, Human
cagagccaggucuaggagucuc

SEQ ID NO: 1050645 - RNA, 22 nt, Human
aggcugaggcuggcagcuccag

SEQ ID NO: 1050646 - RNA, 20 nt, Human
cagaggcaaggagacuugga

SEQ ID NO: 1050647 - RNA, 22 nt, Human
caggaaugaggucguaaguguc

SEQ ID NO: 1050648 - RNA, 22 nt, Human
augcugugccuggaaagcggcu

SEQ ID NO: 1050649 - RNA, 22 nt, Human
accagagcagacuacuggaggu

SEQ ID NO: 1050650 - RNA, 22 nt, Human
cacagacccagaagggaugaag

SEQ ID NO: 1050651 - RNA, 22 nt, Human
acucaggagggaucagcuauca

SEQ ID NO: 1050652 - RNA, 22 nt, Human
ccccaccauguagaaacugaga

SEQ ID NO: 1050653 - RNA, 22 nt, Human
aggggcucaaagugugcaggga

SEQ ID NO: 1050654 - RNA, 22 nt, Human
gcagcugcaauaggcaucaagc

SEQ ID NO: 1050655 - RNA, 22 nt, Human
gccaggagagcuccuucagguu

SEQ ID NO: 1050656 - RNA, 20 nt, Human
uuccaacucacaucucuaca

SEQ ID NO: 1050657 - RNA, 22 nt, Human
agacagugauguaagcaggagu

SEQ ID NO: 1050658 - RNA, 22 nt, Human
uugaaauggaagugaaaauucu

SEQ ID NO: 1050659 - RNA, 22 nt, Human
agcugaggaauaauaacaaggu

SEQ ID NO: 1050660 - RNA, 22 nt, Human
ucuuugcaaauguuauuaucuu

SEQ ID NO: 1050661 - RNA, 22 nt, Human
gacagcugugcaggagaagggg

SEQ ID NO: 1050662 - RNA, 22 nt, Human
aucauucuaguccuuauggucu

SEQ ID NO: 1050663 - RNA, 22 nt, Human
aggaagcuuagugaaaggacca

SEQ ID NO: 1050664 - RNA, 22 nt, Human
ucuuagcacagcuauauaaguu

SEQ ID NO: 1050665 - RNA, 22 nt, Human
uccuggcccgaucccugugaag

SEQ ID NO: 1050666 - RNA, 22 nt, Human
uuuggaaagugugauuucaagg

SEQ ID NO: 1050667 - RNA, 22 nt, Human
uacauacauguauguguguauu

SEQ ID NO: 1050668 - RNA, 20 nt, Human
gcugagguggaggaaggaga

SEQ ID NO: 1050669 - RNA, 22 nt, Human
ugcuuugggucucucuaguuuc

SEQ ID NO: 1050670 - RNA, 22 nt, Human
ugaggcccaucugagauuuuga

SEQ ID NO: 1050671 - RNA, 22 nt, Human
uucuuaacuggaaaaugucaga

SEQ ID NO: 1050672 - RNA, 22 nt, Human
cagugcugagagccuggccagg

SEQ ID NO: 1050673 - RNA, 22 nt, Human
ucccagggcuuuucucaugcuu

SEQ ID NO: 1050674 - RNA, 22 nt, Human
ucacacagauugguagagcuga

SEQ ID NO: 1050675 - RNA, 22 nt, Human
cugucauugagccugucagggc

SEQ ID NO: 1050676 - RNA, 22 nt, Human
uuaggaaagucucuuggcuggg

SEQ ID NO: 1050677 - RNA, 22 nt, Human
gagacagugguugcagaagcuc

SEQ ID NO: 1050678 - RNA, 22 nt, Human
aguccaaggagagacagcauuu

SEQ ID NO: 1050679 - RNA, 22 nt, Human
cccucccugugugccucauuug

SEQ ID NO: 1050680 - RNA, 22 nt, Human
agcugccgaugcccagcugcau

SEQ ID NO: 1050681 - RNA, 22 nt, Human
ucuuuuggaaaugaugugcagg

SEQ ID NO: 1050682 - RNA, 22 nt, Human
ucuggccaggauggcaagacca

SEQ ID NO: 1050683 - RNA, 22 nt, Human
caggcugagcucuggccugggc

SEQ ID NO: 1050684 - RNA, 22 nt, Human
cagcuuccauaagagauggaga

SEQ ID NO: 1050685 - RNA, 22 nt, Human
uggcagcuccuggggccagcac

SEQ ID NO: 1050686 - RNA, 22 nt, Human
ggcaugcugcguacagaugaac

SEQ ID NO: 1050687 - RNA, 22 nt, Human
agugcagcaugcuggggaggcu

SEQ ID NO: 1050688 - RNA, 22 nt, Human
ugugcucuggaguugccuucac

SEQ ID NO: 1050689 - RNA, 17 nt, Human
guguaacuaugagccau

SEQ ID NO: 1050690 - RNA, 22 nt, Human
uccuggccucacaguccugggu

SEQ ID NO: 1050691 - RNA, 22 nt, Human
aaggcagcucagcucauggcag

SEQ ID NO: 1050692 - RNA, 20 nt, Human
ucccucccuccagcucuggg

SEQ ID NO: 1050693 - RNA, 22 nt, Human
gcuugaaaauucauagguauuu

SEQ ID NO: 1050694 - RNA, 22 nt, Human
agucucugcaugccugcugugc

SEQ ID NO: 1050695 - RNA, 22 nt, Human
uuucuaggcacagugucuuccc

SEQ ID NO: 1050696 - RNA, 22 nt, Human
uucucagaugauucagauaaac

SEQ ID NO: 1050697 - RNA, 22 nt, Human
auaaggaaaugaaacucuaaua

SEQ ID NO: 1050698 - RNA, 22 nt, Human
gaaauauugggacucagagcuu

SEQ ID NO: 1050699 - RNA, 22 nt, Human
ggcugaguggcugggucuaguu

SEQ ID NO: 1050700 - RNA, 22 nt, Human
acaggcugauagaccauaaaua

SEQ ID NO: 1050701 - RNA, 20 nt, Human
guauuaggagguaaauguaa

SEQ ID NO: 1050702 - RNA, 22 nt, Human
cugguacaguguuacaaaaugg

SEQ ID NO: 1050703 - RNA, 22 nt, Human
uuuucaguaaugucuacauaau

SEQ ID NO: 1050704 - RNA, 22 nt, Human
uuggccaaauaaucuugcagau

SEQ ID NO: 1050705 - RNA, 22 nt, Human
uuuauauagagauuugugcaug

SEQ ID NO: 1050706 - RNA, 22 nt, Human
gcacugguaucaccugagagcu

SEQ ID NO: 1050707 - RNA, 22 nt, Human
ccuugcguuuuacagcuucuag

SEQ ID NO: 1050708 - RNA, 22 nt, Human
ugcuagaauuugcagaagcaua

SEQ ID NO: 1050709 - RNA, 22 nt, Human
cugcuguguggauucaauggcu

SEQ ID NO: 1050710 - RNA, 22 nt, Human
uacauacagagaugcuaguuaa

SEQ ID NO: 1050711 - RNA, 20 nt, Human
aacuuucucccauuggacug

SEQ ID NO: 1050712 - RNA, 22 nt, Human
auuuucaaaacaucugcugugu

SEQ ID NO: 1050713 - RNA, 23 nt, Human
cccauuuucauguuaacuccugg

SEQ ID NO: 1050714 - RNA, 22 nt, Human
aucugccuccaaguccaugugu

SEQ ID NO: 1050715 - RNA, 22 nt, Human
aucugccucuucuucauugcga

SEQ ID NO: 1050716 - RNA, 22 nt, Human
caguucuuauuuggccaguguc

SEQ ID NO: 1050717 - RNA, 22 nt, Human
agaacuguccuuggaggagagu

SEQ ID NO: 1050718 - RNA, 19 nt, Human
cuugcugggugguuucugc

SEQ ID NO: 1050719 - RNA, 22 nt, Human
accuuuuauguaaauauauguu

SEQ ID NO: 1050720 - RNA, 22 nt, Human
ucauuuguacuugugugcuugu

SEQ ID NO: 1050721 - RNA, 22 nt, Human
agaaguuaccacauacuucucu

SEQ ID NO: 1050722 - RNA, 22 nt, Human
uccaugaggcagggaggcuggc

SEQ ID NO: 1050723 - RNA, 22 nt, Human
gccaggagcaugucauuguuga

SEQ ID NO: 1050724 - RNA, 22 nt, Human
ggucagccuuggauuugguagc

SEQ ID NO: 1050725 - RNA, 22 nt, Human
ugaaaugaaacagaacauauca

SEQ ID NO: 1050726 - RNA, 22 nt, Human
uagcagaggcaaggaugugaau

SEQ ID NO: 1050727 - RNA, 22 nt, Human
aaagaguuggacuuucucaggc

SEQ ID NO: 1050728 - RNA, 22 nt, Human
aggcuaagggaugacuggagug

SEQ ID NO: 1050729 - RNA, 22 nt, Human
ggaaaugacuuggugcuucguu

SEQ ID NO: 1050730 - RNA, 22 nt, Human
uaggauaugguagaaaucauuc

SEQ ID NO: 1050731 - RNA, 22 nt, Human
uuucucugcugccugugucgau

SEQ ID NO: 1050732 - RNA, 22 nt, Human
ccaggagaugggagcaucuaaa

SEQ ID NO: 1050733 - RNA, 22 nt, Human
uguccucagauaugucuacucu

SEQ ID NO: 1050734 - RNA, 20 nt, Human
uacagaaugcaauaaaaugg

SEQ ID NO: 1050735 - RNA, 22 nt, Human
cagauccacccuuguagugaca

SEQ ID NO: 1050736 - RNA, 22 nt, Human
ggacagguucagcaguuuauaa

SEQ ID NO: 1050737 - RNA, 22 nt, Human
caacaauaugccagacucaauu

SEQ ID NO: 1050738 - RNA, 22 nt, Human
cucaguuuugcuagcuggaguu

SEQ ID NO: 1050739 - RNA, 22 nt, Human
gagcugagaagcagcgcuugau

SEQ ID NO: 1050740 - RNA, 22 nt, Human
ggcagcuuccuaggagagggca

SEQ ID NO: 1050741 - RNA, 21 nt, Human
ucuccuggguccaacccaugc

SEQ ID NO: 1050742 - RNA, 22 nt, Human
cagcuagcuaagaaggccagag

SEQ ID NO: 1050743 - RNA, 22 nt, Human
ccacaguccgggcuggcaggac

SEQ ID NO: 1050744 - RNA, 22 nt, Human
ccacaguacaggaaaucuuguu

SEQ ID NO: 1050745 - RNA, 22 nt, Human
caagauggagaagcagcaaggg

SEQ ID NO: 1050746 - RNA, 22 nt, Human
acaaauauuuacugaauccacu

SEQ ID NO: 1050747 - RNA, 22 nt, Human
ccaggagaaugggauuacccua

SEQ ID NO: 1050748 - RNA, 22 nt, Human
agaccaugggcucugaagagca

SEQ ID NO: 1050749 - RNA, 22 nt, Human
uuuggaauauuaaaaugucuca

SEQ ID NO: 1050750 - RNA, 22 nt, Human
gucccauaaguagugcaacuug

SEQ ID NO: 1050751 - RNA, 22 nt, Human
auacacuuguacauuuuuuaau

SEQ ID NO: 1050752 - RNA, 22 nt, Human
gaagcagcugccagagaugucu

SEQ ID NO: 1050753 - RNA, 22 nt, Human
gaggcaucugggcacagaagug

SEQ ID NO: 1050754 - RNA, 22 nt, Human
aacacuuucuuccuugcucagg

SEQ ID NO: 1050755 - RNA, 20 nt, Human
uucuucucuaguuaucuuca

SEQ ID NO: 1050756 - RNA, 22 nt, Human
acuuaaaaagaaucuuuucacg

SEQ ID NO: 1050757 - RNA, 20 nt, Human
ucuccuggugacaguaccca

SEQ ID NO: 1050758 - RNA, 18 nt, Human
guauuaguuuucagagag

SEQ ID NO: 1050759 - RNA, 21 nt, Human
uugaaaguaaauucagcagcu

SEQ ID NO: 1050760 - RNA, 22 nt, Human
caacuauagaucaaaugaguuu

SEQ ID NO: 1050761 - RNA, 22 nt, Human
ccagaagaccccguccaccucc

SEQ ID NO: 1050762 - RNA, 22 nt, Human
cagcugccuucugcgggaaguc

SEQ ID NO: 1050763 - RNA, 22 nt, Human
uuuaaauucugucugccgcuua

SEQ ID NO: 1050764 - RNA, 22 nt, Human
acugcuuuaucugagaaguccu

SEQ ID NO: 1050765 - RNA, 22 nt, Human
ccuucuucuguguggcccaaga

SEQ ID NO: 1050766 - RNA, 22 nt, Human
cugguacaaaaugcugauauca

SEQ ID NO: 1050767 - RNA, 20 nt, Human
agggugagacaugagccucc

SEQ ID NO: 1050768 - RNA, 22 nt, Human
acuuuacuacauccacagaugg

SEQ ID NO: 1050769 - RNA, 22 nt, Human
uagaaaugauugguugagcucu

SEQ ID NO: 1050770 - RNA, 22 nt, Human
auaauauuugcauuacugugau

SEQ ID NO: 1050771 - RNA, 22 nt, Human
cuucucaguugcaagugucaga

SEQ ID NO: 1050772 - RNA, 22 nt, Human
caauacacuaaacuucucugaa

SEQ ID NO: 1050773 - RNA, 22 nt, Human
aggcagcuuuguaguaaagcua

SEQ ID NO: 1050774 - RNA, 22 nt, Human
cuugaaagucagcagaguggau

SEQ ID NO: 1050775 - RNA, 22 nt, Human
ucuuuccauggccacacagucu

SEQ ID NO: 1050776 - RNA, 22 nt, Human
ugucucugaggugagggucagc

SEQ ID NO: 1050777 - RNA, 22 nt, Human
gcuccuggcuucacugacauca

SEQ ID NO: 1050778 - RNA, 22 nt, Human
agggauggaagacuugaagacc

SEQ ID NO: 1050779 - RNA, 22 nt, Human
accucagauuguggcuccgcug

SEQ ID NO: 1050780 - RNA, 22 nt, Human
gcucaguuauccgugugugacu

SEQ ID NO: 1050781 - RNA, 22 nt, Human
uaggauaugugaaaucauauua

SEQ ID NO: 1050782 - RNA, 22 nt, Human
uuuaacagaugcuaugucuacc

SEQ ID NO: 1050783 - RNA, 22 nt, Human
cuucuucaucuguaaaacuugg

SEQ ID NO: 1050784 - RNA, 18 nt, Human
gagaggagccagaauuuu

SEQ ID NO: 1050785 - RNA, 22 nt, Human
agaggcagccguauuucaaagg

SEQ ID NO: 1050786 - RNA, 22 nt, Human
caacauuucaaggucuuuagga

SEQ ID NO: 1050787 - RNA, 22 nt, Human
ccuggugggcaggagugagacc

SEQ ID NO: 1050788 - RNA, 22 nt, Human
agaggaggaagagcuuuaaaau

SEQ ID NO: 1050789 - RNA, 22 nt, Human
auacaucuuccuuuuaaaaugc

SEQ ID NO: 1050790 - RNA, 22 nt, Human
cuguaugaggaucagacuggac

SEQ ID NO: 1050791 - RNA, 22 nt, Human
gcuuuggaugugugccugaggu

SEQ ID NO: 1050792 - RNA, 22 nt, Human
gcccaggaaauaaaagugggcu

SEQ ID NO: 1050793 - RNA, 22 nt, Human
uagcacaucuucuuggccugca

SEQ ID NO: 1050794 - RNA, 21 nt, Human
uccuggcccacucuaucccca

SEQ ID NO: 1050795 - RNA, 22 nt, Human
acccagagaacugugccuugag

SEQ ID NO: 1050796 - RNA, 22 nt, Human
ugccuggaaggcccaugggaag

SEQ ID NO: 1050797 - RNA, 22 nt, Human
uuggccaaccagaacggagguc

SEQ ID NO: 1050798 - RNA, 22 nt, Human
cagcugaguggacccuagaggc

SEQ ID NO: 1050799 - RNA, 22 nt, Human
uggcagcagaacaugaaaccca

SEQ ID NO: 1050800 - RNA, 22 nt, Human
aaagaaguguugaauuugcaag

SEQ ID NO: 1050801 - RNA, 22 nt, Human
aggcagcuggacauaacuaacc

SEQ ID NO: 1050802 - RNA, 22 nt, Human
gggcagcuggccagguauucug

SEQ ID NO: 1050803 - RNA, 22 nt, Human
cuggcuuucucugugguguuca

SEQ ID NO: 1050804 - RNA, 22 nt, Human
agaggaugauuuuaaggacacu

SEQ ID NO: 1050805 - RNA, 22 nt, Human
ucauuucccuccuacaaagagg

SEQ ID NO: 1050806 - RNA, 20 nt, Human
ugaggcucagagagguugag

SEQ ID NO: 1050807 - RNA, 22 nt, Human
cagguugggcugcgaggaggag

SEQ ID NO: 1050808 - RNA, 19 nt, Human
uuucccagcccuugcugug

SEQ ID NO: 1050809 - RNA, 22 nt, Human
gggcagcuggcuuauagguuug

SEQ ID NO: 1050810 - RNA, 22 nt, Human
aggcagacaaggucccuggucu

SEQ ID NO: 1050811 - RNA, 22 nt, Human
aaggcagccucugccagccggg

SEQ ID NO: 1050812 - RNA, 22 nt, Human
uuacacuucugaaagccuaggu

SEQ ID NO: 1050813 - RNA, 22 nt, Human
aacauucugguucuaaaaaccu

SEQ ID NO: 1050814 - RNA, 19 nt, Human
agggaguuuauauuugcac

SEQ ID NO: 1050815 - RNA, 22 nt, Human
ugaauaguccuuggaauaacug

SEQ ID NO: 1050816 - RNA, 19 nt, Human
acacuguagauauagcuau

SEQ ID NO: 1050817 - RNA, 22 nt, Human
aacaacugaaaagcuuuuucug

SEQ ID NO: 1050818 - RNA, 22 nt, Human
gcuaugcaggagccuaaugaca

SEQ ID NO: 1050819 - RNA, 22 nt, Human
cuucagagugcagaagauuggg

SEQ ID NO: 1050820 - RNA, 22 nt, Human
ggcagcauuuagagcacagugu

SEQ ID NO: 1050821 - RNA, 22 nt, Human
ggaggggaacuaaucccgugac

SEQ ID NO: 1050822 - RNA, 22 nt, Human
aggcuccacccuacagagcucc

SEQ ID NO: 1050823 - RNA, 23 nt, Human
uggaaagcggaccuggggcagag

SEQ ID NO: 1050824 - RNA, 22 nt, Human
uuuuaugugcuggacuggcagu

SEQ ID NO: 1050825 - RNA, 22 nt, Human
guuaaauaaccucauguccguu

SEQ ID NO: 1050826 - RNA, 22 nt, Human
ugaggcaggaugcuugcacagg

SEQ ID NO: 1050827 - RNA, 18 nt, Human
gagcugagaagaggaugc

SEQ ID NO: 1050828 - RNA, 22 nt, Human
ggacaguagucacuaaacuaga

SEQ ID NO: 1050829 - RNA, 23 nt, Human
ugcuggcugaaacagccaaagga

SEQ ID NO: 1050830 - RNA, 22 nt, Human
augugucuuugagacucugcua

SEQ ID NO: 1050831 - RNA, 22 nt, Human
ucaugcuuaaaagacacuugag

SEQ ID NO: 1050832 - RNA, 21 nt, Human
agaggcaggcauuaaguacac

SEQ ID NO: 1050833 - RNA, 22 nt, Human
ccaggagacaaagaugacugcu

SEQ ID NO: 1050834 - RNA, 22 nt, Human
uuuaguagaugcagcauuauuu

SEQ ID NO: 1050835 - RNA, 22 nt, Human
aggaggggcaaugauagucugg

SEQ ID NO: 1050836 - RNA, 22 nt, Human
gcagcugagcgugaggaagagu

SEQ ID NO: 1050837 - RNA, 22 nt, Human
uggcugagaaaaugguuuuagg

SEQ ID NO: 1050838 - RNA, 22 nt, Human
agcuccugaaaauccagacugg

SEQ ID NO: 1050839 - RNA, 22 nt, Human
cugaggcugggcauggggucca

SEQ ID NO: 1050840 - RNA, 22 nt, Human
aggcagcuggcaaauucuagag

SEQ ID NO: 1050841 - RNA, 22 nt, Human
ucuccugggugcuuuaucagaa

SEQ ID NO: 1050842 - RNA, 22 nt, Human
uagaagaacaugucaaacuaua

SEQ ID NO: 1050843 - RNA, 22 nt, Human
cuaaauuaucaugagaauuaug

SEQ ID NO: 1050844 - RNA, 22 nt, Human
auauucuuccaaaacaucauuu

SEQ ID NO: 1050845 - RNA, 22 nt, Human
ggcaacauucuccagauccuuu

SEQ ID NO: 1050846 - RNA, 22 nt, Human
uuuauuagauuaucaaagaggu

SEQ ID NO: 1050847 - RNA, 21 nt, Human
agagagggagaugaaacaucc

SEQ ID NO: 1050848 - RNA, 22 nt, Human
ucauuucuauugcuacugucug

SEQ ID NO: 1050849 - RNA, 22 nt, Human
uggugguuaugcgcuuuguggg

SEQ ID NO: 1050850 - RNA, 22 nt, Human
ucugaggucauaaagcaacuuu

SEQ ID NO: 1050851 - RNA, 16 nt, Human
aggccaaaaaggggca

SEQ ID NO: 1050852 - RNA, 22 nt, Human
cacuccuguuccacuaaaugag

SEQ ID NO: 1050853 - RNA, 22 nt, Human
uaacugguagauuuuaaaucgg

SEQ ID NO: 1050854 - RNA, 22 nt, Human
ucacaguuauagucuguagaau

SEQ ID NO: 1050855 - RNA, 22 nt, Human
ggcugaggggcccagaggaaca

SEQ ID NO: 1050856 - RNA, 22 nt, Human
ugaggcaggagaaucacaugaa

SEQ ID NO: 1050857 - RNA, 18 nt, Human
aaacuggcuuggccugug

SEQ ID NO: 1050858 - RNA, 22 nt, Human
uccaggaggcaccuuuggacca

SEQ ID NO: 1050859 - RNA, 22 nt, Human
cuggccagcugacagcagggcu

SEQ ID NO: 1050860 - RNA, 22 nt, Human
gaauacauuggaaaucagaaua

SEQ ID NO: 1050861 - RNA, 22 nt, Human
uauuugcaacauaaaacucuga

SEQ ID NO: 1050862 - RNA, 22 nt, Human
cccuuccuggaguacccucugu

SEQ ID NO: 1050863 - RNA, 22 nt, Human
auggccaugccaguuuacagcc

SEQ ID NO: 1050864 - RNA, 22 nt, Human
uccuggccagaggacaaagcug

SEQ ID NO: 1050865 - RNA, 23 nt, Human
aucauucuccaaucuggagcagg

SEQ ID NO: 1050866 - RNA, 20 nt, Human
ugcugcugccuccgccucug

SEQ ID NO: 1050867 - RNA, 22 nt, Human
uucucugaaggccaugcucacu

SEQ ID NO: 1050868 - RNA, 22 nt, Human
uuguuugaggucacugauauuu

SEQ ID NO: 1050869 - RNA, 22 nt, Human
guucuucaucauuaacacucug

SEQ ID NO: 1050870 - RNA, 22 nt, Human
cuucaguguugccagggccuag

SEQ ID NO: 1050871 - RNA, 22 nt, Human
ucaguagcagaaagcaaugagu

SEQ ID NO: 1050872 - RNA, 22 nt, Human
ucuacccagagcuaugaccuga

SEQ ID NO: 1050873 - RNA, 22 nt, Human
uccuggccaaguuacucucugc

SEQ ID NO: 1050874 - RNA, 22 nt, Human
gcccugaggcaaaagaacaguc

SEQ ID NO: 1050875 - RNA, 21 nt, Human
ccaggcuggccaugguauuga

SEQ ID NO: 1050876 - RNA, 22 nt, Human
caaggccauaagagauacaaaa

SEQ ID NO: 1050877 - RNA, 22 nt, Human
cuucuucacacuggucugaagc

SEQ ID NO: 1050878 - RNA, 19 nt, Human
uucacaauuaugaaauuag

SEQ ID NO: 1050879 - RNA, 22 nt, Human
gcugagguggaggaaggagacc

SEQ ID NO: 1050880 - RNA, 22 nt, Human
gaggaaccaaaucagcuugcac

SEQ ID NO: 1050881 - RNA, 22 nt, Human
gcugagacuggcagcaggaagu

SEQ ID NO: 1050882 - RNA, 22 nt, Human
ucccagaggaaauggcagcuga

SEQ ID NO: 1050883 - RNA, 22 nt, Human
uuuccagagcaugucugcucag

SEQ ID NO: 1050884 - RNA, 22 nt, Human
gcccaggacucagggugucgcg

SEQ ID NO: 1050885 - RNA, 22 nt, Human
guuuauaaggcccaauauuucu

SEQ ID NO: 1050886 - RNA, 22 nt, Human
uugaggucuuugagcaaacgca

SEQ ID NO: 1050887 - RNA, 22 nt, Human
ugaauuagcaguagacagacug

SEQ ID NO: 1050888 - RNA, 22 nt, Human
uuccuuaguguuagauucugug

SEQ ID NO: 1050889 - RNA, 22 nt, Human
ggggcagcucccgagggcagga

SEQ ID NO: 1050890 - RNA, 22 nt, Human
agccagcugugggcucaggcgg

SEQ ID NO: 1050891 - RNA, 22 nt, Human
cugaggcucaagggcagguggg

SEQ ID NO: 1050892 - RNA, 22 nt, Human
uggcuggagucuggugcuagcc

SEQ ID NO: 1050893 - RNA, 22 nt, Human
gaucuguuucauucacagucug

SEQ ID NO: 1050894 - RNA, 20 nt, Human
gaggcugaaguguuuuugcu

SEQ ID NO: 1050895 - RNA, 21 nt, Human
uuauugagacauuuguggaaa

SEQ ID NO: 1050896 - RNA, 22 nt, Human
uucuucaacaaggacacuguua

SEQ ID NO: 1050897 - RNA, 22 nt, Human
gagaggaguuacuauuuccgag

SEQ ID NO: 1050898 - RNA, 22 nt, Human
agacagugcaagaagagcaggc

SEQ ID NO: 1050899 - RNA, 22 nt, Human
guguuuuaagaaagaagcucag

SEQ ID NO: 1050900 - RNA, 22 nt, Human
uuaaauauuauguugucugcaa

SEQ ID NO: 1050901 - RNA, 22 nt, Human
gcccaggaucugcucagaucau

SEQ ID NO: 1050902 - RNA, 22 nt, Human
gggcugaguuccugccucacuc

SEQ ID NO: 1050903 - RNA, 22 nt, Human
caccucuuugauuugaggcaag

SEQ ID NO: 1050904 - RNA, 22 nt, Human
uguccacaucacucacuuguca

SEQ ID NO: 1050905 - RNA, 22 nt, Human
acagaacugcaggaggaaaagc

SEQ ID NO: 1050906 - RNA, 22 nt, Human
uuucaguguaucuuccaaaagc

SEQ ID NO: 1050907 - RNA, 22 nt, Human
aagugcugggauuacagguguc

SEQ ID NO: 1050908 - RNA, 22 nt, Human
uaauuauuugaagacauuagag

SEQ ID NO: 1050909 - RNA, 22 nt, Human
ugaugaaauguugaggcaguga

SEQ ID NO: 1050910 - RNA, 22 nt, Human
cugcuguguaucauuuuagaug

SEQ ID NO: 1050911 - RNA, 22 nt, Human
gggcugagagcuggaaucugag

SEQ ID NO: 1050912 - RNA, 22 nt, Human
uagugcuuuaaguuuacagaga

SEQ ID NO: 1050913 - RNA, 22 nt, Human
ggagcugugcagugacuacaga

SEQ ID NO: 1050914 - RNA, 22 nt, Human
agugacagggaaaaugacacug

SEQ ID NO: 1050915 - RNA, 22 nt, Human
aggccagcaagaaagagagucu

SEQ ID NO: 1050916 - RNA, 22 nt, Human
aacugguaucucuucaguguaa

SEQ ID NO: 1050917 - RNA, 22 nt, Human
caaaugaaaauggcgucuugga

SEQ ID NO: 1050918 - RNA, 22 nt, Human
guagggagcccagagcccagug

SEQ ID NO: 1050919 - RNA, 21 nt, Human
gcugcaucaaucuacccaggg

SEQ ID NO: 1050920 - RNA, 22 nt, Human
cagcaagacaggauucccgugg

SEQ ID NO: 1050921 - RNA, 22 nt, Human
aggccaaagcacagagcuggaa

SEQ ID NO: 1050922 - RNA, 22 nt, Human
ccaggagauaagcugaguuuau

SEQ ID NO: 1050923 - RNA, 21 nt, Human
cacucaggguaugugccaggc

SEQ ID NO: 1050924 - RNA, 22 nt, Human
cuuuccaaugcauuuccaaugu

SEQ ID NO: 1050925 - RNA, 22 nt, Human
gcccaggaaaugccccguggug

SEQ ID NO: 1050926 - RNA, 22 nt, Human
ggcugagccacugcgccuggcu

SEQ ID NO: 1050927 - RNA, 22 nt, Human
uuuccaagagcuuauuucugaa

SEQ ID NO: 1050928 - RNA, 22 nt, Human
cugagcgcgggaccugaggcug

SEQ ID NO: 1050929 - RNA, 22 nt, Human
cuccuuggccguuaaugucaca

SEQ ID NO: 1050930 - RNA, 22 nt, Human
ggcugucucugugacugccacc

SEQ ID NO: 1050931 - RNA, 22 nt, Human
cagaacugggcucgcucugguu

SEQ ID NO: 1050932 - RNA, 22 nt, Human
auggccaaaucuaaacuguugg

SEQ ID NO: 1050933 - RNA, 22 nt, Human
uggcuucuagcaguguugauuu

SEQ ID NO: 1050934 - RNA, 22 nt, Human
ucagaaaauaacuguuaguuug

SEQ ID NO: 1050935 - RNA, 22 nt, Human
guuuuucuuugugugaagacaa

SEQ ID NO: 1050936 - RNA, 22 nt, Human
ugcccaggauugugaggucagg

SEQ ID NO: 1050937 - RNA, 22 nt, Human
cagagcugcagauugaaggcau

SEQ ID NO: 1050938 - RNA, 22 nt, Human
ucuccuggccgggcuguccccu

SEQ ID NO: 1050939 - RNA, 22 nt, Human
uaggaaauugccaauauaugac

SEQ ID NO: 1050940 - RNA, 22 nt, Human
uuuggaauuggcauucuauucu

SEQ ID NO: 1050941 - RNA, 22 nt, Human
aucaggaucagggcuagcagag

SEQ ID NO: 1050942 - RNA, 22 nt, Human
agucacuguucugucaugucaa

SEQ ID NO: 1050943 - RNA, 22 nt, Human
augcugugguagacagcauucc

SEQ ID NO: 1050944 - RNA, 22 nt, Human
acaggcugggcgcuuccugcgg

SEQ ID NO: 1050945 - RNA, 22 nt, Human
gccaccagggggugcaaggucc

SEQ ID NO: 1050946 - RNA, 22 nt, Human
agauggagaccuuggaugaacu

SEQ ID NO: 1050947 - RNA, 22 nt, Human
augaggucacaguguuuggcau

SEQ ID NO: 1050948 - RNA, 22 nt, Human
ucuuuuggguucuuaugauuua

SEQ ID NO: 1050949 - RNA, 22 nt, Human
aaaauauuuuagggccaggaga

SEQ ID NO: 1050950 - RNA, 22 nt, Human
caggagagcccggguccgggcu

SEQ ID NO: 1050951 - RNA, 22 nt, Human
gcugccucaggcaccuccuggc

SEQ ID NO: 1050952 - RNA, 22 nt, Human
gagcugagcagggagccucacu

SEQ ID NO: 1050953 - RNA, 21 nt, Human
gauuugcagaaacuagacagg

SEQ ID NO: 1050954 - RNA, 22 nt, Human
acaauucugaugguuucccagu

SEQ ID NO: 1050955 - RNA, 22 nt, Human
gaggaggcuuccgggaggcacg

SEQ ID NO: 1050956 - RNA, 22 nt, Human
ggucugaguggugcugacucag

SEQ ID NO: 1050957 - RNA, 22 nt, Human
ucagaaaagaccacauuauucu

SEQ ID NO: 1050958 - RNA, 22 nt, Human
uaacuguauuuuucugagauuc

SEQ ID NO: 1050959 - RNA, 21 nt, Human
acagucuccccagaucucucc

SEQ ID NO: 1050960 - RNA, 22 nt, Human
auugugcaaauauuaucuguag

SEQ ID NO: 1050961 - RNA, 22 nt, Human
uuuggaaugguaccuucaguug

SEQ ID NO: 1050962 - RNA, 22 nt, Human
ccuggcuggauggagccccugg

SEQ ID NO: 1050963 - RNA, 22 nt, Human
ucugagguugaacuuugcaaag

SEQ ID NO: 1050964 - RNA, 20 nt, Human
augugagggguugaaguggg

SEQ ID NO: 1050965 - RNA, 22 nt, Human
aaacauuugcaacucgguuugg

SEQ ID NO: 1050966 - RNA, 22 nt, Human
ccugaggucuagagucagggug

SEQ ID NO: 1050967 - RNA, 22 nt, Human
auucaaauuaaguuaauucagc

SEQ ID NO: 1050968 - RNA, 22 nt, Human
ucuggcuuucauuuguuuaaag

SEQ ID NO: 1050969 - RNA, 22 nt, Human
gcaugucaugucauguaggaau

SEQ ID NO: 1050970 - RNA, 22 nt, Human
aggguggcaccuggaagggaug

SEQ ID NO: 1050971 - RNA, 22 nt, Human
guucuucagaggggaaagaacc

SEQ ID NO: 1050972 - RNA, 22 nt, Human
aaggagaaaugguagaugugca

SEQ ID NO: 1050973 - RNA, 22 nt, Human
ucaggagagagaaauuggggcu

SEQ ID NO: 1050974 - RNA, 22 nt, Human
acuguaacacucauacugaagu

SEQ ID NO: 1050975 - RNA, 22 nt, Human
ugccugucuuggaguccuggcc

SEQ ID NO: 1050976 - RNA, 22 nt, Human
aaucuauaugcuuuucacauac

SEQ ID NO: 1050977 - RNA, 22 nt, Human
uuagagaaaggguuugauuccg

SEQ ID NO: 1050978 - RNA, 22 nt, Human
caaggccauauugccuguaugu

SEQ ID NO: 1050979 - RNA, 22 nt, Human
aagcuggagaguuaggugaaua

SEQ ID NO: 1050980 - RNA, 22 nt, Human
gaagcagcaaguauaggacagg

SEQ ID NO: 1050981 - RNA, 22 nt, Human
acccaggaggugacacagggcu

SEQ ID NO: 1050982 - RNA, 22 nt, Human
uaaggccaaguucauauacaac

SEQ ID NO: 1050983 - RNA, 20 nt, Human
aggcugagggugauuguguc

SEQ ID NO: 1050984 - RNA, 22 nt, Human
gacacuuucucagguaaagcau

SEQ ID NO: 1050985 - RNA, 22 nt, Human
auuuucagagacaucuggacuu

SEQ ID NO: 1050986 - RNA, 19 nt, Human
uggucuaaaugugugcccc

SEQ ID NO: 1050987 - RNA, 22 nt, Human
auguuauuaaaguacagauucu

SEQ ID NO: 1050988 - RNA, 17 nt, Human
uuucuccuuccaucuca

SEQ ID NO: 1050989 - RNA, 22 nt, Human
ucuucagagugaaagucuguga

SEQ ID NO: 1050990 - RNA, 22 nt, Human
auuaaauuggacgcugggggaa

SEQ ID NO: 1050991 - RNA, 22 nt, Human
uuccaagaguaaauucaaauug

SEQ ID NO: 1050992 - RNA, 22 nt, Human
acaguuaucuuugaaauagaga

SEQ ID NO: 1050993 - RNA, 22 nt, Human
agguccacaguucagcugccca

SEQ ID NO: 1050994 - RNA, 22 nt, Human
uugcauuugacaaauuauuuaa

SEQ ID NO: 1050995 - RNA, 22 nt, Human
gagagaaaugugcaguuugggc

SEQ ID NO: 1050996 - RNA, 22 nt, Human
auugaaagaguuuucugcugca

SEQ ID NO: 1050997 - RNA, 22 nt, Human
ucuuggcuauccaaguuaucca

SEQ ID NO: 1050998 - RNA, 21 nt, Human
uagggcaggcauuggaagaga

SEQ ID NO: 1050999 - RNA, 21 nt, Human
ccugcugugaucuuagugagu

SEQ ID NO: 1051000 - RNA, 22 nt, Human
caaauguaaauucuuuugaagc

SEQ ID NO: 1051001 - RNA, 22 nt, Human
cagcaggaccauugaggcauca

SEQ ID NO: 1051002 - RNA, 22 nt, Human
ucuuggcuucuguauuuccugu

SEQ ID NO: 1051003 - RNA, 22 nt, Human
aauuauacaugaaggcauuaua

SEQ ID NO: 1051004 - RNA, 22 nt, Human
cucaggaugcaauuccaucaag

SEQ ID NO: 1051005 - RNA, 22 nt, Human
uucugggagagaaagggccuug

SEQ ID NO: 1051006 - RNA, 22 nt, Human
ucacaugaguauuauuuuccaa

SEQ ID NO: 1051007 - RNA, 22 nt, Human
uuauucaggcucucuuuggcua

SEQ ID NO: 1051008 - RNA, 22 nt, Human
aauaccaccucauucuggaggc

SEQ ID NO: 1051009 - RNA, 22 nt, Human
uaaggaaaauggacaucaaaca

SEQ ID NO: 1051010 - RNA, 22 nt, Human
uagcaagaugaugaauuauuca

SEQ ID NO: 1051011 - RNA, 22 nt, Human
gagagggagccagccaggaacc

SEQ ID NO: 1051012 - RNA, 22 nt, Human
uuuccuaggagauugaucacau

SEQ ID NO: 1051013 - RNA, 22 nt, Human
gcuggccauagaagccaaagag

SEQ ID NO: 1051014 - RNA, 22 nt, Human
aggcugagugcuccccuagaug

SEQ ID NO: 1051015 - RNA, 22 nt, Human
caugcaggcccgccugaauggg

SEQ ID NO: 1051016 - RNA, 22 nt, Human
ggagagugggagcaacuguugc

SEQ ID NO: 1051017 - RNA, 20 nt, Human
uuucugugcccaggucuguu

SEQ ID NO: 1051018 - RNA, 21 nt, Human
uggcugaguggaugcaugaau

SEQ ID NO: 1051019 - RNA, 19 nt, Human
gugucaggaugugcagggg

SEQ ID NO: 1051020 - RNA, 23 nt, Human
uuggcagcgggucaggcuguggg

SEQ ID NO: 1051021 - RNA, 22 nt, Human
ccacuguuuuucaguuaacuuu

SEQ ID NO: 1051022 - RNA, 22 nt, Human
aacucuggagcacgcccuggcc

SEQ ID NO: 1051023 - RNA, 22 nt, Human
cccuggaggcuggaggcaguag

SEQ ID NO: 1051024 - RNA, 22 nt, Human
ugccugugguuccaguuuuuuc

SEQ ID NO: 1051025 - RNA, 22 nt, Human
cauuaaaauaucucaugguguu

SEQ ID NO: 1051026 - RNA, 22 nt, Human
agaccauagggaccucagguug

SEQ ID NO: 1051027 - RNA, 18 nt, Human
guaggucaguaccaagca

SEQ ID NO: 1051028 - RNA, 22 nt, Human
cggcugaggaucuccaggccug

SEQ ID NO: 1051029 - RNA, 22 nt, Human
aggcugagaaagugggaagaug

SEQ ID NO: 1051030 - RNA, 19 nt, Human
cauuaggauuagagacaag

SEQ ID NO: 1051031 - RNA, 22 nt, Human
uuugaaagggaaauaaacuccu

SEQ ID NO: 1051032 - RNA, 22 nt, Human
auaucaguaucuauguauuugu

SEQ ID NO: 1051033 - RNA, 22 nt, Human
ucugagccaaaauaaacagcau

SEQ ID NO: 1051034 - RNA, 22 nt, Human
aaaguauuugugauuuuuacca

SEQ ID NO: 1051035 - RNA, 23 nt, Human
uucuuauuuacuuuggaaucucc

SEQ ID NO: 1051036 - RNA, 22 nt, Human
uuucaguuuuugcucgauguau

SEQ ID NO: 1051037 - RNA, 22 nt, Human
uuuuuauaacucuuuugugaca

SEQ ID NO: 1051038 - RNA, 22 nt, Human
ugcugaggucaccuugcugcua

SEQ ID NO: 1051039 - RNA, 22 nt, Human
uauacacugauauaaggaguaa

SEQ ID NO: 1051040 - RNA, 22 nt, Human
ugaacaaacugcauucuucacu

SEQ ID NO: 1051041 - RNA, 22 nt, Human
gaggcagaaguugcagugagca

SEQ ID NO: 1051042 - RNA, 22 nt, Human
cagaaguuugacauguuuagcu

SEQ ID NO: 1051043 - RNA, 22 nt, Human
cagcaagauuuuuaaagcaagg

SEQ ID NO: 1051044 - RNA, 19 nt, Human
ccagaguuggcagagcagg

SEQ ID NO: 1051045 - RNA, 22 nt, Human
aaggcugagguagggccuaaaa

SEQ ID NO: 1051046 - RNA, 22 nt, Human
cuuuguagcugcuucugauuua

SEQ ID NO: 1051047 - RNA, 22 nt, Human
ggccagcagucacagggucaga

SEQ ID NO: 1051048 - RNA, 17 nt, Human
agcugaccagauggacu

SEQ ID NO: 1051049 - RNA, 22 nt, Human
gagggagggccaggucccaacc

SEQ ID NO: 1051050 - RNA, 18 nt, Human
aggcaggcuggagugacu

SEQ ID NO: 1051051 - RNA, 22 nt, Human
uauuuucuguggaggaccagau

SEQ ID NO: 1051052 - RNA, 17 nt, Human
aagacagaagccaugag

SEQ ID NO: 1051053 - RNA, 22 nt, Human
uguauuagguugaugcgaaagu

SEQ ID NO: 1051054 - RNA, 22 nt, Human
cagcugcuguuacugcuuauua

SEQ ID NO: 1051055 - RNA, 22 nt, Human
acaguaaccucuccucugaagg

SEQ ID NO: 1051056 - RNA, 23 nt, Human
ugcugaaguguuggcccugccca

SEQ ID NO: 1051057 - RNA, 22 nt, Human
aaguuacaguuggaacugugaa

SEQ ID NO: 1051058 - RNA, 21 nt, Human
agaggcccucggacugggcgu

SEQ ID NO: 1051059 - RNA, 22 nt, Human
aguggcaggcggagauguagga

SEQ ID NO: 1051060 - RNA, 22 nt, Human
augcuguguggucaaguuaauu

SEQ ID NO: 1051061 - RNA, 18 nt, Human
uugagggaggggcagagu

SEQ ID NO: 1051062 - RNA, 22 nt, Human
gggagacacgcugcaggcauaa

SEQ ID NO: 1051063 - RNA, 22 nt, Human
ccuggccaggcucucagcacug

SEQ ID NO: 1051064 - RNA, 22 nt, Human
uaaauacugaguuggaguuggc

SEQ ID NO: 1051065 - RNA, 22 nt, Human
uuuuauauugagugagaguucc

SEQ ID NO: 1051066 - RNA, 22 nt, Human
uuauuuagucuagaugaauuuu

SEQ ID NO: 1051067 - RNA, 22 nt, Human
ccagagcuaaacacacaggcug

SEQ ID NO: 1051068 - RNA, 22 nt, Human
uaaagcacauaucuuacaauaa

SEQ ID NO: 1051069 - RNA, 22 nt, Human
acacauauauacauauuugugc

SEQ ID NO: 1051070 - RNA, 22 nt, Human
uuugagauggagucuugcucug

SEQ ID NO: 1051071 - RNA, 22 nt, Human
aguaacaucuuugacauuuguu

SEQ ID NO: 1051072 - RNA, 22 nt, Human
cuggggcccgagccuugggcca

SEQ ID NO: 1051073 - RNA, 22 nt, Human
uuggaaaagcguucucuguagc

SEQ ID NO: 1051074 - RNA, 22 nt, Human
acucaggaaaugaagacugguu

SEQ ID NO: 1051075 - RNA, 22 nt, Human
uuuucagaggccuaagagguuu

SEQ ID NO: 1051076 - RNA, 22 nt, Human
gaauuaacuggcaguuagugcu

SEQ ID NO: 1051077 - RNA, 22 nt, Human
auuuggauucuuauuuagcacu

SEQ ID NO: 1051078 - RNA, 22 nt, Human
acugagguuuuuaguguuaaau

SEQ ID NO: 1051079 - RNA, 22 nt, Human
ugccugagugauguggcagcca

SEQ ID NO: 1051080 - RNA, 22 nt, Human
uggcagcaauuugugauguuga

SEQ ID NO: 1051081 - RNA, 22 nt, Human
agucauaugacccuucacaaac

SEQ ID NO: 1051082 - RNA, 22 nt, Human
caggcagcugaggacuuugcua

SEQ ID NO: 1051083 - RNA, 22 nt, Human
uuagugauaggaagccagauug

SEQ ID NO: 1051084 - RNA, 22 nt, Human
ugcucccagggacucuggcugg

SEQ ID NO: 1051085 - RNA, 22 nt, Human
uugcugaauugaauccuuuggu

SEQ ID NO: 1051086 - RNA, 22 nt, Human
auuaaauuaaguggcuaauuua

SEQ ID NO: 1051087 - RNA, 22 nt, Human
uccuggccuugcgucuugggag

SEQ ID NO: 1051088 - RNA, 22 nt, Human
ccagagcugaugggcccagggu

SEQ ID NO: 1051089 - RNA, 22 nt, Human
uauucaaaguaccuucauugcc

SEQ ID NO: 1051090 - RNA, 22 nt, Human
gagggcugcaaugagacagaga

SEQ ID NO: 1051091 - RNA, 22 nt, Human
gaauagcuuccuuuuuuccaaa

SEQ ID NO: 1051092 - RNA, 22 nt, Human
agaauuagucacaauuauagga

SEQ ID NO: 1051093 - RNA, 22 nt, Human
ugccacaguuguuugugcucua

SEQ ID NO: 1051094 - RNA, 22 nt, Human
uauuuccaaaagccuauuauga

SEQ ID NO: 1051095 - RNA, 22 nt, Human
cccaggaugucgaggcugcagu

SEQ ID NO: 1051096 - RNA, 22 nt, Human
ucuucagacccuuagcugugau

SEQ ID NO: 1051097 - RNA, 22 nt, Human
auucuucacaaauauauagaag

SEQ ID NO: 1051098 - RNA, 21 nt, Human
agcaccuuacagcuauaaugg

SEQ ID NO: 1051099 - RNA, 22 nt, Human
uggucuaaauauggcucuaaau

SEQ ID NO: 1051100 - RNA, 22 nt, Human
aacuagucagugauucucagaa

SEQ ID NO: 1051101 - RNA, 22 nt, Human
uggcugagggggcaguucagga

SEQ ID NO: 1051102 - RNA, 22 nt, Human
uuagggaaauaaaauuaucagu

SEQ ID NO: 1051103 - RNA, 22 nt, Human
ucagucucaucaacucuauucc

SEQ ID NO: 1051104 - RNA, 18 nt, Human
ggagcccagaggugaguu

SEQ ID NO: 1051105 - RNA, 22 nt, Human
agccacagagcaggagaccuuu

SEQ ID NO: 1051106 - RNA, 22 nt, Human
gcugagcuagaaaaggaccaca

SEQ ID NO: 1051107 - RNA, 22 nt, Human
gggaagcaggugcagcucgccu

SEQ ID NO: 1051108 - RNA, 22 nt, Human
ucuccugggcuugguugaaguu

SEQ ID NO: 1051109 - RNA, 22 nt, Human
gagagcaggcucucgggggcca

SEQ ID NO: 1051110 - RNA, 22 nt, Human
uugaggucuucauucuugggca

SEQ ID NO: 1051111 - RNA, 22 nt, Human
caaauacuuuauauacuucaaa

SEQ ID NO: 1051112 - RNA, 22 nt, Human
uaauuauaaacugcaguaggua

SEQ ID NO: 1051113 - RNA, 22 nt, Human
gugaggucaccggccguugcca

SEQ ID NO: 1051114 - RNA, 22 nt, Human
cggagaggugggggcagcaucu

SEQ ID NO: 1051115 - RNA, 22 nt, Human
cauuuucaugaguuucuguuca

SEQ ID NO: 1051116 - RNA, 17 nt, Human
agcugagcuggccaggg

SEQ ID NO: 1051117 - RNA, 22 nt, Human
uuucuuaguccuagagugauuu

SEQ ID NO: 1051118 - RNA, 22 nt, Human
ugcugaaacaauaacauacugg

SEQ ID NO: 1051119 - RNA, 22 nt, Human
cacugguagagagaagacaagg

SEQ ID NO: 1051120 - RNA, 22 nt, Human
uacugcauaacuggcauguggg

SEQ ID NO: 1051121 - RNA, 22 nt, Human
ucucucuugucaccccaucugc

SEQ ID NO: 1051122 - RNA, 22 nt, Human
cagagcuggagggaacccuggc

SEQ ID NO: 1051123 - RNA, 22 nt, Human
gaacuguaguuaauacuacaca

SEQ ID NO: 1051124 - RNA, 22 nt, Human
caggcugaggguuaggccuuag

SEQ ID NO: 1051125 - RNA, 22 nt, Human
ugcugaggucauuuccaaguga

SEQ ID NO: 1051126 - RNA, 22 nt, Human
uguucuucuagauugccuuuua

SEQ ID NO: 1051127 - RNA, 22 nt, Human
agacgagggccuggcacacagu

SEQ ID NO: 1051128 - RNA, 22 nt, Human
ucuucucuacaccagcagcccc

SEQ ID NO: 1051129 - RNA, 22 nt, Human
guggcagcggugugcaaggagg

SEQ ID NO: 1051130 - RNA, 22 nt, Human
caacuccuccccagcaugccaa

SEQ ID NO: 1051131 - RNA, 21 nt, Human
ugcuggaaaaagugguucuag

SEQ ID NO: 1051132 - RNA, 22 nt, Human
aggcagcuggaaaacuccaggc

SEQ ID NO: 1051133 - RNA, 22 nt, Human
auguucuguuuuguaauucaua

SEQ ID NO: 1051134 - RNA, 22 nt, Human
acagugagcccacuccaggaga

SEQ ID NO: 1051135 - RNA, 21 nt, Human
auaagcaugcugauuacauuu

SEQ ID NO: 1051136 - RNA, 22 nt, Human
agggagcucuaaguagagggac

SEQ ID NO: 1051137 - RNA, 22 nt, Human
aggauguuaucugugcaggugg

SEQ ID NO: 1051138 - RNA, 22 nt, Human
uaaggccauuauggugggcccg

SEQ ID NO: 1051139 - RNA, 22 nt, Human
gauuuuauauggcauacugugg

SEQ ID NO: 1051140 - RNA, 22 nt, Human
uuaagauagaacccaguagucu

SEQ ID NO: 1051141 - RNA, 22 nt, Human
aaaguauucuugacuguuuuuc

SEQ ID NO: 1051142 - RNA, 22 nt, Human
uggcagcuccggguaggggcug

SEQ ID NO: 1051143 - RNA, 22 nt, Human
cuccaggagggggauggcugua

SEQ ID NO: 1051144 - RNA, 22 nt, Human
cagggcuggauuucauuucuag

SEQ ID NO: 1051145 - RNA, 22 nt, Human
auacaucuagagucauaaaaac

SEQ ID NO: 1051146 - RNA, 20 nt, Human
cugcccagccacugagggau

SEQ ID NO: 1051147 - RNA, 22 nt, Human
aagauaaacucuugauuucuga

SEQ ID NO: 1051148 - RNA, 22 nt, Human
aggcugaggcagguggaucacc

SEQ ID NO: 1051149 - RNA, 22 nt, Human
auucuucacuguuucagaauga

SEQ ID NO: 1051150 - RNA, 22 nt, Human
caagaagugucagcuuuuuaaa

SEQ ID NO: 1051151 - RNA, 22 nt, Human
cccaggagacauauagaaggac

SEQ ID NO: 1051152 - RNA, 22 nt, Human
uuauuuggaaauauggcuucug

SEQ ID NO: 1051153 - RNA, 22 nt, Human
uuucuucauagaccuugucuug

SEQ ID NO: 1051154 - RNA, 22 nt, Human
aacuuucuaauuuuggcugagc

SEQ ID NO: 1051155 - RNA, 22 nt, Human
uuucucuguucucuaacuguaa

SEQ ID NO: 1051156 - RNA, 22 nt, Human
agaaaugacacacaugagacau

SEQ ID NO: 1051157 - RNA, 22 nt, Human
uagcugcugcagcacagggagg

SEQ ID NO: 1051158 - RNA, 22 nt, Human
caaaacugucuagagagagaag

SEQ ID NO: 1051159 - RNA, 22 nt, Human
aagaggaggacgguucccagaa

SEQ ID NO: 1051160 - RNA, 18 nt, Human
aauuuccauaugaauugc

SEQ ID NO: 1051161 - RNA, 17 nt, Human
gccucugcuugugucau

SEQ ID NO: 1051162 - RNA, 22 nt, Human
uuuccucauuuaucugcuggga

SEQ ID NO: 1051163 - RNA, 17 nt, Human
acucaggaucugggagu

SEQ ID NO: 1051164 - RNA, 22 nt, Human
uggagccagagcgcagccuggg

SEQ ID NO: 1051165 - RNA, 20 nt, Human
acaggggcagcacaauaaug

SEQ ID NO: 1051166 - RNA, 20 nt, Human
gggagucuggaugaaagaug

SEQ ID NO: 1051167 - RNA, 22 nt, Human
aggcaagcccccagugaggcuc

SEQ ID NO: 1051168 - RNA, 20 nt, Human
auuaggauuuuaggucauca

SEQ ID NO: 1051169 - RNA, 22 nt, Human
cuggagagagaaaaagccuuaa

SEQ ID NO: 1051170 - RNA, 22 nt, Human
acauuguuugagaauacagaug

SEQ ID NO: 1051171 - RNA, 22 nt, Human
gcccaguaguucaagguugcag

SEQ ID NO: 1051172 - RNA, 22 nt, Human
uagacagagugaagacaagugg

SEQ ID NO: 1051173 - RNA, 22 nt, Human
ccagcagaggggcggagugcag

SEQ ID NO: 1051174 - RNA, 22 nt, Human
uuuaguucucccagucuugauu

SEQ ID NO: 1051175 - RNA, 22 nt, Human
gcugcuugauuagguugacacu

SEQ ID NO: 1051176 - RNA, 19 nt, Human
augucuggguaacagcugc

SEQ ID NO: 1051177 - RNA, 22 nt, Human
aaggcagccagauccuuugggu

SEQ ID NO: 1051178 - RNA, 22 nt, Human
uuagaaaggagcuuauuucuuu

SEQ ID NO: 1051179 - RNA, 22 nt, Human
agugcuuugugcucucacugca

SEQ ID NO: 1051180 - RNA, 22 nt, Human
aauuaggaauaaaugaguacuu

SEQ ID NO: 1051181 - RNA, 22 nt, Human
ggcugcugaaguguggcaaucu

SEQ ID NO: 1051182 - RNA, 19 nt, Human
cugaagucuuuucagcugg

SEQ ID NO: 1051183 - RNA, 23 nt, Human
aggcagcagguuguccaggguga

SEQ ID NO: 1051184 - RNA, 22 nt, Human
aggcagaggagaaugaucuucc

SEQ ID NO: 1051185 - RNA, 22 nt, Human
acuauuagcauaucaugaaugg

SEQ ID NO: 1051186 - RNA, 22 nt, Human
ucugagguucuguuuucaacug

SEQ ID NO: 1051187 - RNA, 22 nt, Human
aaucauucuuauuucacagcaa

SEQ ID NO: 1051188 - RNA, 22 nt, Human
ugaugaaacugagguuccaaga

SEQ ID NO: 1051189 - RNA, 22 nt, Human
ggccagaaguuggaaaagagcc

SEQ ID NO: 1051190 - RNA, 22 nt, Human
gaaaaaugagcugaugucaggg

SEQ ID NO: 1051191 - RNA, 22 nt, Human
uagcacauuguugaccagaagg

SEQ ID NO: 1051192 - RNA, 22 nt, Human
aaauaguuuagcucucauuuca

SEQ ID NO: 1051193 - RNA, 22 nt, Human
agcaccuguugcacuucauaau

SEQ ID NO: 1051194 - RNA, 22 nt, Human
uauuuuaaagacugccagccua

SEQ ID NO: 1051195 - RNA, 22 nt, Human
aagggaggccagagguuuugca

SEQ ID NO: 1051196 - RNA, 22 nt, Human
cccaggaaccuaccagcucgag

SEQ ID NO: 1051197 - RNA, 22 nt, Human
aaggcugaggagggccugcagg

SEQ ID NO: 1051198 - RNA, 22 nt, Human
uugauguacagaauuguucaca

SEQ ID NO: 1051199 - RNA, 22 nt, Human
gcaggcuggucugaccaucccu

SEQ ID NO: 1051200 - RNA, 20 nt, Human
cucuccucacccgugucagg

SEQ ID NO: 1051201 - RNA, 22 nt, Human
gauuuuauuagcccaaacuuug

SEQ ID NO: 1051202 - RNA, 22 nt, Human
cacucuccagcacaccccauuu

SEQ ID NO: 1051203 - RNA, 22 nt, Human
aggcagugcucaagacagcagc

SEQ ID NO: 1051204 - RNA, 22 nt, Human
aaaggaagauugagcuuuucca

SEQ ID NO: 1051205 - RNA, 22 nt, Human
ucugagccguauggcuuggcua

SEQ ID NO: 1051206 - RNA, 22 nt, Human
aaaagucugcucucauuucaga

SEQ ID NO: 1051207 - RNA, 22 nt, Human
auuuccauagagcgucucacag

SEQ ID NO: 1051208 - RNA, 22 nt, Human
gagcugagcuuaacuccuugaa

SEQ ID NO: 1051209 - RNA, 22 nt, Human
guuuauuagaguuuucugucug

SEQ ID NO: 1051210 - RNA, 22 nt, Human
ucagagaguuacacaaauuguu

SEQ ID NO: 1051211 - RNA, 22 nt, Human
aauuaggaaauucagccauuuu

SEQ ID NO: 1051212 - RNA, 22 nt, Human
uagaaagacagagguuuugucu

SEQ ID NO: 1051213 - RNA, 22 nt, Human
ucauauuaggguaaugauaaga

SEQ ID NO: 1051214 - RNA, 20 nt, Human
aggaggcauagucuggaaag

SEQ ID NO: 1051215 - RNA, 22 nt, Human
uaaaacugaauacauacugagg

SEQ ID NO: 1051216 - RNA, 21 nt, Human
ggcagcguguggacaggaagg

SEQ ID NO: 1051217 - RNA, 22 nt, Human
gcuccuggagagauugagaaag

SEQ ID NO: 1051218 - RNA, 22 nt, Human
aagcugaggucaaguagcuagu

SEQ ID NO: 1051219 - RNA, 21 nt, Human
uuccagagauuguuucaccug

SEQ ID NO: 1051220 - RNA, 22 nt, Human
ucuccuggaagaauaccacacu

SEQ ID NO: 1051221 - RNA, 22 nt, Human
ucaggcugcuguacugugaaug

SEQ ID NO: 1051222 - RNA, 23 nt, Human
gugcugugagccccuuggccucc

SEQ ID NO: 1051223 - RNA, 22 nt, Human
uggcucagcgcggccuggucuu

SEQ ID NO: 1051224 - RNA, 22 nt, Human
uucugugauugacauguggcuu

SEQ ID NO: 1051225 - RNA, 18 nt, Human
uaacugguuucuucccau

SEQ ID NO: 1051226 - RNA, 22 nt, Human
ggcugagacuagagugaggcau

SEQ ID NO: 1051227 - RNA, 22 nt, Human
guaaaauagaauaacguggcua

SEQ ID NO: 1051228 - RNA, 22 nt, Human
gaggcagcaucuauggugggaa

SEQ ID NO: 1051229 - RNA, 22 nt, Human
ggaggcagaauagagugugggu

SEQ ID NO: 1051230 - RNA, 19 nt, Human
uauucaggaugauggcaca

SEQ ID NO: 1051231 - RNA, 19 nt, Human
cccaggaggcggagguugc

SEQ ID NO: 1051232 - RNA, 22 nt, Human
acucugggauuguuucugguau

SEQ ID NO: 1051233 - RNA, 22 nt, Human
uggagucugugaugcucugggu

SEQ ID NO: 1051234 - RNA, 22 nt, Human
cucccucaggccuuagcccugc

SEQ ID NO: 1051235 - RNA, 22 nt, Human
agggaggucuuugaggggcuua

SEQ ID NO: 1051236 - RNA, 22 nt, Human
uccugagcugccgcaucagcag

SEQ ID NO: 1051237 - RNA, 22 nt, Human
ggcagcuuccugagccagcagc

SEQ ID NO: 1051238 - RNA, 22 nt, Human
caauacuuccuuguuagaggca

SEQ ID NO: 1051239 - RNA, 22 nt, Human
auagucacucuguuagguguuu

SEQ ID NO: 1051240 - RNA, 22 nt, Human
uucuucucucauagauuaaggu

SEQ ID NO: 1051241 - RNA, 22 nt, Human
cuucuucaagagaaugggagac

SEQ ID NO: 1051242 - RNA, 22 nt, Human
uggagaggagcaccauggccau

SEQ ID NO: 1051243 - RNA, 22 nt, Human
ugcccuggcuggagugcagugg

SEQ ID NO: 1051244 - RNA, 22 nt, Human
gucugcuggugccuggccugcg

SEQ ID NO: 1051245 - RNA, 22 nt, Human
ccugcuguaaugugucuuuauu

SEQ ID NO: 1051246 - RNA, 22 nt, Human
uggcuucugagcauugaaacgu

SEQ ID NO: 1051247 - RNA, 22 nt, Human
aacuccagugucagcugcaaug

SEQ ID NO: 1051248 - RNA, 22 nt, Human
uuagaaagguuuugcucugaaa

SEQ ID NO: 1051249 - RNA, 20 nt, Human
aagcacauuucuacaauaau

SEQ ID NO: 1051250 - RNA, 22 nt, Human
uggacaaaugauuucuaccuuu

SEQ ID NO: 1051251 - RNA, 22 nt, Human
augcugugauuguagaaauauu

SEQ ID NO: 1051252 - RNA, 22 nt, Human
gaaggccacaagagaaguuaag

SEQ ID NO: 1051253 - RNA, 22 nt, Human
cacaaaugugcagaaaugugag

SEQ ID NO: 1051254 - RNA, 22 nt, Human
auacacuuuagaaaaacgcugc

SEQ ID NO: 1051255 - RNA, 22 nt, Human
cuguccugcccacccugcaggg

SEQ ID NO: 1051256 - RNA, 22 nt, Human
cugagccccaucugaggugccc

SEQ ID NO: 1051257 - RNA, 22 nt, Human
ucuggcugacauccuguaugag

SEQ ID NO: 1051258 - RNA, 22 nt, Human
cugggcaauaugcugggccugg

SEQ ID NO: 1051259 - RNA, 22 nt, Human
cagcuucugucugauuagcaag

SEQ ID NO: 1051260 - RNA, 22 nt, Human
ccuaauuaucucccaaagaucc

SEQ ID NO: 1051261 - RNA, 22 nt, Human
aaggaaccuggaguagagggag

SEQ ID NO: 1051262 - RNA, 22 nt, Human
uuccuggcaccaccacuucuag

SEQ ID NO: 1051263 - RNA, 22 nt, Human
ggcaggcaucauguggucauua

SEQ ID NO: 1051264 - RNA, 22 nt, Human
ucuggccauggcaagccgagug

SEQ ID NO: 1051265 - RNA, 22 nt, Human
ccucaggauccgcaggugcagu

SEQ ID NO: 1051266 - RNA, 22 nt, Human
uaccauuucauucuuuccucau

SEQ ID NO: 1051267 - RNA, 22 nt, Human
ucacuucacacccacuaucaug

SEQ ID NO: 1051268 - RNA, 22 nt, Human
uuagagaugucccaaaaugaag

SEQ ID NO: 1051269 - RNA, 22 nt, Human
gcugcugugugggagacaggcg

SEQ ID NO: 1051270 - RNA, 23 nt, Human
gguccacccgagccugcagcuuc

SEQ ID NO: 1051271 - RNA, 22 nt, Human
caccuugugauccucuugccuu

SEQ ID NO: 1051272 - RNA, 22 nt, Human
uccaggagguugagacugcagu

SEQ ID NO: 1051273 - RNA, 22 nt, Human
ucucauugguauauacaugugu

SEQ ID NO: 1051274 - RNA, 22 nt, Human
aggagaggguggcauuaaguuu

SEQ ID NO: 1051275 - RNA, 22 nt, Human
cugagcugcaguccuggcucug

SEQ ID NO: 1051276 - RNA, 19 nt, Human
gccugccuggguuucugag

SEQ ID NO: 1051277 - RNA, 22 nt, Human
uccaggaggcagggcugugccc

SEQ ID NO: 1051278 - RNA, 22 nt, Human
caguaaagcauguaugucuuca

SEQ ID NO: 1051279 - RNA, 22 nt, Human
cuguuuauuacacuggauagca

SEQ ID NO: 1051280 - RNA, 22 nt, Human
cgaggcaggcaggcggaggaua

SEQ ID NO: 1051281 - RNA, 22 nt, Human
guuaggauauggugaaauggag

SEQ ID NO: 1051282 - RNA, 18 nt, Human
ucauuagggauugcaaag

SEQ ID NO: 1051283 - RNA, 22 nt, Human
acaggcagcaaaaucagccuca

SEQ ID NO: 1051284 - RNA, 22 nt, Human
ucauguuaucuuggcucuggga

SEQ ID NO: 1051285 - RNA, 22 nt, Human
agcccagggacagggcggaugu

SEQ ID NO: 1051286 - RNA, 22 nt, Human
gacuuucuugcagaaauauucc

SEQ ID NO: 1051287 - RNA, 22 nt, Human
aguaaucaauuuuucgguggau

SEQ ID NO: 1051288 - RNA, 22 nt, Human
ugugcaggugcaggaagggggc

SEQ ID NO: 1051289 - RNA, 22 nt, Human
aagggcuggaucucucugagca

SEQ ID NO: 1051290 - RNA, 22 nt, Human
gcuguguuugacaguagcagac

SEQ ID NO: 1051291 - RNA, 17 nt, Human
uggcaugaggguguggg

SEQ ID NO: 1051292 - RNA, 22 nt, Human
auucaaguggcugcuauguuaa

SEQ ID NO: 1051293 - RNA, 22 nt, Human
ugaggggagcccgcccuggacg

SEQ ID NO: 1051294 - RNA, 22 nt, Human
caguucuuuguggggaguucuc

SEQ ID NO: 1051295 - RNA, 22 nt, Human
agugugagcccuggaguggugc

SEQ ID NO: 1051296 - RNA, 22 nt, Human
aagcagcagcaggauuaaagag

SEQ ID NO: 1051297 - RNA, 22 nt, Human
agcaguuacuaguuaaaugcau

SEQ ID NO: 1051298 - RNA, 22 nt, Human
ucuucuucccaucccucaaaug

SEQ ID NO: 1051299 - RNA, 22 nt, Human
gaggcuccagcgacaccuaggc

SEQ ID NO: 1051300 - RNA, 22 nt, Human
aaggagagguuguccguguugu

SEQ ID NO: 1051301 - RNA, 22 nt, Human
uacacacagaggccaugggauu

SEQ ID NO: 1051302 - RNA, 22 nt, Human
uucucagagugaccaagucuuu

SEQ ID NO: 1051303 - RNA, 22 nt, Human
uuaugaaguuccuguuacagug

SEQ ID NO: 1051304 - RNA, 22 nt, Human
uagcuaucuguguccagaucca

SEQ ID NO: 1051305 - RNA, 22 nt, Human
gggcugagaaguugaucccaag

SEQ ID NO: 1051306 - RNA, 21 nt, Human
gauugaaaccauggcagugag

SEQ ID NO: 1051307 - RNA, 22 nt, Human
uccugccuuagagcaaggaaaa

SEQ ID NO: 1051308 - RNA, 22 nt, Human
aauuaggaaaugagaguauuug

SEQ ID NO: 1051309 - RNA, 22 nt, Human
agcagcuguggggacaagggua

SEQ ID NO: 1051310 - RNA, 22 nt, Human
ucuccucuauuucuguauguau

SEQ ID NO: 1051311 - RNA, 22 nt, Human
uuugcagucuggccugcuuugg

SEQ ID NO: 1051312 - RNA, 22 nt, Human
ccugaggucagcgguucccaca

SEQ ID NO: 1051313 - RNA, 22 nt, Human
cugagagccuccuguuggcuag

SEQ ID NO: 1051314 - RNA, 18 nt, Human
gugcugugggcaguggcc

SEQ ID NO: 1051315 - RNA, 22 nt, Human
ugcugagggcagaugaauuaga

SEQ ID NO: 1051316 - RNA, 22 nt, Human
uauagaggccaccaacaugaaa

SEQ ID NO: 1051317 - RNA, 22 nt, Human
gagguccacugaggcaacaggg

SEQ ID NO: 1051318 - RNA, 22 nt, Human
aagggagguaaagcuauuuaaa

SEQ ID NO: 1051319 - RNA, 22 nt, Human
aggcugcucaguagauggagcu

SEQ ID NO: 1051320 - RNA, 22 nt, Human
aaaggccaccaacaugaagcau

SEQ ID NO: 1051321 - RNA, 22 nt, Human
gcaaagcauucuguggagucua

SEQ ID NO: 1051322 - RNA, 22 nt, Human
ucuuggcugcugccaauuuacu

SEQ ID NO: 1051323 - RNA, 22 nt, Human
auucaaguucuucugucuuugc

SEQ ID NO: 1051324 - RNA, 22 nt, Human
ccagguaggagagagggauccu

SEQ ID NO: 1051325 - RNA, 22 nt, Human
aaugucugccagaacugaucau

SEQ ID NO: 1051326 - RNA, 22 nt, Human
uggcagagcaaaaagauagaau

SEQ ID NO: 1051327 - RNA, 22 nt, Human
uggcaugaguauaggcuucuca

SEQ ID NO: 1051328 - RNA, 22 nt, Human
ggcugcagggcagcuggugugg

SEQ ID NO: 1051329 - RNA, 22 nt, Human
aggcugagcugguagugaguac

SEQ ID NO: 1051330 - RNA, 21 nt, Human
uggcaggcagcuggaagcuug

SEQ ID NO: 1051331 - RNA, 21 nt, Human
ucaggagagcccaucuacaaa

SEQ ID NO: 1051332 - RNA, 22 nt, Human
cuuaagaugaggucaugcuaua

SEQ ID NO: 1051333 - RNA, 22 nt, Human
guccaucuagaauuuauuucua

SEQ ID NO: 1051334 - RNA, 22 nt, Human
cugagccagggccacacaugga

SEQ ID NO: 1051335 - RNA, 22 nt, Human
uuggaaauacagcaguuacuuu

SEQ ID NO: 1051336 - RNA, 22 nt, Human
uagaacuguccaagucugagcu

SEQ ID NO: 1051337 - RNA, 22 nt, Human
ccuccugggccuugcucuguga

SEQ ID NO: 1051338 - RNA, 22 nt, Human
gucugucucccugugacugaga

SEQ ID NO: 1051339 - RNA, 22 nt, Human
ccacagagcauuagauuucaga

SEQ ID NO: 1051340 - RNA, 22 nt, Human
uaucuaaaggauuuaauuuagu

SEQ ID NO: 1051341 - RNA, 22 nt, Human
acaguaacaaauggccugagga

SEQ ID NO: 1051342 - RNA, 22 nt, Human
acauuuaaccuuugaggaacug

SEQ ID NO: 1051343 - RNA, 22 nt, Human
ccacagcugaccgcaggugagc

SEQ ID NO: 1051344 - RNA, 22 nt, Human
aagaagagaacuggcauccuaa

SEQ ID NO: 1051345 - RNA, 22 nt, Human
cugaggccucguuggcuggaac

SEQ ID NO: 1051346 - RNA, 22 nt, Human
uucaggaugaaagugugcaaca

SEQ ID NO: 1051347 - RNA, 21 nt, Human
ugcacuucaguggcuaaauuc

SEQ ID NO: 1051348 - RNA, 19 nt, Human
gaggcgaggcgugcaggag

SEQ ID NO: 1051349 - RNA, 22 nt, Human
cagagccacuuggagaugagaa

SEQ ID NO: 1051350 - RNA, 22 nt, Human
aggcacaggccucagcacccag

SEQ ID NO: 1051351 - RNA, 22 nt, Human
gaacugguuacagagggauguu

SEQ ID NO: 1051352 - RNA, 22 nt, Human
uugacuucagccuguacuugua

SEQ ID NO: 1051353 - RNA, 22 nt, Human
ucuacugcacuggugucucauc

SEQ ID NO: 1051354 - RNA, 22 nt, Human
gagugucaaggcucucuuuggc

SEQ ID NO: 1051355 - RNA, 22 nt, Human
gacccuccuacuacccuggaaa

SEQ ID NO: 1051356 - RNA, 22 nt, Human
agugucagccugggcaaggaac

SEQ ID NO: 1051357 - RNA, 22 nt, Human
gaggagaagcuaagaaacacag

SEQ ID NO: 1051358 - RNA, 22 nt, Human
aggguagguguaagauagcccu

SEQ ID NO: 1051359 - RNA, 23 nt, Human
aggcccaacucugugagggcugc

SEQ ID NO: 1051360 - RNA, 23 nt, Human
ggcugagaagucccaugauaggu

SEQ ID NO: 1051361 - RNA, 22 nt, Human
acugccugcucauaacauugcu

SEQ ID NO: 1051362 - RNA, 22 nt, Human
cuugaaagaagggucuuuuaau

SEQ ID NO: 1051363 - RNA, 22 nt, Human
ucacaguaaaagcauggaagag

SEQ ID NO: 1051364 - RNA, 22 nt, Human
gauuaggagggagaggcaagua

SEQ ID NO: 1051365 - RNA, 22 nt, Human
uuugaagugggcauuagaaccu

SEQ ID NO: 1051366 - RNA, 22 nt, Human
aaaaaucuaugacugcuucucc

SEQ ID NO: 1051367 - RNA, 22 nt, Human
ggguacagagagaugagguaac

SEQ ID NO: 1051368 - RNA, 22 nt, Human
gccaggaggucagccccucaac

SEQ ID NO: 1051369 - RNA, 22 nt, Human
cagggcuguggaaaacuggugc

SEQ ID NO: 1051370 - RNA, 21 nt, Human
uggcagacaggaggagcucac

SEQ ID NO: 1051371 - RNA, 22 nt, Human
aaggcugaaagaccuugaaccu

SEQ ID NO: 1051372 - RNA, 22 nt, Human
gggcagcucagccaccaugcag

SEQ ID NO: 1051373 - RNA, 20 nt, Human
ccagaagagaugaucaucca

SEQ ID NO: 1051374 - RNA, 22 nt, Human
aaggcugaauucaaggguaggc

SEQ ID NO: 1051375 - RNA, 22 nt, Human
aggacaggauugagcugaacug

SEQ ID NO: 1051376 - RNA, 22 nt, Human
auuaggcagggcaugguggcuc

SEQ ID NO: 1051377 - RNA, 21 nt, Human
ggcugcagggagcccuggggu

SEQ ID NO: 1051378 - RNA, 22 nt, Human
gaggcacuggaggaaaggagaa

SEQ ID NO: 1051379 - RNA, 21 nt, Human
agcugagguaaggcaagagag

SEQ ID NO: 1051380 - RNA, 22 nt, Human
cagaagaguagcugaacaaguu

SEQ ID NO: 1051381 - RNA, 22 nt, Human
gagcgauguggguauguagaag

SEQ ID NO: 1051382 - RNA, 22 nt, Human
agggagcuucuggccucagccu

SEQ ID NO: 1051383 - RNA, 22 nt, Human
uuuauuugaaucaggggagaau

SEQ ID NO: 1051384 - RNA, 22 nt, Human
cuucucagaggccagaagcuau

SEQ ID NO: 1051385 - RNA, 22 nt, Human
ucugucuucaucagcaugugau

SEQ ID NO: 1051386 - RNA, 22 nt, Human
auuguucaaagugcuuugcaug

SEQ ID NO: 1051387 - RNA, 22 nt, Human
aguuucuuuagauagaaaguuc

SEQ ID NO: 1051388 - RNA, 20 nt, Human
ucauuucuugggguuccaag

SEQ ID NO: 1051389 - RNA, 21 nt, Human
gcuguugcccgccgccucuuc

SEQ ID NO: 1051390 - RNA, 22 nt, Human
gcaggcugaaacucggggucua

SEQ ID NO: 1051391 - RNA, 22 nt, Human
gacccaggcucgugggacggcu

SEQ ID NO: 1051392 - RNA, 22 nt, Human
ugcugcugaugcauagucugcu

SEQ ID NO: 1051393 - RNA, 22 nt, Human
gugagggguggcugagcaguuu

SEQ ID NO: 1051394 - RNA, 22 nt, Human
guggccaagagauaaaauugug

SEQ ID NO: 1051395 - RNA, 21 nt, Human
uuuauuaacaacuguggacgu

SEQ ID NO: 1051396 - RNA, 22 nt, Human
uuuuaguuguaguuggugagga

SEQ ID NO: 1051397 - RNA, 18 nt, Human
cugcugugucgucugggc

SEQ ID NO: 1051398 - RNA, 22 nt, Human
acuucaugcagaagagagcugu

SEQ ID NO: 1051399 - RNA, 22 nt, Human
cugucuggauauaccuuggcca

SEQ ID NO: 1051400 - RNA, 22 nt, Human
uuugcaauuugugcugcaaaug

SEQ ID NO: 1051401 - RNA, 22 nt, Human
auacauacauguaugcacauac

SEQ ID NO: 1051402 - RNA, 22 nt, Human
uccugaggcucacuuugaaugu

SEQ ID NO: 1051403 - RNA, 22 nt, Human
uauuugaaaguguacaaaaacu

SEQ ID NO: 1051404 - RNA, 22 nt, Human
acuguaacacaaugguaucugu

SEQ ID NO: 1051405 - RNA, 18 nt, Human
ucugagguggacgaggag

SEQ ID NO: 1051406 - RNA, 22 nt, Human
aucaggauccaccuugagccug

SEQ ID NO: 1051407 - RNA, 22 nt, Human
agcaccugccugcauuggcuau

SEQ ID NO: 1051408 - RNA, 22 nt, Human
cagcugacgccagaguggaauu

SEQ ID NO: 1051409 - RNA, 22 nt, Human
aagggcagagggaaucccacau

SEQ ID NO: 1051410 - RNA, 22 nt, Human
cugccaucugagccaaaagugc

SEQ ID NO: 1051411 - RNA, 22 nt, Human
ugcccagggauaagccuagaga

SEQ ID NO: 1051412 - RNA, 22 nt, Human
uggcagagugcagaagaggcau

SEQ ID NO: 1051413 - RNA, 22 nt, Human
ugugauauuugaguauugucaa

SEQ ID NO: 1051414 - RNA, 21 nt, Human
ugcugaugucagagaagcaag

SEQ ID NO: 1051415 - RNA, 22 nt, Human
aagcagcuggaagaguaagaug

SEQ ID NO: 1051416 - RNA, 22 nt, Human
ugaggcuccuuguagagagugg

SEQ ID NO: 1051417 - RNA, 22 nt, Human
cccaggaggcagauguugcagu

SEQ ID NO: 1051418 - RNA, 22 nt, Human
uuagccauauagaaaaagagcu

SEQ ID NO: 1051419 - RNA, 22 nt, Human
uuuagaaguucacacauuuaaa

SEQ ID NO: 1051420 - RNA, 22 nt, Human
ggcagcucacgggcauggggug

SEQ ID NO: 1051421 - RNA, 22 nt, Human
uaacugguuucauaucauuucc

SEQ ID NO: 1051422 - RNA, 22 nt, Human
caugcuguguguuuuagcucca

SEQ ID NO: 1051423 - RNA, 22 nt, Human
cugaggcuuugugugcaugccu

SEQ ID NO: 1051424 - RNA, 22 nt, Human
uaacauauuguguggcacuagg

SEQ ID NO: 1051425 - RNA, 22 nt, Human
aaagcagaacugagagagcugg

SEQ ID NO: 1051426 - RNA, 23 nt, Human
accaggaguugucucaggaaaca

SEQ ID NO: 1051427 - RNA, 22 nt, Human
guggccaaaaggaagaagguua

SEQ ID NO: 1051428 - RNA, 22 nt, Human
ggcugcuguacugaugucaguu

SEQ ID NO: 1051429 - RNA, 22 nt, Human
aaguguagauuauggagugucu

SEQ ID NO: 1051430 - RNA, 22 nt, Human
cuuugaagagauuacugugcuc

SEQ ID NO: 1051431 - RNA, 22 nt, Human
aagaacugugcuccaggcucca

SEQ ID NO: 1051432 - RNA, 22 nt, Human
ucuccuggccuuuagguuaagg

SEQ ID NO: 1051433 - RNA, 22 nt, Human
ucacaaaugaggaaaucgagca

SEQ ID NO: 1051434 - RNA, 22 nt, Human
ucuucagaggaagucagucuuu

SEQ ID NO: 1051435 - RNA, 22 nt, Human
uuuuaucuucauuccuaucuac

SEQ ID NO: 1051436 - RNA, 22 nt, Human
uccaugagcuagcuuuccaaag

SEQ ID NO: 1051437 - RNA, 22 nt, Human
caaauacuuacugaaccugugc

SEQ ID NO: 1051438 - RNA, 22 nt, Human
ucugcugugauuugcuaccugu

SEQ ID NO: 1051439 - RNA, 22 nt, Human
auuaggaaguaaguaucacaag

SEQ ID NO: 1051440 - RNA, 23 nt, Human
ccacagagcugccaauuccugug

SEQ ID NO: 1051441 - RNA, 22 nt, Human
uugcucaggcuggugugcagug

SEQ ID NO: 1051442 - RNA, 22 nt, Human
aaggcagcagaggaaaggugcu

SEQ ID NO: 1051443 - RNA, 22 nt, Human
cccuggaggucagaggccuggg

SEQ ID NO: 1051444 - RNA, 22 nt, Human
ucaggcugcagcugucagcagc

SEQ ID NO: 1051445 - RNA, 22 nt, Human
ucucaggacuuugggaagcuca

SEQ ID NO: 1051446 - RNA, 22 nt, Human
cuuugaauugccguuucaucug

SEQ ID NO: 1051447 - RNA, 22 nt, Human
ccuccuggaggcucuagggaaa

SEQ ID NO: 1051448 - RNA, 22 nt, Human
augaggcaucugcagucacuag

SEQ ID NO: 1051449 - RNA, 22 nt, Human
cugagguagcugugaauguucu

SEQ ID NO: 1051450 - RNA, 22 nt, Human
cccaggagagagacuugaaucu

SEQ ID NO: 1051451 - RNA, 22 nt, Human
gcaguucuacuuauccauagac

SEQ ID NO: 1051452 - RNA, 22 nt, Human
cacagucucuguugcugggacc

SEQ ID NO: 1051453 - RNA, 22 nt, Human
acagaauugaaaguauaaucug

SEQ ID NO: 1051454 - RNA, 19 nt, Human
uguguguuuauauauguau

SEQ ID NO: 1051455 - RNA, 22 nt, Human
acccagagcagagcuuggcuuc

SEQ ID NO: 1051456 - RNA, 22 nt, Human
auggcuucugucuuggaaauuu

SEQ ID NO: 1051457 - RNA, 22 nt, Human
uacccagggcuuuucugaugca

SEQ ID NO: 1051458 - RNA, 22 nt, Human
ggagaggagcuauugggggcuc

SEQ ID NO: 1051459 - RNA, 22 nt, Human
uuugaagucaggcuuucuaccc

SEQ ID NO: 1051460 - RNA, 22 nt, Human
ccaggagaugggaaaguagcag

SEQ ID NO: 1051461 - RNA, 22 nt, Human
cuggcucaccuccgcuccagca

SEQ ID NO: 1051462 - RNA, 22 nt, Human
uccaggugagugcaggugcaga

SEQ ID NO: 1051463 - RNA, 22 nt, Human
cauuuucagcacccaucugaaa

SEQ ID NO: 1051464 - RNA, 20 nt, Human
uauuuacaacuuagagccuc

SEQ ID NO: 1051465 - RNA, 22 nt, Human
aagaugacccugagggcaauug

SEQ ID NO: 1051466 - RNA, 22 nt, Human
uucuaaauuuuggaagaugcag

SEQ ID NO: 1051467 - RNA, 22 nt, Human
ucauuuguugaacuuuagugcg

SEQ ID NO: 1051468 - RNA, 22 nt, Human
acaggccacaguggagucucug

SEQ ID NO: 1051469 - RNA, 22 nt, Human
cagcugacccgugggaggcggg

SEQ ID NO: 1051470 - RNA, 22 nt, Human
cacaauguauauguauaucaaa

SEQ ID NO: 1051471 - RNA, 22 nt, Human
aagugaguucagcauucacucg

SEQ ID NO: 1051472 - RNA, 22 nt, Human
cccaggaggcagagauagcagu

SEQ ID NO: 1051473 - RNA, 19 nt, Human
agcagcuggagguggagug

SEQ ID NO: 1051474 - RNA, 22 nt, Human
acaaugaaaaaauuuacugugg

SEQ ID NO: 1051475 - RNA, 22 nt, Human
ccucaugguacuuacuguagcu

SEQ ID NO: 1051476 - RNA, 22 nt, Human
gagcacugauuuauuuuugucu

SEQ ID NO: 1051477 - RNA, 22 nt, Human
cugacuuugcucauaggucaaa

SEQ ID NO: 1051478 - RNA, 22 nt, Human
ugaggcaggaggauugcaggau

SEQ ID NO: 1051479 - RNA, 22 nt, Human
aaguaguuggaaauaagacaga

SEQ ID NO: 1051480 - RNA, 22 nt, Human
agcaaaagauagauuaacaaga

SEQ ID NO: 1051481 - RNA, 22 nt, Human
gagcugaggcucaggcuggcgu

SEQ ID NO: 1051482 - RNA, 22 nt, Human
cuggcugaauccuagucucaua

SEQ ID NO: 1051483 - RNA, 22 nt, Human
agggagugguuaagaaggugca

SEQ ID NO: 1051484 - RNA, 22 nt, Human
caaggccaguuucuccuaguca

SEQ ID NO: 1051485 - RNA, 22 nt, Human
ggccaaaugaaggcaaugggac

SEQ ID NO: 1051486 - RNA, 22 nt, Human
cucacugugaccucagcagaca

SEQ ID NO: 1051487 - RNA, 22 nt, Human
ccuuuuauacucagugauauca

SEQ ID NO: 1051488 - RNA, 22 nt, Human
uggcagcagccauggaaggccc

SEQ ID NO: 1051489 - RNA, 18 nt, Human
ggagcccagaggacagga

SEQ ID NO: 1051490 - RNA, 22 nt, Human
gcagggaagaucuuggagcugc

SEQ ID NO: 1051491 - RNA, 22 nt, Human
aagugaagaaauacaugagaau

SEQ ID NO: 1051492 - RNA, 21 nt, Human
caucuuagguuguacauauau

SEQ ID NO: 1051493 - RNA, 19 nt, Human
gagcgcagagggcagggga

SEQ ID NO: 1051494 - RNA, 22 nt, Human
ggaugggagcagaggacgacca

SEQ ID NO: 1051495 - RNA, 22 nt, Human
gaggcagcaaaauauaucauaa

SEQ ID NO: 1051496 - RNA, 21 nt, Human
gagugcagcaagguagagucu

SEQ ID NO: 1051497 - RNA, 22 nt, Human
cagacaggcaggugcugcuuug

SEQ ID NO: 1051498 - RNA, 22 nt, Human
cccaggaacuccagagcuccuc

SEQ ID NO: 1051499 - RNA, 22 nt, Human
ucucugguuauuaacuaacucc

SEQ ID NO: 1051500 - RNA, 22 nt, Human
cccuggagcuagucugagcaga

SEQ ID NO: 1051501 - RNA, 22 nt, Human
auaaucuuucuuuuccagauag

SEQ ID NO: 1051502 - RNA, 22 nt, Human
acagcagcuugcgugucugguc

SEQ ID NO: 1051503 - RNA, 22 nt, Human
acagaaauugcuaauagcucau

SEQ ID NO: 1051504 - RNA, 22 nt, Human
gaaggccaagaggcuccaagau

SEQ ID NO: 1051505 - RNA, 22 nt, Human
aggcuuagaaauucagcugagu

SEQ ID NO: 1051506 - RNA, 22 nt, Human
uuuguuaauucuuauguuagag

SEQ ID NO: 1051507 - RNA, 22 nt, Human
ggucugagagccacugaauccc

SEQ ID NO: 1051508 - RNA, 22 nt, Human
gagggaauggugugcaagaggu

SEQ ID NO: 1051509 - RNA, 22 nt, Human
ggcagccaugcacgcugccugg

SEQ ID NO: 1051510 - RNA, 22 nt, Human
cagcagagggagccauugaaau

SEQ ID NO: 1051511 - RNA, 22 nt, Human
gcugagcagguuugaugcuuuu

SEQ ID NO: 1051512 - RNA, 22 nt, Human
uagggcagaguccaggaugggc

SEQ ID NO: 1051513 - RNA, 22 nt, Human
agcuccugcgcacggugcacac

SEQ ID NO: 1051514 - RNA, 22 nt, Human
gcaccuuuuucuaggagaaugu

SEQ ID NO: 1051515 - RNA, 22 nt, Human
uaaggccaaggggccauagucu

SEQ ID NO: 1051516 - RNA, 22 nt, Human
cauuuuaaaugauuuaagccaa

SEQ ID NO: 1051517 - RNA, 22 nt, Human
gaggccaggaagcccaagauca

SEQ ID NO: 1051518 - RNA, 22 nt, Human
ucacauucucagcaucuauaca

SEQ ID NO: 1051519 - RNA, 22 nt, Human
aaggcagcccuggcucagccug

SEQ ID NO: 1051520 - RNA, 22 nt, Human
uccugccuucauacugcuguau

SEQ ID NO: 1051521 - RNA, 22 nt, Human
caaauacucuggauguguuugu

SEQ ID NO: 1051522 - RNA, 22 nt, Human
cugcuucacccaacuuugggau

SEQ ID NO: 1051523 - RNA, 22 nt, Human
agggggugcauuugugaaugaa

SEQ ID NO: 1051524 - RNA, 22 nt, Human
auuaaggaauguaggcaagaag

SEQ ID NO: 1051525 - RNA, 22 nt, Human
aaguuacagucagagguuaaca

SEQ ID NO: 1051526 - RNA, 22 nt, Human
gcugccucccagagcccugcag

SEQ ID NO: 1051527 - RNA, 22 nt, Human
acaguaauugugaacuuaacgu

SEQ ID NO: 1051528 - RNA, 22 nt, Human
caaaugaagagggcaacuucug

SEQ ID NO: 1051529 - RNA, 19 nt, Human
ggggagaacuagagacagc

SEQ ID NO: 1051530 - RNA, 22 nt, Human
uacaccuuaaucauaugugucu

SEQ ID NO: 1051531 - RNA, 22 nt, Human
cugccuggcauggagaagagaa

SEQ ID NO: 1051532 - RNA, 22 nt, Human
agugcugacucugggcacagug

SEQ ID NO: 1051533 - RNA, 21 nt, Human
uuugaaagcuacaucuauagc

SEQ ID NO: 1051534 - RNA, 22 nt, Human
ccaggcugggcuacaaguugag

SEQ ID NO: 1051535 - RNA, 22 nt, Human
uagugucaaacagggauuagaa

SEQ ID NO: 1051536 - RNA, 22 nt, Human
acugagguuauugcaauaaaau

SEQ ID NO: 1051537 - RNA, 22 nt, Human
ugcucuucggggccacugcuug

SEQ ID NO: 1051538 - RNA, 22 nt, Human
ccugguggagaggggcggagcg

SEQ ID NO: 1051539 - RNA, 18 nt, Human
gacaaaaguacagacaga

SEQ ID NO: 1051540 - RNA, 22 nt, Human
aagggcuguuauguuuuuauac

SEQ ID NO: 1051541 - RNA, 22 nt, Human
auucuucauacagacaaguccu

SEQ ID NO: 1051542 - RNA, 21 nt, Human
cggccaaauuccuccuaggga

SEQ ID NO: 1051543 - RNA, 22 nt, Human
agucugucuacuuaaagucugu

SEQ ID NO: 1051544 - RNA, 18 nt, Human
aggcagacacuagagguc

SEQ ID NO: 1051545 - RNA, 22 nt, Human
acaguacauaauccugagucug

SEQ ID NO: 1051546 - RNA, 22 nt, Human
cugugcacuucucuuuauuugu

SEQ ID NO: 1051547 - RNA, 22 nt, Human
caggcaggucagugaagaagga

SEQ ID NO: 1051548 - RNA, 22 nt, Human
ccuggccacagggcucugcauu

SEQ ID NO: 1051549 - RNA, 22 nt, Human
ugcugaggcaguccuaacagga

SEQ ID NO: 1051550 - RNA, 22 nt, Human
aguccaugguucugacucaucu

SEQ ID NO: 1051551 - RNA, 22 nt, Human
cagauaaauagacuuggucaga

SEQ ID NO: 1051552 - RNA, 22 nt, Human
ucugagguuacugcuuuguaga

SEQ ID NO: 1051553 - RNA, 22 nt, Human
uucaggauucucucccauuuac

SEQ ID NO: 1051554 - RNA, 22 nt, Human
gaggcaccucgcgggaggaggc

SEQ ID NO: 1051555 - RNA, 22 nt, Human
gaggcugcuuugaugacaggag

SEQ ID NO: 1051556 - RNA, 22 nt, Human
cccaggagauaacguucccaag

SEQ ID NO: 1051557 - RNA, 22 nt, Human
gcagcuucaguaggugaagaca

SEQ ID NO: 1051558 - RNA, 23 nt, Human
cauggcugauuucaagcuaccac

SEQ ID NO: 1051559 - RNA, 22 nt, Human
uaaaacuuaacuauccagauua

SEQ ID NO: 1051560 - RNA, 22 nt, Human
aggcagcuuucuggugcaccau

SEQ ID NO: 1051561 - RNA, 22 nt, Human
aucugccugagucuagguuuuc

SEQ ID NO: 1051562 - RNA, 22 nt, Human
auguggcauucuuggucauuuc

SEQ ID NO: 1051563 - RNA, 22 nt, Human
ggccaaaugaaaucugagcaau

SEQ ID NO: 1051564 - RNA, 22 nt, Human
cugccucucaggucccugagau

SEQ ID NO: 1051565 - RNA, 22 nt, Human
acuccugguucccaguugagau

SEQ ID NO: 1051566 - RNA, 22 nt, Human
gaaucuuaaaucggaaucuuaa

SEQ ID NO: 1051567 - RNA, 22 nt, Human
cuggagucuucagcuugcugcc

SEQ ID NO: 1051568 - RNA, 22 nt, Human
uguccauggauagagcugcucg

SEQ ID NO: 1051569 - RNA, 22 nt, Human
cuucagugaauguugaguaagg

SEQ ID NO: 1051570 - RNA, 22 nt, Human
cagcugagaguagaaauggagg

SEQ ID NO: 1051571 - RNA, 23 nt, Human
gggcagcuuaagcuuguuuuucu

SEQ ID NO: 1051572 - RNA, 22 nt, Human
uucuuuugggaauuacguaugc

SEQ ID NO: 1051573 - RNA, 21 nt, Human
uccaggaguggcugggcaggg

SEQ ID NO: 1051574 - RNA, 22 nt, Human
uuugacauuggcuuauucuguu

SEQ ID NO: 1051575 - RNA, 22 nt, Human
gagggcugauaacaggaauaca

SEQ ID NO: 1051576 - RNA, 22 nt, Human
uagcaagaggugaagguuucau

SEQ ID NO: 1051577 - RNA, 22 nt, Human
ccugcugugaagccaggccugu

SEQ ID NO: 1051578 - RNA, 22 nt, Human
uaacaucuuuagcagcucgaac

SEQ ID NO: 1051579 - RNA, 22 nt, Human
aggauguucgggucacauagcc

SEQ ID NO: 1051580 - RNA, 22 nt, Human
cugugccaggcccagcugacuu

SEQ ID NO: 1051581 - RNA, 22 nt, Human
cacaggcucuccagggccugga

SEQ ID NO: 1051582 - RNA, 22 nt, Human
ugugccagccucuggcuguguc

SEQ ID NO: 1051583 - RNA, 22 nt, Human
cagugcuguuguaagcucauug

SEQ ID NO: 1051584 - RNA, 22 nt, Human
cagcaagacaguuuccuaagug

SEQ ID NO: 1051585 - RNA, 22 nt, Human
uucuagauugccuguaaguaaa

SEQ ID NO: 1051586 - RNA, 22 nt, Human
gcugcccauuccacuggauggu

SEQ ID NO: 1051587 - RNA, 22 nt, Human
uggcugagccacuuguucagau

SEQ ID NO: 1051588 - RNA, 22 nt, Human
acuccaggcaucugcuucugcu

SEQ ID NO: 1051589 - RNA, 22 nt, Human
guuacacagcuaagcuucuccu

SEQ ID NO: 1051590 - RNA, 22 nt, Human
aagugcugagacuacaggcaug

SEQ ID NO: 1051591 - RNA, 15 nt, Human
uggcagcuuguuaag

SEQ ID NO: 1051592 - RNA, 22 nt, Human
uuccucagcuggccugauuggg

SEQ ID NO: 1051593 - RNA, 22 nt, Human
ugacaggugcugggggcagugu

SEQ ID NO: 1051594 - RNA, 22 nt, Human
ucugccugcuaacuccugcacc

SEQ ID NO: 1051595 - RNA, 22 nt, Human
auguaacugaaggaaaugcaug

SEQ ID NO: 1051596 - RNA, 22 nt, Human
uuucaguuacugcuauaucauu

SEQ ID NO: 1051597 - RNA, 22 nt, Human
ucaggcugcaguggcaaaagac

SEQ ID NO: 1051598 - RNA, 22 nt, Human
uugaggucucuacagaagagug

SEQ ID NO: 1051599 - RNA, 22 nt, Human
ugccuugcacauaauauacauu

SEQ ID NO: 1051600 - RNA, 22 nt, Human
uacccaggagaaacagcagggc

SEQ ID NO: 1051601 - RNA, 22 nt, Human
uggcaacaugucgaagugcugu

SEQ ID NO: 1051602 - RNA, 21 nt, Human
auugaaagucaacaaucaguu

SEQ ID NO: 1051603 - RNA, 22 nt, Human
ggcugcaggaacgacggagggg

SEQ ID NO: 1051604 - RNA, 22 nt, Human
ccaggcugagcaugauuggagc

SEQ ID NO: 1051605 - RNA, 22 nt, Human
aaauguuucuacuugugagcau

SEQ ID NO: 1051606 - RNA, 22 nt, Human
uucaugugauaaaugugugacu

SEQ ID NO: 1051607 - RNA, 22 nt, Human
aguuacagcacucaaaguuuuc

SEQ ID NO: 1051608 - RNA, 22 nt, Human
ggcagcuggguuggccagaaac

SEQ ID NO: 1051609 - RNA, 22 nt, Human
gagcaccucaauuugcuauuug

SEQ ID NO: 1051610 - RNA, 22 nt, Human
ugauuuuuagcuauucugaaga

SEQ ID NO: 1051611 - RNA, 22 nt, Human
auacacauuacuuucugucuga

SEQ ID NO: 1051612 - RNA, 22 nt, Human
gaaguuuagaguguuguaauuu

SEQ ID NO: 1051613 - RNA, 22 nt, Human
gcuccugggcccugggcuaacu

SEQ ID NO: 1051614 - RNA, 22 nt, Human
uuucaucuucccagagaccuug

SEQ ID NO: 1051615 - RNA, 22 nt, Human
ucauuuuucacacagggucacc

SEQ ID NO: 1051616 - RNA, 23 nt, Human
gcugccuccuacaaaagcccagc

SEQ ID NO: 1051617 - RNA, 22 nt, Human
aucccugcccucauggagcuua

SEQ ID NO: 1051618 - RNA, 22 nt, Human
gcacagaacagagaaauagcca

SEQ ID NO: 1051619 - RNA, 20 nt, Human
aagaaguugguaagcagugc

SEQ ID NO: 1051620 - RNA, 22 nt, Human
ccuaggcccauuaauuccccuu

SEQ ID NO: 1051621 - RNA, 22 nt, Human
auuaacuguacuuucuaauuuu

SEQ ID NO: 1051622 - RNA, 22 nt, Human
ggcugagaguggaucccaggga

SEQ ID NO: 1051623 - RNA, 22 nt, Human
cugagccccucugaccucagag

SEQ ID NO: 1051624 - RNA, 20 nt, Human
aacugccugcccagaggugg

SEQ ID NO: 1051625 - RNA, 22 nt, Human
uuaggaaaaugaaauuaccugu

SEQ ID NO: 1051626 - RNA, 22 nt, Human
auucauuugcuauuguguaugg

SEQ ID NO: 1051627 - RNA, 22 nt, Human
gagugucagugccuggcuuguu

SEQ ID NO: 1051628 - RNA, 22 nt, Human
ucaauucaacacaugcacauug

SEQ ID NO: 1051629 - RNA, 23 nt, Human
uauuagggccaggacuggcaaau

SEQ ID NO: 1051630 - RNA, 22 nt, Human
gagguccagagcagguucagug

SEQ ID NO: 1051631 - RNA, 22 nt, Human
auuuccaguccuaaugaucugg

SEQ ID NO: 1051632 - RNA, 22 nt, Human
aaggccagacaggaccacaucu

SEQ ID NO: 1051633 - RNA, 22 nt, Human
cagaggaguucaguacacagcc

SEQ ID NO: 1051634 - RNA, 22 nt, Human
gcugaggucaggagcugugggg

SEQ ID NO: 1051635 - RNA, 22 nt, Human
uggcagcuguuaauguuuuguu

SEQ ID NO: 1051636 - RNA, 22 nt, Human
ucauucuuuaccaaguugucac

SEQ ID NO: 1051637 - RNA, 22 nt, Human
gaggacagagccgccuggcaag

SEQ ID NO: 1051638 - RNA, 23 nt, Human
agacaaaagccucagucuuaggc

SEQ ID NO: 1051639 - RNA, 22 nt, Human
gaauuauaaacuagugacuuca

SEQ ID NO: 1051640 - RNA, 20 nt, Human
cuucuucauuaacccuacug

SEQ ID NO: 1051641 - RNA, 22 nt, Human
uuuuaguguagucaccgugggu

SEQ ID NO: 1051642 - RNA, 22 nt, Human
uccaggagaaggccauccagcg

SEQ ID NO: 1051643 - RNA, 22 nt, Human
ucccuucacagaugcgauguuu

SEQ ID NO: 1051644 - RNA, 22 nt, Human
auggccaagaaauugccgacug

SEQ ID NO: 1051645 - RNA, 20 nt, Human
aggagggaccuggauuggcg

SEQ ID NO: 1051646 - RNA, 22 nt, Human
acaggcugacuuccugccaugu

SEQ ID NO: 1051647 - RNA, 22 nt, Human
ugucaccaugcgaggcuaauuu

SEQ ID NO: 1051648 - RNA, 22 nt, Human
ucagaaaagagaaaaucuuaua

SEQ ID NO: 1051649 - RNA, 21 nt, Human
auggagggaccagggaagcag

SEQ ID NO: 1051650 - RNA, 22 nt, Human
ggagcaggagucucuugaauuu

SEQ ID NO: 1051651 - RNA, 22 nt, Human
agagaagagucuugucaaauua

SEQ ID NO: 1051652 - RNA, 22 nt, Human
uuagaaagaacuuuagauauca

SEQ ID NO: 1051653 - RNA, 22 nt, Human
auugaaagauaggcuacugugg

SEQ ID NO: 1051654 - RNA, 22 nt, Human
cuguccuggccgcccuugugag

SEQ ID NO: 1051655 - RNA, 22 nt, Human
acucuucuugcugcucauuaau

SEQ ID NO: 1051656 - RNA, 22 nt, Human
uaugauuuguagacauuugauu

SEQ ID NO: 1051657 - RNA, 22 nt, Human
gaguguaguucauuccguccua

SEQ ID NO: 1051658 - RNA, 22 nt, Human
ucccaggauuuuaggcucucag

SEQ ID NO: 1051659 - RNA, 22 nt, Human
ugcugaggagggcacccggggg

SEQ ID NO: 1051660 - RNA, 22 nt, Human
aagauuauuuaagacaggaacc

SEQ ID NO: 1051661 - RNA, 22 nt, Human
agagacagaggcaauauagcuu

SEQ ID NO: 1051662 - RNA, 22 nt, Human
ugugaaggagaugaagggagug

SEQ ID NO: 1051663 - RNA, 22 nt, Human
uauuuuaaagugaagggucuug

SEQ ID NO: 1051664 - RNA, 22 nt, Human
aggcugaggcagguggaucacu

SEQ ID NO: 1051665 - RNA, 22 nt, Human
uuauuucauguaaaauuuaugu

SEQ ID NO: 1051666 - RNA, 22 nt, Human
ggcaagcauaaccuguacagcc

SEQ ID NO: 1051667 - RNA, 22 nt, Human
acuacauuucucaguaccugaa

SEQ ID NO: 1051668 - RNA, 22 nt, Human
gcugagguuuucugccugcuca

SEQ ID NO: 1051669 - RNA, 22 nt, Human
ucaggcugggagacaaucacug

SEQ ID NO: 1051670 - RNA, 22 nt, Human
caggggaguuuuaugcaacaga

SEQ ID NO: 1051671 - RNA, 22 nt, Human
aggagacauaacuaugaugaga

SEQ ID NO: 1051672 - RNA, 22 nt, Human
cccuuagcuccaagggguuugg

SEQ ID NO: 1051673 - RNA, 23 nt, Human
gacaccuuugccagaucaagaug

SEQ ID NO: 1051674 - RNA, 22 nt, Human
augacaguucuacacuuaaucu

SEQ ID NO: 1051675 - RNA, 22 nt, Human
aucuuguuauaagagauaaugg

SEQ ID NO: 1051676 - RNA, 21 nt, Human
uggccaaacuggagcauuuga

SEQ ID NO: 1051677 - RNA, 22 nt, Human
uggcugagcucccuguguguug

SEQ ID NO: 1051678 - RNA, 22 nt, Human
agcaggcuuucaagagucuucu

SEQ ID NO: 1051679 - RNA, 19 nt, Human
ucuaagccucaauguuuuc

SEQ ID NO: 1051680 - RNA, 22 nt, Human
uucauucuuugaaucugaggua

SEQ ID NO: 1051681 - RNA, 22 nt, Human
cauuuguuaaccaguguggauu

SEQ ID NO: 1051682 - RNA, 22 nt, Human
uggcacauagcagguacucagu

SEQ ID NO: 1051683 - RNA, 22 nt, Human
auucacaaaaugauauagauac

SEQ ID NO: 1051684 - RNA, 22 nt, Human
gagaggugaauguggaugccac

SEQ ID NO: 1051685 - RNA, 20 nt, Human
uuggcagcaguuccaaguga

SEQ ID NO: 1051686 - RNA, 22 nt, Human
ucugggaagcugguccuguucu

SEQ ID NO: 1051687 - RNA, 22 nt, Human
uucaggauuauacucucuuccc

SEQ ID NO: 1051688 - RNA, 22 nt, Human
gagcacugagcuggaauuggag

SEQ ID NO: 1051689 - RNA, 22 nt, Human
aggcagacaaggacacaguggg

SEQ ID NO: 1051690 - RNA, 22 nt, Human
ggagcccugcccuaggcagcuc

SEQ ID NO: 1051691 - RNA, 19 nt, Human
ggcagcuugggaagguagc

SEQ ID NO: 1051692 - RNA, 22 nt, Human
cccugagccgcugcuccaaccu

SEQ ID NO: 1051693 - RNA, 22 nt, Human
cuggcagucugccucuucacug

SEQ ID NO: 1051694 - RNA, 20 nt, Human
auuagagcuacauggcuaca

SEQ ID NO: 1051695 - RNA, 20 nt, Human
aggacagcagcugccacuug

SEQ ID NO: 1051696 - RNA, 22 nt, Human
aggaaaacacaguauugaugga

SEQ ID NO: 1051697 - RNA, 22 nt, Human
uaggcugaaaggagaggugaag

SEQ ID NO: 1051698 - RNA, 22 nt, Human
uauguguuugacacccugcaag

SEQ ID NO: 1051699 - RNA, 22 nt, Human
aacuguaagagaauaaaugugu

SEQ ID NO: 1051700 - RNA, 22 nt, Human
ucaggagggugacaggcccugg

SEQ ID NO: 1051701 - RNA, 19 nt, Human
caugcugaccugcuguggu

SEQ ID NO: 1051702 - RNA, 22 nt, Human
uacagagauacucuagaucaaa

SEQ ID NO: 1051703 - RNA, 22 nt, Human
uuuagagcugugcugccacaug

SEQ ID NO: 1051704 - RNA, 22 nt, Human
cccaggaagaggggucaggugu

SEQ ID NO: 1051705 - RNA, 23 nt, Human
agaugaggcuucuccauguuggu

SEQ ID NO: 1051706 - RNA, 22 nt, Human
cuuauuagugucugucugaguu

SEQ ID NO: 1051707 - RNA, 22 nt, Human
cucccaggggaacuaucaagua

SEQ ID NO: 1051708 - RNA, 22 nt, Human
gugcugccugccagcuucuggg

SEQ ID NO: 1051709 - RNA, 22 nt, Human
agugcuguuagguuaauauagu

SEQ ID NO: 1051710 - RNA, 22 nt, Human
auuaggacacauacauguacag

SEQ ID NO: 1051711 - RNA, 19 nt, Human
ucucugcuucucuuggcau

SEQ ID NO: 1051712 - RNA, 22 nt, Human
cuggugguucaggagaauggcu

SEQ ID NO: 1051713 - RNA, 22 nt, Human
gaggagaggggcucccaagagc

SEQ ID NO: 1051714 - RNA, 22 nt, Human
ucuuugaauucaaacuguucaa

SEQ ID NO: 1051715 - RNA, 22 nt, Human
ucuuugcagaauuuaacuuugc

SEQ ID NO: 1051716 - RNA, 22 nt, Human
cugccuggcuaaacucaagucg

SEQ ID NO: 1051717 - RNA, 19 nt, Human
agaggcagucuccaacagg

SEQ ID NO: 1051718 - RNA, 22 nt, Human
aguuugaauugaaaugcagaug

SEQ ID NO: 1051719 - RNA, 22 nt, Human
ugcuguggcaguuuauguauag

SEQ ID NO: 1051720 - RNA, 22 nt, Human
cuuguaauuauaauguacuguu

SEQ ID NO: 1051721 - RNA, 22 nt, Human
uucagaaaucgaguuucauguc

SEQ ID NO: 1051722 - RNA, 22 nt, Human
cgagcaugaugacggcuguggc

SEQ ID NO: 1051723 - RNA, 22 nt, Human
gaagaggaugacaggagccggu

SEQ ID NO: 1051724 - RNA, 22 nt, Human
uucacagaugccugaugugugg

SEQ ID NO: 1051725 - RNA, 22 nt, Human
cagagagagucaaaucuuugcu

SEQ ID NO: 1051726 - RNA, 22 nt, Human
ucuuuccagaggaauuuuuaga

SEQ ID NO: 1051727 - RNA, 22 nt, Human
uauuuuaucugccagaguggag

SEQ ID NO: 1051728 - RNA, 22 nt, Human
cugaacucuuuaugacagcuug

SEQ ID NO: 1051729 - RNA, 23 nt, Human
ccuggcagcaaacgaggagguua

SEQ ID NO: 1051730 - RNA, 22 nt, Human
aggccaaagcaagacccuguaa

SEQ ID NO: 1051731 - RNA, 22 nt, Human
uccaggaggguuuucugccuuc

SEQ ID NO: 1051732 - RNA, 22 nt, Human
ugcugaggcuagaccuggaagu

SEQ ID NO: 1051733 - RNA, 22 nt, Human
aggagagcuggugucuggaauc

SEQ ID NO: 1051734 - RNA, 22 nt, Human
aggguggccaugagggagagau

SEQ ID NO: 1051735 - RNA, 22 nt, Human
gcugccuggagcucagccugcc

SEQ ID NO: 1051736 - RNA, 22 nt, Human
ucaggcuggaaugcaguggggc

SEQ ID NO: 1051737 - RNA, 22 nt, Human
uccuggucuacacugcauuggg

SEQ ID NO: 1051738 - RNA, 23 nt, Human
auuugagaaaguauuuuuaagac

SEQ ID NO: 1051739 - RNA, 22 nt, Human
aucaggauuacacggggaugcu

SEQ ID NO: 1051740 - RNA, 22 nt, Human
cuucaguuaguuucaugugagc

SEQ ID NO: 1051741 - RNA, 23 nt, Human
ugaguucucaucuuggcuucuau

SEQ ID NO: 1051742 - RNA, 22 nt, Human
auggccaagagucgauuugggg

SEQ ID NO: 1051743 - RNA, 18 nt, Human
ugcuuggagcauuuacca

SEQ ID NO: 1051744 - RNA, 22 nt, Human
uggagagguuuaaacaaaaguu

SEQ ID NO: 1051745 - RNA, 22 nt, Human
agggcagcagcuccuccuagcu

SEQ ID NO: 1051746 - RNA, 22 nt, Human
gugucccaggccucuggaauua

SEQ ID NO: 1051747 - RNA, 22 nt, Human
ucugagcccucuuuugcagccc

SEQ ID NO: 1051748 - RNA, 22 nt, Human
gcagagaacccagcagauuggc

SEQ ID NO: 1051749 - RNA, 22 nt, Human
ucccagaguauuagcaauugcu

SEQ ID NO: 1051750 - RNA, 22 nt, Human
auucuagaaggcaaagcaaggg

SEQ ID NO: 1051751 - RNA, 22 nt, Human
uucuucaguuugguaaauguaa

SEQ ID NO: 1051752 - RNA, 22 nt, Human
gcaggagaacaaagcaagcugc

SEQ ID NO: 1051753 - RNA, 22 nt, Human
cacaggcuugucagcaugaggc

SEQ ID NO: 1051754 - RNA, 22 nt, Human
cagucccuaguggagcucacag

SEQ ID NO: 1051755 - RNA, 22 nt, Human
gagccaggggucagcuccgagg

SEQ ID NO: 1051756 - RNA, 22 nt, Human
augcagcugugggcaagaaaug

SEQ ID NO: 1051757 - RNA, 22 nt, Human
uuuaaauuuguguuuagagggu

SEQ ID NO: 1051758 - RNA, 22 nt, Human
gagggcugaaguguuuuaugag

SEQ ID NO: 1051759 - RNA, 22 nt, Human
ugccucagucagcuucccuggg

SEQ ID NO: 1051760 - RNA, 22 nt, Human
aguuauaaucugcuacugauau

SEQ ID NO: 1051761 - RNA, 22 nt, Human
cccaggaaugagcaggcagggg

SEQ ID NO: 1051762 - RNA, 22 nt, Human
aagcugaggcccauggcaaggu

SEQ ID NO: 1051763 - RNA, 22 nt, Human
cuguaacuuagcaugguuacua

SEQ ID NO: 1051764 - RNA, 22 nt, Human
cauucuuauauuuacucauuca

SEQ ID NO: 1051765 - RNA, 22 nt, Human
uggcugaguaaguugugauaug

SEQ ID NO: 1051766 - RNA, 22 nt, Human
cccaggagaauauuuuuggguc

SEQ ID NO: 1051767 - RNA, 22 nt, Human
auuggcaggaaccgaggagggg

SEQ ID NO: 1051768 - RNA, 22 nt, Human
acuggccagguucaaaauacag

SEQ ID NO: 1051769 - RNA, 22 nt, Human
ggaggcugagaaguccaagauc

SEQ ID NO: 1051770 - RNA, 22 nt, Human
auuuggaagcuugaagauuauu

SEQ ID NO: 1051771 - RNA, 22 nt, Human
gaggcugaauggccagaagcca

SEQ ID NO: 1051772 - RNA, 22 nt, Human
caggauagaaaggccauggagu

SEQ ID NO: 1051773 - RNA, 22 nt, Human
uuggaaaauguauuucuagaag

SEQ ID NO: 1051774 - RNA, 22 nt, Human
ucugaggucucaugacuugcau

SEQ ID NO: 1051775 - RNA, 22 nt, Human
aguuauaugugaaaacacguau

SEQ ID NO: 1051776 - RNA, 22 nt, Human
ugaaucauggauaaauagcuua

SEQ ID NO: 1051777 - RNA, 21 nt, Human
agacagaacaacugcucucca

SEQ ID NO: 1051778 - RNA, 22 nt, Human
ugcugugagguugagaaggaag

SEQ ID NO: 1051779 - RNA, 22 nt, Human
cuuauuagaguuguguucuguu

SEQ ID NO: 1051780 - RNA, 21 nt, Human
uaugguaaccagacaagaaug

SEQ ID NO: 1051781 - RNA, 22 nt, Human
uugcuagcugguguaugcauug

SEQ ID NO: 1051782 - RNA, 22 nt, Human
gggcugagugucccaggccgaa

SEQ ID NO: 1051783 - RNA, 20 nt, Human
uuucaagucagcaauucuca

SEQ ID NO: 1051784 - RNA, 22 nt, Human
ucaggcugagaaaaucuggacc

SEQ ID NO: 1051785 - RNA, 22 nt, Human
cagcugcuuuaguuuuccaucc

SEQ ID NO: 1051786 - RNA, 22 nt, Human
cucuucuugucucugguuagaa

SEQ ID NO: 1051787 - RNA, 22 nt, Human
cugccuuugaaaguucuguuga

SEQ ID NO: 1051788 - RNA, 22 nt, Human
caggaugggauguagugggccc

SEQ ID NO: 1051789 - RNA, 22 nt, Human
ggcagcuuguccuggaggaugg

SEQ ID NO: 1051790 - RNA, 22 nt, Human
gcagacaucaagcacaggccca

SEQ ID NO: 1051791 - RNA, 22 nt, Human
gaaacugugaucguguucuggg

SEQ ID NO: 1051792 - RNA, 22 nt, Human
uggcagcugagugcacccccuc

SEQ ID NO: 1051793 - RNA, 22 nt, Human
cuggucaaggagagucucugca

SEQ ID NO: 1051794 - RNA, 22 nt, Human
cacagagcugaaccugggucau

SEQ ID NO: 1051795 - RNA, 22 nt, Human
uaggcugagguugaugccaggg

SEQ ID NO: 1051796 - RNA, 22 nt, Human
uugaaauaucaaguuauuagug

SEQ ID NO: 1051797 - RNA, 22 nt, Human
aaugucugcucuacucaggagg

SEQ ID NO: 1051798 - RNA, 22 nt, Human
uuuagauaaugcucaagcaauu

SEQ ID NO: 1051799 - RNA, 22 nt, Human
acaggcuguacuucuaaucauc

SEQ ID NO: 1051800 - RNA, 22 nt, Human
aagcaccuggguuauaucuuag

SEQ ID NO: 1051801 - RNA, 22 nt, Human
uccuggccuagcucacccugga

SEQ ID NO: 1051802 - RNA, 22 nt, Human
ucuucaucucagauuaacagga

SEQ ID NO: 1051803 - RNA, 22 nt, Human
cccaggaaaugggcucuugccu

SEQ ID NO: 1051804 - RNA, 22 nt, Human
uaacauuagguagacauaagcc

SEQ ID NO: 1051805 - RNA, 22 nt, Human
ugaggcucuaugugguagauua

SEQ ID NO: 1051806 - RNA, 19 nt, Human
ucugagguggaacuggggg

SEQ ID NO: 1051807 - RNA, 22 nt, Human
aggaguggugcaggaccugcca

SEQ ID NO: 1051808 - RNA, 22 nt, Human
caaauaguaugagcaaugauuc

SEQ ID NO: 1051809 - RNA, 18 nt, Human
acugugugaauuagcucc

SEQ ID NO: 1051810 - RNA, 22 nt, Human
ucuggccagaaagacuugaugu

SEQ ID NO: 1051811 - RNA, 22 nt, Human
ccuccuggcccugggccuggaa

SEQ ID NO: 1051812 - RNA, 22 nt, Human
caggaaagggaugggcugccac

SEQ ID NO: 1051813 - RNA, 22 nt, Human
gcucaggagcucuugguggcgc

SEQ ID NO: 1051814 - RNA, 22 nt, Human
cacugguacacugaauggcguu

SEQ ID NO: 1051815 - RNA, 22 nt, Human
ucucaggaauagaguggcagca

SEQ ID NO: 1051816 - RNA, 22 nt, Human
uuggccaaggaaguagcaacgg

SEQ ID NO: 1051817 - RNA, 22 nt, Human
gaggagcugggcugagaggguc

SEQ ID NO: 1051818 - RNA, 18 nt, Human
ccagguggugacagagau

SEQ ID NO: 1051819 - RNA, 22 nt, Human
cagcaagagacuguucucuaag

SEQ ID NO: 1051820 - RNA, 22 nt, Human
uuuauuauccaguguugucaug

SEQ ID NO: 1051821 - RNA, 22 nt, Human
ugguaacacaggcauuaaaguu

SEQ ID NO: 1051822 - RNA, 22 nt, Human
ucaggcugcaucuguaagggug

SEQ ID NO: 1051823 - RNA, 22 nt, Human
caggcagcauuuacucugauga

SEQ ID NO: 1051824 - RNA, 22 nt, Human
gaggucagucagaccaggguuu

SEQ ID NO: 1051825 - RNA, 22 nt, Human
caggcugcggucggcucugguc

SEQ ID NO: 1051826 - RNA, 22 nt, Human
cccuugcacauuugucuuuaau

SEQ ID NO: 1051827 - RNA, 22 nt, Human
uggaggaaguggcuggccagaa

SEQ ID NO: 1051828 - RNA, 22 nt, Human
augaggucaucuugaaguaggg

SEQ ID NO: 1051829 - RNA, 22 nt, Human
cugcugugcaacauugcaccua

SEQ ID NO: 1051830 - RNA, 23 nt, Human
gaggcacucaggaaaugugagug

SEQ ID NO: 1051831 - RNA, 22 nt, Human
uggcuucucaaaauaacugguu

SEQ ID NO: 1051832 - RNA, 22 nt, Human
uggcugagccuuuggggcuuuc

SEQ ID NO: 1051833 - RNA, 22 nt, Human
uuuggacuuagccugcagaauu

SEQ ID NO: 1051834 - RNA, 22 nt, Human
ucacaaauagcuauauuaagga

SEQ ID NO: 1051835 - RNA, 23 nt, Human
ugucuggcucauggugggucuca

SEQ ID NO: 1051836 - RNA, 22 nt, Human
cauuuaguuuugcaguagcagg

SEQ ID NO: 1051837 - RNA, 22 nt, Human
acucuuuacuuaaacucuaagu

SEQ ID NO: 1051838 - RNA, 22 nt, Human
uucauacauuuuuacuaacagc

SEQ ID NO: 1051839 - RNA, 22 nt, Human
aaauugcauuuuaaagguagau

SEQ ID NO: 1051840 - RNA, 15 nt, Human
cuccaugauuuugca

SEQ ID NO: 1051841 - RNA, 22 nt, Human
caggagaggaggcuacuucuua

SEQ ID NO: 1051842 - RNA, 22 nt, Human
gggcugagagugacuguucugu

SEQ ID NO: 1051843 - RNA, 22 nt, Human
uuagagccaguuacaaggucaa

SEQ ID NO: 1051844 - RNA, 22 nt, Human
acaugauuuuaguaucauaaua

SEQ ID NO: 1051845 - RNA, 22 nt, Human
cauuuguaggaugcuucuuguu

SEQ ID NO: 1051846 - RNA, 22 nt, Human
cuggccaagcuucucuaagcag

SEQ ID NO: 1051847 - RNA, 22 nt, Human
ggcugcagauuguagucuguua

SEQ ID NO: 1051848 - RNA, 22 nt, Human
gcugagagcaaggacaaagcau

SEQ ID NO: 1051849 - RNA, 22 nt, Human
augccuggacuguaucccagau

SEQ ID NO: 1051850 - RNA, 22 nt, Human
cagcagagaaauuaaacuucug

SEQ ID NO: 1051851 - RNA, 22 nt, Human
ccacugcuaacuugcugcagcu

SEQ ID NO: 1051852 - RNA, 22 nt, Human
agcugcccagauaggaggaggc

SEQ ID NO: 1051853 - RNA, 22 nt, Human
ucugcuguauuagguugaacug

SEQ ID NO: 1051854 - RNA, 22 nt, Human
uuuaucuuuaggacuuugcaga

SEQ ID NO: 1051855 - RNA, 22 nt, Human
aagaacugaguacguuaauaaa

SEQ ID NO: 1051856 - RNA, 22 nt, Human
augguacaaaauguauaaaguc

SEQ ID NO: 1051857 - RNA, 22 nt, Human
ccagagagaaauggauuugagu

SEQ ID NO: 1051858 - RNA, 22 nt, Human
ucagucucuggggcuucuguuu

SEQ ID NO: 1051859 - RNA, 22 nt, Human
gaaauuaagcaggggucugugg

SEQ ID NO: 1051860 - RNA, 22 nt, Human
ucucaguuuccucauauguaaa

SEQ ID NO: 1051861 - RNA, 22 nt, Human
aguucuucauaaccuuacugug

SEQ ID NO: 1051862 - RNA, 22 nt, Human
uucuccagaccuugugacuaug

SEQ ID NO: 1051863 - RNA, 22 nt, Human
gugcauuuaggucacaugaugu

SEQ ID NO: 1051864 - RNA, 22 nt, Human
acaguaacaccuacucuguccc

SEQ ID NO: 1051865 - RNA, 22 nt, Human
ccccuuccacagugcuuccuaa

SEQ ID NO: 1051866 - RNA, 23 nt, Human
guuaauaaugaacacuuucuccc

SEQ ID NO: 1051867 - RNA, 22 nt, Human
ggcgagggagcagugcgguggg

SEQ ID NO: 1051868 - RNA, 22 nt, Human
gcugagguggugaugguucauc

SEQ ID NO: 1051869 - RNA, 19 nt, Human
uagggcuggccgggcggug

SEQ ID NO: 1051870 - RNA, 21 nt, Human
agccugaaucccaccaguuca

SEQ ID NO: 1051871 - RNA, 22 nt, Human
gugcuuuuaaaggcaauuagua

SEQ ID NO: 1051872 - RNA, 22 nt, Human
uggcugaguucuccaggaguag

SEQ ID NO: 1051873 - RNA, 22 nt, Human
aguauugugacucaaguauucu

SEQ ID NO: 1051874 - RNA, 22 nt, Human
uauuggcagcaugagcuccugg

SEQ ID NO: 1051875 - RNA, 22 nt, Human
uggccaguagagcucagauagu

SEQ ID NO: 1051876 - RNA, 22 nt, Human
caggaaaggugugucaugaugg

SEQ ID NO: 1051877 - RNA, 22 nt, Human
cauuuccagcuccugcaucaug

SEQ ID NO: 1051878 - RNA, 22 nt, Human
uauuucagguauggugugaaau

SEQ ID NO: 1051879 - RNA, 22 nt, Human
ucugccucgcuaacagcagcca

SEQ ID NO: 1051880 - RNA, 22 nt, Human
guaaucguggugguuaauucca

SEQ ID NO: 1051881 - RNA, 22 nt, Human
uucuucaaaacaacacuggccu

SEQ ID NO: 1051882 - RNA, 23 nt, Human
acauacauggagauaaagugaug

SEQ ID NO: 1051883 - RNA, 22 nt, Human
uuuaacauguucaagaaacaua

SEQ ID NO: 1051884 - RNA, 22 nt, Human
uggcagacacugucgaagccua

SEQ ID NO: 1051885 - RNA, 22 nt, Human
cccaggagaauauaauguucuu

SEQ ID NO: 1051886 - RNA, 22 nt, Human
uuugaaagaaaccagugaguga

SEQ ID NO: 1051887 - RNA, 22 nt, Human
caaaugaauuucccugcaaaug

SEQ ID NO: 1051888 - RNA, 22 nt, Human
agggucugcauuccaacuuggg

SEQ ID NO: 1051889 - RNA, 22 nt, Human
ugaaaugacaaagguuuuucuu

SEQ ID NO: 1051890 - RNA, 22 nt, Human
acccaggaggcaagguugcagu

SEQ ID NO: 1051891 - RNA, 22 nt, Human
ccaggcugggcggggaaccugg

SEQ ID NO: 1051892 - RNA, 22 nt, Human
aggcagcuagagagugaaacug

SEQ ID NO: 1051893 - RNA, 22 nt, Human
aggcagcuuucagugucucuca

SEQ ID NO: 1051894 - RNA, 22 nt, Human
agccuauuccaggaugagcuca

SEQ ID NO: 1051895 - RNA, 22 nt, Human
gacagcuguggagaggcaugug

SEQ ID NO: 1051896 - RNA, 21 nt, Human
cccacggaaugaugaggcacu

SEQ ID NO: 1051897 - RNA, 23 nt, Human
acacuuucaaauaugcacagagc

SEQ ID NO: 1051898 - RNA, 18 nt, Human
aagaaguuggccaaagag

SEQ ID NO: 1051899 - RNA, 22 nt, Human
uuacuggcugggccugagggcu

SEQ ID NO: 1051900 - RNA, 22 nt, Human
cuucuucaaccugaaaguuuca

SEQ ID NO: 1051901 - RNA, 22 nt, Human
gacagguggggaaacuaaggua

SEQ ID NO: 1051902 - RNA, 22 nt, Human
uugauuucuauucagauguaga

SEQ ID NO: 1051903 - RNA, 22 nt, Human
cauuuauuggcauguaguaggu

SEQ ID NO: 1051904 - RNA, 22 nt, Human
cuuagaaaucgaacucagguua

SEQ ID NO: 1051905 - RNA, 22 nt, Human
aaauuagucgguuuaggaauuu

SEQ ID NO: 1051906 - RNA, 22 nt, Human
uucucuuugacauuauucaggu

SEQ ID NO: 1051907 - RNA, 22 nt, Human
auuucagaugaccaaauggaaa

SEQ ID NO: 1051908 - RNA, 22 nt, Human
gcaggagagccagcaggcuucc

SEQ ID NO: 1051909 - RNA, 22 nt, Human
cuggcacaaugucacuuuugcu

SEQ ID NO: 1051910 - RNA, 22 nt, Human
uugaggucuggcaguagcguug

SEQ ID NO: 1051911 - RNA, 22 nt, Human
agcuggcagucauccuagugag

SEQ ID NO: 1051912 - RNA, 22 nt, Human
aaguaagucuuacauucacauu

SEQ ID NO: 1051913 - RNA, 22 nt, Human
uuugaauguuuuagguacuuaa

SEQ ID NO: 1051914 - RNA, 22 nt, Human
ggcacagagcccagcuuccuag

SEQ ID NO: 1051915 - RNA, 22 nt, Human
ucagauggcacacagagccugc

SEQ ID NO: 1051916 - RNA, 22 nt, Human
gcccaggaagccaccgggaagu

SEQ ID NO: 1051917 - RNA, 22 nt, Human
auccagucaaaauuaguaaggu

SEQ ID NO: 1051918 - RNA, 22 nt, Human
uggcagcuuccugcucauagga

SEQ ID NO: 1051919 - RNA, 22 nt, Human
uuacacuuuugacaaaccugag

SEQ ID NO: 1051920 - RNA, 22 nt, Human
uccaugucuucaugugucuaac

SEQ ID NO: 1051921 - RNA, 22 nt, Human
augaguucccaggugauuugug

SEQ ID NO: 1051922 - RNA, 20 nt, Human
agcugaggcaccugagguua

SEQ ID NO: 1051923 - RNA, 22 nt, Human
uggaggccuagguugaugugug

SEQ ID NO: 1051924 - RNA, 22 nt, Human
guggcaggagacuggaagaugg

SEQ ID NO: 1051925 - RNA, 22 nt, Human
uucuaauuaaaucuacgcuagg

SEQ ID NO: 1051926 - RNA, 22 nt, Human
gcuucccagcagaggaaagacu

SEQ ID NO: 1051927 - RNA, 22 nt, Human
ggcagucacaggggagacuggg

SEQ ID NO: 1051928 - RNA, 22 nt, Human
uuuugaauaauucagaaacagc

SEQ ID NO: 1051929 - RNA, 22 nt, Human
cagagggaaaaggggaguaaua

SEQ ID NO: 1051930 - RNA, 22 nt, Human
ucaggaugguguggaggaaaua

SEQ ID NO: 1051931 - RNA, 22 nt, Human
cauuuguaucauauguaucuua

SEQ ID NO: 1051932 - RNA, 22 nt, Human
acuggcagccacaacuggcagg

SEQ ID NO: 1051933 - RNA, 22 nt, Human
uggcuucucagaauacucugga

SEQ ID NO: 1051934 - RNA, 22 nt, Human
agugcuuugguauagaacuauu

SEQ ID NO: 1051935 - RNA, 22 nt, Human
cacugguauuugaaaauagaug

SEQ ID NO: 1051936 - RNA, 19 nt, Human
ugcugcuguccuugcaggg

SEQ ID NO: 1051937 - RNA, 22 nt, Human
auuaggauguguauauuguguu

SEQ ID NO: 1051938 - RNA, 22 nt, Human
acaucugauuacaugagaauau

SEQ ID NO: 1051939 - RNA, 17 nt, Human
gucauucucagaaaaug

SEQ ID NO: 1051940 - RNA, 21 nt, Human
cugcuguggcccccgacaugc

SEQ ID NO: 1051941 - RNA, 18 nt, Human
gcuccugguuggaaagaa

SEQ ID NO: 1051942 - RNA, 22 nt, Human
cccagggauguggcagauguua

SEQ ID NO: 1051943 - RNA, 17 nt, Human
uaaauacacaaggguau

SEQ ID NO: 1051944 - RNA, 22 nt, Human
uccaggagggggagccgugccg

SEQ ID NO: 1051945 - RNA, 22 nt, Human
uaacuguagcuaaccgaugaga

SEQ ID NO: 1051946 - RNA, 22 nt, Human
aggcuggagugugcaguggcgc

SEQ ID NO: 1051947 - RNA, 22 nt, Human
uuugaaauaugaggcauuauga

SEQ ID NO: 1051948 - RNA, 23 nt, Human
ucucaguuccagaggcuacaagu

SEQ ID NO: 1051949 - RNA, 22 nt, Human
uggcucaagugauccuccugcc

SEQ ID NO: 1051950 - RNA, 22 nt, Human
auuaaauuggaucugcauaguu

SEQ ID NO: 1051951 - RNA, 22 nt, Human
ggacaagccugugaguggguuu

SEQ ID NO: 1051952 - RNA, 22 nt, Human
aaagauuauggcauugaaauac

SEQ ID NO: 1051953 - RNA, 22 nt, Human
gcugccuguugaagggucugug

SEQ ID NO: 1051954 - RNA, 22 nt, Human
acagcuaacuuaaacuaaccua

SEQ ID NO: 1051955 - RNA, 23 nt, Human
acuuuauugaccccaggucaguu

SEQ ID NO: 1051956 - RNA, 22 nt, Human
agggagcucacaguccaguaga

SEQ ID NO: 1051957 - RNA, 19 nt, Human
cuucuggcccugagccacc

SEQ ID NO: 1051958 - RNA, 22 nt, Human
uucugagccucauucaugaggc

SEQ ID NO: 1051959 - RNA, 23 nt, Human
ucuccuggcugcacuguggccac

SEQ ID NO: 1051960 - RNA, 22 nt, Human
auuaagaucauuguagaagauu

SEQ ID NO: 1051961 - RNA, 22 nt, Human
augcuuuuccaggagaaauaua

SEQ ID NO: 1051962 - RNA, 22 nt, Human
uggcacaaaucuagucccuggu

SEQ ID NO: 1051963 - RNA, 22 nt, Human
acaccuuuuauucgccaggcac

SEQ ID NO: 1051964 - RNA, 22 nt, Human
ugcuggaauaauuucauguuaa

SEQ ID NO: 1051965 - RNA, 22 nt, Human
cuccaggaaaauagggaaugag

SEQ ID NO: 1051966 - RNA, 22 nt, Human
ggaggggagauguuugggcuca

SEQ ID NO: 1051967 - RNA, 22 nt, Human
gaacuggucaguuuagcccacu

SEQ ID NO: 1051968 - RNA, 22 nt, Human
ccaggagacuguacugauauuu

SEQ ID NO: 1051969 - RNA, 22 nt, Human
acauguuuggcucuaugcuaua

SEQ ID NO: 1051970 - RNA, 22 nt, Human
gggagcugaauggcaauggaga

SEQ ID NO: 1051971 - RNA, 22 nt, Human
auuauucuuaugucaucauggc

SEQ ID NO: 1051972 - RNA, 22 nt, Human
auuuguagugaagugaaaauaa

SEQ ID NO: 1051973 - RNA, 22 nt, Human
aagggaggaggauuuauuguac

SEQ ID NO: 1051974 - RNA, 22 nt, Human
uuucaguuguccuguuaauagc

SEQ ID NO: 1051975 - RNA, 22 nt, Human
auacaucuaugccuuucugaca

SEQ ID NO: 1051976 - RNA, 22 nt, Human
gaggcaguguuuacugcccugu

SEQ ID NO: 1051977 - RNA, 22 nt, Human
uuuccagguauuaauacuguau

SEQ ID NO: 1051978 - RNA, 22 nt, Human
cacaggcugcccgcagcuggga

SEQ ID NO: 1051979 - RNA, 22 nt, Human
agggagcugagcugugagcagc

SEQ ID NO: 1051980 - RNA, 22 nt, Human
ggaguaggaguagaacucauca

SEQ ID NO: 1051981 - RNA, 22 nt, Human
aaauauaauuucugccucaaua

SEQ ID NO: 1051982 - RNA, 19 nt, Human
agggccugcagcucaagcu

SEQ ID NO: 1051983 - RNA, 22 nt, Human
uuacaagcagcuacauaucaca

SEQ ID NO: 1051984 - RNA, 22 nt, Human
uuugaacuucuaccugucauau

SEQ ID NO: 1051985 - RNA, 22 nt, Human
uauuagagaaaagauggaugug

SEQ ID NO: 1051986 - RNA, 22 nt, Human
cuugaacucaaugugaggaaga

SEQ ID NO: 1051987 - RNA, 22 nt, Human
ccugcucagagcgucuugugug

SEQ ID NO: 1051988 - RNA, 22 nt, Human
agugcuuugagcguuugaaaag

SEQ ID NO: 1051989 - RNA, 22 nt, Human
gucuucuuguguugccugucuu

SEQ ID NO: 1051990 - RNA, 22 nt, Human
gaaacuguauguaguuuuuggg

SEQ ID NO: 1051991 - RNA, 22 nt, Human
agaaaacugggaggagagcuuc

SEQ ID NO: 1051992 - RNA, 22 nt, Human
uacaugaauguuucaauauugu

SEQ ID NO: 1051993 - RNA, 22 nt, Human
gauggcagucaaccaggugagg

SEQ ID NO: 1051994 - RNA, 22 nt, Human
aucaggauucaccccagagcug

SEQ ID NO: 1051995 - RNA, 22 nt, Human
uaaugucaaggugauagauuug

SEQ ID NO: 1051996 - RNA, 22 nt, Human
cccaggaggcagagguuggagc

SEQ ID NO: 1051997 - RNA, 20 nt, Human
gaugggaaucggagcuggua

SEQ ID NO: 1051998 - RNA, 22 nt, Human
gcucaggaaaacagucuaguaa

SEQ ID NO: 1051999 - RNA, 22 nt, Human
uccauucauucauugaugaaca

SEQ ID NO: 1052000 - RNA, 22 nt, Human
cccuccucucccuaagagucac

SEQ ID NO: 1052001 - RNA, 22 nt, Human
aaaauuauagaucuagugccug

SEQ ID NO: 1052002 - RNA, 22 nt, Human
cucccaggguagggagagacua

SEQ ID NO: 1052003 - RNA, 22 nt, Human
aucaggaucacagaaacuuuua

SEQ ID NO: 1052004 - RNA, 22 nt, Human
cagcuggccaaucagggcgccc

SEQ ID NO: 1052005 - RNA, 22 nt, Human
ucuccuggucaccucagaaguc

SEQ ID NO: 1052006 - RNA, 22 nt, Human
acagugugguuugagcacuggg

SEQ ID NO: 1052007 - RNA, 22 nt, Human
uguuuauuacaguucuuggaau

SEQ ID NO: 1052008 - RNA, 22 nt, Human
uggcagaguucgcugugccuuu

SEQ ID NO: 1052009 - RNA, 22 nt, Human
uuaggcauuggaaggucagcuu

SEQ ID NO: 1052010 - RNA, 22 nt, Human
gcagcugagagaagaacagggc

SEQ ID NO: 1052011 - RNA, 17 nt, Human
ggcagccucaggcguuu

SEQ ID NO: 1052012 - RNA, 22 nt, Human
ccuggccagcagccccuuccuc

SEQ ID NO: 1052013 - RNA, 17 nt, Human
cccacggaggugugaaa

SEQ ID NO: 1052014 - RNA, 22 nt, Human
aggcuguggcccuggucuagca

SEQ ID NO: 1052015 - RNA, 22 nt, Human
ucaggcuggggugcuaaggugu

SEQ ID NO: 1052016 - RNA, 22 nt, Human
gcagcugaauguccauugcugc

SEQ ID NO: 1052017 - RNA, 22 nt, Human
agccacagcauguguguaugua

SEQ ID NO: 1052018 - RNA, 19 nt, Human
uggagaggaaaugcugcuc

SEQ ID NO: 1052019 - RNA, 22 nt, Human
uuauuaggaacucaggauuuuu

SEQ ID NO: 1052020 - RNA, 22 nt, Human
uucucacuauguauguagauug

SEQ ID NO: 1052021 - RNA, 22 nt, Human
aagagagggguugcauggaaau

SEQ ID NO: 1052022 - RNA, 22 nt, Human
ggcagcucugcuccacaugagu

SEQ ID NO: 1052023 - RNA, 22 nt, Human
ggcugcuggccagccuaggagu

SEQ ID NO: 1052024 - RNA, 22 nt, Human
ugcugcaggcagccccucuacu

SEQ ID NO: 1052025 - RNA, 22 nt, Human
ccaggagauuuuuccauagcac

SEQ ID NO: 1052026 - RNA, 22 nt, Human
cccaggaggacauuccauaccc

SEQ ID NO: 1052027 - RNA, 22 nt, Human
auucuuaauugccaugcuguau

SEQ ID NO: 1052028 - RNA, 22 nt, Human
cauuucacaaauggccacauca

SEQ ID NO: 1052029 - RNA, 22 nt, Human
caaaucuauauguugauauucu

SEQ ID NO: 1052030 - RNA, 22 nt, Human
gaaaugaaauagcaccaagguu

SEQ ID NO: 1052031 - RNA, 22 nt, Human
gaggagcuggcugucgggaggc

SEQ ID NO: 1052032 - RNA, 21 nt, Human
ggcugagauggcagaaucacc

SEQ ID NO: 1052033 - RNA, 20 nt, Human
uauuuguauuugggaaaguu

SEQ ID NO: 1052034 - RNA, 22 nt, Human
cuagcaucagaugagaagcugu

SEQ ID NO: 1052035 - RNA, 22 nt, Human
cagcucccgccaucgggaggca

SEQ ID NO: 1052036 - RNA, 22 nt, Human
caggcugccaaggcuggggagg

SEQ ID NO: 1052037 - RNA, 22 nt, Human
ucauuuaauaauuuuugaguag

SEQ ID NO: 1052038 - RNA, 22 nt, Human
uaauuauaacaugcuuucuggc

SEQ ID NO: 1052039 - RNA, 17 nt, Human
uagcuguguuucagcua

SEQ ID NO: 1052040 - RNA, 22 nt, Human
ccugggcaggccggacgcuggg

SEQ ID NO: 1052041 - RNA, 22 nt, Human
gggauggggagcuggaaagggg

SEQ ID NO: 1052042 - RNA, 22 nt, Human
aggcagcuaagauggauaauga

SEQ ID NO: 1052043 - RNA, 22 nt, Human
ggcagcuaggggcagggaauuc

SEQ ID NO: 1052044 - RNA, 22 nt, Human
cugcuuugggcagcuuuguggc

SEQ ID NO: 1052045 - RNA, 22 nt, Human
acauguuuaaguuuguuauaug

SEQ ID NO: 1052046 - RNA, 20 nt, Human
cugcugugauucccuccucc

SEQ ID NO: 1052047 - RNA, 22 nt, Human
aggccagcacgacagccgcagg

SEQ ID NO: 1052048 - RNA, 22 nt, Human
ugccuguguccccuucuuggca

SEQ ID NO: 1052049 - RNA, 22 nt, Human
cugcuguggugucaagcaucuc

SEQ ID NO: 1052050 - RNA, 23 nt, Human
uggccacagggugcuccauugua

SEQ ID NO: 1052051 - RNA, 22 nt, Human
acugugugacuguuauuacugu

SEQ ID NO: 1052052 - RNA, 22 nt, Human
gcugccuggaauaacggcuggc

SEQ ID NO: 1052053 - RNA, 22 nt, Human
cccaggagguggaguucacagu

SEQ ID NO: 1052054 - RNA, 22 nt, Human
ggagaaaggcauagcagaaccu

SEQ ID NO: 1052055 - RNA, 22 nt, Human
guggccaagaggggacuggaua

SEQ ID NO: 1052056 - RNA, 22 nt, Human
uaacuggugaguaggauuuaua

SEQ ID NO: 1052057 - RNA, 23 nt, Human
uacaugcuauaauuucacccuca

SEQ ID NO: 1052058 - RNA, 22 nt, Human
cugccuuugcccuugacacugu

SEQ ID NO: 1052059 - RNA, 22 nt, Human
ugaaggcugggcucagccagcu

SEQ ID NO: 1052060 - RNA, 22 nt, Human
ucauuguuucugcuuuucauga

SEQ ID NO: 1052061 - RNA, 22 nt, Human
uagaaaagauaacauucugugc

SEQ ID NO: 1052062 - RNA, 22 nt, Human
ccacaucucgguccccucuuug

SEQ ID NO: 1052063 - RNA, 22 nt, Human
uugagguccccaguacccacug

SEQ ID NO: 1052064 - RNA, 22 nt, Human
aauggccagcaacaggagugaa

SEQ ID NO: 1052065 - RNA, 22 nt, Human
gggcugagcuguucugaguuua

SEQ ID NO: 1052066 - RNA, 22 nt, Human
aggugcuguuugucagcaguuu

SEQ ID NO: 1052067 - RNA, 21 nt, Human
uaauaauuccacuacagagua

SEQ ID NO: 1052068 - RNA, 22 nt, Human
acacaaauuguaggauaauugc

SEQ ID NO: 1052069 - RNA, 22 nt, Human
gaaauacagaaagggcugaaug

SEQ ID NO: 1052070 - RNA, 22 nt, Human
cuugcaggauuuugcugcugua

SEQ ID NO: 1052071 - RNA, 21 nt, Human
uuuauuuauauaggacacaug

SEQ ID NO: 1052072 - RNA, 22 nt, Human
uugaggucuucagcugacaccu

SEQ ID NO: 1052073 - RNA, 22 nt, Human
aaaggagacuucagaucuccuu

SEQ ID NO: 1052074 - RNA, 22 nt, Human
cagcaagauuaagggcagaaaa

SEQ ID NO: 1052075 - RNA, 22 nt, Human
auuuauuauugugguuacuucu

SEQ ID NO: 1052076 - RNA, 22 nt, Human
accaggagucuagccuagucaa

SEQ ID NO: 1052077 - RNA, 22 nt, Human
ucugagccagccaccuccuuca

SEQ ID NO: 1052078 - RNA, 22 nt, Human
cugcuaaaccucucugagagcu

SEQ ID NO: 1052079 - RNA, 22 nt, Human
uucacagacuuuccauagauug

SEQ ID NO: 1052080 - RNA, 22 nt, Human
ugaggcucagagaagugcuguu

SEQ ID NO: 1052081 - RNA, 22 nt, Human
gauguguuuccaggauuuguuu

SEQ ID NO: 1052082 - RNA, 22 nt, Human
ggaggacacuggcucugccuuc

SEQ ID NO: 1052083 - RNA, 22 nt, Human
ucaauucugguccucaggaacu

SEQ ID NO: 1052084 - RNA, 22 nt, Human
uaucuagauaccaagaagcaca

SEQ ID NO: 1052085 - RNA, 22 nt, Human
uggcagcuauuacaaggaaguc

SEQ ID NO: 1052086 - RNA, 22 nt, Human
uucuucuuucccccugugguac

SEQ ID NO: 1052087 - RNA, 22 nt, Human
gcugccuguggcccuucugggu

SEQ ID NO: 1052088 - RNA, 22 nt, Human
cuggagagaauguggaaugauu

SEQ ID NO: 1052089 - RNA, 22 nt, Human
ggaggcaggaaagacagguuca

SEQ ID NO: 1052090 - RNA, 17 nt, Human
uucucugagcuguauug

SEQ ID NO: 1052091 - RNA, 22 nt, Human
gcccagggcuucaaagagagaa

SEQ ID NO: 1052092 - RNA, 20 nt, Human
guauuagguguuccucuuuc

SEQ ID NO: 1052093 - RNA, 22 nt, Human
aaagcagauucugaugcaguag

SEQ ID NO: 1052094 - RNA, 19 nt, Human
acccagagcccuuugcagg

SEQ ID NO: 1052095 - RNA, 22 nt, Human
uggcagcacaagguggcccaug

SEQ ID NO: 1052096 - RNA, 22 nt, Human
gcugcagggagcuggaaggcuc

SEQ ID NO: 1052097 - RNA, 22 nt, Human
ugcuguguucuccugacucacc

SEQ ID NO: 1052098 - RNA, 22 nt, Human
ggcagcuguaagaugagugaau

SEQ ID NO: 1052099 - RNA, 22 nt, Human
agaagcagcuuucaaggugauu

SEQ ID NO: 1052100 - RNA, 22 nt, Human
aauacaguaauuuugaugaguu

SEQ ID NO: 1052101 - RNA, 23 nt, Human
uucuucucaauuaguugauucag

SEQ ID NO: 1052102 - RNA, 22 nt, Human
ggugguggagccagcugggagu

SEQ ID NO: 1052103 - RNA, 22 nt, Human
cagagacauccauguuaguugg

SEQ ID NO: 1052104 - RNA, 22 nt, Human
uuugcauaagucauguccagug

SEQ ID NO: 1052105 - RNA, 22 nt, Human
caauaagauguauugagcagag

SEQ ID NO: 1052106 - RNA, 21 nt, Human
aucauucuggaaaauucaagc

SEQ ID NO: 1052107 - RNA, 18 nt, Human
uuuaugagcugugggacc

SEQ ID NO: 1052108 - RNA, 18 nt, Human
ucaggcugcccugugucu

SEQ ID NO: 1052109 - RNA, 22 nt, Human
gcugaggcggaaggauugcuag

SEQ ID NO: 1052110 - RNA, 22 nt, Human
ucucacuggguauaaaugagua

SEQ ID NO: 1052111 - RNA, 22 nt, Human
gcuggcagggacagcugcgugu

SEQ ID NO: 1052112 - RNA, 22 nt, Human
cugagggcccugaagcuuggca

SEQ ID NO: 1052113 - RNA, 22 nt, Human
agguaggggguuugggaacugc

SEQ ID NO: 1052114 - RNA, 22 nt, Human
cagggcugaaaucaagguguag

SEQ ID NO: 1052115 - RNA, 22 nt, Human
ggguacuuaauauuuacggggu

SEQ ID NO: 1052116 - RNA, 19 nt, Human
gcuccugggccucacucau

SEQ ID NO: 1052117 - RNA, 22 nt, Human
aagggcugagaaguggggcugg

SEQ ID NO: 1052118 - RNA, 22 nt, Human
ccagagcugcauccagcagguu

SEQ ID NO: 1052119 - RNA, 22 nt, Human
aggcagcuuucuguaggggugu

SEQ ID NO: 1052120 - RNA, 22 nt, Human
uuugaaagccuggcuuuucucu

SEQ ID NO: 1052121 - RNA, 22 nt, Human
aguguugcaugaggcaguacca

SEQ ID NO: 1052122 - RNA, 22 nt, Human
aucugccugcaguggagguggg

SEQ ID NO: 1052123 - RNA, 22 nt, Human
cagcaagacaaggaacaaacug

SEQ ID NO: 1052124 - RNA, 22 nt, Human
gucuucaauagagccucaauuu

SEQ ID NO: 1052125 - RNA, 22 nt, Human
uuauacaguuuauacuuagaau

SEQ ID NO: 1052126 - RNA, 22 nt, Human
ugaaaugagcauuuauucuuua

SEQ ID NO: 1052127 - RNA, 22 nt, Human
cucaguuucuuacucuguauaa

SEQ ID NO: 1052128 - RNA, 22 nt, Human
uagggcugcugcagaugacagg

SEQ ID NO: 1052129 - RNA, 22 nt, Human
uauuuguugaguuguuaugucu

SEQ ID NO: 1052130 - RNA, 22 nt, Human
cccagaaggucgaggcugcagu

SEQ ID NO: 1052131 - RNA, 22 nt, Human
cccaggaggucgaagcugcagu

SEQ ID NO: 1052132 - RNA, 22 nt, Human
gggcagcugccaagugcaucgc

SEQ ID NO: 1052133 - RNA, 22 nt, Human
uuugacaaaggaaaaaugcaca

SEQ ID NO: 1052134 - RNA, 22 nt, Human
cagggcugaggacacaaguaaa

SEQ ID NO: 1052135 - RNA, 22 nt, Human
ucucagaguuuagagcugagcc

SEQ ID NO: 1052136 - RNA, 22 nt, Human
ugaaagguuauuuaggucugcu

SEQ ID NO: 1052137 - RNA, 22 nt, Human
uccaggagagguagaggguucc

SEQ ID NO: 1052138 - RNA, 22 nt, Human
gccagguggagguugcagugag

SEQ ID NO: 1052139 - RNA, 22 nt, Human
uucaauucuaaacuaauauucu

SEQ ID NO: 1052140 - RNA, 18 nt, Human
gccugccuagagcuugcc

SEQ ID NO: 1052141 - RNA, 22 nt, Human
uuuauuaauguagcauccaugg

SEQ ID NO: 1052142 - RNA, 22 nt, Human
uguucucacuggaugcuucaca

SEQ ID NO: 1052143 - RNA, 22 nt, Human
uugaaggacauccuauuucuag

SEQ ID NO: 1052144 - RNA, 20 nt, Human
gaggcccagagaggugaagc

SEQ ID NO: 1052145 - RNA, 22 nt, Human
ucucuucucuagugagcaacug

SEQ ID NO: 1052146 - RNA, 22 nt, Human
aauacauauggaauuccauguu

SEQ ID NO: 1052147 - RNA, 22 nt, Human
uguugauuaguguuuagacuua

SEQ ID NO: 1052148 - RNA, 22 nt, Human
gcacagcucgagcucaggaggg

SEQ ID NO: 1052149 - RNA, 22 nt, Human
uaggcugggagccugaggcuag

SEQ ID NO: 1052150 - RNA, 22 nt, Human
ggagaggacauggcucccacag

SEQ ID NO: 1052151 - RNA, 18 nt, Human
ggcaucugcacagcagcc

SEQ ID NO: 1052152 - RNA, 22 nt, Human
aagacugugucuauggcuacuc

SEQ ID NO: 1052153 - RNA, 22 nt, Human
guugaaaguagaugcuauuugg

SEQ ID NO: 1052154 - RNA, 22 nt, Human
ugagaugcuaaagggcugcuca

SEQ ID NO: 1052155 - RNA, 22 nt, Human
uuugaaagcaccauuugaguag

SEQ ID NO: 1052156 - RNA, 22 nt, Human
auucaaguccagcuucucuaca

SEQ ID NO: 1052157 - RNA, 22 nt, Human
uuuagagcccaugugaguguga

SEQ ID NO: 1052158 - RNA, 22 nt, Human
caguugccuacuacauggcagg

SEQ ID NO: 1052159 - RNA, 22 nt, Human
ugaaaggugacauuucuuggau

SEQ ID NO: 1052160 - RNA, 22 nt, Human
uggcagcuaucuuuaaugagau

SEQ ID NO: 1052161 - RNA, 22 nt, Human
caaaauuagggagugagcugga

SEQ ID NO: 1052162 - RNA, 22 nt, Human
acaguacaccacuguguacagu

SEQ ID NO: 1052163 - RNA, 22 nt, Human
agucucuuccuucaaggcuggu

SEQ ID NO: 1052164 - RNA, 22 nt, Human
gaagcagcuuucuggugaggag

SEQ ID NO: 1052165 - RNA, 20 nt, Human
ccuggagccuggaaggaguc

SEQ ID NO: 1052166 - RNA, 22 nt, Human
acagucuugcuguauggucagg

SEQ ID NO: 1052167 - RNA, 18 nt, Human
ggucuuuaggucaguguc

SEQ ID NO: 1052168 - RNA, 22 nt, Human
uacugccuggagcauuggugcu

SEQ ID NO: 1052169 - RNA, 22 nt, Human
aggaaaggccuuugcauuuggu

SEQ ID NO: 1052170 - RNA, 22 nt, Human
ugcaggaaucagaggggaagcg

SEQ ID NO: 1052171 - RNA, 22 nt, Human
ggauggagguucucagaugcuc

SEQ ID NO: 1052172 - RNA, 22 nt, Human
gaggagcugggucagggagaca

SEQ ID NO: 1052173 - RNA, 22 nt, Human
acugagguaauugugaggauua

SEQ ID NO: 1052174 - RNA, 22 nt, Human
ggagaggaaaugccagcacuuc

SEQ ID NO: 1052175 - RNA, 22 nt, Human
ccuggcuggacuggaccguggc

SEQ ID NO: 1052176 - RNA, 20 nt, Human
uucaggauucuagaccacac

SEQ ID NO: 1052177 - RNA, 22 nt, Human
gagaaaugcaugcaugucauca

SEQ ID NO: 1052178 - RNA, 22 nt, Human
uguugaagauaaaguucucauu

SEQ ID NO: 1052179 - RNA, 22 nt, Human
cuauuagguaugugguugcuau

SEQ ID NO: 1052180 - RNA, 22 nt, Human
ucuggcaaaggcaaccacaguu

SEQ ID NO: 1052181 - RNA, 22 nt, Human
aagaacuuccuaauauauuuuc

SEQ ID NO: 1052182 - RNA, 19 nt, Human
uggcaggcccaggauggac

SEQ ID NO: 1052183 - RNA, 22 nt, Human
cccaggagaccuagaucuguuu

SEQ ID NO: 1052184 - RNA, 21 nt, Human
cccaggaguccuauuuaaaug

SEQ ID NO: 1052185 - RNA, 22 nt, Human
ucaggagaaucagggcuguccu

SEQ ID NO: 1052186 - RNA, 22 nt, Human
auacacauauguguguauaugu

SEQ ID NO: 1052187 - RNA, 22 nt, Human
uuugaaagggacaaagucacug

SEQ ID NO: 1052188 - RNA, 22 nt, Human
gaugagcauuguuucauguguu

SEQ ID NO: 1052189 - RNA, 22 nt, Human
gagaacugauuagcauuugcca

SEQ ID NO: 1052190 - RNA, 22 nt, Human
caggcagcaggagcccugcucg

SEQ ID NO: 1052191 - RNA, 22 nt, Human
gccucaguugaucugugugagc

SEQ ID NO: 1052192 - RNA, 22 nt, Human
agugacagggaaggauaggauu

SEQ ID NO: 1052193 - RNA, 20 nt, Human
ugaggcccagcagagucggg

SEQ ID NO: 1052194 - RNA, 17 nt, Human
aagagaggcugagcugg

SEQ ID NO: 1052195 - RNA, 22 nt, Human
agcaagauuuaaacccagguca

SEQ ID NO: 1052196 - RNA, 22 nt, Human
uggcuucucuguuuuaguauuu

SEQ ID NO: 1052197 - RNA, 22 nt, Human
cccuggaguccuggcaguugau

SEQ ID NO: 1052198 - RNA, 22 nt, Human
cagaacugagucucauggccau

SEQ ID NO: 1052199 - RNA, 22 nt, Human
agaggucagauuucuccuggug

SEQ ID NO: 1052200 - RNA, 22 nt, Human
cucacuguuuaauagcuggauc

SEQ ID NO: 1052201 - RNA, 22 nt, Human
gagaaacuuggaguuauucugg

SEQ ID NO: 1052202 - RNA, 22 nt, Human
accuguuuggaggagguguuag

SEQ ID NO: 1052203 - RNA, 22 nt, Human
cuucagaagaaaagcagugugu

SEQ ID NO: 1052204 - RNA, 22 nt, Human
uauuuccagcaguaagaagaca

SEQ ID NO: 1052205 - RNA, 19 nt, Human
uccaccuuucuucauuugg

SEQ ID NO: 1052206 - RNA, 22 nt, Human
uuugaaaggguuaugagacuga

SEQ ID NO: 1052207 - RNA, 22 nt, Human
uugguuuagagagugugguuac

SEQ ID NO: 1052208 - RNA, 22 nt, Human
aacauacauauuucagugucca

SEQ ID NO: 1052209 - RNA, 22 nt, Human
uuaaauuagucaagcuucucug

SEQ ID NO: 1052210 - RNA, 22 nt, Human
gggcagcugucuugguucucaa

SEQ ID NO: 1052211 - RNA, 22 nt, Human
cuguggaauugaugcuuagugu

SEQ ID NO: 1052212 - RNA, 22 nt, Human
ccaggcagcaaauuuucugaau

SEQ ID NO: 1052213 - RNA, 22 nt, Human
ugaggcaggagaaucaccggaa

SEQ ID NO: 1052214 - RNA, 22 nt, Human
ucuucucucauguaggagggaa

SEQ ID NO: 1052215 - RNA, 22 nt, Human
auuccaguuggguucuaauaca

SEQ ID NO: 1052216 - RNA, 22 nt, Human
ugaggcaggacugagcgggaug

SEQ ID NO: 1052217 - RNA, 22 nt, Human
uuaauuuuaaccuguuuguguc

SEQ ID NO: 1052218 - RNA, 22 nt, Human
uucagcaagaccaccauguacc

SEQ ID NO: 1052219 - RNA, 20 nt, Human
gccaggagggugugaugagc

SEQ ID NO: 1052220 - RNA, 22 nt, Human
ucucgacagccuggcacagugg

SEQ ID NO: 1052221 - RNA, 22 nt, Human
uauuggucuuggaagguuuugu

SEQ ID NO: 1052222 - RNA, 23 nt, Human
cagggaggagauacuguguaucu

SEQ ID NO: 1052223 - RNA, 22 nt, Human
ugucagcucccagucagagaga

SEQ ID NO: 1052224 - RNA, 22 nt, Human
ggccagcucugcacagcagcug

SEQ ID NO: 1052225 - RNA, 22 nt, Human
ccccucccugaccugguugggc

SEQ ID NO: 1052226 - RNA, 22 nt, Human
cccaagagcuucuaggacgcug

SEQ ID NO: 1052227 - RNA, 22 nt, Human
agagggagcccagucauagcug

SEQ ID NO: 1052228 - RNA, 22 nt, Human
uguaggauguaaggcaggcauc

SEQ ID NO: 1052229 - RNA, 22 nt, Human
ucuccuggcucuaaaaggcugu

SEQ ID NO: 1052230 - RNA, 22 nt, Human
uggcgcaacucauucauggugu

SEQ ID NO: 1052231 - RNA, 22 nt, Human
cagccugagccuucuguagcaa

SEQ ID NO: 1052232 - RNA, 22 nt, Human
ggcagaagauaggacagggaau

SEQ ID NO: 1052233 - RNA, 22 nt, Human
agaaaggagaccagcucugccc

SEQ ID NO: 1052234 - RNA, 22 nt, Human
aggccagcccugggcugagaga

SEQ ID NO: 1052235 - RNA, 22 nt, Human
aauugcuaaagauuauguuuuc

SEQ ID NO: 1052236 - RNA, 22 nt, Human
ccagggccugccacuuagcaag

SEQ ID NO: 1052237 - RNA, 21 nt, Human
gcucagaguauugcacuguuu

SEQ ID NO: 1052238 - RNA, 22 nt, Human
cuuuggcagccucugcuauuga

SEQ ID NO: 1052239 - RNA, 22 nt, Human
ggcugcagaggcccccaguggg

SEQ ID NO: 1052240 - RNA, 22 nt, Human
aaucuuucccuauuaaaugugg

SEQ ID NO: 1052241 - RNA, 21 nt, Human
agcagaggcagaauguaugca

SEQ ID NO: 1052242 - RNA, 22 nt, Human
ucauuuauaaggaugcaauuaa

SEQ ID NO: 1052243 - RNA, 22 nt, Human
uucuucagucccacuagccaca

SEQ ID NO: 1052244 - RNA, 22 nt, Human
uggcugaguguuccaaggagca

SEQ ID NO: 1052245 - RNA, 22 nt, Human
ucugagguuauugucugccauu

SEQ ID NO: 1052246 - RNA, 22 nt, Human
gacuuucugauguaaacauuua

SEQ ID NO: 1052247 - RNA, 22 nt, Human
ugcccugggaguuggagcugcu

SEQ ID NO: 1052248 - RNA, 22 nt, Human
gagggcugcugccagauaugcc

SEQ ID NO: 1052249 - RNA, 21 nt, Human
ggcagccugacccccagagag

SEQ ID NO: 1052250 - RNA, 23 nt, Human
cuccccaguguccucaugcaucu

SEQ ID NO: 1052251 - RNA, 22 nt, Human
acacauuuacauguuuacguau

SEQ ID NO: 1052252 - RNA, 22 nt, Human
uccaggagauacacugcaccag

SEQ ID NO: 1052253 - RNA, 22 nt, Human
guggccaaacaccaguuuagga

SEQ ID NO: 1052254 - RNA, 22 nt, Human
cuucugugcuucacaguugcca

SEQ ID NO: 1052255 - RNA, 22 nt, Human
gaaggucaccuccccucucugg

SEQ ID NO: 1052256 - RNA, 22 nt, Human
aauuccuaguuguacuuaguga

SEQ ID NO: 1052257 - RNA, 22 nt, Human
ggccaggagaggagggcacuga

SEQ ID NO: 1052258 - RNA, 22 nt, Human
gcccaggagguggaggugcagu

SEQ ID NO: 1052259 - RNA, 22 nt, Human
gagaggaguagacacuuugguu

SEQ ID NO: 1052260 - RNA, 22 nt, Human
uugcuggcuugaagauagagga

SEQ ID NO: 1052261 - RNA, 22 nt, Human
ccuggccagcuaauugcccauc

SEQ ID NO: 1052262 - RNA, 22 nt, Human
cagagaaaaaauccugcucuca

SEQ ID NO: 1052263 - RNA, 22 nt, Human
uaacuguaauauaaauaugagu

SEQ ID NO: 1052264 - RNA, 22 nt, Human
gaggcaguguugaaaaggagag

SEQ ID NO: 1052265 - RNA, 22 nt, Human
aggaagcuagagccaccggacu

SEQ ID NO: 1052266 - RNA, 22 nt, Human
cuuccugggcaauguucugcuu

SEQ ID NO: 1052267 - RNA, 19 nt, Human
gaggucagcaagaaguauu

SEQ ID NO: 1052268 - RNA, 18 nt, Human
uggcuucuauuuuacuca

SEQ ID NO: 1052269 - RNA, 22 nt, Human
cuccugggagucuuccuggaug

SEQ ID NO: 1052270 - RNA, 22 nt, Human
uccaaaguaauuucacuucugu

SEQ ID NO: 1052271 - RNA, 22 nt, Human
uuuauuguuaucaugggugagu

SEQ ID NO: 1052272 - RNA, 22 nt, Human
cugaggucaauuaaucaacaac

SEQ ID NO: 1052273 - RNA, 22 nt, Human
uuuguuuacucauucauugaug

SEQ ID NO: 1052274 - RNA, 22 nt, Human
augcuguggaugccuugcccca

SEQ ID NO: 1052275 - RNA, 22 nt, Human
uaaaccuugguagcaucuugcu

SEQ ID NO: 1052276 - RNA, 22 nt, Human
guuuaaauaauuaggggccugu

SEQ ID NO: 1052277 - RNA, 21 nt, Human
agucuguuaggaugacucuga

SEQ ID NO: 1052278 - RNA, 22 nt, Human
gagcccugacacugagggaguu

SEQ ID NO: 1052279 - RNA, 22 nt, Human
ucugaggucagugcugcaguua

SEQ ID NO: 1052280 - RNA, 21 nt, Human
ggcagcucagcagauggggac

SEQ ID NO: 1052281 - RNA, 22 nt, Human
cccaggagguagagguugcagu

SEQ ID NO: 1052282 - RNA, 22 nt, Human
uugggcucaggaguuugagacc

SEQ ID NO: 1052283 - RNA, 22 nt, Human
uccugggcaaaaguaucuguga

SEQ ID NO: 1052284 - RNA, 22 nt, Human
uaucuuguaauagguccacuug

SEQ ID NO: 1052285 - RNA, 22 nt, Human
uaaggccagccagcaaaucugu

SEQ ID NO: 1052286 - RNA, 22 nt, Human
accaggagguguuugcucaagu

SEQ ID NO: 1052287 - RNA, 22 nt, Human
uccugccugcaaucccagcacu

SEQ ID NO: 1052288 - RNA, 22 nt, Human
ucuuuguaaaugccuagcauaa

SEQ ID NO: 1052289 - RNA, 22 nt, Human
gaguccaggcuguugcucaucu

SEQ ID NO: 1052290 - RNA, 22 nt, Human
agauauauuuccugcccaaggc

SEQ ID NO: 1052291 - RNA, 17 nt, Human
ggcagcugugugcaugc

SEQ ID NO: 1052292 - RNA, 17 nt, Human
agaggcagauacuugga

SEQ ID NO: 1052293 - RNA, 22 nt, Human
augcugagcagagcugacaugc

SEQ ID NO: 1052294 - RNA, 19 nt, Human
ccaggagagcuuggagaag

SEQ ID NO: 1052295 - RNA, 22 nt, Human
uuauacagcauugcuagugaug

SEQ ID NO: 1052296 - RNA, 23 nt, Human
uugcuuucaucaugagaugcucc

SEQ ID NO: 1052297 - RNA, 22 nt, Human
aggaagcuccuggagagccagu

SEQ ID NO: 1052298 - RNA, 22 nt, Human
caaauguauaaauguacuuucu

SEQ ID NO: 1052299 - RNA, 22 nt, Human
uggguccacaaacaucagauau

SEQ ID NO: 1052300 - RNA, 17 nt, Human
cauuuguugaucaguug

SEQ ID NO: 1052301 - RNA, 22 nt, Human
agugcuuuaccuagauaauguu

SEQ ID NO: 1052302 - RNA, 21 nt, Human
ugaaugaggaggauggcauuu

SEQ ID NO: 1052303 - RNA, 21 nt, Human
ugguacagaggaggugaagug

SEQ ID NO: 1052304 - RNA, 22 nt, Human
cuggaguuagaguagacacuga

SEQ ID NO: 1052305 - RNA, 22 nt, Human
uuugcauaaaggagcauuucuc

SEQ ID NO: 1052306 - RNA, 22 nt, Human
acagucugucccccaggugcua

SEQ ID NO: 1052307 - RNA, 22 nt, Human
uucaucuguaguuuuuccaagg

SEQ ID NO: 1052308 - RNA, 22 nt, Human
uuauuaugguauuucuuugcag

SEQ ID NO: 1052309 - RNA, 22 nt, Human
uggcaugaagucagcagcuggg

SEQ ID NO: 1052310 - RNA, 23 nt, Human
cacuccuguuucuaagccagcau

SEQ ID NO: 1052311 - RNA, 20 nt, Human
gccugccucagcuagcugag

SEQ ID NO: 1052312 - RNA, 22 nt, Human
aagacauugucauuuuauaauu

SEQ ID NO: 1052313 - RNA, 22 nt, Human
auacaucuugucagauucaugu

SEQ ID NO: 1052314 - RNA, 22 nt, Human
uauuagguaugaacuggcaacc

SEQ ID NO: 1052315 - RNA, 22 nt, Human
cagaacuggccuuucaucaguc

SEQ ID NO: 1052316 - RNA, 22 nt, Human
cagaugagcaugggcacaagca

SEQ ID NO: 1052317 - RNA, 22 nt, Human
uagggcagagcuuguacacgau

SEQ ID NO: 1052318 - RNA, 23 nt, Human
aaugauuucaugaugauagcagc

SEQ ID NO: 1052319 - RNA, 17 nt, Human
cagggcugucugccuag

SEQ ID NO: 1052320 - RNA, 22 nt, Human
accagagcuuacaugcuagaaa

SEQ ID NO: 1052321 - RNA, 22 nt, Human
agagcagcugugacauggacag

SEQ ID NO: 1052322 - RNA, 22 nt, Human
uccagaaacuuuuccagucuca

SEQ ID NO: 1052323 - RNA, 22 nt, Human
gcugaggccccagggugauggg

SEQ ID NO: 1052324 - RNA, 22 nt, Human
cccaggaaacccgaaggcgacc

SEQ ID NO: 1052325 - RNA, 22 nt, Human
ucuccugguuuguuaaauaauu

SEQ ID NO: 1052326 - RNA, 22 nt, Human
ugccccagaccuacugaauggg

SEQ ID NO: 1052327 - RNA, 22 nt, Human
aggcaagcugcagagaguccuu

SEQ ID NO: 1052328 - RNA, 23 nt, Human
auaaauuacuaucucccuagagc

SEQ ID NO: 1052329 - RNA, 22 nt, Human
gcaucuaaauaaacgugggagu

SEQ ID NO: 1052330 - RNA, 22 nt, Human
uacuuucuagcucuccccaguu

SEQ ID NO: 1052331 - RNA, 22 nt, Human
ggcugcugacaaacaugaucau

SEQ ID NO: 1052332 - RNA, 21 nt, Human
acaggagaccgccuggcaguc

SEQ ID NO: 1052333 - RNA, 22 nt, Human
acaaauguggacauggauaaug

SEQ ID NO: 1052334 - RNA, 22 nt, Human
aaacugguaaucggcaagugag

SEQ ID NO: 1052335 - RNA, 22 nt, Human
caaaugauaccuauuacuaggc

SEQ ID NO: 1052336 - RNA, 22 nt, Human
cugggccagaccuuguggucuu

SEQ ID NO: 1052337 - RNA, 22 nt, Human
cagcagcugcaaauggaaacag

SEQ ID NO: 1052338 - RNA, 22 nt, Human
uauagccauuuccaguggcauc

SEQ ID NO: 1052339 - RNA, 21 nt, Human
ucugagagcaacugcccuuua

SEQ ID NO: 1052340 - RNA, 23 nt, Human
agggccuggcguggagugugugc

SEQ ID NO: 1052341 - RNA, 22 nt, Human
gaggcagcuggguccggucggg

SEQ ID NO: 1052342 - RNA, 22 nt, Human
gcucaggacuggaggagcgggg

SEQ ID NO: 1052343 - RNA, 21 nt, Human
ucugacuugaucuauucuccc

SEQ ID NO: 1052344 - RNA, 22 nt, Human
ucauuuguggaagugauugugg

SEQ ID NO: 1052345 - RNA, 22 nt, Human
aauuuccagaucagaugacuca

SEQ ID NO: 1052346 - RNA, 22 nt, Human
aggccagaugucgggcuagaag

SEQ ID NO: 1052347 - RNA, 22 nt, Human
aucacauuguuagcauagacug

SEQ ID NO: 1052348 - RNA, 22 nt, Human
ucagagagugcaaaauauagcu

SEQ ID NO: 1052349 - RNA, 22 nt, Human
cugggccaaaagaaguguucuu

SEQ ID NO: 1052350 - RNA, 22 nt, Human
uggcagcagggccccuggagga

SEQ ID NO: 1052351 - RNA, 22 nt, Human
aagggcuggagacugggucuuc

SEQ ID NO: 1052352 - RNA, 22 nt, Human
cagggcugaacugagcuuguga

SEQ ID NO: 1052353 - RNA, 22 nt, Human
ugaggcaguucuuacuuguauu

SEQ ID NO: 1052354 - RNA, 22 nt, Human
uggcugagaaugggaugaugcc

SEQ ID NO: 1052355 - RNA, 22 nt, Human
acuacacugcccuggggaucaa

SEQ ID NO: 1052356 - RNA, 19 nt, Human
ccuggcucugagcccagcc

SEQ ID NO: 1052357 - RNA, 22 nt, Human
aaacugguauucaaauguuugg

SEQ ID NO: 1052358 - RNA, 22 nt, Human
aggcaggcacuccggaaguguc

SEQ ID NO: 1052359 - RNA, 22 nt, Human
aaguaguuaggaacauucucuc

SEQ ID NO: 1052360 - RNA, 22 nt, Human
acuggcagagacccugauggcc

SEQ ID NO: 1052361 - RNA, 22 nt, Human
agggggugucucugauuggguu

SEQ ID NO: 1052362 - RNA, 22 nt, Human
augcugugagugugccgcagag

SEQ ID NO: 1052363 - RNA, 22 nt, Human
ggcugcugggucaugaugcaga

SEQ ID NO: 1052364 - RNA, 22 nt, Human
aaguagugugcuccagcgguga

SEQ ID NO: 1052365 - RNA, 22 nt, Human
uugcugugucauuuguuuaauc

SEQ ID NO: 1052366 - RNA, 22 nt, Human
ucucugaguaagugacaguuca

SEQ ID NO: 1052367 - RNA, 22 nt, Human
auugaaagagaauguagcucuu

SEQ ID NO: 1052368 - RNA, 22 nt, Human
ucaggcugugggcacuggccau

SEQ ID NO: 1052369 - RNA, 20 nt, Human
auacacuugcccagcuugug

SEQ ID NO: 1052370 - RNA, 22 nt, Human
gaggccaggacaugaaagcuga

SEQ ID NO: 1052371 - RNA, 22 nt, Human
gaggcacugcaguacagugacu

SEQ ID NO: 1052372 - RNA, 22 nt, Human
ugaaaugauuauaugguguuug

SEQ ID NO: 1052373 - RNA, 22 nt, Human
uuugaaauuaagauauugucca

SEQ ID NO: 1052374 - RNA, 22 nt, Human
gcggagggcgagcccgcggagc

SEQ ID NO: 1052375 - RNA, 22 nt, Human
uuuauaaguacuuugucugcuu

SEQ ID NO: 1052376 - RNA, 22 nt, Human
uacagcuaggcaaaaaugacau

SEQ ID NO: 1052377 - RNA, 22 nt, Human
ucauuucaaugauacuacuaag

SEQ ID NO: 1052378 - RNA, 23 nt, Human
agugcugaauugaaagcuccagg

SEQ ID NO: 1052379 - RNA, 22 nt, Human
gcuccuggugcuguagagauuu

SEQ ID NO: 1052380 - RNA, 22 nt, Human
ucccaggaagaucccagggacc

SEQ ID NO: 1052381 - RNA, 22 nt, Human
gucaggaucaaauugaaguuau

SEQ ID NO: 1052382 - RNA, 22 nt, Human
augcuuccaaggcuaagacaag

SEQ ID NO: 1052383 - RNA, 15 nt, Human
ccaggcugggugagc

SEQ ID NO: 1052384 - RNA, 22 nt, Human
ugaacucgggaggaggcugcag

SEQ ID NO: 1052385 - RNA, 22 nt, Human
gcaccuuucuauauucaguggc

SEQ ID NO: 1052386 - RNA, 22 nt, Human
aagggcuggccacauucugggu

SEQ ID NO: 1052387 - RNA, 22 nt, Human
ucagguggcuuggagggggacg

SEQ ID NO: 1052388 - RNA, 22 nt, Human
caaggcugcugcgggucgcacc

SEQ ID NO: 1052389 - RNA, 22 nt, Human
uauuagcgcuuacugaguugcc

SEQ ID NO: 1052390 - RNA, 22 nt, Human
uccuggcccaaucugcccauga

SEQ ID NO: 1052391 - RNA, 22 nt, Human
ucccaggaugugcgugccgccg

SEQ ID NO: 1052392 - RNA, 21 nt, Human
ugauacaggaaugguucuaug

SEQ ID NO: 1052393 - RNA, 22 nt, Human
gaaggccaguuuugagauaggu

SEQ ID NO: 1052394 - RNA, 22 nt, Human
ggcggcacgcaggcugcugucg

SEQ ID NO: 1052395 - RNA, 22 nt, Human
ucaaauaccagcaauuucaugu

SEQ ID NO: 1052396 - RNA, 22 nt, Human
ucacaaaagcuuuugaauuugg

SEQ ID NO: 1052397 - RNA, 22 nt, Human
cccgggaggaggaaguugcagu

SEQ ID NO: 1052398 - RNA, 20 nt, Human
augcuuucuugugugcugcu

SEQ ID NO: 1052399 - RNA, 22 nt, Human
aagggcuguaguuuguugauca

SEQ ID NO: 1052400 - RNA, 22 nt, Human
accauguguuuuacacauggua

SEQ ID NO: 1052401 - RNA, 22 nt, Human
uugaaaggguuaaagugguaaa

SEQ ID NO: 1052402 - RNA, 22 nt, Human
gcugaggugucaccuugcuggg

SEQ ID NO: 1052403 - RNA, 22 nt, Human
uccuggccuccguucucugcau

SEQ ID NO: 1052404 - RNA, 22 nt, Human
ggcaggcaaugaggaugggaag

SEQ ID NO: 1052405 - RNA, 22 nt, Human
ucaggcugaaggaggccuaucu

SEQ ID NO: 1052406 - RNA, 22 nt, Human
gcuacugauugaccuuggagag

SEQ ID NO: 1052407 - RNA, 22 nt, Human
ggcuuggaaauugcaggacaca

SEQ ID NO: 1052408 - RNA, 22 nt, Human
agcucccagagcucgagaguaa

SEQ ID NO: 1052409 - RNA, 22 nt, Human
acucaggaaauugagauaaugg

SEQ ID NO: 1052410 - RNA, 22 nt, Human
caggcugcagcagcaguggccc

SEQ ID NO: 1052411 - RNA, 19 nt, Human
ucaucucacagggccuggc

SEQ ID NO: 1052412 - RNA, 22 nt, Human
gcugagagcggccagcugggaa

SEQ ID NO: 1052413 - RNA, 22 nt, Human
uguguuauugccacugaagacc

SEQ ID NO: 1052414 - RNA, 22 nt, Human
uuuacaaccucauauucugaug

SEQ ID NO: 1052415 - RNA, 22 nt, Human
gaggcagccagagguucucauu

SEQ ID NO: 1052416 - RNA, 22 nt, Human
uaacuguacaacugguuaguca

SEQ ID NO: 1052417 - RNA, 22 nt, Human
caagaugaaauugugauauuuu

SEQ ID NO: 1052418 - RNA, 22 nt, Human
uggcugagguaacuaugaauaa

SEQ ID NO: 1052419 - RNA, 22 nt, Human
cagggcuggcuuccaaguuguu

SEQ ID NO: 1052420 - RNA, 22 nt, Human
agauggcagggguaccuggaag

SEQ ID NO: 1052421 - RNA, 22 nt, Human
ggacagcugcuuucaggccaca

SEQ ID NO: 1052422 - RNA, 22 nt, Human
ggucagagggugggcugccugu

SEQ ID NO: 1052423 - RNA, 22 nt, Human
ucagauggguuuugaaggaugu

SEQ ID NO: 1052424 - RNA, 22 nt, Human
ccaggcugcuuuauuacucugu

SEQ ID NO: 1052425 - RNA, 22 nt, Human
cuaggcugagcugggcugagcu

SEQ ID NO: 1052426 - RNA, 22 nt, Human
agcuucuuggcucagcacuugg

SEQ ID NO: 1052427 - RNA, 22 nt, Human
ucuuccucuagaucugaggccc

SEQ ID NO: 1052428 - RNA, 22 nt, Human
cugaaaauguuacacaggaaga

SEQ ID NO: 1052429 - RNA, 22 nt, Human
aggcagugccuggaccccagcu

SEQ ID NO: 1052430 - RNA, 22 nt, Human
aagcuggcaugucaccugagaa

SEQ ID NO: 1052431 - RNA, 20 nt, Human
accaggagauggaggcaggg

SEQ ID NO: 1052432 - RNA, 22 nt, Human
auguagagcaguguuguccaau

SEQ ID NO: 1052433 - RNA, 22 nt, Human
gcugcaggcucugcaggaauug

SEQ ID NO: 1052434 - RNA, 22 nt, Human
ucucuggccgagagucccuggg

SEQ ID NO: 1052435 - RNA, 19 nt, Human
uaacugguuaaaaagcuug

SEQ ID NO: 1052436 - RNA, 22 nt, Human
ugcccuggggucuggagcagca

SEQ ID NO: 1052437 - RNA, 22 nt, Human
uugcagcuuagugauguuaucu

SEQ ID NO: 1052438 - RNA, 22 nt, Human
cuugcuucauuagugucuuagu

SEQ ID NO: 1052439 - RNA, 22 nt, Human
cccaggaaaagcagugccagca

SEQ ID NO: 1052440 - RNA, 22 nt, Human
gcuggagaugcuaugcagaggg

SEQ ID NO: 1052441 - RNA, 22 nt, Human
gacccaggagagaggguugcau

SEQ ID NO: 1052442 - RNA, 22 nt, Human
cugguccauucucucccugaag

SEQ ID NO: 1052443 - RNA, 22 nt, Human
gaggcgagaagcuggagauggu

SEQ ID NO: 1052444 - RNA, 22 nt, Human
uaggaugaaaauccagcuuaua

SEQ ID NO: 1052445 - RNA, 22 nt, Human
uucagaaaaaacuucaauaagu

SEQ ID NO: 1052446 - RNA, 22 nt, Human
uuuugugagcccauaaaugcca

SEQ ID NO: 1052447 - RNA, 22 nt, Human
uuguuauaaagacuaaauaugu

SEQ ID NO: 1052448 - RNA, 22 nt, Human
ucaggagaguguucaguggagg

SEQ ID NO: 1052449 - RNA, 22 nt, Human
cugcugugcuuguggccacccg

SEQ ID NO: 1052450 - RNA, 22 nt, Human
ucaucuugcugccauugcuuua

SEQ ID NO: 1052451 - RNA, 22 nt, Human
ugaggggaaggcaugauaaaua

SEQ ID NO: 1052452 - RNA, 22 nt, Human
agcugcugcggaaagaugccac

SEQ ID NO: 1052453 - RNA, 22 nt, Human
cccucuacagggaagcgcuuuc

SEQ ID NO: 1052454 - RNA, 22 nt, Human
uuucaaagucaauaucauuacc

SEQ ID NO: 1052455 - RNA, 22 nt, Human
uucaggauucuuucagacuggg

SEQ ID NO: 1052456 - RNA, 22 nt, Human
gaggucccccauggcugugacu

SEQ ID NO: 1052457 - RNA, 22 nt, Human
gaggagcuugugagaagauguc

SEQ ID NO: 1052458 - RNA, 22 nt, Human
cugccagucuaugcugcucggc

SEQ ID NO: 1052459 - RNA, 22 nt, Human
auggcuggaggccgggcuuccu

SEQ ID NO: 1052460 - RNA, 22 nt, Human
acaggcuggugguccuggccau

SEQ ID NO: 1052461 - RNA, 22 nt, Human
aggcagcugugaggacuggauu

SEQ ID NO: 1052462 - RNA, 22 nt, Human
uucuuacagaguuuacagagcc

SEQ ID NO: 1052463 - RNA, 19 nt, Human
gacagugcaguuguaguac

SEQ ID NO: 1052464 - RNA, 22 nt, Human
ucaggcuguagggccccuggag

SEQ ID NO: 1052465 - RNA, 22 nt, Human
aauuauacaauugucaaguucu

SEQ ID NO: 1052466 - RNA, 22 nt, Human
aggcacaguggcucacaccugu

SEQ ID NO: 1052467 - RNA, 19 nt, Human
ugaggccaaggucacagau

SEQ ID NO: 1052468 - RNA, 22 nt, Human
acucaggaaaugagaggcucuc

SEQ ID NO: 1052469 - RNA, 22 nt, Human
uucagaaacagagugagugagu

SEQ ID NO: 1052470 - RNA, 22 nt, Human
ugcugaugcuguucuguuagga

SEQ ID NO: 1052471 - RNA, 18 nt, Human
cugcccagagcacuugug

SEQ ID NO: 1052472 - RNA, 22 nt, Human
uauuuccaggccccacucuaga

SEQ ID NO: 1052473 - RNA, 22 nt, Human
gagugucacuugaugcagggca

SEQ ID NO: 1052474 - RNA, 22 nt, Human
guauuagguuggugcaaaauug

SEQ ID NO: 1052475 - RNA, 22 nt, Human
guggucagcagcagugggagug

SEQ ID NO: 1052476 - RNA, 21 nt, Human
gccucuccaaauccugccuuc

SEQ ID NO: 1052477 - RNA, 22 nt, Human
aaugaauugcaguacugacuug

SEQ ID NO: 1052478 - RNA, 22 nt, Human
uaauacagaaguguauuaaaau

SEQ ID NO: 1052479 - RNA, 22 nt, Human
aucaggauagucuguaaauugu

SEQ ID NO: 1052480 - RNA, 22 nt, Human
gcugccugcucacccggccugg

SEQ ID NO: 1052481 - RNA, 22 nt, Human
gaaccucagugaaacuggaggu

SEQ ID NO: 1052482 - RNA, 22 nt, Human
acugagguuuacuugaaggaga

SEQ ID NO: 1052483 - RNA, 22 nt, Human
guacacuugucuugaacagccu

SEQ ID NO: 1052484 - RNA, 22 nt, Human
aggcaguggcugagaccagggg

SEQ ID NO: 1052485 - RNA, 22 nt, Human
gcuguagauggacuggcaucca

SEQ ID NO: 1052486 - RNA, 21 nt, Human
gcaaauguucaggaaaaaaga

SEQ ID NO: 1052487 - RNA, 22 nt, Human
gcugcccaggagagguggggcu

SEQ ID NO: 1052488 - RNA, 22 nt, Human
auaguuacaaagacuuuuuaaa

SEQ ID NO: 1052489 - RNA, 22 nt, Human
caaauguauucucacuucaggg

SEQ ID NO: 1052490 - RNA, 22 nt, Human
uuuuaacuuaaaauacauagau

SEQ ID NO: 1052491 - RNA, 22 nt, Human
acccaggagcaggcugggcagu

SEQ ID NO: 1052492 - RNA, 22 nt, Human
cugcccaggaaggagaggaugg

SEQ ID NO: 1052493 - RNA, 22 nt, Human
guuguuuuuguucucuauagcu

SEQ ID NO: 1052494 - RNA, 22 nt, Human
auuuauuaugggauuuggcaca

SEQ ID NO: 1052495 - RNA, 22 nt, Human
gucuuucuaugaugaacuguug

SEQ ID NO: 1052496 - RNA, 22 nt, Human
gcugauguaagacuuuugguuu

SEQ ID NO: 1052497 - RNA, 22 nt, Human
uccuuagagacaagaccaguuu

SEQ ID NO: 1052498 - RNA, 23 nt, Human
uugaggucggcucucugagccug

SEQ ID NO: 1052499 - RNA, 22 nt, Human
aguuugaaauguuggcaauauu

SEQ ID NO: 1052500 - RNA, 22 nt, Human
cagaauggcuuuuauggcucag

SEQ ID NO: 1052501 - RNA, 22 nt, Human
cugggccaucuccuuugugugg

SEQ ID NO: 1052502 - RNA, 22 nt, Human
cccaggagauggugcguggucu

SEQ ID NO: 1052503 - RNA, 22 nt, Human
gcuuggcauugaccauuaucau

SEQ ID NO: 1052504 - RNA, 22 nt, Human
gagaggggcccaagccacauag

SEQ ID NO: 1052505 - RNA, 22 nt, Human
ucuguccagaacguacaucuug

SEQ ID NO: 1052506 - RNA, 22 nt, Human
auaaaugauucagcaggaaaua

SEQ ID NO: 1052507 - RNA, 22 nt, Human
cugcaucacagcaggaggcaca

SEQ ID NO: 1052508 - RNA, 22 nt, Human
uccugccucuccaugcuaacua

SEQ ID NO: 1052509 - RNA, 22 nt, Human
cauggcugcgagaagagugggu

SEQ ID NO: 1052510 - RNA, 23 nt, Human
agcacacuuguacaaugcccuag

SEQ ID NO: 1052511 - RNA, 22 nt, Human
gcuggccagugucccagggauc

SEQ ID NO: 1052512 - RNA, 23 nt, Human
gggcaguuauguuguccuuggcu

SEQ ID NO: 1052513 - RNA, 22 nt, Human
gaucuuggggggaucaccaugg

SEQ ID NO: 1052514 - RNA, 22 nt, Human
uuucaucuaacacuacauaggg

SEQ ID NO: 1052515 - RNA, 22 nt, Human
aagauacugaugauguaggcua

SEQ ID NO: 1052516 - RNA, 22 nt, Human
ucuuucaaugagcauucuuucc

SEQ ID NO: 1052517 - RNA, 22 nt, Human
cagcugagaagugauagcugca

SEQ ID NO: 1052518 - RNA, 22 nt, Human
cugcugugccucuuuucacgug

SEQ ID NO: 1052519 - RNA, 22 nt, Human
uucugucacagugcugguauca

SEQ ID NO: 1052520 - RNA, 22 nt, Human
cugagcugggaguagagacucu

SEQ ID NO: 1052521 - RNA, 22 nt, Human
uucaugcuuuuaccgcuguuaa

SEQ ID NO: 1052522 - RNA, 22 nt, Human
caggcagcagaggaguguggga

SEQ ID NO: 1052523 - RNA, 23 nt, Human
uagggcagcugggagggacaugc

SEQ ID NO: 1052524 - RNA, 22 nt, Human
ggcagcuuucucacccaugacc

SEQ ID NO: 1052525 - RNA, 22 nt, Human
cuucaggauuuaggaagaugaa

SEQ ID NO: 1052526 - RNA, 22 nt, Human
caggagaucuuaggaauucuua

SEQ ID NO: 1052527 - RNA, 22 nt, Human
agaaaugaauauguagugguua

SEQ ID NO: 1052528 - RNA, 20 nt, Human
aggauuugagaaggcgucuu

SEQ ID NO: 1052529 - RNA, 22 nt, Human
uccaacuuucuccuccggcuug

SEQ ID NO: 1052530 - RNA, 22 nt, Human
uuuauguaguuacggacuauca

SEQ ID NO: 1052531 - RNA, 22 nt, Human
ccucuccuugcacccgucccgc

SEQ ID NO: 1052532 - RNA, 22 nt, Human
cuagggaguggcagagcuggga

SEQ ID NO: 1052533 - RNA, 22 nt, Human
caacugagcaguagcgucugga

SEQ ID NO: 1052534 - RNA, 22 nt, Human
uugugaguagugccgcaauaaa

SEQ ID NO: 1052535 - RNA, 22 nt, Human
ugaggcaggaaguuauauaaug

SEQ ID NO: 1052536 - RNA, 22 nt, Human
uguccccagguccucugccguc

SEQ ID NO: 1052537 - RNA, 22 nt, Human
aacuuucuccagugccaacuau

SEQ ID NO: 1052538 - RNA, 22 nt, Human
ugcccugguuacacuggagucc

SEQ ID NO: 1052539 - RNA, 22 nt, Human
ggcuguguuccaagugucagga

SEQ ID NO: 1052540 - RNA, 22 nt, Human
cucaggcugcccugacagcccc

SEQ ID NO: 1052541 - RNA, 22 nt, Human
cagacaggguccuguccgucac

SEQ ID NO: 1052542 - RNA, 22 nt, Human
uuacagcagugggaaggaguca

SEQ ID NO: 1052543 - RNA, 22 nt, Human
aaggcugagagucacaguccua

SEQ ID NO: 1052544 - RNA, 23 nt, Human
cuuuuaacuugaucugagaccag

SEQ ID NO: 1052545 - RNA, 22 nt, Human
auuacacagcgguuacuacuag

SEQ ID NO: 1052546 - RNA, 22 nt, Human
gcagacagaugagggugcuggg

SEQ ID NO: 1052547 - RNA, 22 nt, Human
gcccaggaguugaaugcagcag

SEQ ID NO: 1052548 - RNA, 22 nt, Human
aggcugaggggcgagggacccu

SEQ ID NO: 1052549 - RNA, 22 nt, Human
gagcaguguuuguggaccugga

SEQ ID NO: 1052550 - RNA, 22 nt, Human
uguucucuaagaaaagaagcau

SEQ ID NO: 1052551 - RNA, 22 nt, Human
aaugccuuggagagccuagagg

SEQ ID NO: 1052552 - RNA, 23 nt, Human
gccaggaguggguagacuaaugc

SEQ ID NO: 1052553 - RNA, 22 nt, Human
cuaagaaaauagaagcaugcua

SEQ ID NO: 1052554 - RNA, 22 nt, Human
uucuucaaccaucuacauaaac

SEQ ID NO: 1052555 - RNA, 22 nt, Human
uagagaaaagcagggaucagga

SEQ ID NO: 1052556 - RNA, 19 nt, Human
cauggcugcugcuugggag

SEQ ID NO: 1052557 - RNA, 22 nt, Human
ugcccuggugaagugcucuccu

SEQ ID NO: 1052558 - RNA, 20 nt, Human
uuucaguuaucuugaccuuc

SEQ ID NO: 1052559 - RNA, 22 nt, Human
ccuggcugagggaccucgggua

SEQ ID NO: 1052560 - RNA, 22 nt, Human
uggcuggaauggagcugagccu

SEQ ID NO: 1052561 - RNA, 22 nt, Human
caaauacugagcacgcaaucaa

SEQ ID NO: 1052562 - RNA, 22 nt, Human
uuugacauggaauaacucauuu

SEQ ID NO: 1052563 - RNA, 22 nt, Human
agauaacucauuuuguauaucc

SEQ ID NO: 1052564 - RNA, 17 nt, Human
ugaggccugcaucagug

SEQ ID NO: 1052565 - RNA, 22 nt, Human
aaggcugagccagggccccuau

SEQ ID NO: 1052566 - RNA, 22 nt, Human
agagugcagauaagagaauguu

SEQ ID NO: 1052567 - RNA, 22 nt, Human
uugauacauuuuuaggauaaac

SEQ ID NO: 1052568 - RNA, 22 nt, Human
uugcauuugagaaaguucuccu

SEQ ID NO: 1052569 - RNA, 22 nt, Human
cugcuuccauaaauaaugugcu

SEQ ID NO: 1052570 - RNA, 22 nt, Human
uagcaagaaguagcucuggauu

SEQ ID NO: 1052571 - RNA, 22 nt, Human
aggaugagccgcgcaagcugac

SEQ ID NO: 1052572 - RNA, 19 nt, Human
acaaugaauguguucucuu

SEQ ID NO: 1052573 - RNA, 22 nt, Human
uuaggaaaggaacauugaaacg

SEQ ID NO: 1052574 - RNA, 22 nt, Human
aggcugaugcuggcugaggcug

SEQ ID NO: 1052575 - RNA, 22 nt, Human
cagcuggcaaguggagcagggu

SEQ ID NO: 1052576 - RNA, 22 nt, Human
cuggccauguugccucugagac

SEQ ID NO: 1052577 - RNA, 22 nt, Human
uccaugagggacacuggaugcu

SEQ ID NO: 1052578 - RNA, 22 nt, Human
acagaaauugggcaaauggaag

SEQ ID NO: 1052579 - RNA, 22 nt, Human
aaauacuagaauucagaguuga

SEQ ID NO: 1052580 - RNA, 22 nt, Human
ccuccccugcucagaacucugg

SEQ ID NO: 1052581 - RNA, 22 nt, Human
uacuuacagagcuuauaaguua

SEQ ID NO: 1052582 - RNA, 22 nt, Human
gaauacaccaaggaaucagaau

SEQ ID NO: 1052583 - RNA, 22 nt, Human
aggguagggcccggagacagac

SEQ ID NO: 1052584 - RNA, 22 nt, Human
ugaggcccagccgcccugagag

SEQ ID NO: 1052585 - RNA, 22 nt, Human
aucuuucagggccauuuguauu

SEQ ID NO: 1052586 - RNA, 19 nt, Human
ugcaagcuuuuucuuguua

SEQ ID NO: 1052587 - RNA, 22 nt, Human
uuuucauuguuccucgagcauu

SEQ ID NO: 1052588 - RNA, 22 nt, Human
ucugaggucauuccaaggacau

SEQ ID NO: 1052589 - RNA, 22 nt, Human
cugcauuagucaugcuuugcag

SEQ ID NO: 1052590 - RNA, 22 nt, Human
aaggcagcaggauuuggugacu

SEQ ID NO: 1052591 - RNA, 22 nt, Human
cugagggcuggagcugaggccu

SEQ ID NO: 1052592 - RNA, 21 nt, Human
ucauuugugaucugauuucca

SEQ ID NO: 1052593 - RNA, 22 nt, Human
agugcuggauuacaggcgugag

SEQ ID NO: 1052594 - RNA, 22 nt, Human
uuuaacagaugugaaauuuuca

SEQ ID NO: 1052595 - RNA, 22 nt, Human
uagggcuggguacacucuugcc

SEQ ID NO: 1052596 - RNA, 22 nt, Human
uugaaagucacaauggcauuaa

SEQ ID NO: 1052597 - RNA, 19 nt, Human
gcuuuggagggagguucua

SEQ ID NO: 1052598 - RNA, 22 nt, Human
aagcagcuuuugaagagugagg

SEQ ID NO: 1052599 - RNA, 17 nt, Human
ucaggcugggugcagug

SEQ ID NO: 1052600 - RNA, 21 nt, Human
uuaccaauggcuucucuuucc

SEQ ID NO: 1052601 - RNA, 22 nt, Human
ugaggcaguauucuccauucca

SEQ ID NO: 1052602 - RNA, 22 nt, Human
uaucuguugucuuuuacaugua

SEQ ID NO: 1052603 - RNA, 22 nt, Human
agagggagugaaauggaauaga

SEQ ID NO: 1052604 - RNA, 22 nt, Human
cagcugcaguucaaugcuugcu

SEQ ID NO: 1052605 - RNA, 22 nt, Human
ucagugugaguaccaugcucag

SEQ ID NO: 1052606 - RNA, 22 nt, Human
gguggagcuggaccaggagagg

SEQ ID NO: 1052607 - RNA, 22 nt, Human
ggccaaaccgcaauuauuuuug

SEQ ID NO: 1052608 - RNA, 22 nt, Human
gagacagcacaggccacuggga

SEQ ID NO: 1052609 - RNA, 22 nt, Human
uguagaaagaauauguuucaua

SEQ ID NO: 1052610 - RNA, 22 nt, Human
ggcugcaguugugugaaggccg

SEQ ID NO: 1052611 - RNA, 22 nt, Human
ucugggaacucugucauuuccc

SEQ ID NO: 1052612 - RNA, 22 nt, Human
cccaggagauggagguugcagu

SEQ ID NO: 1052613 - RNA, 22 nt, Human
aggcugagggcuccugagggca

SEQ ID NO: 1052614 - RNA, 22 nt, Human
ugaccaaaaaauucccugugag

SEQ ID NO: 1052615 - RNA, 22 nt, Human
cagugaaaucacaacuuuaguu

SEQ ID NO: 1052616 - RNA, 20 nt, Human
ucauuacagugcuaagaugu

SEQ ID NO: 1052617 - RNA, 19 nt, Human
ucuuggcuuugucuacugu

SEQ ID NO: 1052618 - RNA, 22 nt, Human
uuucacaucagagguagauuag

SEQ ID NO: 1052619 - RNA, 22 nt, Human
cagaggucugacacugaauggu

SEQ ID NO: 1052620 - RNA, 22 nt, Human
ugaggcagggaguuuaauuguc

SEQ ID NO: 1052621 - RNA, 22 nt, Human
aggagaggcucuaacucugugu

SEQ ID NO: 1052622 - RNA, 20 nt, Human
caggagggacauuucagcau

SEQ ID NO: 1052623 - RNA, 23 nt, Human
ugcaugugaauucauacuuguuu

SEQ ID NO: 1052624 - RNA, 22 nt, Human
ucugucucaaguucuugcacuc

SEQ ID NO: 1052625 - RNA, 22 nt, Human
uggaaagucucuuuugacugua

SEQ ID NO: 1052626 - RNA, 20 nt, Human
ugagugcuccauucugccca

SEQ ID NO: 1052627 - RNA, 22 nt, Human
agagcagaggcauggccguggg

SEQ ID NO: 1052628 - RNA, 22 nt, Human
cuccuggcucgcccccagcuga

SEQ ID NO: 1052629 - RNA, 22 nt, Human
cugcugccauuagggcacagac

SEQ ID NO: 1052630 - RNA, 22 nt, Human
gggcugagauuggugcccuguc

SEQ ID NO: 1052631 - RNA, 22 nt, Human
gacaaaaguguuuugaacaagg

SEQ ID NO: 1052632 - RNA, 22 nt, Human
cagggcugagucauauagccuu

SEQ ID NO: 1052633 - RNA, 22 nt, Human
ccaggcuggauuuugcaguuca

SEQ ID NO: 1052634 - RNA, 22 nt, Human
ugccuggcaccccagucugcac

SEQ ID NO: 1052635 - RNA, 22 nt, Human
acuccugggugcauuucugauu

SEQ ID NO: 1052636 - RNA, 22 nt, Human
cagaguggcacucugcuggaug

SEQ ID NO: 1052637 - RNA, 22 nt, Human
cugcuucuaagaaccugcagcu

SEQ ID NO: 1052638 - RNA, 22 nt, Human
uugagguccaggugugggcagg

SEQ ID NO: 1052639 - RNA, 22 nt, Human
agagacugcgugucagcgcugg

SEQ ID NO: 1052640 - RNA, 17 nt, Human
ccuguguuugcuccuuc

SEQ ID NO: 1052641 - RNA, 22 nt, Human
agaccaagugcaggugccacua

SEQ ID NO: 1052642 - RNA, 22 nt, Human
agaggcagcagucauacuacag

SEQ ID NO: 1052643 - RNA, 22 nt, Human
uggcaagccugagauccgggag

SEQ ID NO: 1052644 - RNA, 22 nt, Human
cagagcuguugcggggcuuggc

SEQ ID NO: 1052645 - RNA, 22 nt, Human
accagagcuggcucugagcacc

SEQ ID NO: 1052646 - RNA, 22 nt, Human
agacccagaaagcagcugcauu

SEQ ID NO: 1052647 - RNA, 22 nt, Human
guauuaggaggaacacaggccu

SEQ ID NO: 1052648 - RNA, 22 nt, Human
ugaggggagaagcagcagccug

SEQ ID NO: 1052649 - RNA, 22 nt, Human
uccucagaaaccccugugaggu

SEQ ID NO: 1052650 - RNA, 22 nt, Human
gcugagguggagauugcaguga

SEQ ID NO: 1052651 - RNA, 22 nt, Human
uaacugguuuggcucagggucu

SEQ ID NO: 1052652 - RNA, 22 nt, Human
auuguuaugaaaauaagauguu

SEQ ID NO: 1052653 - RNA, 22 nt, Human
aggaagcucaaagccaugaugu

SEQ ID NO: 1052654 - RNA, 20 nt, Human
gcugaggucccugugguuuu

SEQ ID NO: 1052655 - RNA, 22 nt, Human
cuuuguauucaguugggcugug

SEQ ID NO: 1052656 - RNA, 22 nt, Human
agcaccauugcaaauauggcag

SEQ ID NO: 1052657 - RNA, 22 nt, Human
gaaaggccagcucacagaugag

SEQ ID NO: 1052658 - RNA, 22 nt, Human
ugcuugcuggaggcagacagaa

SEQ ID NO: 1052659 - RNA, 19 nt, Human
ccuggccagacuucugccc

SEQ ID NO: 1052660 - RNA, 22 nt, Human
uggcagacuuuagggucuacau

SEQ ID NO: 1052661 - RNA, 22 nt, Human
gcugaguguaaugauggcagag

SEQ ID NO: 1052662 - RNA, 22 nt, Human
acucuuuuauaaagcaucuuga

SEQ ID NO: 1052663 - RNA, 16 nt, Human
gcccaggacgggaggc

SEQ ID NO: 1052664 - RNA, 22 nt, Human
aaugaacauggacaaguuaaua

SEQ ID NO: 1052665 - RNA, 19 nt, Human
uuuaggauaaagucuggac

SEQ ID NO: 1052666 - RNA, 22 nt, Human
cagcuguguaugagagcaugcu

SEQ ID NO: 1052667 - RNA, 22 nt, Human
cuguauuucccacauucucuau

SEQ ID NO: 1052668 - RNA, 22 nt, Human
ccugcugugaccggggagcagg

SEQ ID NO: 1052669 - RNA, 19 nt, Human
uucccaggaaaggggugca

SEQ ID NO: 1052670 - RNA, 22 nt, Human
uagaaagaucuguaggcaagag

SEQ ID NO: 1052671 - RNA, 22 nt, Human
auuuagaacuuuguuugccaau

SEQ ID NO: 1052672 - RNA, 22 nt, Human
aggcugcuucaauggauaagau

SEQ ID NO: 1052673 - RNA, 22 nt, Human
uuguugguggaauugaugcuag

SEQ ID NO: 1052674 - RNA, 22 nt, Human
uuauguagcagaaagauguuug

SEQ ID NO: 1052675 - RNA, 20 nt, Human
auuuggcaugaaguauugau

SEQ ID NO: 1052676 - RNA, 22 nt, Human
aacagccucagugagauuagga

SEQ ID NO: 1052677 - RNA, 22 nt, Human
aggcagauuacuugaggccagg

SEQ ID NO: 1052678 - RNA, 19 nt, Human
aggcaggugcagagguccc

SEQ ID NO: 1052679 - RNA, 22 nt, Human
aaacuggugucacugagggcug

SEQ ID NO: 1052680 - RNA, 22 nt, Human
cucaggaaaggccaugcaaggg

SEQ ID NO: 1052681 - RNA, 22 nt, Human
gcuggaggauggacuggaagaa

SEQ ID NO: 1052682 - RNA, 22 nt, Human
ucaccgccuugcccggccgggc

SEQ ID NO: 1052683 - RNA, 22 nt, Human
uggucaaaaacucucaguggac

SEQ ID NO: 1052684 - RNA, 22 nt, Human
auucuuauuuaaauagagucug

SEQ ID NO: 1052685 - RNA, 22 nt, Human
gcaggcugugguauguugggca

SEQ ID NO: 1052686 - RNA, 18 nt, Human
ccuaagcuccagccccag

SEQ ID NO: 1052687 - RNA, 22 nt, Human
gcucaggacccaggugugaccu

SEQ ID NO: 1052688 - RNA, 22 nt, Human
aucuuucuauuucuaaaaacua

SEQ ID NO: 1052689 - RNA, 22 nt, Human
ucccaggaggugcuuccuagga

SEQ ID NO: 1052690 - RNA, 22 nt, Human
aggaagcuccaugaaggcagag

SEQ ID NO: 1052691 - RNA, 22 nt, Human
agucaauucuuuucaacucaag

SEQ ID NO: 1052692 - RNA, 22 nt, Human
cugcugugugaccauggacagg

SEQ ID NO: 1052693 - RNA, 22 nt, Human
aggcuagauagagggucaucuu

SEQ ID NO: 1052694 - RNA, 22 nt, Human
aggcugaguuucucauucucgc

SEQ ID NO: 1052695 - RNA, 22 nt, Human
uuggcagugaugcagcuuguuc

SEQ ID NO: 1052696 - RNA, 22 nt, Human
uagcccagcaugagcagagcug

SEQ ID NO: 1052697 - RNA, 22 nt, Human
gcccaggauggagaauaguggu

SEQ ID NO: 1052698 - RNA, 22 nt, Human
ggcagccaugcuccaggugcag

SEQ ID NO: 1052699 - RNA, 23 nt, Human
uuuggacuugugacucuucuccu

SEQ ID NO: 1052700 - RNA, 22 nt, Human
uaaauuaugucacaugacucug

SEQ ID NO: 1052701 - RNA, 22 nt, Human
cucuucucugcagccuuugaag

SEQ ID NO: 1052702 - RNA, 22 nt, Human
acuauacaguauguacgugcac

SEQ ID NO: 1052703 - RNA, 22 nt, Human
auuuccaggagaaaggauuuua

SEQ ID NO: 1052704 - RNA, 17 nt, Human
gaggacagggaaguagg

SEQ ID NO: 1052705 - RNA, 22 nt, Human
uuuacagauguggaaagugagc

SEQ ID NO: 1052706 - RNA, 23 nt, Human
ccacuagcaccuguucaacuucu

SEQ ID NO: 1052707 - RNA, 23 nt, Human
agcagcugugguuuaccuuagua

SEQ ID NO: 1052708 - RNA, 19 nt, Human
ugaaauggcaguugcuaaa

SEQ ID NO: 1052709 - RNA, 22 nt, Human
ucuguccaggcuuacuauauau

SEQ ID NO: 1052710 - RNA, 20 nt, Human
cccagguaggugccaugagu

SEQ ID NO: 1052711 - RNA, 22 nt, Human
cugccucaugcugccugcagcc

SEQ ID NO: 1052712 - RNA, 22 nt, Human
gagccagcuauguagcaagagg

SEQ ID NO: 1052713 - RNA, 22 nt, Human
uggcaccaggcgggguggcugu

SEQ ID NO: 1052714 - RNA, 22 nt, Human
ucaggugguccuaagugccauc

SEQ ID NO: 1052715 - RNA, 22 nt, Human
agacucaagacugcagaagacg

SEQ ID NO: 1052716 - RNA, 22 nt, Human
uuuauuaaaacuguuggcucug

SEQ ID NO: 1052717 - RNA, 22 nt, Human
ucugagguccugugauuucucu

SEQ ID NO: 1052718 - RNA, 22 nt, Human
ucaucugucccaggcuuuuuuc

SEQ ID NO: 1052719 - RNA, 22 nt, Human
gggaggugauuaggaccaugua

SEQ ID NO: 1052720 - RNA, 22 nt, Human
guaacugguuuucuucccucuc

SEQ ID NO: 1052721 - RNA, 22 nt, Human
uuucuucacaggguauugggug

SEQ ID NO: 1052722 - RNA, 22 nt, Human
cugccaccaugccccagcagag

SEQ ID NO: 1052723 - RNA, 22 nt, Human
uucauugucucuguuugccuuc

SEQ ID NO: 1052724 - RNA, 22 nt, Human
gaggagagaugguagauugggu

SEQ ID NO: 1052725 - RNA, 22 nt, Human
cagugguuauacuuacuguuuc

SEQ ID NO: 1052726 - RNA, 22 nt, Human
guauuaggaaauaugaagaaag

SEQ ID NO: 1052727 - RNA, 22 nt, Human
auuagguuagugugcaagagaa

SEQ ID NO: 1052728 - RNA, 22 nt, Human
cuuccuucugaagcauagaagc

SEQ ID NO: 1052729 - RNA, 22 nt, Human
agucucuuauucccuauugcug

SEQ ID NO: 1052730 - RNA, 22 nt, Human
gugcugaggugggugggcagcc

SEQ ID NO: 1052731 - RNA, 22 nt, Human
ucccaggauguuggcggcaggu

SEQ ID NO: 1052732 - RNA, 22 nt, Human
caaauacuacgauucuugcagu

SEQ ID NO: 1052733 - RNA, 22 nt, Human
ucucuggcagggauaucuggcu

SEQ ID NO: 1052734 - RNA, 22 nt, Human
cuaaaugauauuuugguuuccu

SEQ ID NO: 1052735 - RNA, 22 nt, Human
acugagcucuugacugggaguu

SEQ ID NO: 1052736 - RNA, 21 nt, Human
uagaacugacgauuucagagu

SEQ ID NO: 1052737 - RNA, 22 nt, Human
gcagacauuuugaaucuaggcu

SEQ ID NO: 1052738 - RNA, 22 nt, Human
gagugcuguaggacugagcccu

SEQ ID NO: 1052739 - RNA, 22 nt, Human
cucuggccuggggccugcuccc

SEQ ID NO: 1052740 - RNA, 22 nt, Human
ccaggagacccagggaaggagc

SEQ ID NO: 1052741 - RNA, 22 nt, Human
aggcacaggaaugucauccagu

SEQ ID NO: 1052742 - RNA, 22 nt, Human
gcccaggaaguugaggcugccg

SEQ ID NO: 1052743 - RNA, 22 nt, Human
cuucucaaaguugugaaucagg

SEQ ID NO: 1052744 - RNA, 22 nt, Human
cauauaaauacaacauguguua

SEQ ID NO: 1052745 - RNA, 22 nt, Human
agagggcagggcgguaaguccu

SEQ ID NO: 1052746 - RNA, 22 nt, Human
acccuccccaagaggucgugcc

SEQ ID NO: 1052747 - RNA, 22 nt, Human
ucccaggaauugaagccagugu

SEQ ID NO: 1052748 - RNA, 22 nt, Human
guaguuauugcuguuuacuucu

SEQ ID NO: 1052749 - RNA, 22 nt, Human
cugccugccuuggccuccagga

SEQ ID NO: 1052750 - RNA, 22 nt, Human
auucuucaccugagucagucua

SEQ ID NO: 1052751 - RNA, 22 nt, Human
caugcugugugguuagaacugu

SEQ ID NO: 1052752 - RNA, 22 nt, Human
augcuguggaaguuccugaagc

SEQ ID NO: 1052753 - RNA, 22 nt, Human
uggcucaggggucuggcucugu

SEQ ID NO: 1052754 - RNA, 19 nt, Human
cccaggagcaguauugaug

SEQ ID NO: 1052755 - RNA, 22 nt, Human
agugcagccgagaucaggugcu

SEQ ID NO: 1052756 - RNA, 23 nt, Human
uuugaaguugacugccuuccaga

SEQ ID NO: 1052757 - RNA, 22 nt, Human
ucaggaugagcucauaacuaug

SEQ ID NO: 1052758 - RNA, 23 nt, Human
ucagagagcuguugagagcugcc

SEQ ID NO: 1052759 - RNA, 22 nt, Human
ggugaagggugucauggcauuu

SEQ ID NO: 1052760 - RNA, 22 nt, Human
uuuuauugucaaugaagacaga

SEQ ID NO: 1052761 - RNA, 22 nt, Human
caggcgagugaacagacucuca

SEQ ID NO: 1052762 - RNA, 22 nt, Human
aaauacauacacuguacguggc

SEQ ID NO: 1052763 - RNA, 22 nt, Human
ugcugaggaaagaggauaaaag

SEQ ID NO: 1052764 - RNA, 22 nt, Human
acagucuugagcaucagccaga

SEQ ID NO: 1052765 - RNA, 22 nt, Human
aacugcuggggaggccaaacuc

SEQ ID NO: 1052766 - RNA, 22 nt, Human
cagcugacccagugaggaggca

SEQ ID NO: 1052767 - RNA, 19 nt, Human
cugggccagagcuguccuc

SEQ ID NO: 1052768 - RNA, 22 nt, Human
ucuucauuuuauagcaucugug

SEQ ID NO: 1052769 - RNA, 22 nt, Human
uccaggaggccucauuuccugu

SEQ ID NO: 1052770 - RNA, 21 nt, Human
agcagcugggcaacauggagg

SEQ ID NO: 1052771 - RNA, 22 nt, Human
auggccaagaaguauuccugac

SEQ ID NO: 1052772 - RNA, 22 nt, Human
uacacuaauagccacacuaaug

SEQ ID NO: 1052773 - RNA, 22 nt, Human
auucuuugcaucucuggguggc

SEQ ID NO: 1052774 - RNA, 22 nt, Human
uauuaggguaaauuugacaugc

SEQ ID NO: 1052775 - RNA, 22 nt, Human
cugcuguguuccuccugcaucu

SEQ ID NO: 1052776 - RNA, 22 nt, Human
aauccugugugacucuggggag

SEQ ID NO: 1052777 - RNA, 21 nt, Human
uggaccaaaguaauuugccuu

SEQ ID NO: 1052778 - RNA, 23 nt, Human
agacugaggcugccagggucaga

SEQ ID NO: 1052779 - RNA, 22 nt, Human
ugcaugcugcacacaugcguag

SEQ ID NO: 1052780 - RNA, 22 nt, Human
cauuuguaauacugacuugcag

SEQ ID NO: 1052781 - RNA, 22 nt, Human
aaauauagugacacuuauaguc

SEQ ID NO: 1052782 - RNA, 23 nt, Human
agggugagcaagcuauggagacc

SEQ ID NO: 1052783 - RNA, 22 nt, Human
aguuagagacacaugcacaugc

SEQ ID NO: 1052784 - RNA, 22 nt, Human
guaggcagugguuggaagagaa

SEQ ID NO: 1052785 - RNA, 22 nt, Human
gaggagaggcuggacgcgguga

SEQ ID NO: 1052786 - RNA, 22 nt, Human
auucuucacauaagugcuguac

SEQ ID NO: 1052787 - RNA, 22 nt, Human
uccuccccucagggcaacggau

SEQ ID NO: 1052788 - RNA, 22 nt, Human
accaugucauuuauuggccaaa

SEQ ID NO: 1052789 - RNA, 22 nt, Human
ccuggcugccgagugugcagcg

SEQ ID NO: 1052790 - RNA, 18 nt, Human
uggcagcuagguaaagaa

SEQ ID NO: 1052791 - RNA, 22 nt, Human
uuuugcuugagugcacaaaaug

SEQ ID NO: 1052792 - RNA, 22 nt, Human
ccuggagcucacugggagccgg

SEQ ID NO: 1052793 - RNA, 18 nt, Human
ucaggagacacagacgca

SEQ ID NO: 1052794 - RNA, 22 nt, Human
uagggaggaggguuuucaaauc

SEQ ID NO: 1052795 - RNA, 22 nt, Human
gagggcuggggcuuaggcuuag

SEQ ID NO: 1052796 - RNA, 22 nt, Human
uuugaaugcaggacauacagaa

SEQ ID NO: 1052797 - RNA, 22 nt, Human
ccuggagcaucaggaggaaggg

SEQ ID NO: 1052798 - RNA, 22 nt, Human
gugagguccaguaacuugucca

SEQ ID NO: 1052799 - RNA, 22 nt, Human
gaggcaacacauuuggaaagca

SEQ ID NO: 1052800 - RNA, 22 nt, Human
cuuuuuaucucuuaaugauguu

SEQ ID NO: 1052801 - RNA, 22 nt, Human
uagagcugggcagugcucugag

SEQ ID NO: 1052802 - RNA, 22 nt, Human
aaaaacuguaauuacuuuugca

SEQ ID NO: 1052803 - RNA, 21 nt, Human
uucuucaguuuaauauaaaau

SEQ ID NO: 1052804 - RNA, 22 nt, Human
gaggagcuugaggcuaggagcc

SEQ ID NO: 1052805 - RNA, 22 nt, Human
aaacugguagcaauuuaagggu

SEQ ID NO: 1052806 - RNA, 22 nt, Human
uagugucaugaaaaguacacua

SEQ ID NO: 1052807 - RNA, 22 nt, Human
uuuuaugauugagcuggcuaca

SEQ ID NO: 1052808 - RNA, 22 nt, Human
cugaauuaauacacagaauggc

SEQ ID NO: 1052809 - RNA, 22 nt, Human
acauguuuaaguuuaaugaaaa

SEQ ID NO: 1052810 - RNA, 22 nt, Human
cugccugccacguucagcugua

SEQ ID NO: 1052811 - RNA, 22 nt, Human
ggcugcugagucacgacaguga

SEQ ID NO: 1052812 - RNA, 22 nt, Human
ggcucagaccucccagcuccag

SEQ ID NO: 1052813 - RNA, 22 nt, Human
auuagguaaucuuuagauacac

SEQ ID NO: 1052814 - RNA, 22 nt, Human
ucaggauaaaauguaauggcaa

SEQ ID NO: 1052815 - RNA, 22 nt, Human
cccaggaagagugaguggcauu

SEQ ID NO: 1052816 - RNA, 22 nt, Human
aagcaguuuagauaggcaaagg

SEQ ID NO: 1052817 - RNA, 22 nt, Human
auuauuauuguugauguuaggg

SEQ ID NO: 1052818 - RNA, 22 nt, Human
cucaguuuccucuucuguugaa

SEQ ID NO: 1052819 - RNA, 22 nt, Human
ucaguucugcuagaaaaacagu

SEQ ID NO: 1052820 - RNA, 23 nt, Human
uccuuccuuugagaggcuccauc

SEQ ID NO: 1052821 - RNA, 21 nt, Human
gaccccagaccagcagacaca

SEQ ID NO: 1052822 - RNA, 22 nt, Human
auggaguucuuuaaauucacag

SEQ ID NO: 1052823 - RNA, 22 nt, Human
uccaggagugauaaggccacug

SEQ ID NO: 1052824 - RNA, 22 nt, Human
aacugguauggugagaagagag

SEQ ID NO: 1052825 - RNA, 22 nt, Human
ccuccuggagcauuggugagga

SEQ ID NO: 1052826 - RNA, 22 nt, Human
uuuccaagacuccaguucuccc

SEQ ID NO: 1052827 - RNA, 22 nt, Human
uaaggccaaacuauuauaguuc

SEQ ID NO: 1052828 - RNA, 18 nt, Human
gucacuguguuucugagc

SEQ ID NO: 1052829 - RNA, 22 nt, Human
auuugaauggcuuaacacaacg

SEQ ID NO: 1052830 - RNA, 22 nt, Human
uauugaugcuuggauugggcca

SEQ ID NO: 1052831 - RNA, 22 nt, Human
aggcagcagucaugaggaaaga

SEQ ID NO: 1052832 - RNA, 22 nt, Human
uugagaagaaauaguuugcaau

SEQ ID NO: 1052833 - RNA, 20 nt, Human
guggcaggcagugaaggagc

SEQ ID NO: 1052834 - RNA, 22 nt, Human
aacacuuuccugccuuucugau

SEQ ID NO: 1052835 - RNA, 22 nt, Human
gucuucuuguuuugaaggaaau

SEQ ID NO: 1052836 - RNA, 22 nt, Human
cugagccaccggcagggacauc

SEQ ID NO: 1052837 - RNA, 22 nt, Human
uucuugcaggucacucacugag

SEQ ID NO: 1052838 - RNA, 22 nt, Human
caaaugaagggagcugaagucu

SEQ ID NO: 1052839 - RNA, 22 nt, Human
gccucugcaauuacauugugcc

SEQ ID NO: 1052840 - RNA, 22 nt, Human
uuagaaaacauaagugguaaag

SEQ ID NO: 1052841 - RNA, 22 nt, Human
aggcagcuggaggcagagacua

SEQ ID NO: 1052842 - RNA, 22 nt, Human
ccauccuaucugaccuacuugu

SEQ ID NO: 1052843 - RNA, 22 nt, Human
cuuuguaucuaaauaucuugaa

SEQ ID NO: 1052844 - RNA, 22 nt, Human
cauaauaucuccgauuacuugc

SEQ ID NO: 1052845 - RNA, 22 nt, Human
uugcaauagccuuauuuccaaa

SEQ ID NO: 1052846 - RNA, 23 nt, Human
auguuauuauuagcagucuugcc

SEQ ID NO: 1052847 - RNA, 22 nt, Human
uauuuccaccuauuauuuucug

SEQ ID NO: 1052848 - RNA, 22 nt, Human
cuggcugugcagucuuccagaa

SEQ ID NO: 1052849 - RNA, 22 nt, Human
uauuagugaaagaauuaguuug

SEQ ID NO: 1052850 - RNA, 22 nt, Human
ucccaggacuuccaguuggagg

SEQ ID NO: 1052851 - RNA, 22 nt, Human
gcaagcugaugugauagugaaa

SEQ ID NO: 1052852 - RNA, 22 nt, Human
uagcagaggcugucugacuuaa

SEQ ID NO: 1052853 - RNA, 22 nt, Human
ugcuucagaggaaaggcaaaag

SEQ ID NO: 1052854 - RNA, 22 nt, Human
uuugaauagaggccccucagaa

SEQ ID NO: 1052855 - RNA, 22 nt, Human
agugcugucaguuuuauagaua

SEQ ID NO: 1052856 - RNA, 22 nt, Human
aucuucucaagcagcauccugu

SEQ ID NO: 1052857 - RNA, 22 nt, Human
cugccaggcacgugcagcauca

SEQ ID NO: 1052858 - RNA, 22 nt, Human
gugggguagaucuuucucagga

SEQ ID NO: 1052859 - RNA, 22 nt, Human
aggucacccguuugacuaucca

SEQ ID NO: 1052860 - RNA, 22 nt, Human
ugaaaugaagggcuuguucugg

SEQ ID NO: 1052861 - RNA, 23 nt, Human
ugagacccuaauuuagcaagugu

SEQ ID NO: 1052862 - RNA, 18 nt, Human
agcugaggggacugaaga

SEQ ID NO: 1052863 - RNA, 22 nt, Human
cuauuacauuucuggacauuca

SEQ ID NO: 1052864 - RNA, 22 nt, Human
agauggaguuaguaccagaguc

SEQ ID NO: 1052865 - RNA, 22 nt, Human
agccacagagagggagcugcaa

SEQ ID NO: 1052866 - RNA, 22 nt, Human
ucaggcugaaaggacuccaguu

SEQ ID NO: 1052867 - RNA, 22 nt, Human
gaggaaccacucugagaagcca

SEQ ID NO: 1052868 - RNA, 22 nt, Human
uucauguguauggaacauuuuu

SEQ ID NO: 1052869 - RNA, 18 nt, Human
agcuucccucugagaggg

SEQ ID NO: 1052870 - RNA, 21 nt, Human
gccaccccuggcacaggugcu

SEQ ID NO: 1052871 - RNA, 22 nt, Human
cccaggagccaucugucuuggc

SEQ ID NO: 1052872 - RNA, 22 nt, Human
ugaaaugacagucuuaagcucu

SEQ ID NO: 1052873 - RNA, 22 nt, Human
agcuccugcucuuugucccuaa

SEQ ID NO: 1052874 - RNA, 22 nt, Human
cugaggccggagcacugaagag

SEQ ID NO: 1052875 - RNA, 22 nt, Human
auuaggauguuccuaugcacau

SEQ ID NO: 1052876 - RNA, 19 nt, Human
uuucuuaggccuuuggccu

SEQ ID NO: 1052877 - RNA, 22 nt, Human
accaggagcauuuuuuauuagu

SEQ ID NO: 1052878 - RNA, 22 nt, Human
gucaggaucucccaguacauau

SEQ ID NO: 1052879 - RNA, 22 nt, Human
gagccaagaucgcaccacugca

SEQ ID NO: 1052880 - RNA, 21 nt, Human
gcugcccaacccugcaucucc

SEQ ID NO: 1052881 - RNA, 22 nt, Human
uacuuuuuagcacagugugugc

SEQ ID NO: 1052882 - RNA, 22 nt, Human
auuaaauacugcaggcuaagca

SEQ ID NO: 1052883 - RNA, 22 nt, Human
cagcugcuuucagcaggaggga

SEQ ID NO: 1052884 - RNA, 19 nt, Human
agccacagaacuugcagga

SEQ ID NO: 1052885 - RNA, 22 nt, Human
cccuuccugggugucccggagu

SEQ ID NO: 1052886 - RNA, 22 nt, Human
aacuuucuuucacagaaguauc

SEQ ID NO: 1052887 - RNA, 22 nt, Human
uuucugugguggguaguucaga

SEQ ID NO: 1052888 - RNA, 22 nt, Human
uuccaugaagggcagccucuca

SEQ ID NO: 1052889 - RNA, 22 nt, Human
gcugagagaucaaggcaggauu

SEQ ID NO: 1052890 - RNA, 21 nt, Human
gaaauacugccuuaggagcug

SEQ ID NO: 1052891 - RNA, 22 nt, Human
ggaggagggguuuacauuggaa

SEQ ID NO: 1052892 - RNA, 22 nt, Human
caugugguucaaguacuccaca

SEQ ID NO: 1052893 - RNA, 22 nt, Human
ucuaagaucuacuauacaugug

SEQ ID NO: 1052894 - RNA, 22 nt, Human
gaggcagcggcucacagagaaa

SEQ ID NO: 1052895 - RNA, 22 nt, Human
gggcagcuccuguggaauccac

SEQ ID NO: 1052896 - RNA, 22 nt, Human
caggcagggagcuggaaaggau

SEQ ID NO: 1052897 - RNA, 21 nt, Human
uguaaguuucaucugaauugg

SEQ ID NO: 1052898 - RNA, 22 nt, Human
caagagagaugcagcucacuca

SEQ ID NO: 1052899 - RNA, 22 nt, Human
uuggcaggaauauugcagaggu

SEQ ID NO: 1052900 - RNA, 20 nt, Human
ucacuaguaaccaucugcuu

SEQ ID NO: 1052901 - RNA, 22 nt, Human
ggcaucuccaaaacaugaacuc

SEQ ID NO: 1052902 - RNA, 22 nt, Human
ggcugcagaggcgaucugaggu

SEQ ID NO: 1052903 - RNA, 22 nt, Human
ggcugcuguuucagagacuguu

SEQ ID NO: 1052904 - RNA, 22 nt, Human
cagaccagaaggaagccgacaa

SEQ ID NO: 1052905 - RNA, 22 nt, Human
ugccugggccuucccaccucug

SEQ ID NO: 1052906 - RNA, 22 nt, Human
agcacuguggggaacucacaga

SEQ ID NO: 1052907 - RNA, 22 nt, Human
ugaaggcuugacugaggcagga

SEQ ID NO: 1052908 - RNA, 22 nt, Human
gaaauauuucucuugagccccu

SEQ ID NO: 1052909 - RNA, 22 nt, Human
acagaaauucaaacuggaauuu

SEQ ID NO: 1052910 - RNA, 22 nt, Human
gacggcagaaacucaugagguc

SEQ ID NO: 1052911 - RNA, 21 nt, Human
cccaggagaagaaaagaugca

SEQ ID NO: 1052912 - RNA, 22 nt, Human
agugcugagugauugcaaagga

SEQ ID NO: 1052913 - RNA, 22 nt, Human
cuauuagguaugcagccuauuu

SEQ ID NO: 1052914 - RNA, 22 nt, Human
ucugggaguuagaauacauggg

SEQ ID NO: 1052915 - RNA, 22 nt, Human
guuaauaaagguauagaaucag

SEQ ID NO: 1052916 - RNA, 22 nt, Human
cugcuuuggacaacuauucuug

SEQ ID NO: 1052917 - RNA, 22 nt, Human
gugaauuaaauauagccagguc

SEQ ID NO: 1052918 - RNA, 18 nt, Human
gaugggagcaagagaaga

SEQ ID NO: 1052919 - RNA, 22 nt, Human
gcccaggaguuggaggcugcag

SEQ ID NO: 1052920 - RNA, 22 nt, Human
uucuucucagggucccacaugg

SEQ ID NO: 1052921 - RNA, 22 nt, Human
auauuucaugggguuccauacu

SEQ ID NO: 1052922 - RNA, 19 nt, Human
ggcaggcuggauagagagg

SEQ ID NO: 1052923 - RNA, 22 nt, Human
cagcucagacgcaggucgagca

SEQ ID NO: 1052924 - RNA, 22 nt, Human
acuuccugcaaucguccacucc

SEQ ID NO: 1052925 - RNA, 22 nt, Human
cuggagaggcugggaacagguu

SEQ ID NO: 1052926 - RNA, 22 nt, Human
ccagaggaggggggucuuucug

SEQ ID NO: 1052927 - RNA, 22 nt, Human
aggcugaggcgggaggaucacu

SEQ ID NO: 1052928 - RNA, 22 nt, Human
uggccauagcucagcuccuuca

SEQ ID NO: 1052929 - RNA, 20 nt, Human
guugaaaguaauaugaugcu

SEQ ID NO: 1052930 - RNA, 22 nt, Human
uuagccaugcccuagaagagga

SEQ ID NO: 1052931 - RNA, 21 nt, Human
uucucagagucuauuacaguu

SEQ ID NO: 1052932 - RNA, 22 nt, Human
gaggccacaguccugaggcauc

SEQ ID NO: 1052933 - RNA, 22 nt, Human
caucaucaaaagugacagagaa

SEQ ID NO: 1052934 - RNA, 21 nt, Human
gggugggaggacacagcaggc

SEQ ID NO: 1052935 - RNA, 20 nt, Human
ccucaguguccuggacuggg

SEQ ID NO: 1052936 - RNA, 22 nt, Human
uggaggccgcguagucugagca

SEQ ID NO: 1052937 - RNA, 22 nt, Human
caaggccaugagcagcgagugu

SEQ ID NO: 1052938 - RNA, 21 nt, Human
ucacagacuggucagugaggc

SEQ ID NO: 1052939 - RNA, 22 nt, Human
ugcauggacucaucagacaaga

SEQ ID NO: 1052940 - RNA, 22 nt, Human
ucacugucugaaagaaauggcc

SEQ ID NO: 1052941 - RNA, 22 nt, Human
uuuaggauaacuccaguuuucc

SEQ ID NO: 1052942 - RNA, 22 nt, Human
uuauuuaaaagugguaagauuc

SEQ ID NO: 1052943 - RNA, 22 nt, Human
caagaugugccuaaucagaccu

SEQ ID NO: 1052944 - RNA, 22 nt, Human
uuuacauuucccucugucaguu

SEQ ID NO: 1052945 - RNA, 22 nt, Human
cagaggcacaagaaagcaaggc

SEQ ID NO: 1052946 - RNA, 22 nt, Human
gcccaggauaaugcugucccug

SEQ ID NO: 1052947 - RNA, 22 nt, Human
gcucacugccauucucuagaug

SEQ ID NO: 1052948 - RNA, 17 nt, Human
ugaggcucggugaggag

SEQ ID NO: 1052949 - RNA, 20 nt, Human
cauacacuauucuguauagu

SEQ ID NO: 1052950 - RNA, 22 nt, Human
accaggaggccuugguucugag

SEQ ID NO: 1052951 - RNA, 22 nt, Human
uggucaaaagaaagcucagaac

SEQ ID NO: 1052952 - RNA, 22 nt, Human
ucugcuguucauucuuuuagcu

SEQ ID NO: 1052953 - RNA, 20 nt, Human
gaaauacuuacccaacuguu

SEQ ID NO: 1052954 - RNA, 22 nt, Human
guuuucugauuagcaaaucuga

SEQ ID NO: 1052955 - RNA, 22 nt, Human
uucagugucaauuuuuaaauau

SEQ ID NO: 1052956 - RNA, 22 nt, Human
augguacaauguguuuguuagg

SEQ ID NO: 1052957 - RNA, 22 nt, Human
agagguagagguugcagugagc

SEQ ID NO: 1052958 - RNA, 22 nt, Human
uagaaaugugauaauagcuuaa

SEQ ID NO: 1052959 - RNA, 22 nt, Human
gagcccugaacaacagcaggaa

SEQ ID NO: 1052960 - RNA, 22 nt, Human
uagugcuuuaggccugaguguc

SEQ ID NO: 1052961 - RNA, 22 nt, Human
uccauuuuagaagaaaauccac

SEQ ID NO: 1052962 - RNA, 22 nt, Human
auucugagacaauugccgucag

SEQ ID NO: 1052963 - RNA, 23 nt, Human
uggacgccgacuuuggaggcgcu

SEQ ID NO: 1052964 - RNA, 22 nt, Human
ccccaggagauuugggagcaca

SEQ ID NO: 1052965 - RNA, 22 nt, Human
ucaaauaaugccauucaucauc

SEQ ID NO: 1052966 - RNA, 22 nt, Human
ccugguugagggagguguggac

SEQ ID NO: 1052967 - RNA, 22 nt, Human
uuggccaagggcucuuuaggcu

SEQ ID NO: 1052968 - RNA, 22 nt, Human
cagcacaguagaguaguuguaa

SEQ ID NO: 1052969 - RNA, 22 nt, Human
gaaguacaguuuuaucuagcca

SEQ ID NO: 1052970 - RNA, 22 nt, Human
gcagaggcuguagggaagguug

SEQ ID NO: 1052971 - RNA, 23 nt, Human
ucuagaaaaugaaagaaugcagu

SEQ ID NO: 1052972 - RNA, 22 nt, Human
aggccaaagcucaccugcagcu

SEQ ID NO: 1052973 - RNA, 22 nt, Human
uacuaucucuucuaacuucaga

SEQ ID NO: 1052974 - RNA, 22 nt, Human
gauguagagggaagauuuuaaa

SEQ ID NO: 1052975 - RNA, 22 nt, Human
cuggagucacucauguagcugc

SEQ ID NO: 1052976 - RNA, 22 nt, Human
gcuggcuguaucaccuggccag

SEQ ID NO: 1052977 - RNA, 22 nt, Human
uaacucuagucccaggcaugaa

SEQ ID NO: 1052978 - RNA, 22 nt, Human
uccuggccuuauccccaaacug

SEQ ID NO: 1052979 - RNA, 22 nt, Human
uccuggcccggccgggccugcu

SEQ ID NO: 1052980 - RNA, 22 nt, Human
uggcagcugcguuguguuucug

SEQ ID NO: 1052981 - RNA, 22 nt, Human
cugaggccuaagacaugaauga

SEQ ID NO: 1052982 - RNA, 22 nt, Human
aacauaaauuugaaguggcaaa

SEQ ID NO: 1052983 - RNA, 22 nt, Human
cagaugaggcaaccucauugcu

SEQ ID NO: 1052984 - RNA, 22 nt, Human
ucacagaacaauguuuaguucu

SEQ ID NO: 1052985 - RNA, 22 nt, Human
acauacauauguuuaaaugcau

SEQ ID NO: 1052986 - RNA, 22 nt, Human
uuuaucagagauauguguggac

SEQ ID NO: 1052987 - RNA, 22 nt, Human
gauacaguauuuaaagagcaac

SEQ ID NO: 1052988 - RNA, 22 nt, Human
auguaguuagaagauucaaaca

SEQ ID NO: 1052989 - RNA, 22 nt, Human
uugugguuaaccgcacauuuuu

SEQ ID NO: 1052990 - RNA, 22 nt, Human
ccugggcaucucaugcaccugc

SEQ ID NO: 1052991 - RNA, 20 nt, Human
guaacucuggcuaaguaaau

SEQ ID NO: 1052992 - RNA, 22 nt, Human
uuagccaugugggaaaaacagc

SEQ ID NO: 1052993 - RNA, 21 nt, Human
acauuuucuguuuuaggaagu

SEQ ID NO: 1052994 - RNA, 22 nt, Human
aggcuagcuuuggcucaguaaa

SEQ ID NO: 1052995 - RNA, 22 nt, Human
ucugaaaugcaaauuugacuga

SEQ ID NO: 1052996 - RNA, 22 nt, Human
uaauuauagcauuggaguggcc

SEQ ID NO: 1052997 - RNA, 22 nt, Human
gagcuguccaagauggucguaa

SEQ ID NO: 1052998 - RNA, 22 nt, Human
uugcagcuucgagucuaucugu

SEQ ID NO: 1052999 - RNA, 22 nt, Human
cucuucuugaaagaggaauuca

SEQ ID NO: 1053000 - RNA, 22 nt, Human
caggugacccucucaccugcuu

SEQ ID NO: 1053001 - RNA, 22 nt, Human
cugagguggcauccuagcucua

SEQ ID NO: 1053002 - RNA, 22 nt, Human
cuccaggaaagccugaggcccg

SEQ ID NO: 1053003 - RNA, 22 nt, Human
augaaacacacacgcgcauacu

SEQ ID NO: 1053004 - RNA, 22 nt, Human
gacuuucuuguagugucugaug

SEQ ID NO: 1053005 - RNA, 22 nt, Human
gauauagguucauaguguuaca

SEQ ID NO: 1053006 - RNA, 22 nt, Human
ccucagcuugauuucugcagag

SEQ ID NO: 1053007 - RNA, 22 nt, Human
uucugaaccauugagcacugcc

SEQ ID NO: 1053008 - RNA, 22 nt, Human
ucauuauuuuggacuggagugu

SEQ ID NO: 1053009 - RNA, 22 nt, Human
ccugaggucagccauucuugcc

SEQ ID NO: 1053010 - RNA, 22 nt, Human
gcugcagacugggaggcaggug

SEQ ID NO: 1053011 - RNA, 22 nt, Human
cuguccugauggugccacuggu

SEQ ID NO: 1053012 - RNA, 22 nt, Human
cugccucuccccagaguggccc

SEQ ID NO: 1053013 - RNA, 20 nt, Human
agacaggagcccccauucag

SEQ ID NO: 1053014 - RNA, 18 nt, Human
ccagagcuggcuccucgc

SEQ ID NO: 1053015 - RNA, 19 nt, Human
cagcaagaaugaaggcaua

SEQ ID NO: 1053016 - RNA, 22 nt, Human
auugaaagcacaaagaacaagu

SEQ ID NO: 1053017 - RNA, 22 nt, Human
ggcuggagacaacguccugccc

SEQ ID NO: 1053018 - RNA, 22 nt, Human
gcccaggagccuggagaugugu

SEQ ID NO: 1053019 - RNA, 18 nt, Human
ucccucccugcuguggcc

SEQ ID NO: 1053020 - RNA, 20 nt, Human
acuugcugggcuuuguuacc

SEQ ID NO: 1053021 - RNA, 22 nt, Human
uuccuuaguugacugucuuagu

SEQ ID NO: 1053022 - RNA, 22 nt, Human
uccugagcuucaaaacacuuug

SEQ ID NO: 1053023 - RNA, 22 nt, Human
cagaggcauacucccagucuug

SEQ ID NO: 1053024 - RNA, 20 nt, Human
gaguuccccauuucuccugg

SEQ ID NO: 1053025 - RNA, 22 nt, Human
gcuuuauuuugugagggauuac

SEQ ID NO: 1053026 - RNA, 22 nt, Human
ggcugcugcccaccccugcaug

SEQ ID NO: 1053027 - RNA, 16 nt, Human
aaggagggaagagaau

SEQ ID NO: 1053028 - RNA, 22 nt, Human
uagggcuguggucaguccucua

SEQ ID NO: 1053029 - RNA, 22 nt, Human
uagaacugacguuagggaagaa

SEQ ID NO: 1053030 - RNA, 22 nt, Human
aaaauaacuucuacuauuugca

SEQ ID NO: 1053031 - RNA, 22 nt, Human
ucugaggugucacaaggccagg

SEQ ID NO: 1053032 - RNA, 22 nt, Human
augcccugcucucgggaaggga

SEQ ID NO: 1053033 - RNA, 22 nt, Human
ugaacucucucaagugacagaa

SEQ ID NO: 1053034 - RNA, 17 nt, Human
aggccagaugaggcaag

SEQ ID NO: 1053035 - RNA, 22 nt, Human
gguuauauaauucagugcuuuc

SEQ ID NO: 1053036 - RNA, 22 nt, Human
aagugaccucaugguuucuccu

SEQ ID NO: 1053037 - RNA, 22 nt, Human
uuucacaaaugucuuuaacuug

SEQ ID NO: 1053038 - RNA, 22 nt, Human
uaaaugaagaaauggagauugu

SEQ ID NO: 1053039 - RNA, 22 nt, Human
acuguguggaccacucugaggc

SEQ ID NO: 1053040 - RNA, 22 nt, Human
ucuggcugaagcuuuugcagcu

SEQ ID NO: 1053041 - RNA, 22 nt, Human
acccaggacaugggcacccgug

SEQ ID NO: 1053042 - RNA, 19 nt, Human
uggcagggagaguuugaag

SEQ ID NO: 1053043 - RNA, 23 nt, Human
uuuauccaacucuguaaucucuc

SEQ ID NO: 1053044 - RNA, 22 nt, Human
aggacagcccuugagagcacau

SEQ ID NO: 1053045 - RNA, 21 nt, Human
acucaggagacuaacuauguc

SEQ ID NO: 1053046 - RNA, 22 nt, Human
ugcaggaaauuccaggguggcc

SEQ ID NO: 1053047 - RNA, 22 nt, Human
augauguuaccaguacuuagag

SEQ ID NO: 1053048 - RNA, 22 nt, Human
ggauggcaggacaaggacccag

SEQ ID NO: 1053049 - RNA, 22 nt, Human
uagcaagagugggcuuuguggg

SEQ ID NO: 1053050 - RNA, 22 nt, Human
uuuauguaauuucauaggugug

SEQ ID NO: 1053051 - RNA, 22 nt, Human
uugcugaaguuaaugcuugcaa

SEQ ID NO: 1053052 - RNA, 20 nt, Human
ucucagcauaagaacccuuc

SEQ ID NO: 1053053 - RNA, 22 nt, Human
gagcaagacucacugcaucuug

SEQ ID NO: 1053054 - RNA, 22 nt, Human
uuagacaggauguaugaaagcu

SEQ ID NO: 1053055 - RNA, 22 nt, Human
ucagccucucugaguccagacc

SEQ ID NO: 1053056 - RNA, 22 nt, Human
uauacagucuuuugcuauauuc

SEQ ID NO: 1053057 - RNA, 22 nt, Human
ucuucagacuccaaauguuuua

SEQ ID NO: 1053058 - RNA, 22 nt, Human
gguuugaacagcuuuggagaag

SEQ ID NO: 1053059 - RNA, 22 nt, Human
guucuucaggccauccucccag

SEQ ID NO: 1053060 - RNA, 22 nt, Human
gagggucccugcucagggccag

SEQ ID NO: 1053061 - RNA, 22 nt, Human
gagcagcucugugccuggagac

SEQ ID NO: 1053062 - RNA, 22 nt, Human
uuaacaugucuugacuucaucu

SEQ ID NO: 1053063 - RNA, 22 nt, Human
aguaccaugcuuccugacuggu

SEQ ID NO: 1053064 - RNA, 22 nt, Human
acacuaguauuucuauaaguga

SEQ ID NO: 1053065 - RNA, 22 nt, Human
uaguacaguggagagcaaagaa

SEQ ID NO: 1053066 - RNA, 22 nt, Human
ucugcaggcuuggaguggcagc

SEQ ID NO: 1053067 - RNA, 22 nt, Human
uaucuguuguaguacagaugau

SEQ ID NO: 1053068 - RNA, 22 nt, Human
aggaaaaauaaggcagcagggc

SEQ ID NO: 1053069 - RNA, 22 nt, Human
uucucagauccaucagaagucc

SEQ ID NO: 1053070 - RNA, 22 nt, Human
ugaggcucauucugcaugccaa

SEQ ID NO: 1053071 - RNA, 22 nt, Human
aucaggauucaguaucuccagc

SEQ ID NO: 1053072 - RNA, 22 nt, Human
aggcugaggagggauguugcuu

SEQ ID NO: 1053073 - RNA, 22 nt, Human
auucuucauuuacuguuacuug

SEQ ID NO: 1053074 - RNA, 22 nt, Human
uauuagguuggugcaacaguaa

SEQ ID NO: 1053075 - RNA, 22 nt, Human
ggcugagaacaggcccagccuc

SEQ ID NO: 1053076 - RNA, 22 nt, Human
agcacagguacggagaugcuac

SEQ ID NO: 1053077 - RNA, 22 nt, Human
aggauauuugcuuaagauagcu

SEQ ID NO: 1053078 - RNA, 22 nt, Human
cuuaaauucuuaaugcccucau

SEQ ID NO: 1053079 - RNA, 22 nt, Human
acccaggagacagguugcagug

SEQ ID NO: 1053080 - RNA, 22 nt, Human
ucucaggaaauaggauuugagu

SEQ ID NO: 1053081 - RNA, 22 nt, Human
uuggcaguaaaagaaaaugcuu

SEQ ID NO: 1053082 - RNA, 22 nt, Human
gagugucagugcuuggggcuac

SEQ ID NO: 1053083 - RNA, 22 nt, Human
ggacugaggcccacuugaggga

SEQ ID NO: 1053084 - RNA, 22 nt, Human
uucucagauauuuacugagcau

SEQ ID NO: 1053085 - RNA, 20 nt, Human
uauauaggaaauauuguguu

SEQ ID NO: 1053086 - RNA, 22 nt, Human
uugaggucaaguaaccacugga

SEQ ID NO: 1053087 - RNA, 22 nt, Human
guauuagucaauuacagugggg

SEQ ID NO: 1053088 - RNA, 22 nt, Human
aagcacugagcacaguggcuga

SEQ ID NO: 1053089 - RNA, 17 nt, Human
uugaacugcugagucag

SEQ ID NO: 1053090 - RNA, 22 nt, Human
cagcugugaauugucuuaucua

SEQ ID NO: 1053091 - RNA, 22 nt, Human
acccaggacacagagaugaccc

SEQ ID NO: 1053092 - RNA, 19 nt, Human
agggccugagcagauguug

SEQ ID NO: 1053093 - RNA, 20 nt, Human
ugugaaagcaguagaaugac

SEQ ID NO: 1053094 - RNA, 22 nt, Human
uucuucuucauuucugacgaug

SEQ ID NO: 1053095 - RNA, 22 nt, Human
augcuguguuugagaaccuagg

SEQ ID NO: 1053096 - RNA, 22 nt, Human
acugguguugauuuggaagggg

SEQ ID NO: 1053097 - RNA, 22 nt, Human
cccagggacagcuagguggggc

SEQ ID NO: 1053098 - RNA, 22 nt, Human
uacucagagucauugcccuucu

SEQ ID NO: 1053099 - RNA, 22 nt, Human
cagggucuuggcgccaucaccc

SEQ ID NO: 1053100 - RNA, 22 nt, Human
agggccuggaacugugggcagg

SEQ ID NO: 1053101 - RNA, 21 nt, Human
ucaggcugaugucgauguuag

SEQ ID NO: 1053102 - RNA, 22 nt, Human
aguuaaagaaagauaauucgcc

SEQ ID NO: 1053103 - RNA, 22 nt, Human
ugcugagggagggguuuuccag

SEQ ID NO: 1053104 - RNA, 22 nt, Human
cauuuauucauuugcuagggcu

SEQ ID NO: 1053105 - RNA, 22 nt, Human
ucaggcugcuuucaugcuuaga

SEQ ID NO: 1053106 - RNA, 22 nt, Human
uuggcacagagcugcagccugg

SEQ ID NO: 1053107 - RNA, 22 nt, Human
aaggcagcagugcacgacugau

SEQ ID NO: 1053108 - RNA, 20 nt, Human
gggcagcuccccucauucug

SEQ ID NO: 1053109 - RNA, 22 nt, Human
uaggauguagcuaugucaucau

SEQ ID NO: 1053110 - RNA, 22 nt, Human
aucacauugccagugauuaccc

SEQ ID NO: 1053111 - RNA, 22 nt, Human
guucuucaggcugugcucuaga

SEQ ID NO: 1053112 - RNA, 22 nt, Human
gcugccucugcgacucugggcg

SEQ ID NO: 1053113 - RNA, 22 nt, Human
uuggcagagaguaugcugaaga

SEQ ID NO: 1053114 - RNA, 22 nt, Human
uacaguaagaugaaauagcaau

SEQ ID NO: 1053115 - RNA, 22 nt, Human
aggacagcaguuggugagguuc

SEQ ID NO: 1053116 - RNA, 22 nt, Human
uagaacugcucucauacuugcu

SEQ ID NO: 1053117 - RNA, 22 nt, Human
uucaucaauguguuuaauaaug

SEQ ID NO: 1053118 - RNA, 22 nt, Human
auugcuguacacuucuagaucu

SEQ ID NO: 1053119 - RNA, 22 nt, Human
uucugccuucaguccucugacu

SEQ ID NO: 1053120 - RNA, 22 nt, Human
gccugccuguuggcugaggugc

SEQ ID NO: 1053121 - RNA, 22 nt, Human
gagcccuguagcaagucauguc

SEQ ID NO: 1053122 - RNA, 18 nt, Human
cgaggcaggcggaucacg

SEQ ID NO: 1053123 - RNA, 22 nt, Human
cuggccaaugccuggggaauag

SEQ ID NO: 1053124 - RNA, 17 nt, Human
acagagcacaucaagau

SEQ ID NO: 1053125 - RNA, 22 nt, Human
agguaacacuacuuaguauacu

SEQ ID NO: 1053126 - RNA, 22 nt, Human
cccaggauggggcugcaguuau

SEQ ID NO: 1053127 - RNA, 22 nt, Human
acugaggucaugcauaguuucu

SEQ ID NO: 1053128 - RNA, 22 nt, Human
uggaggaaguugcuggaaguca

SEQ ID NO: 1053129 - RNA, 22 nt, Human
uaacugccagcagcgaugaaca

SEQ ID NO: 1053130 - RNA, 23 nt, Human
ucucuuucaagagcuuaaugugc

SEQ ID NO: 1053131 - RNA, 22 nt, Human
gugugcagggaugagugcaggu

SEQ ID NO: 1053132 - RNA, 22 nt, Human
auuuuacuacuccaauuaauga

SEQ ID NO: 1053133 - RNA, 22 nt, Human
uccugccuugccugggacauca

SEQ ID NO: 1053134 - RNA, 22 nt, Human
acccagaggcggagguugcagu

SEQ ID NO: 1053135 - RNA, 22 nt, Human
guagcagaaucagugcuacaga

SEQ ID NO: 1053136 - RNA, 22 nt, Human
aaggcaguaggaucuuccacag

SEQ ID NO: 1053137 - RNA, 22 nt, Human
cacuggugaguccagaagucau

SEQ ID NO: 1053138 - RNA, 22 nt, Human
ugauugaacugagcuucaagau

SEQ ID NO: 1053139 - RNA, 22 nt, Human
cucccagagaccaagcugagaa

SEQ ID NO: 1053140 - RNA, 23 nt, Human
cagggcugguagggaagagcgug

SEQ ID NO: 1053141 - RNA, 22 nt, Human
uaggcagcugcaaacuucgguc

SEQ ID NO: 1053142 - RNA, 22 nt, Human
cagggagggaggaaaauuugcu

SEQ ID NO: 1053143 - RNA, 22 nt, Human
ugcaccuucauuuuaggcagcu

SEQ ID NO: 1053144 - RNA, 22 nt, Human
cccugccuucuuggccuuuaaa

SEQ ID NO: 1053145 - RNA, 20 nt, Human
accagagcucucaguaugug

SEQ ID NO: 1053146 - RNA, 22 nt, Human
gugcugagauuacaggugugag

SEQ ID NO: 1053147 - RNA, 22 nt, Human
aaagccaugaauguuauagagg

SEQ ID NO: 1053148 - RNA, 22 nt, Human
cagaacugggcagggagcagag

SEQ ID NO: 1053149 - RNA, 22 nt, Human
ucugccugagaaguggggugcc

SEQ ID NO: 1053150 - RNA, 22 nt, Human
uguacauacauagauauacaca

SEQ ID NO: 1053151 - RNA, 22 nt, Human
ugcaggaacugggagggauagu

SEQ ID NO: 1053152 - RNA, 22 nt, Human
gugacagagcugggauuugaag

SEQ ID NO: 1053153 - RNA, 22 nt, Human
ccaccaggcacucacagggaag

SEQ ID NO: 1053154 - RNA, 22 nt, Human
gccugcuggaggagccucaggg

SEQ ID NO: 1053155 - RNA, 22 nt, Human
uuaauuaaauucaugagcauug

SEQ ID NO: 1053156 - RNA, 23 nt, Human
uagagcagggaaaucugucagag

SEQ ID NO: 1053157 - RNA, 21 nt, Human
uuugaaagugggugauucuuu

SEQ ID NO: 1053158 - RNA, 22 nt, Human
ccuguuuacaucaucaaggacu

SEQ ID NO: 1053159 - RNA, 22 nt, Human
uaauaucuacuucauagaguuu

SEQ ID NO: 1053160 - RNA, 22 nt, Human
uccaggagauucauuaggucau

SEQ ID NO: 1053161 - RNA, 22 nt, Human
acagucauuagauacaaugucu

SEQ ID NO: 1053162 - RNA, 22 nt, Human
gcauuuccugugcuuggcauau

SEQ ID NO: 1053163 - RNA, 22 nt, Human
aggcugagcaaagggccuuacc

SEQ ID NO: 1053164 - RNA, 22 nt, Human
cagcuccucacgagucuugaaa

SEQ ID NO: 1053165 - RNA, 23 nt, Human
uccaggagaaccccugucugucc

SEQ ID NO: 1053166 - RNA, 22 nt, Human
augcugagacuggagcagcugg

SEQ ID NO: 1053167 - RNA, 22 nt, Human
ccagcagagucuaggaaggagg

SEQ ID NO: 1053168 - RNA, 22 nt, Human
aggagcagcuucugaaccaugu

SEQ ID NO: 1053169 - RNA, 22 nt, Human
uuugcagucaaauuugcuaaau

SEQ ID NO: 1053170 - RNA, 22 nt, Human
gccaggagggaaaggacaauuu

SEQ ID NO: 1053171 - RNA, 22 nt, Human
ucugguaaccuuuaucccuccu

SEQ ID NO: 1053172 - RNA, 22 nt, Human
uauuuguauguguguacauaua

SEQ ID NO: 1053173 - RNA, 22 nt, Human
gaaaugaacugauuaucauugc

SEQ ID NO: 1053174 - RNA, 22 nt, Human
uggcagcugaauggcuggaugg

SEQ ID NO: 1053175 - RNA, 22 nt, Human
cuggcucauccagguguugcuc

SEQ ID NO: 1053176 - RNA, 22 nt, Human
acagagagaaacaaucagcagc

SEQ ID NO: 1053177 - RNA, 22 nt, Human
gucagcugggcaucugcagaug

SEQ ID NO: 1053178 - RNA, 22 nt, Human
uuucuucauucaccuucacccc

SEQ ID NO: 1053179 - RNA, 22 nt, Human
cuugcaggccuuucuagcucua

SEQ ID NO: 1053180 - RNA, 22 nt, Human
caguaguuauuaguugccacug

SEQ ID NO: 1053181 - RNA, 22 nt, Human
ucagggugaaccaggcaggaau

SEQ ID NO: 1053182 - RNA, 22 nt, Human
ccaggaagcugucugauaugaa

SEQ ID NO: 1053183 - RNA, 18 nt, Human
ugaacuggcaucagaauc

SEQ ID NO: 1053184 - RNA, 16 nt, Human
ccccaggacuuggcac

SEQ ID NO: 1053185 - RNA, 22 nt, Human
gaggcugacggcaccaucuucu

SEQ ID NO: 1053186 - RNA, 18 nt, Human
guccacagauucuucacu

SEQ ID NO: 1053187 - RNA, 22 nt, Human
cccacagggcugcugauggcag

SEQ ID NO: 1053188 - RNA, 22 nt, Human
acaggagaauuaucuggaacaa

SEQ ID NO: 1053189 - RNA, 22 nt, Human
cccaggaggcagaaguugcagu

SEQ ID NO: 1053190 - RNA, 16 nt, Human
auuuccagauuaugca

SEQ ID NO: 1053191 - RNA, 21 nt, Human
cccagggaagccgcagucacc

SEQ ID NO: 1053192 - RNA, 22 nt, Human
agcugcagucaagcugggccac

SEQ ID NO: 1053193 - RNA, 22 nt, Human
ucugagguuaauccugcugcau

SEQ ID NO: 1053194 - RNA, 22 nt, Human
guccaugacugugacucacaug

SEQ ID NO: 1053195 - RNA, 22 nt, Human
ggcagcuuguccuucaggagag

SEQ ID NO: 1053196 - RNA, 22 nt, Human
aggguaggaacugaguggaagg

SEQ ID NO: 1053197 - RNA, 22 nt, Human
cugccucagccuucugggugac

SEQ ID NO: 1053198 - RNA, 18 nt, Human
gaaaggagagacaguagg

SEQ ID NO: 1053199 - RNA, 22 nt, Human
cagcugccugucuggaggcaau

SEQ ID NO: 1053200 - RNA, 22 nt, Human
cucccagggucuaggcugcugg

SEQ ID NO: 1053201 - RNA, 22 nt, Human
uggccacaugcgucugugaggc

SEQ ID NO: 1053202 - RNA, 22 nt, Human
uugaaaguuaucuagauucuga

SEQ ID NO: 1053203 - RNA, 22 nt, Human
gagggcugauaaaugcgcaugg

SEQ ID NO: 1053204 - RNA, 22 nt, Human
gaggagagaagcuaacggugcu

SEQ ID NO: 1053205 - RNA, 22 nt, Human
gcccugagccuaugagccucuc

SEQ ID NO: 1053206 - RNA, 22 nt, Human
uggcagucuggguuggcaguua

SEQ ID NO: 1053207 - RNA, 22 nt, Human
cugcugugggcaggguagcugg

SEQ ID NO: 1053208 - RNA, 22 nt, Human
aggcugagcggggucccagagc

SEQ ID NO: 1053209 - RNA, 22 nt, Human
ggcuguagguuggugcuggaca

SEQ ID NO: 1053210 - RNA, 22 nt, Human
uaaauacuuuacaggaugucuc

SEQ ID NO: 1053211 - RNA, 22 nt, Human
cugacagucucauugauuugcu

SEQ ID NO: 1053212 - RNA, 22 nt, Human
ucauuuguucucauucucuacu

SEQ ID NO: 1053213 - RNA, 22 nt, Human
gccaggaggggagaguguguca

SEQ ID NO: 1053214 - RNA, 22 nt, Human
gagaggcaggcgcugcaauggu

SEQ ID NO: 1053215 - RNA, 18 nt, Human
ggcugagguugacuagaa

SEQ ID NO: 1053216 - RNA, 22 nt, Human
gugcaagguacauccuugaugu

SEQ ID NO: 1053217 - RNA, 22 nt, Human
ggaggcgauccugggaaacacc

SEQ ID NO: 1053218 - RNA, 22 nt, Human
cuuacagagaagaaaauguagu

SEQ ID NO: 1053219 - RNA, 22 nt, Human
uugcugaaaacaguggguauug

SEQ ID NO: 1053220 - RNA, 22 nt, Human
ugaggcaggaguuaaugugcuc

SEQ ID NO: 1053221 - RNA, 22 nt, Human
guuaggauguggggacuuuggg

SEQ ID NO: 1053222 - RNA, 19 nt, Human
uccugggcugcgucuugcc

SEQ ID NO: 1053223 - RNA, 22 nt, Human
cagagccauuauggagacuugc

SEQ ID NO: 1053224 - RNA, 23 nt, Human
uucuuucaagaaguucacagugc

SEQ ID NO: 1053225 - RNA, 22 nt, Human
ccucacugaagaggugacauuu

SEQ ID NO: 1053226 - RNA, 22 nt, Human
agaggaggcagcuuaacucagu

SEQ ID NO: 1053227 - RNA, 22 nt, Human
gaggcauggccugaggcuagga

SEQ ID NO: 1053228 - RNA, 22 nt, Human
ccuuuucuaaucuuaagaaugu

SEQ ID NO: 1053229 - RNA, 22 nt, Human
acuccuggguugcaguccucaa

SEQ ID NO: 1053230 - RNA, 22 nt, Human
aacuccuguucuaugacaagag

SEQ ID NO: 1053231 - RNA, 22 nt, Human
ccugucacgaugacugcacucu

SEQ ID NO: 1053232 - RNA, 22 nt, Human
cucucuguuaugcuuucaugaa

SEQ ID NO: 1053233 - RNA, 22 nt, Human
ucccagaggucucugcugguuc

SEQ ID NO: 1053234 - RNA, 22 nt, Human
aggacugacuuuugccaugaaa

SEQ ID NO: 1053235 - RNA, 22 nt, Human
caaaugauacuguuuuuagucu

SEQ ID NO: 1053236 - RNA, 22 nt, Human
gacagugcauuuccuggcaugg

SEQ ID NO: 1053237 - RNA, 22 nt, Human
gauguuucaugcuagcaugugu

SEQ ID NO: 1053238 - RNA, 22 nt, Human
ggggggugcugaucaguggagc

SEQ ID NO: 1053239 - RNA, 22 nt, Human
aagggcuggagaggaaagguug

SEQ ID NO: 1053240 - RNA, 22 nt, Human
cagcaggaggugaguagcaggu

SEQ ID NO: 1053241 - RNA, 22 nt, Human
gagguggucgaggagggguacc

SEQ ID NO: 1053242 - RNA, 22 nt, Human
agcaagauuuuccuugaauguu

SEQ ID NO: 1053243 - RNA, 22 nt, Human
ccuccuggcuuuucccauugaa

SEQ ID NO: 1053244 - RNA, 22 nt, Human
aaguaaucuggaauuugguuuu

SEQ ID NO: 1053245 - RNA, 22 nt, Human
auuaguagcuguaauaacuggg

SEQ ID NO: 1053246 - RNA, 22 nt, Human
gcugcagagggaggggcucgca

SEQ ID NO: 1053247 - RNA, 22 nt, Human
acuggccaggcacagcuguggg

SEQ ID NO: 1053248 - RNA, 22 nt, Human
ugucugccugcgggccggcaca

SEQ ID NO: 1053249 - RNA, 22 nt, Human
gcaacuguuuugagcacccagu

SEQ ID NO: 1053250 - RNA, 22 nt, Human
aaaaugaugcuguaauuuggca

SEQ ID NO: 1053251 - RNA, 22 nt, Human
ucucccaggcugcccuguggac

SEQ ID NO: 1053252 - RNA, 22 nt, Human
auuagagaaugugcugacauug

SEQ ID NO: 1053253 - RNA, 21 nt, Human
aguguaggucauuagcuguug

SEQ ID NO: 1053254 - RNA, 23 nt, Human
cagaugagguuggcagcaugguc

SEQ ID NO: 1053255 - RNA, 22 nt, Human
gcucaggaaauaguuuaguguu

SEQ ID NO: 1053256 - RNA, 22 nt, Human
agcugcaggagucgccuaggau

SEQ ID NO: 1053257 - RNA, 22 nt, Human
gaggaggcacuugagcagaugu

SEQ ID NO: 1053258 - RNA, 22 nt, Human
aagggcuguaagccaaguaaag

SEQ ID NO: 1053259 - RNA, 22 nt, Human
ucagagaguuagugucuuagcu

SEQ ID NO: 1053260 - RNA, 22 nt, Human
uguguucuggaaagcucacuga

SEQ ID NO: 1053261 - RNA, 22 nt, Human
ggaggacaggggcugcagcaca

SEQ ID NO: 1053262 - RNA, 22 nt, Human
agugcuggcccauagcugcugg

SEQ ID NO: 1053263 - RNA, 22 nt, Human
ucaaugacugguccaagguggc

SEQ ID NO: 1053264 - RNA, 22 nt, Human
uucuccaacacaagcaugaugu

SEQ ID NO: 1053265 - RNA, 22 nt, Human
aaugcauauguaggcaagcagu

SEQ ID NO: 1053266 - RNA, 22 nt, Human
aacuuucugaaaagcuugauca

SEQ ID NO: 1053267 - RNA, 22 nt, Human
aggcucagaggugagcaucugc

SEQ ID NO: 1053268 - RNA, 22 nt, Human
aggcuggaguacaguggcuauu

SEQ ID NO: 1053269 - RNA, 22 nt, Human
auuacaaaagaagggagaaggu

SEQ ID NO: 1053270 - RNA, 23 nt, Human
uuucaacuccugccauuauuucu

SEQ ID NO: 1053271 - RNA, 20 nt, Human
cccaggagcugugccccauc

SEQ ID NO: 1053272 - RNA, 22 nt, Human
gagcaagauuaaaaggcugggu

SEQ ID NO: 1053273 - RNA, 22 nt, Human
aggcaagcauugggaacagggc

SEQ ID NO: 1053274 - RNA, 22 nt, Human
aagggcuguagacaagauugcu

SEQ ID NO: 1053275 - RNA, 22 nt, Human
ucuccuggcccugucgccaucu

SEQ ID NO: 1053276 - RNA, 22 nt, Human
uuggccaaacagaguucaacag

SEQ ID NO: 1053277 - RNA, 22 nt, Human
uaguccaggaagguggggcaga

SEQ ID NO: 1053278 - RNA, 22 nt, Human
uuagagaagcuguaauuauuca

SEQ ID NO: 1053279 - RNA, 22 nt, Human
cggcugagacggccauagacac

SEQ ID NO: 1053280 - RNA, 22 nt, Human
ugcuucagugcucugagccugu

SEQ ID NO: 1053281 - RNA, 22 nt, Human
caggcagaguuagagcaacugg

SEQ ID NO: 1053282 - RNA, 23 nt, Human
acucguggaauucucugcgaucg

SEQ ID NO: 1053283 - RNA, 22 nt, Human
gcagaggagcaaguugcuacag

SEQ ID NO: 1053284 - RNA, 22 nt, Human
gcugaagcugacacauagugcu

SEQ ID NO: 1053285 - RNA, 22 nt, Human
uucucuuuugugaugugagaug

SEQ ID NO: 1053286 - RNA, 22 nt, Human
gaaauuaaccaccuuuggcuuu

SEQ ID NO: 1053287 - RNA, 22 nt, Human
uuuucagugggcaaugauguga

SEQ ID NO: 1053288 - RNA, 22 nt, Human
gccugcagaacugugaggcaau

SEQ ID NO: 1053289 - RNA, 22 nt, Human
agaggacaaaaugagaagugcu

SEQ ID NO: 1053290 - RNA, 20 nt, Human
agggcagcuugaggagccgg

SEQ ID NO: 1053291 - RNA, 22 nt, Human
ggcccacacugacagcugagcu

SEQ ID NO: 1053292 - RNA, 22 nt, Human
uccaccagcuucuucaccagcu

SEQ ID NO: 1053293 - RNA, 22 nt, Human
uugaaaggugaacaugaugcac

SEQ ID NO: 1053294 - RNA, 22 nt, Human
gaccauuugcuaguaaauugca

SEQ ID NO: 1053295 - RNA, 22 nt, Human
ccagggaguuuccaaucugaga

SEQ ID NO: 1053296 - RNA, 19 nt, Human
cugcuucaggcgccuugcc

SEQ ID NO: 1053297 - RNA, 17 nt, Human
ucaggauguagcaguag

SEQ ID NO: 1053298 - RNA, 22 nt, Human
gcugagagugggugcagugcuu

SEQ ID NO: 1053299 - RNA, 22 nt, Human
cuggccaguugccuuccugggu

SEQ ID NO: 1053300 - RNA, 17 nt, Human
agagagagcaugccacc

SEQ ID NO: 1053301 - RNA, 22 nt, Human
ggaggugggcuaaggacucucu

SEQ ID NO: 1053302 - RNA, 22 nt, Human
acuggccagaacuaagucacau

SEQ ID NO: 1053303 - RNA, 22 nt, Human
ggguccaccugagcagcagccu

SEQ ID NO: 1053304 - RNA, 22 nt, Human
ucuggguaugaccuauuuuucc

SEQ ID NO: 1053305 - RNA, 22 nt, Human
ucuuggcaauuugaucucaguu

SEQ ID NO: 1053306 - RNA, 22 nt, Human
ccaggcuggaguguagucgcau

SEQ ID NO: 1053307 - RNA, 22 nt, Human
auuuggcaaauaauuugagggu

SEQ ID NO: 1053308 - RNA, 23 nt, Human
uugaaagguagcuggcagcuaga

SEQ ID NO: 1053309 - RNA, 22 nt, Human
cagcagaaaauaccuguaacuc

SEQ ID NO: 1053310 - RNA, 22 nt, Human
gcagcucccagcuugaaagguc

SEQ ID NO: 1053311 - RNA, 22 nt, Human
cugucauuuaagacauucugga

SEQ ID NO: 1053312 - RNA, 22 nt, Human
gagaggucaucucccaucagca

SEQ ID NO: 1053313 - RNA, 22 nt, Human
auaaaugaacauucacagagcu

SEQ ID NO: 1053314 - RNA, 22 nt, Human
aggaugaggcuggcaggucuug

SEQ ID NO: 1053315 - RNA, 22 nt, Human
agccugagugcuuaggacuguu

SEQ ID NO: 1053316 - RNA, 22 nt, Human
auuugcuucugugaaaucaagu

SEQ ID NO: 1053317 - RNA, 21 nt, Human
cacugguagauggcccgcagg

SEQ ID NO: 1053318 - RNA, 22 nt, Human
gcaggagacuggcugugguagu

SEQ ID NO: 1053319 - RNA, 15 nt, Human
uucaggauaugacuc

SEQ ID NO: 1053320 - RNA, 23 nt, Human
gcugccucuguuggucuucaguu

SEQ ID NO: 1053321 - RNA, 21 nt, Human
cucaggaucuuauauauuagu

SEQ ID NO: 1053322 - RNA, 17 nt, Human
gagagcugcugcuuccg

SEQ ID NO: 1053323 - RNA, 18 nt, Human
cugccugcucuccagcuu

SEQ ID NO: 1053324 - RNA, 22 nt, Human
ccuggccagaggcgugccugug

SEQ ID NO: 1053325 - RNA, 22 nt, Human
agggaguuagaaauccaggaua

SEQ ID NO: 1053326 - RNA, 22 nt, Human
aggagacaucuaacuguagguu

SEQ ID NO: 1053327 - RNA, 22 nt, Human
uuguaaaugaccuuuucuaauu

SEQ ID NO: 1053328 - RNA, 22 nt, Human
ccagugcuuccaggaauacggu

SEQ ID NO: 1053329 - RNA, 22 nt, Human
gggcagcuguaucugagcuuau

SEQ ID NO: 1053330 - RNA, 22 nt, Human
uauuucagggagaauaaauuug

SEQ ID NO: 1053331 - RNA, 22 nt, Human
uacacacaugcauuugccuuau

SEQ ID NO: 1053332 - RNA, 22 nt, Human
ugaggcaguauuuuagugacuu

SEQ ID NO: 1053333 - RNA, 22 nt, Human
uucugucaugcucauguaauug

SEQ ID NO: 1053334 - RNA, 22 nt, Human
guagacaucuagauuuaugugu

SEQ ID NO: 1053335 - RNA, 22 nt, Human
ucuggagaagcccagggagcug

SEQ ID NO: 1053336 - RNA, 19 nt, Human
cuguggcugaccucuggcc

SEQ ID NO: 1053337 - RNA, 22 nt, Human
gcaagcugcucuuauguggagg

SEQ ID NO: 1053338 - RNA, 23 nt, Human
cuaggcaggauuguaggcgggua

SEQ ID NO: 1053339 - RNA, 22 nt, Human
agggucuguggaugcaucuggg

SEQ ID NO: 1053340 - RNA, 22 nt, Human
ucugucccugagagcucaggag

SEQ ID NO: 1053341 - RNA, 22 nt, Human
uagaagcaguaauagaaauagg

SEQ ID NO: 1053342 - RNA, 22 nt, Human
caaauuaaugugucucaaaaua

SEQ ID NO: 1053343 - RNA, 22 nt, Human
uaacuguauauuaagguggccc

SEQ ID NO: 1053344 - RNA, 22 nt, Human
ggggcagcuaccggaaguaggg

SEQ ID NO: 1053345 - RNA, 22 nt, Human
gaauacaugauacaugaacugc

SEQ ID NO: 1053346 - RNA, 22 nt, Human
acaggcugaggaugauugcauc

SEQ ID NO: 1053347 - RNA, 22 nt, Human
ucacaauuuggauacagcuaug

SEQ ID NO: 1053348 - RNA, 22 nt, Human
ucugcaggcucuagaugagguu

SEQ ID NO: 1053349 - RNA, 22 nt, Human
gaaggaaaacagaucugccuga

SEQ ID NO: 1053350 - RNA, 22 nt, Human
auacaaagacaaaucucaaucu

SEQ ID NO: 1053351 - RNA, 23 nt, Human
uuucuucagaagccuugcgaggc

SEQ ID NO: 1053352 - RNA, 22 nt, Human
cuaccuuucugacucuugggau

SEQ ID NO: 1053353 - RNA, 22 nt, Human
uuuguagaggguaauugacaga

SEQ ID NO: 1053354 - RNA, 22 nt, Human
ucugagguaccagcugguuuau

SEQ ID NO: 1053355 - RNA, 22 nt, Human
gugagguccugagaggcuugug

SEQ ID NO: 1053356 - RNA, 23 nt, Human
cugcccugaucuugaucuauugu

SEQ ID NO: 1053357 - RNA, 23 nt, Human
accaggagccaagaucucccugg

SEQ ID NO: 1053358 - RNA, 22 nt, Human
ucuccucucuuaccugguacaa

SEQ ID NO: 1053359 - RNA, 22 nt, Human
acauugcugcauucuccuuccc

SEQ ID NO: 1053360 - RNA, 22 nt, Human
gacugagggacagggcagugga

SEQ ID NO: 1053361 - RNA, 20 nt, Human
cuucuucagccuaugcuuca

SEQ ID NO: 1053362 - RNA, 22 nt, Human
acaggcagagaacucagccaga

SEQ ID NO: 1053363 - RNA, 22 nt, Human
uuauagaaggagcauucacuua

SEQ ID NO: 1053364 - RNA, 22 nt, Human
cagaggcaaaagagguggaggu

SEQ ID NO: 1053365 - RNA, 22 nt, Human
gagagcuggguucaaguagcug

SEQ ID NO: 1053366 - RNA, 22 nt, Human
caaggccagggaauuuuucugg

SEQ ID NO: 1053367 - RNA, 22 nt, Human
aggcugugaacucuaugcugaa

SEQ ID NO: 1053368 - RNA, 20 nt, Human
agcuucuucugucuaauuuu

SEQ ID NO: 1053369 - RNA, 22 nt, Human
aucauucuauuguugagcugcc

SEQ ID NO: 1053370 - RNA, 22 nt, Human
uaauuauagccgcuauuuugcu

SEQ ID NO: 1053371 - RNA, 22 nt, Human
caagaugggcaccccagcaccu

SEQ ID NO: 1053372 - RNA, 22 nt, Human
aggcagauuuaggagaaaagaa

SEQ ID NO: 1053373 - RNA, 22 nt, Human
ugaaggccagcagagugaaggc

SEQ ID NO: 1053374 - RNA, 22 nt, Human
acauaccauacauggugagaug

SEQ ID NO: 1053375 - RNA, 22 nt, Human
ucugccugcggcugcagguggc

SEQ ID NO: 1053376 - RNA, 22 nt, Human
uaggcuggaggaagcagugccu

SEQ ID NO: 1053377 - RNA, 22 nt, Human
agcaccuugcucuuggccuucc

SEQ ID NO: 1053378 - RNA, 22 nt, Human
gcuccucuauuccccacauuuu

SEQ ID NO: 1053379 - RNA, 22 nt, Human
uugaaaguuuauggagucugca

SEQ ID NO: 1053380 - RNA, 22 nt, Human
acaguggagaaggcaugaggcu

SEQ ID NO: 1053381 - RNA, 22 nt, Human
gaggcugaugcugccucacaga

SEQ ID NO: 1053382 - RNA, 22 nt, Human
gcaggcugcccucuuguguuga

SEQ ID NO: 1053383 - RNA, 22 nt, Human
ggcagggaagcuggcaucacgg

SEQ ID NO: 1053384 - RNA, 22 nt, Human
augugaggcagcacggagauua

SEQ ID NO: 1053385 - RNA, 22 nt, Human
ggccucaguuucuucaacugua

SEQ ID NO: 1053386 - RNA, 22 nt, Human
uuucuucagccacuccaaacug

SEQ ID NO: 1053387 - RNA, 22 nt, Human
cuuauuucuccauccagaguca

SEQ ID NO: 1053388 - RNA, 22 nt, Human
ucaggagagaguuggguaggcu

SEQ ID NO: 1053389 - RNA, 22 nt, Human
aaguccaugaucaagauguggc

SEQ ID NO: 1053390 - RNA, 22 nt, Human
cugaggucuagacaccccaggg

SEQ ID NO: 1053391 - RNA, 22 nt, Human
uccaugagagguaacuuuacaa

SEQ ID NO: 1053392 - RNA, 22 nt, Human
ucauuucucccggccaaaaacu

SEQ ID NO: 1053393 - RNA, 22 nt, Human
uaaaaugaucucucauguucuu

SEQ ID NO: 1053394 - RNA, 22 nt, Human
uccugggcgguuaugugaucug

SEQ ID NO: 1053395 - RNA, 22 nt, Human
gacaggcaauuaccagcgccca

SEQ ID NO: 1053396 - RNA, 22 nt, Human
ccugagguugaaguauaaauug

SEQ ID NO: 1053397 - RNA, 22 nt, Human
ucccaggacaggccacauggaa

SEQ ID NO: 1053398 - RNA, 21 nt, Human
uucaaaaugguguguuugucu

SEQ ID NO: 1053399 - RNA, 22 nt, Human
aggcaggcaaccaccugggaag

SEQ ID NO: 1053400 - RNA, 22 nt, Human
uuauacuaaaacgcauugaauu

SEQ ID NO: 1053401 - RNA, 22 nt, Human
acccaggagguggaggcugcag

SEQ ID NO: 1053402 - RNA, 22 nt, Human
auuauuaggacuacugggguug

SEQ ID NO: 1053403 - RNA, 22 nt, Human
cugaguccagggacagaggcgu

SEQ ID NO: 1053404 - RNA, 22 nt, Human
cugagguccuugacugcuugcc

SEQ ID NO: 1053405 - RNA, 22 nt, Human
uuugcauaggauggacauuuua

SEQ ID NO: 1053406 - RNA, 19 nt, Human
caggagagcaugcacuuug

SEQ ID NO: 1053407 - RNA, 22 nt, Human
aagcaauauacugauaugauua

SEQ ID NO: 1053408 - RNA, 22 nt, Human
cagcaagaguugggguuguugg

SEQ ID NO: 1053409 - RNA, 22 nt, Human
aucaggaugaagcuguagcgaa

SEQ ID NO: 1053410 - RNA, 21 nt, Human
ggccugaguauaggacaggcc

SEQ ID NO: 1053411 - RNA, 22 nt, Human
ugaggcaggacauggacaacug

SEQ ID NO: 1053412 - RNA, 22 nt, Human
acacagaagaucucuuaaugcu

SEQ ID NO: 1053413 - RNA, 22 nt, Human
cagcuuccgaccgggggcugca

SEQ ID NO: 1053414 - RNA, 22 nt, Human
aucauacagaaccugagcacuu

SEQ ID NO: 1053415 - RNA, 22 nt, Human
ucaucugucauccacaaagcug

SEQ ID NO: 1053416 - RNA, 22 nt, Human
aggcaguggaaggagaaagcaa

SEQ ID NO: 1053417 - RNA, 22 nt, Human
acuggccaggagcuggaaauac

SEQ ID NO: 1053418 - RNA, 22 nt, Human
aucuccaggcauuucaagagac

SEQ ID NO: 1053419 - RNA, 22 nt, Human
gugauuuugagaccuauauagu

SEQ ID NO: 1053420 - RNA, 22 nt, Human
aaauuauuaugccccucuauaa

SEQ ID NO: 1053421 - RNA, 22 nt, Human
ccuugagccagggagcuggcag

SEQ ID NO: 1053422 - RNA, 22 nt, Human
cuucagaagccugcagccuuug

SEQ ID NO: 1053423 - RNA, 22 nt, Human
uuggccaaagcucaccagugcu

SEQ ID NO: 1053424 - RNA, 22 nt, Human
gucaggauuuuaaaaucccagu

SEQ ID NO: 1053425 - RNA, 22 nt, Human
gagcugagggucuaggaggguu

SEQ ID NO: 1053426 - RNA, 22 nt, Human
aaaauuauggaguaucccaaag

SEQ ID NO: 1053427 - RNA, 22 nt, Human
gcugccucacuccagcccaaua

SEQ ID NO: 1053428 - RNA, 22 nt, Human
ccuggagcccaaggcagugaga

SEQ ID NO: 1053429 - RNA, 22 nt, Human
uguuuuaagagcgcacuuuaua

SEQ ID NO: 1053430 - RNA, 20 nt, Human
cacguuuuuccacuagcaaa

SEQ ID NO: 1053431 - RNA, 22 nt, Human
aacuacauuuuacagaagauga

SEQ ID NO: 1053432 - RNA, 22 nt, Human
cuggcugugcugcaggcuuugg

SEQ ID NO: 1053433 - RNA, 22 nt, Human
aggcagucuaucucuggagccu

SEQ ID NO: 1053434 - RNA, 22 nt, Human
uugcauuugaucuuggguucuc

SEQ ID NO: 1053435 - RNA, 22 nt, Human
ccugcuguucuguuuagugaac

SEQ ID NO: 1053436 - RNA, 22 nt, Human
ucugaagccaccucugcuuguc

SEQ ID NO: 1053437 - RNA, 21 nt, Human
acauuauaauucauauuccac

SEQ ID NO: 1053438 - RNA, 22 nt, Human
agacaggcugcugucugcuagg

SEQ ID NO: 1053439 - RNA, 18 nt, Human
ggcagggaaaagauaggg

SEQ ID NO: 1053440 - RNA, 22 nt, Human
aaacugccacaagagggacauc

SEQ ID NO: 1053441 - RNA, 22 nt, Human
aucauuucccuuuagaucacaa

SEQ ID NO: 1053442 - RNA, 22 nt, Human
ucugggaaccagugcggcuggg

SEQ ID NO: 1053443 - RNA, 22 nt, Human
aggagggagaugcccauccugg

SEQ ID NO: 1053444 - RNA, 22 nt, Human
cugagcccauugggugcuguua

SEQ ID NO: 1053445 - RNA, 21 nt, Human
gccuggcucucacuggccugg

SEQ ID NO: 1053446 - RNA, 22 nt, Human
gacugaggagguaagguuugaa

SEQ ID NO: 1053447 - RNA, 19 nt, Human
aucugccuuagugcugcug

SEQ ID NO: 1053448 - RNA, 22 nt, Human
uuacaagauaaccugaugcugu

SEQ ID NO: 1053449 - RNA, 22 nt, Human
guacacuugacucauaggaaau

SEQ ID NO: 1053450 - RNA, 22 nt, Human
acugccucuuggugcugagaga

SEQ ID NO: 1053451 - RNA, 22 nt, Human
gcauucuuuuuaggagguuccu

SEQ ID NO: 1053452 - RNA, 22 nt, Human
acgcuuuuacuauuuugagcuc

SEQ ID NO: 1053453 - RNA, 22 nt, Human
uguagggaggaaggguuggaaa

SEQ ID NO: 1053454 - RNA, 22 nt, Human
agcaguguggccuuagacccgg

SEQ ID NO: 1053455 - RNA, 22 nt, Human
cggccaagccggggccccgaag

SEQ ID NO: 1053456 - RNA, 22 nt, Human
ugagcagagcaguaacaggagc

SEQ ID NO: 1053457 - RNA, 22 nt, Human
uucuagaugcuuauaggcauau

SEQ ID NO: 1053458 - RNA, 22 nt, Human
uuuguuuagaugguaaaucagu

SEQ ID NO: 1053459 - RNA, 22 nt, Human
cauuuguuuagaagucuuuaua

SEQ ID NO: 1053460 - RNA, 22 nt, Human
uucuuuucuuuaggcauugugu

SEQ ID NO: 1053461 - RNA, 22 nt, Human
acugacuuuggaauauuucuag

SEQ ID NO: 1053462 - RNA, 22 nt, Human
ccucuucuaggacguccuugug

SEQ ID NO: 1053463 - RNA, 22 nt, Human
ugaaaugauguacaagaaggca

SEQ ID NO: 1053464 - RNA, 22 nt, Human
ugucugugaccucuuaggcaag

SEQ ID NO: 1053465 - RNA, 22 nt, Human
caggccugagacaucugagaua

SEQ ID NO: 1053466 - RNA, 22 nt, Human
augaggauuaacuguugucaua

SEQ ID NO: 1053467 - RNA, 22 nt, Human
gggcugagucugcugccuguca

SEQ ID NO: 1053468 - RNA, 22 nt, Human
auguuucaccagcaaauuaccu

SEQ ID NO: 1053469 - RNA, 22 nt, Human
cugaggcugggcuugccuucuu

SEQ ID NO: 1053470 - RNA, 22 nt, Human
agcggcugcuccgcaggcuggc

SEQ ID NO: 1053471 - RNA, 22 nt, Human
gcugcugucacggugcuaaggg

SEQ ID NO: 1053472 - RNA, 22 nt, Human
aaugccaacuuggauauacauu

SEQ ID NO: 1053473 - RNA, 22 nt, Human
ucucaagaucucaagauggccc

SEQ ID NO: 1053474 - RNA, 22 nt, Human
gcugagcugaggcagggcuggg

SEQ ID NO: 1053475 - RNA, 22 nt, Human
aggagggaccuaggaauauugc

SEQ ID NO: 1053476 - RNA, 22 nt, Human
gcucccaggcauggagguaauu

SEQ ID NO: 1053477 - RNA, 18 nt, Human
cugagggcaacagaggcu

SEQ ID NO: 1053478 - RNA, 22 nt, Human
uagggaggcuacuucuuguagg

SEQ ID NO: 1053479 - RNA, 22 nt, Human
ugcugcugaucauuuauagucu

SEQ ID NO: 1053480 - RNA, 22 nt, Human
gcugaggauuacuugaagucag

SEQ ID NO: 1053481 - RNA, 22 nt, Human
uccugagagcagcugcuuugga

SEQ ID NO: 1053482 - RNA, 22 nt, Human
ucuuucuugguauaaagcaggg

SEQ ID NO: 1053483 - RNA, 22 nt, Human
auuagagaaauguugccaagau

SEQ ID NO: 1053484 - RNA, 22 nt, Human
acagaagugacaauuucuuggg

SEQ ID NO: 1053485 - RNA, 22 nt, Human
aaaggccacugcaagggaaggu

SEQ ID NO: 1053486 - RNA, 22 nt, Human
ucuucauuccguagauauuuau

SEQ ID NO: 1053487 - RNA, 22 nt, Human
aacaugcugccuuucuacgagu

SEQ ID NO: 1053488 - RNA, 22 nt, Human
ggagcacuauaauagagauuuu

SEQ ID NO: 1053489 - RNA, 22 nt, Human
uccaugagcuagggauucauca

SEQ ID NO: 1053490 - RNA, 22 nt, Human
cuuugcaauagaggcacacaug

SEQ ID NO: 1053491 - RNA, 22 nt, Human
ccauggcaauggucagucuauu

SEQ ID NO: 1053492 - RNA, 22 nt, Human
uggcugaggcuggagugcagug

SEQ ID NO: 1053493 - RNA, 20 nt, Human
ggcugcugugggcagagagg

SEQ ID NO: 1053494 - RNA, 22 nt, Human
gcagcugcuggagggaggcagg

SEQ ID NO: 1053495 - RNA, 22 nt, Human
cacugguagcaguuaaguuagg

SEQ ID NO: 1053496 - RNA, 22 nt, Human
ugcuuccuauccacacaaugcc

SEQ ID NO: 1053497 - RNA, 22 nt, Human
uuaggauagucuguuagaaaag

SEQ ID NO: 1053498 - RNA, 22 nt, Human
aggccaaaccggauggaaaagg

SEQ ID NO: 1053499 - RNA, 22 nt, Human
gaggggaagacuucuggacagu

SEQ ID NO: 1053500 - RNA, 22 nt, Human
cagugcugugcuggaagcuguu

SEQ ID NO: 1053501 - RNA, 22 nt, Human
gcugaagggagugcugagucug

SEQ ID NO: 1053502 - RNA, 22 nt, Human
uuauuagguuuacauaaagguu

SEQ ID NO: 1053503 - RNA, 22 nt, Human
gcuggccacauugugccguccu

SEQ ID NO: 1053504 - RNA, 22 nt, Human
gagggagucugugcaaagaauu

SEQ ID NO: 1053505 - RNA, 23 nt, Human
ccuggcuguggauuugggccugc

SEQ ID NO: 1053506 - RNA, 22 nt, Human
gaggcagcugggcuggugguuu

SEQ ID NO: 1053507 - RNA, 22 nt, Human
ugcucaguagcagugugcugcu

SEQ ID NO: 1053508 - RNA, 22 nt, Human
gagagcuguccggcugagcagc

SEQ ID NO: 1053509 - RNA, 22 nt, Human
ugaggcaggaguucaggcugcg

SEQ ID NO: 1053510 - RNA, 22 nt, Human
auaaaaguaggaccaacuuaca

SEQ ID NO: 1053511 - RNA, 22 nt, Human
uuugaauagcauaggauuacau

SEQ ID NO: 1053512 - RNA, 22 nt, Human
aguuauuacucuuuaacauauu

SEQ ID NO: 1053513 - RNA, 22 nt, Human
ucagagaggcaauacuguuuaa

SEQ ID NO: 1053514 - RNA, 22 nt, Human
gcuggagaaacugcagcugagg

SEQ ID NO: 1053515 - RNA, 22 nt, Human
guccucuguuagaaaugugcuu

SEQ ID NO: 1053516 - RNA, 22 nt, Human
caggguggcacucagcgcaucu

SEQ ID NO: 1053517 - RNA, 22 nt, Human
uacuuuuagccuauuugauucu

SEQ ID NO: 1053518 - RNA, 21 nt, Human
uccugccuuaguccagagcag

SEQ ID NO: 1053519 - RNA, 22 nt, Human
augagguccagggaaguuaaau

SEQ ID NO: 1053520 - RNA, 22 nt, Human
aggagcagaacugauucugacu

SEQ ID NO: 1053521 - RNA, 22 nt, Human
uugaauuauaagugugucuacu

SEQ ID NO: 1053522 - RNA, 22 nt, Human
ggcuuuagggcaggcaguguua

SEQ ID NO: 1053523 - RNA, 22 nt, Human
uccaugagacagauacuguaag

SEQ ID NO: 1053524 - RNA, 22 nt, Human
uaguccaggacaaucuucauau

SEQ ID NO: 1053525 - RNA, 22 nt, Human
acaggcuggaggaggaccaaga

SEQ ID NO: 1053526 - RNA, 21 nt, Human
acuggccaccacuggcagggg

SEQ ID NO: 1053527 - RNA, 22 nt, Human
uugaggucaaagaagugagugg

SEQ ID NO: 1053528 - RNA, 22 nt, Human
uaacuguaccuagauaacgaac

SEQ ID NO: 1053529 - RNA, 22 nt, Human
aaguggacuaauacaaggacua

SEQ ID NO: 1053530 - RNA, 22 nt, Human
ugaggcaggaauggggaaaagu

SEQ ID NO: 1053531 - RNA, 22 nt, Human
uuuaaauaggacuccugggggu

SEQ ID NO: 1053532 - RNA, 18 nt, Human
ggcagcuugacuagcaac

SEQ ID NO: 1053533 - RNA, 22 nt, Human
aagaguuauaccuauuucuaac

SEQ ID NO: 1053534 - RNA, 19 nt, Human
auggaaaauuguacucaau

SEQ ID NO: 1053535 - RNA, 22 nt, Human
ugccaggagucaggccaggcag

SEQ ID NO: 1053536 - RNA, 19 nt, Human
ucccaggaaccuuuuauuu

SEQ ID NO: 1053537 - RNA, 19 nt, Human
cucugccucuggcuguggc

SEQ ID NO: 1053538 - RNA, 22 nt, Human
agcuccaggauaagacaggugc

SEQ ID NO: 1053539 - RNA, 22 nt, Human
uagcucuucaaucacugucucc

SEQ ID NO: 1053540 - RNA, 22 nt, Human
caugcugauucuuccugagcuu

SEQ ID NO: 1053541 - RNA, 22 nt, Human
uucuguuacaagugaaaaaaug

SEQ ID NO: 1053542 - RNA, 22 nt, Human
uccauguguuuuccuguccaca

SEQ ID NO: 1053543 - RNA, 22 nt, Human
ugacuuuagaauuuuauccaga

SEQ ID NO: 1053544 - RNA, 22 nt, Human
agagcugaggauccagcugagc

SEQ ID NO: 1053545 - RNA, 22 nt, Human
accaggaggcuacacuguccca

SEQ ID NO: 1053546 - RNA, 22 nt, Human
aauacuggcugucaaagaugga

SEQ ID NO: 1053547 - RNA, 22 nt, Human
cuuaaauuuucaucuacaagaa

SEQ ID NO: 1053548 - RNA, 22 nt, Human
gcuccuggucuggagcuucaag

SEQ ID NO: 1053549 - RNA, 22 nt, Human
caaauacuggguaaguuaauuu

SEQ ID NO: 1053550 - RNA, 22 nt, Human
gcagagaagaugcccaggcuuc

SEQ ID NO: 1053551 - RNA, 22 nt, Human
cccugcuuugcacccaggcugg

SEQ ID NO: 1053552 - RNA, 22 nt, Human
gccaugaggaacuguaagacaa

SEQ ID NO: 1053553 - RNA, 22 nt, Human
ugagguccugcauguugagguc

SEQ ID NO: 1053554 - RNA, 22 nt, Human
gagugcagaugaacagaagauu

SEQ ID NO: 1053555 - RNA, 22 nt, Human
cuugagguuuugacucagcuuu

SEQ ID NO: 1053556 - RNA, 22 nt, Human
gcucaggaucccaggggugugc

SEQ ID NO: 1053557 - RNA, 22 nt, Human
uaccuuuugcuuauuaugacac

SEQ ID NO: 1053558 - RNA, 22 nt, Human
caguuucuacgaaggucaaccc

SEQ ID NO: 1053559 - RNA, 22 nt, Human
uuggccaagauacgagcacaua

SEQ ID NO: 1053560 - RNA, 22 nt, Human
aacuuucuguuacguccccaga

SEQ ID NO: 1053561 - RNA, 22 nt, Human
gaggucaggcuugcagcagggu

SEQ ID NO: 1053562 - RNA, 22 nt, Human
cagaaguugauccugcguuucc

SEQ ID NO: 1053563 - RNA, 22 nt, Human
gcaggcugggguagccccacuu

SEQ ID NO: 1053564 - RNA, 19 nt, Human
uccucagugacaaccucag

SEQ ID NO: 1053565 - RNA, 22 nt, Human
uggcaaacuggaggaagcccug

SEQ ID NO: 1053566 - RNA, 22 nt, Human
cuagccugggauuugaacuuau

SEQ ID NO: 1053567 - RNA, 22 nt, Human
ggccugagcuugggcagcguau

SEQ ID NO: 1053568 - RNA, 22 nt, Human
guggcagagcaggagacaggac

SEQ ID NO: 1053569 - RNA, 22 nt, Human
uaaauuauggcuggcagagcag

SEQ ID NO: 1053570 - RNA, 22 nt, Human
guuaaauucgaugauggauaaa

SEQ ID NO: 1053571 - RNA, 22 nt, Human
agaggcggagcuugcagugagc

SEQ ID NO: 1053572 - RNA, 22 nt, Human
ugcccuggcauuggguuggaua

SEQ ID NO: 1053573 - RNA, 22 nt, Human
agcugaggcaugaugcuaucag

SEQ ID NO: 1053574 - RNA, 22 nt, Human
ugacccugagagcugaauggcu

SEQ ID NO: 1053575 - RNA, 22 nt, Human
uucucagaauugacugggagca

SEQ ID NO: 1053576 - RNA, 22 nt, Human
uuugcaguagacaucuuauuuu

SEQ ID NO: 1053577 - RNA, 22 nt, Human
gcuggcugugauuuugccaaca

SEQ ID NO: 1053578 - RNA, 22 nt, Human
ccaggaguggcuggugaccuuc

SEQ ID NO: 1053579 - RNA, 22 nt, Human
aacugguagaaagcaguaagug

SEQ ID NO: 1053580 - RNA, 22 nt, Human
cugaggcugagacaggugaaau

SEQ ID NO: 1053581 - RNA, 22 nt, Human
gaacuggugagaguucacggga

SEQ ID NO: 1053582 - RNA, 22 nt, Human
auggagggugucagagagcgaa

SEQ ID NO: 1053583 - RNA, 16 nt, Human
gcuccugggcccucga

SEQ ID NO: 1053584 - RNA, 22 nt, Human
gcuccuggauguucaagucggc

SEQ ID NO: 1053585 - RNA, 22 nt, Human
aacuauacauauuuacauagac

SEQ ID NO: 1053586 - RNA, 22 nt, Human
agcugaggguucgguguccaca

SEQ ID NO: 1053587 - RNA, 22 nt, Human
gcuggccauggccugcgccauc

SEQ ID NO: 1053588 - RNA, 22 nt, Human
agccugagccccauccagcuga

SEQ ID NO: 1053589 - RNA, 22 nt, Human
uagaaauaaaucugcagcuggg

SEQ ID NO: 1053590 - RNA, 22 nt, Human
aaaugaugcucacagauuagug

SEQ ID NO: 1053591 - RNA, 22 nt, Human
ugcugaggcccaggagcacuuu

SEQ ID NO: 1053592 - RNA, 22 nt, Human
auaaacagccugcccaaauugg

SEQ ID NO: 1053593 - RNA, 22 nt, Human
gcugccuccugagauuugggca

SEQ ID NO: 1053594 - RNA, 22 nt, Human
uuucaguuuaugucuugaauua

SEQ ID NO: 1053595 - RNA, 17 nt, Human
aggcuggcucacaggga

SEQ ID NO: 1053596 - RNA, 22 nt, Human
caaggccacguucugcaugcgg

SEQ ID NO: 1053597 - RNA, 22 nt, Human
cagaacugaccucugauucuag

SEQ ID NO: 1053598 - RNA, 22 nt, Human
uucuucuccuaaggagaguccu

SEQ ID NO: 1053599 - RNA, 22 nt, Human
cagucuucuaaccuagcagccu

SEQ ID NO: 1053600 - RNA, 22 nt, Human
aaggcugagggcuguaccuggc

SEQ ID NO: 1053601 - RNA, 22 nt, Human
auucuuauuauaguaaaacagu

SEQ ID NO: 1053602 - RNA, 22 nt, Human
cagcuggcugcaugaugccaaa

SEQ ID NO: 1053603 - RNA, 22 nt, Human
gaggcagcucuucugaaugggg

SEQ ID NO: 1053604 - RNA, 22 nt, Human
cagugcugggcagaggagagcg

SEQ ID NO: 1053605 - RNA, 22 nt, Human
uugaggucauauauauuuggca

SEQ ID NO: 1053606 - RNA, 22 nt, Human
aauaauuagugggacagagaac

SEQ ID NO: 1053607 - RNA, 22 nt, Human
cuaggcagauggagaaguggcu

SEQ ID NO: 1053608 - RNA, 22 nt, Human
ucuucucuccugcuuggcagaa

SEQ ID NO: 1053609 - RNA, 22 nt, Human
gagcugaguaucccacugaagu

SEQ ID NO: 1053610 - RNA, 22 nt, Human
cagcuggcgggcagagccgcca

SEQ ID NO: 1053611 - RNA, 22 nt, Human
caacugguggucaaccuucugu

SEQ ID NO: 1053612 - RNA, 22 nt, Human
gccuccccaaagugcugacagc

SEQ ID NO: 1053613 - RNA, 22 nt, Human
aggagcugcagauucugccuug

SEQ ID NO: 1053614 - RNA, 22 nt, Human
ucugggaacugagcuccccuag

SEQ ID NO: 1053615 - RNA, 22 nt, Human
aaagccauuacaaaauuucaua

SEQ ID NO: 1053616 - RNA, 22 nt, Human
ucuccuggcauuugguugagua

SEQ ID NO: 1053617 - RNA, 23 nt, Human
gcagacagagcagacuaagacaa

SEQ ID NO: 1053618 - RNA, 22 nt, Human
uacuggguauacaaagaugaau

SEQ ID NO: 1053619 - RNA, 20 nt, Human
gcccaagguccagaaggggg

SEQ ID NO: 1053620 - RNA, 22 nt, Human
agaggcugcacuugcucaugau

SEQ ID NO: 1053621 - RNA, 20 nt, Human
gagauggacagaugaagggg

SEQ ID NO: 1053622 - RNA, 22 nt, Human
accagcuggucaccugggcacu

SEQ ID NO: 1053623 - RNA, 22 nt, Human
uugaaagaagaagcugcgaugu

SEQ ID NO: 1053624 - RNA, 22 nt, Human
uuagauaaaaguguucaauaaa

SEQ ID NO: 1053625 - RNA, 22 nt, Human
gaggcagcauucgcauagacag

SEQ ID NO: 1053626 - RNA, 22 nt, Human
gagagucuaggaaccucauaua

SEQ ID NO: 1053627 - RNA, 22 nt, Human
cuucagaggggacucaaaguca

SEQ ID NO: 1053628 - RNA, 18 nt, Human
ugcuggguaacuguaugg

SEQ ID NO: 1053629 - RNA, 22 nt, Human
uucugaaagccaauucauugaa

SEQ ID NO: 1053630 - RNA, 22 nt, Human
uugguuuacuaggauucaaauu

SEQ ID NO: 1053631 - RNA, 22 nt, Human
gucaggaugggcagccaaacua

SEQ ID NO: 1053632 - RNA, 22 nt, Human
guugaaaguggagaaccugguu

SEQ ID NO: 1053633 - RNA, 22 nt, Human
agacagcuaauaaaugagugug

SEQ ID NO: 1053634 - RNA, 22 nt, Human
cuggagcauccaugcccagggu

SEQ ID NO: 1053635 - RNA, 22 nt, Human
ucuagaaauuuugccuuguauu

SEQ ID NO: 1053636 - RNA, 20 nt, Human
uugauucaagggcugaugga

SEQ ID NO: 1053637 - RNA, 22 nt, Human
gcuuccuaaaugcacagggcag

SEQ ID NO: 1053638 - RNA, 22 nt, Human
ucugggaagcugcgugccuguu

SEQ ID NO: 1053639 - RNA, 18 nt, Human
gcuccuggagucugacuc

SEQ ID NO: 1053640 - RNA, 22 nt, Human
uuuuaucugugacaucuggcag

SEQ ID NO: 1053641 - RNA, 22 nt, Human
uggcuucucgccugucaucccg

SEQ ID NO: 1053642 - RNA, 22 nt, Human
auucuucaaagagugucaaagu

SEQ ID NO: 1053643 - RNA, 22 nt, Human
gucuccugagacugcagucacc

SEQ ID NO: 1053644 - RNA, 22 nt, Human
ugauuuccccagucuugcugcu

SEQ ID NO: 1053645 - RNA, 22 nt, Human
cacugguacguagguuggggca

SEQ ID NO: 1053646 - RNA, 22 nt, Human
uauuuauucauucagcaagcau

SEQ ID NO: 1053647 - RNA, 22 nt, Human
guggccaacucaauguuuuuca

SEQ ID NO: 1053648 - RNA, 22 nt, Human
uuccuggcaugaaaaauaucac

SEQ ID NO: 1053649 - RNA, 22 nt, Human
gauuucuugauaauucaaaucc

SEQ ID NO: 1053650 - RNA, 22 nt, Human
agcccaggaaguugaggcuugc

SEQ ID NO: 1053651 - RNA, 22 nt, Human
uaucuguuguccaugcagaaag

SEQ ID NO: 1053652 - RNA, 22 nt, Human
uccaggaguccuggguggcccc

SEQ ID NO: 1053653 - RNA, 23 nt, Human
agcugaggcagaggggcauucuc

SEQ ID NO: 1053654 - RNA, 22 nt, Human
gagggcugauguugccaccuca

SEQ ID NO: 1053655 - RNA, 22 nt, Human
agucuucucauuucacaugcuu

SEQ ID NO: 1053656 - RNA, 22 nt, Human
ucuuggcuaguaccuuccugcc

SEQ ID NO: 1053657 - RNA, 22 nt, Human
ggguggaguagaaagaugaauu

SEQ ID NO: 1053658 - RNA, 21 nt, Human
uuucacaaaaguaugugacaa

SEQ ID NO: 1053659 - RNA, 22 nt, Human
gcccccagaagggccacagauu

SEQ ID NO: 1053660 - RNA, 22 nt, Human
uagugucauuucaguggaguuu

SEQ ID NO: 1053661 - RNA, 23 nt, Human
aagaacugcgaauggagaaagua

SEQ ID NO: 1053662 - RNA, 22 nt, Human
guuaggauuauauaucccauga

SEQ ID NO: 1053663 - RNA, 22 nt, Human
ucaggcuguaaauggugugggu

SEQ ID NO: 1053664 - RNA, 22 nt, Human
cucccuggugacucccaaagcu

SEQ ID NO: 1053665 - RNA, 22 nt, Human
ccuggccagccagggcuggggu

SEQ ID NO: 1053666 - RNA, 22 nt, Human
ccagagcugagggagccugagc

SEQ ID NO: 1053667 - RNA, 22 nt, Human
ggaccuggcaauuugcaucucu

SEQ ID NO: 1053668 - RNA, 22 nt, Human
uugaaguuguaguucagugaag

SEQ ID NO: 1053669 - RNA, 22 nt, Human
gccaggaguguguggcuauguu

SEQ ID NO: 1053670 - RNA, 17 nt, Human
ucugaagccagucugcu

SEQ ID NO: 1053671 - RNA, 22 nt, Human
acagagcuuaggaugacuccca

SEQ ID NO: 1053672 - RNA, 20 nt, Human
agaaaaaguguggaaauuuc

SEQ ID NO: 1053673 - RNA, 20 nt, Human
cauuuguuagcuuucuacug

SEQ ID NO: 1053674 - RNA, 21 nt, Human
agggagcuggccacacagccu

SEQ ID NO: 1053675 - RNA, 22 nt, Human
uccaggagguaugaguggcccc

SEQ ID NO: 1053676 - RNA, 22 nt, Human
uggucuuuaagguagcugucau

SEQ ID NO: 1053677 - RNA, 22 nt, Human
acagagcuaauguugcauaggc

SEQ ID NO: 1053678 - RNA, 21 nt, Human
ucaggcugucugcugguucca

SEQ ID NO: 1053679 - RNA, 22 nt, Human
cuguauuuguccucuauuuauu

SEQ ID NO: 1053680 - RNA, 22 nt, Human
ccuguuuagugaggugaggagu

SEQ ID NO: 1053681 - RNA, 22 nt, Human
auuuauuaagcaucugcuaugu

SEQ ID NO: 1053682 - RNA, 20 nt, Human
ucuggcaggugaacgagcug

SEQ ID NO: 1053683 - RNA, 22 nt, Human
cagggucuuauaaggccaauuu

SEQ ID NO: 1053684 - RNA, 22 nt, Human
uaggcugagcuuguagaucgua

SEQ ID NO: 1053685 - RNA, 22 nt, Human
cccaggaguuagagguuguggu

SEQ ID NO: 1053686 - RNA, 22 nt, Human
aaggcugaggcagugaggcaga

SEQ ID NO: 1053687 - RNA, 22 nt, Human
ugauggucaggaugcauggaga

SEQ ID NO: 1053688 - RNA, 22 nt, Human
gacagagaggcugagcaguaca

SEQ ID NO: 1053689 - RNA, 22 nt, Human
guggcagaaauauucuugcucu

SEQ ID NO: 1053690 - RNA, 22 nt, Human
gagagucuagugcaccuaguuu

SEQ ID NO: 1053691 - RNA, 22 nt, Human
cugcuucugggaugauggagua

SEQ ID NO: 1053692 - RNA, 23 nt, Human
cugcugugaaacaugguuuuggu

SEQ ID NO: 1053693 - RNA, 22 nt, Human
ugaggcagcuuuuucugugugu

SEQ ID NO: 1053694 - RNA, 22 nt, Human
cauuuguacagaacagcuuuau

SEQ ID NO: 1053695 - RNA, 22 nt, Human
ucugcaggaggcuggcugcagg

SEQ ID NO: 1053696 - RNA, 22 nt, Human
aggcugaggcaagaggaucacu

SEQ ID NO: 1053697 - RNA, 22 nt, Human
uggaaggagacugggaagugug

SEQ ID NO: 1053698 - RNA, 22 nt, Human
ggcuaggcaggcucagagccua

SEQ ID NO: 1053699 - RNA, 22 nt, Human
uuaggaaacgcugcuauugacu

SEQ ID NO: 1053700 - RNA, 22 nt, Human
cuucugagcagaccuccugggg

SEQ ID NO: 1053701 - RNA, 22 nt, Human
ugcuggguagaaguauuagucu

SEQ ID NO: 1053702 - RNA, 22 nt, Human
gcugagguuucaggaguggcag

SEQ ID NO: 1053703 - RNA, 22 nt, Human
acuggccaggcgaaccacacug

SEQ ID NO: 1053704 - RNA, 22 nt, Human
cagucucucugaaguauuaaga

SEQ ID NO: 1053705 - RNA, 22 nt, Human
ccuggacucaggcugugggcac

SEQ ID NO: 1053706 - RNA, 21 nt, Human
aaucauacaaaacaugucagg

SEQ ID NO: 1053707 - RNA, 22 nt, Human
guuauaaaaugcacaguuguuu

SEQ ID NO: 1053708 - RNA, 22 nt, Human
caaggccaguucaccaagggca

SEQ ID NO: 1053709 - RNA, 22 nt, Human
gcugauguuuaguugauguuac

SEQ ID NO: 1053710 - RNA, 17 nt, Human
gcugacccuggagaagu

SEQ ID NO: 1053711 - RNA, 22 nt, Human
aguuacagugaccauuuauuua

SEQ ID NO: 1053712 - RNA, 22 nt, Human
cccaggaguaagugacauuguu

SEQ ID NO: 1053713 - RNA, 22 nt, Human
uuccaagagcuuuaauuguuga

SEQ ID NO: 1053714 - RNA, 22 nt, Human
ggugagggaguggaacgaggug

SEQ ID NO: 1053715 - RNA, 21 nt, Human
ccuggccaaucugauaggguu

SEQ ID NO: 1053716 - RNA, 22 nt, Human
cuucucagaucucagcuuugag

SEQ ID NO: 1053717 - RNA, 22 nt, Human
cugaggccccucucuugagcuu

SEQ ID NO: 1053718 - RNA, 22 nt, Human
gcaggcugaguugggaaaccaa

SEQ ID NO: 1053719 - RNA, 22 nt, Human
gcagggaagacccggagcagcg

SEQ ID NO: 1053720 - RNA, 22 nt, Human
cugccucagcguuguggcccua

SEQ ID NO: 1053721 - RNA, 22 nt, Human
agcugcccuuuaugaugcugaa

SEQ ID NO: 1053722 - RNA, 22 nt, Human
uuacagaacugucuugaaauuu

SEQ ID NO: 1053723 - RNA, 22 nt, Human
agucuugcucuugcaucugcuu

SEQ ID NO: 1053724 - RNA, 22 nt, Human
ggccagagaauaugccuuacgu

SEQ ID NO: 1053725 - RNA, 22 nt, Human
acuuccugaauggggcuaauua

SEQ ID NO: 1053726 - RNA, 21 nt, Human
uggccaaaaccauauuauuaa

SEQ ID NO: 1053727 - RNA, 22 nt, Human
ccuggccacucagguguggggc

SEQ ID NO: 1053728 - RNA, 22 nt, Human
cccugccuugggguccacaccg

SEQ ID NO: 1053729 - RNA, 22 nt, Human
cagucucuugcuucauuaguug

SEQ ID NO: 1053730 - RNA, 20 nt, Human
ccaggcuggcaaaugggggc

SEQ ID NO: 1053731 - RNA, 22 nt, Human
uccccagggcugcagagggugu

SEQ ID NO: 1053732 - RNA, 22 nt, Human
cagagacauuaagugccaugau

SEQ ID NO: 1053733 - RNA, 22 nt, Human
gaucauuuugaugcccuuuuag

SEQ ID NO: 1053734 - RNA, 22 nt, Human
ucucagucagccuugauguccc

SEQ ID NO: 1053735 - RNA, 22 nt, Human
agagcagauggagcuggaagag

SEQ ID NO: 1053736 - RNA, 22 nt, Human
ugcuggcuuugcgagaugcauu

SEQ ID NO: 1053737 - RNA, 20 nt, Human
aagagaggaaguuauacuag

SEQ ID NO: 1053738 - RNA, 22 nt, Human
guauaagguauguaaacuauuu

SEQ ID NO: 1053739 - RNA, 22 nt, Human
ucccaggaugaagacaguguug

SEQ ID NO: 1053740 - RNA, 22 nt, Human
ugcugcuggguuugacagucac

SEQ ID NO: 1053741 - RNA, 22 nt, Human
aggcagacucaauggcuagaua

SEQ ID NO: 1053742 - RNA, 22 nt, Human
cugacccauauaagaguggagg

SEQ ID NO: 1053743 - RNA, 22 nt, Human
cacaggcuuuucugacauaggc

SEQ ID NO: 1053744 - RNA, 22 nt, Human
cauaaagucucauaauucacuu

SEQ ID NO: 1053745 - RNA, 22 nt, Human
cuugaaagcuuugcgucuucua

SEQ ID NO: 1053746 - RNA, 22 nt, Human
uuugaaagcaggugugggaggg

SEQ ID NO: 1053747 - RNA, 22 nt, Human
ugaggcagcccacuuuccuuag

SEQ ID NO: 1053748 - RNA, 22 nt, Human
cugccaggcgauggauuggcug

SEQ ID NO: 1053749 - RNA, 22 nt, Human
uggcugcagaucaagggcaggc

SEQ ID NO: 1053750 - RNA, 22 nt, Human
ugaaaugaucaguuugguuacu

SEQ ID NO: 1053751 - RNA, 22 nt, Human
aggcagcugaccacaguaugau

SEQ ID NO: 1053752 - RNA, 22 nt, Human
gcagagcuucuguccuucagga

SEQ ID NO: 1053753 - RNA, 22 nt, Human
ggaggaugccaagcugugcaca

SEQ ID NO: 1053754 - RNA, 22 nt, Human
ccuugcugcgugcuagcacaga

SEQ ID NO: 1053755 - RNA, 23 nt, Human
aucuaauuucuccaaaucucuac

SEQ ID NO: 1053756 - RNA, 22 nt, Human
gagcuccagggaacagcagcua

SEQ ID NO: 1053757 - RNA, 22 nt, Human
aggcaacuuuuggggaugaugg

SEQ ID NO: 1053758 - RNA, 22 nt, Human
agcaccaugaccuugccauuga

SEQ ID NO: 1053759 - RNA, 22 nt, Human
aaaacuaaauacgcuuugccuc

SEQ ID NO: 1053760 - RNA, 22 nt, Human
acaaugaagauaauguugcagu

SEQ ID NO: 1053761 - RNA, 22 nt, Human
aaggcagcacagcaacugcuca

SEQ ID NO: 1053762 - RNA, 22 nt, Human
caggauggugugagugugagga

SEQ ID NO: 1053763 - RNA, 20 nt, Human
aggcugaguucuaugcacuu

SEQ ID NO: 1053764 - RNA, 17 nt, Human
gcccaggaaggacggcc

SEQ ID NO: 1053765 - RNA, 20 nt, Human
cuguggaauuuuaccaugcg

SEQ ID NO: 1053766 - RNA, 21 nt, Human
gggucugaauaucuggugcug

SEQ ID NO: 1053767 - RNA, 22 nt, Human
ccugccucccagagguccucua

SEQ ID NO: 1053768 - RNA, 22 nt, Human
gcagcugcagagaccggguggg

SEQ ID NO: 1053769 - RNA, 22 nt, Human
ccacagugguuguggcaugugg

SEQ ID NO: 1053770 - RNA, 22 nt, Human
cuggcucaauuuguacugcugu

SEQ ID NO: 1053771 - RNA, 22 nt, Human
aaaaugaagcaaaggcauucag

SEQ ID NO: 1053772 - RNA, 22 nt, Human
gagguagcgaguggacagugca

SEQ ID NO: 1053773 - RNA, 20 nt, Human
ggggcugcaugcagagaaga

SEQ ID NO: 1053774 - RNA, 22 nt, Human
cagggaggaugggcuguuuugc

SEQ ID NO: 1053775 - RNA, 22 nt, Human
uuucacaaagcauagcacuuua

SEQ ID NO: 1053776 - RNA, 22 nt, Human
ugaggcccucugggcugguccu

SEQ ID NO: 1053777 - RNA, 22 nt, Human
gucaggauuaaugggaguaugc

SEQ ID NO: 1053778 - RNA, 20 nt, Human
gcugaggucauuaugccuca

SEQ ID NO: 1053779 - RNA, 22 nt, Human
agcuggcagcucucagggguac

SEQ ID NO: 1053780 - RNA, 21 nt, Human
ggcagccucuguggaagggga

SEQ ID NO: 1053781 - RNA, 22 nt, Human
uuauucuuuucuccagaauccc

SEQ ID NO: 1053782 - RNA, 22 nt, Human
aucaggauuauuaaaucuggau

SEQ ID NO: 1053783 - RNA, 22 nt, Human
cccaugagauucugaauuuggc

SEQ ID NO: 1053784 - RNA, 22 nt, Human
ucugugcuggacugauuucaua

SEQ ID NO: 1053785 - RNA, 22 nt, Human
uggccacaguguccagcagcag

SEQ ID NO: 1053786 - RNA, 22 nt, Human
uggagagguugaauaacuuguc

SEQ ID NO: 1053787 - RNA, 22 nt, Human
uauuauuauaguuauugggaag

SEQ ID NO: 1053788 - RNA, 22 nt, Human
aggcaccuugagagcaggagcu

SEQ ID NO: 1053789 - RNA, 20 nt, Human
cugggccauccuuuuacaau

SEQ ID NO: 1053790 - RNA, 22 nt, Human
ugcugaggacuaaaggagauga

SEQ ID NO: 1053791 - RNA, 20 nt, Human
acacacuuugaucuugagcc

SEQ ID NO: 1053792 - RNA, 22 nt, Human
uuuuaauugcaauuaugguccc

SEQ ID NO: 1053793 - RNA, 20 nt, Human
aucaggauucuugcuuuguu

SEQ ID NO: 1053794 - RNA, 23 nt, Human
uuuuccagaaucgacucuguaga

SEQ ID NO: 1053795 - RNA, 22 nt, Human
cugaggcugggcugaggguaua

SEQ ID NO: 1053796 - RNA, 22 nt, Human
aacuuacaaggaugauagcugc

SEQ ID NO: 1053797 - RNA, 22 nt, Human
cuugaaguugcaaaacauuaau

SEQ ID NO: 1053798 - RNA, 22 nt, Human
ucuuaaagagcgcaauuugagg

SEQ ID NO: 1053799 - RNA, 22 nt, Human
aaaggugacugcagcagcuauu

SEQ ID NO: 1053800 - RNA, 22 nt, Human
cugccuggcccagggaugggcc

SEQ ID NO: 1053801 - RNA, 22 nt, Human
aauauaauuuuauuccuagagu

SEQ ID NO: 1053802 - RNA, 22 nt, Human
cuaggcuggagugcauuggcgu

SEQ ID NO: 1053803 - RNA, 22 nt, Human
uuucuagucucgaucucuuaau

SEQ ID NO: 1053804 - RNA, 22 nt, Human
ugccucagcugaggccgcucca

SEQ ID NO: 1053805 - RNA, 22 nt, Human
cagggcugagaauuuagagaca

SEQ ID NO: 1053806 - RNA, 22 nt, Human
uauuagguuggugcaaaauuaa

SEQ ID NO: 1053807 - RNA, 22 nt, Human
ggcugagggucccagacccuaa

SEQ ID NO: 1053808 - RNA, 22 nt, Human
gagccaaggguugccauggaga

SEQ ID NO: 1053809 - RNA, 22 nt, Human
aggcugaggcagguggaucauu

SEQ ID NO: 1053810 - RNA, 22 nt, Human
uacacuuuucaauguagucugu

SEQ ID NO: 1053811 - RNA, 22 nt, Human
ucugagguggggcuggagcauu

SEQ ID NO: 1053812 - RNA, 22 nt, Human
uuaggaaacaguagccuuugcu

SEQ ID NO: 1053813 - RNA, 22 nt, Human
agagggcagucucagauuggga

SEQ ID NO: 1053814 - RNA, 22 nt, Human
auugucuuuccacugagaaguu

SEQ ID NO: 1053815 - RNA, 22 nt, Human
aauaguuaagcaacuuuuucca

SEQ ID NO: 1053816 - RNA, 22 nt, Human
aaagcagacugauuugcaucac

SEQ ID NO: 1053817 - RNA, 19 nt, Human
ggucagcugggcuagaggc

SEQ ID NO: 1053818 - RNA, 22 nt, Human
aguguguccagaaaucuguauu

SEQ ID NO: 1053819 - RNA, 22 nt, Human
cgaggcagaggcugaaacggcu

SEQ ID NO: 1053820 - RNA, 23 nt, Human
ucuccuccuagauacagucaugg

SEQ ID NO: 1053821 - RNA, 22 nt, Human
cuuaggauuuaauuucagacuc

SEQ ID NO: 1053822 - RNA, 22 nt, Human
cuggcacaugcucccugagugg

SEQ ID NO: 1053823 - RNA, 22 nt, Human
uuucaguuuccagcuuugucau

SEQ ID NO: 1053824 - RNA, 22 nt, Human
uuagauaaauuaagacuuuaca

SEQ ID NO: 1053825 - RNA, 22 nt, Human
ucaagugcuugugagguauuug

SEQ ID NO: 1053826 - RNA, 22 nt, Human
caggauggucucgaucuccuga

SEQ ID NO: 1053827 - RNA, 17 nt, Human
gacugagguaaggugag

SEQ ID NO: 1053828 - RNA, 22 nt, Human
agcacugugguggaagcaucaa

SEQ ID NO: 1053829 - RNA, 20 nt, Human
uuaggcauuuggauuggcuu

SEQ ID NO: 1053830 - RNA, 22 nt, Human
cccaggaguuugaguucagcau

SEQ ID NO: 1053831 - RNA, 22 nt, Human
ggcugagcuuauauaugugcug

SEQ ID NO: 1053832 - RNA, 22 nt, Human
ucagcuggaagauggugcagaa

SEQ ID NO: 1053833 - RNA, 22 nt, Human
ugugugucagagucuccauggu

SEQ ID NO: 1053834 - RNA, 21 nt, Human
uccuuccuugagguccuuucc

SEQ ID NO: 1053835 - RNA, 22 nt, Human
aaacugcuuuccacaguggcua

SEQ ID NO: 1053836 - RNA, 22 nt, Human
cuaaucaucuuucucuuaaagc

SEQ ID NO: 1053837 - RNA, 22 nt, Human
uacuuccuguuuccaugucugu

SEQ ID NO: 1053838 - RNA, 22 nt, Human
auauauuugagaauauucauga

SEQ ID NO: 1053839 - RNA, 22 nt, Human
agaggaugguugaggaagaccu

SEQ ID NO: 1053840 - RNA, 22 nt, Human
gucauauacacugcauguaauc

SEQ ID NO: 1053841 - RNA, 18 nt, Human
gaggcagcuagcaauuuu

SEQ ID NO: 1053842 - RNA, 19 nt, Human
uuagccauccacagugaaa

SEQ ID NO: 1053843 - RNA, 22 nt, Human
gggcugagccauuugaaccuug

SEQ ID NO: 1053844 - RNA, 22 nt, Human
agaccaagaaaggaugaggauc

SEQ ID NO: 1053845 - RNA, 22 nt, Human
aacaguaaagacagaauuuauc

SEQ ID NO: 1053846 - RNA, 22 nt, Human
uagggcugcuuuguauucugcu

SEQ ID NO: 1053847 - RNA, 22 nt, Human
ucuccugguauguaugcaccug

SEQ ID NO: 1053848 - RNA, 22 nt, Human
aaaaaagauugaugguggaugc

SEQ ID NO: 1053849 - RNA, 22 nt, Human
gugcagcugcaggagucagguc

SEQ ID NO: 1053850 - RNA, 22 nt, Human
gucuucaacaauaacuaccacu

SEQ ID NO: 1053851 - RNA, 22 nt, Human
guggccaagaaaauagaugcau

SEQ ID NO: 1053852 - RNA, 22 nt, Human
uggcugaggucuggggcuucug

SEQ ID NO: 1053853 - RNA, 22 nt, Human
acagaacuggaauuggaacuca

SEQ ID NO: 1053854 - RNA, 22 nt, Human
aggcuggagacccgccaagaaa

SEQ ID NO: 1053855 - RNA, 18 nt, Human
uccuggccacacuaccuu

SEQ ID NO: 1053856 - RNA, 22 nt, Human
cagagcugagucuucaagguug

SEQ ID NO: 1053857 - RNA, 22 nt, Human
ucuccuggcucaccaggcugga

SEQ ID NO: 1053858 - RNA, 22 nt, Human
auucugagaaaugcauugucag

SEQ ID NO: 1053859 - RNA, 22 nt, Human
gagguagccacagauagagacu

SEQ ID NO: 1053860 - RNA, 22 nt, Human
caggcagcugggucaccguccc

SEQ ID NO: 1053861 - RNA, 22 nt, Human
uugcauuucccauugaguaaug

SEQ ID NO: 1053862 - RNA, 22 nt, Human
aauacaguagguaauaguucau

SEQ ID NO: 1053863 - RNA, 18 nt, Human
cugcuugggagacgucag

SEQ ID NO: 1053864 - RNA, 17 nt, Human
agaacuguaguagcucc

SEQ ID NO: 1053865 - RNA, 22 nt, Human
uggcaucauagccaaggugcuu

SEQ ID NO: 1053866 - RNA, 22 nt, Human
uggaagggagugacagucagag

SEQ ID NO: 1053867 - RNA, 22 nt, Human
ggcugagggccagggcuagucu

SEQ ID NO: 1053868 - RNA, 20 nt, Human
cgugcugugaccuugagcau

SEQ ID NO: 1053869 - RNA, 22 nt, Human
uucaggauccccaccgcguuua

SEQ ID NO: 1053870 - RNA, 22 nt, Human
ucugagguggacgauggagccu

SEQ ID NO: 1053871 - RNA, 22 nt, Human
gaggccaggggccuggagauga

SEQ ID NO: 1053872 - RNA, 22 nt, Human
caccccagcuucucaggauaga

SEQ ID NO: 1053873 - RNA, 22 nt, Human
agcugaugccauguggaacagu

SEQ ID NO: 1053874 - RNA, 22 nt, Human
ugucaccaugccagcuucugcc

SEQ ID NO: 1053875 - RNA, 22 nt, Human
cauugcuuccuaugucccuucu

SEQ ID NO: 1053876 - RNA, 22 nt, Human
ccugccugcaccuucucugggg

SEQ ID NO: 1053877 - RNA, 20 nt, Human
ugcguguguauuuauuuucu

SEQ ID NO: 1053878 - RNA, 22 nt, Human
aagcagaggaccgacggaggga

SEQ ID NO: 1053879 - RNA, 22 nt, Human
aaggcugauuagacugauagcu

SEQ ID NO: 1053880 - RNA, 21 nt, Human
uucuucuuggacuguuuuggc

SEQ ID NO: 1053881 - RNA, 22 nt, Human
ugcaggcuggggaggcagacuu

SEQ ID NO: 1053882 - RNA, 22 nt, Human
ccaggaaaauaccaagcuuuaa

SEQ ID NO: 1053883 - RNA, 22 nt, Human
ugaggcagcaauuguauuguau

SEQ ID NO: 1053884 - RNA, 22 nt, Human
gagugcaguuggggugagggga

SEQ ID NO: 1053885 - RNA, 19 nt, Human
ggcugcugguuacagaggc

SEQ ID NO: 1053886 - RNA, 22 nt, Human
auauuaggugcucaauacaugc

SEQ ID NO: 1053887 - RNA, 22 nt, Human
agcccagguucuaaagccaaac

SEQ ID NO: 1053888 - RNA, 22 nt, Human
aggcuaagauguggucugagca

SEQ ID NO: 1053889 - RNA, 22 nt, Human
ccuggaccaaacacuggccugg

SEQ ID NO: 1053890 - RNA, 20 nt, Human
ccuggccaaugagauaggaa

SEQ ID NO: 1053891 - RNA, 22 nt, Human
gcuguggucugugagcuccaaa

SEQ ID NO: 1053892 - RNA, 22 nt, Human
aggagagggguaggauuaauuu

SEQ ID NO: 1053893 - RNA, 22 nt, Human
agaggcaggagguugacuugag

SEQ ID NO: 1053894 - RNA, 20 nt, Human
uugagcuuuuaguacagaca

SEQ ID NO: 1053895 - RNA, 22 nt, Human
acccaggaaaacauggugcaga

SEQ ID NO: 1053896 - RNA, 22 nt, Human
ugaggcagugcugggaagccug

SEQ ID NO: 1053897 - RNA, 22 nt, Human
uugaaaggaauacagaggccua

SEQ ID NO: 1053898 - RNA, 22 nt, Human
uagcacaucuggcgcuuauagg

SEQ ID NO: 1053899 - RNA, 18 nt, Human
caaauacuguugucuuau

SEQ ID NO: 1053900 - RNA, 22 nt, Human
uccaggaguuugagacugcagu

SEQ ID NO: 1053901 - RNA, 22 nt, Human
uugcugaaaucuaugacauccu

SEQ ID NO: 1053902 - RNA, 18 nt, Human
gcugagguggugucagag

SEQ ID NO: 1053903 - RNA, 22 nt, Human
gcuggcaggagccuuucccuuu

SEQ ID NO: 1053904 - RNA, 22 nt, Human
uaguuaggguucugcagagaca

SEQ ID NO: 1053905 - RNA, 22 nt, Human
gcaggaagcauagaagaaugcc

SEQ ID NO: 1053906 - RNA, 22 nt, Human
aggcaguuucugggacagcaua

SEQ ID NO: 1053907 - RNA, 22 nt, Human
gcaggcugauagaggauuccau

SEQ ID NO: 1053908 - RNA, 22 nt, Human
gcugcugccuguagccagggug

SEQ ID NO: 1053909 - RNA, 22 nt, Human
uuagcgcacaucacagggggaa

SEQ ID NO: 1053910 - RNA, 22 nt, Human
ccugggcaauauagugaggccc

SEQ ID NO: 1053911 - RNA, 22 nt, Human
acucugggcuuugauuuguuac

SEQ ID NO: 1053912 - RNA, 18 nt, Human
ugaauagggguuugcaga

SEQ ID NO: 1053913 - RNA, 23 nt, Human
ucagucuucccugucaguaauag

SEQ ID NO: 1053914 - RNA, 22 nt, Human
ggcugcaggcagaggcugucug

SEQ ID NO: 1053915 - RNA, 22 nt, Human
gagcugaggcugaggccucacu

SEQ ID NO: 1053916 - RNA, 22 nt, Human
aaggcagccaugugcuuugggu

SEQ ID NO: 1053917 - RNA, 22 nt, Human
aggcagauauuggggugaugug

SEQ ID NO: 1053918 - RNA, 22 nt, Human
ugaaacauuugaugaucuuugg

SEQ ID NO: 1053919 - RNA, 22 nt, Human
uagugucaggagggaaaugcaa

SEQ ID NO: 1053920 - RNA, 22 nt, Human
uuugaaagacagaauauuuuug

SEQ ID NO: 1053921 - RNA, 22 nt, Human
cuggcgcaacagaaaaucugga

SEQ ID NO: 1053922 - RNA, 22 nt, Human
agcauaaguugguacagccacu

SEQ ID NO: 1053923 - RNA, 22 nt, Human
acuccuggguuccggagauucu

SEQ ID NO: 1053924 - RNA, 22 nt, Human
uaugccugauaacugugucucu

SEQ ID NO: 1053925 - RNA, 22 nt, Human
gcccaggaguucaagucuagug

SEQ ID NO: 1053926 - RNA, 22 nt, Human
aaagccagagcaagcugucaca

SEQ ID NO: 1053927 - RNA, 22 nt, Human
ucugcugucacucauuugcuuc

SEQ ID NO: 1053928 - RNA, 22 nt, Human
ggcagcugcaaaucugcucugu

SEQ ID NO: 1053929 - RNA, 22 nt, Human
ugucaauguguacaggagcuca

SEQ ID NO: 1053930 - RNA, 22 nt, Human
agaggggaggcgaaccagaguc

SEQ ID NO: 1053931 - RNA, 22 nt, Human
aggccagcucuacccuuggacu

SEQ ID NO: 1053932 - RNA, 22 nt, Human
acuaacauuuguguaugucuug

SEQ ID NO: 1053933 - RNA, 22 nt, Human
aauuuccaaauuucugucacac

SEQ ID NO: 1053934 - RNA, 22 nt, Human
uuuauauuucccaggauuggcc

SEQ ID NO: 1053935 - RNA, 22 nt, Human
uucugaauggcaagcauuaggc

SEQ ID NO: 1053936 - RNA, 22 nt, Human
caugcaggcacccagagcccac

SEQ ID NO: 1053937 - RNA, 22 nt, Human
uggcugaguuacgaacagagca

SEQ ID NO: 1053938 - RNA, 22 nt, Human
acuuuauuuccuauugcaucca

SEQ ID NO: 1053939 - RNA, 22 nt, Human
uuagccauuaaauuacaaggug

SEQ ID NO: 1053940 - RNA, 22 nt, Human
ucaggagaaggcaauguggaaa

SEQ ID NO: 1053941 - RNA, 22 nt, Human
cagaaauguacugacaugcagu

SEQ ID NO: 1053942 - RNA, 22 nt, Human
cccagggaagccauuucugacu

SEQ ID NO: 1053943 - RNA, 22 nt, Human
guggccaaaucaugucaaaggc

SEQ ID NO: 1053944 - RNA, 22 nt, Human
uauuuucuggacagucuugcuu

SEQ ID NO: 1053945 - RNA, 22 nt, Human
ugucucugauaaguaguucagu

SEQ ID NO: 1053946 - RNA, 22 nt, Human
aggcugaggaucguacuuucca

SEQ ID NO: 1053947 - RNA, 22 nt, Human
ugaaaugagagcacagaauaaa

SEQ ID NO: 1053948 - RNA, 22 nt, Human
uuauuagguuauucucuguacu

SEQ ID NO: 1053949 - RNA, 22 nt, Human
ucuuugcaggccaaauuguuaa

SEQ ID NO: 1053950 - RNA, 22 nt, Human
acuccugguuuguguccuggcu

SEQ ID NO: 1053951 - RNA, 22 nt, Human
uucugagcugcaacacuaacau

SEQ ID NO: 1053952 - RNA, 21 nt, Human
cucaaagaccaaaaguguaga

SEQ ID NO: 1053953 - RNA, 22 nt, Human
agaaaugaaaccaaagccuaga

SEQ ID NO: 1053954 - RNA, 22 nt, Human
gggcagcugccagaggccaugg

SEQ ID NO: 1053955 - RNA, 22 nt, Human
cuguggaaaauuuguauguaau

SEQ ID NO: 1053956 - RNA, 22 nt, Human
gcugcugugaauuuuuuaaaug

SEQ ID NO: 1053957 - RNA, 22 nt, Human
aggaugagaagauuggaaucuu

SEQ ID NO: 1053958 - RNA, 22 nt, Human
uggcacaugguaagugcuuaac

SEQ ID NO: 1053959 - RNA, 15 nt, Human
cccaggaguucgaga

SEQ ID NO: 1053960 - RNA, 22 nt, Human
aucugcaggaaugugugcagag

SEQ ID NO: 1053961 - RNA, 22 nt, Human
gaaaacugugauuagaaugccu

SEQ ID NO: 1053962 - RNA, 22 nt, Human
ucucuuucuauaugugagucuu

SEQ ID NO: 1053963 - RNA, 22 nt, Human
uuugaaaguguuuacuugggaa

SEQ ID NO: 1053964 - RNA, 22 nt, Human
ucuaagccuaggaaaugaguuu

SEQ ID NO: 1053965 - RNA, 22 nt, Human
ugaggcagaguaagauacauga

SEQ ID NO: 1053966 - RNA, 22 nt, Human
uuuuagcacuaagugauaugcu

SEQ ID NO: 1053967 - RNA, 22 nt, Human
auauucuugugauuauaaagua

SEQ ID NO: 1053968 - RNA, 22 nt, Human
uguaggucucagugucugagcu

SEQ ID NO: 1053969 - RNA, 22 nt, Human
uaggcagcgcuuggcugugcuu

SEQ ID NO: 1053970 - RNA, 22 nt, Human
caggaugaagggcaaaggcaag

SEQ ID NO: 1053971 - RNA, 22 nt, Human
gcuccucugucaaaugagagug

SEQ ID NO: 1053972 - RNA, 22 nt, Human
gcugccucuguagcuuuggacc

SEQ ID NO: 1053973 - RNA, 22 nt, Human
gaggggaaagugugaggcugcg

SEQ ID NO: 1053974 - RNA, 22 nt, Human
cugcugugcaggugccuaugau

SEQ ID NO: 1053975 - RNA, 22 nt, Human
uuuacuuuugguaaggucauuu

SEQ ID NO: 1053976 - RNA, 17 nt, Human
gaggagcuccaguaggu

SEQ ID NO: 1053977 - RNA, 22 nt, Human
uuucaaagaccauuaacuauca

SEQ ID NO: 1053978 - RNA, 22 nt, Human
agaccgagaaguucuccaggcc

SEQ ID NO: 1053979 - RNA, 20 nt, Human
ugaaggccagcagcauaggg

SEQ ID NO: 1053980 - RNA, 22 nt, Human
ucucacugcaaauauuauguau

SEQ ID NO: 1053981 - RNA, 22 nt, Human
acagagcuguacuacuuacuga

SEQ ID NO: 1053982 - RNA, 22 nt, Human
aggcaccuugcgguccagugaa

SEQ ID NO: 1053983 - RNA, 22 nt, Human
cagaaggcuggcagauugagau

SEQ ID NO: 1053984 - RNA, 21 nt, Human
cucuugugucagagccagagg

SEQ ID NO: 1053985 - RNA, 22 nt, Human
gcacuuucagcaggcagacaga

SEQ ID NO: 1053986 - RNA, 22 nt, Human
ggcugagcccccucugcguagg

SEQ ID NO: 1053987 - RNA, 22 nt, Human
aaggccagccugagagcuaaca

SEQ ID NO: 1053988 - RNA, 22 nt, Human
cuggagagggagcccuggcagu

SEQ ID NO: 1053989 - RNA, 22 nt, Human
uuuuauucuaaguaugauggga

SEQ ID NO: 1053990 - RNA, 22 nt, Human
gugaggucaaagccuuggguau

SEQ ID NO: 1053991 - RNA, 22 nt, Human
uaggcagauguuaacaggaaaa

SEQ ID NO: 1053992 - RNA, 22 nt, Human
guauuaggagguggagccuuug

SEQ ID NO: 1053993 - RNA, 22 nt, Human
gcuccuggccagcacagggccc

SEQ ID NO: 1053994 - RNA, 22 nt, Human
agcugaggacgugaagggcggc

SEQ ID NO: 1053995 - RNA, 22 nt, Human
uucuagaugauaaaccagcagc

SEQ ID NO: 1053996 - RNA, 22 nt, Human
auuuggaacuuauaauaaguuu

SEQ ID NO: 1053997 - RNA, 22 nt, Human
agggcaguucaacuucauagug

SEQ ID NO: 1053998 - RNA, 23 nt, Human
ucugggccacuugucugcacuuc

SEQ ID NO: 1053999 - RNA, 22 nt, Human
ccaggcuggagugcaauggugc

SEQ ID NO: 1054000 - RNA, 22 nt, Human
uggcaguccccugugccuggaa

SEQ ID NO: 1054001 - RNA, 20 nt, Human
ugcugcugugagcgucccug

SEQ ID NO: 1054002 - RNA, 22 nt, Human
gaggagagaacauuccuccaua

SEQ ID NO: 1054003 - RNA, 22 nt, Human
ggcuuggaaaugguaaugagcu

SEQ ID NO: 1054004 - RNA, 22 nt, Human
cugagcuguuuaaucccagaua

SEQ ID NO: 1054005 - RNA, 22 nt, Human
cugcuucacuucgguugcauag

SEQ ID NO: 1054006 - RNA, 22 nt, Human
uucuucaguguagcaacuguau

SEQ ID NO: 1054007 - RNA, 22 nt, Human
aaguuauaucaucucauugacg

SEQ ID NO: 1054008 - RNA, 22 nt, Human
ggugaguugggguucacagguc

SEQ ID NO: 1054009 - RNA, 22 nt, Human
cugggccauggaagucucugcc

SEQ ID NO: 1054010 - RNA, 22 nt, Human
acugagguuguaguaggaauuc

SEQ ID NO: 1054011 - RNA, 22 nt, Human
ccaggagagcauugcacagagg

SEQ ID NO: 1054012 - RNA, 22 nt, Human
uaggaucucaccauagaaggaa

SEQ ID NO: 1054013 - RNA, 22 nt, Human
uuuuauuaucuuugaaugggac

SEQ ID NO: 1054014 - RNA, 22 nt, Human
agucugaguaucucugagccag

SEQ ID NO: 1054015 - RNA, 22 nt, Human
cuuguagcugcuucuucugaag

SEQ ID NO: 1054016 - RNA, 22 nt, Human
ccugagcugcggggcagugcuc

SEQ ID NO: 1054017 - RNA, 22 nt, Human
aaauucacuugccugcuuagcu

SEQ ID NO: 1054018 - RNA, 21 nt, Human
ccugagugagaccuggcccgu

SEQ ID NO: 1054019 - RNA, 22 nt, Human
uccagccuaggggaacagcugc

SEQ ID NO: 1054020 - RNA, 22 nt, Human
caaauaguuuuucauguauuau

SEQ ID NO: 1054021 - RNA, 22 nt, Human
ucucucagaggaagaggcagug

SEQ ID NO: 1054022 - RNA, 22 nt, Human
agggcagcccuucugggagggc

SEQ ID NO: 1054023 - RNA, 22 nt, Human
cccuggccccucacuccgaggc

SEQ ID NO: 1054024 - RNA, 22 nt, Human
augcugagauccucaggccaga

SEQ ID NO: 1054025 - RNA, 22 nt, Human
ucugagguccuacuauaagugg

SEQ ID NO: 1054026 - RNA, 22 nt, Human
uagggcugaggcaacaagggag

SEQ ID NO: 1054027 - RNA, 22 nt, Human
auauucuucuuguucagacuau

SEQ ID NO: 1054028 - RNA, 22 nt, Human
cucaguuucugacauuaaaauc

SEQ ID NO: 1054029 - RNA, 20 nt, Human
cugcugugugugccucagcc

SEQ ID NO: 1054030 - RNA, 22 nt, Human
auuugcuuucagguauaaaagg

SEQ ID NO: 1054031 - RNA, 22 nt, Human
cauuuguagcuauuuacuguau

SEQ ID NO: 1054032 - RNA, 22 nt, Human
uuggaauucaaguuguagcuua

SEQ ID NO: 1054033 - RNA, 22 nt, Human
accauuuuggguauuuucagag

SEQ ID NO: 1054034 - RNA, 19 nt, Human
uucauucuuucuacuuacc

SEQ ID NO: 1054035 - RNA, 22 nt, Human
gcccaggaugguguguaguggu

SEQ ID NO: 1054036 - RNA, 23 nt, Human
cagugugacgaggugaggcaggc

SEQ ID NO: 1054037 - RNA, 22 nt, Human
ucaggcuguggcuucaguucuu

SEQ ID NO: 1054038 - RNA, 23 nt, Human
acagacaacacugaugagagaaa

SEQ ID NO: 1054039 - RNA, 22 nt, Human
uucuucuucaagugcugcauuc

SEQ ID NO: 1054040 - RNA, 22 nt, Human
ugaggcagaaauuccuguuuuc

SEQ ID NO: 1054041 - RNA, 22 nt, Human
guucuucaguaaaauuaaaugu

SEQ ID NO: 1054042 - RNA, 22 nt, Human
auacuguuuugugacuuaucuu

SEQ ID NO: 1054043 - RNA, 22 nt, Human
ggcugaggcggcgaugcccuug

SEQ ID NO: 1054044 - RNA, 22 nt, Human
agagcagcacguuguccccaca

SEQ ID NO: 1054045 - RNA, 22 nt, Human
uucuacaugguugcucagaggg

SEQ ID NO: 1054046 - RNA, 22 nt, Human
guuagagcacauacuuugcaug

SEQ ID NO: 1054047 - RNA, 22 nt, Human
guuauuaguaagacucgcacau

SEQ ID NO: 1054048 - RNA, 22 nt, Human
cucaggauucucgacacucaca

SEQ ID NO: 1054049 - RNA, 19 nt, Human
caggaaugagguaauggcu

SEQ ID NO: 1054050 - RNA, 22 nt, Human
uuggccaacauggugaaacccc

SEQ ID NO: 1054051 - RNA, 22 nt, Human
gaccuuuuuacuguguacgcug

SEQ ID NO: 1054052 - RNA, 22 nt, Human
aggcagagcuggguuuugaaau

SEQ ID NO: 1054053 - RNA, 22 nt, Human
acuauacaccaaaauauuaagg

SEQ ID NO: 1054054 - RNA, 22 nt, Human
aauccuggaauacaagagugaa

SEQ ID NO: 1054055 - RNA, 22 nt, Human
uugaggucuucaggaucaggcu

SEQ ID NO: 1054056 - RNA, 22 nt, Human
agcccuggcagagccagguagu

SEQ ID NO: 1054057 - RNA, 22 nt, Human
gccuggcuaguuagugucaggu

SEQ ID NO: 1054058 - RNA, 22 nt, Human
aaacugcugguugcuggccagc

SEQ ID NO: 1054059 - RNA, 22 nt, Human
uccaggaggugaggggaccaaa

SEQ ID NO: 1054060 - RNA, 22 nt, Human
aaaggugacacucugccagcug

SEQ ID NO: 1054061 - RNA, 22 nt, Human
augcaucuauucccaagggcag

SEQ ID NO: 1054062 - RNA, 22 nt, Human
gcugacaguuacugcuguaaca

SEQ ID NO: 1054063 - RNA, 22 nt, Human
uagaaagugaagguuaauuaau

SEQ ID NO: 1054064 - RNA, 22 nt, Human
cuguguuggcuuuucucuugua

SEQ ID NO: 1054065 - RNA, 21 nt, Human
acagcaagccuucacaugagu

SEQ ID NO: 1054066 - RNA, 17 nt, Human
caggcagacauguaagc

SEQ ID NO: 1054067 - RNA, 17 nt, Human
agauggcaggaggcaga

SEQ ID NO: 1054068 - RNA, 22 nt, Human
gaggcuccgugcugcugcccug

SEQ ID NO: 1054069 - RNA, 22 nt, Human
uaacuguauagcuuggacuaaa

SEQ ID NO: 1054070 - RNA, 22 nt, Human
aacaugauggggaagaacaaga

SEQ ID NO: 1054071 - RNA, 22 nt, Human
gagagguccauuccccugucag

SEQ ID NO: 1054072 - RNA, 22 nt, Human
uggguccacggaagacuuaggg

SEQ ID NO: 1054073 - RNA, 22 nt, Human
aaagcagaggugauaugacuua

SEQ ID NO: 1054074 - RNA, 22 nt, Human
uaggagagcugaacuauugucu

SEQ ID NO: 1054075 - RNA, 21 nt, Human
cccaggaggagcuccggcucc

SEQ ID NO: 1054076 - RNA, 22 nt, Human
gagugcaggccugagcaccauc

SEQ ID NO: 1054077 - RNA, 22 nt, Human
uccacauccauugcuugacuuu

SEQ ID NO: 1054078 - RNA, 22 nt, Human
augcugcagcugcaggaucaga

SEQ ID NO: 1054079 - RNA, 21 nt, Human
cauuaaguaccagggcacugu

SEQ ID NO: 1054080 - RNA, 22 nt, Human
ccuggagagagaggccaacugc

SEQ ID NO: 1054081 - RNA, 22 nt, Human
uggcuucuugacuucuuggcug

SEQ ID NO: 1054082 - RNA, 22 nt, Human
ugcauguguguguauuuauaaa

SEQ ID NO: 1054083 - RNA, 22 nt, Human
ggauggcauguugggcucuguu

SEQ ID NO: 1054084 - RNA, 22 nt, Human
gacaggaggcagagcucaggug

SEQ ID NO: 1054085 - RNA, 21 nt, Human
uaggcagaggagcagguaucu

SEQ ID NO: 1054086 - RNA, 23 nt, Human
aggcuccacucccugggaugugg

SEQ ID NO: 1054087 - RNA, 22 nt, Human
ucuggccacuaauaggucucac

SEQ ID NO: 1054088 - RNA, 22 nt, Human
cuuguccccagcagguugguuu

SEQ ID NO: 1054089 - RNA, 22 nt, Human
aaguuacaguuacagaauggag

SEQ ID NO: 1054090 - RNA, 22 nt, Human
ucucuucuauuugagacuauuu

SEQ ID NO: 1054091 - RNA, 22 nt, Human
aaauuguugaucuacaguaagg

SEQ ID NO: 1054092 - RNA, 22 nt, Human
uuucuaggucuuccauacugcc

SEQ ID NO: 1054093 - RNA, 22 nt, Human
gucaggaugacaagugcuuuca

SEQ ID NO: 1054094 - RNA, 22 nt, Human
auaagcauguuagaauauuuga

SEQ ID NO: 1054095 - RNA, 22 nt, Human
ucuaaagaagaggguucugcgg

SEQ ID NO: 1054096 - RNA, 22 nt, Human
gcaggcagagguggaggagaca

SEQ ID NO: 1054097 - RNA, 22 nt, Human
acucaggaauggggcugggacu

SEQ ID NO: 1054098 - RNA, 22 nt, Human
acagugcuaaacacuucuugaa

SEQ ID NO: 1054099 - RNA, 22 nt, Human
auuaauaaaauaccacuuuguu

SEQ ID NO: 1054100 - RNA, 22 nt, Human
caauuacauuuauugagcauuc

SEQ ID NO: 1054101 - RNA, 22 nt, Human
accuuuuccagcuucuagaggc

SEQ ID NO: 1054102 - RNA, 18 nt, Human
gcuuuauuucuuggggaa

SEQ ID NO: 1054103 - RNA, 18 nt, Human
cugaggcuggcaggagcc

SEQ ID NO: 1054104 - RNA, 22 nt, Human
cccuggaggaaaaucugaggcu

SEQ ID NO: 1054105 - RNA, 22 nt, Human
aggacagggauucaaacuccca

SEQ ID NO: 1054106 - RNA, 22 nt, Human
auuaggcaauucugggcaucuc

SEQ ID NO: 1054107 - RNA, 22 nt, Human
ggugaaggucagagcaggaaaa

SEQ ID NO: 1054108 - RNA, 22 nt, Human
gaggccagggaugcaaugagag

SEQ ID NO: 1054109 - RNA, 22 nt, Human
acugagguuucauuuuaucgcu

SEQ ID NO: 1054110 - RNA, 22 nt, Human
aaacugguaauaaaauggauua

SEQ ID NO: 1054111 - RNA, 22 nt, Human
gcucaggaucagccaccucuuu

SEQ ID NO: 1054112 - RNA, 22 nt, Human
uacccaggaggaaacugaggcu

SEQ ID NO: 1054113 - RNA, 22 nt, Human
cacugucuuuugugaagacaau

SEQ ID NO: 1054114 - RNA, 22 nt, Human
gcauguguugguuuaugcaugu

SEQ ID NO: 1054115 - RNA, 22 nt, Human
aggcaguggagcuggaauaggc

SEQ ID NO: 1054116 - RNA, 22 nt, Human
ccuccucugggaagauucagag

SEQ ID NO: 1054117 - RNA, 22 nt, Human
gaggaacccagcugggguugcc

SEQ ID NO: 1054118 - RNA, 22 nt, Human
gcagcugcagacccucagugcu

SEQ ID NO: 1054119 - RNA, 22 nt, Human
aagcaggauggagguugaguua

SEQ ID NO: 1054120 - RNA, 22 nt, Human
ucugagguucccucaacuaccu

SEQ ID NO: 1054121 - RNA, 22 nt, Human
cccugggcucagagcagguagc

SEQ ID NO: 1054122 - RNA, 22 nt, Human
ccauccugcauugcuauucaga

SEQ ID NO: 1054123 - RNA, 22 nt, Human
cccaggagcuucucucugccuc

SEQ ID NO: 1054124 - RNA, 22 nt, Human
cuugcugugugguguucucaga

SEQ ID NO: 1054125 - RNA, 22 nt, Human
aagggcugaaugaaggguugaa

SEQ ID NO: 1054126 - RNA, 22 nt, Human
gcuggccauauauuuugcuguu

SEQ ID NO: 1054127 - RNA, 22 nt, Human
uaggaggguuagagggaaauau

SEQ ID NO: 1054128 - RNA, 22 nt, Human
cagaggcaggaagaugggcagu

SEQ ID NO: 1054129 - RNA, 22 nt, Human
gccaggcuaagaaaggugugau

SEQ ID NO: 1054130 - RNA, 22 nt, Human
gcugaggaaaggcuggaaggga

SEQ ID NO: 1054131 - RNA, 22 nt, Human
uguaggccuauguccagcaauu

SEQ ID NO: 1054132 - RNA, 22 nt, Human
ggcugaggguauagcuguccca

SEQ ID NO: 1054133 - RNA, 22 nt, Human
accauccugaaaccuucaugcu

SEQ ID NO: 1054134 - RNA, 22 nt, Human
gcagcuccuccugggcuggaga

SEQ ID NO: 1054135 - RNA, 22 nt, Human
gguccaccuccaagcuggggac

SEQ ID NO: 1054136 - RNA, 22 nt, Human
aggcaguguguagcuggaagag

SEQ ID NO: 1054137 - RNA, 22 nt, Human
uuugaauauacuucaaacaaag

SEQ ID NO: 1054138 - RNA, 22 nt, Human
uguuagcagagcagcugacaga

SEQ ID NO: 1054139 - RNA, 22 nt, Human
cuaggccacuugcucucaugga

SEQ ID NO: 1054140 - RNA, 22 nt, Human
ucugagcuucugcauuuccaac

SEQ ID NO: 1054141 - RNA, 22 nt, Human
auuugcuuaucuccacaguugu

SEQ ID NO: 1054142 - RNA, 22 nt, Human
ggagggcugagacuggggucug

SEQ ID NO: 1054143 - RNA, 22 nt, Human
ucauuucaaguucugacagcua

SEQ ID NO: 1054144 - RNA, 23 nt, Human
agggcugaugccauugcagcucu

SEQ ID NO: 1054145 - RNA, 22 nt, Human
agcuaagacuuagugacuuagu

SEQ ID NO: 1054146 - RNA, 20 nt, Human
cugccgaccacagccaugga

SEQ ID NO: 1054147 - RNA, 21 nt, Human
auacacauacacauaaaugug

SEQ ID NO: 1054148 - RNA, 22 nt, Human
accccagaggcggaggcugcag

SEQ ID NO: 1054149 - RNA, 19 nt, Human
ucucacaguuuccuugccu

SEQ ID NO: 1054150 - RNA, 22 nt, Human
gagggcuguggggcaugaccag

SEQ ID NO: 1054151 - RNA, 22 nt, Human
cuugauguauaaguugauaugu

SEQ ID NO: 1054152 - RNA, 22 nt, Human
uucuucaugcuguugcugcuug

SEQ ID NO: 1054153 - RNA, 22 nt, Human
ucaugcuuauugcauauuugga

SEQ ID NO: 1054154 - RNA, 22 nt, Human
cuggaaauuggagaugauguuu

SEQ ID NO: 1054155 - RNA, 18 nt, Human
ucaggcuggaaguuugcc

SEQ ID NO: 1054156 - RNA, 22 nt, Human
uucuuuuccuacacagcgauuu

SEQ ID NO: 1054157 - RNA, 22 nt, Human
caggauggccccggggcugugc

SEQ ID NO: 1054158 - RNA, 22 nt, Human
ccaagaugaucuuuacaguguu

SEQ ID NO: 1054159 - RNA, 22 nt, Human
agaggccagguccagaguuugu

SEQ ID NO: 1054160 - RNA, 22 nt, Human
aauguauuccucaugcaagagu

SEQ ID NO: 1054161 - RNA, 22 nt, Human
agugagaguauuaaugugaacu

SEQ ID NO: 1054162 - RNA, 22 nt, Human
gugcuuucugcugcauuccucu

SEQ ID NO: 1054163 - RNA, 22 nt, Human
auggaaagggaagcaaggaaca

SEQ ID NO: 1054164 - RNA, 22 nt, Human
ucccugccaguccuggucugaa

SEQ ID NO: 1054165 - RNA, 22 nt, Human
aaggcagucugguuucaaagca

SEQ ID NO: 1054166 - RNA, 22 nt, Human
cagcuggcuggucagugcacaa

SEQ ID NO: 1054167 - RNA, 22 nt, Human
gacugaggugcccagaggugac

SEQ ID NO: 1054168 - RNA, 22 nt, Human
uuaguaggagagcuuguucauu

SEQ ID NO: 1054169 - RNA, 21 nt, Human
uucucagaucgaguagugaga

SEQ ID NO: 1054170 - RNA, 22 nt, Human
cagcuuuuuagaaucuagggca

SEQ ID NO: 1054171 - RNA, 22 nt, Human
gaggcaguuugccaugccagga

SEQ ID NO: 1054172 - RNA, 22 nt, Human
uaagaaauuuaguuauagaaug

SEQ ID NO: 1054173 - RNA, 21 nt, Human
cugagggccgcagcugggcuc

SEQ ID NO: 1054174 - RNA, 22 nt, Human
cagggagggacaauugucaccu

SEQ ID NO: 1054175 - RNA, 21 nt, Human
ugcccuggggcucuucccuca

SEQ ID NO: 1054176 - RNA, 22 nt, Human
uaauauaccaaacuguaauuuu

SEQ ID NO: 1054177 - RNA, 22 nt, Human
ucuuuucaucauuuaauaggua

SEQ ID NO: 1054178 - RNA, 22 nt, Human
ucugcaucauuuuucagagccg

SEQ ID NO: 1054179 - RNA, 23 nt, Human
agaugagccaacaccuccaugcc

SEQ ID NO: 1054180 - RNA, 22 nt, Human
cccuuagcucaauuucuugccc

SEQ ID NO: 1054181 - RNA, 22 nt, Human
ugguaauuaauuugauagguuc

SEQ ID NO: 1054182 - RNA, 16 nt, Human
aggaggggaauuagga

SEQ ID NO: 1054183 - RNA, 22 nt, Human
cucccaggcacagggaggagcc

SEQ ID NO: 1054184 - RNA, 22 nt, Human
cuuagagcuuaggcuagccauu

SEQ ID NO: 1054185 - RNA, 22 nt, Human
uuuuaucugcuucauuaguuga

SEQ ID NO: 1054186 - RNA, 22 nt, Human
agagggaucacccuguuucugg

SEQ ID NO: 1054187 - RNA, 22 nt, Human
ccaccagcuucagcagccgcgg

SEQ ID NO: 1054188 - RNA, 22 nt, Human
uuucugcugugcuuucuugcgu

SEQ ID NO: 1054189 - RNA, 22 nt, Human
auuggaaaugcuacaaguuaga

SEQ ID NO: 1054190 - RNA, 22 nt, Human
cuguccccugugcuuucacuug

SEQ ID NO: 1054191 - RNA, 22 nt, Human
auuuguugcuagcagcacugau

SEQ ID NO: 1054192 - RNA, 22 nt, Human
ccacugcuagagaugcaucccc

SEQ ID NO: 1054193 - RNA, 22 nt, Human
acacuuucuggagcugcacaua

SEQ ID NO: 1054194 - RNA, 22 nt, Human
aaguuacacauuuucauuguaa

SEQ ID NO: 1054195 - RNA, 20 nt, Human
aggaagcugagauguagagg

SEQ ID NO: 1054196 - RNA, 22 nt, Human
agcugccccaugagaggcaggu

SEQ ID NO: 1054197 - RNA, 22 nt, Human
cugcuuugacuguuaagaacca

SEQ ID NO: 1054198 - RNA, 22 nt, Human
gaauacacgaauagagcauggu

SEQ ID NO: 1054199 - RNA, 19 nt, Human
ugcuagaaauucugugacu

SEQ ID NO: 1054200 - RNA, 22 nt, Human
uaacaugaaacuccaaauggua

SEQ ID NO: 1054201 - RNA, 22 nt, Human
cugccugcguugccucgugccu

SEQ ID NO: 1054202 - RNA, 22 nt, Human
guccaugauucugugacacccu

SEQ ID NO: 1054203 - RNA, 22 nt, Human
ccuucauugcaucuuuaagaga

SEQ ID NO: 1054204 - RNA, 22 nt, Human
cagggucugaaacugaucacag

SEQ ID NO: 1054205 - RNA, 22 nt, Human
ggcagacuguaauaggagaauu

SEQ ID NO: 1054206 - RNA, 22 nt, Human
agcacagggcccagccuaggcc

SEQ ID NO: 1054207 - RNA, 22 nt, Human
cugggccagcaacugcaaugga

SEQ ID NO: 1054208 - RNA, 22 nt, Human
gagagcuguuuaucuucuucaa

SEQ ID NO: 1054209 - RNA, 20 nt, Human
cugagcccccagccugcagg

SEQ ID NO: 1054210 - RNA, 22 nt, Human
acugaggauuagcccaggcuag

SEQ ID NO: 1054211 - RNA, 22 nt, Human
ucuccugguacccuuccuagca

SEQ ID NO: 1054212 - RNA, 22 nt, Human
auugaaaguccuaucuaaggga

SEQ ID NO: 1054213 - RNA, 20 nt, Human
cuucuucaguaguuuguucu

SEQ ID NO: 1054214 - RNA, 22 nt, Human
aagcgccaugguuccugcgcag

SEQ ID NO: 1054215 - RNA, 22 nt, Human
uccaggagugugugcuaauggg

SEQ ID NO: 1054216 - RNA, 22 nt, Human
aggccaaauugaucaucuuuag

SEQ ID NO: 1054217 - RNA, 19 nt, Human
aaagcagaggagcaucuga

SEQ ID NO: 1054218 - RNA, 17 nt, Human
caguuggagacaagucc

SEQ ID NO: 1054219 - RNA, 22 nt, Human
cagaagaggacuggguagcuca

SEQ ID NO: 1054220 - RNA, 22 nt, Human
acuggccaggcagcaguagcuu

SEQ ID NO: 1054221 - RNA, 22 nt, Human
gcugccuccacuggcucccagu

SEQ ID NO: 1054222 - RNA, 22 nt, Human
uaagauuauacuuaaagagaaa

SEQ ID NO: 1054223 - RNA, 21 nt, Human
agggagcuuuagguagaaguu

SEQ ID NO: 1054224 - RNA, 22 nt, Human
uuccuuaggcuguuugcagugc

SEQ ID NO: 1054225 - RNA, 22 nt, Human
uuaucacuuaugagcuuuuugc

SEQ ID NO: 1054226 - RNA, 22 nt, Human
cagcaagacuucagggcuuggu

SEQ ID NO: 1054227 - RNA, 22 nt, Human
ugaggcagugauguuuaagcac

SEQ ID NO: 1054228 - RNA, 22 nt, Human
ucccagggcucuagagugcugg

SEQ ID NO: 1054229 - RNA, 22 nt, Human
aaaugccucuggguuauucuag

SEQ ID NO: 1054230 - RNA, 22 nt, Human
cugagcugggacucaguagcaa

SEQ ID NO: 1054231 - RNA, 22 nt, Human
cugcugugucagaguccagggg

SEQ ID NO: 1054232 - RNA, 17 nt, Human
uuugaaaggaugucagu

SEQ ID NO: 1054233 - RNA, 22 nt, Human
ggcagucuuaucagcauuggac

SEQ ID NO: 1054234 - RNA, 22 nt, Human
aggcaguggaugucaggaaugg

SEQ ID NO: 1054235 - RNA, 22 nt, Human
uaggaaauauuugaacauagga

SEQ ID NO: 1054236 - RNA, 19 nt, Human
uuugaaagaguuuuauugg

SEQ ID NO: 1054237 - RNA, 22 nt, Human
uggagaggaaagugcaguuuug

SEQ ID NO: 1054238 - RNA, 22 nt, Human
ccucacugcuauguguuugcuc

SEQ ID NO: 1054239 - RNA, 22 nt, Human
ccugaggucaugguccaguguu

SEQ ID NO: 1054240 - RNA, 22 nt, Human
agaggggagagcuaagcaauuc

SEQ ID NO: 1054241 - RNA, 22 nt, Human
gcaaguuauuuccauuuaaagc

SEQ ID NO: 1054242 - RNA, 22 nt, Human
uugacacagaucaauauucaac

SEQ ID NO: 1054243 - RNA, 22 nt, Human
gggcaguuuauucuagaugguu

SEQ ID NO: 1054244 - RNA, 23 nt, Human
ggagaggggugugggcaucuuua

SEQ ID NO: 1054245 - RNA, 22 nt, Human
cuguggaaggccuguccugaaa

SEQ ID NO: 1054246 - RNA, 19 nt, Human
gugcuuuuuaagagcucag

SEQ ID NO: 1054247 - RNA, 22 nt, Human
uauuagguaaaggacuugcagg

SEQ ID NO: 1054248 - RNA, 22 nt, Human
uggcuguguuaccacuucaugu

SEQ ID NO: 1054249 - RNA, 22 nt, Human
cccaugagaccugguuuaaggc

SEQ ID NO: 1054250 - RNA, 22 nt, Human
aacugcuguggccuaguacuua

SEQ ID NO: 1054251 - RNA, 22 nt, Human
cugcuguguuucacaccucugg

SEQ ID NO: 1054252 - RNA, 22 nt, Human
aguggacucuucccagugcuug

SEQ ID NO: 1054253 - RNA, 22 nt, Human
cacagaacauccuuagcucaug

SEQ ID NO: 1054254 - RNA, 22 nt, Human
cuaaauuauuugcacauuagag

SEQ ID NO: 1054255 - RNA, 22 nt, Human
uggcaucucaaacaggcagauu

SEQ ID NO: 1054256 - RNA, 22 nt, Human
aggcuccagcccaaggcugcag

SEQ ID NO: 1054257 - RNA, 22 nt, Human
acauccugaagucagucauuug

SEQ ID NO: 1054258 - RNA, 22 nt, Human
uucaggaugcucagaguagucu

SEQ ID NO: 1054259 - RNA, 22 nt, Human
gccaggaggcugcuguguaggc

SEQ ID NO: 1054260 - RNA, 22 nt, Human
uuggcuucuugugaaaucugag

SEQ ID NO: 1054261 - RNA, 20 nt, Human
gcccaggaucucugaggcau

SEQ ID NO: 1054262 - RNA, 22 nt, Human
uaguccagccuuggguguagcc

SEQ ID NO: 1054263 - RNA, 22 nt, Human
uauaucauggagauuaacauuc

SEQ ID NO: 1054264 - RNA, 22 nt, Human
cagugcuguugggcccagagag

SEQ ID NO: 1054265 - RNA, 22 nt, Human
aagugagugguaaggagcaugg

SEQ ID NO: 1054266 - RNA, 22 nt, Human
uguucauuuggcccuuuuguau

SEQ ID NO: 1054267 - RNA, 22 nt, Human
ccagaccacccuggccaugcac

SEQ ID NO: 1054268 - RNA, 22 nt, Human
ucuacugugguccuuguaacca

SEQ ID NO: 1054269 - RNA, 18 nt, Human
uuaaggauaagcagacua

SEQ ID NO: 1054270 - RNA, 22 nt, Human
accaggaguuuugaccaggggc

SEQ ID NO: 1054271 - RNA, 22 nt, Human
ucuucagauaaagggagaguau

SEQ ID NO: 1054272 - RNA, 22 nt, Human
cccaggagaccugugaaaggac

SEQ ID NO: 1054273 - RNA, 22 nt, Human
cccaggagguggagguugcggu

SEQ ID NO: 1054274 - RNA, 22 nt, Human
cuaagccacucaaaucuugugg

SEQ ID NO: 1054275 - RNA, 22 nt, Human
gauagucaccucccuuaacuuu

SEQ ID NO: 1054276 - RNA, 22 nt, Human
uuaacauacaucaugaacaaug

SEQ ID NO: 1054277 - RNA, 22 nt, Human
uaucuauaaguacuaacauggu

SEQ ID NO: 1054278 - RNA, 22 nt, Human
gacaguaacugagagauguaau

SEQ ID NO: 1054279 - RNA, 22 nt, Human
gaggcagcugaaggagugacag

SEQ ID NO: 1054280 - RNA, 22 nt, Human
cacauauuguaguucaccagga

SEQ ID NO: 1054281 - RNA, 22 nt, Human
aaauacagaguugcuuaaaagc

SEQ ID NO: 1054282 - RNA, 22 nt, Human
cccaggaggcagagcuugcagu

SEQ ID NO: 1054283 - RNA, 22 nt, Human
ugcaggcugccuucacagagcc

SEQ ID NO: 1054284 - RNA, 22 nt, Human
cccccagucugaacagcagcug

SEQ ID NO: 1054285 - RNA, 21 nt, Human
gcaggcuggucaaaccucagu

SEQ ID NO: 1054286 - RNA, 22 nt, Human
ccuggauucaagucuuucuuuc

SEQ ID NO: 1054287 - RNA, 22 nt, Human
auuuaguuuaggaaaaguaggu

SEQ ID NO: 1054288 - RNA, 19 nt, Human
ucccaggaagcaaauguca

SEQ ID NO: 1054289 - RNA, 22 nt, Human
cccaggaggcgcagguugcggu

SEQ ID NO: 1054290 - RNA, 22 nt, Human
ccccggaggcggagguugcagu

SEQ ID NO: 1054291 - RNA, 22 nt, Human
uuaggaguccagaugucuuggg

SEQ ID NO: 1054292 - RNA, 22 nt, Human
aauaugcauuaacuguguacau

SEQ ID NO: 1054293 - RNA, 22 nt, Human
aggcugagucgggaggaucacu

SEQ ID NO: 1054294 - RNA, 22 nt, Human
uuaaauuccagccucauaauag

SEQ ID NO: 1054295 - RNA, 22 nt, Human
ucuuuauuucugaaucccccau

SEQ ID NO: 1054296 - RNA, 22 nt, Human
uucuucaaacaaaaguggcaug

SEQ ID NO: 1054297 - RNA, 22 nt, Human
gaggcuccucauucaguaugcu

SEQ ID NO: 1054298 - RNA, 22 nt, Human
aaagauuugaguucugcuuaua

SEQ ID NO: 1054299 - RNA, 22 nt, Human
uuucuauucuggaucuguggca

SEQ ID NO: 1054300 - RNA, 22 nt, Human
gaggcagcuuaggguacugacu

SEQ ID NO: 1054301 - RNA, 22 nt, Human
gaccaggaaagagugugacuaa

SEQ ID NO: 1054302 - RNA, 22 nt, Human
auuuggcaacauuaauugaauc

SEQ ID NO: 1054303 - RNA, 22 nt, Human
aacaugaaaaccuccacagcaa

SEQ ID NO: 1054304 - RNA, 22 nt, Human
gaggcugcccaacuggagugga

SEQ ID NO: 1054305 - RNA, 22 nt, Human
aguuaucaucccuuacacuuug

SEQ ID NO: 1054306 - RNA, 17 nt, Human
ucaggcugugccuggua

SEQ ID NO: 1054307 - RNA, 21 nt, Human
ucucugugucuuuaagcugga

SEQ ID NO: 1054308 - RNA, 22 nt, Human
guugaaagaugucuugguuccc

SEQ ID NO: 1054309 - RNA, 22 nt, Human
gcuccugggcucuaccuugcua

SEQ ID NO: 1054310 - RNA, 22 nt, Human
acaacauucuuaaauacacuga

SEQ ID NO: 1054311 - RNA, 22 nt, Human
uccaggagucuagccucaggcc

SEQ ID NO: 1054312 - RNA, 22 nt, Human
cugagccagcgggcucacuuuu

SEQ ID NO: 1054313 - RNA, 22 nt, Human
cugcccaggcugaaggaacauc

SEQ ID NO: 1054314 - RNA, 20 nt, Human
agaggaggauuauuuuauuc

SEQ ID NO: 1054315 - RNA, 22 nt, Human
aguugcugcuucucucuagaga

SEQ ID NO: 1054316 - RNA, 22 nt, Human
ucuucacaugaccuucaugucu

SEQ ID NO: 1054317 - RNA, 18 nt, Human
cugaggccaacuacacug

SEQ ID NO: 1054318 - RNA, 22 nt, Human
cuggccuaaaauugcuucugca

SEQ ID NO: 1054319 - RNA, 22 nt, Human
aaccauuugccauuaucuuaag

SEQ ID NO: 1054320 - RNA, 21 nt, Human
ucuuggccuaaguucacugaa

SEQ ID NO: 1054321 - RNA, 22 nt, Human
gcuggccaggugcuuugguucu

SEQ ID NO: 1054322 - RNA, 22 nt, Human
cugaggucaggaguucaagcug

SEQ ID NO: 1054323 - RNA, 22 nt, Human
gcuggagcugaguucccugggc

SEQ ID NO: 1054324 - RNA, 22 nt, Human
uagggauguccugagacuuggc

SEQ ID NO: 1054325 - RNA, 22 nt, Human
cacagcaauagcuaacugauac

SEQ ID NO: 1054326 - RNA, 22 nt, Human
gccaggggacgcggagcgacga

SEQ ID NO: 1054327 - RNA, 22 nt, Human
agaaaguuguuuuagccaaacc

SEQ ID NO: 1054328 - RNA, 20 nt, Human
uaagaugagcuauaagaagu

SEQ ID NO: 1054329 - RNA, 22 nt, Human
uggcagcucauuuggaaaugga

SEQ ID NO: 1054330 - RNA, 22 nt, Human
gggcugagacgauggggucuuc

SEQ ID NO: 1054331 - RNA, 22 nt, Human
ccuggcugcugucacugaccau

SEQ ID NO: 1054332 - RNA, 22 nt, Human
uccaggaggacugagggggcug

SEQ ID NO: 1054333 - RNA, 21 nt, Human
uccuggccagggcacuaggca

SEQ ID NO: 1054334 - RNA, 22 nt, Human
aggaagcugcuggaguagugug

SEQ ID NO: 1054335 - RNA, 22 nt, Human
uuuuuggguccaggcuguaucu

SEQ ID NO: 1054336 - RNA, 22 nt, Human
uaaaugaagcucaugggccaca

SEQ ID NO: 1054337 - RNA, 22 nt, Human
accuuauuuugaaauagauugu

SEQ ID NO: 1054338 - RNA, 22 nt, Human
ggcugcuggcauugagguaggu

SEQ ID NO: 1054339 - RNA, 22 nt, Human
guaacuuaccauuguagcauca

SEQ ID NO: 1054340 - RNA, 22 nt, Human
cauucauuagaauagauaugua

SEQ ID NO: 1054341 - RNA, 22 nt, Human
gcagaggggaagcugaggaauu

SEQ ID NO: 1054342 - RNA, 22 nt, Human
accaggaguugggggugggacc

SEQ ID NO: 1054343 - RNA, 22 nt, Human
gaggccaaucaauagggcaaua

SEQ ID NO: 1054344 - RNA, 22 nt, Human
uagggcuguuuaaaagugaggu

SEQ ID NO: 1054345 - RNA, 20 nt, Human
uuugucuguuaaguguuucu

SEQ ID NO: 1054346 - RNA, 22 nt, Human
uaaguucauaagcuuauucuua

SEQ ID NO: 1054347 - RNA, 22 nt, Human
agaguucugcucuucucaguga

SEQ ID NO: 1054348 - RNA, 22 nt, Human
aaggagaguacaggaguuggua

SEQ ID NO: 1054349 - RNA, 23 nt, Human
aacuccugaaucgugagccaucu

SEQ ID NO: 1054350 - RNA, 22 nt, Human
gggcagcuggauaguuuuaaau

SEQ ID NO: 1054351 - RNA, 22 nt, Human
ucaggaauccagacagggcaca

SEQ ID NO: 1054352 - RNA, 22 nt, Human
uggcucaguuucaguccugguu

SEQ ID NO: 1054353 - RNA, 18 nt, Human
uggcagcaggaagccauu

SEQ ID NO: 1054354 - RNA, 22 nt, Human
gcugccucccccauggcuggaa

SEQ ID NO: 1054355 - RNA, 22 nt, Human
gcccagggcugcaaguggacgc

SEQ ID NO: 1054356 - RNA, 22 nt, Human
agagccagcauuugacacuggc

SEQ ID NO: 1054357 - RNA, 20 nt, Human
gcccaggaauuugcauuucu

SEQ ID NO: 1054358 - RNA, 22 nt, Human
cggcagcugauugcagagcacc

SEQ ID NO: 1054359 - RNA, 22 nt, Human
gcaggcugugaggcucagaugg

SEQ ID NO: 1054360 - RNA, 22 nt, Human
aggccagcgcugcuagcucccg

SEQ ID NO: 1054361 - RNA, 22 nt, Human
uucuucuuuccuauaauuaauu

SEQ ID NO: 1054362 - RNA, 22 nt, Human
agaggccaggcugcagagggau

SEQ ID NO: 1054363 - RNA, 22 nt, Human
uaaccauauuuuccauuaaguu

SEQ ID NO: 1054364 - RNA, 22 nt, Human
uggaguuccuuugaaaggcucu

SEQ ID NO: 1054365 - RNA, 22 nt, Human
acuccuggguucuaaauuugaa

SEQ ID NO: 1054366 - RNA, 22 nt, Human
agcugaggccacgagugaaggg

SEQ ID NO: 1054367 - RNA, 22 nt, Human
auguuuccgugagcauccuuga

SEQ ID NO: 1054368 - RNA, 22 nt, Human
auuauauaggacuugcccuucc

SEQ ID NO: 1054369 - RNA, 22 nt, Human
aggacagcagugcuggcacuug

SEQ ID NO: 1054370 - RNA, 22 nt, Human
gcuggcugguccagcaggggcu

SEQ ID NO: 1054371 - RNA, 22 nt, Human
cacagcauaaugaaauauacuu

SEQ ID NO: 1054372 - RNA, 22 nt, Human
cuucucagcaugguuacuguga

SEQ ID NO: 1054373 - RNA, 22 nt, Human
uagcagaguaauacuuuggagc

SEQ ID NO: 1054374 - RNA, 19 nt, Human
cuggccaggccaggggccc

SEQ ID NO: 1054375 - RNA, 22 nt, Human
agaaggggagaagcuaccagga

SEQ ID NO: 1054376 - RNA, 22 nt, Human
agacucaagcagauaggaauua

SEQ ID NO: 1054377 - RNA, 22 nt, Human
ugcugaggaauuugguuuaugu

SEQ ID NO: 1054378 - RNA, 22 nt, Human
uuaauaggcuucuaacauagcu

SEQ ID NO: 1054379 - RNA, 23 nt, Human
ggccacaaauagucuccccuggc

SEQ ID NO: 1054380 - RNA, 22 nt, Human
ugagccaaacuucuccuugguc

SEQ ID NO: 1054381 - RNA, 22 nt, Human
gggagggguugcauguuugagu

SEQ ID NO: 1054382 - RNA, 22 nt, Human
ucccaggaauccguccucuaga

SEQ ID NO: 1054383 - RNA, 22 nt, Human
ucugccucuuucaggccuggca

SEQ ID NO: 1054384 - RNA, 22 nt, Human
cuauuaggcuuccauuucaugc

SEQ ID NO: 1054385 - RNA, 22 nt, Human
acacagaguauuuagaaggggu

SEQ ID NO: 1054386 - RNA, 22 nt, Human
uucacagauguauuggaacucc

SEQ ID NO: 1054387 - RNA, 22 nt, Human
agagagcauugaggaaaucuuc

SEQ ID NO: 1054388 - RNA, 22 nt, Human
uucuucaauuuuccauauacug

SEQ ID NO: 1054389 - RNA, 22 nt, Human
caggguggcacaucacagcauu

SEQ ID NO: 1054390 - RNA, 20 nt, Human
aggcucagcugagcucuugg

SEQ ID NO: 1054391 - RNA, 22 nt, Human
gaaauauuacaguggaggggau

SEQ ID NO: 1054392 - RNA, 22 nt, Human
uuauuuauaucucugcaguuua

SEQ ID NO: 1054393 - RNA, 22 nt, Human
aguguuugagacacauuucacu

SEQ ID NO: 1054394 - RNA, 22 nt, Human
cagucucucagcuuucagcugu

SEQ ID NO: 1054395 - RNA, 22 nt, Human
aacauuucagcaaauaagaaca

SEQ ID NO: 1054396 - RNA, 22 nt, Human
aucaggaucugcaucauaagaa

SEQ ID NO: 1054397 - RNA, 22 nt, Human
ccagagcugaggagaugggcuu

SEQ ID NO: 1054398 - RNA, 22 nt, Human
uuuguaugugauaagacuauuc

SEQ ID NO: 1054399 - RNA, 22 nt, Human
uugaacugguaguuggaaaucu

SEQ ID NO: 1054400 - RNA, 22 nt, Human
ggcugcagauagccagccacca

SEQ ID NO: 1054401 - RNA, 21 nt, Human
gcccagugauuucuucacagu

SEQ ID NO: 1054402 - RNA, 20 nt, Human
ugaaggccauuuguuccaga

SEQ ID NO: 1054403 - RNA, 20 nt, Human
cugagccaacucucuucuug

SEQ ID NO: 1054404 - RNA, 22 nt, Human
gagugcaguaugagaggcugcu

SEQ ID NO: 1054405 - RNA, 22 nt, Human
ggagggaaugucuagcauucuu

SEQ ID NO: 1054406 - RNA, 19 nt, Human
acaaaugauguugcacuga

SEQ ID NO: 1054407 - RNA, 22 nt, Human
aggcagcccacaggacacagga

SEQ ID NO: 1054408 - RNA, 19 nt, Human
auacacuaauauaaaccac

SEQ ID NO: 1054409 - RNA, 22 nt, Human
ugcacauuaguguuugagaugc

SEQ ID NO: 1054410 - RNA, 23 nt, Human
cagugcugguucugccugugggg

SEQ ID NO: 1054411 - RNA, 22 nt, Human
ggcaagaaggcuucagguagcu

SEQ ID NO: 1054412 - RNA, 19 nt, Human
augauacaggugaaaauug

SEQ ID NO: 1054413 - RNA, 22 nt, Human
uccaggagagguguggggacug

SEQ ID NO: 1054414 - RNA, 22 nt, Human
ucaggaugguccuuuaugagaa

SEQ ID NO: 1054415 - RNA, 17 nt, Human
uggcagcugaaagcucu

SEQ ID NO: 1054416 - RNA, 22 nt, Human
gucaggaugagggaugaggagu

SEQ ID NO: 1054417 - RNA, 22 nt, Human
cugagggugcuauucuugccuu

SEQ ID NO: 1054418 - RNA, 22 nt, Human
cugugccaguguauuccuguga

SEQ ID NO: 1054419 - RNA, 22 nt, Human
acuggcaggcugcuggccggcg

SEQ ID NO: 1054420 - RNA, 22 nt, Human
aggcagaugggagcuggaaguu

SEQ ID NO: 1054421 - RNA, 22 nt, Human
uucuuuuacauuaagauuucag

SEQ ID NO: 1054422 - RNA, 22 nt, Human
guuugcauauuugcacaggaau

SEQ ID NO: 1054423 - RNA, 22 nt, Human
guaaauaacugguaauuggggu

SEQ ID NO: 1054424 - RNA, 22 nt, Human
auugcuaggaacagguugcacc

SEQ ID NO: 1054425 - RNA, 22 nt, Human
auacacuugaccuggagugaag

SEQ ID NO: 1054426 - RNA, 21 nt, Human
aaaggccauaaucacggagca

SEQ ID NO: 1054427 - RNA, 22 nt, Human
ucucaggagccacagcgggagu

SEQ ID NO: 1054428 - RNA, 22 nt, Human
aagauggagcacgagcagaagc

SEQ ID NO: 1054429 - RNA, 22 nt, Human
ccccaggaagccucagauuugc

SEQ ID NO: 1054430 - RNA, 22 nt, Human
accaggagacaugaccaaugag

SEQ ID NO: 1054431 - RNA, 22 nt, Human
uacaaaaaauugauacugacga

SEQ ID NO: 1054432 - RNA, 22 nt, Human
cagcaagagaggcagggcaaau

SEQ ID NO: 1054433 - RNA, 22 nt, Human
gggcugagugaccucaggccaa

SEQ ID NO: 1054434 - RNA, 22 nt, Human
accaggaguagaauaucuguga

SEQ ID NO: 1054435 - RNA, 22 nt, Human
uucuuuggugggagauugaggu

SEQ ID NO: 1054436 - RNA, 22 nt, Human
uacuccugcugauccugccagc

SEQ ID NO: 1054437 - RNA, 23 nt, Human
uggagcugacagucagagggagg

SEQ ID NO: 1054438 - RNA, 22 nt, Human
uucaggaucacuaaacccucca

SEQ ID NO: 1054439 - RNA, 22 nt, Human
uuucaaaauuuugcagugguaa

SEQ ID NO: 1054440 - RNA, 22 nt, Human
cagaccucaguccucaguagga

SEQ ID NO: 1054441 - RNA, 22 nt, Human
gucuuugcugucuuugcucuca

SEQ ID NO: 1054442 - RNA, 22 nt, Human
ugaggggaacugaugcccauug

SEQ ID NO: 1054443 - RNA, 18 nt, Human
ucuuccaacacugacacc

SEQ ID NO: 1054444 - RNA, 22 nt, Human
acuccugggugcugaccagcgu

SEQ ID NO: 1054445 - RNA, 22 nt, Human
acuuucugucaucuagacaagu

SEQ ID NO: 1054446 - RNA, 22 nt, Human
guuuuauuggaacacagccaug

SEQ ID NO: 1054447 - RNA, 19 nt, Human
uagaagcacuaggcaaacu

SEQ ID NO: 1054448 - RNA, 22 nt, Human
ugaaucugauuucccuggaggc

SEQ ID NO: 1054449 - RNA, 23 nt, Human
agaggcaggaguggcuugcccgg

SEQ ID NO: 1054450 - RNA, 22 nt, Human
gcaucuaauccaguccagcauc

SEQ ID NO: 1054451 - RNA, 22 nt, Human
cccucccugaagaaguuacucu

SEQ ID NO: 1054452 - RNA, 22 nt, Human
cagaggcagccgggggagaacg

SEQ ID NO: 1054453 - RNA, 22 nt, Human
aaauacuggcaagugcuaauuc

SEQ ID NO: 1054454 - RNA, 22 nt, Human
uugacaauguccuuugaauuuc

SEQ ID NO: 1054455 - RNA, 22 nt, Human
acacaaaaucaaaguccuaggc

SEQ ID NO: 1054456 - RNA, 22 nt, Human
ugcugagguuucugacuaugga

SEQ ID NO: 1054457 - RNA, 22 nt, Human
ccaggagagcaaaggucacucu

SEQ ID NO: 1054458 - RNA, 22 nt, Human
aucugcagaggacaggcgagga

SEQ ID NO: 1054459 - RNA, 22 nt, Human
aaaaauacuucacuucugggug

SEQ ID NO: 1054460 - RNA, 22 nt, Human
gcugaggcugggagcagccugu

SEQ ID NO: 1054461 - RNA, 22 nt, Human
uuauucuuuaaacauauauguu

SEQ ID NO: 1054462 - RNA, 22 nt, Human
ucacagacacagggagaagcau

SEQ ID NO: 1054463 - RNA, 22 nt, Human
cagcaggauuugaaaggaagag

SEQ ID NO: 1054464 - RNA, 22 nt, Human
cagucucagaggugggaguggg

SEQ ID NO: 1054465 - RNA, 22 nt, Human
ugaaagcagcaccaauaccauu

SEQ ID NO: 1054466 - RNA, 22 nt, Human
gccugaccucuucugcccuggg

SEQ ID NO: 1054467 - RNA, 22 nt, Human
aaagacuuggcuuaugauuugc

SEQ ID NO: 1054468 - RNA, 22 nt, Human
gggcacagaagucuaagacauc

SEQ ID NO: 1054469 - RNA, 18 nt, Human
aggauauuaagaguacag

SEQ ID NO: 1054470 - RNA, 22 nt, Human
uuauuuacaacucuucucuucc

SEQ ID NO: 1054471 - RNA, 22 nt, Human
aggcugaggcggguagaucacc

SEQ ID NO: 1054472 - RNA, 20 nt, Human
gcugaggauuccuggccccu

SEQ ID NO: 1054473 - RNA, 22 nt, Human
uaguuaaaauaauggagauguu

SEQ ID NO: 1054474 - RNA, 22 nt, Human
ggccacagcaaugcugugaugu

SEQ ID NO: 1054475 - RNA, 22 nt, Human
aaggcugaguaaaacagagaac

SEQ ID NO: 1054476 - RNA, 22 nt, Human
ucugcagggaugugagggguga

SEQ ID NO: 1054477 - RNA, 22 nt, Human
uuuauuagugcuuguaucacug

SEQ ID NO: 1054478 - RNA, 22 nt, Human
agggacccauagagagaccagu

SEQ ID NO: 1054479 - RNA, 22 nt, Human
uguaaucauuacaguacaugga

SEQ ID NO: 1054480 - RNA, 22 nt, Human
ccucaggaaaugaauaaauggc

SEQ ID NO: 1054481 - RNA, 22 nt, Human
aagggcaggagaagacggauau

SEQ ID NO: 1054482 - RNA, 22 nt, Human
auuagagcaguguauuaugaua

SEQ ID NO: 1054483 - RNA, 22 nt, Human
uggcugaggcuuuucuuaaaga

SEQ ID NO: 1054484 - RNA, 22 nt, Human
cccuggaggcggagcuugcagu

SEQ ID NO: 1054485 - RNA, 18 nt, Human
auggucucauacugggag

SEQ ID NO: 1054486 - RNA, 22 nt, Human
agcagagguguuuauuauggga

SEQ ID NO: 1054487 - RNA, 22 nt, Human
gugcugagcaucaugaggcacu

SEQ ID NO: 1054488 - RNA, 22 nt, Human
aggcacagcacaccuggccccc

SEQ ID NO: 1054489 - RNA, 22 nt, Human
gcuucugaggaaggcucagccu

SEQ ID NO: 1054490 - RNA, 22 nt, Human
ggagaggggcaaguuuaucuag

SEQ ID NO: 1054491 - RNA, 22 nt, Human
ugcacuucauuguaaauuguac

SEQ ID NO: 1054492 - RNA, 22 nt, Human
augggaggaugcucgggugcuc

SEQ ID NO: 1054493 - RNA, 23 nt, Human
ugcuggcuguguuauugccaaca

SEQ ID NO: 1054494 - RNA, 22 nt, Human
gugcugaguagaaugaaugccu

SEQ ID NO: 1054495 - RNA, 22 nt, Human
caggcugaggcaguaggguuug

SEQ ID NO: 1054496 - RNA, 22 nt, Human
uguuugaauuuugcuaacgugu

SEQ ID NO: 1054497 - RNA, 22 nt, Human
cucaguuuuugcugucugguuc

SEQ ID NO: 1054498 - RNA, 22 nt, Human
aggcugaggugugcugugaucg

SEQ ID NO: 1054499 - RNA, 22 nt, Human
gacugaggugaccuaggacuac

SEQ ID NO: 1054500 - RNA, 22 nt, Human
gggcugagggguaucucauggg

SEQ ID NO: 1054501 - RNA, 22 nt, Human
uuuguaaauagcaguacucaug

SEQ ID NO: 1054502 - RNA, 22 nt, Human
aaccauuugcaguuacugagac

SEQ ID NO: 1054503 - RNA, 20 nt, Human
ugacuucugggauuuguggu

SEQ ID NO: 1054504 - RNA, 22 nt, Human
auucuucaguauguguggauug

SEQ ID NO: 1054505 - RNA, 22 nt, Human
ugcugcucgccacggcccaggg

SEQ ID NO: 1054506 - RNA, 22 nt, Human
aaauuaacuaucacuuuuguga

SEQ ID NO: 1054507 - RNA, 18 nt, Human
cugaauuaucucaucauu

SEQ ID NO: 1054508 - RNA, 22 nt, Human
uaauuauacaaaaaggcaugca

SEQ ID NO: 1054509 - RNA, 22 nt, Human
cagccuuuaagcuuggauaggu

SEQ ID NO: 1054510 - RNA, 21 nt, Human
uuuuauugaugaauggccacu

SEQ ID NO: 1054511 - RNA, 22 nt, Human
ugacauaauaauccaaacauac

SEQ ID NO: 1054512 - RNA, 22 nt, Human
ccaggcugugguuuagauagag

SEQ ID NO: 1054513 - RNA, 18 nt, Human
agucuucugauccauuuu

SEQ ID NO: 1054514 - RNA, 22 nt, Human
agccuaaugcuuuucccaaagu

SEQ ID NO: 1054515 - RNA, 22 nt, Human
uuagagucaaaauggcauguua

SEQ ID NO: 1054516 - RNA, 22 nt, Human
ccagagcuccagggcuacagaa

SEQ ID NO: 1054517 - RNA, 22 nt, Human
agaugcugccaggccccucagu

SEQ ID NO: 1054518 - RNA, 22 nt, Human
auaaucuuguauuuccuaaagu

SEQ ID NO: 1054519 - RNA, 22 nt, Human
ucaggagaaaauaucaggaagu

SEQ ID NO: 1054520 - RNA, 22 nt, Human
gagguagcaugcuggaagggac

SEQ ID NO: 1054521 - RNA, 18 nt, Human
uuccaugauuccuuucac

SEQ ID NO: 1054522 - RNA, 22 nt, Human
gcucccagcaauugaggcagcc

SEQ ID NO: 1054523 - RNA, 22 nt, Human
auacuuucugaccaauuaauug

SEQ ID NO: 1054524 - RNA, 22 nt, Human
auuucagguaccugugggaucc

SEQ ID NO: 1054525 - RNA, 19 nt, Human
ucccucccuguaaucucac

SEQ ID NO: 1054526 - RNA, 22 nt, Human
guuuuauaauugcuucauaaga

SEQ ID NO: 1054527 - RNA, 22 nt, Human
aagaaguuaaauaaauggacca

SEQ ID NO: 1054528 - RNA, 22 nt, Human
uagcacauacauaauagauaga

SEQ ID NO: 1054529 - RNA, 22 nt, Human
gacuucuauuaauaccucuacu

SEQ ID NO: 1054530 - RNA, 22 nt, Human
agacaggagagggaacugccgg

SEQ ID NO: 1054531 - RNA, 22 nt, Human
ucagagagccucaggcacugcc

SEQ ID NO: 1054532 - RNA, 23 nt, Human
uuaaguggucaguuuuagacaac

SEQ ID NO: 1054533 - RNA, 22 nt, Human
uuaggaaagcauuguguaaaag

SEQ ID NO: 1054534 - RNA, 22 nt, Human
gaaauacuguaaaguuauuauu

SEQ ID NO: 1054535 - RNA, 22 nt, Human
aagggcugagcacagugagcca

SEQ ID NO: 1054536 - RNA, 23 nt, Human
uggcagcuguguaagagaaagca

SEQ ID NO: 1054537 - RNA, 22 nt, Human
cuggugagacucagggaugcuu

SEQ ID NO: 1054538 - RNA, 22 nt, Human
auuauggacguuaauuuuggaa

SEQ ID NO: 1054539 - RNA, 22 nt, Human
gaaauauucuugucuuguuuuc

SEQ ID NO: 1054540 - RNA, 22 nt, Human
caaggccaaagggccacuguca

SEQ ID NO: 1054541 - RNA, 22 nt, Human
cagcuguggcugccacugcucc

SEQ ID NO: 1054542 - RNA, 22 nt, Human
auuuccagugcacugaauagaa

SEQ ID NO: 1054543 - RNA, 22 nt, Human
ugacagguucguuagucauguu

SEQ ID NO: 1054544 - RNA, 22 nt, Human
acauguaaaaauuaagguaaga

SEQ ID NO: 1054545 - RNA, 22 nt, Human
uagagcaguggguaccauggca

SEQ ID NO: 1054546 - RNA, 22 nt, Human
accuuauuaaaaugaugaugua

SEQ ID NO: 1054547 - RNA, 22 nt, Human
ucuggcaggcaaucggcucugg

SEQ ID NO: 1054548 - RNA, 22 nt, Human
uuaacaauagaguuucuucagg

SEQ ID NO: 1054549 - RNA, 22 nt, Human
cagaaguuggagcuuuccauca

SEQ ID NO: 1054550 - RNA, 22 nt, Human
aacacuuuuuauauauuguauc

SEQ ID NO: 1054551 - RNA, 22 nt, Human
aggcagccaucugcaggaagga

SEQ ID NO: 1054552 - RNA, 22 nt, Human
cccuccccacaaagcuucacac

SEQ ID NO: 1054553 - RNA, 22 nt, Human
uuuaaauuuagaagaaacacug

SEQ ID NO: 1054554 - RNA, 22 nt, Human
gugcauuugacgaauacucacu

SEQ ID NO: 1054555 - RNA, 22 nt, Human
agcugaggcauggacaggcugc

SEQ ID NO: 1054556 - RNA, 22 nt, Human
acaaauaugguacucggagaaa

SEQ ID NO: 1054557 - RNA, 22 nt, Human
cugcuguccaggagugcccugu

SEQ ID NO: 1054558 - RNA, 22 nt, Human
uccugugccuccaccugcuccg

SEQ ID NO: 1054559 - RNA, 22 nt, Human
ugaggccucugaggccuaggcu

SEQ ID NO: 1054560 - RNA, 22 nt, Human
cugcaucaguggauaugauggu

SEQ ID NO: 1054561 - RNA, 22 nt, Human
agggagcucaguuggaagcggu

SEQ ID NO: 1054562 - RNA, 19 nt, Human
agucuggaguaaaaggaau

SEQ ID NO: 1054563 - RNA, 22 nt, Human
ucaggcugauuucuuuugaggg

SEQ ID NO: 1054564 - RNA, 22 nt, Human
ugcccacauggugccauggcca

SEQ ID NO: 1054565 - RNA, 22 nt, Human
gcagagcuccccaagacaccaa

SEQ ID NO: 1054566 - RNA, 20 nt, Human
acuccugguaacuuuuguga

SEQ ID NO: 1054567 - RNA, 22 nt, Human
uuaacauuguccuuagcagauu

SEQ ID NO: 1054568 - RNA, 22 nt, Human
aucccaugagaccacguuggcu

SEQ ID NO: 1054569 - RNA, 22 nt, Human
gcugagggaggcugaacugagu

SEQ ID NO: 1054570 - RNA, 22 nt, Human
aaggcagcuuuaaaaaagaugc

SEQ ID NO: 1054571 - RNA, 22 nt, Human
uggaguucucaggugagggcuu

SEQ ID NO: 1054572 - RNA, 23 nt, Human
aaggccagaauuucaauggugcc

SEQ ID NO: 1054573 - RNA, 18 nt, Human
augggaggggccaagaga

SEQ ID NO: 1054574 - RNA, 22 nt, Human
acuggcagcagcagcccuuggg

SEQ ID NO: 1054575 - RNA, 22 nt, Human
cccaggagagggaaccaaaugu

SEQ ID NO: 1054576 - RNA, 22 nt, Human
uucucagagcucacuguaguaa

SEQ ID NO: 1054577 - RNA, 22 nt, Human
caagauggaguccgggaaugug

SEQ ID NO: 1054578 - RNA, 22 nt, Human
ucacagaaaucuguuuuuucua

SEQ ID NO: 1054579 - RNA, 22 nt, Human
gaaacugugaggaucuuaacuu

SEQ ID NO: 1054580 - RNA, 22 nt, Human
cugcuuugauuagaagaguaca

SEQ ID NO: 1054581 - RNA, 22 nt, Human
gcaucuaaacuugcaucauugu

SEQ ID NO: 1054582 - RNA, 22 nt, Human
uuacuuugcuuucucauuacag

SEQ ID NO: 1054583 - RNA, 22 nt, Human
gcaggcugaugacuggaguugg

SEQ ID NO: 1054584 - RNA, 22 nt, Human
cugagguaugugggacuagccu

SEQ ID NO: 1054585 - RNA, 22 nt, Human
ugaguuuugucuugcuagaagu

SEQ ID NO: 1054586 - RNA, 22 nt, Human
guuuucaaggggauuuaacuga

SEQ ID NO: 1054587 - RNA, 22 nt, Human
auuuauuaccucggaguuucug

SEQ ID NO: 1054588 - RNA, 22 nt, Human
ggaggugggauuaggaccuaaa

SEQ ID NO: 1054589 - RNA, 22 nt, Human
cuugaaagauuuggccucugug

SEQ ID NO: 1054590 - RNA, 23 nt, Human
uggcaaggaaugggauggagacu

SEQ ID NO: 1054591 - RNA, 22 nt, Human
uagcaagaagggagaugggguu

SEQ ID NO: 1054592 - RNA, 22 nt, Human
agaggauguucuaggcacucau

SEQ ID NO: 1054593 - RNA, 22 nt, Human
ugccacagagcaauucugcuga

SEQ ID NO: 1054594 - RNA, 22 nt, Human
uugaauaggacucagcagugau

SEQ ID NO: 1054595 - RNA, 22 nt, Human
cccaggaauuggaggcugcagu

SEQ ID NO: 1054596 - RNA, 22 nt, Human
uugcacuaggaaaaggcagcca

SEQ ID NO: 1054597 - RNA, 22 nt, Human
ucuggccaacccucaaguugua

SEQ ID NO: 1054598 - RNA, 22 nt, Human
gcugguuuccuuaucuauaaag

SEQ ID NO: 1054599 - RNA, 22 nt, Human
aacuucugggcuguccaaaacu

SEQ ID NO: 1054600 - RNA, 22 nt, Human
caggcagcucaaccuugggagc

SEQ ID NO: 1054601 - RNA, 17 nt, Human
uuucaucugggaccacc

SEQ ID NO: 1054602 - RNA, 22 nt, Human
cccaggaaaugaacuucugauu

SEQ ID NO: 1054603 - RNA, 22 nt, Human
gcuucccacagcuggacugggg

SEQ ID NO: 1054604 - RNA, 21 nt, Human
aggcaucuaaagagaguagac

SEQ ID NO: 1054605 - RNA, 22 nt, Human
cagcagagaccaagugauuuga

SEQ ID NO: 1054606 - RNA, 22 nt, Human
agggcagcagcggcccaggccu

SEQ ID NO: 1054607 - RNA, 22 nt, Human
gggcagcucucacagcagccaa

SEQ ID NO: 1054608 - RNA, 22 nt, Human
ugucagagcaaugagguucagc

SEQ ID NO: 1054609 - RNA, 22 nt, Human
agcagagccugggcuaggggug

SEQ ID NO: 1054610 - RNA, 22 nt, Human
cuggccacugguggucauaggc

SEQ ID NO: 1054611 - RNA, 22 nt, Human
ucauuuguugcuguuaccugag

SEQ ID NO: 1054612 - RNA, 20 nt, Human
gcugagguuucuuccuauau

SEQ ID NO: 1054613 - RNA, 22 nt, Human
aggcugagauagguggaucauu

SEQ ID NO: 1054614 - RNA, 22 nt, Human
ccuccuggguucaagcgauucu

SEQ ID NO: 1054615 - RNA, 22 nt, Human
gcuccuggcuccaggcagccaa

SEQ ID NO: 1054616 - RNA, 22 nt, Human
cggcagcuccgcgccguaggac

SEQ ID NO: 1054617 - RNA, 22 nt, Human
ucagugugaggucuuccacccg

SEQ ID NO: 1054618 - RNA, 22 nt, Human
auggccaagcauauacagauug

SEQ ID NO: 1054619 - RNA, 22 nt, Human
ggccaaauuuggccaugagcau

SEQ ID NO: 1054620 - RNA, 22 nt, Human
ccuggccauagggcccaggaaa

SEQ ID NO: 1054621 - RNA, 22 nt, Human
cccaucacagacacuggguuau

SEQ ID NO: 1054622 - RNA, 22 nt, Human
cucaacagcucugccauacucc

SEQ ID NO: 1054623 - RNA, 19 nt, Human
uuugcagugguuccuuugu

SEQ ID NO: 1054624 - RNA, 22 nt, Human
gacuuuauuuccuuauuuguga

SEQ ID NO: 1054625 - RNA, 22 nt, Human
uaguuacagaagauaaggguau

SEQ ID NO: 1054626 - RNA, 22 nt, Human
auguuucagauacagaucaaau

SEQ ID NO: 1054627 - RNA, 22 nt, Human
ggguggagcuuggacaccagua

SEQ ID NO: 1054628 - RNA, 19 nt, Human
aaacuaaggggaaauguuu

SEQ ID NO: 1054629 - RNA, 22 nt, Human
ccagagagauugcuucuaaaga

SEQ ID NO: 1054630 - RNA, 22 nt, Human
ggcugagccaugggcacugcag

SEQ ID NO: 1054631 - RNA, 22 nt, Human
gaaggccauugcguccugggau

SEQ ID NO: 1054632 - RNA, 22 nt, Human
auguucuuucagccagugcauc

SEQ ID NO: 1054633 - RNA, 22 nt, Human
gaggagagccugcacuuugacc

SEQ ID NO: 1054634 - RNA, 22 nt, Human
acaucugacaugaucuucagua

SEQ ID NO: 1054635 - RNA, 20 nt, Human
acuaaucauccagucacagu

SEQ ID NO: 1054636 - RNA, 22 nt, Human
acagucuggaagcagggggcaa

SEQ ID NO: 1054637 - RNA, 22 nt, Human
caaguaaacaauaugugauuca

SEQ ID NO: 1054638 - RNA, 22 nt, Human
auuagguaagauaaagcagagg

SEQ ID NO: 1054639 - RNA, 22 nt, Human
uaacuacaagggcggucucugu

SEQ ID NO: 1054640 - RNA, 22 nt, Human
aaaggaagaugccaggacucug

SEQ ID NO: 1054641 - RNA, 22 nt, Human
uaaugucagcauaguuuauuuu

SEQ ID NO: 1054642 - RNA, 22 nt, Human
ucugugccaccucuccaguguc

SEQ ID NO: 1054643 - RNA, 22 nt, Human
cuccuggaagcccgcccugcug

SEQ ID NO: 1054644 - RNA, 20 nt, Human
uaguccaguaggggggcuuu

SEQ ID NO: 1054645 - RNA, 22 nt, Human
cuccuggcuucugaaaucgugg

SEQ ID NO: 1054646 - RNA, 22 nt, Human
uuucaaaguugggaauuguaau

SEQ ID NO: 1054647 - RNA, 22 nt, Human
cccagcugauuuuugcagagau

SEQ ID NO: 1054648 - RNA, 18 nt, Human
cugaggcuuagagagguu

SEQ ID NO: 1054649 - RNA, 22 nt, Human
uaggcuggaacuuaggcagagg

SEQ ID NO: 1054650 - RNA, 22 nt, Human
uauuucagucacuucuucucug

SEQ ID NO: 1054651 - RNA, 22 nt, Human
uugaggucccaaacccacugag

SEQ ID NO: 1054652 - RNA, 22 nt, Human
agggggugcccagaugaaggau

SEQ ID NO: 1054653 - RNA, 22 nt, Human
uaggagaggugaauggcacacu

SEQ ID NO: 1054654 - RNA, 22 nt, Human
gcuccucuucucccacugaaug

SEQ ID NO: 1054655 - RNA, 22 nt, Human
agcagcugauggggaaggaguu

SEQ ID NO: 1054656 - RNA, 21 nt, Human
acagacagggccagugucccc

SEQ ID NO: 1054657 - RNA, 23 nt, Human
ugccucaguggaaugugagggug

SEQ ID NO: 1054658 - RNA, 22 nt, Human
cccagcaguaaccaguggaaau

SEQ ID NO: 1054659 - RNA, 22 nt, Human
ccucagggaaugggaggcuggg

SEQ ID NO: 1054660 - RNA, 22 nt, Human
cccugccuacaggguuuucuuu

SEQ ID NO: 1054661 - RNA, 22 nt, Human
agcauacaguugaaaguggcuu

SEQ ID NO: 1054662 - RNA, 22 nt, Human
ucuuagaaauuccccaguggcu

SEQ ID NO: 1054663 - RNA, 22 nt, Human
aggcugagcuggcccuugaaau

SEQ ID NO: 1054664 - RNA, 20 nt, Human
caguccaaucagaggccacc

SEQ ID NO: 1054665 - RNA, 22 nt, Human
uagacagauuuaaaggaaugga

SEQ ID NO: 1054666 - RNA, 22 nt, Human
aaaggccaugguuggaguguuu

SEQ ID NO: 1054667 - RNA, 22 nt, Human
ucucuucuagcuucuugugguu

SEQ ID NO: 1054668 - RNA, 22 nt, Human
auuugcuugugcuaugaaaguu

SEQ ID NO: 1054669 - RNA, 22 nt, Human
cugcugugcacccaggaaggcu

SEQ ID NO: 1054670 - RNA, 22 nt, Human
guuuuucuaggaccaugugauu

SEQ ID NO: 1054671 - RNA, 22 nt, Human
cagcgucucguugugggccucg

SEQ ID NO: 1054672 - RNA, 23 nt, Human
gagugcagaauagacaugcagug

SEQ ID NO: 1054673 - RNA, 22 nt, Human
ucgagcucuggagccaaggaug

SEQ ID NO: 1054674 - RNA, 22 nt, Human
caaauacuuuuagccuauugag

SEQ ID NO: 1054675 - RNA, 22 nt, Human
gcucucuuuuuccagugguggu

SEQ ID NO: 1054676 - RNA, 22 nt, Human
auuguauaacagcauguauuuu

SEQ ID NO: 1054677 - RNA, 22 nt, Human
uucuuauucuugaaauguggga

SEQ ID NO: 1054678 - RNA, 22 nt, Human
cacacuuuuggcauguuugguu

SEQ ID NO: 1054679 - RNA, 22 nt, Human
gacuuucugcuauacuuucugu

SEQ ID NO: 1054680 - RNA, 22 nt, Human
aaaggccaagcaugagguggac

SEQ ID NO: 1054681 - RNA, 22 nt, Human
cuauuagguuggugcaaaagua

SEQ ID NO: 1054682 - RNA, 22 nt, Human
uugagaagaggcuuuguaggaa

SEQ ID NO: 1054683 - RNA, 22 nt, Human
auuuaaauuuucugauggagag

SEQ ID NO: 1054684 - RNA, 22 nt, Human
cucaggauguacuacagaaggc

SEQ ID NO: 1054685 - RNA, 22 nt, Human
ucuuggcugucuuugaaguuag

SEQ ID NO: 1054686 - RNA, 22 nt, Human
gagggagggacuagcauucucu

SEQ ID NO: 1054687 - RNA, 22 nt, Human
aggcagugcugugcccugaacc

SEQ ID NO: 1054688 - RNA, 22 nt, Human
cauggagauaaacugaaauauu

SEQ ID NO: 1054689 - RNA, 22 nt, Human
ucaggcugggcuccucucccca

SEQ ID NO: 1054690 - RNA, 22 nt, Human
uacaacauuguguugcuucaua

SEQ ID NO: 1054691 - RNA, 22 nt, Human
uccaccagagccuucccaugcu

SEQ ID NO: 1054692 - RNA, 22 nt, Human
caguugcuggaugugcagcucu

SEQ ID NO: 1054693 - RNA, 22 nt, Human
uuuaauuaggaaaugggcaggg

SEQ ID NO: 1054694 - RNA, 22 nt, Human
cagggcuggcucaugaaaaguu

SEQ ID NO: 1054695 - RNA, 22 nt, Human
uacauguauguguuaauaucug

SEQ ID NO: 1054696 - RNA, 22 nt, Human
uaagaugagguagguaagacuu

SEQ ID NO: 1054697 - RNA, 22 nt, Human
cuguuuaucuaggaguugcagg

SEQ ID NO: 1054698 - RNA, 22 nt, Human
caguggagagacuuuuacucuu

SEQ ID NO: 1054699 - RNA, 22 nt, Human
gagggcauaguuaaauaggagg

SEQ ID NO: 1054700 - RNA, 22 nt, Human
ucagcugcucaaauuuauguca

SEQ ID NO: 1054701 - RNA, 22 nt, Human
ucugugcucauucagucauuca

SEQ ID NO: 1054702 - RNA, 22 nt, Human
agcugaaagugcuuugaggacu

SEQ ID NO: 1054703 - RNA, 22 nt, Human
gacugguaagguauuggaauuc

SEQ ID NO: 1054704 - RNA, 22 nt, Human
aucacugucgucaucugagauu

SEQ ID NO: 1054705 - RNA, 22 nt, Human
uuccuggcauagagagggcaca

SEQ ID NO: 1054706 - RNA, 22 nt, Human
gcucccagacugaccagaggug

SEQ ID NO: 1054707 - RNA, 22 nt, Human
gaccauuucuaggaaucagacu

SEQ ID NO: 1054708 - RNA, 22 nt, Human
agaaaugacaagacugaucagg

SEQ ID NO: 1054709 - RNA, 22 nt, Human
acccaggacaaaauaaccaggu

SEQ ID NO: 1054710 - RNA, 17 nt, Human
uucugagccacuuccuu

SEQ ID NO: 1054711 - RNA, 22 nt, Human
ugauugaagaggugaggaaguu

SEQ ID NO: 1054712 - RNA, 22 nt, Human
cagaaguuugcaauuguuuauu

SEQ ID NO: 1054713 - RNA, 22 nt, Human
ucccaggauguuuauggcuggu

SEQ ID NO: 1054714 - RNA, 22 nt, Human
uaugaacucuggagucugagug

SEQ ID NO: 1054715 - RNA, 22 nt, Human
uaacugguuaagggugaaaucc

SEQ ID NO: 1054716 - RNA, 18 nt, Human
uggcagagugucuguucu

SEQ ID NO: 1054717 - RNA, 22 nt, Human
uuaguuuucccaucuuuauggu

SEQ ID NO: 1054718 - RNA, 22 nt, Human
auaaagauuucuuuuucucuac

SEQ ID NO: 1054719 - RNA, 22 nt, Human
ugcugcugcuucuguacagccu

SEQ ID NO: 1054720 - RNA, 22 nt, Human
uaaagugguggugcuaauguau

SEQ ID NO: 1054721 - RNA, 22 nt, Human
uuucccagagguaugaauaagu

SEQ ID NO: 1054722 - RNA, 22 nt, Human
uaaccuuuguucaauguaagau

SEQ ID NO: 1054723 - RNA, 22 nt, Human
uuauuacacugaaagaauugcg

SEQ ID NO: 1054724 - RNA, 22 nt, Human
cuuuauuagauguagacuuucu

SEQ ID NO: 1054725 - RNA, 22 nt, Human
cauggcugaaauucuucgcuug

SEQ ID NO: 1054726 - RNA, 20 nt, Human
uugauaggcagcuugucagg

SEQ ID NO: 1054727 - RNA, 22 nt, Human
uuugaaagcuacuuucggguca

SEQ ID NO: 1054728 - RNA, 22 nt, Human
ucaggagacaaagggugcggag

SEQ ID NO: 1054729 - RNA, 22 nt, Human
cugaggcuggcguuugaggaag

SEQ ID NO: 1054730 - RNA, 22 nt, Human
gcccucccuacagccuauuucu

SEQ ID NO: 1054731 - RNA, 22 nt, Human
cacugguguauuagagcuagaa

SEQ ID NO: 1054732 - RNA, 18 nt, Human
agcagcugugccacacug

SEQ ID NO: 1054733 - RNA, 22 nt, Human
agaaauucaauucuaauuagcu

SEQ ID NO: 1054734 - RNA, 22 nt, Human
ggcuagaguggaacuggagcgg

SEQ ID NO: 1054735 - RNA, 22 nt, Human
cuucuucaauagcaagcgcaua

SEQ ID NO: 1054736 - RNA, 22 nt, Human
ggcaggcugggugucauggagu

SEQ ID NO: 1054737 - RNA, 20 nt, Human
gggugggagagucugagggu

SEQ ID NO: 1054738 - RNA, 22 nt, Human
uauuucuaagagauaucuguac

SEQ ID NO: 1054739 - RNA, 22 nt, Human
gaucauuugcaggaaacauuaa

SEQ ID NO: 1054740 - RNA, 19 nt, Human
cacaauuaugagacacuua

SEQ ID NO: 1054741 - RNA, 21 nt, Human
aucacauuggcuguuauuauu

SEQ ID NO: 1054742 - RNA, 22 nt, Human
ugaaacagcuaucaguagacug

SEQ ID NO: 1054743 - RNA, 22 nt, Human
aggcaggcugcuauggaguaga

SEQ ID NO: 1054744 - RNA, 22 nt, Human
uuuucauuguuacuaugagcua

SEQ ID NO: 1054745 - RNA, 22 nt, Human
gccaggaggcuuaacuggacag

SEQ ID NO: 1054746 - RNA, 16 nt, Human
uucuagaaaagaaggu

SEQ ID NO: 1054747 - RNA, 23 nt, Human
uauacacauguggcaguauagug

SEQ ID NO: 1054748 - RNA, 22 nt, Human
uucugagguccaugcaguacug

SEQ ID NO: 1054749 - RNA, 22 nt, Human
cuuuugauaguugcugagcagg

SEQ ID NO: 1054750 - RNA, 22 nt, Human
ggacccugggcucugggccuau

SEQ ID NO: 1054751 - RNA, 22 nt, Human
uuugacaucuaagaauucuuac

SEQ ID NO: 1054752 - RNA, 19 nt, Human
ugcccaggccagguugggc

SEQ ID NO: 1054753 - RNA, 22 nt, Human
uuggcagcauccaagucucggg

SEQ ID NO: 1054754 - RNA, 20 nt, Human
aggcaccugucacaggugag

SEQ ID NO: 1054755 - RNA, 22 nt, Human
auuuaaaugcuuaagaggguuu

SEQ ID NO: 1054756 - RNA, 22 nt, Human
aggcuagcaaugggagaugagu

SEQ ID NO: 1054757 - RNA, 22 nt, Human
aaauuuucagagcacuagagaa

SEQ ID NO: 1054758 - RNA, 22 nt, Human
guugacagaaaaauaacauagc

SEQ ID NO: 1054759 - RNA, 23 nt, Human
accaggagaaaagcuuugcggga

SEQ ID NO: 1054760 - RNA, 22 nt, Human
caaggaaaagaaguauuucaga

SEQ ID NO: 1054761 - RNA, 18 nt, Human
ugaggcccgcagaggugg

SEQ ID NO: 1054762 - RNA, 22 nt, Human
gugggagcuuuggcaucaggcu

SEQ ID NO: 1054763 - RNA, 20 nt, Human
ugaggcaggagaauggcaug

SEQ ID NO: 1054764 - RNA, 19 nt, Human
ugaguucugugguucucaa

SEQ ID NO: 1054765 - RNA, 23 nt, Human
acugucugauauguuuuccauca

SEQ ID NO: 1054766 - RNA, 22 nt, Human
uacaucuagccuuacaauuauu

SEQ ID NO: 1054767 - RNA, 22 nt, Human
agcagaggaggauuuaguuagg

SEQ ID NO: 1054768 - RNA, 22 nt, Human
ucugugccucaucugguucagg

SEQ ID NO: 1054769 - RNA, 22 nt, Human
ugaggucugcagggcugugcau

SEQ ID NO: 1054770 - RNA, 22 nt, Human
aacuguaauuuuuacauaguaa

SEQ ID NO: 1054771 - RNA, 22 nt, Human
aggcaggcucaggcccaugcuu

SEQ ID NO: 1054772 - RNA, 22 nt, Human
guuuuauuuccaugagagaccg

SEQ ID NO: 1054773 - RNA, 22 nt, Human
auuauacauuuuguguagagau

SEQ ID NO: 1054774 - RNA, 22 nt, Human
aauaucagcacuuuugugguau

SEQ ID NO: 1054775 - RNA, 22 nt, Human
uggcugagaaguucugguggga

SEQ ID NO: 1054776 - RNA, 22 nt, Human
gaaauuauugcuagagacugca

SEQ ID NO: 1054777 - RNA, 22 nt, Human
ggucugaguagagggcuggcga

SEQ ID NO: 1054778 - RNA, 19 nt, Human
aggcuggagacaccaggcc

SEQ ID NO: 1054779 - RNA, 22 nt, Human
agcagacauaucucaugucaca

SEQ ID NO: 1054780 - RNA, 22 nt, Human
gcaccugauugauuucacugcu

SEQ ID NO: 1054781 - RNA, 22 nt, Human
uuagaaagcuuuccauagucaa

SEQ ID NO: 1054782 - RNA, 20 nt, Human
gugcugagggcugggcaaug

SEQ ID NO: 1054783 - RNA, 22 nt, Human
ccuccugggacucauuagcacc

SEQ ID NO: 1054784 - RNA, 22 nt, Human
auugaaagauauacuguucuca

SEQ ID NO: 1054785 - RNA, 22 nt, Human
caguuucuuggaugccaauuuc

SEQ ID NO: 1054786 - RNA, 23 nt, Human
ucugagguccaccaguuugcaga

SEQ ID NO: 1054787 - RNA, 22 nt, Human
caaauagugucacauugugagg

SEQ ID NO: 1054788 - RNA, 22 nt, Human
aaucuucuuucuuaacaguaca

SEQ ID NO: 1054789 - RNA, 22 nt, Human
agggaagcccuggcugagaccc

SEQ ID NO: 1054790 - RNA, 22 nt, Human
uggggcuccuccuggcaggagg

SEQ ID NO: 1054791 - RNA, 22 nt, Human
gcccaggaaagauagggccuca

SEQ ID NO: 1054792 - RNA, 22 nt, Human
ugaggcagucacccccuccugc

SEQ ID NO: 1054793 - RNA, 22 nt, Human
uggcuucuugggaugggucauu

SEQ ID NO: 1054794 - RNA, 22 nt, Human
gggcagcucugcccaucagagg

SEQ ID NO: 1054795 - RNA, 22 nt, Human
ccaggagagcaggcgugcagcu

SEQ ID NO: 1054796 - RNA, 22 nt, Human
gaaucucaaggcuugugaggau

SEQ ID NO: 1054797 - RNA, 22 nt, Human
ggacuucuggggacuguagauu

SEQ ID NO: 1054798 - RNA, 22 nt, Human
ugaaucaguauaaauucucaaa

SEQ ID NO: 1054799 - RNA, 22 nt, Human
cacaauuuguuuuaucaguauu

SEQ ID NO: 1054800 - RNA, 22 nt, Human
aguaacucuccuuugacauauu

SEQ ID NO: 1054801 - RNA, 22 nt, Human
gcagacaggcccaguggaggga

SEQ ID NO: 1054802 - RNA, 22 nt, Human
aggcaagcgcagaagcggagga

SEQ ID NO: 1054803 - RNA, 22 nt, Human
uagaaacaucagcuaaccaaaa

SEQ ID NO: 1054804 - RNA, 23 nt, Human
cagaaaacccagagcucaguccc

SEQ ID NO: 1054805 - RNA, 23 nt, Human
uuccagaguccacaucugccacc

SEQ ID NO: 1054806 - RNA, 22 nt, Human
uaaucuaucaagcaacaaagug

SEQ ID NO: 1054807 - RNA, 22 nt, Human
acucuggcccuccugcugccag

SEQ ID NO: 1054808 - RNA, 22 nt, Human
caaggccaagucucugugaaga

SEQ ID NO: 1054809 - RNA, 22 nt, Human
guggcagagugcgguucugacc

SEQ ID NO: 1054810 - RNA, 22 nt, Human
uggcugaggagggucuucuggu

SEQ ID NO: 1054811 - RNA, 22 nt, Human
ugcccaaaccucuccuagcucu

SEQ ID NO: 1054812 - RNA, 22 nt, Human
cugcucugacccuuucaccuuc

SEQ ID NO: 1054813 - RNA, 23 nt, Human
aaacugcuuccaauuccugccau

SEQ ID NO: 1054814 - RNA, 22 nt, Human
uggcugagugauauuugcaaag

SEQ ID NO: 1054815 - RNA, 22 nt, Human
ucucucuuuuuaaucauguaau

SEQ ID NO: 1054816 - RNA, 22 nt, Human
agggcagcacaaggcauggacu

SEQ ID NO: 1054817 - RNA, 22 nt, Human
cuucagaauccagaaucagaau

SEQ ID NO: 1054818 - RNA, 22 nt, Human
auucuucaccauggauaauuug

SEQ ID NO: 1054819 - RNA, 17 nt, Human
ugauaguucauuuuaag

SEQ ID NO: 1054820 - RNA, 20 nt, Human
ggccgaaauaauaguggcuu

SEQ ID NO: 1054821 - RNA, 22 nt, Human
ugaggccagucucaucacaggc

SEQ ID NO: 1054822 - RNA, 22 nt, Human
gcuguagguaaggauggcaaag

SEQ ID NO: 1054823 - RNA, 22 nt, Human
ggaggaggcggcagaaguuccu

SEQ ID NO: 1054824 - RNA, 22 nt, Human
ugcugaggcagaugucugugac

SEQ ID NO: 1054825 - RNA, 22 nt, Human
ucagaaaagguagcugugacaa

SEQ ID NO: 1054826 - RNA, 22 nt, Human
ugaggcagugugagauaauaaa

SEQ ID NO: 1054827 - RNA, 22 nt, Human
auuuggaacaaauauuaguaaa

SEQ ID NO: 1054828 - RNA, 22 nt, Human
aucuucucauguguaaugaggu

SEQ ID NO: 1054829 - RNA, 22 nt, Human
cagaggaugaucuggccucucu

SEQ ID NO: 1054830 - RNA, 22 nt, Human
caggcagcguccugcuuccugu

SEQ ID NO: 1054831 - RNA, 22 nt, Human
ugaaggccucugguacaugcca

SEQ ID NO: 1054832 - RNA, 22 nt, Human
cccugguguggaugugauuggc

SEQ ID NO: 1054833 - RNA, 22 nt, Human
cuucuaauucuuauguaagcuu

SEQ ID NO: 1054834 - RNA, 21 nt, Human
agcagaggcugccuggugacu

SEQ ID NO: 1054835 - RNA, 22 nt, Human
gaauuauagguuugcaugcuaa

SEQ ID NO: 1054836 - RNA, 22 nt, Human
ccuggagaccagaggauacuuc

SEQ ID NO: 1054837 - RNA, 23 nt, Human
ggagugcaauggcgccaucucgg

SEQ ID NO: 1054838 - RNA, 22 nt, Human
gucagagagggcacgugcacac

SEQ ID NO: 1054839 - RNA, 22 nt, Human
uaacuguaguuauaaagcuauc

SEQ ID NO: 1054840 - RNA, 22 nt, Human
uuacacuuaccuguccauugaa

SEQ ID NO: 1054841 - RNA, 22 nt, Human
agacaaaugguaauuaugucua

SEQ ID NO: 1054842 - RNA, 22 nt, Human
gccauuuucugucuuguuuauu

SEQ ID NO: 1054843 - RNA, 22 nt, Human
ucuuugaauuucugacugucuu

SEQ ID NO: 1054844 - RNA, 22 nt, Human
uuuccauguuggugaaaugagg

SEQ ID NO: 1054845 - RNA, 22 nt, Human
gagggugggccagauaugaggg

SEQ ID NO: 1054846 - RNA, 22 nt, Human
ugaggcccuagggcaugggaga

SEQ ID NO: 1054847 - RNA, 22 nt, Human
caggcagcagccacucugguau

SEQ ID NO: 1054848 - RNA, 22 nt, Human
ugaggcucagagaacagugacu

SEQ ID NO: 1054849 - RNA, 20 nt, Human
agggccuguugcaagcguuu

SEQ ID NO: 1054850 - RNA, 22 nt, Human
gugcugugugauccaugcuggc

SEQ ID NO: 1054851 - RNA, 22 nt, Human
ucugggagccaugccuuggagu

SEQ ID NO: 1054852 - RNA, 22 nt, Human
ggucugaguggggccugagauu

SEQ ID NO: 1054853 - RNA, 22 nt, Human
uuuagagcaggguguggcacau

SEQ ID NO: 1054854 - RNA, 22 nt, Human
aaauaaguuaaacuagaaugau

SEQ ID NO: 1054855 - RNA, 22 nt, Human
ucccaggaaggauucggcauuu

SEQ ID NO: 1054856 - RNA, 22 nt, Human
aguaaaaauugaggugcaaaau

SEQ ID NO: 1054857 - RNA, 22 nt, Human
agaggagugggaagcagugcaa

SEQ ID NO: 1054858 - RNA, 22 nt, Human
uaucaucuuguugucaugcagc

SEQ ID NO: 1054859 - RNA, 22 nt, Human
cucucuggaccucaacuauuuu

SEQ ID NO: 1054860 - RNA, 22 nt, Human
agcccaggucucaaaguacagg

SEQ ID NO: 1054861 - RNA, 22 nt, Human
ucauuuguaccauuuuuuaaga

SEQ ID NO: 1054862 - RNA, 22 nt, Human
auuucagauucagaaauguagg

SEQ ID NO: 1054863 - RNA, 22 nt, Human
uggcagcaauuagcuagagcug

SEQ ID NO: 1054864 - RNA, 22 nt, Human
guggccaauaggagcagcuauc

SEQ ID NO: 1054865 - RNA, 22 nt, Human
auucauuuagguauucacuuac

SEQ ID NO: 1054866 - RNA, 22 nt, Human
aagcaaaggcaggagcuuguga

SEQ ID NO: 1054867 - RNA, 22 nt, Human
uucccucuccuacucaggaaag

SEQ ID NO: 1054868 - RNA, 22 nt, Human
aucaggaugacuauaaggcugc

SEQ ID NO: 1054869 - RNA, 22 nt, Human
uuucuauuuuaaaggcauaugg

SEQ ID NO: 1054870 - RNA, 22 nt, Human
gcugaggaaaccaaugcucaga

SEQ ID NO: 1054871 - RNA, 22 nt, Human
uagcaagaagcugucacaggug

SEQ ID NO: 1054872 - RNA, 22 nt, Human
aggcaggcuggucugaagagug

SEQ ID NO: 1054873 - RNA, 22 nt, Human
uuaguuaggaaacaaaguuguu

SEQ ID NO: 1054874 - RNA, 22 nt, Human
aucacauucuuucaaagcaguc

SEQ ID NO: 1054875 - RNA, 23 nt, Human
aaauuauugcucuucaauugccu

SEQ ID NO: 1054876 - RNA, 22 nt, Human
ccaggcuguaaacaccuucaaa

SEQ ID NO: 1054877 - RNA, 22 nt, Human
gaggggagacagggaaaucagu

SEQ ID NO: 1054878 - RNA, 22 nt, Human
gauggcagcagcagccagggau

SEQ ID NO: 1054879 - RNA, 22 nt, Human
aggcagguccccuggaaggcac

SEQ ID NO: 1054880 - RNA, 22 nt, Human
aggccagcuuccagaggggcag

SEQ ID NO: 1054881 - RNA, 22 nt, Human
aggagagaauguuccaggcuug

SEQ ID NO: 1054882 - RNA, 22 nt, Human
cugaagccaugugcucacuggu

SEQ ID NO: 1054883 - RNA, 22 nt, Human
uuucuagggcucuugucuucug

SEQ ID NO: 1054884 - RNA, 19 nt, Human
ucuuucauuucuagcucug

SEQ ID NO: 1054885 - RNA, 22 nt, Human
cagcugaguuacucugaggucu

SEQ ID NO: 1054886 - RNA, 22 nt, Human
cucaggaucgcuugcccuaggg

SEQ ID NO: 1054887 - RNA, 22 nt, Human
caaauacuguacugaacacugu

SEQ ID NO: 1054888 - RNA, 22 nt, Human
gagaggauccacaaaccaggaa

SEQ ID NO: 1054889 - RNA, 22 nt, Human
cagcugcuuacuagcuguguga

SEQ ID NO: 1054890 - RNA, 22 nt, Human
auccauuauugggccaauaaag

SEQ ID NO: 1054891 - RNA, 22 nt, Human
agucuccuuggccucaaugccu

SEQ ID NO: 1054892 - RNA, 19 nt, Human
ggcucagggcgcugccgcc

SEQ ID NO: 1054893 - RNA, 22 nt, Human
ugugaacuggcagguggacggg

SEQ ID NO: 1054894 - RNA, 22 nt, Human
acucagaagauauaaugacuca

SEQ ID NO: 1054895 - RNA, 22 nt, Human
agcuagccuaggcagagugcau

SEQ ID NO: 1054896 - RNA, 21 nt, Human
ggagggcagcccagacuggcu

SEQ ID NO: 1054897 - RNA, 22 nt, Human
ugaggcaggagguugagaacug

SEQ ID NO: 1054898 - RNA, 22 nt, Human
ucacagacauggugagguaaca

SEQ ID NO: 1054899 - RNA, 22 nt, Human
auuggcaaggcugcggugucug

SEQ ID NO: 1054900 - RNA, 22 nt, Human
cagacaggaauucuggcguggu

SEQ ID NO: 1054901 - RNA, 22 nt, Human
aagaagagaaaugugcugcugg

SEQ ID NO: 1054902 - RNA, 23 nt, Human
uccaugagaugugggcuucuagu

SEQ ID NO: 1054903 - RNA, 22 nt, Human
acaaaugugucuaauugugccu

SEQ ID NO: 1054904 - RNA, 22 nt, Human
agcugaggccugauuucgccgu

SEQ ID NO: 1054905 - RNA, 22 nt, Human
uggguccauggaacagaggugc

SEQ ID NO: 1054906 - RNA, 22 nt, Human
cccugagcaacaaacugaauac

SEQ ID NO: 1054907 - RNA, 22 nt, Human
uccugccuagcaggugaccuau

SEQ ID NO: 1054908 - RNA, 21 nt, Human
gaacauuuggguuguuucuac

SEQ ID NO: 1054909 - RNA, 22 nt, Human
uugaggucccugccuugccuuc

SEQ ID NO: 1054910 - RNA, 22 nt, Human
uugguaaaaucauagugguaac

SEQ ID NO: 1054911 - RNA, 22 nt, Human
ucaggcugcuggccagcaggcu

SEQ ID NO: 1054912 - RNA, 22 nt, Human
caguucuuaauaccaugugguu

SEQ ID NO: 1054913 - RNA, 22 nt, Human
caacugccauacagcuccaugg

SEQ ID NO: 1054914 - RNA, 22 nt, Human
aaaauuauucauggcuuuugga

SEQ ID NO: 1054915 - RNA, 22 nt, Human
uuuauuguuuagaagggggcug

SEQ ID NO: 1054916 - RNA, 22 nt, Human
cuggcaaguacugggccagcuc

SEQ ID NO: 1054917 - RNA, 23 nt, Human
cccaggagccugaguccucucug

SEQ ID NO: 1054918 - RNA, 22 nt, Human
ugcccaggaucuggcgaugcuc

SEQ ID NO: 1054919 - RNA, 22 nt, Human
gcugcugucagugguggcaguu

SEQ ID NO: 1054920 - RNA, 22 nt, Human
cucccagagagcaggugggccg

SEQ ID NO: 1054921 - RNA, 22 nt, Human
aucauuacuccuguaaaauugu

SEQ ID NO: 1054922 - RNA, 22 nt, Human
uaagcugugggagauuggcaua

SEQ ID NO: 1054923 - RNA, 22 nt, Human
cggcugagcagugcugauggaa

SEQ ID NO: 1054924 - RNA, 22 nt, Human
ucuucacauggaacaugaagcu

SEQ ID NO: 1054925 - RNA, 22 nt, Human
gugauuuucuccuccuagaagu

SEQ ID NO: 1054926 - RNA, 22 nt, Human
ccaggagaauaauggcagauua

SEQ ID NO: 1054927 - RNA, 22 nt, Human
aacuccugaggaaauggucuca

SEQ ID NO: 1054928 - RNA, 22 nt, Human
uugaggucaucugaaguacuag

SEQ ID NO: 1054929 - RNA, 22 nt, Human
aggccacaagaacuaccccauc

SEQ ID NO: 1054930 - RNA, 22 nt, Human
auggcuucuagcauugucacaa

SEQ ID NO: 1054931 - RNA, 22 nt, Human
uacuuucuuguuccuuucauaa

SEQ ID NO: 1054932 - RNA, 22 nt, Human
ugaggcagguaagcaaguuuug

SEQ ID NO: 1054933 - RNA, 22 nt, Human
ugcuuagacgucaaguacagcc

SEQ ID NO: 1054934 - RNA, 22 nt, Human
ccaggacagugaacauguaaga

SEQ ID NO: 1054935 - RNA, 22 nt, Human
uuuaguagugacagauucuggg

SEQ ID NO: 1054936 - RNA, 22 nt, Human
gcuggccaggaagagucucaga

SEQ ID NO: 1054937 - RNA, 22 nt, Human
aucauacacucacauaaacaga

SEQ ID NO: 1054938 - RNA, 22 nt, Human
gagcagcucgagaaggaagcag

SEQ ID NO: 1054939 - RNA, 22 nt, Human
aaaaacugcaauuacuuuuguc

SEQ ID NO: 1054940 - RNA, 22 nt, Human
uguuuuuaaauaaugauagaaa

SEQ ID NO: 1054941 - RNA, 22 nt, Human
uuggccaauggugauucccggc

SEQ ID NO: 1054942 - RNA, 22 nt, Human
uuuggaauuggaaagugcugug

SEQ ID NO: 1054943 - RNA, 18 nt, Human
gcagcugacacuggaguu

SEQ ID NO: 1054944 - RNA, 22 nt, Human
uggcacauaguaggugcucaau

SEQ ID NO: 1054945 - RNA, 22 nt, Human
caggcagccuucucgucucaca

SEQ ID NO: 1054946 - RNA, 22 nt, Human
cacccugggcugggccuguuaa

SEQ ID NO: 1054947 - RNA, 20 nt, Human
cccaggagugagcagcuuua

SEQ ID NO: 1054948 - RNA, 22 nt, Human
aacuucugccaaacagcuguua

SEQ ID NO: 1054949 - RNA, 18 nt, Human
aagaacugagguccuaga

SEQ ID NO: 1054950 - RNA, 22 nt, Human
guucuugccagcauccucaggu

SEQ ID NO: 1054951 - RNA, 22 nt, Human
cccaggagagaggccaguuggc

SEQ ID NO: 1054952 - RNA, 22 nt, Human
accuauuuaugcaauuaugaaa

SEQ ID NO: 1054953 - RNA, 22 nt, Human
cucaggauuuaaaggggcacuc

SEQ ID NO: 1054954 - RNA, 22 nt, Human
cuccuggcucugccacuuacua

SEQ ID NO: 1054955 - RNA, 22 nt, Human
uuugacaucaauacccuagaau

SEQ ID NO: 1054956 - RNA, 22 nt, Human
agggaagcuuguuacugagaag

SEQ ID NO: 1054957 - RNA, 22 nt, Human
uccaugagaacccuuggagaua

SEQ ID NO: 1054958 - RNA, 22 nt, Human
ucuagaaugacaugcaagagua

SEQ ID NO: 1054959 - RNA, 22 nt, Human
agaggcagaaguguucaaaccc

SEQ ID NO: 1054960 - RNA, 22 nt, Human
gcccuccccucuggguggugag

SEQ ID NO: 1054961 - RNA, 22 nt, Human
uagaaaugaauguuuaaaaguc

SEQ ID NO: 1054962 - RNA, 22 nt, Human
gagggagugccagagggccagc

SEQ ID NO: 1054963 - RNA, 22 nt, Human
cagagcugcaaaugccccuccg

SEQ ID NO: 1054964 - RNA, 22 nt, Human
caguuucuauggcugggcucug

SEQ ID NO: 1054965 - RNA, 22 nt, Human
auagucuuagaucagauaaagu

SEQ ID NO: 1054966 - RNA, 22 nt, Human
cuuauuagaaagaaaagacaug

SEQ ID NO: 1054967 - RNA, 22 nt, Human
gcugaggugaggcuggaaagga

SEQ ID NO: 1054968 - RNA, 22 nt, Human
cggaggggauacauuuucugaa

SEQ ID NO: 1054969 - RNA, 22 nt, Human
ccuccugguccagcaucucuuu

SEQ ID NO: 1054970 - RNA, 22 nt, Human
cuugcugucuugcauuuagagc

SEQ ID NO: 1054971 - RNA, 22 nt, Human
gagagcaggaggcagcgggacg

SEQ ID NO: 1054972 - RNA, 22 nt, Human
caaggaaaacagaugaucaaca

SEQ ID NO: 1054973 - RNA, 22 nt, Human
ugagauguaagguaugcuuacu

SEQ ID NO: 1054974 - RNA, 22 nt, Human
uuuauuuggcaucucugccaag

SEQ ID NO: 1054975 - RNA, 22 nt, Human
aggagcagaauuuaaugugcag

SEQ ID NO: 1054976 - RNA, 22 nt, Human
uggcagcuuuuuguuucaggcu

SEQ ID NO: 1054977 - RNA, 22 nt, Human
gcugcccaggguggagccggcu

SEQ ID NO: 1054978 - RNA, 22 nt, Human
agucugucugucacuucugcag

SEQ ID NO: 1054979 - RNA, 22 nt, Human
uaucuguuggcuccuaguugua

SEQ ID NO: 1054980 - RNA, 22 nt, Human
aucugacaaggccacauauucu

SEQ ID NO: 1054981 - RNA, 21 nt, Human
ucugccugagacuuugcuggu

SEQ ID NO: 1054982 - RNA, 22 nt, Human
gcugaggauauagcaggaacaa

SEQ ID NO: 1054983 - RNA, 22 nt, Human
uggcucagucuggguugacuga

SEQ ID NO: 1054984 - RNA, 22 nt, Human
gcugaggaggugugguuaggug

SEQ ID NO: 1054985 - RNA, 22 nt, Human
gucuucuuuaaccuacuaaagc

SEQ ID NO: 1054986 - RNA, 22 nt, Human
aggaaacuccccuacaucucaa

SEQ ID NO: 1054987 - RNA, 22 nt, Human
uuggaacaggauucaauuaaag

SEQ ID NO: 1054988 - RNA, 22 nt, Human
aauauuguuucaagaucacaga

SEQ ID NO: 1054989 - RNA, 22 nt, Human
ugaaggaaugaguauacuguuu

SEQ ID NO: 1054990 - RNA, 22 nt, Human
cagggcuguuagcugcugcucu

SEQ ID NO: 1054991 - RNA, 22 nt, Human
cccaggaggccaagguugcagu

SEQ ID NO: 1054992 - RNA, 22 nt, Human
agugcuguaacaacuuauuugg

SEQ ID NO: 1054993 - RNA, 22 nt, Human
agcagccuuugaucaucuggga

SEQ ID NO: 1054994 - RNA, 22 nt, Human
agaacguggaauguggcuccuu

SEQ ID NO: 1054995 - RNA, 21 nt, Human
aaggcugagacaacucaggag

SEQ ID NO: 1054996 - RNA, 20 nt, Human
agugccagggcaggugagag

SEQ ID NO: 1054997 - RNA, 21 nt, Human
agagaaagucauggcuguggc

SEQ ID NO: 1054998 - RNA, 22 nt, Human
cccauucauccucgcuuccuuc

SEQ ID NO: 1054999 - RNA, 22 nt, Human
uuuucaguuccaucucugcucu

SEQ ID NO: 1055000 - RNA, 22 nt, Human
cugacuuuuccaaauaauacuu

SEQ ID NO: 1055001 - RNA, 22 nt, Human
ugucuuuggaauauuuagcuga

SEQ ID NO: 1055002 - RNA, 22 nt, Human
guucuucagucacaucacagaa

SEQ ID NO: 1055003 - RNA, 22 nt, Human
ggagcagggcagugaauucugg

SEQ ID NO: 1055004 - RNA, 22 nt, Human
uuuaagauucaguaaggcaaac

SEQ ID NO: 1055005 - RNA, 22 nt, Human
cugcucuguucccccaucaucu

SEQ ID NO: 1055006 - RNA, 22 nt, Human
aggcaguuguagagagggcucu

SEQ ID NO: 1055007 - RNA, 22 nt, Human
ccugagguuauccaucuaccug

SEQ ID NO: 1055008 - RNA, 21 nt, Human
augucaaaugcuuuauuuuau

SEQ ID NO: 1055009 - RNA, 22 nt, Human
auacaguaaccacauucuauag

SEQ ID NO: 1055010 - RNA, 22 nt, Human
gagcaagauuuuauaaguugug

SEQ ID NO: 1055011 - RNA, 22 nt, Human
aggcagcugcccucuccuuccu

SEQ ID NO: 1055012 - RNA, 22 nt, Human
uucuuaggacuaguauagcaug

SEQ ID NO: 1055013 - RNA, 22 nt, Human
uggcuggauuauuggcuaguac

SEQ ID NO: 1055014 - RNA, 22 nt, Human
aggauuuuagauaagacagcaa

SEQ ID NO: 1055015 - RNA, 22 nt, Human
ucacugcucuccaauguggagu

SEQ ID NO: 1055016 - RNA, 17 nt, Human
gcugagaggcagcacag

SEQ ID NO: 1055017 - RNA, 22 nt, Human
cugcccucuagggaugcacugg

SEQ ID NO: 1055018 - RNA, 22 nt, Human
acuuugcagggcuugauaucca

SEQ ID NO: 1055019 - RNA, 22 nt, Human
cacagcuaggaggaaagcagag

SEQ ID NO: 1055020 - RNA, 22 nt, Human
augaggucauccuggaguaagg

SEQ ID NO: 1055021 - RNA, 22 nt, Human
uaauuauaacaguuacaucuua

SEQ ID NO: 1055022 - RNA, 22 nt, Human
aggauguugcuauuggcagucu

SEQ ID NO: 1055023 - RNA, 22 nt, Human
ccaaauuaaaucauacagacag

SEQ ID NO: 1055024 - RNA, 23 nt, Human
ucuugaaaagccuacagcaguuc

SEQ ID NO: 1055025 - RNA, 22 nt, Human
aagcagagcaagcguauuuauu

SEQ ID NO: 1055026 - RNA, 22 nt, Human
agauggagaaugacaauuaagg

SEQ ID NO: 1055027 - RNA, 22 nt, Human
aagggaggggauguaagccugg

SEQ ID NO: 1055028 - RNA, 22 nt, Human
aggaucuugcuguagaggauag

SEQ ID NO: 1055029 - RNA, 22 nt, Human
agccacagcacauuguaagaaa

SEQ ID NO: 1055030 - RNA, 22 nt, Human
aaguuacauaaauguccucuag

SEQ ID NO: 1055031 - RNA, 22 nt, Human
auuauuagauucuuaauuguaa

SEQ ID NO: 1055032 - RNA, 22 nt, Human
ugcacuucaaaaaugucacuga

SEQ ID NO: 1055033 - RNA, 22 nt, Human
uuuaaauuauaguuaaugucug

SEQ ID NO: 1055034 - RNA, 22 nt, Human
aggaagcugccugggaugggaa

SEQ ID NO: 1055035 - RNA, 22 nt, Human
uaacaaacuggaaauugacauu

SEQ ID NO: 1055036 - RNA, 22 nt, Human
aacugcuucuuacugcugggca

SEQ ID NO: 1055037 - RNA, 22 nt, Human
caggucuggguugauggccugg

SEQ ID NO: 1055038 - RNA, 22 nt, Human
caggagggcccgagacucuucc

SEQ ID NO: 1055039 - RNA, 23 nt, Human
auauuagggagauuagcccucua

SEQ ID NO: 1055040 - RNA, 17 nt, Human
cuccuggccaccccucu

SEQ ID NO: 1055041 - RNA, 22 nt, Human
cccagggacucgggauucuagg

SEQ ID NO: 1055042 - RNA, 23 nt, Human
cagagcuggcucagagcugccug

SEQ ID NO: 1055043 - RNA, 22 nt, Human
ugcugaaauuagaacauugagg

SEQ ID NO: 1055044 - RNA, 22 nt, Human
uaggacauguguuuuauauaug

SEQ ID NO: 1055045 - RNA, 22 nt, Human
agagccagcauuugggcccugc

SEQ ID NO: 1055046 - RNA, 22 nt, Human
agagagagggaaacugcuaaac

SEQ ID NO: 1055047 - RNA, 22 nt, Human
uaggcagcauggauucugaaua

SEQ ID NO: 1055048 - RNA, 22 nt, Human
ugcccuggcuccucccacgcug

SEQ ID NO: 1055049 - RNA, 22 nt, Human
ccaggagagcucuaaauggcug

SEQ ID NO: 1055050 - RNA, 22 nt, Human
gcugaggacaucauggaaggaa

SEQ ID NO: 1055051 - RNA, 23 nt, Human
gcugagguacauuuacaggaaga

SEQ ID NO: 1055052 - RNA, 19 nt, Human
gccaggcuccauagccggc

SEQ ID NO: 1055053 - RNA, 22 nt, Human
cuuuccaagaaugcagauaccu

SEQ ID NO: 1055054 - RNA, 22 nt, Human
gugcugugucuaucaggaauaa

SEQ ID NO: 1055055 - RNA, 22 nt, Human
ccaggaaauggcuugcuucuuu

SEQ ID NO: 1055056 - RNA, 23 nt, Human
uaugaacugcauugcuggugugu

SEQ ID NO: 1055057 - RNA, 22 nt, Human
ggaggggucucuagcgaggaga

SEQ ID NO: 1055058 - RNA, 22 nt, Human
caggagaaauguggcugcuacc

SEQ ID NO: 1055059 - RNA, 22 nt, Human
cugaggcuaaccucgagagaca

SEQ ID NO: 1055060 - RNA, 22 nt, Human
gcugccucugcacagcucacuc

SEQ ID NO: 1055061 - RNA, 22 nt, Human
caggagauguaagacuucuguu

SEQ ID NO: 1055062 - RNA, 22 nt, Human
augcuguggggagugaggguag

SEQ ID NO: 1055063 - RNA, 22 nt, Human
ucaggcugugucuuuaaacaau

SEQ ID NO: 1055064 - RNA, 22 nt, Human
ugcacagugaccccuggugacu

SEQ ID NO: 1055065 - RNA, 22 nt, Human
ucuggccaauguugugaucaca

SEQ ID NO: 1055066 - RNA, 22 nt, Human
uuauccuggauuauauauguga

SEQ ID NO: 1055067 - RNA, 22 nt, Human
ugaugaaaauaugauucugagg

SEQ ID NO: 1055068 - RNA, 22 nt, Human
guugacagcuggugagcugcua

SEQ ID NO: 1055069 - RNA, 22 nt, Human
gugagguccucccugcugggag

SEQ ID NO: 1055070 - RNA, 22 nt, Human
cucaggauuaaggaaucuaaau

SEQ ID NO: 1055071 - RNA, 22 nt, Human
uuucuggcagcgggacaggggu

SEQ ID NO: 1055072 - RNA, 22 nt, Human
cugagguccucagagggaaagg

SEQ ID NO: 1055073 - RNA, 19 nt, Human
uuacacuucugcuuuguga

SEQ ID NO: 1055074 - RNA, 22 nt, Human
augaaacaguguguauagcaaa

SEQ ID NO: 1055075 - RNA, 22 nt, Human
auuucauugaaguuaauucuuc

SEQ ID NO: 1055076 - RNA, 18 nt, Human
ucagcuggggcugcagcc

SEQ ID NO: 1055077 - RNA, 22 nt, Human
uuguuuuaucuuucuacagacu

SEQ ID NO: 1055078 - RNA, 23 nt, Human
agaggggagcaucugcuggcuga

SEQ ID NO: 1055079 - RNA, 22 nt, Human
ccuuuuaugaacuugagcaggu

SEQ ID NO: 1055080 - RNA, 22 nt, Human
acaggcugccacuugcauccaa

SEQ ID NO: 1055081 - RNA, 22 nt, Human
gaaggaggugucaguuggacug

SEQ ID NO: 1055082 - RNA, 22 nt, Human
agcacauucugccuugcuuugc

SEQ ID NO: 1055083 - RNA, 22 nt, Human
ccucagaugucuuaaggcacug

SEQ ID NO: 1055084 - RNA, 22 nt, Human
auuuggcacacuggguucucgu

SEQ ID NO: 1055085 - RNA, 22 nt, Human
cugcuucauauuucauagugau

SEQ ID NO: 1055086 - RNA, 22 nt, Human
ugagccuguccugugcauguga

SEQ ID NO: 1055087 - RNA, 22 nt, Human
uauacacauuuuuaccuauagu

SEQ ID NO: 1055088 - RNA, 22 nt, Human
ccuccuggaggcucuaagggag

SEQ ID NO: 1055089 - RNA, 22 nt, Human
ggccagcuuugagcugcaggaa

SEQ ID NO: 1055090 - RNA, 22 nt, Human
ccccagagagcaccaugaagcc

SEQ ID NO: 1055091 - RNA, 22 nt, Human
agggagcuuccgaacuacagcu

SEQ ID NO: 1055092 - RNA, 22 nt, Human
cagcagaggugguucacauugu

SEQ ID NO: 1055093 - RNA, 22 nt, Human
uuuagucuaauaaaaguggagu

SEQ ID NO: 1055094 - RNA, 22 nt, Human
aaaaugagauacaguuugaaag

SEQ ID NO: 1055095 - RNA, 22 nt, Human
uuucauuauaaaaaguuggcuu

SEQ ID NO: 1055096 - RNA, 22 nt, Human
ggccagggccuggggacugucc

SEQ ID NO: 1055097 - RNA, 22 nt, Human
gaucuucuauguaaugaagugu

SEQ ID NO: 1055098 - RNA, 22 nt, Human
ucccaggacccaggcauucaca

SEQ ID NO: 1055099 - RNA, 22 nt, Human
agaaucugaaggcaccucuggu

SEQ ID NO: 1055100 - RNA, 22 nt, Human
caggaugguggcaugaucagaa

SEQ ID NO: 1055101 - RNA, 22 nt, Human
cucucagacugaagggccugug

SEQ ID NO: 1055102 - RNA, 22 nt, Human
uuggcacacaguaagcccuaag

SEQ ID NO: 1055103 - RNA, 22 nt, Human
gcagaagucagaccaucugaau

SEQ ID NO: 1055104 - RNA, 22 nt, Human
ucccagaggacuguuggugcua

SEQ ID NO: 1055105 - RNA, 23 nt, Human
agcugaggcugugggugucagag

SEQ ID NO: 1055106 - RNA, 22 nt, Human
cugcugagaaaagacugaggga

SEQ ID NO: 1055107 - RNA, 22 nt, Human
guuuauuauucaacuucauguu

SEQ ID NO: 1055108 - RNA, 22 nt, Human
guuuauuaacugucaagugauu

SEQ ID NO: 1055109 - RNA, 20 nt, Human
agaggccaguuaggagucua

SEQ ID NO: 1055110 - RNA, 22 nt, Human
ggccugaggcgucccagcugug

SEQ ID NO: 1055111 - RNA, 22 nt, Human
cccuuccuccucgccugucaga

SEQ ID NO: 1055112 - RNA, 22 nt, Human
ucauggauggccgggaggugau

SEQ ID NO: 1055113 - RNA, 22 nt, Human
uccuggccuugcuccugaugcc

SEQ ID NO: 1055114 - RNA, 19 nt, Human
aggucuaaucauaagacaa

SEQ ID NO: 1055115 - RNA, 22 nt, Human
cugcuguguuucugcuagaaaa

SEQ ID NO: 1055116 - RNA, 22 nt, Human
auggcuuccucuggauuggauu

SEQ ID NO: 1055117 - RNA, 22 nt, Human
ggagcuguuggcagcuaucuug

SEQ ID NO: 1055118 - RNA, 22 nt, Human
ucccucucccuauugccuggag

SEQ ID NO: 1055119 - RNA, 22 nt, Human
aagaguaaagcaaagcacuugu

SEQ ID NO: 1055120 - RNA, 22 nt, Human
uuauuuaauuuucucacucaga

SEQ ID NO: 1055121 - RNA, 22 nt, Human
cccuggcagagggggcaggugc

SEQ ID NO: 1055122 - RNA, 22 nt, Human
cacugagcugauagaauuccag

SEQ ID NO: 1055123 - RNA, 22 nt, Human
agaggccacuuugccugugaug

SEQ ID NO: 1055124 - RNA, 22 nt, Human
ucugggaaugaauaagaccugu

SEQ ID NO: 1055125 - RNA, 22 nt, Human
ugaguaauaaacugucuugcuc

SEQ ID NO: 1055126 - RNA, 22 nt, Human
ugaguuuuuucaacauaugaag

SEQ ID NO: 1055127 - RNA, 23 nt, Human
ucucaagaggaagcagggcucau

SEQ ID NO: 1055128 - RNA, 22 nt, Human
ucuauaaagggccagauaguag

SEQ ID NO: 1055129 - RNA, 22 nt, Human
ugacagaaauaguucuuaauuu

SEQ ID NO: 1055130 - RNA, 22 nt, Human
cugcuguggguuaagacacugu

SEQ ID NO: 1055131 - RNA, 22 nt, Human
uugaacuguaagcaugucugcc

SEQ ID NO: 1055132 - RNA, 22 nt, Human
aggcugagcugaccugguuugg

SEQ ID NO: 1055133 - RNA, 22 nt, Human
auuaucuauguagaaugauuuu

SEQ ID NO: 1055134 - RNA, 22 nt, Human
agccacagucugaugccugaga

SEQ ID NO: 1055135 - RNA, 22 nt, Human
guuguuuugcaggauccuuaca

SEQ ID NO: 1055136 - RNA, 22 nt, Human
cugagccuguguuucucuggca

SEQ ID NO: 1055137 - RNA, 22 nt, Human
uugcaaaggggaauaaagcaau

SEQ ID NO: 1055138 - RNA, 22 nt, Human
aucuuucaaucaggaaaaaucu

SEQ ID NO: 1055139 - RNA, 22 nt, Human
uugauuaaacaggcauauucaa

SEQ ID NO: 1055140 - RNA, 20 nt, Human
cugcuguguuauuguagaac

SEQ ID NO: 1055141 - RNA, 22 nt, Human
aggcagcugaggucuggcgccc

SEQ ID NO: 1055142 - RNA, 22 nt, Human
cagaggucaagaucugaaguga

SEQ ID NO: 1055143 - RNA, 22 nt, Human
gcugagaggcagccagacccuc

SEQ ID NO: 1055144 - RNA, 22 nt, Human
gcuggccagcccucuuccucca

SEQ ID NO: 1055145 - RNA, 22 nt, Human
gcccaggaguugguggcugcag

SEQ ID NO: 1055146 - RNA, 22 nt, Human
ggcugcugguagggguaggaag

SEQ ID NO: 1055147 - RNA, 22 nt, Human
caagauggguguugugaugguu

SEQ ID NO: 1055148 - RNA, 22 nt, Human
gagucuuugguaaagucugcug

SEQ ID NO: 1055149 - RNA, 22 nt, Human
aucaggauggguuuggcuuagg

SEQ ID NO: 1055150 - RNA, 22 nt, Human
ucagguccagcuccugugccuc

SEQ ID NO: 1055151 - RNA, 22 nt, Human
ugcugaggaauaauuguuccug

SEQ ID NO: 1055152 - RNA, 22 nt, Human
gaaggccacuuuguguugagaa

SEQ ID NO: 1055153 - RNA, 22 nt, Human
agcggcuggaccagcguucaag

SEQ ID NO: 1055154 - RNA, 22 nt, Human
caaaugaauauuuccauggguu

SEQ ID NO: 1055155 - RNA, 22 nt, Human
cuugcacacauguacaugugua

SEQ ID NO: 1055156 - RNA, 19 nt, Human
acuggcaguuucugcaugg

SEQ ID NO: 1055157 - RNA, 22 nt, Human
acaggcugcugagccauuugcu

SEQ ID NO: 1055158 - RNA, 22 nt, Human
gaggcagccucaguggaccucg

SEQ ID NO: 1055159 - RNA, 22 nt, Human
auaaauaucacuguugucccuc

SEQ ID NO: 1055160 - RNA, 22 nt, Human
cauuuccacuucugaaaacugg

SEQ ID NO: 1055161 - RNA, 22 nt, Human
aaaggccacacugcucuuucuc

SEQ ID NO: 1055162 - RNA, 22 nt, Human
cuucugaggcagcuauucaguu

SEQ ID NO: 1055163 - RNA, 17 nt, Human
cccagggaccacugcuu

SEQ ID NO: 1055164 - RNA, 22 nt, Human
ugggucagaaucagagaguugc

SEQ ID NO: 1055165 - RNA, 22 nt, Human
aaguugagaugucauaggagac

SEQ ID NO: 1055166 - RNA, 22 nt, Human
ucuaaccuuugaaacugcuuuc

SEQ ID NO: 1055167 - RNA, 22 nt, Human
ggacagcucugccaggagcuca

SEQ ID NO: 1055168 - RNA, 22 nt, Human
ucuccuggaagugauuccccug

SEQ ID NO: 1055169 - RNA, 22 nt, Human
ugucaaauuuuuauugcaguau

SEQ ID NO: 1055170 - RNA, 22 nt, Human
aguaacaugaguuuuucuaaug

SEQ ID NO: 1055171 - RNA, 22 nt, Human
gcucuggguucugauuuaugag

SEQ ID NO: 1055172 - RNA, 22 nt, Human
aacugcuuaucuuugguagaug

SEQ ID NO: 1055173 - RNA, 22 nt, Human
uuucacuagaacguucuuguuu

SEQ ID NO: 1055174 - RNA, 22 nt, Human
guaucacuuuugagagugagaa

SEQ ID NO: 1055175 - RNA, 22 nt, Human
gcuccuggcauccugcuuuuaa

SEQ ID NO: 1055176 - RNA, 22 nt, Human
cccaggagguggagguugcagc

SEQ ID NO: 1055177 - RNA, 20 nt, Human
ucauuguguugccaauuccc

SEQ ID NO: 1055178 - RNA, 22 nt, Human
uggcaggcagugugggagcugg

SEQ ID NO: 1055179 - RNA, 22 nt, Human
ccuccuggauggauuuggugga

SEQ ID NO: 1055180 - RNA, 22 nt, Human
ccuggcugguugucugauucua

SEQ ID NO: 1055181 - RNA, 22 nt, Human
cugccugcaucccacagugggg

SEQ ID NO: 1055182 - RNA, 22 nt, Human
cccaggugcugcgugaagccuc

SEQ ID NO: 1055183 - RNA, 19 nt, Human
ucugccucuggucaggcuc

SEQ ID NO: 1055184 - RNA, 22 nt, Human
uggagacugugcuaagggaguu

SEQ ID NO: 1055185 - RNA, 22 nt, Human
cuguggaaauaaacaaugcuaa

SEQ ID NO: 1055186 - RNA, 22 nt, Human
ucucugcccauccucaguccac

SEQ ID NO: 1055187 - RNA, 22 nt, Human
aagcagaguccccuucccaugg

SEQ ID NO: 1055188 - RNA, 19 nt, Human
uccaggaggcugccauuga

SEQ ID NO: 1055189 - RNA, 22 nt, Human
uucaggauggaguaccuuuuau

SEQ ID NO: 1055190 - RNA, 22 nt, Human
gcccaggauggcuggaggugcu

SEQ ID NO: 1055191 - RNA, 17 nt, Human
auuagguuuugucauga

SEQ ID NO: 1055192 - RNA, 22 nt, Human
caagauuaucuucuucuuguua

SEQ ID NO: 1055193 - RNA, 22 nt, Human
cuucuucaguugcauguauugg

SEQ ID NO: 1055194 - RNA, 22 nt, Human
ggaagaggcugagccagguccc

SEQ ID NO: 1055195 - RNA, 22 nt, Human
ggcagucaagagggagucugaa

SEQ ID NO: 1055196 - RNA, 17 nt, Human
ccaggagagaugcuugu

SEQ ID NO: 1055197 - RNA, 22 nt, Human
aaguuacaguuaugaaacucac

SEQ ID NO: 1055198 - RNA, 22 nt, Human
ugagugcucuguaugugccaga

SEQ ID NO: 1055199 - RNA, 22 nt, Human
ccucaggggucacugugaggag

SEQ ID NO: 1055200 - RNA, 22 nt, Human
cugcugugcagacagacucucu

SEQ ID NO: 1055201 - RNA, 22 nt, Human
aagagggcagcacagguggguc

SEQ ID NO: 1055202 - RNA, 22 nt, Human
caggcagcugcuggguucagcc

SEQ ID NO: 1055203 - RNA, 22 nt, Human
uaacugccuacugugcaaauau

SEQ ID NO: 1055204 - RNA, 22 nt, Human
aagaacugguuauguuaucuug

SEQ ID NO: 1055205 - RNA, 22 nt, Human
accaggaguaacagugaguggu

SEQ ID NO: 1055206 - RNA, 22 nt, Human
uacuaaauaguuuaauuccuca

SEQ ID NO: 1055207 - RNA, 22 nt, Human
aggcagcagugauaagauagga

SEQ ID NO: 1055208 - RNA, 19 nt, Human
aguggcagaucuggaagua

SEQ ID NO: 1055209 - RNA, 22 nt, Human
agcugagguuaguauaaaugug

SEQ ID NO: 1055210 - RNA, 22 nt, Human
acuugcugguggcauuuacagu

SEQ ID NO: 1055211 - RNA, 23 nt, Human
auucuucauuaucuucuagaaaa

SEQ ID NO: 1055212 - RNA, 22 nt, Human
aguaaacagaaagcaagaugau

SEQ ID NO: 1055213 - RNA, 22 nt, Human
gcaggagagucugugccagguu

SEQ ID NO: 1055214 - RNA, 22 nt, Human
uaugaaacauucauacaaauaa

SEQ ID NO: 1055215 - RNA, 22 nt, Human
ucauuuguucaucugcucuucu

SEQ ID NO: 1055216 - RNA, 22 nt, Human
ugcugcuguuuccuacaucuca

SEQ ID NO: 1055217 - RNA, 22 nt, Human
uuuccuaguucuaagaaaugua

SEQ ID NO: 1055218 - RNA, 22 nt, Human
cagaaggcuuuguggaguagac

SEQ ID NO: 1055219 - RNA, 22 nt, Human
aagggcugccagggggugccag

SEQ ID NO: 1055220 - RNA, 19 nt, Human
caggaaggggcgaaucugg

SEQ ID NO: 1055221 - RNA, 22 nt, Human
augaggucuggcaaucagaaac

SEQ ID NO: 1055222 - RNA, 22 nt, Human
cggagggguuugaacagaggag

SEQ ID NO: 1055223 - RNA, 22 nt, Human
auuuauuaugggauuuggcuca

SEQ ID NO: 1055224 - RNA, 22 nt, Human
caaaugaaguccaaagggcuua

SEQ ID NO: 1055225 - RNA, 22 nt, Human
uuucauuuugguuaugccauaa

SEQ ID NO: 1055226 - RNA, 22 nt, Human
uucaggauucugugucugacaa

SEQ ID NO: 1055227 - RNA, 22 nt, Human
ugaguucuaguggcugcagauu

SEQ ID NO: 1055228 - RNA, 22 nt, Human
cccaaggaagacgcuugugaua

SEQ ID NO: 1055229 - RNA, 22 nt, Human
uggcugagggcacuaugaagcc

SEQ ID NO: 1055230 - RNA, 20 nt, Human
aagggcagagggaacagacu

SEQ ID NO: 1055231 - RNA, 22 nt, Human
ucugaaggugcuagagaaagcu

SEQ ID NO: 1055232 - RNA, 22 nt, Human
cuacccagagugaaucucuuaa

SEQ ID NO: 1055233 - RNA, 22 nt, Human
aagggcugaaagaccuugggca

SEQ ID NO: 1055234 - RNA, 22 nt, Human
aguguaggguggucagagcaga

SEQ ID NO: 1055235 - RNA, 22 nt, Human
uugcuuuguggugguucuucca

SEQ ID NO: 1055236 - RNA, 22 nt, Human
uuacaguuuaguccaagccaga

SEQ ID NO: 1055237 - RNA, 22 nt, Human
guggccaauuuccaucuguaag

SEQ ID NO: 1055238 - RNA, 21 nt, Human
aagaaguuuggauuuuguccu

SEQ ID NO: 1055239 - RNA, 22 nt, Human
uuucuucucgacaccuuauccc

SEQ ID NO: 1055240 - RNA, 19 nt, Human
cucucacucgccacauccu

SEQ ID NO: 1055241 - RNA, 22 nt, Human
gauuucuucauuuguggugaau

SEQ ID NO: 1055242 - RNA, 20 nt, Human
uccaggagaacugggagccg

SEQ ID NO: 1055243 - RNA, 20 nt, Human
gcucagggccugggucugga

SEQ ID NO: 1055244 - RNA, 22 nt, Human
auucuucauaccuacugagguu

SEQ ID NO: 1055245 - RNA, 22 nt, Human
ucaggcugaggucaucugcauc

SEQ ID NO: 1055246 - RNA, 22 nt, Human
ggaggccagggacccagucagc

SEQ ID NO: 1055247 - RNA, 22 nt, Human
uuugaaaggugucgagaugugu

SEQ ID NO: 1055248 - RNA, 22 nt, Human
auuccaaagguuaaugcccauu

SEQ ID NO: 1055249 - RNA, 22 nt, Human
acaacauuauacauagaaagcu

SEQ ID NO: 1055250 - RNA, 22 nt, Human
aaaauugaagugaucaggaacu

SEQ ID NO: 1055251 - RNA, 18 nt, Human
uugcuuuguaagcuugca

SEQ ID NO: 1055252 - RNA, 22 nt, Human
cucccaggacucagaggagaag

SEQ ID NO: 1055253 - RNA, 22 nt, Human
caggcagcccugcaccaagugu

SEQ ID NO: 1055254 - RNA, 22 nt, Human
cuuagaaaugcagauucucagg

SEQ ID NO: 1055255 - RNA, 20 nt, Human
aggaaaaauggaaacuggag

SEQ ID NO: 1055256 - RNA, 22 nt, Human
uggcugaguuccuggcacacgg

SEQ ID NO: 1055257 - RNA, 22 nt, Human
aucuagguuuggaagauagagu

SEQ ID NO: 1055258 - RNA, 22 nt, Human
gaggagagagggacugucugca

SEQ ID NO: 1055259 - RNA, 22 nt, Human
aggagaggcaucaagaaaaucg

SEQ ID NO: 1055260 - RNA, 22 nt, Human
uuugaauaucacaaacuuucaa

SEQ ID NO: 1055261 - RNA, 22 nt, Human
aggcagcaugggccccagcucc

SEQ ID NO: 1055262 - RNA, 21 nt, Human
aggaggggucuuucccacuga

SEQ ID NO: 1055263 - RNA, 22 nt, Human
ggcagccagagggcagcuggau

SEQ ID NO: 1055264 - RNA, 22 nt, Human
uuugaaagagcugauacaugaa

SEQ ID NO: 1055265 - RNA, 22 nt, Human
cugcuucacguugugccuuguu

SEQ ID NO: 1055266 - RNA, 22 nt, Human
acugaaguccacacauguagga

SEQ ID NO: 1055267 - RNA, 19 nt, Human
uggggcuguguuuugaccc

SEQ ID NO: 1055268 - RNA, 22 nt, Human
gccuggcucccucugcagcucc

SEQ ID NO: 1055269 - RNA, 21 nt, Human
ccauaccuaccucaccugguu

SEQ ID NO: 1055270 - RNA, 22 nt, Human
cucacuguccaacaggcuuuac

SEQ ID NO: 1055271 - RNA, 22 nt, Human
cuaauacacccuauugcuuguu

SEQ ID NO: 1055272 - RNA, 22 nt, Human
guagauaaggauugauuuuuau

SEQ ID NO: 1055273 - RNA, 19 nt, Human
ugugaaagcuaguguucuu

SEQ ID NO: 1055274 - RNA, 22 nt, Human
uccucuccaugucucacgccac

SEQ ID NO: 1055275 - RNA, 22 nt, Human
uccaccaggcuccauguucagu

SEQ ID NO: 1055276 - RNA, 22 nt, Human
gaucuucucuuuaguagaaaca

SEQ ID NO: 1055277 - RNA, 22 nt, Human
ugguccaagugagguggccucu

SEQ ID NO: 1055278 - RNA, 17 nt, Human
uccaugagacaugaaga

SEQ ID NO: 1055279 - RNA, 22 nt, Human
ggcagcauauauucagugggca

SEQ ID NO: 1055280 - RNA, 22 nt, Human
gaaugaaagauuugcauucuau

SEQ ID NO: 1055281 - RNA, 22 nt, Human
ggcuuggaccagucacaguggu

SEQ ID NO: 1055282 - RNA, 22 nt, Human
cccaggagguuggggcuacagu

SEQ ID NO: 1055283 - RNA, 22 nt, Human
uccccacacagauacagaguag

SEQ ID NO: 1055284 - RNA, 18 nt, Human
agggaguuuuagggaagg

SEQ ID NO: 1055285 - RNA, 22 nt, Human
agcagcauuaugauauaucuua

SEQ ID NO: 1055286 - RNA, 22 nt, Human
cuguguuugaugagaagccacc

SEQ ID NO: 1055287 - RNA, 22 nt, Human
aggauuuguuuauaggucuuaa

SEQ ID NO: 1055288 - RNA, 22 nt, Human
uauuauuaaauggcagaauuuu

SEQ ID NO: 1055289 - RNA, 22 nt, Human
cauuguuaccaucuuuuaccua

SEQ ID NO: 1055290 - RNA, 22 nt, Human
ugagacaguuuuucuauuucca

SEQ ID NO: 1055291 - RNA, 22 nt, Human
uuacuuuggguccugcuuauaa

SEQ ID NO: 1055292 - RNA, 22 nt, Human
uccaaauauucggucuuucuga

SEQ ID NO: 1055293 - RNA, 22 nt, Human
aagauggaguaguguaaugguu

SEQ ID NO: 1055294 - RNA, 22 nt, Human
cauuugcagagggugacacucu

SEQ ID NO: 1055295 - RNA, 21 nt, Human
gccaggaguagauuacauuua

SEQ ID NO: 1055296 - RNA, 22 nt, Human
gacacuuuggugcuuugugguu

SEQ ID NO: 1055297 - RNA, 22 nt, Human
agggagcuaggauccugaaggu

SEQ ID NO: 1055298 - RNA, 22 nt, Human
aaggcaguaaaaucuaccuugc

SEQ ID NO: 1055299 - RNA, 22 nt, Human
gcuccuggguguggcugccccu

SEQ ID NO: 1055300 - RNA, 22 nt, Human
ccugagguggcugcagcacugc

SEQ ID NO: 1055301 - RNA, 23 nt, Human
caguuggagguacagagacacug

SEQ ID NO: 1055302 - RNA, 22 nt, Human
guguguuucagaagccaggugu

SEQ ID NO: 1055303 - RNA, 23 nt, Human
ucguugaauagcaauagcacaac

SEQ ID NO: 1055304 - RNA, 22 nt, Human
ccaggcugugcuuuucauaaau

SEQ ID NO: 1055305 - RNA, 22 nt, Human
ccacagugggcacagcaggacu

SEQ ID NO: 1055306 - RNA, 21 nt, Human
aauuacagauggaauuacaga

SEQ ID NO: 1055307 - RNA, 22 nt, Human
ggcugcagagcugggugggccu

SEQ ID NO: 1055308 - RNA, 22 nt, Human
aaaaguuaccucuguaauauaa

SEQ ID NO: 1055309 - RNA, 22 nt, Human
uggcucagaaggcugccuucac

SEQ ID NO: 1055310 - RNA, 22 nt, Human
uuggccaagucacugguuaaug

SEQ ID NO: 1055311 - RNA, 23 nt, Human
uagugucaagagggaguguaauu

SEQ ID NO: 1055312 - RNA, 22 nt, Human
aggcagcaugggcccagagucc

SEQ ID NO: 1055313 - RNA, 22 nt, Human
auuaaauuuucacuaggcuccc

SEQ ID NO: 1055314 - RNA, 21 nt, Human
agucugagguggggccuagga

SEQ ID NO: 1055315 - RNA, 22 nt, Human
agcccaggcagagggaugcuug

SEQ ID NO: 1055316 - RNA, 22 nt, Human
guaguucugcagugucaccuga

SEQ ID NO: 1055317 - RNA, 22 nt, Human
ugcauaguucuccuuccuccuc

SEQ ID NO: 1055318 - RNA, 19 nt, Human
ugaggggcucacagucuca

SEQ ID NO: 1055319 - RNA, 22 nt, Human
ccauggcuuacagauggagcau

SEQ ID NO: 1055320 - RNA, 20 nt, Human
guaaaauauggucuuugggu

SEQ ID NO: 1055321 - RNA, 22 nt, Human
auuauuagacuuauaugguagu

SEQ ID NO: 1055322 - RNA, 22 nt, Human
gcaggagacaacuguaaggaga

SEQ ID NO: 1055323 - RNA, 22 nt, Human
gcccaggaguucaaggcugcag

SEQ ID NO: 1055324 - RNA, 22 nt, Human
cucaguuuccucaacugcaaaa

SEQ ID NO: 1055325 - RNA, 22 nt, Human
cagaggcagugggguugcuccu

SEQ ID NO: 1055326 - RNA, 22 nt, Human
agucucagaaaagaagcaugga

SEQ ID NO: 1055327 - RNA, 22 nt, Human
cagcuucugcuaucgaacaucu

SEQ ID NO: 1055328 - RNA, 22 nt, Human
agcaugcgcuugaucagcucca

SEQ ID NO: 1055329 - RNA, 20 nt, Human
uaggcagagcugugcagccu

SEQ ID NO: 1055330 - RNA, 22 nt, Human
ucuggccagcaugagaccuggu

SEQ ID NO: 1055331 - RNA, 22 nt, Human
cuuuggcacagucucauuugau

SEQ ID NO: 1055332 - RNA, 22 nt, Human
cacucaggguacaauggagggc

SEQ ID NO: 1055333 - RNA, 22 nt, Human
cugaaugaggaaaagagugagg

SEQ ID NO: 1055334 - RNA, 22 nt, Human
cccaggaggcagagguugcagu

SEQ ID NO: 1055335 - RNA, 20 nt, Human
gcugcucgcugcagucacuc

SEQ ID NO: 1055336 - RNA, 22 nt, Human
cugccuucaucucugagcuggg

SEQ ID NO: 1055337 - RNA, 22 nt, Human
uucuucuccgaggagggcuggu

SEQ ID NO: 1055338 - RNA, 22 nt, Human
cuggguaaguuccuaaggcuca

SEQ ID NO: 1055339 - RNA, 22 nt, Human
ugccuggauucgguuguuguca

SEQ ID NO: 1055340 - RNA, 22 nt, Human
gcugccuuaugucuauuaguau

SEQ ID NO: 1055341 - RNA, 22 nt, Human
agcugguaaaggggaaagcaga

SEQ ID NO: 1055342 - RNA, 22 nt, Human
acuguagcugccacuggaugca

SEQ ID NO: 1055343 - RNA, 22 nt, Human
uaggauuuggcuuuagucaggu

SEQ ID NO: 1055344 - RNA, 22 nt, Human
cccagggacagaugggcagcua

SEQ ID NO: 1055345 - RNA, 22 nt, Human
cuguaacuuaaugagaggcaga

SEQ ID NO: 1055346 - RNA, 22 nt, Human
cagaaguuccuauuuaccuccu

SEQ ID NO: 1055347 - RNA, 22 nt, Human
ucaggcugguggucagauggcu

SEQ ID NO: 1055348 - RNA, 22 nt, Human
aguacauauaguaauuuagcca

SEQ ID NO: 1055349 - RNA, 22 nt, Human
gaaaggcaguacagcugagccu

SEQ ID NO: 1055350 - RNA, 22 nt, Human
caaauacugaguuuauuuucaa

SEQ ID NO: 1055351 - RNA, 22 nt, Human
uuagccauggacugaauugacu

SEQ ID NO: 1055352 - RNA, 22 nt, Human
cagggaggcugucuuaugccug

SEQ ID NO: 1055353 - RNA, 22 nt, Human
cuugggaaugcuaacagaugac

SEQ ID NO: 1055354 - RNA, 22 nt, Human
cagccuuuuccauguauuguug

SEQ ID NO: 1055355 - RNA, 22 nt, Human
gaugccuccaaaugagggcaga

SEQ ID NO: 1055356 - RNA, 22 nt, Human
gagcaggcauucuaguggcuga

SEQ ID NO: 1055357 - RNA, 22 nt, Human
aauagcucacugauuucucuuu

SEQ ID NO: 1055358 - RNA, 19 nt, Human
cugaggcccauguaccaug

SEQ ID NO: 1055359 - RNA, 22 nt, Human
ucuuggcuguaccauugacuag

SEQ ID NO: 1055360 - RNA, 22 nt, Human
uauaucaccaaaaacaguucug

SEQ ID NO: 1055361 - RNA, 22 nt, Human
uuggccaagugguuaaucucca

SEQ ID NO: 1055362 - RNA, 22 nt, Human
uucauugugaacacauucugcc

SEQ ID NO: 1055363 - RNA, 22 nt, Human
agguaaacaggagaaaaugaga

SEQ ID NO: 1055364 - RNA, 22 nt, Human
ugcauggaggaagaugaaugca

SEQ ID NO: 1055365 - RNA, 22 nt, Human
ccuggcugugugaccuuggcaa

SEQ ID NO: 1055366 - RNA, 22 nt, Human
cucaggaugaaagucaugguga

SEQ ID NO: 1055367 - RNA, 22 nt, Human
uaaaacugcuugguauggucua

SEQ ID NO: 1055368 - RNA, 22 nt, Human
acugaggucuaucaugagccag

SEQ ID NO: 1055369 - RNA, 22 nt, Human
uccccucccuuccaacagagcu

SEQ ID NO: 1055370 - RNA, 22 nt, Human
uagcccagaagagggaagcaac

SEQ ID NO: 1055371 - RNA, 18 nt, Human
auaaagugcuaauaaugg

SEQ ID NO: 1055372 - RNA, 22 nt, Human
gaggcccacagggaguaccaag

SEQ ID NO: 1055373 - RNA, 22 nt, Human
cugcugugagcacuccagccug

SEQ ID NO: 1055374 - RNA, 22 nt, Human
ucuccugggaggacaaggaagg

SEQ ID NO: 1055375 - RNA, 22 nt, Human
aaggcugacguuuguguuuauu

SEQ ID NO: 1055376 - RNA, 17 nt, Human
gagacagcaggagcccc

SEQ ID NO: 1055377 - RNA, 22 nt, Human
accuacauguuccacauaguug

SEQ ID NO: 1055378 - RNA, 22 nt, Human
ucuacuguagugaugcugcagu

SEQ ID NO: 1055379 - RNA, 22 nt, Human
aguagugaacagccacaggauu

SEQ ID NO: 1055380 - RNA, 22 nt, Human
guucuucagauuccauuucagu

SEQ ID NO: 1055381 - RNA, 22 nt, Human
aagccgaggccacacagcagga

SEQ ID NO: 1055382 - RNA, 17 nt, Human
cagacaggcugucaccc

SEQ ID NO: 1055383 - RNA, 22 nt, Human
uggagcugggguuugaaucugg

SEQ ID NO: 1055384 - RNA, 23 nt, Human
aguaaagcaauuguuggcgagag

SEQ ID NO: 1055385 - RNA, 22 nt, Human
ucuuuggaucccaacuggcugg

SEQ ID NO: 1055386 - RNA, 22 nt, Human
gggcugagcacauacugacagc

SEQ ID NO: 1055387 - RNA, 22 nt, Human
uacacuuucguuuguggauuag

SEQ ID NO: 1055388 - RNA, 22 nt, Human
ggccaggagcugcacagggcuc

SEQ ID NO: 1055389 - RNA, 22 nt, Human
uagcaagacaacuuuucucagu

SEQ ID NO: 1055390 - RNA, 22 nt, Human
cuuuaaauaauacaagguccag

SEQ ID NO: 1055391 - RNA, 22 nt, Human
ggcagccaggaggguguaguuu

SEQ ID NO: 1055392 - RNA, 22 nt, Human
cagcuaauccucucuauccaag

SEQ ID NO: 1055393 - RNA, 22 nt, Human
uuaaauauuuucagcaggguca

SEQ ID NO: 1055394 - RNA, 22 nt, Human
gggcagcugcagggauggugac

SEQ ID NO: 1055395 - RNA, 22 nt, Human
cugggccagggaggugucugua

SEQ ID NO: 1055396 - RNA, 22 nt, Human
gaagccuugaacugcaaacccc

SEQ ID NO: 1055397 - RNA, 22 nt, Human
agacagagauacuauguuguca

SEQ ID NO: 1055398 - RNA, 22 nt, Human
ucccuccccacuucugagcuuu

SEQ ID NO: 1055399 - RNA, 22 nt, Human
ggcuuugccuggaauuuccuug

SEQ ID NO: 1055400 - RNA, 22 nt, Human
cccugguggggccagacuugcu

SEQ ID NO: 1055401 - RNA, 22 nt, Human
aguuagaauggauguugagagc

SEQ ID NO: 1055402 - RNA, 22 nt, Human
aggguagggccguagggccaug

SEQ ID NO: 1055403 - RNA, 22 nt, Human
auguuucaaugcacuuuagccu

SEQ ID NO: 1055404 - RNA, 22 nt, Human
uacaucauaauaauacuuagaa

SEQ ID NO: 1055405 - RNA, 22 nt, Human
caggauggagaguuguugguug

SEQ ID NO: 1055406 - RNA, 20 nt, Human
uuuacauuuugaaacaguga

SEQ ID NO: 1055407 - RNA, 22 nt, Human
gagggcugcuggaaaaaugcag

SEQ ID NO: 1055408 - RNA, 22 nt, Human
cuccuggaccagggcuauuggg

SEQ ID NO: 1055409 - RNA, 22 nt, Human
ggcaagcucaggccucaggugu

SEQ ID NO: 1055410 - RNA, 22 nt, Human
aagggcuggcccugggaagagu

SEQ ID NO: 1055411 - RNA, 22 nt, Human
gacauuuauuagaaaacuauca

SEQ ID NO: 1055412 - RNA, 22 nt, Human
aggaagcuaaccagggagugag

SEQ ID NO: 1055413 - RNA, 22 nt, Human
aagcaauagcaacaacuuuaca

SEQ ID NO: 1055414 - RNA, 22 nt, Human
cagagagggcggcccuggcuuc

SEQ ID NO: 1055415 - RNA, 22 nt, Human
caggguggggaaauagcgcccu

SEQ ID NO: 1055416 - RNA, 22 nt, Human
uauuggaugauucacuuggcag

SEQ ID NO: 1055417 - RNA, 22 nt, Human
gcuuugaagucugugucuuuug

SEQ ID NO: 1055418 - RNA, 22 nt, Human
uggcagcuguguccagguagaa

SEQ ID NO: 1055419 - RNA, 22 nt, Human
ucauuugugugagugauuugac

SEQ ID NO: 1055420 - RNA, 17 nt, Human
aggcagcucagaacauc

SEQ ID NO: 1055421 - RNA, 22 nt, Human
ugccaggauauaagagugcgau

SEQ ID NO: 1055422 - RNA, 22 nt, Human
ccaggaugacccccacuuuccu

SEQ ID NO: 1055423 - RNA, 22 nt, Human
acauuuaaauaccuauguuucu

SEQ ID NO: 1055424 - RNA, 22 nt, Human
augaacagcauugaaauccagc

SEQ ID NO: 1055425 - RNA, 22 nt, Human
ucugaaagaagggcagucuuuu

SEQ ID NO: 1055426 - RNA, 22 nt, Human
ggagggacccacucuagaggug

SEQ ID NO: 1055427 - RNA, 22 nt, Human
gaaaacuuggaucucuagaaug

SEQ ID NO: 1055428 - RNA, 22 nt, Human
gcucagagcuugaaguuccacu

SEQ ID NO: 1055429 - RNA, 22 nt, Human
cccaggaacagggcucagaccc

SEQ ID NO: 1055430 - RNA, 23 nt, Human
cccaggaguuucacugcaaaggu

SEQ ID NO: 1055431 - RNA, 20 nt, Human
ccuggcugcauucaggacgg

SEQ ID NO: 1055432 - RNA, 22 nt, Human
augcugagauaaggcuuuaguc

SEQ ID NO: 1055433 - RNA, 16 nt, Human
gucuggccuaccugcc

SEQ ID NO: 1055434 - RNA, 22 nt, Human
gcaggcugcugagauccuuagg

SEQ ID NO: 1055435 - RNA, 22 nt, Human
ccagagcuugacgugcaacgga

SEQ ID NO: 1055436 - RNA, 22 nt, Human
cagagggcacaugguuuccuca

SEQ ID NO: 1055437 - RNA, 22 nt, Human
auuuuacuuugugaauauugac

SEQ ID NO: 1055438 - RNA, 22 nt, Human
aggcagcauccagaggagaaug

SEQ ID NO: 1055439 - RNA, 22 nt, Human
uugaaaguagcagcugcauaug

SEQ ID NO: 1055440 - RNA, 22 nt, Human
agaggagguccuuuucugaugu

SEQ ID NO: 1055441 - RNA, 22 nt, Human
ccacagugaguucuguacucug

SEQ ID NO: 1055442 - RNA, 22 nt, Human
uccuucuuugacaaguggcaga

SEQ ID NO: 1055443 - RNA, 22 nt, Human
gucaggauuggggucaugaguc

SEQ ID NO: 1055444 - RNA, 22 nt, Human
gcugaaugaauguauuuuaaaa

SEQ ID NO: 1055445 - RNA, 22 nt, Human
gacccaggaagcuacuucuggu

SEQ ID NO: 1055446 - RNA, 22 nt, Human
cugacuguaauucuguucuuaa

SEQ ID NO: 1055447 - RNA, 22 nt, Human
agacaggcagaggcugcagagg

SEQ ID NO: 1055448 - RNA, 22 nt, Human
agcuagaauguuccuuuucauu

SEQ ID NO: 1055449 - RNA, 22 nt, Human
uuuggaaaguugucacuuuaga

SEQ ID NO: 1055450 - RNA, 19 nt, Human
uaaggccaaaaguaagugu

SEQ ID NO: 1055451 - RNA, 22 nt, Human
gucaggauguuuauucuccagu

SEQ ID NO: 1055452 - RNA, 22 nt, Human
cagagcuguccaaacccugaca

SEQ ID NO: 1055453 - RNA, 22 nt, Human
aggcugagguaggaggaucgcu

SEQ ID NO: 1055454 - RNA, 22 nt, Human
cccuggagguggagguugcagg

SEQ ID NO: 1055455 - RNA, 22 nt, Human
agcaagaugcauuauuucuuau

SEQ ID NO: 1055456 - RNA, 22 nt, Human
ggagagaaucugaaccugcucc

SEQ ID NO: 1055457 - RNA, 22 nt, Human
auaguuugaaggcuguucuacu

SEQ ID NO: 1055458 - RNA, 22 nt, Human
cugagauggccacugggucuca

SEQ ID NO: 1055459 - RNA, 22 nt, Human
cagcaagauggugaaugagacg

SEQ ID NO: 1055460 - RNA, 22 nt, Human
cuugcuggugguguuuucuaug

SEQ ID NO: 1055461 - RNA, 22 nt, Human
uucagaaugugaccuuauuugg

SEQ ID NO: 1055462 - RNA, 22 nt, Human
cugagccagcuggcaugugcua

SEQ ID NO: 1055463 - RNA, 22 nt, Human
ccuccugggagagcacggaggg

SEQ ID NO: 1055464 - RNA, 22 nt, Human
aaaggcaggcuuucacaucuca

SEQ ID NO: 1055465 - RNA, 22 nt, Human
uauuucuucgggauucaagcua

SEQ ID NO: 1055466 - RNA, 22 nt, Human
guaggcagauaggagugcagcc

SEQ ID NO: 1055467 - RNA, 22 nt, Human
uggucaacaggcagggaugaaa

SEQ ID NO: 1055468 - RNA, 22 nt, Human
ugaagggggagauauaugugug

SEQ ID NO: 1055469 - RNA, 22 nt, Human
caggcagcugacugucagauau

SEQ ID NO: 1055470 - RNA, 22 nt, Human
aaucuucuacuugacaguucuc

SEQ ID NO: 1055471 - RNA, 18 nt, Human
cagggcuguggggucacu

SEQ ID NO: 1055472 - RNA, 22 nt, Human
gcagacagggcuacagagguac

SEQ ID NO: 1055473 - RNA, 22 nt, Human
ucccaggaaugucugaaaguga

SEQ ID NO: 1055474 - RNA, 22 nt, Human
ggcugagacaaccugggaccca

SEQ ID NO: 1055475 - RNA, 23 nt, Human
aggcgagcucuucuccagcacgu

SEQ ID NO: 1055476 - RNA, 22 nt, Human
auggccaagaucacagacuuca

SEQ ID NO: 1055477 - RNA, 22 nt, Human
aagagaggacauggugaaccug

SEQ ID NO: 1055478 - RNA, 22 nt, Human
uggcuucucaguuucauaauga

SEQ ID NO: 1055479 - RNA, 22 nt, Human
gcauguguggaggagaugugcu

SEQ ID NO: 1055480 - RNA, 22 nt, Human
ucaacugcaaguuugcuuaguu

SEQ ID NO: 1055481 - RNA, 22 nt, Human
acaggagacccugcugguucug

SEQ ID NO: 1055482 - RNA, 22 nt, Human
uucagggagagcgggacgggug

SEQ ID NO: 1055483 - RNA, 22 nt, Human
cuggcugaggcagagccugggg

SEQ ID NO: 1055484 - RNA, 22 nt, Human
cauuuguaucugggcugcugug

SEQ ID NO: 1055485 - RNA, 22 nt, Human
uagaaaguagccacuuacagag

SEQ ID NO: 1055486 - RNA, 22 nt, Human
ucugaggucacagauuucaaga

SEQ ID NO: 1055487 - RNA, 22 nt, Human
ggaggcagaacuucccgucagu

SEQ ID NO: 1055488 - RNA, 22 nt, Human
gacccaggguauccagagcugc

SEQ ID NO: 1055489 - RNA, 22 nt, Human
ucugcuguaaagaauuucugcc

SEQ ID NO: 1055490 - RNA, 22 nt, Human
aggaugagagauacauggagca

SEQ ID NO: 1055491 - RNA, 22 nt, Human
cacauuuaauccuuuauaagua

SEQ ID NO: 1055492 - RNA, 23 nt, Human
uuugaaaguaucaacucgccuga

SEQ ID NO: 1055493 - RNA, 18 nt, Human
aacaugcauuagaacugc

SEQ ID NO: 1055494 - RNA, 18 nt, Human
agaggggagguaagucug

SEQ ID NO: 1055495 - RNA, 22 nt, Human
uuugaaguguuauuucuaucac

SEQ ID NO: 1055496 - RNA, 22 nt, Human
uggcuacaaguguguuuaguuu

SEQ ID NO: 1055497 - RNA, 22 nt, Human
aaagccaugggucuuuggcaua

SEQ ID NO: 1055498 - RNA, 22 nt, Human
ggcaugcucuuuguccacagua

SEQ ID NO: 1055499 - RNA, 21 nt, Human
auacauucuauuaagcauuua

SEQ ID NO: 1055500 - RNA, 22 nt, Human
cugaggucuauuuugaaacugc

SEQ ID NO: 1055501 - RNA, 22 nt, Human
uaucuaaauggaauauuccaga

SEQ ID NO: 1055502 - RNA, 22 nt, Human
uaaauuguuuucuagaaguugu

SEQ ID NO: 1055503 - RNA, 22 nt, Human
ucacacagguuugcaaugauuu

SEQ ID NO: 1055504 - RNA, 22 nt, Human
gugguuuucuccaacccagaac

SEQ ID NO: 1055505 - RNA, 22 nt, Human
gcuggcugcacaggggcucacu

SEQ ID NO: 1055506 - RNA, 22 nt, Human
gaucuguuauaaucucuuuuau

SEQ ID NO: 1055507 - RNA, 22 nt, Human
uuauucuucuucucuugccagg

SEQ ID NO: 1055508 - RNA, 17 nt, Human
uucaaagcuuaucaagg

SEQ ID NO: 1055509 - RNA, 22 nt, Human
ccaggagcagauauggacauaa

SEQ ID NO: 1055510 - RNA, 22 nt, Human
cccaggagagaggggauaaagc

SEQ ID NO: 1055511 - RNA, 22 nt, Human
cccuggugcccugggucagccu

SEQ ID NO: 1055512 - RNA, 22 nt, Human
uuauuccaguaaucucuguaau

SEQ ID NO: 1055513 - RNA, 22 nt, Human
uuuuauauggcacauugguugg

SEQ ID NO: 1055514 - RNA, 22 nt, Human
uggaggggcaauggagcgcgga

SEQ ID NO: 1055515 - RNA, 22 nt, Human
cagguuggucggcaaguacaca

SEQ ID NO: 1055516 - RNA, 20 nt, Human
aguuacgcuauuacucuccu

SEQ ID NO: 1055517 - RNA, 22 nt, Human
agaccauggccauccuaggaaa

SEQ ID NO: 1055518 - RNA, 22 nt, Human
caguuggaggaaugaggcugua

SEQ ID NO: 1055519 - RNA, 22 nt, Human
cccaaggacacgggcagggaca

SEQ ID NO: 1055520 - RNA, 22 nt, Human
uucauucugggcucuaaggaac

SEQ ID NO: 1055521 - RNA, 22 nt, Human
ugcucaguccuccugcagugcc

SEQ ID NO: 1055522 - RNA, 22 nt, Human
uagugcagaggaggagccucug

SEQ ID NO: 1055523 - RNA, 22 nt, Human
ucuuugcacugugcaagcagaa

SEQ ID NO: 1055524 - RNA, 22 nt, Human
gcugaguugaaagcagaggaua

SEQ ID NO: 1055525 - RNA, 22 nt, Human
guggcacaaggcuuacacagca

SEQ ID NO: 1055526 - RNA, 22 nt, Human
uugauacaggcucuauuucauc

SEQ ID NO: 1055527 - RNA, 22 nt, Human
ucauuauccuaguaucuugaau

SEQ ID NO: 1055528 - RNA, 22 nt, Human
ugcugagggagcaucaaagaaa

SEQ ID NO: 1055529 - RNA, 20 nt, Human
uucuaauuugauggaguagc

SEQ ID NO: 1055530 - RNA, 22 nt, Human
gauuucuuugcaagcuguguuc

SEQ ID NO: 1055531 - RNA, 22 nt, Human
uggaaagcgaggaguuggcauu

SEQ ID NO: 1055532 - RNA, 22 nt, Human
auaagguauaaggccuauuuuu

SEQ ID NO: 1055533 - RNA, 22 nt, Human
ggaggggauuuaguagaugcua

SEQ ID NO: 1055534 - RNA, 22 nt, Human
uccaagcuugcuuuagccacag

SEQ ID NO: 1055535 - RNA, 22 nt, Human
cucugcauuuuaacagaugauu

SEQ ID NO: 1055536 - RNA, 22 nt, Human
uaggagggcccugaaaauggca

SEQ ID NO: 1055537 - RNA, 20 nt, Human
uugaggucaaggacuaggcc

SEQ ID NO: 1055538 - RNA, 22 nt, Human
aggaaagguagcgugccagcag

SEQ ID NO: 1055539 - RNA, 22 nt, Human
cuuugcaaacugucacacuuuc

SEQ ID NO: 1055540 - RNA, 19 nt, Human
cuucuucuuggcagccaag

SEQ ID NO: 1055541 - RNA, 22 nt, Human
uggcaccagcaccuagaugggg

SEQ ID NO: 1055542 - RNA, 22 nt, Human
uuacacuuaggguuugucagag

SEQ ID NO: 1055543 - RNA, 22 nt, Human
uagggcuguuaguaauucucag

SEQ ID NO: 1055544 - RNA, 22 nt, Human
uuauguagugacugacuguuag

SEQ ID NO: 1055545 - RNA, 22 nt, Human
ggaggaggggugacugaaugcu

SEQ ID NO: 1055546 - RNA, 22 nt, Human
cugagcuguuacucuguccucg

SEQ ID NO: 1055547 - RNA, 22 nt, Human
ggccaggaagggaagaucagca

SEQ ID NO: 1055548 - RNA, 22 nt, Human
guagccauuggcaaugaagccu

SEQ ID NO: 1055549 - RNA, 22 nt, Human
agcccaggaaucugcaucuuga

SEQ ID NO: 1055550 - RNA, 22 nt, Human
ugaggcuguucuaccagggcca

SEQ ID NO: 1055551 - RNA, 22 nt, Human
uuggcaucaguguaggaccugu

SEQ ID NO: 1055552 - RNA, 22 nt, Human
acagugcuggcuacaacccugg

SEQ ID NO: 1055553 - RNA, 22 nt, Human
uggucaaaaaggccuagacaca

SEQ ID NO: 1055554 - RNA, 22 nt, Human
ugcugaggacaccuagccuucu

SEQ ID NO: 1055555 - RNA, 21 nt, Human
ucacaucuauguuaagcaaac

SEQ ID NO: 1055556 - RNA, 22 nt, Human
gagcaagacuacaggcagauga

SEQ ID NO: 1055557 - RNA, 19 nt, Human
cuuauuagagugagagcuu

SEQ ID NO: 1055558 - RNA, 22 nt, Human
uaacauuauacagagaggacag

SEQ ID NO: 1055559 - RNA, 22 nt, Human
aaauauaguaaaugcauaguuc

SEQ ID NO: 1055560 - RNA, 22 nt, Human
uucacaaaacacuauuuucugg

SEQ ID NO: 1055561 - RNA, 22 nt, Human
aggcacagagaaugcccuccau

SEQ ID NO: 1055562 - RNA, 22 nt, Human
gacaggcuucauccucagaguu

SEQ ID NO: 1055563 - RNA, 22 nt, Human
ggagugucagaaacaguguccu

SEQ ID NO: 1055564 - RNA, 22 nt, Human
auauuagguuggugcaaaagua

SEQ ID NO: 1055565 - RNA, 22 nt, Human
cugccugcacugccuggcucca

SEQ ID NO: 1055566 - RNA, 22 nt, Human
aggcugaggcuuuccuuggaga

SEQ ID NO: 1055567 - RNA, 22 nt, Human
aaacccugcccuucccaagaug

SEQ ID NO: 1055568 - RNA, 22 nt, Human
ggcugcggaucuaaggcuggga

SEQ ID NO: 1055569 - RNA, 22 nt, Human
auauauaaccuggauaaggcuu

SEQ ID NO: 1055570 - RNA, 22 nt, Human
guggccaaggugcagagcagcu

SEQ ID NO: 1055571 - RNA, 20 nt, Human
agguccacugaggcugccuc

SEQ ID NO: 1055572 - RNA, 22 nt, Human
ucaggcuguuccuguccaaaau

SEQ ID NO: 1055573 - RNA, 20 nt, Human
cacaggaaagcuacucaguu

SEQ ID NO: 1055574 - RNA, 23 nt, Human
uggaggaaacacaucagaagacc

SEQ ID NO: 1055575 - RNA, 22 nt, Human
agcugcccuuaauaggcauuca

SEQ ID NO: 1055576 - RNA, 22 nt, Human
ugcuucugggcaaaugugugug

SEQ ID NO: 1055577 - RNA, 22 nt, Human
ucaguucuuuauuucacaguga

SEQ ID NO: 1055578 - RNA, 22 nt, Human
gucuggccuuuuuagcuugugg

SEQ ID NO: 1055579 - RNA, 22 nt, Human
aauaucaacaguguccuucuaa

SEQ ID NO: 1055580 - RNA, 22 nt, Human
cuggccaacaucuggggcacau

SEQ ID NO: 1055581 - RNA, 19 nt, Human
uccaggagcaaagccaguu

SEQ ID NO: 1055582 - RNA, 22 nt, Human
acccaggagcucugggguccuc

SEQ ID NO: 1055583 - RNA, 22 nt, Human
uauguuauuuucauacaacaga

SEQ ID NO: 1055584 - RNA, 22 nt, Human
acuucuucuucagcugggggau

SEQ ID NO: 1055585 - RNA, 22 nt, Human
uucccaugccuggccccuaucc

SEQ ID NO: 1055586 - RNA, 22 nt, Human
aaacaggcaucacucagcaaag

SEQ ID NO: 1055587 - RNA, 19 nt, Human
accaggaguaucagagcug

SEQ ID NO: 1055588 - RNA, 22 nt, Human
acagugaggacagggacugugu

SEQ ID NO: 1055589 - RNA, 21 nt, Human
cuguggaagggaacuagaggg

SEQ ID NO: 1055590 - RNA, 22 nt, Human
aagauuauggcagauaacaauu

SEQ ID NO: 1055591 - RNA, 22 nt, Human
auacauauaugguacuuccugg

SEQ ID NO: 1055592 - RNA, 22 nt, Human
caccguuugguuuggauuuaca

SEQ ID NO: 1055593 - RNA, 22 nt, Human
uuaaaugaggcugauguagauu

SEQ ID NO: 1055594 - RNA, 22 nt, Human
gugaaggacuagcauggagggc

SEQ ID NO: 1055595 - RNA, 20 nt, Human
uuggcagcuucaggguacua

SEQ ID NO: 1055596 - RNA, 19 nt, Human
acuuccugcccgcuccuuu

SEQ ID NO: 1055597 - RNA, 22 nt, Human
caauuauauuuagaaugauaca

SEQ ID NO: 1055598 - RNA, 22 nt, Human
gcaggcaguuauuuaguagaau

SEQ ID NO: 1055599 - RNA, 22 nt, Human
augcuguguggccaccuccaug

SEQ ID NO: 1055600 - RNA, 22 nt, Human
ccuggccaggcauggagucaca

SEQ ID NO: 1055601 - RNA, 22 nt, Human
aaauuauuacaagcuaguuggc

SEQ ID NO: 1055602 - RNA, 22 nt, Human
guaggcagucucucaggugauc

SEQ ID NO: 1055603 - RNA, 22 nt, Human
uguuaagaagaggcaguacuua

SEQ ID NO: 1055604 - RNA, 22 nt, Human
cucuuucugauucgcugggacc

SEQ ID NO: 1055605 - RNA, 22 nt, Human
ccauuaguaccucuggaaaauu

SEQ ID NO: 1055606 - RNA, 22 nt, Human
uuuuuaguagagguggguuuca

SEQ ID NO: 1055607 - RNA, 22 nt, Human
uagacuuugauauuguacaccc

SEQ ID NO: 1055608 - RNA, 22 nt, Human
gcugccagccaacuugcugugc

SEQ ID NO: 1055609 - RNA, 22 nt, Human
uaaauuauguuccauguccuuu

SEQ ID NO: 1055610 - RNA, 22 nt, Human
auguuucaccaguuuuauaaga

SEQ ID NO: 1055611 - RNA, 22 nt, Human
auuaggaaauguguugcaagca

SEQ ID NO: 1055612 - RNA, 22 nt, Human
uugguacaugcagauauuuagu

SEQ ID NO: 1055613 - RNA, 18 nt, Human
gagagcccagcagguggu

SEQ ID NO: 1055614 - RNA, 22 nt, Human
auauuguugacuauaagaguaa

SEQ ID NO: 1055615 - RNA, 22 nt, Human
uaggcagccagcaucaguuggg

SEQ ID NO: 1055616 - RNA, 22 nt, Human
ggcagccuugagggaggccugg

SEQ ID NO: 1055617 - RNA, 22 nt, Human
ccagugcuucuuugcuagcugg

SEQ ID NO: 1055618 - RNA, 22 nt, Human
gccugcagauauauaggauggu

SEQ ID NO: 1055619 - RNA, 22 nt, Human
gagcaagacccuggguucucuc

SEQ ID NO: 1055620 - RNA, 22 nt, Human
uagggauguggugagaacugag

SEQ ID NO: 1055621 - RNA, 22 nt, Human
augcugugccuucucugugcca

SEQ ID NO: 1055622 - RNA, 22 nt, Human
augcagcuucaggauuaugaug

SEQ ID NO: 1055623 - RNA, 22 nt, Human
cucagugugaaugcucaguaaa

SEQ ID NO: 1055624 - RNA, 22 nt, Human
ccagaggaaaaauaucucccua

SEQ ID NO: 1055625 - RNA, 22 nt, Human
ccagcagagcauggggaggaag

SEQ ID NO: 1055626 - RNA, 22 nt, Human
uagggcugccauuugcuuuucu

SEQ ID NO: 1055627 - RNA, 22 nt, Human
cuucuuaucaaguggcaaaucu

SEQ ID NO: 1055628 - RNA, 22 nt, Human
gcaggggcuaaggacacagaga

SEQ ID NO: 1055629 - RNA, 22 nt, Human
cauuuuaagaugaccugguuuc

SEQ ID NO: 1055630 - RNA, 22 nt, Human
accaggagggacccugguggcc

SEQ ID NO: 1055631 - RNA, 22 nt, Human
caggcugcggccgugugagcau

SEQ ID NO: 1055632 - RNA, 22 nt, Human
cucuucuuggcccccaugaggg

SEQ ID NO: 1055633 - RNA, 22 nt, Human
auucugaguccaugggggcagg

SEQ ID NO: 1055634 - RNA, 22 nt, Human
aaagcagagguugcagugagcu

SEQ ID NO: 1055635 - RNA, 22 nt, Human
ggucugaaaauggugaccacca

SEQ ID NO: 1055636 - RNA, 22 nt, Human
uuaaaaugaauauugauuagca

SEQ ID NO: 1055637 - RNA, 22 nt, Human
agacaguguguguauauauggu

SEQ ID NO: 1055638 - RNA, 22 nt, Human
guucucucugcuuccaagaugg

SEQ ID NO: 1055639 - RNA, 23 nt, Human
acagaaaucauuuguaagguacc

SEQ ID NO: 1055640 - RNA, 21 nt, Human
agacaguaacucuucuacucc

SEQ ID NO: 1055641 - RNA, 22 nt, Human
cauaaaguaaagaugucuucca

SEQ ID NO: 1055642 - RNA, 22 nt, Human
aggcaggccccugagaauagac

SEQ ID NO: 1055643 - RNA, 22 nt, Human
gaggcagugucgguggcaggau

SEQ ID NO: 1055644 - RNA, 22 nt, Human
aguuggcauuuuauuuaaguau

SEQ ID NO: 1055645 - RNA, 22 nt, Human
ugaggccagcuucagcagugga

SEQ ID NO: 1055646 - RNA, 22 nt, Human
ugaaagguagcuggccucauag

SEQ ID NO: 1055647 - RNA, 20 nt, Human
ggcaggcuuuauauggaggg

SEQ ID NO: 1055648 - RNA, 22 nt, Human
cagcuggccccacaguagaggc

SEQ ID NO: 1055649 - RNA, 22 nt, Human
gcuguguuuuauguuagguuaa

SEQ ID NO: 1055650 - RNA, 22 nt, Human
guaagauuuaaaauagcaauug

SEQ ID NO: 1055651 - RNA, 22 nt, Human
uccucagacuucccuuugugua

SEQ ID NO: 1055652 - RNA, 22 nt, Human
guugaaagaucauguggcugcc

SEQ ID NO: 1055653 - RNA, 20 nt, Human
aucuucuuggccagcuugcu

SEQ ID NO: 1055654 - RNA, 22 nt, Human
uucacagucacccuucuccaug

SEQ ID NO: 1055655 - RNA, 22 nt, Human
uguggaaaauuggaacguuccu

SEQ ID NO: 1055656 - RNA, 22 nt, Human
auuauuaggugcucucugacaa

SEQ ID NO: 1055657 - RNA, 22 nt, Human
uucuucucggcugucagauagu

SEQ ID NO: 1055658 - RNA, 22 nt, Human
uguggaaaagaauaagggagau

SEQ ID NO: 1055659 - RNA, 22 nt, Human
gcugaaauucagauuccuaggc

SEQ ID NO: 1055660 - RNA, 22 nt, Human
aaucauaauuguauacauucau

SEQ ID NO: 1055661 - RNA, 22 nt, Human
cacagauaaggauguuaauuuu

SEQ ID NO: 1055662 - RNA, 22 nt, Human
ggugagaggcagaggacagcuu

SEQ ID NO: 1055663 - RNA, 22 nt, Human
uaacugguccugaacagcccag

SEQ ID NO: 1055664 - RNA, 19 nt, Human
uucuccagccugaccugag

SEQ ID NO: 1055665 - RNA, 22 nt, Human
guucuucaucauuuuagauagg

SEQ ID NO: 1055666 - RNA, 22 nt, Human
ucaggcuguuagccaccuccuc

SEQ ID NO: 1055667 - RNA, 22 nt, Human
acagaacuuccagggaacauac

SEQ ID NO: 1055668 - RNA, 22 nt, Human
uaagauuacagugagaaauaaa

SEQ ID NO: 1055669 - RNA, 22 nt, Human
aaaaccugauugaauucuauuu

SEQ ID NO: 1055670 - RNA, 22 nt, Human
ggcugagaaggagugggugagg

SEQ ID NO: 1055671 - RNA, 20 nt, Human
ugacuucuucaugcuguacu

SEQ ID NO: 1055672 - RNA, 22 nt, Human
cuaaaugacagguaccauagug

SEQ ID NO: 1055673 - RNA, 22 nt, Human
auguucuuguucaaaugucagu

SEQ ID NO: 1055674 - RNA, 22 nt, Human
ggagagaauuccauggacaugu

SEQ ID NO: 1055675 - RNA, 23 nt, Human
auguauuuaaauuucagugauga

SEQ ID NO: 1055676 - RNA, 22 nt, Human
gagcugagacacacuuuggcaa

SEQ ID NO: 1055677 - RNA, 22 nt, Human
augcuguguauuuuacucuuuc

SEQ ID NO: 1055678 - RNA, 22 nt, Human
ggagaggagauuguggcauuuu

SEQ ID NO: 1055679 - RNA, 22 nt, Human
caggcaugcuucugucugggca

SEQ ID NO: 1055680 - RNA, 22 nt, Human
ucugggaacacacgucacuuca

SEQ ID NO: 1055681 - RNA, 22 nt, Human
cuguaguugaugauuucugaua

SEQ ID NO: 1055682 - RNA, 22 nt, Human
ugcugagguaaccauauccugc

SEQ ID NO: 1055683 - RNA, 21 nt, Human
uuucuucacuuugccccaugu

SEQ ID NO: 1055684 - RNA, 22 nt, Human
ccacagagacaggguccuugcu

SEQ ID NO: 1055685 - RNA, 22 nt, Human
caggaugagaagggcucuuacg

SEQ ID NO: 1055686 - RNA, 22 nt, Human
agcugugaccuucaagagcuac

SEQ ID NO: 1055687 - RNA, 22 nt, Human
uagggaugagccaguggguagu

SEQ ID NO: 1055688 - RNA, 19 nt, Human
caacugcccccucaaacau

SEQ ID NO: 1055689 - RNA, 18 nt, Human
ccuggagcuccacagcaa

SEQ ID NO: 1055690 - RNA, 22 nt, Human
caucuuuuggccuauucugagg

SEQ ID NO: 1055691 - RNA, 22 nt, Human
cugcuguggaugcaggaccuca

SEQ ID NO: 1055692 - RNA, 22 nt, Human
caggcagcucuaauggaaagug

SEQ ID NO: 1055693 - RNA, 22 nt, Human
ugaugaauaaacuugagaguca

SEQ ID NO: 1055694 - RNA, 22 nt, Human
gauauuuugagaaauccuauga

SEQ ID NO: 1055695 - RNA, 22 nt, Human
cagagggcucuuggcugccugc

SEQ ID NO: 1055696 - RNA, 22 nt, Human
uacauaguauucacauuguuuu

SEQ ID NO: 1055697 - RNA, 22 nt, Human
uuccaugaaagugaaauggagc

SEQ ID NO: 1055698 - RNA, 22 nt, Human
aauuuuaaucaguggugcugag

SEQ ID NO: 1055699 - RNA, 22 nt, Human
cugccuggggaaugugaggauu

SEQ ID NO: 1055700 - RNA, 22 nt, Human
agugcuuucuugcuccaucagu

SEQ ID NO: 1055701 - RNA, 18 nt, Human
cucuuucuuuggcacaaa

SEQ ID NO: 1055702 - RNA, 22 nt, Human
uuggccaaaaaagucauuagaa

SEQ ID NO: 1055703 - RNA, 22 nt, Human
ucaggcugguccccacagugga

SEQ ID NO: 1055704 - RNA, 22 nt, Human
aauuaacuaauuugguacaaga

SEQ ID NO: 1055705 - RNA, 23 nt, Human
gugagucuugccuuugcugugga

SEQ ID NO: 1055706 - RNA, 22 nt, Human
ggagggcugccagguggagcgg

SEQ ID NO: 1055707 - RNA, 22 nt, Human
ugaacuccaaauacugcugauu

SEQ ID NO: 1055708 - RNA, 22 nt, Human
gaaauauuguacuggagauguu

SEQ ID NO: 1055709 - RNA, 22 nt, Human
ggaggccagccugaggcugagg

SEQ ID NO: 1055710 - RNA, 22 nt, Human
acgagagguccuuagaaucugu

SEQ ID NO: 1055711 - RNA, 20 nt, Human
auccaugagagucuggauuc

SEQ ID NO: 1055712 - RNA, 20 nt, Human
aggcaguuagaaggagauga

SEQ ID NO: 1055713 - RNA, 22 nt, Human
uuauuugcccauguuuagcaga

SEQ ID NO: 1055714 - RNA, 22 nt, Human
uuagauaaagugauguaggcua

SEQ ID NO: 1055715 - RNA, 22 nt, Human
uucauucuugucuuuguauagu

SEQ ID NO: 1055716 - RNA, 21 nt, Human
acauaacugucaaguaacguu

SEQ ID NO: 1055717 - RNA, 22 nt, Human
agagcugaauucaagugcuggc

SEQ ID NO: 1055718 - RNA, 22 nt, Human
ugcuucagcacuuugagagccu

SEQ ID NO: 1055719 - RNA, 22 nt, Human
uaucuguuaggaucagagcugg

SEQ ID NO: 1055720 - RNA, 22 nt, Human
uugacuucccagacuuguguuu

SEQ ID NO: 1055721 - RNA, 22 nt, Human
gggagagguuacccgagcaacu

SEQ ID NO: 1055722 - RNA, 22 nt, Human
aucauucugauggucaaugcua

SEQ ID NO: 1055723 - RNA, 22 nt, Human
uguuuauuuucaggauggauug

SEQ ID NO: 1055724 - RNA, 22 nt, Human
cuucugcaauaaguuuuggucc

SEQ ID NO: 1055725 - RNA, 22 nt, Human
cugcuguggccagccaggucaa

SEQ ID NO: 1055726 - RNA, 22 nt, Human
ugccaggauggccagggggcca

SEQ ID NO: 1055727 - RNA, 22 nt, Human
aaauuaguacauugcaaagucc

SEQ ID NO: 1055728 - RNA, 17 nt, Human
ucuccuggcucuaucag

SEQ ID NO: 1055729 - RNA, 22 nt, Human
uucuacagacuauaacugugau

SEQ ID NO: 1055730 - RNA, 22 nt, Human
aaaccgcaauuacuuuugcguc

SEQ ID NO: 1055731 - RNA, 22 nt, Human
uaaauuaaagauuggagaagga

SEQ ID NO: 1055732 - RNA, 22 nt, Human
gauuucuugaccccugucucag

SEQ ID NO: 1055733 - RNA, 22 nt, Human
acucagaaugacugaugcugug

SEQ ID NO: 1055734 - RNA, 22 nt, Human
agguccagcuguugcagccucc

SEQ ID NO: 1055735 - RNA, 22 nt, Human
ccaggcugcucacaagcugccc

SEQ ID NO: 1055736 - RNA, 22 nt, Human
cuauuucaaggcccagauauga

SEQ ID NO: 1055737 - RNA, 22 nt, Human
gaguagcagccacagaggaccc

SEQ ID NO: 1055738 - RNA, 22 nt, Human
acuccuggaaaagaacgcaggg

SEQ ID NO: 1055739 - RNA, 21 nt, Human
gguguccagaggaguccccag

SEQ ID NO: 1055740 - RNA, 22 nt, Human
caggcagcucgaugccuuguug

SEQ ID NO: 1055741 - RNA, 22 nt, Human
uucucugaucuugcuagacuga

SEQ ID NO: 1055742 - RNA, 22 nt, Human
acagacuggagcccuuuugccc

SEQ ID NO: 1055743 - RNA, 22 nt, Human
uuccuggcgccacggagccggu

SEQ ID NO: 1055744 - RNA, 23 nt, Human
aggcugagcucucccagcuucag

SEQ ID NO: 1055745 - RNA, 23 nt, Human
cuuuuaacuagaguaucagcugc

SEQ ID NO: 1055746 - RNA, 22 nt, Human
acccaggauaaucuguguaucu

SEQ ID NO: 1055747 - RNA, 19 nt, Human
caggaugaucccaugacac

SEQ ID NO: 1055748 - RNA, 22 nt, Human
caggcagagugagaagcccuug

SEQ ID NO: 1055749 - RNA, 22 nt, Human
acugagguauaauugacauaac

SEQ ID NO: 1055750 - RNA, 22 nt, Human
gggcugagggccaauuccuacu

SEQ ID NO: 1055751 - RNA, 22 nt, Human
aaaauacuguggaguguugaaa

SEQ ID NO: 1055752 - RNA, 22 nt, Human
auuaaauuagcaaacugugaaa

SEQ ID NO: 1055753 - RNA, 22 nt, Human
uaaguggaagguuauaugcuaa

SEQ ID NO: 1055754 - RNA, 22 nt, Human
ucuuccaagguugcacacuauc

SEQ ID NO: 1055755 - RNA, 23 nt, Human
uaauucacauauacauugcuuca

SEQ ID NO: 1055756 - RNA, 22 nt, Human
uguuguuuucucauggagaaua

SEQ ID NO: 1055757 - RNA, 22 nt, Human
aggcaggcucaaugcccagucu

SEQ ID NO: 1055758 - RNA, 21 nt, Human
uuugaaagcccuauguuuuca

SEQ ID NO: 1055759 - RNA, 22 nt, Human
uucaaugauuuuuagggaucau

SEQ ID NO: 1055760 - RNA, 22 nt, Human
cuguuaaucugcuugcaugaug

SEQ ID NO: 1055761 - RNA, 22 nt, Human
cugugccaucugcacucucguc

SEQ ID NO: 1055762 - RNA, 23 nt, Human
agggagcuaaaaggcuggagcag

SEQ ID NO: 1055763 - RNA, 19 nt, Human
cagagcugcuggccucguc

SEQ ID NO: 1055764 - RNA, 22 nt, Human
agggugguucuuuuaguggaag

SEQ ID NO: 1055765 - RNA, 22 nt, Human
gcugagagaaaagugagguucu

SEQ ID NO: 1055766 - RNA, 22 nt, Human
guucuucacauuucauugagga

SEQ ID NO: 1055767 - RNA, 22 nt, Human
ccaggcuguaagagugauguug

SEQ ID NO: 1055768 - RNA, 22 nt, Human
aggccagaaaugucagggagug

SEQ ID NO: 1055769 - RNA, 20 nt, Human
uucagaaauaaggaaugagg

SEQ ID NO: 1055770 - RNA, 22 nt, Human
uaaacauuuguuauucuuguuu

SEQ ID NO: 1055771 - RNA, 21 nt, Human
agcagaggggacauguuugau

SEQ ID NO: 1055772 - RNA, 22 nt, Human
uugcuguguaacuccuggccug

SEQ ID NO: 1055773 - RNA, 22 nt, Human
cucuccucugaaguggugaccc

SEQ ID NO: 1055774 - RNA, 22 nt, Human
caccuuuugugucugcguuugu

SEQ ID NO: 1055775 - RNA, 22 nt, Human
gaggcagcaggcugaggaggau

SEQ ID NO: 1055776 - RNA, 22 nt, Human
gguggcaccuugaucuuggacu

SEQ ID NO: 1055777 - RNA, 18 nt, Human
uguuaggaagggcacaca

SEQ ID NO: 1055778 - RNA, 22 nt, Human
ucaaggaaggucuguugcucca

SEQ ID NO: 1055779 - RNA, 22 nt, Human
caaguaaagaaucacauuucuu

SEQ ID NO: 1055780 - RNA, 22 nt, Human
uggcugagaccuucccaaauuc

SEQ ID NO: 1055781 - RNA, 22 nt, Human
gcaccaggcagcugagcaggcc

SEQ ID NO: 1055782 - RNA, 22 nt, Human
acuccaggguuuugcaccugga

SEQ ID NO: 1055783 - RNA, 22 nt, Human
cauuuguuggucagauuguagu

SEQ ID NO: 1055784 - RNA, 22 nt, Human
caacuccuggcuguuaggcaca

SEQ ID NO: 1055785 - RNA, 22 nt, Human
uuucaugagauuccuccacauc

SEQ ID NO: 1055786 - RNA, 22 nt, Human
aacucacuuuguggcuucugaa

SEQ ID NO: 1055787 - RNA, 23 nt, Human
cuggcucauccugguugcagugg

SEQ ID NO: 1055788 - RNA, 22 nt, Human
cagugugaggaauuagugucca

SEQ ID NO: 1055789 - RNA, 22 nt, Human
gcaaauauucaagacuuuucca

SEQ ID NO: 1055790 - RNA, 22 nt, Human
ucacaaauauuuuaacaguagg

SEQ ID NO: 1055791 - RNA, 23 nt, Human
gcugagguccugcugaguggugg

SEQ ID NO: 1055792 - RNA, 22 nt, Human
cauuuguauguuccuccuuagg

SEQ ID NO: 1055793 - RNA, 22 nt, Human
aggcuccaccagucaggugcau

SEQ ID NO: 1055794 - RNA, 22 nt, Human
uuuuaguuguacugucaacagu

SEQ ID NO: 1055795 - RNA, 20 nt, Human
ucaggaugugcugagugaag

SEQ ID NO: 1055796 - RNA, 22 nt, Human
ggcucagagaccugcgaucuga

SEQ ID NO: 1055797 - RNA, 22 nt, Human
cugagagugcucuuugauguca

SEQ ID NO: 1055798 - RNA, 22 nt, Human
ggcagaggagcuggaaacaugg

SEQ ID NO: 1055799 - RNA, 22 nt, Human
cuugcugggguaagucugugcu

SEQ ID NO: 1055800 - RNA, 22 nt, Human
uaugacuuuggaaaaauuacuu

SEQ ID NO: 1055801 - RNA, 21 nt, Human
uucuucaaagaagaaggcaca

SEQ ID NO: 1055802 - RNA, 22 nt, Human
cugggccaagaaguuguguaug

SEQ ID NO: 1055803 - RNA, 22 nt, Human
gaggaaccaaucugugauauuc

SEQ ID NO: 1055804 - RNA, 22 nt, Human
cccaggaggugugcccaacucg

SEQ ID NO: 1055805 - RNA, 22 nt, Human
gaggcccaggguacaggccgcu

SEQ ID NO: 1055806 - RNA, 22 nt, Human
gcuggagguagggagguccugu

SEQ ID NO: 1055807 - RNA, 22 nt, Human
auuaggacagagaugucaagag

SEQ ID NO: 1055808 - RNA, 20 nt, Human
acugagcugcauggagagga

SEQ ID NO: 1055809 - RNA, 17 nt, Human
acuccuggucugaaggg

SEQ ID NO: 1055810 - RNA, 22 nt, Human
gaguagcauucuagaguaugcu

SEQ ID NO: 1055811 - RNA, 22 nt, Human
agguaggcccugagugcuguug

SEQ ID NO: 1055812 - RNA, 22 nt, Human
gagcagcuccagccgcaugacu

SEQ ID NO: 1055813 - RNA, 22 nt, Human
uagggcuggcgugcucagggaa

SEQ ID NO: 1055814 - RNA, 20 nt, Human
acugagguuagauaacaggu

SEQ ID NO: 1055815 - RNA, 22 nt, Human
ggaggggagguccagcugaucu

SEQ ID NO: 1055816 - RNA, 22 nt, Human
gacugagggauagaggugcuuc

SEQ ID NO: 1055817 - RNA, 22 nt, Human
ccuggccagcgccggcugcucg

SEQ ID NO: 1055818 - RNA, 22 nt, Human
ugacccauggucugaucauagg

SEQ ID NO: 1055819 - RNA, 22 nt, Human
cugccuggguucaaguccuguu

SEQ ID NO: 1055820 - RNA, 22 nt, Human
aucuuucuuauuugaagaaaga

SEQ ID NO: 1055821 - RNA, 22 nt, Human
ccaggacaaguguggccauggc

SEQ ID NO: 1055822 - RNA, 22 nt, Human
ugcugaggucacggcggccaga

SEQ ID NO: 1055823 - RNA, 22 nt, Human
aaauguauugcauaggauauuu

SEQ ID NO: 1055824 - RNA, 18 nt, Human
ugugaacacauuuuucug

SEQ ID NO: 1055825 - RNA, 22 nt, Human
cugaggccguuggugggccuua

SEQ ID NO: 1055826 - RNA, 22 nt, Human
cuuaaauuggaugaguuaaguu

SEQ ID NO: 1055827 - RNA, 22 nt, Human
uuuaugagcaccuuggcccaga

SEQ ID NO: 1055828 - RNA, 22 nt, Human
agcccuggguuagggugggagc

SEQ ID NO: 1055829 - RNA, 22 nt, Human
agagccaguuguuaagcacuua

SEQ ID NO: 1055830 - RNA, 22 nt, Human
gauuuuaauuauaggagguccu

SEQ ID NO: 1055831 - RNA, 22 nt, Human
uuggcagcagggaguuggccgc

SEQ ID NO: 1055832 - RNA, 19 nt, Human
agauggcaaaaugcaaaga

SEQ ID NO: 1055833 - RNA, 22 nt, Human
ccccaggacacauggaccaagu

SEQ ID NO: 1055834 - RNA, 22 nt, Human
aggauaguugugaagauaggcu

SEQ ID NO: 1055835 - RNA, 22 nt, Human
acccaggauagagugcugcagu

SEQ ID NO: 1055836 - RNA, 22 nt, Human
cugccuccugccgugcagcuuc

SEQ ID NO: 1055837 - RNA, 22 nt, Human
aaacugccuccugggcaacuaa

SEQ ID NO: 1055838 - RNA, 22 nt, Human
cuggagccccaggcugugcaga

SEQ ID NO: 1055839 - RNA, 22 nt, Human
aguaaagcagaguugcaguaca

SEQ ID NO: 1055840 - RNA, 22 nt, Human
uuauuauagauuaugcaagauu

SEQ ID NO: 1055841 - RNA, 22 nt, Human
cccaggagaucuggaucucguc

SEQ ID NO: 1055842 - RNA, 22 nt, Human
cugagauggaguuucgcucuuc

SEQ ID NO: 1055843 - RNA, 22 nt, Human
uucuucuugaaacuuuagguug

SEQ ID NO: 1055844 - RNA, 22 nt, Human
auuaggaaacugaaugucagaa

SEQ ID NO: 1055845 - RNA, 22 nt, Human
ucuggcaggucaaucauucuuu

SEQ ID NO: 1055846 - RNA, 22 nt, Human
aaguauaagcuauucuucauga

SEQ ID NO: 1055847 - RNA, 22 nt, Human
uaggcagaaaggaaggcaaguu

SEQ ID NO: 1055848 - RNA, 22 nt, Human
cugcuucacccugccugagaac

SEQ ID NO: 1055849 - RNA, 22 nt, Human
uccaggaguccugggagugauu

SEQ ID NO: 1055850 - RNA, 22 nt, Human
uuucaggguacauggagcaaau

SEQ ID NO: 1055851 - RNA, 22 nt, Human
aguggcaguagaugagcugguu

SEQ ID NO: 1055852 - RNA, 22 nt, Human
gaaaaaugcuccaaaucugugg

SEQ ID NO: 1055853 - RNA, 22 nt, Human
guggaaugaauagauuugcauu

SEQ ID NO: 1055854 - RNA, 22 nt, Human
auggacauuugaguuauuucca

SEQ ID NO: 1055855 - RNA, 22 nt, Human
ccaggcugcagucaaggggcau

SEQ ID NO: 1055856 - RNA, 22 nt, Human
uggcugagguuaugcugguugu

SEQ ID NO: 1055857 - RNA, 22 nt, Human
cugccugcuuuucugggagccg

SEQ ID NO: 1055858 - RNA, 19 nt, Human
ugcauaaauuauauacuuu

SEQ ID NO: 1055859 - RNA, 20 nt, Human
agauuauuccuaagauuucu

SEQ ID NO: 1055860 - RNA, 22 nt, Human
agacagcugggaaauggagugu

SEQ ID NO: 1055861 - RNA, 22 nt, Human
uccccuccaacuccaacuaugg

SEQ ID NO: 1055862 - RNA, 22 nt, Human
cuucuucauguauugauagucu

SEQ ID NO: 1055863 - RNA, 22 nt, Human
uucuuucucaacaugaauguuu

SEQ ID NO: 1055864 - RNA, 22 nt, Human
gcugagugauucauacgcugcu

SEQ ID NO: 1055865 - RNA, 22 nt, Human
ugcugaaagucccaaaucucau

SEQ ID NO: 1055866 - RNA, 22 nt, Human
gcagcugccccgacugugaguc

SEQ ID NO: 1055867 - RNA, 23 nt, Human
cuucuggcucuauaucagaauuc

SEQ ID NO: 1055868 - RNA, 21 nt, Human
ggauggauagggaagagauuu

SEQ ID NO: 1055869 - RNA, 22 nt, Human
uaagauaaguggguugagaugg

SEQ ID NO: 1055870 - RNA, 22 nt, Human
uuucuuguaagauguuuauuaa

SEQ ID NO: 1055871 - RNA, 22 nt, Human
aggccagcagcaugacggcauc

SEQ ID NO: 1055872 - RNA, 20 nt, Human
gacaugucuuucucacacaa

SEQ ID NO: 1055873 - RNA, 22 nt, Human
cuggggcccaucgagggcugag

SEQ ID NO: 1055874 - RNA, 22 nt, Human
cuccugaguaguagcauuguca

SEQ ID NO: 1055875 - RNA, 22 nt, Human
ggccuucugccuuucagcaaug

SEQ ID NO: 1055876 - RNA, 22 nt, Human
acccaggagacggaggugcagu

SEQ ID NO: 1055877 - RNA, 22 nt, Human
ucugccuccugcuugucccgac

SEQ ID NO: 1055878 - RNA, 22 nt, Human
agaggggaguccuaaucugauu

SEQ ID NO: 1055879 - RNA, 20 nt, Human
uccugagccuccaccauguc

SEQ ID NO: 1055880 - RNA, 19 nt, Human
aucugccuguuaucacaua

SEQ ID NO: 1055881 - RNA, 22 nt, Human
ggcaggcagaggcugagacagg

SEQ ID NO: 1055882 - RNA, 22 nt, Human
cugcacaguuugauuucuugcu

SEQ ID NO: 1055883 - RNA, 22 nt, Human
cugcuguguuggcauuggauag

SEQ ID NO: 1055884 - RNA, 22 nt, Human
cuuuuauuuugaauuaagggcu

SEQ ID NO: 1055885 - RNA, 22 nt, Human
cugagggcaccgacagagugga

SEQ ID NO: 1055886 - RNA, 22 nt, Human
auacacauguuauuguggaagc

SEQ ID NO: 1055887 - RNA, 22 nt, Human
agagggauggccccguaacuca

SEQ ID NO: 1055888 - RNA, 22 nt, Human
uggcuucugguuuauccuuaua

SEQ ID NO: 1055889 - RNA, 22 nt, Human
gagggcaguagccucguacccu

SEQ ID NO: 1055890 - RNA, 22 nt, Human
auggccaagaauauuucucaac

SEQ ID NO: 1055891 - RNA, 22 nt, Human
aggcuggagggcaauggcaaga

SEQ ID NO: 1055892 - RNA, 22 nt, Human
acucauuuaaacauuuacugaa

SEQ ID NO: 1055893 - RNA, 22 nt, Human
uccaaauauucaucuacuucug

SEQ ID NO: 1055894 - RNA, 22 nt, Human
cucuucuuauggccguggcuga

SEQ ID NO: 1055895 - RNA, 22 nt, Human
gagccuggacaucucaggccca

SEQ ID NO: 1055896 - RNA, 22 nt, Human
gaggcugccccuuccucagcug

SEQ ID NO: 1055897 - RNA, 22 nt, Human
aguucucagcuuaguaugcugu

SEQ ID NO: 1055898 - RNA, 22 nt, Human
uucaaacaguguagaauauaug

SEQ ID NO: 1055899 - RNA, 22 nt, Human
uaaggccaauuaacaaccaggg

SEQ ID NO: 1055900 - RNA, 22 nt, Human
gcaagaugguuauaaaaaaugu

SEQ ID NO: 1055901 - RNA, 22 nt, Human
cuuagagccuuacucuucuugu

SEQ ID NO: 1055902 - RNA, 22 nt, Human
ucccaggagcaccuuuugagcc

SEQ ID NO: 1055903 - RNA, 22 nt, Human
uguacauagaucuugaaaauua

SEQ ID NO: 1055904 - RNA, 22 nt, Human
uuaggcauauggcacaugauag

SEQ ID NO: 1055905 - RNA, 23 nt, Human
acacauuuuucccguucugaggu

SEQ ID NO: 1055906 - RNA, 22 nt, Human
acaggcugcccgcuccccaccu

SEQ ID NO: 1055907 - RNA, 22 nt, Human
cccagggagguagcaggagaaa

SEQ ID NO: 1055908 - RNA, 22 nt, Human
ggcugcugggaauaugccagcu

SEQ ID NO: 1055909 - RNA, 22 nt, Human
uagugcuugagucucuccguac

SEQ ID NO: 1055910 - RNA, 22 nt, Human
auguuagugauaguaaauagug

SEQ ID NO: 1055911 - RNA, 22 nt, Human
aaggcagcaugaaucccuguac

SEQ ID NO: 1055912 - RNA, 16 nt, Human
aaggcugauuuucccu

SEQ ID NO: 1055913 - RNA, 23 nt, Human
gaggcagcuccugcagugcccug

SEQ ID NO: 1055914 - RNA, 22 nt, Human
aagcugagccaguggcaagugc

SEQ ID NO: 1055915 - RNA, 21 nt, Human
ucuugaaaauuguagcaguuu

SEQ ID NO: 1055916 - RNA, 22 nt, Human
ggagauggaauagauucugacu

SEQ ID NO: 1055917 - RNA, 22 nt, Human
ugcccaggcuggaaugcagugg

SEQ ID NO: 1055918 - RNA, 22 nt, Human
ugcugaggcauuuggacagagu

SEQ ID NO: 1055919 - RNA, 22 nt, Human
agacagguaaauagagaugcug

SEQ ID NO: 1055920 - RNA, 22 nt, Human
uagugucaucguugcagcugag

SEQ ID NO: 1055921 - RNA, 22 nt, Human
aaggcagcuucaccacagcauu

SEQ ID NO: 1055922 - RNA, 22 nt, Human
uggccaaauuugguguaacuug

SEQ ID NO: 1055923 - RNA, 22 nt, Human
uaggccagcccuuaguccuguc

SEQ ID NO: 1055924 - RNA, 22 nt, Human
cucaggauggaagccuacagga

SEQ ID NO: 1055925 - RNA, 22 nt, Human
cacucaggcugugucaggagga

SEQ ID NO: 1055926 - RNA, 22 nt, Human
uuugaaagaauuuauguacuuu

SEQ ID NO: 1055927 - RNA, 22 nt, Human
cugaggcuucucuaguucagcu

SEQ ID NO: 1055928 - RNA, 22 nt, Human
uauuaugagguauuuggacuuu

SEQ ID NO: 1055929 - RNA, 22 nt, Human
agaaaacuugucacagcucuca

SEQ ID NO: 1055930 - RNA, 22 nt, Human
auccaugaagguacuucucagg

SEQ ID NO: 1055931 - RNA, 22 nt, Human
uagggcugugucuccaggacca

SEQ ID NO: 1055932 - RNA, 22 nt, Human
uuucaucuuccuuggcauaggu

SEQ ID NO: 1055933 - RNA, 19 nt, Human
ccauggagagagaugcauu

SEQ ID NO: 1055934 - RNA, 19 nt, Human
uuggcagcugagauccugc

SEQ ID NO: 1055935 - RNA, 16 nt, Human
uagggcugggaaggag

SEQ ID NO: 1055936 - RNA, 22 nt, Human
auauuagggucucuaaauucua

SEQ ID NO: 1055937 - RNA, 22 nt, Human
uuuaggaucucucuuguuacau

SEQ ID NO: 1055938 - RNA, 22 nt, Human
uccugggcuuuguuucucuccu

SEQ ID NO: 1055939 - RNA, 22 nt, Human
gcccaggaggcagagguugugg

SEQ ID NO: 1055940 - RNA, 22 nt, Human
uuauuuaaugugaucugaagag

SEQ ID NO: 1055941 - RNA, 22 nt, Human
aaagccauugaacuguacuuua

SEQ ID NO: 1055942 - RNA, 22 nt, Human
gcuggccaaaguguaccuggag

SEQ ID NO: 1055943 - RNA, 22 nt, Human
gacuccugggccucugagaggc

SEQ ID NO: 1055944 - RNA, 22 nt, Human
ucuggagaggggccuagaauuu

SEQ ID NO: 1055945 - RNA, 22 nt, Human
ugcccuggcacacacacagcug

SEQ ID NO: 1055946 - RNA, 22 nt, Human
ccacaggcugcugcaggucccg

SEQ ID NO: 1055947 - RNA, 22 nt, Human
ugucuucagcaaaugccuuucu

SEQ ID NO: 1055948 - RNA, 22 nt, Human
cacaaugugguuugucaucuuu

SEQ ID NO: 1055949 - RNA, 22 nt, Human
cgaggcagacaaaaguuggaag

SEQ ID NO: 1055950 - RNA, 22 nt, Human
ucaagaaggagacuccacugug

SEQ ID NO: 1055951 - RNA, 22 nt, Human
gauggcaggugauagccgaguc

SEQ ID NO: 1055952 - RNA, 22 nt, Human
aagggcugggucugguuaaccc

SEQ ID NO: 1055953 - RNA, 22 nt, Human
uucuucaaauagcagggaguca

SEQ ID NO: 1055954 - RNA, 22 nt, Human
ugguuuugcuaaaauagaaaga

SEQ ID NO: 1055955 - RNA, 22 nt, Human
uuccaugaaggagacugagaag

SEQ ID NO: 1055956 - RNA, 22 nt, Human
gcaggcuggaggcuguucuggg

SEQ ID NO: 1055957 - RNA, 20 nt, Human
ucagaugggagugagccauc

SEQ ID NO: 1055958 - RNA, 22 nt, Human
cugaggugagaggaggccaugu

SEQ ID NO: 1055959 - RNA, 22 nt, Human
auucuucacauggauaggaucu

SEQ ID NO: 1055960 - RNA, 22 nt, Human
gaggggaaaguucugcacaagg

SEQ ID NO: 1055961 - RNA, 22 nt, Human
aucuacccacugaacacaauau

SEQ ID NO: 1055962 - RNA, 22 nt, Human
uuacacuucuaaaaaaagcagg

SEQ ID NO: 1055963 - RNA, 22 nt, Human
gacuccuggcuuucccucuuag

SEQ ID NO: 1055964 - RNA, 22 nt, Human
aagaguuagcucaauaacuuga

SEQ ID NO: 1055965 - RNA, 20 nt, Human
ccagagcugauggcugcccg

SEQ ID NO: 1055966 - RNA, 22 nt, Human
gcuaacauugauucagugccug

SEQ ID NO: 1055967 - RNA, 22 nt, Human
ccuccuggccugugcagagccc

SEQ ID NO: 1055968 - RNA, 22 nt, Human
ucccaggaaaacacucgaggac

SEQ ID NO: 1055969 - RNA, 22 nt, Human
uagugugguaaauaaauguuuu

SEQ ID NO: 1055970 - RNA, 22 nt, Human
uuugacauuauccuguuacugg

SEQ ID NO: 1055971 - RNA, 22 nt, Human
uaggaugaucuuguagagagau

SEQ ID NO: 1055972 - RNA, 22 nt, Human
gccaggagaaaaggcgaaugau

SEQ ID NO: 1055973 - RNA, 22 nt, Human
cagagagggagcaguagucucu

SEQ ID NO: 1055974 - RNA, 22 nt, Human
gaggauggaggugugagcuaug

SEQ ID NO: 1055975 - RNA, 22 nt, Human
cccaggagguguagcugcgugg

SEQ ID NO: 1055976 - RNA, 22 nt, Human
acacuaaugagaaaggaauuaa

SEQ ID NO: 1055977 - RNA, 22 nt, Human
uggcagcugucagaaugcaaau

SEQ ID NO: 1055978 - RNA, 22 nt, Human
uuauggaaaauacaauuauaag

SEQ ID NO: 1055979 - RNA, 22 nt, Human
ccaggagaugauguuggggauu

SEQ ID NO: 1055980 - RNA, 22 nt, Human
cugcuucuccaaaguaggacuu

SEQ ID NO: 1055981 - RNA, 22 nt, Human
cugccccauggucccugguggg

SEQ ID NO: 1055982 - RNA, 21 nt, Human
acagcauguuuguguguuugc

SEQ ID NO: 1055983 - RNA, 22 nt, Human
gaggccagaguuccccgaguca

SEQ ID NO: 1055984 - RNA, 22 nt, Human
gaggcagcuuggggcugugggu

SEQ ID NO: 1055985 - RNA, 22 nt, Human
uacaguaauaaaaugagcuaca

SEQ ID NO: 1055986 - RNA, 22 nt, Human
ucugagccuauuucaaauuccu

SEQ ID NO: 1055987 - RNA, 22 nt, Human
auggcuucugucuuggaaacuu

SEQ ID NO: 1055988 - RNA, 22 nt, Human
accaggaggaaguguuaaugau

SEQ ID NO: 1055989 - RNA, 22 nt, Human
uucaugugaucacagauuguaa

SEQ ID NO: 1055990 - RNA, 22 nt, Human
uaggaugagggguggccaagua

SEQ ID NO: 1055991 - RNA, 20 nt, Human
cucaggauacugcaaaguug

SEQ ID NO: 1055992 - RNA, 22 nt, Human
ucauacaucuguccuggagcuc

SEQ ID NO: 1055993 - RNA, 23 nt, Human
uggcugagcccacuaucuuggcc

SEQ ID NO: 1055994 - RNA, 22 nt, Human
ucaucucaaaacccaaggggca

SEQ ID NO: 1055995 - RNA, 22 nt, Human
acugccauuggucaaaugagug

SEQ ID NO: 1055996 - RNA, 22 nt, Human
agcugagguugaagagugaacg

SEQ ID NO: 1055997 - RNA, 22 nt, Human
gagggaggggagcuccacccuc

SEQ ID NO: 1055998 - RNA, 22 nt, Human
aaggcugagacagcacaggucc

SEQ ID NO: 1055999 - RNA, 19 nt, Human
cuuugucagaacaugcuuc

SEQ ID NO: 1056000 - RNA, 22 nt, Human
ccaaaugugccuguuucaacaa

SEQ ID NO: 1056001 - RNA, 22 nt, Human
uuggccaaaggaaagacuacug

SEQ ID NO: 1056002 - RNA, 22 nt, Human
acugcccucccaucuauugcaa

SEQ ID NO: 1056003 - RNA, 20 nt, Human
ccacaggaguccagucgacc

SEQ ID NO: 1056004 - RNA, 22 nt, Human
ggcagucacuuuugcuugugcc

SEQ ID NO: 1056005 - RNA, 22 nt, Human
gacccaggagugcagagagugg

SEQ ID NO: 1056006 - RNA, 22 nt, Human
aauggccagcugggagaguuga

SEQ ID NO: 1056007 - RNA, 22 nt, Human
uuagcagcuaaacugacagacc

SEQ ID NO: 1056008 - RNA, 21 nt, Human
ccaggaaggacugagcucccu

SEQ ID NO: 1056009 - RNA, 22 nt, Human
ugcauuuccagauuucuggagu

SEQ ID NO: 1056010 - RNA, 22 nt, Human
aggcagcucuguggccucccag

SEQ ID NO: 1056011 - RNA, 22 nt, Human
uuggccaauccuauuggguggg

SEQ ID NO: 1056012 - RNA, 22 nt, Human
cagcucugaggaacacuccuuu

SEQ ID NO: 1056013 - RNA, 22 nt, Human
ugccgcagugcggggagggccc

SEQ ID NO: 1056014 - RNA, 19 nt, Human
cucugccucccuccugggu

SEQ ID NO: 1056015 - RNA, 22 nt, Human
uccaggagggauugggcugugg

SEQ ID NO: 1056016 - RNA, 22 nt, Human
cagcugccccgcuggcugacca

SEQ ID NO: 1056017 - RNA, 22 nt, Human
auugaaagguuuugagcagaua

SEQ ID NO: 1056018 - RNA, 22 nt, Human
ggcucagacucccaggcccucu

SEQ ID NO: 1056019 - RNA, 22 nt, Human
caggcugacaacugagcauuuu

SEQ ID NO: 1056020 - RNA, 22 nt, Human
agucucuuuguggacucugccu

SEQ ID NO: 1056021 - RNA, 23 nt, Human
cuccuggaggguccggcccugcc

SEQ ID NO: 1056022 - RNA, 18 nt, Human
aggccaaacuuguaagca

SEQ ID NO: 1056023 - RNA, 22 nt, Human
uuccugagggacuuuugagauu

SEQ ID NO: 1056024 - RNA, 23 nt, Human
uacuacagggucuugcuaugaau

SEQ ID NO: 1056025 - RNA, 22 nt, Human
aacuuucuuugcaucuaaguuu

SEQ ID NO: 1056026 - RNA, 22 nt, Human
augcugugucaggaauuugaua

SEQ ID NO: 1056027 - RNA, 22 nt, Human
gaaggaggcguuagcccuagga

SEQ ID NO: 1056028 - RNA, 22 nt, Human
aacaugcauauagguaaaugga

SEQ ID NO: 1056029 - RNA, 22 nt, Human
uuuuuuauaucaacugaagucu

SEQ ID NO: 1056030 - RNA, 22 nt, Human
caacugguaaucuccacgguca

SEQ ID NO: 1056031 - RNA, 22 nt, Human
aaaaugaacagaacaaugggga

SEQ ID NO: 1056032 - RNA, 22 nt, Human
guaaaucauggucagaauaaau

SEQ ID NO: 1056033 - RNA, 22 nt, Human
augcugugucuagcaggaacac

SEQ ID NO: 1056034 - RNA, 22 nt, Human
gagggcugaugcuuacuuauuu

SEQ ID NO: 1056035 - RNA, 22 nt, Human
uggccaaaguagaaaauaauag

SEQ ID NO: 1056036 - RNA, 22 nt, Human
uucuccagagggcucugcagga

SEQ ID NO: 1056037 - RNA, 22 nt, Human
gauuucuuuaugaaguacagaa

SEQ ID NO: 1056038 - RNA, 21 nt, Human
ccuggcugcacaguugcuggu

SEQ ID NO: 1056039 - RNA, 22 nt, Human
gcugccuccgccggcuccacag

SEQ ID NO: 1056040 - RNA, 21 nt, Human
aaauacagaaacuuguuuuca

SEQ ID NO: 1056041 - RNA, 22 nt, Human
cugagaucccaggcaggguggc

SEQ ID NO: 1056042 - RNA, 22 nt, Human
uuucagaauagcaaagcaagcu

SEQ ID NO: 1056043 - RNA, 22 nt, Human
uauuuccaagcugaauccaaug

SEQ ID NO: 1056044 - RNA, 22 nt, Human
uaggauaugcauuuuuauacau

SEQ ID NO: 1056045 - RNA, 22 nt, Human
uucuguuagaauuuugaaaaua

SEQ ID NO: 1056046 - RNA, 23 nt, Human
uggcuaaaggcucuaguccugcu

SEQ ID NO: 1056047 - RNA, 22 nt, Human
uuucaacaccagagaccaugcg

SEQ ID NO: 1056048 - RNA, 22 nt, Human
cuggcccagagcucuggccuuu

SEQ ID NO: 1056049 - RNA, 22 nt, Human
uccuggcccucugcaaacgcca

SEQ ID NO: 1056050 - RNA, 22 nt, Human
ucucuucuaauuuucccgagua

SEQ ID NO: 1056051 - RNA, 21 nt, Human
uuccuggcggcagaaacguga

SEQ ID NO: 1056052 - RNA, 22 nt, Human
uuggucagcucaauggagaggg

SEQ ID NO: 1056053 - RNA, 22 nt, Human
cuaggaaagacacagagaguuu

SEQ ID NO: 1056054 - RNA, 22 nt, Human
augaaggcaguuaaacgucauc

SEQ ID NO: 1056055 - RNA, 22 nt, Human
uuucacauaugguuguugauug

SEQ ID NO: 1056056 - RNA, 22 nt, Human
cucaggauccaucuccugcccu

SEQ ID NO: 1056057 - RNA, 22 nt, Human
uuugcaaauaccaugaaacuug

SEQ ID NO: 1056058 - RNA, 22 nt, Human
ccugguccuuacgucauugcuu

SEQ ID NO: 1056059 - RNA, 22 nt, Human
cuugaucuacauagugaaaccc

SEQ ID NO: 1056060 - RNA, 22 nt, Human
gcugccugguuucucagcugca

SEQ ID NO: 1056061 - RNA, 22 nt, Human
ccaugagcuuccuauauagggu

SEQ ID NO: 1056062 - RNA, 22 nt, Human
gcugccuccugaaagcgcucug

SEQ ID NO: 1056063 - RNA, 22 nt, Human
uccuaggcaguuggugcuccau

SEQ ID NO: 1056064 - RNA, 22 nt, Human
ugcuguguggaugugaagaauc

SEQ ID NO: 1056065 - RNA, 22 nt, Human
aucuuucaguuucauaccaauu

SEQ ID NO: 1056066 - RNA, 22 nt, Human
gcugggaagugcaagaucaagg

SEQ ID NO: 1056067 - RNA, 22 nt, Human
cccaggaguucgaggcuguagu

SEQ ID NO: 1056068 - RNA, 22 nt, Human
ugaggggauacgguacacauug

SEQ ID NO: 1056069 - RNA, 22 nt, Human
ucuucuuccucauuuauacaua

SEQ ID NO: 1056070 - RNA, 22 nt, Human
aggcugcugaggccaccacgcu

SEQ ID NO: 1056071 - RNA, 22 nt, Human
uaagaugaccuuauaaagagca

SEQ ID NO: 1056072 - RNA, 22 nt, Human
ugcuucuggaaacaguggcugu

SEQ ID NO: 1056073 - RNA, 22 nt, Human
agcugaggaggaaugaugggua

SEQ ID NO: 1056074 - RNA, 22 nt, Human
ucuuggccagguguggugccuc

SEQ ID NO: 1056075 - RNA, 22 nt, Human
aggcuccauuuuccugcagcug

SEQ ID NO: 1056076 - RNA, 22 nt, Human
agaacuauugcaauaacaagaa

SEQ ID NO: 1056077 - RNA, 22 nt, Human
gaggcagagugcaccccaggag

SEQ ID NO: 1056078 - RNA, 22 nt, Human
aggacuuagaacauuauguacu

SEQ ID NO: 1056079 - RNA, 22 nt, Human
ucuggccaacaaaaacuaaguc

SEQ ID NO: 1056080 - RNA, 22 nt, Human
uauugaggauugaggaaagcac

SEQ ID NO: 1056081 - RNA, 22 nt, Human
ggagcuguucaggacugcuuca

SEQ ID NO: 1056082 - RNA, 22 nt, Human
gagguggaaggcaggaacaaau

SEQ ID NO: 1056083 - RNA, 22 nt, Human
cagaguggcgacccccucagcu

SEQ ID NO: 1056084 - RNA, 22 nt, Human
agaaaaaucuuggcgcuugucu

SEQ ID NO: 1056085 - RNA, 22 nt, Human
ugacaguauugauggcaggauu

SEQ ID NO: 1056086 - RNA, 22 nt, Human
gcuaggcucggaagcagcaggg

SEQ ID NO: 1056087 - RNA, 22 nt, Human
agauauauuuaagguaauaagu

SEQ ID NO: 1056088 - RNA, 19 nt, Human
uaacuggugccuucaguca

SEQ ID NO: 1056089 - RNA, 22 nt, Human
ggacuucuaagugccagacacu

SEQ ID NO: 1056090 - RNA, 22 nt, Human
ugguagcaacaucucaguggcu

SEQ ID NO: 1056091 - RNA, 22 nt, Human
uggguccacuucugcacugugg

SEQ ID NO: 1056092 - RNA, 22 nt, Human
uguuuuaaucucccauugcucu

SEQ ID NO: 1056093 - RNA, 22 nt, Human
cuucuucagcacaauauugaug

SEQ ID NO: 1056094 - RNA, 21 nt, Human
auuucagagcacacaaguaaa

SEQ ID NO: 1056095 - RNA, 22 nt, Human
aagacacugauacucugugauu

SEQ ID NO: 1056096 - RNA, 22 nt, Human
ugaacaguuucaagaaaacuuu

SEQ ID NO: 1056097 - RNA, 20 nt, Human
gcugaggggucuauggcaua

SEQ ID NO: 1056098 - RNA, 22 nt, Human
auguuuuugagauacaaacaga

SEQ ID NO: 1056099 - RNA, 22 nt, Human
gaggcugaguagcuuugugcuc

SEQ ID NO: 1056100 - RNA, 22 nt, Human
aggcuggcgacaucuggcgggc

SEQ ID NO: 1056101 - RNA, 22 nt, Human
cugucuaguuaggaugccagca

SEQ ID NO: 1056102 - RNA, 22 nt, Human
acacauuaucucauuaaauacu

SEQ ID NO: 1056103 - RNA, 22 nt, Human
cagccuuuuaggacuauuugug

SEQ ID NO: 1056104 - RNA, 22 nt, Human
aacauucuauuuugcuaaaaca

SEQ ID NO: 1056105 - RNA, 22 nt, Human
ccaggcuguuuucaaacuuggg

SEQ ID NO: 1056106 - RNA, 19 nt, Human
agaaguuagacauugcaau

SEQ ID NO: 1056107 - RNA, 22 nt, Human
ucuuagucacagaggugagaaa

SEQ ID NO: 1056108 - RNA, 22 nt, Human
uacccaggggcugagcagaggu

SEQ ID NO: 1056109 - RNA, 22 nt, Human
ugaaggccagcucuuuaucagc

SEQ ID NO: 1056110 - RNA, 22 nt, Human
acauguaaaaggaacaugcaug

SEQ ID NO: 1056111 - RNA, 22 nt, Human
cccaggagaugcacuccauugg

SEQ ID NO: 1056112 - RNA, 22 nt, Human
aagaaguuggaaaugauugaga

SEQ ID NO: 1056113 - RNA, 22 nt, Human
ggcugagaggacgucgggcuca

SEQ ID NO: 1056114 - RNA, 22 nt, Human
acagucucuccacacugcaggg

SEQ ID NO: 1056115 - RNA, 20 nt, Human
cuacacuuggcaccuggcau

SEQ ID NO: 1056116 - RNA, 22 nt, Human
gaggcagagaccuucaggaccu

SEQ ID NO: 1056117 - RNA, 19 nt, Human
caagugaagccugggaugg

SEQ ID NO: 1056118 - RNA, 22 nt, Human
ucugaggucuaugacuuugcuu

SEQ ID NO: 1056119 - RNA, 22 nt, Human
gccaggagaaugcuagcagagg

SEQ ID NO: 1056120 - RNA, 22 nt, Human
aggucaccauggcaugcuccac

SEQ ID NO: 1056121 - RNA, 22 nt, Human
cucaguuuccccggccugggcg

SEQ ID NO: 1056122 - RNA, 22 nt, Human
agucuuaggcuccauuaguaga

SEQ ID NO: 1056123 - RNA, 22 nt, Human
ugccugggagugaccaagacuc

SEQ ID NO: 1056124 - RNA, 22 nt, Human
aauauaaugcuguuuuaugcca

SEQ ID NO: 1056125 - RNA, 22 nt, Human
uggccucagauuauugcacagu

SEQ ID NO: 1056126 - RNA, 22 nt, Human
cuggcugaguuacuccacugag

SEQ ID NO: 1056127 - RNA, 22 nt, Human
uucuggaacauagcaagaaguu

SEQ ID NO: 1056128 - RNA, 22 nt, Human
gaggcugagacucugaauuuuu

SEQ ID NO: 1056129 - RNA, 22 nt, Human
auucuucaucacuaccuuguga

SEQ ID NO: 1056130 - RNA, 20 nt, Human
uucugccuaggguuagccug

SEQ ID NO: 1056131 - RNA, 22 nt, Human
gccuggcuggucacugccuggc

SEQ ID NO: 1056132 - RNA, 17 nt, Human
ucauuuguugugacuag

SEQ ID NO: 1056133 - RNA, 21 nt, Human
ugaggccugccagucucagaa

SEQ ID NO: 1056134 - RNA, 19 nt, Human
uucuccaggcugcagaggg

SEQ ID NO: 1056135 - RNA, 22 nt, Human
uggcagcauuaauuauucaggu

SEQ ID NO: 1056136 - RNA, 22 nt, Human
aggaagcuggugugaggaugaa

SEQ ID NO: 1056137 - RNA, 21 nt, Human
gcuggcuggcugaccggccuu

SEQ ID NO: 1056138 - RNA, 22 nt, Human
gagggcugugaaggagcggguu

SEQ ID NO: 1056139 - RNA, 22 nt, Human
uucuucuugucugcccucacau

SEQ ID NO: 1056140 - RNA, 22 nt, Human
aguaaaucagaccucauuaugu

SEQ ID NO: 1056141 - RNA, 22 nt, Human
ucuguggauuuuaguguucaug

SEQ ID NO: 1056142 - RNA, 22 nt, Human
agaaaaguuuucugagacugac

SEQ ID NO: 1056143 - RNA, 22 nt, Human
cugcccaggaaccagaggggca

SEQ ID NO: 1056144 - RNA, 22 nt, Human
ucuuggccccaccugugccagc

SEQ ID NO: 1056145 - RNA, 19 nt, Human
uauggcaggccgaggcacu

SEQ ID NO: 1056146 - RNA, 22 nt, Human
uuccagcaggcagacaggagau

SEQ ID NO: 1056147 - RNA, 22 nt, Human
cauauauucugguuuucacugg

SEQ ID NO: 1056148 - RNA, 22 nt, Human
cagggcuggcuguggcaaucuc

SEQ ID NO: 1056149 - RNA, 22 nt, Human
aauuaggagaaaacuguugucu

SEQ ID NO: 1056150 - RNA, 22 nt, Human
aggaggcacucacucucagggu

SEQ ID NO: 1056151 - RNA, 22 nt, Human
guggcagagagcaagugucuga

SEQ ID NO: 1056152 - RNA, 22 nt, Human
ugcuuggcuuucugagcuucug

SEQ ID NO: 1056153 - RNA, 22 nt, Human
uuuguaaaggccugaauuucag

SEQ ID NO: 1056154 - RNA, 22 nt, Human
uucagaaauaaaauaucccaac

SEQ ID NO: 1056155 - RNA, 22 nt, Human
aguuugaaaguauugacagaag

SEQ ID NO: 1056156 - RNA, 22 nt, Human
caggcagcaucagucugcugua

SEQ ID NO: 1056157 - RNA, 17 nt, Human
agugucagggcccuucc

SEQ ID NO: 1056158 - RNA, 22 nt, Human
guguacagugauuugaguucac

SEQ ID NO: 1056159 - RNA, 22 nt, Human
guccucugaaguugugcaaugc

SEQ ID NO: 1056160 - RNA, 22 nt, Human
ggugaaggcacaagagggcaag

SEQ ID NO: 1056161 - RNA, 22 nt, Human
uucaauucaauucuaaauauau

SEQ ID NO: 1056162 - RNA, 22 nt, Human
cuccugcgguacuacugugcuu

SEQ ID NO: 1056163 - RNA, 22 nt, Human
uguuuucagucauauagcaggu

SEQ ID NO: 1056164 - RNA, 22 nt, Human
uguuggcauuagaggguuauug

SEQ ID NO: 1056165 - RNA, 22 nt, Human
ggggcagccuccaggaaagcug

SEQ ID NO: 1056166 - RNA, 22 nt, Human
agacgagggcccccaggacagc

SEQ ID NO: 1056167 - RNA, 22 nt, Human
gaggcagcagggcugguuccuu

SEQ ID NO: 1056168 - RNA, 22 nt, Human
ugcccuggaaaugagaggugug

SEQ ID NO: 1056169 - RNA, 22 nt, Human
aggcugaggaucccuguguucu

SEQ ID NO: 1056170 - RNA, 22 nt, Human
uuaaguaacuuguccaaaugag

SEQ ID NO: 1056171 - RNA, 22 nt, Human
gaaaugaaacaggcuuuuaagg

SEQ ID NO: 1056172 - RNA, 22 nt, Human
gcucacugcaaccucugcuucc

SEQ ID NO: 1056173 - RNA, 22 nt, Human
gagggccagcagccucagcaug

SEQ ID NO: 1056174 - RNA, 22 nt, Human
gagaaaggcauuccuaugcaaa

SEQ ID NO: 1056175 - RNA, 22 nt, Human
ggcagcuucucccaggcuguuu

SEQ ID NO: 1056176 - RNA, 22 nt, Human
uuugaaaguccuaggagagucc

SEQ ID NO: 1056177 - RNA, 22 nt, Human
gaggccagaagugccucgggcu

SEQ ID NO: 1056178 - RNA, 22 nt, Human
uauuagguagauuuuacugauu

SEQ ID NO: 1056179 - RNA, 22 nt, Human
ugcauauuguccuugauauuau

SEQ ID NO: 1056180 - RNA, 22 nt, Human
auuugguagugauugaaauuau

SEQ ID NO: 1056181 - RNA, 22 nt, Human
auucuucagcaggggacacuau

SEQ ID NO: 1056182 - RNA, 22 nt, Human
cuccacagcucaggcucagagu

SEQ ID NO: 1056183 - RNA, 22 nt, Human
guauuaggugguggaauuguag

SEQ ID NO: 1056184 - RNA, 22 nt, Human
uuagguaaguaggaucaaaaaa

SEQ ID NO: 1056185 - RNA, 22 nt, Human
ccuccuggugacaaggcaaagc

SEQ ID NO: 1056186 - RNA, 22 nt, Human
cagcugaguuuccaagucugcc

SEQ ID NO: 1056187 - RNA, 22 nt, Human
cauucauuuaugaaauaucuau

SEQ ID NO: 1056188 - RNA, 22 nt, Human
uuucacauuuaggcgugaauug

SEQ ID NO: 1056189 - RNA, 22 nt, Human
gacuuucuuaggcccccuaaua

SEQ ID NO: 1056190 - RNA, 22 nt, Human
gcagcauauuguacuggccugc

SEQ ID NO: 1056191 - RNA, 22 nt, Human
cucaggaugucggugacuauug

SEQ ID NO: 1056192 - RNA, 22 nt, Human
aauauccacacugugucccugc

SEQ ID NO: 1056193 - RNA, 22 nt, Human
acuggccaugaacuugggaucu

SEQ ID NO: 1056194 - RNA, 21 nt, Human
cagcagaguaaugcauucgua

SEQ ID NO: 1056195 - RNA, 22 nt, Human
aaggcaguacuuuauguccaua

SEQ ID NO: 1056196 - RNA, 20 nt, Human
augugucuguaaacaacucu

SEQ ID NO: 1056197 - RNA, 23 nt, Human
ccagugugguagguccacaggug

SEQ ID NO: 1056198 - RNA, 18 nt, Human
gagagggaucccucagga

SEQ ID NO: 1056199 - RNA, 22 nt, Human
cccagggauuauaaaggugaaa

SEQ ID NO: 1056200 - RNA, 22 nt, Human
ucuucaaguuccaaagugcagg

SEQ ID NO: 1056201 - RNA, 22 nt, Human
aauauaugugguauugaccagc

SEQ ID NO: 1056202 - RNA, 22 nt, Human
cugccucacauuggcuguguga

SEQ ID NO: 1056203 - RNA, 22 nt, Human
gucaggaugcuauuguuauuaa

SEQ ID NO: 1056204 - RNA, 22 nt, Human
uccuuagagauacugucuugaa

SEQ ID NO: 1056205 - RNA, 19 nt, Human
cccaggagucuggcugguu

SEQ ID NO: 1056206 - RNA, 22 nt, Human
uuauguaggauaaugaauugcc

SEQ ID NO: 1056207 - RNA, 22 nt, Human
guggcagagccgugcagguagg

SEQ ID NO: 1056208 - RNA, 22 nt, Human
uucaguuucguuaucuaugaga

SEQ ID NO: 1056209 - RNA, 22 nt, Human
uccuucuuucccccuagucauu

SEQ ID NO: 1056210 - RNA, 22 nt, Human
ugcugagguuguggagugcauu

SEQ ID NO: 1056211 - RNA, 20 nt, Human
caucaucacaugagccaauu

SEQ ID NO: 1056212 - RNA, 22 nt, Human
gucugcugcagagcauggcuuu

SEQ ID NO: 1056213 - RNA, 19 nt, Human
ggcagucucaagcagcaca

SEQ ID NO: 1056214 - RNA, 22 nt, Human
ucugagguguagcugggcuuca

SEQ ID NO: 1056215 - RNA, 22 nt, Human
uggcagcagacaaaaggccauu

SEQ ID NO: 1056216 - RNA, 22 nt, Human
cccaggaaugaggggcggaggc

SEQ ID NO: 1056217 - RNA, 22 nt, Human
gcuggccaguguggugaccacc

SEQ ID NO: 1056218 - RNA, 22 nt, Human
caaguaacuugauuaagguaag

SEQ ID NO: 1056219 - RNA, 22 nt, Human
caaggccaagguuuugugaacu

SEQ ID NO: 1056220 - RNA, 22 nt, Human
aguuacaguguucuauuacucu

SEQ ID NO: 1056221 - RNA, 22 nt, Human
ccuuaaauucuccauuugaaag

SEQ ID NO: 1056222 - RNA, 22 nt, Human
uuuaggaucaaugagaaagucu

SEQ ID NO: 1056223 - RNA, 22 nt, Human
auuggcagaaacagcagggcca

SEQ ID NO: 1056224 - RNA, 22 nt, Human
gaaaggccauuucugaggguuu

SEQ ID NO: 1056225 - RNA, 22 nt, Human
ggugaagguggaacgcagagca

SEQ ID NO: 1056226 - RNA, 23 nt, Human
acagaaaguucugcuggacagag

SEQ ID NO: 1056227 - RNA, 22 nt, Human
uugcugaagugaagguauguuu

SEQ ID NO: 1056228 - RNA, 22 nt, Human
ugcugcuguugacggcugucca

SEQ ID NO: 1056229 - RNA, 22 nt, Human
gcuccuggugcaaaguuucuuc

SEQ ID NO: 1056230 - RNA, 20 nt, Human
cucaggauugucuagccccu

SEQ ID NO: 1056231 - RNA, 22 nt, Human
auuauuagugauguuguuacug

SEQ ID NO: 1056232 - RNA, 22 nt, Human
uuccaugaaauguguuaugcuu

SEQ ID NO: 1056233 - RNA, 22 nt, Human
aggcaguuuaggcagcgauuua

SEQ ID NO: 1056234 - RNA, 22 nt, Human
gcucaggaccgaggggugggaa

SEQ ID NO: 1056235 - RNA, 20 nt, Human
cugagagucugugcuuaguc

SEQ ID NO: 1056236 - RNA, 23 nt, Human
caguggagacucaugcuuccuua

SEQ ID NO: 1056237 - RNA, 23 nt, Human
ucaggauauugugugccaaggug

SEQ ID NO: 1056238 - RNA, 22 nt, Human
gaggcugaggguuagagaguca

SEQ ID NO: 1056239 - RNA, 22 nt, Human
uucuuauagaagcaaccauugu

SEQ ID NO: 1056240 - RNA, 23 nt, Human
guaaaauacgcagugcaguguga

SEQ ID NO: 1056241 - RNA, 22 nt, Human
ucacugcucagucuguacuaca

SEQ ID NO: 1056242 - RNA, 22 nt, Human
aaguaaaauguuuccuuuauua

SEQ ID NO: 1056243 - RNA, 22 nt, Human
uugagaaauguuuuuuaagcug

SEQ ID NO: 1056244 - RNA, 21 nt, Human
aggcagcaggauccagggaca

SEQ ID NO: 1056245 - RNA, 22 nt, Human
cauucucaauaguagaugagua

SEQ ID NO: 1056246 - RNA, 22 nt, Human
gugguuuugccauuacaaguaa

SEQ ID NO: 1056247 - RNA, 22 nt, Human
cagcuuucaucagugacacuca

SEQ ID NO: 1056248 - RNA, 22 nt, Human
gggcugaggcuaccacuggucu

SEQ ID NO: 1056249 - RNA, 22 nt, Human
agcugcccugguaagauugaug

SEQ ID NO: 1056250 - RNA, 22 nt, Human
cugcugugauugggagaaaccg

SEQ ID NO: 1056251 - RNA, 22 nt, Human
uucaggauggcggauguugggg

SEQ ID NO: 1056252 - RNA, 22 nt, Human
cagagcugcuucccaguuugug

SEQ ID NO: 1056253 - RNA, 22 nt, Human
aaggccagcuuguagggcuggu

SEQ ID NO: 1056254 - RNA, 22 nt, Human
uggaaugacagagagucugaau

SEQ ID NO: 1056255 - RNA, 22 nt, Human
ucaggcugauaggaggaacuga

SEQ ID NO: 1056256 - RNA, 22 nt, Human
guuaucaugcuucaucaucacu

SEQ ID NO: 1056257 - RNA, 22 nt, Human
aguuaucagguguuuucaugga

SEQ ID NO: 1056258 - RNA, 22 nt, Human
cugcgcagcaaucagagaggag

SEQ ID NO: 1056259 - RNA, 22 nt, Human
uucauucuuauuugugaucugg

SEQ ID NO: 1056260 - RNA, 19 nt, Human
acagagcucucugcuucug

SEQ ID NO: 1056261 - RNA, 22 nt, Human
gcccagggcagggcaagaguga

SEQ ID NO: 1056262 - RNA, 22 nt, Human
ucuuugcaaaauacaacaaugg

SEQ ID NO: 1056263 - RNA, 22 nt, Human
uagcucuucauuucaucugauu

SEQ ID NO: 1056264 - RNA, 22 nt, Human
ggcagcugucucugaguuagca

SEQ ID NO: 1056265 - RNA, 22 nt, Human
agugcuuuauguuguugugcaa

SEQ ID NO: 1056266 - RNA, 22 nt, Human
auguauuucuauguagugaaga

SEQ ID NO: 1056267 - RNA, 22 nt, Human
aggagggagcuuaagccaggca

SEQ ID NO: 1056268 - RNA, 23 nt, Human
cagggcugggcuugguguuaggc

SEQ ID NO: 1056269 - RNA, 22 nt, Human
ucagugaucuaaggguauggcc

SEQ ID NO: 1056270 - RNA, 22 nt, Human
gacugguaaggaaauucacuaa

SEQ ID NO: 1056271 - RNA, 22 nt, Human
ccacaguagaauucaucucccu

SEQ ID NO: 1056272 - RNA, 21 nt, Human
aguugcugcugcugcagguga

SEQ ID NO: 1056273 - RNA, 22 nt, Human
uugcaggaaacugagugugagc

SEQ ID NO: 1056274 - RNA, 22 nt, Human
uagcagcaauuacacaguccgu

SEQ ID NO: 1056275 - RNA, 22 nt, Human
aggcuccagcagccagaggaag

SEQ ID NO: 1056276 - RNA, 22 nt, Human
gacugaggcuccccuaggcuca

SEQ ID NO: 1056277 - RNA, 22 nt, Human
ucccagggauccuccgggucgc

SEQ ID NO: 1056278 - RNA, 22 nt, Human
gcugccugcacagagcugcuuu

SEQ ID NO: 1056279 - RNA, 22 nt, Human
ggcugcuggaagacugaacaag

SEQ ID NO: 1056280 - RNA, 22 nt, Human
gaagcagcuggugagauggagc

SEQ ID NO: 1056281 - RNA, 22 nt, Human
cagcaggauaugguggagagag

SEQ ID NO: 1056282 - RNA, 22 nt, Human
auugaaagauuuugggcucaug

SEQ ID NO: 1056283 - RNA, 22 nt, Human
ugcuuucaaaggcuuucuagau

SEQ ID NO: 1056284 - RNA, 22 nt, Human
agugcaggagccuggccagagc

SEQ ID NO: 1056285 - RNA, 22 nt, Human
ccuccugggcuccugucugcac

SEQ ID NO: 1056286 - RNA, 20 nt, Human
accaauguuagcuuaguacu

SEQ ID NO: 1056287 - RNA, 18 nt, Human
acauacauucugucugca

SEQ ID NO: 1056288 - RNA, 19 nt, Human
auacagauguauccaugau

SEQ ID NO: 1056289 - RNA, 22 nt, Human
aaagauuaaaucaaauugguca

SEQ ID NO: 1056290 - RNA, 22 nt, Human
uccugggcuuaagugauccucc

SEQ ID NO: 1056291 - RNA, 22 nt, Human
ggcagcuucuuaauauggagac

SEQ ID NO: 1056292 - RNA, 22 nt, Human
uacugcaugguggaguggagcu

SEQ ID NO: 1056293 - RNA, 22 nt, Human
cuguaaauaugaagaauauaug

SEQ ID NO: 1056294 - RNA, 22 nt, Human
gaugccucuuuuggcugaauua

SEQ ID NO: 1056295 - RNA, 22 nt, Human
aagggcugcaauccaaaacacu

SEQ ID NO: 1056296 - RNA, 22 nt, Human
ugagaacugaggauuugaauuc

SEQ ID NO: 1056297 - RNA, 22 nt, Human
acagugaggaagcagcugugcu

SEQ ID NO: 1056298 - RNA, 22 nt, Human
augauauuugcaaugugcuugc

SEQ ID NO: 1056299 - RNA, 22 nt, Human
uuucagggagccuagaagagcu

SEQ ID NO: 1056300 - RNA, 21 nt, Human
gcuccuggugcugcguggcgc

SEQ ID NO: 1056301 - RNA, 19 nt, Human
aggguggcaaaggagggug

SEQ ID NO: 1056302 - RNA, 20 nt, Human
agggcugagaagggacuagc

SEQ ID NO: 1056303 - RNA, 20 nt, Human
uuggccaaaucuuagucaug

SEQ ID NO: 1056304 - RNA, 22 nt, Human
uucauugugauucuuggcuagc

SEQ ID NO: 1056305 - RNA, 23 nt, Human
gcccucccucccagguggguguu

SEQ ID NO: 1056306 - RNA, 20 nt, Human
caggaugauuggacacgaug

SEQ ID NO: 1056307 - RNA, 22 nt, Human
uggcugagggggcucugcucag

SEQ ID NO: 1056308 - RNA, 22 nt, Human
uggcagcugugcuucauucuuu

SEQ ID NO: 1056309 - RNA, 22 nt, Human
aggcugagacugugcauuagug

SEQ ID NO: 1056310 - RNA, 22 nt, Human
agccagcuguucuggggcagca

SEQ ID NO: 1056311 - RNA, 17 nt, Human
gccaggagguuugagcu

SEQ ID NO: 1056312 - RNA, 22 nt, Human
auuacaguaacagcuacaaugc

SEQ ID NO: 1056313 - RNA, 22 nt, Human
gaauuuaagaggaugaaucugu

SEQ ID NO: 1056314 - RNA, 22 nt, Human
cauccugguuaccccauaguca

SEQ ID NO: 1056315 - RNA, 22 nt, Human
aggauuugaaccugcauccagu

SEQ ID NO: 1056316 - RNA, 22 nt, Human
ugaaggcccuaucuccauauac

SEQ ID NO: 1056317 - RNA, 22 nt, Human
uguugagacugagggagucagc

SEQ ID NO: 1056318 - RNA, 22 nt, Human
ugaggcagggagaguggauaug

SEQ ID NO: 1056319 - RNA, 22 nt, Human
ccugggauuuccugagcacucu

SEQ ID NO: 1056320 - RNA, 20 nt, Human
auaaaauaacugccacaaga

SEQ ID NO: 1056321 - RNA, 22 nt, Human
agaggcaguauacaauccgagc

SEQ ID NO: 1056322 - RNA, 22 nt, Human
ucuuuguaacugucuauugaga

SEQ ID NO: 1056323 - RNA, 22 nt, Human
uuggccaauuuagaacguguug

SEQ ID NO: 1056324 - RNA, 22 nt, Human
aauuuuaagcauaugacugguu

SEQ ID NO: 1056325 - RNA, 22 nt, Human
aggcugagagcaacgugucaga

SEQ ID NO: 1056326 - RNA, 22 nt, Human
gcugcuguuccuccaguggauc

SEQ ID NO: 1056327 - RNA, 22 nt, Human
uugaaagacuucuccugugaaa

SEQ ID NO: 1056328 - RNA, 22 nt, Human
gauugaaacauaggcagucgag

SEQ ID NO: 1056329 - RNA, 22 nt, Human
uugaaagaggcaaaguuugauc

SEQ ID NO: 1056330 - RNA, 22 nt, Human
ucugaagccuuuguacaggccu

SEQ ID NO: 1056331 - RNA, 22 nt, Human
ugucugugaccucuuuggagcc

SEQ ID NO: 1056332 - RNA, 19 nt, Human
cugggccagaaucagcuca

SEQ ID NO: 1056333 - RNA, 22 nt, Human
ucaggcuggagugcaguggcgc

SEQ ID NO: 1056334 - RNA, 21 nt, Human
uggcagacuagaguauagaug

SEQ ID NO: 1056335 - RNA, 22 nt, Human
uggcuucugucccugcuacauu

SEQ ID NO: 1056336 - RNA, 22 nt, Human
caugaggugauaaagcugggau

SEQ ID NO: 1056337 - RNA, 22 nt, Human
gauagauaaaacuauauuuuca

SEQ ID NO: 1056338 - RNA, 22 nt, Human
uacaguaaccuuauuugucauu

SEQ ID NO: 1056339 - RNA, 22 nt, Human
uccuggccgccgcguggggccg

SEQ ID NO: 1056340 - RNA, 22 nt, Human
uuauccaagcagaagcugcaca

SEQ ID NO: 1056341 - RNA, 19 nt, Human
uggcugagcuggacugagg

SEQ ID NO: 1056342 - RNA, 22 nt, Human
uagauaaaagggcaaagggcau

SEQ ID NO: 1056343 - RNA, 22 nt, Human
agaccaagacuauaaugagagg

SEQ ID NO: 1056344 - RNA, 22 nt, Human
ugaggcaggacuugcauaaagu

SEQ ID NO: 1056345 - RNA, 22 nt, Human
agaaaugaagcaggaguuauua

SEQ ID NO: 1056346 - RNA, 22 nt, Human
ugucucaguacacuccgauguu

SEQ ID NO: 1056347 - RNA, 22 nt, Human
caugauuuugucuuguguuaau

SEQ ID NO: 1056348 - RNA, 22 nt, Human
ccucuucugcuucaggagcacu

SEQ ID NO: 1056349 - RNA, 22 nt, Human
cacauauuugaugaagcuuugu

SEQ ID NO: 1056350 - RNA, 22 nt, Human
cuugcugucccuugguaugaac

SEQ ID NO: 1056351 - RNA, 22 nt, Human
gauuuggccuuucgcaugguau

SEQ ID NO: 1056352 - RNA, 22 nt, Human
gggucugaggaguaccauuguc

SEQ ID NO: 1056353 - RNA, 22 nt, Human
auugaaagcauggauuuggauu

SEQ ID NO: 1056354 - RNA, 21 nt, Human
agccuguugguuuacugcuca

SEQ ID NO: 1056355 - RNA, 22 nt, Human
uuaguaaauaaagucuacuuuc

SEQ ID NO: 1056356 - RNA, 22 nt, Human
aauuuccagaccccauccacag

SEQ ID NO: 1056357 - RNA, 22 nt, Human
caaaauuagaaaugcagcuguu

SEQ ID NO: 1056358 - RNA, 22 nt, Human
ucugggaauuuauuggcacuuu

SEQ ID NO: 1056359 - RNA, 22 nt, Human
aagggcuggaauaucucuuaga

SEQ ID NO: 1056360 - RNA, 22 nt, Human
ucugcccucauugcugccugga

SEQ ID NO: 1056361 - RNA, 22 nt, Human
cucaugauguagcgaaugagaa

SEQ ID NO: 1056362 - RNA, 22 nt, Human
cucacugacgaggaagcugaga

SEQ ID NO: 1056363 - RNA, 22 nt, Human
cagacaggagacuggaucaugg

SEQ ID NO: 1056364 - RNA, 22 nt, Human
uggcagcagacaucugaggucu

SEQ ID NO: 1056365 - RNA, 19 nt, Human
gcugagguggaggaaggag

SEQ ID NO: 1056366 - RNA, 22 nt, Human
caaaugaagguggugggucauu

SEQ ID NO: 1056367 - RNA, 22 nt, Human
gggacuucauagcuaggcacuu

SEQ ID NO: 1056368 - RNA, 22 nt, Human
agagggcaaguguaguccagua

SEQ ID NO: 1056369 - RNA, 22 nt, Human
gacagcuggcaguggaaaggug

SEQ ID NO: 1056370 - RNA, 20 nt, Human
aggccaaacccagcgcgccc

SEQ ID NO: 1056371 - RNA, 22 nt, Human
auuuccuuugcaaagacugugc

SEQ ID NO: 1056372 - RNA, 22 nt, Human
uuuuucaagacaaccugcaugu

SEQ ID NO: 1056373 - RNA, 22 nt, Human
uacacuauuuuacugauacaaa

SEQ ID NO: 1056374 - RNA, 22 nt, Human
ucugcagguguuggaaggguca

SEQ ID NO: 1056375 - RNA, 22 nt, Human
uuuauagggacaguucuuggag

SEQ ID NO: 1056376 - RNA, 22 nt, Human
uuagaaagggugucugaaucug

SEQ ID NO: 1056377 - RNA, 22 nt, Human
ucaggcugaaucauccuagcuu

SEQ ID NO: 1056378 - RNA, 22 nt, Human
acacaaugcauauuuuuccaga

SEQ ID NO: 1056379 - RNA, 22 nt, Human
accaggagaggcacuugcaaug

SEQ ID NO: 1056380 - RNA, 19 nt, Human
uugaaauuguuugauaugg

SEQ ID NO: 1056381 - RNA, 22 nt, Human
gcugucccgcugacuuccagcu

SEQ ID NO: 1056382 - RNA, 22 nt, Human
ucuucacaggagccugccugcc

SEQ ID NO: 1056383 - RNA, 22 nt, Human
aggcagacugugcgggaagagu

SEQ ID NO: 1056384 - RNA, 20 nt, Human
uauuaggaaggaggaaggaa

SEQ ID NO: 1056385 - RNA, 22 nt, Human
cuccuggcacugucuugaccca

SEQ ID NO: 1056386 - RNA, 22 nt, Human
cagugcuggcuguuaggacagu

SEQ ID NO: 1056387 - RNA, 20 nt, Human
uccuggccucccuggggcuc

SEQ ID NO: 1056388 - RNA, 22 nt, Human
uaucuguucaauggaagaugac

SEQ ID NO: 1056389 - RNA, 22 nt, Human
ggcagcaucacuugucuccagc

SEQ ID NO: 1056390 - RNA, 22 nt, Human
cugccucuugacagaucguggc

SEQ ID NO: 1056391 - RNA, 22 nt, Human
acuccuggggauccauuccuuu

SEQ ID NO: 1056392 - RNA, 22 nt, Human
ccucuucuagguuucagccugc

SEQ ID NO: 1056393 - RNA, 22 nt, Human
guugaaugaaucauucuaugua

SEQ ID NO: 1056394 - RNA, 22 nt, Human
uaagaacuucggacauguuauc

SEQ ID NO: 1056395 - RNA, 22 nt, Human
cuggaggcacccuuagagaggc

SEQ ID NO: 1056396 - RNA, 22 nt, Human
caucacccggaacugugucugc

SEQ ID NO: 1056397 - RNA, 22 nt, Human
gcuggcugaguucugucgucug

SEQ ID NO: 1056398 - RNA, 22 nt, Human
gcaggagaaaugaagauugggu

SEQ ID NO: 1056399 - RNA, 22 nt, Human
aagcuggaacaucuugaggaag

SEQ ID NO: 1056400 - RNA, 22 nt, Human
aggugagggugccagugcaugg

SEQ ID NO: 1056401 - RNA, 22 nt, Human
gaggcugagaguuuguucuacu

SEQ ID NO: 1056402 - RNA, 22 nt, Human
cuuaacauccugcauuuuucuu

SEQ ID NO: 1056403 - RNA, 22 nt, Human
guccacagcuggccagggccuc

SEQ ID NO: 1056404 - RNA, 22 nt, Human
ccccugccagcuaucccugaac

SEQ ID NO: 1056405 - RNA, 22 nt, Human
cucagaagaacaaaggcucuac

SEQ ID NO: 1056406 - RNA, 22 nt, Human
ccugguggcgaauggugguagg

SEQ ID NO: 1056407 - RNA, 22 nt, Human
uucucagagcacugcugacaaa

SEQ ID NO: 1056408 - RNA, 22 nt, Human
acauuucuaguuguucaucucc

SEQ ID NO: 1056409 - RNA, 22 nt, Human
cuacagacccaccuuggaagaa

SEQ ID NO: 1056410 - RNA, 22 nt, Human
cccaggaaaucaggcuuucuag

SEQ ID NO: 1056411 - RNA, 22 nt, Human
ucugcaggcuguacaggaagca

SEQ ID NO: 1056412 - RNA, 22 nt, Human
augugaggaagaaagagguaag

SEQ ID NO: 1056413 - RNA, 22 nt, Human
gugugcaggugucagugcagcu

SEQ ID NO: 1056414 - RNA, 22 nt, Human
caucaucaaaacaaauggaguc

SEQ ID NO: 1056415 - RNA, 22 nt, Human
uuccucagaaaauacuguccaa

SEQ ID NO: 1056416 - RNA, 22 nt, Human
gcagcugccuucagcuggaugg

SEQ ID NO: 1056417 - RNA, 22 nt, Human
auuagguugugcuuuguggaca

SEQ ID NO: 1056418 - RNA, 22 nt, Human
ugguaauuuacgcauuucugua

SEQ ID NO: 1056419 - RNA, 22 nt, Human
acuuucuuaggcuguauaaaug

SEQ ID NO: 1056420 - RNA, 22 nt, Human
ggcaggcaggagcgugcuuggg

SEQ ID NO: 1056421 - RNA, 22 nt, Human
auauuaggcaaggagauuauuu

SEQ ID NO: 1056422 - RNA, 22 nt, Human
uaggcugacuuguuucauaaag

SEQ ID NO: 1056423 - RNA, 22 nt, Human
ccuuuauucaauuaguccuaau

SEQ ID NO: 1056424 - RNA, 22 nt, Human
uucuccucuguuggccuucccu

SEQ ID NO: 1056425 - RNA, 22 nt, Human
guacauuucucuuguucuuauu

SEQ ID NO: 1056426 - RNA, 22 nt, Human
gcugagcacaccuaggguagag

SEQ ID NO: 1056427 - RNA, 22 nt, Human
gcauacagagaggauguggcau

SEQ ID NO: 1056428 - RNA, 22 nt, Human
uuugaaagucaaccuuccaguu

SEQ ID NO: 1056429 - RNA, 22 nt, Human
aacauagagacaggaagugcuu

SEQ ID NO: 1056430 - RNA, 23 nt, Human
cagcccuuccugcauguuuuugu

SEQ ID NO: 1056431 - RNA, 22 nt, Human
aagaggagacuucagcaacuug

SEQ ID NO: 1056432 - RNA, 22 nt, Human
ugcuuuggaucuauuugcugag

SEQ ID NO: 1056433 - RNA, 22 nt, Human
agcugaggcucugagagggaag

SEQ ID NO: 1056434 - RNA, 17 nt, Human
ccagagcuacugagacu

SEQ ID NO: 1056435 - RNA, 23 nt, Human
ggcagcucucaucugaugacuga

SEQ ID NO: 1056436 - RNA, 22 nt, Human
ucugggaaaugcuguuccuugu

SEQ ID NO: 1056437 - RNA, 22 nt, Human
uagcaagaccaauauguagaua

SEQ ID NO: 1056438 - RNA, 22 nt, Human
uaacacauauuucaagaguagu

SEQ ID NO: 1056439 - RNA, 22 nt, Human
augcuuuuaugucacaugguca

SEQ ID NO: 1056440 - RNA, 22 nt, Human
acaggcugaaaguuaaguucug

SEQ ID NO: 1056441 - RNA, 22 nt, Human
cuccuggaggauagugacuggg

SEQ ID NO: 1056442 - RNA, 22 nt, Human
cuggcucaggaaaguugcugcu

SEQ ID NO: 1056443 - RNA, 19 nt, Human
gcuccuggaugaccugugg

SEQ ID NO: 1056444 - RNA, 22 nt, Human
cuuuggcaaugucauuuucaau

SEQ ID NO: 1056445 - RNA, 22 nt, Human
cacuuucuguguugugcaaaaa

SEQ ID NO: 1056446 - RNA, 22 nt, Human
uucaggauccccuugaugggcu

SEQ ID NO: 1056447 - RNA, 22 nt, Human
caaaugaauagggagugugaug

SEQ ID NO: 1056448 - RNA, 22 nt, Human
gaacuguucccucacaggcugg

SEQ ID NO: 1056449 - RNA, 22 nt, Human
uggccacacccaccuagaggag

SEQ ID NO: 1056450 - RNA, 22 nt, Human
gucauucuuaacaacucaguag

SEQ ID NO: 1056451 - RNA, 19 nt, Human
accaggagacagugagcuu

SEQ ID NO: 1056452 - RNA, 22 nt, Human
gaggagagggcugcgggcccac

SEQ ID NO: 1056453 - RNA, 22 nt, Human
ugaaugaguuuggcugcuguuc

SEQ ID NO: 1056454 - RNA, 23 nt, Human
ggcugagacuacaggcgcuugcc

SEQ ID NO: 1056455 - RNA, 22 nt, Human
ucuggccacuugcuucacacug

SEQ ID NO: 1056456 - RNA, 20 nt, Human
uuucugugagaaacacuguu

SEQ ID NO: 1056457 - RNA, 19 nt, Human
aggcagcaggccagggaug

SEQ ID NO: 1056458 - RNA, 22 nt, Human
guggcaggagagacacagccau

SEQ ID NO: 1056459 - RNA, 22 nt, Human
ccugggcaacauagggagaccc

SEQ ID NO: 1056460 - RNA, 22 nt, Human
gagaagcaaucaguggccaccc

SEQ ID NO: 1056461 - RNA, 22 nt, Human
uggcagcuagauaguguguuua

SEQ ID NO: 1056462 - RNA, 22 nt, Human
gacuucuguuaacuuguaagag

SEQ ID NO: 1056463 - RNA, 20 nt, Human
aggcagcugggaaaugaggg

SEQ ID NO: 1056464 - RNA, 22 nt, Human
aggcucagccugggccuagagc

SEQ ID NO: 1056465 - RNA, 22 nt, Human
uggcuucugcauauuuuuagag

SEQ ID NO: 1056466 - RNA, 22 nt, Human
gggcugaggaacauauuuuguu

SEQ ID NO: 1056467 - RNA, 22 nt, Human
ccacugaggcaggcaguaucua

SEQ ID NO: 1056468 - RNA, 22 nt, Human
uaaugcuuaacagcuggcuuuu

SEQ ID NO: 1056469 - RNA, 17 nt, Human
cccaugagcccacuccc

SEQ ID NO: 1056470 - RNA, 22 nt, Human
aaguuacaguuauuauuuaaaa

SEQ ID NO: 1056471 - RNA, 22 nt, Human
cagaaguuagacuucaacuaau

SEQ ID NO: 1056472 - RNA, 22 nt, Human
gggcagcugccccucucugggc

SEQ ID NO: 1056473 - RNA, 22 nt, Human
ucuggagaggaggauguggaca

SEQ ID NO: 1056474 - RNA, 17 nt, Human
augaggucauuaagaua

SEQ ID NO: 1056475 - RNA, 22 nt, Human
gcugagucagauugcagucuug

SEQ ID NO: 1056476 - RNA, 22 nt, Human
aaggcagccuuuguuugauuga

SEQ ID NO: 1056477 - RNA, 22 nt, Human
uagaaagagcauaguauuauaa

SEQ ID NO: 1056478 - RNA, 22 nt, Human
acuccuggugcugaugaagaga

SEQ ID NO: 1056479 - RNA, 22 nt, Human
caacugugaauuuuaugauacc

SEQ ID NO: 1056480 - RNA, 22 nt, Human
gcccagugcugagggugcugcu

SEQ ID NO: 1056481 - RNA, 22 nt, Human
cccaggaaaguggaggcggcug

SEQ ID NO: 1056482 - RNA, 23 nt, Human
cccuggaguaaauucuuggaagg

SEQ ID NO: 1056483 - RNA, 22 nt, Human
gcuggcuugauaguuucugcuu

SEQ ID NO: 1056484 - RNA, 22 nt, Human
aggcugagccacggggcuggcu

SEQ ID NO: 1056485 - RNA, 22 nt, Human
auggccaacugaaaugaaagau

SEQ ID NO: 1056486 - RNA, 22 nt, Human
ggcaggcugcuugggucauguc

SEQ ID NO: 1056487 - RNA, 22 nt, Human
ggcugagaguuuccucuggggc

SEQ ID NO: 1056488 - RNA, 22 nt, Human
acucauugaaacuuaagaucua

SEQ ID NO: 1056489 - RNA, 22 nt, Human
uuuuuguagucauuagaagagg

SEQ ID NO: 1056490 - RNA, 22 nt, Human
caggcagccugagggaucuggg

SEQ ID NO: 1056491 - RNA, 22 nt, Human
cacugguaguuucagcaaccag

SEQ ID NO: 1056492 - RNA, 22 nt, Human
aucacaaaggcugcuucaugau

SEQ ID NO: 1056493 - RNA, 22 nt, Human
cuggcugggagcgagcugcuca

SEQ ID NO: 1056494 - RNA, 22 nt, Human
gugcugagcacaccuuggagca

SEQ ID NO: 1056495 - RNA, 22 nt, Human
ggccugagcagacagcaugaug

SEQ ID NO: 1056496 - RNA, 22 nt, Human
uucucagaggagucgggagcug

SEQ ID NO: 1056497 - RNA, 22 nt, Human
cugccuggccacaacccagggu

SEQ ID NO: 1056498 - RNA, 22 nt, Human
aggcuccaugcaaaggcuguuu

SEQ ID NO: 1056499 - RNA, 22 nt, Human
uaaaugaaaggguuuaauuuau

SEQ ID NO: 1056500 - RNA, 22 nt, Human
gcccaggauucuuucuuccuua

SEQ ID NO: 1056501 - RNA, 22 nt, Human
gcugagguccagcauucgccua

SEQ ID NO: 1056502 - RNA, 20 nt, Human
augauuuugcacuaacuuca

SEQ ID NO: 1056503 - RNA, 22 nt, Human
ucaggcuguggcuuugaccgca

SEQ ID NO: 1056504 - RNA, 22 nt, Human
caaggcugugcaggguccauau

SEQ ID NO: 1056505 - RNA, 22 nt, Human
acacuucucuuugaagaacaau

SEQ ID NO: 1056506 - RNA, 22 nt, Human
aaagcagagcagggcacuuaug

SEQ ID NO: 1056507 - RNA, 22 nt, Human
agaggggacagccaccugcccg

SEQ ID NO: 1056508 - RNA, 22 nt, Human
uggcugagagcaauugacucug

SEQ ID NO: 1056509 - RNA, 22 nt, Human
cccagggaaggcagauggagga

SEQ ID NO: 1056510 - RNA, 22 nt, Human
auacacauguguaugugcaugc

SEQ ID NO: 1056511 - RNA, 19 nt, Human
aguccaugaauggaggaug

SEQ ID NO: 1056512 - RNA, 22 nt, Human
gacuuucuguccagugauuucu

SEQ ID NO: 1056513 - RNA, 22 nt, Human
cuuuuccacugagccucacaaa

SEQ ID NO: 1056514 - RNA, 22 nt, Human
aagaacuguaucaagauguagu

SEQ ID NO: 1056515 - RNA, 22 nt, Human
uacuaggaagcagcugcauugg

SEQ ID NO: 1056516 - RNA, 22 nt, Human
guuauuagaagugaaggauugu

SEQ ID NO: 1056517 - RNA, 22 nt, Human
gcuccuggcucucugagggcug

SEQ ID NO: 1056518 - RNA, 22 nt, Human
uucaggaugcagagguuguagu

SEQ ID NO: 1056519 - RNA, 18 nt, Human
cugcccagagcauuucau

SEQ ID NO: 1056520 - RNA, 22 nt, Human
ccugguugugaguugaguugag

SEQ ID NO: 1056521 - RNA, 22 nt, Human
aggagaggaaucauuauuacaa

SEQ ID NO: 1056522 - RNA, 22 nt, Human
ucuugcuaaagaccaacacauu

SEQ ID NO: 1056523 - RNA, 22 nt, Human
cuuaauaauaggugaggcuaug

SEQ ID NO: 1056524 - RNA, 22 nt, Human
aaggcagccuuuugaguugauu

SEQ ID NO: 1056525 - RNA, 22 nt, Human
aacaucuacuaagugccaggca

SEQ ID NO: 1056526 - RNA, 22 nt, Human
augauguuauuuucagaaacau

SEQ ID NO: 1056527 - RNA, 22 nt, Human
ggcagcaucucuggcagcagcu

SEQ ID NO: 1056528 - RNA, 22 nt, Human
ugccuugcgggcguuucuguug

SEQ ID NO: 1056529 - RNA, 23 nt, Human
uagagcaguagaucaccauggga

SEQ ID NO: 1056530 - RNA, 22 nt, Human
ucaggagacauucuuaaaguag

SEQ ID NO: 1056531 - RNA, 22 nt, Human
aagaugacuauuuaucuguaag

SEQ ID NO: 1056532 - RNA, 17 nt, Human
agcagcugaagcagcca

SEQ ID NO: 1056533 - RNA, 18 nt, Human
ucuuggcagcaucuggca

SEQ ID NO: 1056534 - RNA, 22 nt, Human
cugaggccugggggcguggacg

SEQ ID NO: 1056535 - RNA, 22 nt, Human
gccaucacauccaggcuaccuc

SEQ ID NO: 1056536 - RNA, 22 nt, Human
ucugucuccucugaggugccag

SEQ ID NO: 1056537 - RNA, 21 nt, Human
uucugagcacucaucacuguc

SEQ ID NO: 1056538 - RNA, 22 nt, Human
ccuguccuccaagagcacaucu

SEQ ID NO: 1056539 - RNA, 22 nt, Human
cccaggagguggagguugcagu

SEQ ID NO: 1056540 - RNA, 22 nt, Human
cauuuguauagugcuuagacca

SEQ ID NO: 1056541 - RNA, 22 nt, Human
uggcaacauggacaggucugcc

SEQ ID NO: 1056542 - RNA, 22 nt, Human
acugaggucucagguggggaag

SEQ ID NO: 1056543 - RNA, 22 nt, Human
gaggcaugcagagcuggagcag

SEQ ID NO: 1056544 - RNA, 22 nt, Human
uagugcagguuaauaggacuuc

SEQ ID NO: 1056545 - RNA, 17 nt, Human
gcgcagcuccuggcgcg

SEQ ID NO: 1056546 - RNA, 22 nt, Human
ccuggccaaucuagggcuguua

SEQ ID NO: 1056547 - RNA, 22 nt, Human
ggcuggagaagggugguugaca

SEQ ID NO: 1056548 - RNA, 22 nt, Human
ugacagaaagaauaugucaauc

SEQ ID NO: 1056549 - RNA, 22 nt, Human
ucugccugccagucugguccuc

SEQ ID NO: 1056550 - RNA, 22 nt, Human
ugaggcagauauuuauuggguu

SEQ ID NO: 1056551 - RNA, 22 nt, Human
gaacuggucuuuuagguuuucu

SEQ ID NO: 1056552 - RNA, 22 nt, Human
aggcagcauuugaauccagguc

SEQ ID NO: 1056553 - RNA, 22 nt, Human
gcuggagagauaggcauggggu

SEQ ID NO: 1056554 - RNA, 22 nt, Human
cagcugccccuccagggcuggg

SEQ ID NO: 1056555 - RNA, 18 nt, Human
ucuuuggacaacuacugg

SEQ ID NO: 1056556 - RNA, 22 nt, Human
cagggcuggauccuccagacuc

SEQ ID NO: 1056557 - RNA, 21 nt, Human
gacaggacuagaccagagcuc

SEQ ID NO: 1056558 - RNA, 22 nt, Human
auggccaagcaugccuguggcc

SEQ ID NO: 1056559 - RNA, 22 nt, Human
ggcuguaguuaccugaugaaau

SEQ ID NO: 1056560 - RNA, 22 nt, Human
aggagaggucucccuuccccag

SEQ ID NO: 1056561 - RNA, 22 nt, Human
uucaacuagauuuauacaauuc

SEQ ID NO: 1056562 - RNA, 22 nt, Human
ucugcaggcuuauaggaugggu

SEQ ID NO: 1056563 - RNA, 22 nt, Human
aggagaaggaagugcaucacua

SEQ ID NO: 1056564 - RNA, 22 nt, Human
accaggagccacaggaggagcc

SEQ ID NO: 1056565 - RNA, 22 nt, Human
cugccucucagccugaccgcca

SEQ ID NO: 1056566 - RNA, 22 nt, Human
uauuuccauguuagaacuaagu

SEQ ID NO: 1056567 - RNA, 22 nt, Human
uugcugugucugauggcugaga

SEQ ID NO: 1056568 - RNA, 22 nt, Human
uggcuucuaguuugaggaaaaa

SEQ ID NO: 1056569 - RNA, 22 nt, Human
uucacagacauugcagacugaa

SEQ ID NO: 1056570 - RNA, 22 nt, Human
uuaggauaugaaacaguauaag

SEQ ID NO: 1056571 - RNA, 22 nt, Human
aagcaagaguuggagugauguu

SEQ ID NO: 1056572 - RNA, 22 nt, Human
gaggcugaaguguacaugggug

SEQ ID NO: 1056573 - RNA, 22 nt, Human
agagcugagcaccaagcauggu

SEQ ID NO: 1056574 - RNA, 22 nt, Human
uccccagauucaugucugcugu

SEQ ID NO: 1056575 - RNA, 22 nt, Human
ccccaggagaaaucuuaaacua

SEQ ID NO: 1056576 - RNA, 22 nt, Human
cagagcugcgcuuuuuccuggu

SEQ ID NO: 1056577 - RNA, 22 nt, Human
aggcugaaaacgagauggcaau

SEQ ID NO: 1056578 - RNA, 22 nt, Human
ucugccuggcucauggcaguga

SEQ ID NO: 1056579 - RNA, 22 nt, Human
auauaauacaaccugcuaagug

SEQ ID NO: 1056580 - RNA, 22 nt, Human
ugaggccccgaagcugagguuu

SEQ ID NO: 1056581 - RNA, 22 nt, Human
aaaaaugucauuauggaacuga

SEQ ID NO: 1056582 - RNA, 22 nt, Human
ccaggauggggagcagauagaa

SEQ ID NO: 1056583 - RNA, 22 nt, Human
ggcugcugguggaaugguaggc

SEQ ID NO: 1056584 - RNA, 22 nt, Human
gcucucuugguggcuguccugg

SEQ ID NO: 1056585 - RNA, 22 nt, Human
ugcugcugacauuuggggcuug

SEQ ID NO: 1056586 - RNA, 22 nt, Human
uucugugaaucuuuuuucccac

SEQ ID NO: 1056587 - RNA, 22 nt, Human
gcagaggagaugaagauacuuu

SEQ ID NO: 1056588 - RNA, 20 nt, Human
ggcaugagaugugagggagg

SEQ ID NO: 1056589 - RNA, 22 nt, Human
guucuucagcauuagaagucau

SEQ ID NO: 1056590 - RNA, 22 nt, Human
uuaggaaucaccugcagaucuu

SEQ ID NO: 1056591 - RNA, 22 nt, Human
auucuagauaagaaaagggcug

SEQ ID NO: 1056592 - RNA, 22 nt, Human
ugucucugggugauucaguccu

SEQ ID NO: 1056593 - RNA, 22 nt, Human
uuugaaguucccccauaucaga

SEQ ID NO: 1056594 - RNA, 22 nt, Human
ccaggagagcagaagcccaggc

SEQ ID NO: 1056595 - RNA, 22 nt, Human
cucuucuuuaguccagaccauc

SEQ ID NO: 1056596 - RNA, 17 nt, Human
cagcugugagagccuua

SEQ ID NO: 1056597 - RNA, 22 nt, Human
cugcugugacagcugccguguu

SEQ ID NO: 1056598 - RNA, 22 nt, Human
uucagaauauuuguuuuacaug

SEQ ID NO: 1056599 - RNA, 22 nt, Human
aaguguauauaugacuuauaaa

SEQ ID NO: 1056600 - RNA, 23 nt, Human
uucauuugucuacuucacuuguu

SEQ ID NO: 1056601 - RNA, 22 nt, Human
aucugccuggcuccaggugagc

SEQ ID NO: 1056602 - RNA, 20 nt, Human
ccucaggaugagggugagca

SEQ ID NO: 1056603 - RNA, 22 nt, Human
ccuuuuauaaaguuguauugaa

SEQ ID NO: 1056604 - RNA, 22 nt, Human
uugaacaguccuaagagacccu

SEQ ID NO: 1056605 - RNA, 22 nt, Human
cuacccaggcuggagugcagua

SEQ ID NO: 1056606 - RNA, 22 nt, Human
aguuggagugaacaugagauug

SEQ ID NO: 1056607 - RNA, 22 nt, Human
uagggcugccuauggcuagaua

SEQ ID NO: 1056608 - RNA, 22 nt, Human
ccuggccaggcuccaaguacug

SEQ ID NO: 1056609 - RNA, 22 nt, Human
ggcagcuuucaauaggguuaug

SEQ ID NO: 1056610 - RNA, 22 nt, Human
guaggcagggcuguggggagaa

SEQ ID NO: 1056611 - RNA, 22 nt, Human
uggcagcuggagggcaauggcc

SEQ ID NO: 1056612 - RNA, 22 nt, Human
guggcagcaaaugccuggacua

SEQ ID NO: 1056613 - RNA, 22 nt, Human
aacuuucuauagguugggauuu

SEQ ID NO: 1056614 - RNA, 22 nt, Human
cagaaacuagauuuagacacaa

SEQ ID NO: 1056615 - RNA, 22 nt, Human
ggcugaugagcuuagcuagaga

SEQ ID NO: 1056616 - RNA, 22 nt, Human
caaggccacuccagagacuggu

SEQ ID NO: 1056617 - RNA, 22 nt, Human
cacaaauggccguguucaaaga

SEQ ID NO: 1056618 - RNA, 22 nt, Human
uucagaaagugaaucuuguuau

SEQ ID NO: 1056619 - RNA, 22 nt, Human
aaggcugacucaacagggggcc

SEQ ID NO: 1056620 - RNA, 22 nt, Human
aggguggcuggaggaaucagaa

SEQ ID NO: 1056621 - RNA, 22 nt, Human
uaucaauacauguuaucagugu

SEQ ID NO: 1056622 - RNA, 22 nt, Human
aagauauucaaagauuuauuag

SEQ ID NO: 1056623 - RNA, 22 nt, Human
cagcugagcugccagacuacug

SEQ ID NO: 1056624 - RNA, 22 nt, Human
cugcugugagugguucuugccu

SEQ ID NO: 1056625 - RNA, 22 nt, Human
uaguuuuacuugcgaugauaau

SEQ ID NO: 1056626 - RNA, 17 nt, Human
cucacggaggaugaauc

SEQ ID NO: 1056627 - RNA, 22 nt, Human
ggccaaaucuguaaggcaagau

SEQ ID NO: 1056628 - RNA, 22 nt, Human
uucacauuggugauauguuucu

SEQ ID NO: 1056629 - RNA, 22 nt, Human
uuuuauagcugaauaguauucc

SEQ ID NO: 1056630 - RNA, 22 nt, Human
cgucuuccucuuacgaugcgcu

SEQ ID NO: 1056631 - RNA, 22 nt, Human
ccaccagagggcagacugugau

SEQ ID NO: 1056632 - RNA, 22 nt, Human
auuagagcuguuagugaagugc

SEQ ID NO: 1056633 - RNA, 22 nt, Human
auucuucacaccuguuccuguu

SEQ ID NO: 1056634 - RNA, 22 nt, Human
ucacccuugauaauguucuucu

SEQ ID NO: 1056635 - RNA, 22 nt, Human
gccugccucaaaaucccaguuc

SEQ ID NO: 1056636 - RNA, 22 nt, Human
aaugaaacucgaaauaaucaca

SEQ ID NO: 1056637 - RNA, 21 nt, Human
aggucagcccagcucuggaag

SEQ ID NO: 1056638 - RNA, 22 nt, Human
acaauacaggcuucuggacuua

SEQ ID NO: 1056639 - RNA, 22 nt, Human
caaauacuaaacauaagauuuu

SEQ ID NO: 1056640 - RNA, 22 nt, Human
uugaaauacugcauuguucagu

SEQ ID NO: 1056641 - RNA, 22 nt, Human
ccaggcuggagugcaguagugu

SEQ ID NO: 1056642 - RNA, 23 nt, Human
uguugaaguaacuguuacauaga

SEQ ID NO: 1056643 - RNA, 20 nt, Human
guacacuucauguuucaccu

SEQ ID NO: 1056644 - RNA, 23 nt, Human
aggauguaggauguauggcagag

SEQ ID NO: 1056645 - RNA, 22 nt, Human
ucaggagauggucuuuauaggc

SEQ ID NO: 1056646 - RNA, 22 nt, Human
uccauuuuguagguaugcuaca

SEQ ID NO: 1056647 - RNA, 22 nt, Human
cacaugugugcugaggacugug

SEQ ID NO: 1056648 - RNA, 22 nt, Human
cccaggaaguggagguugcagu

SEQ ID NO: 1056649 - RNA, 20 nt, Human
uccuggccuucucgggcagu

SEQ ID NO: 1056650 - RNA, 21 nt, Human
caaauacuuagaaacuuaaga

SEQ ID NO: 1056651 - RNA, 22 nt, Human
uuagccauuaauguccugugca

SEQ ID NO: 1056652 - RNA, 22 nt, Human
aacuuucuuggaugucucaaca

SEQ ID NO: 1056653 - RNA, 19 nt, Human
ugagaggcuuaaggcagcu

SEQ ID NO: 1056654 - RNA, 22 nt, Human
auacauuagaaucugguacuca

SEQ ID NO: 1056655 - RNA, 22 nt, Human
ucaggcuguauaucuugcacuc

SEQ ID NO: 1056656 - RNA, 22 nt, Human
gagugucugaauuagagcacaa

SEQ ID NO: 1056657 - RNA, 22 nt, Human
gcugaggccucagaaggcugag

SEQ ID NO: 1056658 - RNA, 20 nt, Human
gaagcagcuucauguagaca

SEQ ID NO: 1056659 - RNA, 22 nt, Human
ggagugggaacaaugacauggu

SEQ ID NO: 1056660 - RNA, 22 nt, Human
cugagaguauuggcaggcuugg

SEQ ID NO: 1056661 - RNA, 17 nt, Human
acacagggagagggagc

SEQ ID NO: 1056662 - RNA, 22 nt, Human
acaggcugccuaccaaguauca

SEQ ID NO: 1056663 - RNA, 22 nt, Human
cuuagcaugugguguccuugua

SEQ ID NO: 1056664 - RNA, 18 nt, Human
uuugcaaaggaaguaugg

SEQ ID NO: 1056665 - RNA, 22 nt, Human
ucauuucuccgaccugcugucc

SEQ ID NO: 1056666 - RNA, 22 nt, Human
ccuggccaguuuccaggcccug

SEQ ID NO: 1056667 - RNA, 22 nt, Human
aagaaaugcacacaacugcugg

SEQ ID NO: 1056668 - RNA, 23 nt, Human
cagucugcagcccacuugggcag

SEQ ID NO: 1056669 - RNA, 22 nt, Human
ugcuugugagaguuuuuucaga

SEQ ID NO: 1056670 - RNA, 22 nt, Human
gagugcagaugccagccccagu

SEQ ID NO: 1056671 - RNA, 22 nt, Human
agaggccaugcuagaggccugg

SEQ ID NO: 1056672 - RNA, 22 nt, Human
cccuggaggcaaagguugcagu

SEQ ID NO: 1056673 - RNA, 22 nt, Human
uccauuuucuugcucuagguaa

SEQ ID NO: 1056674 - RNA, 16 nt, Human
uggcugagagaggguu

SEQ ID NO: 1056675 - RNA, 22 nt, Human
augacaaauucagaccauagca

SEQ ID NO: 1056676 - RNA, 20 nt, Human
auacaguaggugcucaauau

SEQ ID NO: 1056677 - RNA, 22 nt, Human
aacauuuaugauugagguaaau

SEQ ID NO: 1056678 - RNA, 22 nt, Human
uuguaaauaguaguaagaugcc

SEQ ID NO: 1056679 - RNA, 22 nt, Human
uugaauaguguuuucaguauac

SEQ ID NO: 1056680 - RNA, 23 nt, Human
uuagagaugauuaaaaaaucuug

SEQ ID NO: 1056681 - RNA, 22 nt, Human
ucuucccuaaucaccaucuuca

SEQ ID NO: 1056682 - RNA, 22 nt, Human
uauuucagcccuacuacuuggc

SEQ ID NO: 1056683 - RNA, 22 nt, Human
cacagcaaagacacucucaacu

SEQ ID NO: 1056684 - RNA, 22 nt, Human
ccuggccagggucugggcugcu

SEQ ID NO: 1056685 - RNA, 22 nt, Human
auuaggaagaggaugucagcau

SEQ ID NO: 1056686 - RNA, 22 nt, Human
aggccaaauguguauaaaacau

SEQ ID NO: 1056687 - RNA, 22 nt, Human
cccaggagacugagcuguaacc

SEQ ID NO: 1056688 - RNA, 22 nt, Human
cccugccuuguuggagccuaug

SEQ ID NO: 1056689 - RNA, 22 nt, Human
gugaggucuuugggaggugauu

SEQ ID NO: 1056690 - RNA, 22 nt, Human
uucuuaacucaaauauauaucc

SEQ ID NO: 1056691 - RNA, 22 nt, Human
uggguccagugcagcugcgcgu

SEQ ID NO: 1056692 - RNA, 22 nt, Human
aguugcucaauguggcugugga

SEQ ID NO: 1056693 - RNA, 22 nt, Human
uagaaaguacuaaauuuaacug

SEQ ID NO: 1056694 - RNA, 22 nt, Human
ugaggcucacgaacagaagacu

SEQ ID NO: 1056695 - RNA, 22 nt, Human
uucaauucugcucugaucuuag

SEQ ID NO: 1056696 - RNA, 22 nt, Human
aacauguugaguugaaaguagc

SEQ ID NO: 1056697 - RNA, 22 nt, Human
agaaaagaggcuuucuaagcau

SEQ ID NO: 1056698 - RNA, 22 nt, Human
uguuggcagauugucuaggguu

SEQ ID NO: 1056699 - RNA, 22 nt, Human
aggguggcugaguagauggaag

SEQ ID NO: 1056700 - RNA, 21 nt, Human
uucuccccagcgaauccucgg

SEQ ID NO: 1056701 - RNA, 22 nt, Human
uuucuucagccuucacaaccug

SEQ ID NO: 1056702 - RNA, 22 nt, Human
uguccucuuccagugcuccuuc

SEQ ID NO: 1056703 - RNA, 22 nt, Human
auguuuccauuuucuuguauca

SEQ ID NO: 1056704 - RNA, 22 nt, Human
cauuuguuaauuacuauuaucu

SEQ ID NO: 1056705 - RNA, 19 nt, Human
gugaggucuuuccuuuugu

SEQ ID NO: 1056706 - RNA, 22 nt, Human
uagggcugcagaacaauggccu

SEQ ID NO: 1056707 - RNA, 22 nt, Human
cagguaaaaauaaauuugugag

SEQ ID NO: 1056708 - RNA, 22 nt, Human
uuugcagugauucuugcaguga

SEQ ID NO: 1056709 - RNA, 22 nt, Human
uucuuaaaacuuauggacaggu

SEQ ID NO: 1056710 - RNA, 22 nt, Human
uaugaacuuuugaugugacaug

SEQ ID NO: 1056711 - RNA, 22 nt, Human
aaacuacuaugggaauguacuu

SEQ ID NO: 1056712 - RNA, 22 nt, Human
caaggcugcaaaacuacauggg

SEQ ID NO: 1056713 - RNA, 23 nt, Human
uuccuggcagguacaacuuuuac

SEQ ID NO: 1056714 - RNA, 22 nt, Human
uggcuucuccagaaaucuuggu

SEQ ID NO: 1056715 - RNA, 22 nt, Human
uaaccuuucaggcauguagguu

SEQ ID NO: 1056716 - RNA, 22 nt, Human
gagcugaguguccuaggcaugg

SEQ ID NO: 1056717 - RNA, 22 nt, Human
acgguaacagauaccacagacu

SEQ ID NO: 1056718 - RNA, 22 nt, Human
ggagagaaauugagguagcaag

SEQ ID NO: 1056719 - RNA, 21 nt, Human
agccagcuaucacacagcauu

SEQ ID NO: 1056720 - RNA, 22 nt, Human
cuucucagucaccugugagucu

SEQ ID NO: 1056721 - RNA, 22 nt, Human
acucauuugacacuuuaaacug

SEQ ID NO: 1056722 - RNA, 23 nt, Human
gagcugaguguagggagacuagg

SEQ ID NO: 1056723 - RNA, 22 nt, Human
auaucaaacgaaguuauuuuaa

SEQ ID NO: 1056724 - RNA, 22 nt, Human
ggaagagggaaccacgacugua

SEQ ID NO: 1056725 - RNA, 22 nt, Human
cuggcacacaaguauuuccuuu

SEQ ID NO: 1056726 - RNA, 22 nt, Human
augaggccagggugccaugaaa

SEQ ID NO: 1056727 - RNA, 22 nt, Human
gugcugagcacagcugcccagg

SEQ ID NO: 1056728 - RNA, 20 nt, Human
gcugccuguuucuguaagua

SEQ ID NO: 1056729 - RNA, 21 nt, Human
auuuggauauugcuggcaaau

SEQ ID NO: 1056730 - RNA, 19 nt, Human
cauuuuaagcauccccagu

SEQ ID NO: 1056731 - RNA, 22 nt, Human
uuagugauuacuacauagauga

SEQ ID NO: 1056732 - RNA, 22 nt, Human
cccucgccgcagcugcuucccg

SEQ ID NO: 1056733 - RNA, 22 nt, Human
aaauguuuugcucccauguggu

SEQ ID NO: 1056734 - RNA, 22 nt, Human
ucauuuaauagcuuuugucuuu

SEQ ID NO: 1056735 - RNA, 23 nt, Human
uggcugagguccagguaguuuca

SEQ ID NO: 1056736 - RNA, 22 nt, Human
agcgagggaggucugaggacag

SEQ ID NO: 1056737 - RNA, 19 nt, Human
uucauucucuuauuguugu

SEQ ID NO: 1056738 - RNA, 22 nt, Human
gucuccugagccuugacugcaa

SEQ ID NO: 1056739 - RNA, 22 nt, Human
uagauuuuacuucugucauuac

SEQ ID NO: 1056740 - RNA, 22 nt, Human
ugaggcagcaauugauuauuca

SEQ ID NO: 1056741 - RNA, 22 nt, Human
aguccuuugggaaaaaugacua

SEQ ID NO: 1056742 - RNA, 22 nt, Human
uguuugaacugaauaacauagu

SEQ ID NO: 1056743 - RNA, 22 nt, Human
uguccccagagccuguuccugc

SEQ ID NO: 1056744 - RNA, 22 nt, Human
ccagaggagaugccuccucugu

SEQ ID NO: 1056745 - RNA, 22 nt, Human
uccuggccucgcuguccaccuu

SEQ ID NO: 1056746 - RNA, 22 nt, Human
gaggcagugcauugucuagggg

SEQ ID NO: 1056747 - RNA, 20 nt, Human
uccaggagguuaguguggcu

SEQ ID NO: 1056748 - RNA, 22 nt, Human
uucuaauugaccuuaggcugug

SEQ ID NO: 1056749 - RNA, 22 nt, Human
aacaaaugaccugauuucuucc

SEQ ID NO: 1056750 - RNA, 22 nt, Human
aggaugaauaacugaaauggug

SEQ ID NO: 1056751 - RNA, 20 nt, Human
gcucccagccugcagucccc

SEQ ID NO: 1056752 - RNA, 17 nt, Human
agacagugagugccuug

SEQ ID NO: 1056753 - RNA, 22 nt, Human
acuggccaugggauuuauauuu

SEQ ID NO: 1056754 - RNA, 22 nt, Human
uagcaaaaacugcaguuacuuu

SEQ ID NO: 1056755 - RNA, 22 nt, Human
ucugccugagggagcugaggaa

SEQ ID NO: 1056756 - RNA, 22 nt, Human
aaucuuacaccgaauuuaaacu

SEQ ID NO: 1056757 - RNA, 17 nt, Human
cuccuggcagccucagg

SEQ ID NO: 1056758 - RNA, 22 nt, Human
cauuguuauagcauuacacacc

SEQ ID NO: 1056759 - RNA, 22 nt, Human
uaaggccaccguuauagaacca

SEQ ID NO: 1056760 - RNA, 22 nt, Human
agcauccaacaggagggaaggg

SEQ ID NO: 1056761 - RNA, 22 nt, Human
augcuguggccagaguucaacu

SEQ ID NO: 1056762 - RNA, 22 nt, Human
gcaaaaaaugcuuguugcuuag

SEQ ID NO: 1056763 - RNA, 22 nt, Human
ugaggcaggagaauggcgggaa

SEQ ID NO: 1056764 - RNA, 22 nt, Human
uuugcacuagcauuuguccaug

SEQ ID NO: 1056765 - RNA, 22 nt, Human
uccugccuguuuaccuguacuu

SEQ ID NO: 1056766 - RNA, 22 nt, Human
ggaggugguggcagugacaauu

SEQ ID NO: 1056767 - RNA, 22 nt, Human
aguucagaguaaauguugaagg

SEQ ID NO: 1056768 - RNA, 22 nt, Human
acuucuggauagagucagcuuu

SEQ ID NO: 1056769 - RNA, 22 nt, Human
uccuggcccacuaugccagcau

SEQ ID NO: 1056770 - RNA, 22 nt, Human
cccaggaaagagacugcugggu

SEQ ID NO: 1056771 - RNA, 22 nt, Human
aagacaauuugauacuaguugc

SEQ ID NO: 1056772 - RNA, 22 nt, Human
uccaggaggaggaaggcugcca

SEQ ID NO: 1056773 - RNA, 22 nt, Human
agcaccugcuaugugucaggga

SEQ ID NO: 1056774 - RNA, 22 nt, Human
gugaggucauauagcgaacucc

SEQ ID NO: 1056775 - RNA, 22 nt, Human
ccuggcugcauuuugcuggaug

SEQ ID NO: 1056776 - RNA, 22 nt, Human
ggcugaugggcaugagcuguca

SEQ ID NO: 1056777 - RNA, 22 nt, Human
agggacuauuuacccaucucac

SEQ ID NO: 1056778 - RNA, 22 nt, Human
aaggcagcaccgccuccugaaa

SEQ ID NO: 1056779 - RNA, 22 nt, Human
agagcacuuucgagagccggag

SEQ ID NO: 1056780 - RNA, 22 nt, Human
ugcugcugauggcaccuaggca

SEQ ID NO: 1056781 - RNA, 22 nt, Human
uuuuucagccaugaauuacacu

SEQ ID NO: 1056782 - RNA, 22 nt, Human
ccugggccugaaaacauuucuc

SEQ ID NO: 1056783 - RNA, 22 nt, Human
acauuuaaccaaacuguuuaau

SEQ ID NO: 1056784 - RNA, 22 nt, Human
cuggcugacaccuugauagcag

SEQ ID NO: 1056785 - RNA, 22 nt, Human
cuggcugaggucaccaguagcu

SEQ ID NO: 1056786 - RNA, 22 nt, Human
gcuggagagugaggggagcaag

SEQ ID NO: 1056787 - RNA, 22 nt, Human
uuuuacuuaauucuuggucaug

SEQ ID NO: 1056788 - RNA, 22 nt, Human
guguguuuagcauuagcagggg

SEQ ID NO: 1056789 - RNA, 22 nt, Human
uuggccaagggaucgagguugg

SEQ ID NO: 1056790 - RNA, 22 nt, Human
agguaacuguggcuagguaacu

SEQ ID NO: 1056791 - RNA, 22 nt, Human
accuugaugccuuuccaagaug

SEQ ID NO: 1056792 - RNA, 22 nt, Human
cugagggucaacuugauuguau

SEQ ID NO: 1056793 - RNA, 22 nt, Human
uucaggauaugugauaucugaa

SEQ ID NO: 1056794 - RNA, 22 nt, Human
uucucagguagugcugaugcug

SEQ ID NO: 1056795 - RNA, 20 nt, Human
uuucuugucggcuguugcug

SEQ ID NO: 1056796 - RNA, 22 nt, Human
gggacgggcaguccaagggguc

SEQ ID NO: 1056797 - RNA, 22 nt, Human
cugaggucaccccacuggcugu

SEQ ID NO: 1056798 - RNA, 22 nt, Human
gagggcugaagauuguggcccc

SEQ ID NO: 1056799 - RNA, 22 nt, Human
gaggcagcgggucaggaccgug

SEQ ID NO: 1056800 - RNA, 22 nt, Human
cccucccucugcuggguguaga

SEQ ID NO: 1056801 - RNA, 20 nt, Human
ugcugagguugacaugccca

SEQ ID NO: 1056802 - RNA, 22 nt, Human
uuugcaguuucauugcugaaau

SEQ ID NO: 1056803 - RNA, 22 nt, Human
aauacacuauuuugugcucagu

SEQ ID NO: 1056804 - RNA, 22 nt, Human
uucaggauuguguuuuuccuga

SEQ ID NO: 1056805 - RNA, 22 nt, Human
ugguuacauauccuuuggagcc

SEQ ID NO: 1056806 - RNA, 22 nt, Human
cugcuuugcauagcugccagag

SEQ ID NO: 1056807 - RNA, 22 nt, Human
guauuaguuaucuacugcugug

SEQ ID NO: 1056808 - RNA, 22 nt, Human
acagcugcacacugaacuuggu

SEQ ID NO: 1056809 - RNA, 22 nt, Human
caggcugccgugggguccaggc

SEQ ID NO: 1056810 - RNA, 22 nt, Human
aggcagguuggugagaagacug

SEQ ID NO: 1056811 - RNA, 22 nt, Human
gucaggauuugaacucaggucu

SEQ ID NO: 1056812 - RNA, 22 nt, Human
acaugaaaugcagccuguaacc

SEQ ID NO: 1056813 - RNA, 22 nt, Human
cuggagucucuucuguagcuac

SEQ ID NO: 1056814 - RNA, 22 nt, Human
uaacugguccucggauguugug

SEQ ID NO: 1056815 - RNA, 22 nt, Human
ccaugagcuucaacugacacag

SEQ ID NO: 1056816 - RNA, 22 nt, Human
cagaccagcucuaugaacccaa

SEQ ID NO: 1056817 - RNA, 22 nt, Human
ucuccuggagcaggaagguggg

SEQ ID NO: 1056818 - RNA, 22 nt, Human
uggcacaugguaagacucagua

SEQ ID NO: 1056819 - RNA, 22 nt, Human
caccagcuccaccagggcaggu

SEQ ID NO: 1056820 - RNA, 22 nt, Human
agcuggcaguaugacuggugac

SEQ ID NO: 1056821 - RNA, 22 nt, Human
gggagucugggcuagacuccuu

SEQ ID NO: 1056822 - RNA, 22 nt, Human
agcuaagaacuugagcucugga

SEQ ID NO: 1056823 - RNA, 22 nt, Human
gcacaauuauuuaugcaguaug

SEQ ID NO: 1056824 - RNA, 20 nt, Human
aguuauaguaucuagccaug

SEQ ID NO: 1056825 - RNA, 22 nt, Human
uugcauuuccuguacuguuuga

SEQ ID NO: 1056826 - RNA, 21 nt, Human
uacugagaccucacagugugc

SEQ ID NO: 1056827 - RNA, 22 nt, Human
caggcagccaggggaccugucc

SEQ ID NO: 1056828 - RNA, 22 nt, Human
agaaguuguagguuugcauauu

SEQ ID NO: 1056829 - RNA, 22 nt, Human
caacagcugaucuuugaugaag

SEQ ID NO: 1056830 - RNA, 22 nt, Human
caaaugaagaaccuucucaccu

SEQ ID NO: 1056831 - RNA, 22 nt, Human
uuuaucagaaguuagagaaaga

SEQ ID NO: 1056832 - RNA, 21 nt, Human
uguuacaguccaaauguuugu

SEQ ID NO: 1056833 - RNA, 22 nt, Human
auggccaaagccacagcagagg

SEQ ID NO: 1056834 - RNA, 22 nt, Human
caaggccagagccagcgauaag

SEQ ID NO: 1056835 - RNA, 22 nt, Human
gaaggccacggaauggagcugg

SEQ ID NO: 1056836 - RNA, 22 nt, Human
uagugcuuaacacaaagugauu

SEQ ID NO: 1056837 - RNA, 22 nt, Human
agaggggaaggaugugauguga

SEQ ID NO: 1056838 - RNA, 22 nt, Human
cagucucuaaaucaaucugaau

SEQ ID NO: 1056839 - RNA, 22 nt, Human
cuugaaagucacaugcagcccu

SEQ ID NO: 1056840 - RNA, 22 nt, Human
gaggccagcuaguccaggaagu

SEQ ID NO: 1056841 - RNA, 20 nt, Human
ugagacccgcugacaaguuc

SEQ ID NO: 1056842 - RNA, 22 nt, Human
uuuggaauguaguuuaaucauc

SEQ ID NO: 1056843 - RNA, 22 nt, Human
acacaaguucuaaagauugcgc

SEQ ID NO: 1056844 - RNA, 21 nt, Human
auguaggaguuauuggaacag

SEQ ID NO: 1056845 - RNA, 20 nt, Human
acuguuaguauacuugugcc

SEQ ID NO: 1056846 - RNA, 22 nt, Human
ucuuagaaugucaacugauguu

SEQ ID NO: 1056847 - RNA, 22 nt, Human
cacaugaguccugccagguaug

SEQ ID NO: 1056848 - RNA, 18 nt, Human
aggcaggugcuggaaguc

SEQ ID NO: 1056849 - RNA, 22 nt, Human
aggcagucuaguccccaggcaa

SEQ ID NO: 1056850 - RNA, 21 nt, Human
uuucuuaggcucuaaaaugac

SEQ ID NO: 1056851 - RNA, 22 nt, Human
gccaggagacuccauucauuug

SEQ ID NO: 1056852 - RNA, 22 nt, Human
uaauuaacauacaaaacagcug

SEQ ID NO: 1056853 - RNA, 19 nt, Human
uuacuuggcaaagucaguc

SEQ ID NO: 1056854 - RNA, 22 nt, Human
acuuccaaauaccaucacauug

SEQ ID NO: 1056855 - RNA, 23 nt, Human
ucugagguggcucuugcuuugaa

SEQ ID NO: 1056856 - RNA, 22 nt, Human
uugauagguuuuauguauaguu

SEQ ID NO: 1056857 - RNA, 22 nt, Human
uaggauaggauggagacagaau

SEQ ID NO: 1056858 - RNA, 22 nt, Human
uggcagcuugaaugcagucuuu

SEQ ID NO: 1056859 - RNA, 22 nt, Human
ucaggaugaccacgagccucua

SEQ ID NO: 1056860 - RNA, 22 nt, Human
ugagggagagggcgaaaaugaa

SEQ ID NO: 1056861 - RNA, 22 nt, Human
uauguagguaaacacagacaua

SEQ ID NO: 1056862 - RNA, 22 nt, Human
agaaaguuugagaacuguagau

SEQ ID NO: 1056863 - RNA, 22 nt, Human
gcaggcuguagacaccaaacua

SEQ ID NO: 1056864 - RNA, 22 nt, Human
uuggccaacagcgacagggcca

SEQ ID NO: 1056865 - RNA, 21 nt, Human
uggcugagccaggugugugga

SEQ ID NO: 1056866 - RNA, 19 nt, Human
agucuuucccacucgucuu

SEQ ID NO: 1056867 - RNA, 23 nt, Human
uugcacauuggagcuggucuucu

SEQ ID NO: 1056868 - RNA, 22 nt, Human
uugcuucaguagcucuuuaaag

SEQ ID NO: 1056869 - RNA, 22 nt, Human
cagagcugucauuugccaguga

SEQ ID NO: 1056870 - RNA, 21 nt, Human
uuagaaagcucacuacaguua

SEQ ID NO: 1056871 - RNA, 22 nt, Human
ucucuucuaauuaggguccaug

SEQ ID NO: 1056872 - RNA, 22 nt, Human
uuuuuauaugaaggauagugcg

SEQ ID NO: 1056873 - RNA, 22 nt, Human
uuauacauguguuuugagauga

SEQ ID NO: 1056874 - RNA, 22 nt, Human
ucuggccaguagauguggguug

SEQ ID NO: 1056875 - RNA, 19 nt, Human
aaaaacuuaguccagaaag

SEQ ID NO: 1056876 - RNA, 22 nt, Human
uagccaggcugcagcugauccg

SEQ ID NO: 1056877 - RNA, 22 nt, Human
uuuaguagaaauauuugggccu

SEQ ID NO: 1056878 - RNA, 22 nt, Human
cgaggcagggaagcugcaaaag

SEQ ID NO: 1056879 - RNA, 22 nt, Human
gauuucuugauaaguaguguga

SEQ ID NO: 1056880 - RNA, 22 nt, Human
ccaggcugcuguugguguccgc

SEQ ID NO: 1056881 - RNA, 22 nt, Human
aacugccuggccaggcugcaac

SEQ ID NO: 1056882 - RNA, 22 nt, Human
gacaguaagucagagacuuggu

SEQ ID NO: 1056883 - RNA, 22 nt, Human
uguugccuggggaagcucugau

SEQ ID NO: 1056884 - RNA, 22 nt, Human
cucuccucagaacaggcccucu

SEQ ID NO: 1056885 - RNA, 22 nt, Human
auauaauaguuucauaaaggcu

SEQ ID NO: 1056886 - RNA, 22 nt, Human
ggggccccucggacacgugcgg

SEQ ID NO: 1056887 - RNA, 22 nt, Human
ccaggcuggucugaauuucuag

SEQ ID NO: 1056888 - RNA, 22 nt, Human
agccagcucccuccccugcagg

SEQ ID NO: 1056889 - RNA, 22 nt, Human
aaccuuuugcaagugccuugac

SEQ ID NO: 1056890 - RNA, 22 nt, Human
aaucuguuuaguucugcguaug

SEQ ID NO: 1056891 - RNA, 22 nt, Human
agaggacagguuuuccaugggc

SEQ ID NO: 1056892 - RNA, 21 nt, Human
aggcagcuggaaggccuggcu

SEQ ID NO: 1056893 - RNA, 22 nt, Human
aggucagcaggccaggggcgaa

SEQ ID NO: 1056894 - RNA, 22 nt, Human
cuacccagcaccuaggcugccu

SEQ ID NO: 1056895 - RNA, 22 nt, Human
caggaggggguggaguuucgcc

SEQ ID NO: 1056896 - RNA, 22 nt, Human
gcagaggccuagguggaaggcc

SEQ ID NO: 1056897 - RNA, 22 nt, Human
aacuucuggauguuucaaaugu

SEQ ID NO: 1056898 - RNA, 22 nt, Human
cucacugugccuuuucccaaac

SEQ ID NO: 1056899 - RNA, 22 nt, Human
aguggaccagaagacugaagcu

SEQ ID NO: 1056900 - RNA, 22 nt, Human
uccccaccuacacacugcuccu

SEQ ID NO: 1056901 - RNA, 22 nt, Human
ggagguggcagagggacauucu

SEQ ID NO: 1056902 - RNA, 22 nt, Human
gucaggauuauuuuauuaaaag

SEQ ID NO: 1056903 - RNA, 22 nt, Human
cugacuuuagaacccaaaaagu

SEQ ID NO: 1056904 - RNA, 22 nt, Human
guccaugauucuguguaguaga

SEQ ID NO: 1056905 - RNA, 22 nt, Human
uccauuuuucaugacuccucaa

SEQ ID NO: 1056906 - RNA, 22 nt, Human
uaauuccaaguugagacaugca

SEQ ID NO: 1056907 - RNA, 22 nt, Human
uccaugaguuugaggaaaagag

SEQ ID NO: 1056908 - RNA, 22 nt, Human
gcagaggauagcauaugaaccu

SEQ ID NO: 1056909 - RNA, 22 nt, Human
augaaauugaucuugaacuuuu

SEQ ID NO: 1056910 - RNA, 22 nt, Human
acugagguugaaauagugaugu

SEQ ID NO: 1056911 - RNA, 22 nt, Human
auuugcuuuaagguauaaaagg

SEQ ID NO: 1056912 - RNA, 22 nt, Human
uucugagagugccagaaguucu

SEQ ID NO: 1056913 - RNA, 22 nt, Human
acagugacguuuauuugagacg

SEQ ID NO: 1056914 - RNA, 22 nt, Human
aucuugcauuugcuaaaaugca

SEQ ID NO: 1056915 - RNA, 22 nt, Human
gauggacagccuggaaggaaag

SEQ ID NO: 1056916 - RNA, 23 nt, Human
uuucaaauuacucugcagaugac

SEQ ID NO: 1056917 - RNA, 22 nt, Human
cucaggauauugggcuggagca

SEQ ID NO: 1056918 - RNA, 22 nt, Human
cgcagggauuucaaggggccuu

SEQ ID NO: 1056919 - RNA, 22 nt, Human
gggucccuggaauuacuugaca

SEQ ID NO: 1056920 - RNA, 17 nt, Human
aaggccauuuccaccca

SEQ ID NO: 1056921 - RNA, 22 nt, Human
uuggcagauuugucaguaagcu

SEQ ID NO: 1056922 - RNA, 20 nt, Human
ugcugcugcuucacccccau

SEQ ID NO: 1056923 - RNA, 22 nt, Human
cuuaaaaucuggcaguuagcua

SEQ ID NO: 1056924 - RNA, 21 nt, Human
cucuuuauauaguaaagauau

SEQ ID NO: 1056925 - RNA, 22 nt, Human
guaaguuauauuaaaauuucag

SEQ ID NO: 1056926 - RNA, 22 nt, Human
uugaaaguccuucuugaguuac

SEQ ID NO: 1056927 - RNA, 22 nt, Human
cccaggaggguggccucugccc

SEQ ID NO: 1056928 - RNA, 22 nt, Human
cuucagugauauaggcuucucc

SEQ ID NO: 1056929 - RNA, 22 nt, Human
uucuaugccauguucagcuacu

SEQ ID NO: 1056930 - RNA, 18 nt, Human
aguaaagcuuauuacaug

SEQ ID NO: 1056931 - RNA, 15 nt, Human
caggagaggaagguu

SEQ ID NO: 1056932 - RNA, 22 nt, Human
cuguccccgcgaguccagagcu

SEQ ID NO: 1056933 - RNA, 22 nt, Human
gguggaaggccuggaaggaggc

SEQ ID NO: 1056934 - RNA, 22 nt, Human
acaccuuugccccaagucauag

SEQ ID NO: 1056935 - RNA, 22 nt, Human
uuggccaaauacacaccuuuug

SEQ ID NO: 1056936 - RNA, 22 nt, Human
ucuuagaaguucauguuccagc

SEQ ID NO: 1056937 - RNA, 22 nt, Human
uuucacagguacaaacacuccu

SEQ ID NO: 1056938 - RNA, 22 nt, Human
ccccaggagcuuguuuuagaga

SEQ ID NO: 1056939 - RNA, 22 nt, Human
acucaccacacccuugcacuug

SEQ ID NO: 1056940 - RNA, 22 nt, Human
agugucauuccagggacccucg

SEQ ID NO: 1056941 - RNA, 22 nt, Human
augcuguguccuagugaaagaa

SEQ ID NO: 1056942 - RNA, 22 nt, Human
gcugcugugccuggcguccugu

SEQ ID NO: 1056943 - RNA, 22 nt, Human
gaggacaggagacucacuguuu

SEQ ID NO: 1056944 - RNA, 22 nt, Human
ugaggucauggcugauauuucc

SEQ ID NO: 1056945 - RNA, 23 nt, Human
agcugaggugcagauccaaagaa

SEQ ID NO: 1056946 - RNA, 22 nt, Human
gaggcagcagaacauggaagag

SEQ ID NO: 1056947 - RNA, 22 nt, Human
aaacuccugcauacucagaagc

SEQ ID NO: 1056948 - RNA, 22 nt, Human
acaucucaugaaugauaaauca

SEQ ID NO: 1056949 - RNA, 22 nt, Human
acugagguggggucugcuugga

SEQ ID NO: 1056950 - RNA, 22 nt, Human
ugagccugguugcagugucugg

SEQ ID NO: 1056951 - RNA, 22 nt, Human
uucuacaaauauuuacuguucc

SEQ ID NO: 1056952 - RNA, 22 nt, Human
uauuucagcaagaagaaugugg

SEQ ID NO: 1056953 - RNA, 23 nt, Human
agacaguggccgagagguacuag

SEQ ID NO: 1056954 - RNA, 22 nt, Human
cuccugggcucaagugauccuc

SEQ ID NO: 1056955 - RNA, 18 nt, Human
cucaccauucugcccaau

SEQ ID NO: 1056956 - RNA, 22 nt, Human
cagcagaggcacgucugugaau

SEQ ID NO: 1056957 - RNA, 22 nt, Human
aaggcugaccaguuuacacuuu

SEQ ID NO: 1056958 - RNA, 22 nt, Human
ugacagacagcuucucauuuua

SEQ ID NO: 1056959 - RNA, 22 nt, Human
ggacagaggguugacagaguau

SEQ ID NO: 1056960 - RNA, 22 nt, Human
acccaggaggcagagguugcag

SEQ ID NO: 1056961 - RNA, 22 nt, Human
ggugaagggccuuaggagacag

SEQ ID NO: 1056962 - RNA, 22 nt, Human
gcuggagguuucaccugaguuu

SEQ ID NO: 1056963 - RNA, 22 nt, Human
aggcuccaaauuaccaagcucu

SEQ ID NO: 1056964 - RNA, 22 nt, Human
auugaggcagcauaguucaggg

SEQ ID NO: 1056965 - RNA, 22 nt, Human
cgccucagccguggucaucuuc

SEQ ID NO: 1056966 - RNA, 22 nt, Human
gcugcuggggccuucccucggg

SEQ ID NO: 1056967 - RNA, 22 nt, Human
auggccaagcuuacucuguugu

SEQ ID NO: 1056968 - RNA, 22 nt, Human
acaugcauacacguacauaccu

SEQ ID NO: 1056969 - RNA, 22 nt, Human
uagcaagaaaacacaagaauua

SEQ ID NO: 1056970 - RNA, 22 nt, Human
gaggccaggagugcuguaaguu

SEQ ID NO: 1056971 - RNA, 18 nt, Human
cuggucucccuucgcuuu

SEQ ID NO: 1056972 - RNA, 22 nt, Human
acaaaugucuccucuuuuguua

SEQ ID NO: 1056973 - RNA, 22 nt, Human
aacaugcucuguuucuuggaug

SEQ ID NO: 1056974 - RNA, 22 nt, Human
ggcugaggguuaagaucagaca

SEQ ID NO: 1056975 - RNA, 22 nt, Human
cuccuggcccugagcucccagg

SEQ ID NO: 1056976 - RNA, 22 nt, Human
accuuguuaaaaugaggauucu

SEQ ID NO: 1056977 - RNA, 22 nt, Human
uuccaaagaaguucacauuuac

SEQ ID NO: 1056978 - RNA, 22 nt, Human
cugaggccgucugggucugcag

SEQ ID NO: 1056979 - RNA, 22 nt, Human
uuuaggaugcucuauucugacu

SEQ ID NO: 1056980 - RNA, 22 nt, Human
uccaggagcauccaggugaagc

SEQ ID NO: 1056981 - RNA, 22 nt, Human
uaacaguguggacuugagaucu

SEQ ID NO: 1056982 - RNA, 22 nt, Human
ccccuccuggccacacugucag

SEQ ID NO: 1056983 - RNA, 22 nt, Human
auggcagccugagcagaggaau

SEQ ID NO: 1056984 - RNA, 22 nt, Human
agucacuguuucagaacugagu

SEQ ID NO: 1056985 - RNA, 22 nt, Human
cuauuuaugugcuauuuuguau

SEQ ID NO: 1056986 - RNA, 22 nt, Human
cugaggcucagcgugaggaaag

SEQ ID NO: 1056987 - RNA, 22 nt, Human
uuagcaucugcuguaagcuuau

SEQ ID NO: 1056988 - RNA, 22 nt, Human
ccuggagauuucuucaagcuuu

SEQ ID NO: 1056989 - RNA, 22 nt, Human
cugagggccuuggcuccugccc

SEQ ID NO: 1056990 - RNA, 22 nt, Human
ucaauuauuugauaugaaaggg

SEQ ID NO: 1056991 - RNA, 22 nt, Human
uccaggagguagugcuuaauuu

SEQ ID NO: 1056992 - RNA, 22 nt, Human
augcugugucaccuuaggauuu

SEQ ID NO: 1056993 - RNA, 22 nt, Human
ccccaggacguggcccucauag

SEQ ID NO: 1056994 - RNA, 22 nt, Human
aagcugaggcuccccugaggga

SEQ ID NO: 1056995 - RNA, 22 nt, Human
uucaguaaaacacugcaauguc

SEQ ID NO: 1056996 - RNA, 22 nt, Human
agaucaaugugucagaagagau

SEQ ID NO: 1056997 - RNA, 22 nt, Human
uaacuggugaguugguugagug

SEQ ID NO: 1056998 - RNA, 20 nt, Human
ucaggcuggugggcuuuccc

SEQ ID NO: 1056999 - RNA, 22 nt, Human
uuauuuggguuugaguguggca

SEQ ID NO: 1057000 - RNA, 22 nt, Human
uaggcugagcuaagagagcuua

SEQ ID NO: 1057001 - RNA, 22 nt, Human
uaauaggagccaggucacauag

SEQ ID NO: 1057002 - RNA, 22 nt, Human
auacaacuuuacaugcaauucc

SEQ ID NO: 1057003 - RNA, 22 nt, Human
uuuguuaaauauuuauugagug

SEQ ID NO: 1057004 - RNA, 22 nt, Human
cuuaggaugaguuuuugcguuu

SEQ ID NO: 1057005 - RNA, 22 nt, Human
aggucagcaugaguagaaggua

SEQ ID NO: 1057006 - RNA, 22 nt, Human
acauuuuuuagagucccacauu

SEQ ID NO: 1057007 - RNA, 22 nt, Human
cagugguugguagauacuugag

SEQ ID NO: 1057008 - RNA, 22 nt, Human
acuguggccaaagccucuggga

SEQ ID NO: 1057009 - RNA, 22 nt, Human
cacuuucucaugaauuuggccc

SEQ ID NO: 1057010 - RNA, 22 nt, Human
cacaggagagcugggaggugcc

SEQ ID NO: 1057011 - RNA, 22 nt, Human
aagcagaggguauggccagguu

SEQ ID NO: 1057012 - RNA, 22 nt, Human
ucuuuauuuuaugcuugugcaa

SEQ ID NO: 1057013 - RNA, 22 nt, Human
gucccaggugggcuccaccucu

SEQ ID NO: 1057014 - RNA, 22 nt, Human
ggcaugaguggcagugggcagu

SEQ ID NO: 1057015 - RNA, 22 nt, Human
acccaggagagagcuauaaaau

SEQ ID NO: 1057016 - RNA, 22 nt, Human
cugucccuucauuauucacuac

SEQ ID NO: 1057017 - RNA, 22 nt, Human
aggcuggcccuacuggcugccu

SEQ ID NO: 1057018 - RNA, 22 nt, Human
agagugcaaccgaaacaagcag

SEQ ID NO: 1057019 - RNA, 22 nt, Human
cagagcagucuggagauccagc

SEQ ID NO: 1057020 - RNA, 22 nt, Human
uucaccuugaauaugucuuaaa

SEQ ID NO: 1057021 - RNA, 22 nt, Human
aguuaacacaaguaagauucca

SEQ ID NO: 1057022 - RNA, 22 nt, Human
ggcagccuugacuagugacuua

SEQ ID NO: 1057023 - RNA, 21 nt, Human
uggaggaauaaagcacagaag

SEQ ID NO: 1057024 - RNA, 22 nt, Human
ggauggcagucugcaugagaaa

SEQ ID NO: 1057025 - RNA, 22 nt, Human
gcugagauuacgggcaugagcc

SEQ ID NO: 1057026 - RNA, 22 nt, Human
agaggacagacggaaagugcca

SEQ ID NO: 1057027 - RNA, 22 nt, Human
ucuggccagugaaaugcagaau

SEQ ID NO: 1057028 - RNA, 21 nt, Human
auucugaguugucagucuuca

SEQ ID NO: 1057029 - RNA, 22 nt, Human
agcuucccaagguuggaagguu

SEQ ID NO: 1057030 - RNA, 21 nt, Human
agcugcagucaagccagaggu

SEQ ID NO: 1057031 - RNA, 22 nt, Human
uccaggagacacccuugugugu

SEQ ID NO: 1057032 - RNA, 22 nt, Human
caggcagcucugcuuuuccuaa

SEQ ID NO: 1057033 - RNA, 22 nt, Human
uccuggccaggaugaccuaaca

SEQ ID NO: 1057034 - RNA, 22 nt, Human
cccaagagguggagguugcagu

SEQ ID NO: 1057035 - RNA, 22 nt, Human
aagagggcugcaaucuuauugc

SEQ ID NO: 1057036 - RNA, 22 nt, Human
agauaaauuccuaagauuucag

SEQ ID NO: 1057037 - RNA, 17 nt, Human
cagcucugcaucuuccu

SEQ ID NO: 1057038 - RNA, 22 nt, Human
gcugagcagguguaaggaaggc

SEQ ID NO: 1057039 - RNA, 23 nt, Human
gcagaggagcaagcuggacacca

SEQ ID NO: 1057040 - RNA, 22 nt, Human
aguaaucugauuuuauagcuau

SEQ ID NO: 1057041 - RNA, 22 nt, Human
aaggcaguagguguuucaaacu

SEQ ID NO: 1057042 - RNA, 22 nt, Human
uucuucaaugugcccuguuuuc

SEQ ID NO: 1057043 - RNA, 22 nt, Human
gugagagaucccccacucaucu

SEQ ID NO: 1057044 - RNA, 22 nt, Human
uccacaugaccauugugcuccu

SEQ ID NO: 1057045 - RNA, 22 nt, Human
gcugccugccuugccuggagga

SEQ ID NO: 1057046 - RNA, 22 nt, Human
agcagcugagccccagcuguga

SEQ ID NO: 1057047 - RNA, 22 nt, Human
uaucuguuugcucacagguguu

SEQ ID NO: 1057048 - RNA, 22 nt, Human
ggcagcuaguuuaagaaagagg

SEQ ID NO: 1057049 - RNA, 22 nt, Human
acuccagguuuuuucacugaag

SEQ ID NO: 1057050 - RNA, 22 nt, Human
gcuggugcauuagcugcaguuc

SEQ ID NO: 1057051 - RNA, 22 nt, Human
uggcuucuuuguagaaauugaa

SEQ ID NO: 1057052 - RNA, 22 nt, Human
cucagagaggcaguggaaguca

SEQ ID NO: 1057053 - RNA, 22 nt, Human
accaggaggccuggagcacaaa

SEQ ID NO: 1057054 - RNA, 22 nt, Human
gcuccuggcaggcagugugugu

SEQ ID NO: 1057055 - RNA, 23 nt, Human
uccaggagcaugcuggcuggcga

SEQ ID NO: 1057056 - RNA, 22 nt, Human
ccuccuggugggcgcuucuggc

SEQ ID NO: 1057057 - RNA, 22 nt, Human
aggcagcccugugcuggaugcu

SEQ ID NO: 1057058 - RNA, 22 nt, Human
uggcacauagaaaaggaucaau

SEQ ID NO: 1057059 - RNA, 22 nt, Human
cagacagggaccucgcuccaga

SEQ ID NO: 1057060 - RNA, 22 nt, Human
ugccuggcccugacagcccugg

SEQ ID NO: 1057061 - RNA, 20 nt, Human
auggccaaccugcuuaugac

SEQ ID NO: 1057062 - RNA, 22 nt, Human
cucugccauuuaucagaacugu

SEQ ID NO: 1057063 - RNA, 22 nt, Human
uggcugagugaacauguccauu

SEQ ID NO: 1057064 - RNA, 22 nt, Human
cuucugugauuugguuaggaua

SEQ ID NO: 1057065 - RNA, 22 nt, Human
gcagcugaaagggaucucuaca

SEQ ID NO: 1057066 - RNA, 22 nt, Human
uaaucacagaaacagacuguuu

SEQ ID NO: 1057067 - RNA, 22 nt, Human
guauaucuucagaaauuauagg

SEQ ID NO: 1057068 - RNA, 22 nt, Human
agacccugcauuuuccaggguu

SEQ ID NO: 1057069 - RNA, 22 nt, Human
auacagauguugaauguuauau

SEQ ID NO: 1057070 - RNA, 22 nt, Human
ucuucuccagugcuucugcaca

SEQ ID NO: 1057071 - RNA, 22 nt, Human
aaggcaguuaauuuggcuagaa

SEQ ID NO: 1057072 - RNA, 22 nt, Human
gcgcaggagccgcggagggccg

SEQ ID NO: 1057073 - RNA, 22 nt, Human
cacaggcugggaagccuaggcc

SEQ ID NO: 1057074 - RNA, 22 nt, Human
cagggcugaagaaauucaaaag

SEQ ID NO: 1057075 - RNA, 22 nt, Human
cuggccaauccauuaauuuguu

SEQ ID NO: 1057076 - RNA, 22 nt, Human
gaggucaggggagaggcugaug

SEQ ID NO: 1057077 - RNA, 21 nt, Human
uacaguaaguugggugguccu

SEQ ID NO: 1057078 - RNA, 22 nt, Human
cauuuguaguaucuguuuauau

SEQ ID NO: 1057079 - RNA, 22 nt, Human
aggcagaucacuugaggccagg

SEQ ID NO: 1057080 - RNA, 23 nt, Human
augaggucagccauaagacggaa

SEQ ID NO: 1057081 - RNA, 22 nt, Human
gacuuucugagucaaagaaagg

SEQ ID NO: 1057082 - RNA, 22 nt, Human
gagaggugaaggcugcccuggg

SEQ ID NO: 1057083 - RNA, 22 nt, Human
uguuuuaaagccauugccuuuc

SEQ ID NO: 1057084 - RNA, 22 nt, Human
ucucuguaguugggcagcugcu

SEQ ID NO: 1057085 - RNA, 22 nt, Human
caggaaaugggguuuaguuauu

SEQ ID NO: 1057086 - RNA, 22 nt, Human
uuaaaugagauguucagauauu

SEQ ID NO: 1057087 - RNA, 22 nt, Human
ccucaggauacaggagccacag

SEQ ID NO: 1057088 - RNA, 22 nt, Human
uuucaugaggggcaaaaucuca

SEQ ID NO: 1057089 - RNA, 22 nt, Human
augaaggcuguguagauggaug

SEQ ID NO: 1057090 - RNA, 22 nt, Human
ugcccaggguuucuaagagcag

SEQ ID NO: 1057091 - RNA, 18 nt, Human
acucaggaaaugaugaca

SEQ ID NO: 1057092 - RNA, 23 nt, Human
gcuggcuggcaguaaagguuguu

SEQ ID NO: 1057093 - RNA, 22 nt, Human
gaccuggaggauccucuucuug

SEQ ID NO: 1057094 - RNA, 22 nt, Human
cagugauggauauggagaaguc

SEQ ID NO: 1057095 - RNA, 22 nt, Human
cuucucagcauuuugucagucu

SEQ ID NO: 1057096 - RNA, 22 nt, Human
uccaggaguggggcagaggucu

SEQ ID NO: 1057097 - RNA, 22 nt, Human
cugagcucuaaugucagccuug

SEQ ID NO: 1057098 - RNA, 22 nt, Human
gcuccuggcucuggccaaggga

SEQ ID NO: 1057099 - RNA, 22 nt, Human
gcugcuguugauuuaguccaau

SEQ ID NO: 1057100 - RNA, 19 nt, Human
gcugcucugggucucaucu

SEQ ID NO: 1057101 - RNA, 22 nt, Human
auauguuacucuuucaagcaga

SEQ ID NO: 1057102 - RNA, 22 nt, Human
auauucuauaagcaguuggaag

SEQ ID NO: 1057103 - RNA, 22 nt, Human
uucaggaucaaguugccaguag

SEQ ID NO: 1057104 - RNA, 22 nt, Human
augcagcugucagggagaacau

SEQ ID NO: 1057105 - RNA, 22 nt, Human
cugaggccucucuccugggcuu

SEQ ID NO: 1057106 - RNA, 22 nt, Human
ccuuuucaacuaagauucugca

SEQ ID NO: 1057107 - RNA, 22 nt, Human
augaaggcuguguggagccccc

SEQ ID NO: 1057108 - RNA, 22 nt, Human
cagugcugcaggcgccugcggu

SEQ ID NO: 1057109 - RNA, 22 nt, Human
caggcagcugcgacaagagagc

SEQ ID NO: 1057110 - RNA, 22 nt, Human
ggagaaaggauaggaaugugcu

SEQ ID NO: 1057111 - RNA, 22 nt, Human
aaugaaauguagcuuauccaua

SEQ ID NO: 1057112 - RNA, 22 nt, Human
uugcucagcacuggagccagcu

SEQ ID NO: 1057113 - RNA, 22 nt, Human
aagugggaauagaaaugaaggu

SEQ ID NO: 1057114 - RNA, 20 nt, Human
aaacauucauguacaaguga

SEQ ID NO: 1057115 - RNA, 22 nt, Human
gugacaguggucacuuguaguu

SEQ ID NO: 1057116 - RNA, 22 nt, Human
ugaggggagcuagcaugccuug

SEQ ID NO: 1057117 - RNA, 22 nt, Human
acaauauuguacccagaaguuu

SEQ ID NO: 1057118 - RNA, 22 nt, Human
cccaggaguuggaggcuacggu

SEQ ID NO: 1057119 - RNA, 18 nt, Human
gagucuuuguuacugcug

SEQ ID NO: 1057120 - RNA, 22 nt, Human
uggccaggcagguagaacggcc

SEQ ID NO: 1057121 - RNA, 22 nt, Human
cauaauauacuacauugaugaa

SEQ ID NO: 1057122 - RNA, 22 nt, Human
ugaaaaaacaaguuggcccauu

SEQ ID NO: 1057123 - RNA, 22 nt, Human
agggcagcucucaccucuggcc

SEQ ID NO: 1057124 - RNA, 21 nt, Human
auucuagacaacacugaaauc

SEQ ID NO: 1057125 - RNA, 22 nt, Human
ggagguggcagggaacauaauu

SEQ ID NO: 1057126 - RNA, 22 nt, Human
ccuugcauauauuauaucuuug

SEQ ID NO: 1057127 - RNA, 22 nt, Human
uugacacaguuuucucauuaag

SEQ ID NO: 1057128 - RNA, 22 nt, Human
gcuuuggagccuguguucugcc

SEQ ID NO: 1057129 - RNA, 22 nt, Human
gaucuucuagcagaaguaauuu

SEQ ID NO: 1057130 - RNA, 22 nt, Human
aaauaguucagcuuguaaaccc

SEQ ID NO: 1057131 - RNA, 22 nt, Human
ccuggagcaggagcugcagagg

SEQ ID NO: 1057132 - RNA, 22 nt, Human
ucugcucagguuaccuagcuag

SEQ ID NO: 1057133 - RNA, 22 nt, Human
ggaggaggggcgcuuugucuau

SEQ ID NO: 1057134 - RNA, 22 nt, Human
aggcugagucaaguuaggguga

SEQ ID NO: 1057135 - RNA, 22 nt, Human
gaggguggguuucuugcacguc

SEQ ID NO: 1057136 - RNA, 22 nt, Human
aaagauaauguuuccuuauucu

SEQ ID NO: 1057137 - RNA, 20 nt, Human
ugcugucguguuuucugcuu

SEQ ID NO: 1057138 - RNA, 21 nt, Human
auguaggguuugccuucucua

SEQ ID NO: 1057139 - RNA, 22 nt, Human
acacagcuuucagucauuaucu

SEQ ID NO: 1057140 - RNA, 22 nt, Human
cugaacuuauugagugcuugcu

SEQ ID NO: 1057141 - RNA, 22 nt, Human
uuagagucaagcugcauguucu

SEQ ID NO: 1057142 - RNA, 22 nt, Human
ggccagcugggccaccaggugc

SEQ ID NO: 1057143 - RNA, 22 nt, Human
gccagagguucaacaacugucu

SEQ ID NO: 1057144 - RNA, 22 nt, Human
agcugcccugggcuggagaugg

SEQ ID NO: 1057145 - RNA, 22 nt, Human
acaggcugcugggcuccgugcu

SEQ ID NO: 1057146 - RNA, 22 nt, Human
caggcuugagggcaggcccagu

SEQ ID NO: 1057147 - RNA, 23 nt, Human
aaaugacauaugguuucugaagg

SEQ ID NO: 1057148 - RNA, 21 nt, Human
uaaaacuguaacuuuguccug

SEQ ID NO: 1057149 - RNA, 22 nt, Human
aggccagacagcuagaaacagg

SEQ ID NO: 1057150 - RNA, 22 nt, Human
gcaccuggcugcccagguggag

SEQ ID NO: 1057151 - RNA, 22 nt, Human
gaauuccuuaggcucuugacug

SEQ ID NO: 1057152 - RNA, 22 nt, Human
auggccaaauaacagcuugcau

SEQ ID NO: 1057153 - RNA, 22 nt, Human
uugaggucuugaguacugggga

SEQ ID NO: 1057154 - RNA, 22 nt, Human
cccaggcagugugugcaugcgu

SEQ ID NO: 1057155 - RNA, 22 nt, Human
uuucauuauucaugcuaguuau

SEQ ID NO: 1057156 - RNA, 22 nt, Human
uagcaaaagccacgauuacuuu

SEQ ID NO: 1057157 - RNA, 22 nt, Human
aaaggccacacagagcagggag

SEQ ID NO: 1057158 - RNA, 22 nt, Human
ucccaggaucugagggcagaga

SEQ ID NO: 1057159 - RNA, 22 nt, Human
auucggaucauguguauguguu

SEQ ID NO: 1057160 - RNA, 22 nt, Human
cuguuuauggagguaaggcauc

SEQ ID NO: 1057161 - RNA, 22 nt, Human
cguggccagccauuuccuggaa

SEQ ID NO: 1057162 - RNA, 22 nt, Human
acaccuuucagguccagacagu

SEQ ID NO: 1057163 - RNA, 22 nt, Human
uuaaaauagccagugccccucu

SEQ ID NO: 1057164 - RNA, 22 nt, Human
gaaaggugccccauaggcagga

SEQ ID NO: 1057165 - RNA, 23 nt, Human
aguaacaugcaaauaacagucug

SEQ ID NO: 1057166 - RNA, 22 nt, Human
cuguucucuggcgguggcuguu

SEQ ID NO: 1057167 - RNA, 20 nt, Human
ggcagcuugggcagcaguua

SEQ ID NO: 1057168 - RNA, 22 nt, Human
caggaggaagaacucugcaaca

SEQ ID NO: 1057169 - RNA, 22 nt, Human
ccugaggucacaacuugcuuau

SEQ ID NO: 1057170 - RNA, 22 nt, Human
uggcaaggcugugggggcagag

SEQ ID NO: 1057171 - RNA, 22 nt, Human
cugcccaaauccuucuuccucu

SEQ ID NO: 1057172 - RNA, 22 nt, Human
ugaaaugaaugugauucgauag

SEQ ID NO: 1057173 - RNA, 22 nt, Human
uugcauuuaaguagauguuaca

SEQ ID NO: 1057174 - RNA, 22 nt, Human
uaaaauagcaugugcagugaaa

SEQ ID NO: 1057175 - RNA, 22 nt, Human
aaacuccugggcucaagcaguu

SEQ ID NO: 1057176 - RNA, 22 nt, Human
aagaacuguuuacaauuuucac

SEQ ID NO: 1057177 - RNA, 20 nt, Human
ucuccuggucugguccgugc

SEQ ID NO: 1057178 - RNA, 22 nt, Human
ugaaagguuaaaaguaguauug

SEQ ID NO: 1057179 - RNA, 22 nt, Human
uugagaagaauguguugaguuu

SEQ ID NO: 1057180 - RNA, 22 nt, Human
aaggccagaguacuagaggcug

SEQ ID NO: 1057181 - RNA, 22 nt, Human
acccaggacuuggcaaccucau

SEQ ID NO: 1057182 - RNA, 22 nt, Human
ucucaguguguuuucucucaga

SEQ ID NO: 1057183 - RNA, 22 nt, Human
aaguuaacccaguauuucuuuu

SEQ ID NO: 1057184 - RNA, 22 nt, Human
cucaucugauaaaucacucuua

SEQ ID NO: 1057185 - RNA, 22 nt, Human
aaauuauaggugccaccuugga

SEQ ID NO: 1057186 - RNA, 20 nt, Human
aggaggggauagaaucaaag

SEQ ID NO: 1057187 - RNA, 22 nt, Human
uuucauugcagagucugugugc

SEQ ID NO: 1057188 - RNA, 22 nt, Human
cccaggaaugggaaggaggaau

SEQ ID NO: 1057189 - RNA, 22 nt, Human
cggagccugcuuguugcagcug

SEQ ID NO: 1057190 - RNA, 22 nt, Human
caugugcuguagcagagaggaa

SEQ ID NO: 1057191 - RNA, 22 nt, Human
gcccacuggcuggagugcuggu

SEQ ID NO: 1057192 - RNA, 22 nt, Human
cccuggugguacggcacuggca

SEQ ID NO: 1057193 - RNA, 22 nt, Human
auccaugaucaauuuauuacua

SEQ ID NO: 1057194 - RNA, 22 nt, Human
agaggcaggaagagcugauuuu

SEQ ID NO: 1057195 - RNA, 22 nt, Human
aguugcagacgcagagauguug

SEQ ID NO: 1057196 - RNA, 21 nt, Human
cagagcuguccaaacccugac

SEQ ID NO: 1057197 - RNA, 22 nt, Human
uugaggucugagacugugcagg

SEQ ID NO: 1057198 - RNA, 22 nt, Human
ucuccuggauagauacuaucca

SEQ ID NO: 1057199 - RNA, 22 nt, Human
gcccaggaguugaagggcugac

SEQ ID NO: 1057200 - RNA, 22 nt, Human
uuggccaaggaccuuuuuggag

SEQ ID NO: 1057201 - RNA, 22 nt, Human
ugguggcaucaauugacuucuc

SEQ ID NO: 1057202 - RNA, 17 nt, Human
gcuguaguuugauaaga

SEQ ID NO: 1057203 - RNA, 22 nt, Human
ugucccucugaggcuucccugg

SEQ ID NO: 1057204 - RNA, 21 nt, Human
gauguuggaggcuggggucug

SEQ ID NO: 1057205 - RNA, 22 nt, Human
aucaggaucacugggagucuug

SEQ ID NO: 1057206 - RNA, 18 nt, Human
ucuccuggguaggggccu

SEQ ID NO: 1057207 - RNA, 22 nt, Human
uuccuggccccaccccuggaga

SEQ ID NO: 1057208 - RNA, 22 nt, Human
aauaucaguauauuguaucagu

SEQ ID NO: 1057209 - RNA, 22 nt, Human
cucaggauuuacuaauuucaag

SEQ ID NO: 1057210 - RNA, 22 nt, Human
gacccuggagccgucugaggca

SEQ ID NO: 1057211 - RNA, 19 nt, Human
agcuccugauugugccucg

SEQ ID NO: 1057212 - RNA, 22 nt, Human
aaaauacuacugucuucuuccc

SEQ ID NO: 1057213 - RNA, 22 nt, Human
ggcugaguucucuugcugaauc

SEQ ID NO: 1057214 - RNA, 22 nt, Human
gaggcagcugggauacaaggga

SEQ ID NO: 1057215 - RNA, 22 nt, Human
uucagcaaauggacuguucagg

SEQ ID NO: 1057216 - RNA, 22 nt, Human
uuucuucagagagagcuuuccc

SEQ ID NO: 1057217 - RNA, 22 nt, Human
cugcugugaguuuggaggucua

SEQ ID NO: 1057218 - RNA, 22 nt, Human
acagaagugucuuuuucauuca

SEQ ID NO: 1057219 - RNA, 22 nt, Human
uucauucugcaguucucagcuc

SEQ ID NO: 1057220 - RNA, 22 nt, Human
caggcagccugcggucugcaca

SEQ ID NO: 1057221 - RNA, 22 nt, Human
ucacaguaucacacaaggauua

SEQ ID NO: 1057222 - RNA, 22 nt, Human
augcugagugagugaaacccag

SEQ ID NO: 1057223 - RNA, 22 nt, Human
ggcugcuggggacgugggagag

SEQ ID NO: 1057224 - RNA, 22 nt, Human
ugauuuccuaggucuggagaag

SEQ ID NO: 1057225 - RNA, 22 nt, Human
ggauuugggcuugcagcagagc

SEQ ID NO: 1057226 - RNA, 22 nt, Human
uggcugagagucauccugugug

SEQ ID NO: 1057227 - RNA, 22 nt, Human
ggcaggcucagcagccaaggag

SEQ ID NO: 1057228 - RNA, 22 nt, Human
ucaggauguccaaaauccagcc

SEQ ID NO: 1057229 - RNA, 22 nt, Human
gagggaggugauacugaacgua

SEQ ID NO: 1057230 - RNA, 22 nt, Human
aggcagcuuaagcccuggccca

SEQ ID NO: 1057231 - RNA, 22 nt, Human
guuugcauuuauuagucuucug

SEQ ID NO: 1057232 - RNA, 22 nt, Human
guaacucuuuggaaaacauuuu

SEQ ID NO: 1057233 - RNA, 22 nt, Human
uuuccucacuucaugagaguuu

SEQ ID NO: 1057234 - RNA, 22 nt, Human
gaguccaguuagugaggcuggg

SEQ ID NO: 1057235 - RNA, 22 nt, Human
uguuacagugacuaauguuuua

SEQ ID NO: 1057236 - RNA, 22 nt, Human
ugcaccuuguugcuuuuacgaa

SEQ ID NO: 1057237 - RNA, 22 nt, Human
cuuucauucuuagauauuagug

SEQ ID NO: 1057238 - RNA, 22 nt, Human
uggcagcugccauguccacgug

SEQ ID NO: 1057239 - RNA, 22 nt, Human
ugcugaaaacucaaccauugug

SEQ ID NO: 1057240 - RNA, 22 nt, Human
ccugagccucuugcacgcucag

SEQ ID NO: 1057241 - RNA, 22 nt, Human
auguuauaguuauaaaaugagg

SEQ ID NO: 1057242 - RNA, 22 nt, Human
agugcuggagggaggcagguuc

SEQ ID NO: 1057243 - RNA, 22 nt, Human
ggccacaagugguccugagucc

SEQ ID NO: 1057244 - RNA, 20 nt, Human
ugugcaggagagugaggcug

SEQ ID NO: 1057245 - RNA, 22 nt, Human
uagggaugacgaaaggacagag

SEQ ID NO: 1057246 - RNA, 21 nt, Human
uucugggaaaugagcuggggc

SEQ ID NO: 1057247 - RNA, 22 nt, Human
gcugagugagguccagagcuug

SEQ ID NO: 1057248 - RNA, 22 nt, Human
uaguccagguuaaucccugccu

SEQ ID NO: 1057249 - RNA, 22 nt, Human
ucugggaacagccuggcugugu

SEQ ID NO: 1057250 - RNA, 22 nt, Human
uuucaguucaguuuauuauauc

SEQ ID NO: 1057251 - RNA, 22 nt, Human
aaggaguuuggguagucauaca

SEQ ID NO: 1057252 - RNA, 22 nt, Human
aacuaguuuuagcucuagcaac

SEQ ID NO: 1057253 - RNA, 22 nt, Human
ugaggcccggguggaggaaugc

SEQ ID NO: 1057254 - RNA, 22 nt, Human
auacacuuccaaauauugauua

SEQ ID NO: 1057255 - RNA, 22 nt, Human
cugcugugcauauuuaucuagg

SEQ ID NO: 1057256 - RNA, 22 nt, Human
uccauuuucuaaguaucacuua

SEQ ID NO: 1057257 - RNA, 22 nt, Human
uggcagcuagcuguuuucaugc

SEQ ID NO: 1057258 - RNA, 23 nt, Human
uuauugaggguguagauuggugu

SEQ ID NO: 1057259 - RNA, 22 nt, Human
gggcaguugauggaggucugga

SEQ ID NO: 1057260 - RNA, 22 nt, Human
gaucauuuacuuguucuggacu

SEQ ID NO: 1057261 - RNA, 22 nt, Human
gagaggagguggcuaugacagc

SEQ ID NO: 1057262 - RNA, 22 nt, Human
uccaggagaaaacugacggugg

SEQ ID NO: 1057263 - RNA, 22 nt, Human
ucugagaggcaucugcacuucu

SEQ ID NO: 1057264 - RNA, 22 nt, Human
agcccaggagguggagguugca

SEQ ID NO: 1057265 - RNA, 22 nt, Human
ugcugaugaguccuucuaucgc

SEQ ID NO: 1057266 - RNA, 22 nt, Human
uucuucuucuggcugcaccugg

SEQ ID NO: 1057267 - RNA, 22 nt, Human
gucacuguuuccuauuauauuu

SEQ ID NO: 1057268 - RNA, 22 nt, Human
guucuucaaagugacaacuaaa

SEQ ID NO: 1057269 - RNA, 22 nt, Human
gugcugugcgcuuuuucuguau

SEQ ID NO: 1057270 - RNA, 22 nt, Human
ugcaccuuguccauuuuuggcc

SEQ ID NO: 1057271 - RNA, 22 nt, Human
gcaccuuuggaaugaaaaguug

SEQ ID NO: 1057272 - RNA, 22 nt, Human
agucucugucguagaucagcgu

SEQ ID NO: 1057273 - RNA, 22 nt, Human
uucucugagauagacuaagugg

SEQ ID NO: 1057274 - RNA, 22 nt, Human
gugguaauagagcuccaaacua

SEQ ID NO: 1057275 - RNA, 22 nt, Human
gcuuugaagacuuuuccagggu

SEQ ID NO: 1057276 - RNA, 21 nt, Human
uacagaaugcgcuucagucug

SEQ ID NO: 1057277 - RNA, 22 nt, Human
ucuuuauuuaagucuguuguaa

SEQ ID NO: 1057278 - RNA, 22 nt, Human
ggcagcacugcagcuuguuggg

SEQ ID NO: 1057279 - RNA, 22 nt, Human
gaaguuacucucguuaaauaug

SEQ ID NO: 1057280 - RNA, 22 nt, Human
cccugagccacacagagcaggu

SEQ ID NO: 1057281 - RNA, 22 nt, Human
ucugagccaauuucugugucca

SEQ ID NO: 1057282 - RNA, 22 nt, Human
auucuucagaauaucuggcacu

SEQ ID NO: 1057283 - RNA, 22 nt, Human
ggcugcagguugguuggcagcu

SEQ ID NO: 1057284 - RNA, 22 nt, Human
gccuuuauuguuuauucagugc

SEQ ID NO: 1057285 - RNA, 22 nt, Human
ucuuuuauccuacauuuagcuc

SEQ ID NO: 1057286 - RNA, 22 nt, Human
uuauggcauauuccucauugua

SEQ ID NO: 1057287 - RNA, 22 nt, Human
aacugcuuguaaauaauguuga

SEQ ID NO: 1057288 - RNA, 22 nt, Human
ccaggcugaauauguuccaggg

SEQ ID NO: 1057289 - RNA, 22 nt, Human
uuugcaaagugacuauuauaug

SEQ ID NO: 1057290 - RNA, 21 nt, Human
uggcuucugccaauguuaaga

SEQ ID NO: 1057291 - RNA, 22 nt, Human
cugcugugccuuaaaaugcaag

SEQ ID NO: 1057292 - RNA, 22 nt, Human
aagggcugcuguagaagcagag

SEQ ID NO: 1057293 - RNA, 20 nt, Human
acuaacauuugcaaggggcu

SEQ ID NO: 1057294 - RNA, 17 nt, Human
uuuaaacuacuacaagg

SEQ ID NO: 1057295 - RNA, 22 nt, Human
aagcaagacagaaguuacugcc

SEQ ID NO: 1057296 - RNA, 22 nt, Human
aagcaccugcaguugacaaaaa

SEQ ID NO: 1057297 - RNA, 22 nt, Human
ucuggccacccgaggccccugc

SEQ ID NO: 1057298 - RNA, 22 nt, Human
aggccaaagugcuccuuuuaga

SEQ ID NO: 1057299 - RNA, 22 nt, Human
uuaggaaaauggaguccuuuua

SEQ ID NO: 1057300 - RNA, 22 nt, Human
gaggcugcuguuagcccugggc

SEQ ID NO: 1057301 - RNA, 22 nt, Human
ucaggagacuuaugucacagug

SEQ ID NO: 1057302 - RNA, 21 nt, Human
aaaaaugaaguuguucaggaa

SEQ ID NO: 1057303 - RNA, 22 nt, Human
cagcaagaggguaagguugaag

SEQ ID NO: 1057304 - RNA, 22 nt, Human
agggcagccucucagccuaggu

SEQ ID NO: 1057305 - RNA, 22 nt, Human
cagaggcaggauaagaacugcg

SEQ ID NO: 1057306 - RNA, 22 nt, Human
uggcuuuaggagcuauauaccu

SEQ ID NO: 1057307 - RNA, 22 nt, Human
ccugccucaggacucugcauau

SEQ ID NO: 1057308 - RNA, 22 nt, Human
gccaugcuugguaugcugugag

SEQ ID NO: 1057309 - RNA, 22 nt, Human
agucuugcauuuucugaagaug

SEQ ID NO: 1057310 - RNA, 22 nt, Human
gucacaaaggugagggacauga

SEQ ID NO: 1057311 - RNA, 22 nt, Human
uagaagcacagguuaaaggcau

SEQ ID NO: 1057312 - RNA, 22 nt, Human
auuucucuuagcaagacauuac

SEQ ID NO: 1057313 - RNA, 22 nt, Human
uaagaugaucaccaaaugcugg

SEQ ID NO: 1057314 - RNA, 22 nt, Human
cccuguacagucucuguggcac

SEQ ID NO: 1057315 - RNA, 22 nt, Human
ugaggcagcauucuucaagaca

SEQ ID NO: 1057316 - RNA, 22 nt, Human
ugaaggccuaacuuccagugcu

SEQ ID NO: 1057317 - RNA, 23 nt, Human
cugagggcuggucugaagucugc

SEQ ID NO: 1057318 - RNA, 22 nt, Human
acagagcugggaucugaaccca

SEQ ID NO: 1057319 - RNA, 22 nt, Human
cagagcuguuacuauucaugaa

SEQ ID NO: 1057320 - RNA, 22 nt, Human
uacuuucuuucugauccuuaug

SEQ ID NO: 1057321 - RNA, 22 nt, Human
uaagaugacuacuuaccacuga

SEQ ID NO: 1057322 - RNA, 22 nt, Human
ucuccuccuuuuuucaacauag

SEQ ID NO: 1057323 - RNA, 22 nt, Human
gcucagggucccuuggugcugg

SEQ ID NO: 1057324 - RNA, 22 nt, Human
uuuauaagaagcaaugucugag

SEQ ID NO: 1057325 - RNA, 22 nt, Human
gcugauggcuugcuggcugaca

SEQ ID NO: 1057326 - RNA, 22 nt, Human
ugcaggugucuccagggcaggu

SEQ ID NO: 1057327 - RNA, 23 nt, Human
auuucuaggggauuuucuggugc

SEQ ID NO: 1057328 - RNA, 22 nt, Human
gaggcugauucggggaacagca

SEQ ID NO: 1057329 - RNA, 22 nt, Human
gaacccaggcuuuugaggcugu

SEQ ID NO: 1057330 - RNA, 22 nt, Human
uuugaaaucuaaucaaggaaca

SEQ ID NO: 1057331 - RNA, 22 nt, Human
ucccagagcccaaguuggagag

SEQ ID NO: 1057332 - RNA, 22 nt, Human
uuucaaauagaaucuuuccaaa

SEQ ID NO: 1057333 - RNA, 22 nt, Human
gccagagccggcuucacaggau

SEQ ID NO: 1057334 - RNA, 22 nt, Human
gaauauuuuuaaagggacuaau

SEQ ID NO: 1057335 - RNA, 22 nt, Human
ccagacaggaacacacaucucc

SEQ ID NO: 1057336 - RNA, 22 nt, Human
ucacagaaggaccuuguuucau

SEQ ID NO: 1057337 - RNA, 22 nt, Human
ugaggcaguugagcuuccugag

SEQ ID NO: 1057338 - RNA, 22 nt, Human
uagcaagauccuucccuggcgu

SEQ ID NO: 1057339 - RNA, 22 nt, Human
cagggcugugcccaucuucccc

SEQ ID NO: 1057340 - RNA, 22 nt, Human
ugaaggccagggauuugcagcc

SEQ ID NO: 1057341 - RNA, 22 nt, Human
ucuuugaauccuuuacaucuga

SEQ ID NO: 1057342 - RNA, 22 nt, Human
ugcauguggaccccuggugccu

SEQ ID NO: 1057343 - RNA, 22 nt, Human
cuggcccaggaagacguguccc

SEQ ID NO: 1057344 - RNA, 22 nt, Human
ccuggccauuugaacuucagac

SEQ ID NO: 1057345 - RNA, 22 nt, Human
gcuggaaaucaaagaaguggau

SEQ ID NO: 1057346 - RNA, 22 nt, Human
ucuuugaaagcuguucuagagu

SEQ ID NO: 1057347 - RNA, 22 nt, Human
aacacugcugcuggguucugug

SEQ ID NO: 1057348 - RNA, 22 nt, Human
ugggagcccaagggagcugccg

SEQ ID NO: 1057349 - RNA, 22 nt, Human
cugagccaugagccugcgccca

SEQ ID NO: 1057350 - RNA, 22 nt, Human
cagaguucaaagccugcuggga

SEQ ID NO: 1057351 - RNA, 22 nt, Human
gagugucagcagggcagagcac

SEQ ID NO: 1057352 - RNA, 22 nt, Human
aaaaacugguaacuauucccca

SEQ ID NO: 1057353 - RNA, 22 nt, Human
uuauuaguguugauauuaggau

SEQ ID NO: 1057354 - RNA, 22 nt, Human
ccaucccugggccauguccccu

SEQ ID NO: 1057355 - RNA, 20 nt, Human
uccaugaguuagagacuaua

SEQ ID NO: 1057356 - RNA, 22 nt, Human
cuggccaagcacuggggucaaa

SEQ ID NO: 1057357 - RNA, 22 nt, Human
gcagugcagugggacagggcgc

SEQ ID NO: 1057358 - RNA, 22 nt, Human
uccauuuuagagaugaagaaac

SEQ ID NO: 1057359 - RNA, 22 nt, Human
uccccuccucuccugauauggg

SEQ ID NO: 1057360 - RNA, 22 nt, Human
guucuucaucuuaaccaucugu

SEQ ID NO: 1057361 - RNA, 22 nt, Human
aaggccaacuaggaugagcuag

SEQ ID NO: 1057362 - RNA, 22 nt, Human
agcacagagguggaaguguaua

SEQ ID NO: 1057363 - RNA, 22 nt, Human
cagcagagcugggcuuugaauu

SEQ ID NO: 1057364 - RNA, 19 nt, Human
uggcagcauugguaccuug

SEQ ID NO: 1057365 - RNA, 22 nt, Human
ccagggcaacgcugucucagag

SEQ ID NO: 1057366 - RNA, 22 nt, Human
cagcuccugggccaucuccuag

SEQ ID NO: 1057367 - RNA, 22 nt, Human
cacuguaauagcauuauaagug

SEQ ID NO: 1057368 - RNA, 22 nt, Human
agcugccaucugaagaacugca

SEQ ID NO: 1057369 - RNA, 22 nt, Human
gcugccucuccugaguugacag

SEQ ID NO: 1057370 - RNA, 22 nt, Human
augauguugauaaauuacuuua

SEQ ID NO: 1057371 - RNA, 22 nt, Human
uuacacuuguaaauggcaugua

SEQ ID NO: 1057372 - RNA, 22 nt, Human
ugaaaugagauagauaaucagg

SEQ ID NO: 1057373 - RNA, 20 nt, Human
gucaggauuaguaaacucug

SEQ ID NO: 1057374 - RNA, 22 nt, Human
uggaguucauccaugacagcuu

SEQ ID NO: 1057375 - RNA, 22 nt, Human
ggaggagguggguuaaguugua

SEQ ID NO: 1057376 - RNA, 22 nt, Human
gaggccuggagccgccuaggcg

SEQ ID NO: 1057377 - RNA, 22 nt, Human
ccugagccuggcucaugcacuc

SEQ ID NO: 1057378 - RNA, 22 nt, Human
acaggcugguuuguaaaagaug

SEQ ID NO: 1057379 - RNA, 22 nt, Human
cagccuuugggucagaagauuc

SEQ ID NO: 1057380 - RNA, 23 nt, Human
ucccaggaaucugcauuuuuaac

SEQ ID NO: 1057381 - RNA, 22 nt, Human
cagcaagaaucagacaaccuca

SEQ ID NO: 1057382 - RNA, 22 nt, Human
cccuggaggagcuuagagcuug

SEQ ID NO: 1057383 - RNA, 22 nt, Human
acagucuacuugagcuuguaua

SEQ ID NO: 1057384 - RNA, 22 nt, Human
acagaaauuagcagugaguuua

SEQ ID NO: 1057385 - RNA, 22 nt, Human
cuacacuuugguugacuuugug

SEQ ID NO: 1057386 - RNA, 22 nt, Human
gauuucuuuagguguaauagug

SEQ ID NO: 1057387 - RNA, 22 nt, Human
uuggccaauuccagaggaucau

SEQ ID NO: 1057388 - RNA, 22 nt, Human
aaacugccaaaagaccuuggau

SEQ ID NO: 1057389 - RNA, 22 nt, Human
cauucuuacacaauauuuuaau

SEQ ID NO: 1057390 - RNA, 22 nt, Human
cagggcuggguuaaaagcaggg

SEQ ID NO: 1057391 - RNA, 22 nt, Human
aggccagaaauuuggaguaugu

SEQ ID NO: 1057392 - RNA, 22 nt, Human
ucaggauggcuucugcaucaaa

SEQ ID NO: 1057393 - RNA, 22 nt, Human
uuuuauuaguggcuagaugggg

SEQ ID NO: 1057394 - RNA, 22 nt, Human
cugcugccaagggugccacagg

SEQ ID NO: 1057395 - RNA, 19 nt, Human
acugccugaggcucacagg

SEQ ID NO: 1057396 - RNA, 22 nt, Human
uugaaagugccaaguccuagug

SEQ ID NO: 1057397 - RNA, 22 nt, Human
uaacaauaguguuugcuaguca

SEQ ID NO: 1057398 - RNA, 22 nt, Human
aaacaugaauagauauuaaaca

SEQ ID NO: 1057399 - RNA, 22 nt, Human
gcuccuucaggugguagcuguu

SEQ ID NO: 1057400 - RNA, 22 nt, Human
ggcacacauagaucugcacugg

SEQ ID NO: 1057401 - RNA, 22 nt, Human
gcagcuaccacccaggaaggac

SEQ ID NO: 1057402 - RNA, 22 nt, Human
aucaggaugcugucaguuacca

SEQ ID NO: 1057403 - RNA, 22 nt, Human
cucuucuugcuagacugagugc

SEQ ID NO: 1057404 - RNA, 22 nt, Human
agcacugugagcaccagcacgc

SEQ ID NO: 1057405 - RNA, 22 nt, Human
gacccaggcccaaggcugccag

SEQ ID NO: 1057406 - RNA, 22 nt, Human
aaucuguucuacucuauucaga

SEQ ID NO: 1057407 - RNA, 22 nt, Human
aaugcuuuuugcgaaaugugca

SEQ ID NO: 1057408 - RNA, 22 nt, Human
agagcagcuggggcagagacca

SEQ ID NO: 1057409 - RNA, 22 nt, Human
aggggagguggcagaaaugugc

SEQ ID NO: 1057410 - RNA, 22 nt, Human
gacagaggcuggagcaccuccu

SEQ ID NO: 1057411 - RNA, 22 nt, Human
uagcaagaggaaacaaggggcc

SEQ ID NO: 1057412 - RNA, 22 nt, Human
accuguuuuccuaucuagauug

SEQ ID NO: 1057413 - RNA, 22 nt, Human
cagcuacuccucccaugacuuc

SEQ ID NO: 1057414 - RNA, 22 nt, Human
agggacuuguguccuauguaug

SEQ ID NO: 1057415 - RNA, 22 nt, Human
gggcagcucuuugguauccuuc

SEQ ID NO: 1057416 - RNA, 22 nt, Human
guggccaagggacucuaaggca

SEQ ID NO: 1057417 - RNA, 22 nt, Human
aggauuuugacuuauucaggga

SEQ ID NO: 1057418 - RNA, 19 nt, Human
uuugaaaggauuguuauuu

SEQ ID NO: 1057419 - RNA, 22 nt, Human
uguccaggcuaaagugcagugg

SEQ ID NO: 1057420 - RNA, 22 nt, Human
agucuuuccugcuugacuguuc

SEQ ID NO: 1057421 - RNA, 22 nt, Human
ugacuuuaagcuaucugauucu

SEQ ID NO: 1057422 - RNA, 22 nt, Human
gucugucuguuguugagaagca

SEQ ID NO: 1057423 - RNA, 22 nt, Human
uccaccagccaggcccaggcug

SEQ ID NO: 1057424 - RNA, 22 nt, Human
uugagguccagucuccacccac

SEQ ID NO: 1057425 - RNA, 22 nt, Human
ugcaggcucucugcugccagau

SEQ ID NO: 1057426 - RNA, 22 nt, Human
cuguuuauagcagagcaagccu

SEQ ID NO: 1057427 - RNA, 22 nt, Human
uagggcaggggaggaaucugaa

SEQ ID NO: 1057428 - RNA, 22 nt, Human
uuugaagucagacacugcuuug

SEQ ID NO: 1057429 - RNA, 22 nt, Human
aauauuuguuaguguuuuaaug

SEQ ID NO: 1057430 - RNA, 22 nt, Human
gcccaggaguuugcauuuuaac

SEQ ID NO: 1057431 - RNA, 22 nt, Human
ugucagguugguuuucagagaa

SEQ ID NO: 1057432 - RNA, 22 nt, Human
gaaggggacuggcagcugcaga

SEQ ID NO: 1057433 - RNA, 22 nt, Human
cugacaaaggcaaggcaggggg

SEQ ID NO: 1057434 - RNA, 22 nt, Human
uuuuccagauuggacuuagucc

SEQ ID NO: 1057435 - RNA, 22 nt, Human
acaauguguuuuuauacauuug

SEQ ID NO: 1057436 - RNA, 22 nt, Human
gucuagagugcuuccuagucau

SEQ ID NO: 1057437 - RNA, 22 nt, Human
aggcugcugccuuggagagugu

SEQ ID NO: 1057438 - RNA, 22 nt, Human
gcugacagagugccuggccuca

SEQ ID NO: 1057439 - RNA, 22 nt, Human
agcugcuucaaaaugggcuccu

SEQ ID NO: 1057440 - RNA, 22 nt, Human
accuuuuuguucuguucucagc

SEQ ID NO: 1057441 - RNA, 22 nt, Human
uguucuuuggcuucacagcucu

SEQ ID NO: 1057442 - RNA, 22 nt, Human
agauggcuuugcuuuuagaagc

SEQ ID NO: 1057443 - RNA, 22 nt, Human
cuucugaagagguuaucauaga

SEQ ID NO: 1057444 - RNA, 22 nt, Human
aggcagugcaugcaaaggucgg

SEQ ID NO: 1057445 - RNA, 22 nt, Human
ccugguggaaggugagugaggc

SEQ ID NO: 1057446 - RNA, 22 nt, Human
uucaacuaauguuuauuuuaug

SEQ ID NO: 1057447 - RNA, 23 nt, Human
aggcagcuggguagcaucuuucu

SEQ ID NO: 1057448 - RNA, 22 nt, Human
aggcggcugguguccugcaggu

SEQ ID NO: 1057449 - RNA, 22 nt, Human
cugcugugugcuuacuuggguu

SEQ ID NO: 1057450 - RNA, 22 nt, Human
cucaagacugaucgcaguggaa

SEQ ID NO: 1057451 - RNA, 22 nt, Human
auuucacucauucauguuacuu

SEQ ID NO: 1057452 - RNA, 22 nt, Human
cacuggcccauuccugucuggc

SEQ ID NO: 1057453 - RNA, 22 nt, Human
gaggcagcaauaaaaagaauuu

SEQ ID NO: 1057454 - RNA, 22 nt, Human
cugaggcuuguccucucagcuu

SEQ ID NO: 1057455 - RNA, 22 nt, Human
ggcagaggaggggugaauuugc

SEQ ID NO: 1057456 - RNA, 22 nt, Human
uucugagcuacauaguacuggg

SEQ ID NO: 1057457 - RNA, 22 nt, Human
gccugccuagaauugcagcuuu

SEQ ID NO: 1057458 - RNA, 21 nt, Human
gcugcugugggccagggaggc

SEQ ID NO: 1057459 - RNA, 22 nt, Human
auauuaggaguuaaauguauua

SEQ ID NO: 1057460 - RNA, 22 nt, Human
caaggccacugcucagguuucc

SEQ ID NO: 1057461 - RNA, 22 nt, Human
caaggcugcuggcuucugagcu

SEQ ID NO: 1057462 - RNA, 20 nt, Human
agcauuugaaauaugacuau

SEQ ID NO: 1057463 - RNA, 18 nt, Human
gcagcuagccaggggggc

SEQ ID NO: 1057464 - RNA, 22 nt, Human
auagcacugguuuuucuugguu

SEQ ID NO: 1057465 - RNA, 19 nt, Human
aucauacauguuacacucu

SEQ ID NO: 1057466 - RNA, 21 nt, Human
gacuuucuuaccagauuuuug

SEQ ID NO: 1057467 - RNA, 22 nt, Human
gcuggccacacugcugauggag

SEQ ID NO: 1057468 - RNA, 22 nt, Human
aggccagccucaggcagggacc

SEQ ID NO: 1057469 - RNA, 22 nt, Human
cuggccaggcuugggacagaca

SEQ ID NO: 1057470 - RNA, 22 nt, Human
cugcuuuguaaaauagacauaa

SEQ ID NO: 1057471 - RNA, 22 nt, Human
acagugagauccaagggcaggc

SEQ ID NO: 1057472 - RNA, 22 nt, Human
gccaggagcccugggcaaguuc

SEQ ID NO: 1057473 - RNA, 23 nt, Human
cugcuguguuggucucgauggga

SEQ ID NO: 1057474 - RNA, 22 nt, Human
cugccaggcagggagauggcug

SEQ ID NO: 1057475 - RNA, 22 nt, Human
ugguaacuuucagcauggugac

SEQ ID NO: 1057476 - RNA, 22 nt, Human
caacugcugacaccaucacucc

SEQ ID NO: 1057477 - RNA, 22 nt, Human
agugagggaugaagaacugcgg

SEQ ID NO: 1057478 - RNA, 19 nt, Human
ggcugagcgccuuggcugc

SEQ ID NO: 1057479 - RNA, 22 nt, Human
cggccaaauugcagagagaagc

SEQ ID NO: 1057480 - RNA, 22 nt, Human
uuugacaugcaaagcacuuuag

SEQ ID NO: 1057481 - RNA, 22 nt, Human
gaagcagcagcuggggacaguu

SEQ ID NO: 1057482 - RNA, 18 nt, Human
aagaggaggaaacccagg

SEQ ID NO: 1057483 - RNA, 22 nt, Human
gcugcuguguuggagagggacu

SEQ ID NO: 1057484 - RNA, 22 nt, Human
aggagcugggcugcugcuggga

SEQ ID NO: 1057485 - RNA, 19 nt, Human
acauuuaaauucagaucuc

SEQ ID NO: 1057486 - RNA, 22 nt, Human
gcugagguaggagguugcagug

SEQ ID NO: 1057487 - RNA, 22 nt, Human
aauucacugaacuucucugaga

SEQ ID NO: 1057488 - RNA, 22 nt, Human
cagaggauucccuagugaccug

SEQ ID NO: 1057489 - RNA, 22 nt, Human
agugugucugaucacuugugag

SEQ ID NO: 1057490 - RNA, 22 nt, Human
gggcugagugggccucuuacuu

SEQ ID NO: 1057491 - RNA, 22 nt, Human
cauugcuguuaauugucucuag

SEQ ID NO: 1057492 - RNA, 22 nt, Human
ucaggcugccuaucagacugug

SEQ ID NO: 1057493 - RNA, 22 nt, Human
acccaggagccgugagagguua

SEQ ID NO: 1057494 - RNA, 22 nt, Human
aagggcagaauagagaagaugg

SEQ ID NO: 1057495 - RNA, 22 nt, Human
auugaaaggcaaaguaggaagc

SEQ ID NO: 1057496 - RNA, 22 nt, Human
caccagaguuguccaaaugauu

SEQ ID NO: 1057497 - RNA, 22 nt, Human
gagcaagaguguuggacuuuga

SEQ ID NO: 1057498 - RNA, 22 nt, Human
acccagaggugucuagcaagcu

SEQ ID NO: 1057499 - RNA, 22 nt, Human
uggccacauccuuuccuuguca

SEQ ID NO: 1057500 - RNA, 22 nt, Human
uucugggacaucuggacaguuu

SEQ ID NO: 1057501 - RNA, 22 nt, Human
ccaggagagcucucguucagug

SEQ ID NO: 1057502 - RNA, 22 nt, Human
ucucugaguauccugaacugcc

SEQ ID NO: 1057503 - RNA, 22 nt, Human
gauuaggacauggauguauguu

SEQ ID NO: 1057504 - RNA, 22 nt, Human
cugaggucagaguuuagucugg

SEQ ID NO: 1057505 - RNA, 22 nt, Human
cugugauuguuaguuccuauac

SEQ ID NO: 1057506 - RNA, 22 nt, Human
aggcagccaaucagaggcugac

SEQ ID NO: 1057507 - RNA, 22 nt, Human
uugaggucuguguaggcagcaa

SEQ ID NO: 1057508 - RNA, 22 nt, Human
ugccucagucuaaagucucuca

SEQ ID NO: 1057509 - RNA, 22 nt, Human
gccacagcucacguuccccauu

SEQ ID NO: 1057510 - RNA, 22 nt, Human
uccaggagucagacagauggug

SEQ ID NO: 1057511 - RNA, 22 nt, Human
ugucuagaggccaacaggaaag

SEQ ID NO: 1057512 - RNA, 22 nt, Human
gagagggauacugaguuuuggu

SEQ ID NO: 1057513 - RNA, 22 nt, Human
cacauuaaaauccuaacuucca

SEQ ID NO: 1057514 - RNA, 21 nt, Human
cugcucugacagugaggccag

SEQ ID NO: 1057515 - RNA, 22 nt, Human
auggcuucgaguauauacauag

SEQ ID NO: 1057516 - RNA, 22 nt, Human
acaagcaugggcuuugacauca

SEQ ID NO: 1057517 - RNA, 22 nt, Human
aggcaggcacacuuccuccagg

SEQ ID NO: 1057518 - RNA, 22 nt, Human
uuauuaggaaaaggucagaugu

SEQ ID NO: 1057519 - RNA, 22 nt, Human
gggcagcuagcccucuagccca

SEQ ID NO: 1057520 - RNA, 22 nt, Human
auuugcaaagucguaucuguga

SEQ ID NO: 1057521 - RNA, 22 nt, Human
aguuacaaacacuaucaguucu

SEQ ID NO: 1057522 - RNA, 22 nt, Human
ugaguucucacccauucuucuu

SEQ ID NO: 1057523 - RNA, 22 nt, Human
gccacaggcacuuaagggcugg

SEQ ID NO: 1057524 - RNA, 22 nt, Human
agccauuggcugccuggugcgu

SEQ ID NO: 1057525 - RNA, 22 nt, Human
uuauuugguugcugacuuggaa

SEQ ID NO: 1057526 - RNA, 22 nt, Human
acacauuucucuuuuuguaagu

SEQ ID NO: 1057527 - RNA, 18 nt, Human
gcuccuggaccaggucac

SEQ ID NO: 1057528 - RNA, 22 nt, Human
caggcagcuagauuuauaacaa

SEQ ID NO: 1057529 - RNA, 22 nt, Human
ucuucaauuagauuuaccaauu

SEQ ID NO: 1057530 - RNA, 22 nt, Human
gcugccuccaaucugugccccg

SEQ ID NO: 1057531 - RNA, 22 nt, Human
ggauuuggaagaccgggucaca

SEQ ID NO: 1057532 - RNA, 22 nt, Human
aggcuagacuuuggcgaagcac

SEQ ID NO: 1057533 - RNA, 22 nt, Human
caggcgagggcccugaggagcc

SEQ ID NO: 1057534 - RNA, 22 nt, Human
agggcugugucccuaggggagc

SEQ ID NO: 1057535 - RNA, 22 nt, Human
ggguggagaggcuaaguccagu

SEQ ID NO: 1057536 - RNA, 22 nt, Human
agagggcugcugcacagugcuc

SEQ ID NO: 1057537 - RNA, 17 nt, Human
caagagagaugacugga

SEQ ID NO: 1057538 - RNA, 22 nt, Human
gagaggcuggcagugccagguu

SEQ ID NO: 1057539 - RNA, 22 nt, Human
ccagagcuucggggcggcugua

SEQ ID NO: 1057540 - RNA, 22 nt, Human
uccaggagaccagauguaggcc

SEQ ID NO: 1057541 - RNA, 22 nt, Human
auucuucauuguugauucaugu

SEQ ID NO: 1057542 - RNA, 22 nt, Human
uucuacaauaugaauaaugaag

SEQ ID NO: 1057543 - RNA, 22 nt, Human
cuccccagguucaggagguggg

SEQ ID NO: 1057544 - RNA, 22 nt, Human
aaacugguuucugagauggaac

SEQ ID NO: 1057545 - RNA, 18 nt, Human
ccucagggagagagacgc

SEQ ID NO: 1057546 - RNA, 22 nt, Human
aggcuaaggagugugaugcuca

SEQ ID NO: 1057547 - RNA, 22 nt, Human
ucugagguuuucauguuuucug

SEQ ID NO: 1057548 - RNA, 22 nt, Human
gcugggagugggcaagaugaga

SEQ ID NO: 1057549 - RNA, 20 nt, Human
ucagugauuuugaagaggaa

SEQ ID NO: 1057550 - RNA, 23 nt, Human
cuuugccacccagagccugacag

SEQ ID NO: 1057551 - RNA, 22 nt, Human
cuggcuguauuaguuugauccu

SEQ ID NO: 1057552 - RNA, 22 nt, Human
uacuuucuguccuucuguuaaa

SEQ ID NO: 1057553 - RNA, 22 nt, Human
gcaggcugagaguccaagaagg

SEQ ID NO: 1057554 - RNA, 22 nt, Human
agcugcccuguggggaggguug

SEQ ID NO: 1057555 - RNA, 22 nt, Human
auggcugagaugggcuccaggc

SEQ ID NO: 1057556 - RNA, 22 nt, Human
aauaauuauuugagagcagacc

SEQ ID NO: 1057557 - RNA, 22 nt, Human
gugacagucaaagacaugacuu

SEQ ID NO: 1057558 - RNA, 22 nt, Human
cuuuauauccagauguuuggug

SEQ ID NO: 1057559 - RNA, 22 nt, Human
gagggaggcaucaugaauccag

SEQ ID NO: 1057560 - RNA, 23 nt, Human
ugauuaggucuacucuuggcucc

SEQ ID NO: 1057561 - RNA, 22 nt, Human
cauuuguaguuaaaaaugucuc

SEQ ID NO: 1057562 - RNA, 22 nt, Human
cugggccaguuaugucucaucu

SEQ ID NO: 1057563 - RNA, 20 nt, Human
ucugagguaugauagggucu

SEQ ID NO: 1057564 - RNA, 22 nt, Human
acuugcauuauauuuaucacaa

SEQ ID NO: 1057565 - RNA, 18 nt, Human
ucauuuguuuugcaugaa

SEQ ID NO: 1057566 - RNA, 22 nt, Human
guuauauauaguauuucucuga

SEQ ID NO: 1057567 - RNA, 22 nt, Human
guuauacauauguguuaacaaa

SEQ ID NO: 1057568 - RNA, 22 nt, Human
aggcacaguuucauccccgggc

SEQ ID NO: 1057569 - RNA, 22 nt, Human
uccaugaggaccaaauucguag

SEQ ID NO: 1057570 - RNA, 22 nt, Human
ccucugcucugguccaugugcu

SEQ ID NO: 1057571 - RNA, 22 nt, Human
ugaaguuauauauguugaaaau

SEQ ID NO: 1057572 - RNA, 22 nt, Human
gguguccaucaggcugugcuuc

SEQ ID NO: 1057573 - RNA, 22 nt, Human
uggcacaugguuaaucauaauu

SEQ ID NO: 1057574 - RNA, 22 nt, Human
caggcagcgcucguggccuggc

SEQ ID NO: 1057575 - RNA, 22 nt, Human
gugcauuugugcaugcacaugu

SEQ ID NO: 1057576 - RNA, 21 nt, Human
ugaaacagauggaaguauuug

SEQ ID NO: 1057577 - RNA, 22 nt, Human
gcgucugaguugcgggggcuca

SEQ ID NO: 1057578 - RNA, 22 nt, Human
uggcugaguuucaugcaucaug

SEQ ID NO: 1057579 - RNA, 22 nt, Human
caggugagcucuaucuagggag

SEQ ID NO: 1057580 - RNA, 22 nt, Human
cagcugcugcccuuggcugcag

SEQ ID NO: 1057581 - RNA, 22 nt, Human
guguugaugacauuuuagaaac

SEQ ID NO: 1057582 - RNA, 20 nt, Human
ucucaguuucuagagucagg

SEQ ID NO: 1057583 - RNA, 22 nt, Human
cuguaacucugccaagaaggcu

SEQ ID NO: 1057584 - RNA, 21 nt, Human
uggagacucugguucuuugug

SEQ ID NO: 1057585 - RNA, 22 nt, Human
aaaggccacuugaaggauuuuu

SEQ ID NO: 1057586 - RNA, 22 nt, Human
gggcugagccacagcuuuuguu

SEQ ID NO: 1057587 - RNA, 22 nt, Human
uacacauacaccaaugugguca

SEQ ID NO: 1057588 - RNA, 22 nt, Human
gcugcaggcuguggcaggggag

SEQ ID NO: 1057589 - RNA, 22 nt, Human
ugcuagugcaggguuuucaguu

SEQ ID NO: 1057590 - RNA, 22 nt, Human
cuccaugaauuugagcuuugug

SEQ ID NO: 1057591 - RNA, 22 nt, Human
agcugcaggcccaugcucaguc

SEQ ID NO: 1057592 - RNA, 22 nt, Human
uuuaaaaucagaugggaguugg

SEQ ID NO: 1057593 - RNA, 22 nt, Human
ucuucuaguaggccaagaagcu

SEQ ID NO: 1057594 - RNA, 22 nt, Human
ccaggcugcuuagccuuaucuu

SEQ ID NO: 1057595 - RNA, 22 nt, Human
gaggggcagagguagagaacaa

SEQ ID NO: 1057596 - RNA, 22 nt, Human
aucugcuugaaugagcaacagg

SEQ ID NO: 1057597 - RNA, 22 nt, Human
gagggcguucagucagugucuc

SEQ ID NO: 1057598 - RNA, 22 nt, Human
uagggauguaaacauaguaauu

SEQ ID NO: 1057599 - RNA, 22 nt, Human
uucagaaguagcuaagcaguca

SEQ ID NO: 1057600 - RNA, 21 nt, Human
cucaggauggcggccuggugg

SEQ ID NO: 1057601 - RNA, 22 nt, Human
cugcuguguugccagugucacc

SEQ ID NO: 1057602 - RNA, 22 nt, Human
aucauucuagcuguuguguuga

SEQ ID NO: 1057603 - RNA, 22 nt, Human
auauacuuccccauuauggggg

SEQ ID NO: 1057604 - RNA, 21 nt, Human
gagacagcccagugccagggc

SEQ ID NO: 1057605 - RNA, 22 nt, Human
ugaggcucaagaaagauuuguu

SEQ ID NO: 1057606 - RNA, 22 nt, Human
guugaaagcuuuucauuuaguu

SEQ ID NO: 1057607 - RNA, 22 nt, Human
aggcagcguagcaaggcuagua

SEQ ID NO: 1057608 - RNA, 22 nt, Human
aaaggccagguuggcugguauu

SEQ ID NO: 1057609 - RNA, 22 nt, Human
gaggagaggccaucguuguuau

SEQ ID NO: 1057610 - RNA, 22 nt, Human
cagcaagaacagccugaugugc

SEQ ID NO: 1057611 - RNA, 22 nt, Human
acacaguauugugacuauaacu

SEQ ID NO: 1057612 - RNA, 22 nt, Human
cuccuggcuuucccagaccagg

SEQ ID NO: 1057613 - RNA, 22 nt, Human
auggaaagugcauggaagucau

SEQ ID NO: 1057614 - RNA, 22 nt, Human
gguggaguaauucgcagagguu

SEQ ID NO: 1057615 - RNA, 22 nt, Human
agcugguauuucugaaggaaag

SEQ ID NO: 1057616 - RNA, 22 nt, Human
uggaaggaaagguagcagagaa

SEQ ID NO: 1057617 - RNA, 22 nt, Human
gcuggccauucucuuugagaug

SEQ ID NO: 1057618 - RNA, 22 nt, Human
gagaggggcgcgcagcucgcga

SEQ ID NO: 1057619 - RNA, 22 nt, Human
aacuggauuuugaugagcaguu

SEQ ID NO: 1057620 - RNA, 22 nt, Human
agagagggcauagaaaaaggga

SEQ ID NO: 1057621 - RNA, 22 nt, Human
aagacuguacauuuuccagucu

SEQ ID NO: 1057622 - RNA, 22 nt, Human
guuuucaauuauaagauggcuu

SEQ ID NO: 1057623 - RNA, 17 nt, Human
uccaggagaggcaaugg

SEQ ID NO: 1057624 - RNA, 22 nt, Human
uuggcagcccagcuuacuagca

SEQ ID NO: 1057625 - RNA, 22 nt, Human
gcuggagcugcagccugggccu

SEQ ID NO: 1057626 - RNA, 22 nt, Human
cccaggcagccugcagggaagg

SEQ ID NO: 1057627 - RNA, 22 nt, Human
cucacugucuguacuagcugau

SEQ ID NO: 1057628 - RNA, 22 nt, Human
aacuccagggcauugucuccug

SEQ ID NO: 1057629 - RNA, 22 nt, Human
auuucccagcuuugaucaguuu

SEQ ID NO: 1057630 - RNA, 19 nt, Human
uagaacugaggacuugcau

SEQ ID NO: 1057631 - RNA, 22 nt, Human
agcuaccuggcuuaucacuguc

SEQ ID NO: 1057632 - RNA, 22 nt, Human
uuaaauuuuagaaacagacucu

SEQ ID NO: 1057633 - RNA, 22 nt, Human
aggguccugggugcaguugcuu

SEQ ID NO: 1057634 - RNA, 22 nt, Human
augcuguguuuuaaauggaaau

SEQ ID NO: 1057635 - RNA, 22 nt, Human
gaggaggccaguggaaggaagc

SEQ ID NO: 1057636 - RNA, 22 nt, Human
cuacccaggcuuagagggcugg

SEQ ID NO: 1057637 - RNA, 22 nt, Human
uauuggauagcuugugcagaau

SEQ ID NO: 1057638 - RNA, 23 nt, Human
cuugcagggcuggaggcuuagaa

SEQ ID NO: 1057639 - RNA, 22 nt, Human
cuggccaacuugcuuguuggca

SEQ ID NO: 1057640 - RNA, 22 nt, Human
cacuaaguugguguuaauuagu

SEQ ID NO: 1057641 - RNA, 22 nt, Human
aggcagcuuuaacugguaguag

SEQ ID NO: 1057642 - RNA, 22 nt, Human
aggugcugugcuaugcacuugu

SEQ ID NO: 1057643 - RNA, 22 nt, Human
auuuggaaaaucugguuauaga

SEQ ID NO: 1057644 - RNA, 22 nt, Human
uguuggcaucucugagagaguu

SEQ ID NO: 1057645 - RNA, 22 nt, Human
gggcagcucuggcugugggaag

SEQ ID NO: 1057646 - RNA, 22 nt, Human
cucuuaguaaugccaugaagca

SEQ ID NO: 1057647 - RNA, 22 nt, Human
ggccagaggugguacauagcuu

SEQ ID NO: 1057648 - RNA, 22 nt, Human
aagacugucuuuucugagugac

SEQ ID NO: 1057649 - RNA, 21 nt, Human
aaauacugggcagugacuuga

SEQ ID NO: 1057650 - RNA, 22 nt, Human
cagugucuccagaugcuccaau

SEQ ID NO: 1057651 - RNA, 22 nt, Human
cagcaacugugccugacacaca

SEQ ID NO: 1057652 - RNA, 22 nt, Human
cuugaaagcacuccuuugacug

SEQ ID NO: 1057653 - RNA, 22 nt, Human
auuaggauuuuguccaaguagc

SEQ ID NO: 1057654 - RNA, 22 nt, Human
ggcugagguguggggaacuaua

SEQ ID NO: 1057655 - RNA, 22 nt, Human
cagagcugggaucccaugggcg

SEQ ID NO: 1057656 - RNA, 22 nt, Human
cuccugugggucaccaauaggc

SEQ ID NO: 1057657 - RNA, 22 nt, Human
aaaacaguuuaggcaucacagu

SEQ ID NO: 1057658 - RNA, 22 nt, Human
cuacuucuaaguacauggugau

SEQ ID NO: 1057659 - RNA, 22 nt, Human
uagaagcagcaggaguaaaggc

SEQ ID NO: 1057660 - RNA, 22 nt, Human
aggcaugacuuuggcugaagaa

SEQ ID NO: 1057661 - RNA, 22 nt, Human
agaggccggccgagcccauggg

SEQ ID NO: 1057662 - RNA, 22 nt, Human
cagcaagaaaauucacaugcuc

SEQ ID NO: 1057663 - RNA, 22 nt, Human
uguagauaaguaaaagcccagu

SEQ ID NO: 1057664 - RNA, 19 nt, Human
uggcaucuguaaaauggug

SEQ ID NO: 1057665 - RNA, 22 nt, Human
ugaaaugagauaauuuaagugc

SEQ ID NO: 1057666 - RNA, 22 nt, Human
cauagagugauguaagguaugu

SEQ ID NO: 1057667 - RNA, 22 nt, Human
cuagaaaaauacuuuauuguga

SEQ ID NO: 1057668 - RNA, 22 nt, Human
gcugcccacaaugauuacaugg

SEQ ID NO: 1057669 - RNA, 22 nt, Human
aucaggauagugguuaccuggg

SEQ ID NO: 1057670 - RNA, 22 nt, Human
ugaaagcacaaguucuaacagg

SEQ ID NO: 1057671 - RNA, 22 nt, Human
ccuguuuaucuaucuagagaug

SEQ ID NO: 1057672 - RNA, 22 nt, Human
uuucagcugguaaaggaguagc

SEQ ID NO: 1057673 - RNA, 22 nt, Human
acucaggaagaaagcagcuggu

SEQ ID NO: 1057674 - RNA, 22 nt, Human
agaaaguuagcagacucuuggc

SEQ ID NO: 1057675 - RNA, 22 nt, Human
cucagaagccuucagucuuggc

SEQ ID NO: 1057676 - RNA, 22 nt, Human
gaaauccaguucccuacucuua

SEQ ID NO: 1057677 - RNA, 22 nt, Human
ucugagccaccugccagugcug

SEQ ID NO: 1057678 - RNA, 21 nt, Human
uccaggaguucuaauaggugu

SEQ ID NO: 1057679 - RNA, 22 nt, Human
uugcccagaguccacagcguac

SEQ ID NO: 1057680 - RNA, 22 nt, Human
aucaggauguuuggcugucaua

SEQ ID NO: 1057681 - RNA, 22 nt, Human
aacuuucuggcuuuggggagag

SEQ ID NO: 1057682 - RNA, 17 nt, Human
aggcaggcagagcggga

SEQ ID NO: 1057683 - RNA, 22 nt, Human
agagccugugggagaugcagcu

SEQ ID NO: 1057684 - RNA, 22 nt, Human
agugcuuuagcauccaacuguc

SEQ ID NO: 1057685 - RNA, 22 nt, Human
ugagcagauggaggcuucugca

SEQ ID NO: 1057686 - RNA, 22 nt, Human
uggcagcuauggucuaagggcc

SEQ ID NO: 1057687 - RNA, 22 nt, Human
auaguuugugaaacacagcagu

SEQ ID NO: 1057688 - RNA, 22 nt, Human
uggcugagagaagacggggaag

SEQ ID NO: 1057689 - RNA, 22 nt, Human
acuuggcaaguaucuauaaagu

SEQ ID NO: 1057690 - RNA, 22 nt, Human
ugcauguguuugccacagugag

SEQ ID NO: 1057691 - RNA, 21 nt, Human
uggcugccuacaugcugcagg

SEQ ID NO: 1057692 - RNA, 22 nt, Human
ugcugaggagguggcugugcuu

SEQ ID NO: 1057693 - RNA, 22 nt, Human
ugagagggcccagagcacacca

SEQ ID NO: 1057694 - RNA, 22 nt, Human
ccuccuggaaaaauucccuggc

SEQ ID NO: 1057695 - RNA, 22 nt, Human
uugcaucuaccauaucaaagau

SEQ ID NO: 1057696 - RNA, 22 nt, Human
augguaaccagaagacuaugac

SEQ ID NO: 1057697 - RNA, 22 nt, Human
aagggcaggaaaagauggaugu

SEQ ID NO: 1057698 - RNA, 22 nt, Human
ugcugaggaaaaaugugacucu

SEQ ID NO: 1057699 - RNA, 22 nt, Human
uuugaaaggaauuaggaugaca

SEQ ID NO: 1057700 - RNA, 22 nt, Human
ugaaagggguugaguuacagcu

SEQ ID NO: 1057701 - RNA, 22 nt, Human
auacaucucuuugaagugcuuu

SEQ ID NO: 1057702 - RNA, 22 nt, Human
ccuccugguaauuagcgaaagg

SEQ ID NO: 1057703 - RNA, 22 nt, Human
accaggagagauuuuauugaga

SEQ ID NO: 1057704 - RNA, 20 nt, Human
uacuuaggcuuguuuuggcc

SEQ ID NO: 1057705 - RNA, 20 nt, Human
caaaugaagcuguuggccuc

SEQ ID NO: 1057706 - RNA, 22 nt, Human
uuuauuuggcauccagggagaa

SEQ ID NO: 1057707 - RNA, 22 nt, Human
gcugugcuugggaagaaucucu

SEQ ID NO: 1057708 - RNA, 22 nt, Human
accuguuuguguccauuaguga

SEQ ID NO: 1057709 - RNA, 22 nt, Human
acagauguacacucauauauaa

SEQ ID NO: 1057710 - RNA, 22 nt, Human
cccaggaccgcgcggcugagcg

SEQ ID NO: 1057711 - RNA, 22 nt, Human
gccaggaguucagaugcauguu

SEQ ID NO: 1057712 - RNA, 22 nt, Human
uuauuauuggugaguuaaggaa

SEQ ID NO: 1057713 - RNA, 22 nt, Human
guccucuggaagaugaguucuu

SEQ ID NO: 1057714 - RNA, 22 nt, Human
gucaggauuauaauccccaugg

SEQ ID NO: 1057715 - RNA, 23 nt, Human
cugagguaaaauauucugaagga

SEQ ID NO: 1057716 - RNA, 22 nt, Human
ucauucuugaucacuaguuagu

SEQ ID NO: 1057717 - RNA, 20 nt, Human
uaggcagcuugacccuuggu

SEQ ID NO: 1057718 - RNA, 22 nt, Human
uugaagaggacuuugcagcugu

SEQ ID NO: 1057719 - RNA, 22 nt, Human
cagagcucuauguucauggagg

SEQ ID NO: 1057720 - RNA, 22 nt, Human
agaaaagugcucuagugagagc

SEQ ID NO: 1057721 - RNA, 22 nt, Human
caggaugagguagaggcagaua

SEQ ID NO: 1057722 - RNA, 22 nt, Human
auacaguauaacuaauaaaccc

SEQ ID NO: 1057723 - RNA, 22 nt, Human
uaggcugggcugagcuggacgg

SEQ ID NO: 1057724 - RNA, 22 nt, Human
uucccucucacuuaaagcuugg

SEQ ID NO: 1057725 - RNA, 22 nt, Human
ucagugcacagagauuuuuguu

SEQ ID NO: 1057726 - RNA, 22 nt, Human
ccugguggcuucuggguggacg

SEQ ID NO: 1057727 - RNA, 22 nt, Human
aagggcugcauuugauguguca

SEQ ID NO: 1057728 - RNA, 22 nt, Human
cuuauuucagcccugggcaccc

SEQ ID NO: 1057729 - RNA, 20 nt, Human
uuaagaaaagcacauccugc

SEQ ID NO: 1057730 - RNA, 22 nt, Human
gaaggccauuagagccugugcc

SEQ ID NO: 1057731 - RNA, 22 nt, Human
ccaggaaauagugcugugaucu

SEQ ID NO: 1057732 - RNA, 22 nt, Human
acccaggacucucuuccaguag

SEQ ID NO: 1057733 - RNA, 22 nt, Human
uagcuguguaagcuugguaaga

SEQ ID NO: 1057734 - RNA, 23 nt, Human
ucaguuuguauaauccauaugca

SEQ ID NO: 1057735 - RNA, 22 nt, Human
uagaacuggaauuuugugguuu

SEQ ID NO: 1057736 - RNA, 22 nt, Human
gagggcugccacguugggcgag

SEQ ID NO: 1057737 - RNA, 22 nt, Human
uaggaugacacagcaaguauag

SEQ ID NO: 1057738 - RNA, 22 nt, Human
caggcugauaggguccaaaguu

SEQ ID NO: 1057739 - RNA, 19 nt, Human
gccaggagggcucuggcug

SEQ ID NO: 1057740 - RNA, 20 nt, Human
uguuaaaggacacuugcuuu

SEQ ID NO: 1057741 - RNA, 22 nt, Human
aaggcugaggcuggagaauuac

SEQ ID NO: 1057742 - RNA, 22 nt, Human
ucuuuauugcuacugguuuguc

SEQ ID NO: 1057743 - RNA, 22 nt, Human
gaaucucaguggaagcaggaag

SEQ ID NO: 1057744 - RNA, 22 nt, Human
aggcggcuccgggagugugggc

SEQ ID NO: 1057745 - RNA, 22 nt, Human
aacuggauuuaggaacagagaa

SEQ ID NO: 1057746 - RNA, 22 nt, Human
cugaggacauugaugaggcaau

SEQ ID NO: 1057747 - RNA, 22 nt, Human
uggaaauguauuugggcaugcc

SEQ ID NO: 1057748 - RNA, 22 nt, Human
uuuuuuaguuaggucagaaugu

SEQ ID NO: 1057749 - RNA, 22 nt, Human
uccugucuaaagaccugcaggc

SEQ ID NO: 1057750 - RNA, 22 nt, Human
uucucugaguacguuucagugu

SEQ ID NO: 1057751 - RNA, 22 nt, Human
cugccuggaugaauggcgccuu

SEQ ID NO: 1057752 - RNA, 21 nt, Human
ccugggccaaauucccuggac

SEQ ID NO: 1057753 - RNA, 23 nt, Human
agugcuggagaagcuucuggcuu

SEQ ID NO: 1057754 - RNA, 22 nt, Human
uucagcaaacacgaugcuuguu

SEQ ID NO: 1057755 - RNA, 22 nt, Human
ccaugagccaggcugaggaagc

SEQ ID NO: 1057756 - RNA, 22 nt, Human
agaaaauauucauugagaggcu

SEQ ID NO: 1057757 - RNA, 22 nt, Human
gcuggagccauuggcuuggccu

SEQ ID NO: 1057758 - RNA, 22 nt, Human
uucacagaauggcaaguuaugg

SEQ ID NO: 1057759 - RNA, 22 nt, Human
uacaaagagguaauugcauaua

SEQ ID NO: 1057760 - RNA, 22 nt, Human
uagcuuuccuuguugccugugc

SEQ ID NO: 1057761 - RNA, 22 nt, Human
ugcuugaaagggguuucccagu

SEQ ID NO: 1057762 - RNA, 22 nt, Human
gcugaagagcaaggcugggucu

SEQ ID NO: 1057763 - RNA, 22 nt, Human
ucaggagacuggcagugcccac

SEQ ID NO: 1057764 - RNA, 22 nt, Human
ccugagguuuuuggauaguugu

SEQ ID NO: 1057765 - RNA, 22 nt, Human
auacuaaaguauagaacuuagu

SEQ ID NO: 1057766 - RNA, 22 nt, Human
auuagcauauuaaauagucauu

SEQ ID NO: 1057767 - RNA, 22 nt, Human
cugaggccagcugcagagcucu

SEQ ID NO: 1057768 - RNA, 20 nt, Human
uggcaucucucaauuguagg

SEQ ID NO: 1057769 - RNA, 22 nt, Human
aaggagagagcuuugcuggaac

SEQ ID NO: 1057770 - RNA, 18 nt, Human
ugagaggcagguagagga

SEQ ID NO: 1057771 - RNA, 22 nt, Human
cuaagaaauguugugaaugcca

SEQ ID NO: 1057772 - RNA, 18 nt, Human
aagggcuggccuuuggag

SEQ ID NO: 1057773 - RNA, 22 nt, Human
acacauuucuaaauuuuuaccg

SEQ ID NO: 1057774 - RNA, 22 nt, Human
cugaguguuuucagccacggcc

SEQ ID NO: 1057775 - RNA, 22 nt, Human
ccuugcugaccaucaccuuuga

SEQ ID NO: 1057776 - RNA, 22 nt, Human
ucucaggaucuaauacauggua

SEQ ID NO: 1057777 - RNA, 23 nt, Human
uugauuucaaaugcagagaacac

SEQ ID NO: 1057778 - RNA, 22 nt, Human
ugaaaugauaucugauaacaaa

SEQ ID NO: 1057779 - RNA, 19 nt, Human
gcagcugcuugaaaagaaa

SEQ ID NO: 1057780 - RNA, 22 nt, Human
ggcugcagcccucgccuagcca

SEQ ID NO: 1057781 - RNA, 22 nt, Human
cuucuagagcuggagcaaaugu

SEQ ID NO: 1057782 - RNA, 20 nt, Human
uuggcagcagcucagccacc

SEQ ID NO: 1057783 - RNA, 18 nt, Human
caugucugcgccacaagg

SEQ ID NO: 1057784 - RNA, 21 nt, Human
cccaggaggcugagaagagca

SEQ ID NO: 1057785 - RNA, 22 nt, Human
aucagcugcuacauuggccucu

SEQ ID NO: 1057786 - RNA, 22 nt, Human
guaggcagguggaggagugaag

SEQ ID NO: 1057787 - RNA, 22 nt, Human
ccuucuuaaacaucauuuuggc

SEQ ID NO: 1057788 - RNA, 22 nt, Human
cuggagaguuggaagauggacu

SEQ ID NO: 1057789 - RNA, 22 nt, Human
cggagaggaccugcaacucgcu

SEQ ID NO: 1057790 - RNA, 22 nt, Human
aggcaguuuauccccagagccu

SEQ ID NO: 1057791 - RNA, 22 nt, Human
cagucuuuguucccauuacuga

SEQ ID NO: 1057792 - RNA, 22 nt, Human
uggcagcaccagcaguguccuu

SEQ ID NO: 1057793 - RNA, 22 nt, Human
gacagguugaaguaucaaaggu

SEQ ID NO: 1057794 - RNA, 22 nt, Human
ucuuagaaguuuauggcacgga

SEQ ID NO: 1057795 - RNA, 22 nt, Human
ucuccuggguaaaaggguugau

SEQ ID NO: 1057796 - RNA, 22 nt, Human
uaggacaugcuacauaaauagg

SEQ ID NO: 1057797 - RNA, 22 nt, Human
uggaaauggaucugaugagucu

SEQ ID NO: 1057798 - RNA, 22 nt, Human
auacaguaauuuguaacucauc

SEQ ID NO: 1057799 - RNA, 21 nt, Human
gggcagcucuguuuuauuuuc

SEQ ID NO: 1057800 - RNA, 22 nt, Human
gcugcccagacauugaaucagg

SEQ ID NO: 1057801 - RNA, 21 nt, Human
acugagguuagaugccuugcc

SEQ ID NO: 1057802 - RNA, 17 nt, Human
guccuacccauggucua

SEQ ID NO: 1057803 - RNA, 22 nt, Human
augcugugcuggcuaaccaugg

SEQ ID NO: 1057804 - RNA, 22 nt, Human
acuguugucaggcugcuuugga

SEQ ID NO: 1057805 - RNA, 22 nt, Human
cugaggccccucuugugagcau

SEQ ID NO: 1057806 - RNA, 22 nt, Human
uggcugagcugcagcguggcuu

SEQ ID NO: 1057807 - RNA, 22 nt, Human
caguuuuugccauuaagaguaa

SEQ ID NO: 1057808 - RNA, 22 nt, Human
ccaggagagcgcccucccggcc

SEQ ID NO: 1057809 - RNA, 22 nt, Human
uuggccaaggucacugggugag

SEQ ID NO: 1057810 - RNA, 22 nt, Human
caggauggagggagggcuguua

SEQ ID NO: 1057811 - RNA, 20 nt, Human
acaggagaucugaggaaagg

SEQ ID NO: 1057812 - RNA, 19 nt, Human
agccuggcuuugcucugcu

SEQ ID NO: 1057813 - RNA, 22 nt, Human
guuuuauaggugaaauauuacu

SEQ ID NO: 1057814 - RNA, 22 nt, Human
ucaggauguuaauauagcauua

SEQ ID NO: 1057815 - RNA, 22 nt, Human
ccuggcugaacaaagucccucc

SEQ ID NO: 1057816 - RNA, 22 nt, Human
uguagcagugucuaccacauua

SEQ ID NO: 1057817 - RNA, 23 nt, Human
ugaaggccuggaggacgcguugu

SEQ ID NO: 1057818 - RNA, 19 nt, Human
agcagcuguagauagacac

SEQ ID NO: 1057819 - RNA, 22 nt, Human
uggcagcacuugaacuugagcc

SEQ ID NO: 1057820 - RNA, 22 nt, Human
agcccagggaaccaggaagugg

SEQ ID NO: 1057821 - RNA, 22 nt, Human
uccaggagguuuggaggaagca

SEQ ID NO: 1057822 - RNA, 22 nt, Human
agcugcagcacuccaguagccg

SEQ ID NO: 1057823 - RNA, 22 nt, Human
gaccauuuuuacagagcauuca

SEQ ID NO: 1057824 - RNA, 22 nt, Human
gagaaggaguagcugaccuggg

SEQ ID NO: 1057825 - RNA, 22 nt, Human
uuucagaaagcugaacauauga

SEQ ID NO: 1057826 - RNA, 20 nt, Human
uuucacagucccuguuuccu

SEQ ID NO: 1057827 - RNA, 22 nt, Human
gaauuauaggcaaagcagucau

SEQ ID NO: 1057828 - RNA, 22 nt, Human
uagcacugaaucacaugcugcu

SEQ ID NO: 1057829 - RNA, 22 nt, Human
uaacaguagccuuauguggucu

SEQ ID NO: 1057830 - RNA, 22 nt, Human
uaguaacucuacacacgacacu

SEQ ID NO: 1057831 - RNA, 22 nt, Human
ucaggagaaagccaauuagagu

SEQ ID NO: 1057832 - RNA, 22 nt, Human
agaggggaaguaaugaaugaua

SEQ ID NO: 1057833 - RNA, 22 nt, Human
caaauauuccagguacaucccu

SEQ ID NO: 1057834 - RNA, 22 nt, Human
acccaggaugauaauguucaca

SEQ ID NO: 1057835 - RNA, 23 nt, Human
cuugcaggaagcagauggcacac

SEQ ID NO: 1057836 - RNA, 22 nt, Human
gagaggcagaggccugaaaccg

SEQ ID NO: 1057837 - RNA, 22 nt, Human
uagugcuuaauaaauuucagaa

SEQ ID NO: 1057838 - RNA, 22 nt, Human
aacauauaaacucuuaaguuca

SEQ ID NO: 1057839 - RNA, 23 nt, Human
acuauaaaguuguucugauuuac

SEQ ID NO: 1057840 - RNA, 22 nt, Human
gagcagcucugggugacccagu

SEQ ID NO: 1057841 - RNA, 22 nt, Human
gucugagcgcuggagcuugugu

SEQ ID NO: 1057842 - RNA, 22 nt, Human
gcuuaguccccaagagagacca

SEQ ID NO: 1057843 - RNA, 22 nt, Human
cuugugaaaugccagauaaucu

SEQ ID NO: 1057844 - RNA, 22 nt, Human
uuuucuaacaucuaguaauuug

SEQ ID NO: 1057845 - RNA, 21 nt, Human
uuuguucaggggcaaaguuaa

SEQ ID NO: 1057846 - RNA, 22 nt, Human
uuuguucaccuagcaaacuuuu

SEQ ID NO: 1057847 - RNA, 22 nt, Human
uaucuguuuuuacagugucuuu

SEQ ID NO: 1057848 - RNA, 22 nt, Human
uuguuuguaaggcucuuagaau

SEQ ID NO: 1057849 - RNA, 22 nt, Human
cugucacagcccgcgucuccuc

SEQ ID NO: 1057850 - RNA, 22 nt, Human
uguucaguuugcuaucauaauc

SEQ ID NO: 1057851 - RNA, 22 nt, Human
uauuuguuucuaguggcagcaa

SEQ ID NO: 1057852 - RNA, 22 nt, Human
cauugcugugggcauuugcugc

SEQ ID NO: 1057853 - RNA, 22 nt, Human
uaucacauacuucucauccagg

SEQ ID NO: 1057854 - RNA, 22 nt, Human
auuguauacaagcuuaauuguu

SEQ ID NO: 1057855 - RNA, 22 nt, Human
augcaucaccgaguugcccacc

SEQ ID NO: 1057856 - RNA, 22 nt, Human
ucaauuuauguggcuauucauu

SEQ ID NO: 1057857 - RNA, 23 nt, Human
uaucauuucagcucucugccugg

SEQ ID NO: 1057858 - RNA, 22 nt, Human
aaugcugugauuuauuaaguau

SEQ ID NO: 1057859 - RNA, 22 nt, Human
uuuugaauaauucagaaacagc

SEQ ID NO: 1057860 - RNA, 22 nt, Human
cuuguauuaggaagaaugcuuu

SEQ ID NO: 1057861 - RNA, 22 nt, Human
ugacauuugagagagauauaca

SEQ ID NO: 1057862 - RNA, 22 nt, Human
uaaaaguuagcuaggacaaagu

SEQ ID NO: 1057863 - RNA, 20 nt, Human
uugagcuuuuaguacagaca

SEQ ID NO: 1057864 - RNA, 22 nt, Human
ucaguaaaugagcaaaaauuuc

SEQ ID NO: 1057865 - RNA, 22 nt, Human
uuuguugguugcacuggugggu

SEQ ID NO: 1057866 - RNA, 22 nt, Human
cuuucuuucgaagacgugauua

SEQ ID NO: 1057867 - RNA, 22 nt, Human
uauuucagcucuuuggauuauc

SEQ ID NO: 1057868 - RNA, 22 nt, Human
auauuuguuuggcagaguucag

SEQ ID NO: 1057869 - RNA, 22 nt, Human
uagcaucuguacugacauaauc

SEQ ID NO: 1057870 - RNA, 22 nt, Human
cugcugucuuuauuucacugcu

SEQ ID NO: 1057871 - RNA, 22 nt, Human
augugauacuccuucuagugga

SEQ ID NO: 1057872 - RNA, 22 nt, Human
uccagaugcugcacauuccuga

SEQ ID NO: 1057873 - RNA, 21 nt, Human
uuccuccucuggagaagaaga

SEQ ID NO: 1057874 - RNA, 22 nt, Human
uucacagugguagugcauuuag

SEQ ID NO: 1057875 - RNA, 22 nt, Human
aguuagugaagcucaucacagc

SEQ ID NO: 1057876 - RNA, 22 nt, Human
ugcuccaucuagagcucugcag

SEQ ID NO: 1057877 - RNA, 22 nt, Human
auggaguugagcucuguugucc

SEQ ID NO: 1057878 - RNA, 18 nt, Human
agguguguuucuaggagc

SEQ ID NO: 1057879 - RNA, 22 nt, Human
auauaugaagaagucuugauua

SEQ ID NO: 1057880 - RNA, 22 nt, Human
aauaaguacuuggggauaacuu

SEQ ID NO: 1057881 - RNA, 22 nt, Human
uuuuuugucuugaagaaauggu

SEQ ID NO: 1057882 - RNA, 22 nt, Human
aucuaugugggaaucauaauag

SEQ ID NO: 1057883 - RNA, 22 nt, Human
uugcauauccuccaacacaugg

SEQ ID NO: 1057884 - RNA, 22 nt, Human
gucugcugacagagcauggacc

SEQ ID NO: 1057885 - RNA, 22 nt, Human
uagauuaucccugauuugucca

SEQ ID NO: 1057886 - RNA, 22 nt, Human
uaggauaugcauuuuuauacau

SEQ ID NO: 1057887 - RNA, 22 nt, Human
ugcauuugcaauggguacacaa

SEQ ID NO: 1057888 - RNA, 22 nt, Human
uggauguuugaaguugcaugug

SEQ ID NO: 1057889 - RNA, 22 nt, Human
cacagaggacuguagcggggag

SEQ ID NO: 1057890 - RNA, 22 nt, Human
uacagugcuugguaucuaguaa

SEQ ID NO: 1057891 - RNA, 22 nt, Human
auuugcuuguucaccaguacuu

SEQ ID NO: 1057892 - RNA, 22 nt, Human
acugugugccaggcgcuggucu

SEQ ID NO: 1057893 - RNA, 22 nt, Human
auucuggacaaggcaagcuccu

SEQ ID NO: 1057894 - RNA, 22 nt, Human
auuuccagcagcauauuugucu

SEQ ID NO: 1057895 - RNA, 22 nt, Human
uuucuaguggguauucccuguu

SEQ ID NO: 1057896 - RNA, 22 nt, Human
ucuuuuaucuguuguguaacaa

SEQ ID NO: 1057897 - RNA, 16 nt, Human
ucauugaagacaguac

SEQ ID NO: 1057898 - RNA, 22 nt, Human
uucuguaauucuguuaguuuca

SEQ ID NO: 1057899 - RNA, 22 nt, Human
ggauguuuauccuaucuuaguu

SEQ ID NO: 1057900 - RNA, 22 nt, Human
caugggaauaaaguuauuucaa

SEQ ID NO: 1057901 - RNA, 22 nt, Human
gggcauuucuugucaauguagg

SEQ ID NO: 1057902 - RNA, 22 nt, Human
uuauuuaaaagugguaagauuc

SEQ ID NO: 1057903 - RNA, 22 nt, Human
auuaaauuggacgcugggggaa

SEQ ID NO: 1057904 - RNA, 21 nt, Human
cuuuucuagucccagccccgc

SEQ ID NO: 1057905 - RNA, 22 nt, Human
acauuucuccuacuuguuauuu

SEQ ID NO: 1057906 - RNA, 22 nt, Human
uuuuuggguccaggcuguaucu

SEQ ID NO: 1057907 - RNA, 22 nt, Human
uugucaggaacuaugauuaugc

SEQ ID NO: 1057908 - RNA, 22 nt, Human
guucuucaggcugugcucuaga

SEQ ID NO: 1057909 - RNA, 22 nt, Human
ucugaauucuuagaauuaaagg

SEQ ID NO: 1057910 - RNA, 17 nt, Human
ggugaguguccaggugg

SEQ ID NO: 1057911 - RNA, 22 nt, Human
uaguguguggucucucccuugu

SEQ ID NO: 1057912 - RNA, 22 nt, Human
auugagaaggagauuggcaucu

SEQ ID NO: 1057913 - RNA, 22 nt, Human
aggaauuugggguuacaugaug

SEQ ID NO: 1057914 - RNA, 22 nt, Human
uuauuuuguagcucugaucuuu

SEQ ID NO: 1057915 - RNA, 21 nt, Human
ugcuuugcagguggauuuagu

SEQ ID NO: 1057916 - RNA, 22 nt, Human
gcugcaagugcauguugcaacu

SEQ ID NO: 1057917 - RNA, 20 nt, Human
ugugguuuuugccaguugaa

SEQ ID NO: 1057918 - RNA, 22 nt, Human
gagaugggcgagaagguggacu

SEQ ID NO: 1057919 - RNA, 19 nt, Human
ucuuucauuucuagcucug

SEQ ID NO: 1057920 - RNA, 22 nt, Human
ccuugcagcauauagagucccu

SEQ ID NO: 1057921 - RNA, 22 nt, Human
uuaaguauauccauuugacugg

SEQ ID NO: 1057922 - RNA, 22 nt, Human
ugugagauuuuauuugauaugc

SEQ ID NO: 1057923 - RNA, 22 nt, Human
uguaaagaaagacgcagaguua

SEQ ID NO: 1057924 - RNA, 22 nt, Human
cagguuagcaacaugguuagag

SEQ ID NO: 1057925 - RNA, 22 nt, Human
ucauuguuucugcuuuucauga

SEQ ID NO: 1057926 - RNA, 22 nt, Human
ggagguggagcuggaaguucca

SEQ ID NO: 1057927 - RNA, 22 nt, Human
acuuugccuucuuacuguguug

SEQ ID NO: 1057928 - RNA, 22 nt, Human
uucucuucacagggaucauccu

SEQ ID NO: 1057929 - RNA, 22 nt, Human
uugauuugauuguaauggcucu

SEQ ID NO: 1057930 - RNA, 22 nt, Human
acauuuuuggguugaugucuga

SEQ ID NO: 1057931 - RNA, 22 nt, Human
cugaggcucugagaaagccaaa

SEQ ID NO: 1057932 - RNA, 22 nt, Human
acaguguuucacuuaaccguuu

SEQ ID NO: 1057933 - RNA, 22 nt, Human
cuuguuuucuucugcagucuau

SEQ ID NO: 1057934 - RNA, 22 nt, Human
ucacaugcucaccuaagccaca

SEQ ID NO: 1057935 - RNA, 23 nt, Human
cguuuuuuccucagauguucugg

SEQ ID NO: 1057936 - RNA, 22 nt, Human
auugucgucaauggacacauag

SEQ ID NO: 1057937 - RNA, 21 nt, Human
agcugugguuuuacaucuuuu

SEQ ID NO: 1057938 - RNA, 22 nt, Human
cuuugcuaauguugcauuuuca

SEQ ID NO: 1057939 - RNA, 22 nt, Human
aggcuccaugguucucccucag

SEQ ID NO: 1057940 - RNA, 22 nt, Human
gauggaggagauggcagggugc

SEQ ID NO: 1057941 - RNA, 22 nt, Human
cagguguugcaguugaagacug

SEQ ID NO: 1057942 - RNA, 22 nt, Human
uuauuugcccauguuuagcaga

SEQ ID NO: 1057943 - RNA, 22 nt, Human
augcuugaaaguuauuucauuu

SEQ ID NO: 1057944 - RNA, 18 nt, Human
ggaggcucugugguuucc

SEQ ID NO: 1057945 - RNA, 21 nt, Human
uguguucuucuaggucagcua

SEQ ID NO: 1057946 - RNA, 22 nt, Human
uucaguaugcugaaugauuuuu

SEQ ID NO: 1057947 - RNA, 22 nt, Human
aucuuuggguacaaacuugccu

SEQ ID NO: 1057948 - RNA, 22 nt, Human
uuguaacaguagcugucagcuc

SEQ ID NO: 1057949 - RNA, 22 nt, Human
auauaguuggguuucauucuac

SEQ ID NO: 1057950 - RNA, 22 nt, Human
ugaauaugugacuuugauuuca

SEQ ID NO: 1057951 - RNA, 20 nt, Human
uuucacaaugaacaugucuc

SEQ ID NO: 1057952 - RNA, 22 nt, Human
gagugugucggucagcguggcg

SEQ ID NO: 1057953 - RNA, 22 nt, Human
ucaucuguuaugggaguuuuug

SEQ ID NO: 1057954 - RNA, 22 nt, Human
gggcuccagaggcucacccugg

SEQ ID NO: 1057955 - RNA, 22 nt, Human
auucugcugccuaguuuaugaa

SEQ ID NO: 1057956 - RNA, 22 nt, Human
agguuuggguucauugcuggcu

SEQ ID NO: 1057957 - RNA, 22 nt, Human
aauacagugaaagugagcaagg

SEQ ID NO: 1057958 - RNA, 22 nt, Human
uugcaaucagcaguguuuucac

SEQ ID NO: 1057959 - RNA, 22 nt, Human
cauuguguauuucuguaguacu

SEQ ID NO: 1057960 - RNA, 22 nt, Human
uugcaucagcaggcauaauugg

SEQ ID NO: 1057961 - RNA, 22 nt, Human
ucugaggcugaauggacuccgu

SEQ ID NO: 1057962 - RNA, 22 nt, Human
ugugucuuuggcgaugucugga

SEQ ID NO: 1057963 - RNA, 21 nt, Human
uuuguucacacacagggcagc

SEQ ID NO: 1057964 - RNA, 22 nt, Human
ugaguguuguaaccauaugauu

SEQ ID NO: 1057965 - RNA, 22 nt, Human
ugugguuuugguucagaaacaa

SEQ ID NO: 1057966 - RNA, 22 nt, Human
gauuuucauuauagcuaguuuc

SEQ ID NO: 1057967 - RNA, 22 nt, Human
uuggaaaugcauuuguuauuau

SEQ ID NO: 1057968 - RNA, 22 nt, Human
auguaguauuuggaaauguaaa

SEQ ID NO: 1057969 - RNA, 22 nt, Human
aaguuugucucauuugaucuuc

SEQ ID NO: 1057970 - RNA, 22 nt, Human
ugagaauacugcauuguuagga

SEQ ID NO: 1057971 - RNA, 22 nt, Human
uuuguguuguacuucugugcau

SEQ ID NO: 1057972 - RNA, 22 nt, Human
uuguauuaaaauguguuucugu

SEQ ID NO: 1057973 - RNA, 22 nt, Human
uuuuguguugccauguuaagca

SEQ ID NO: 1057974 - RNA, 22 nt, Human
augccccagugugugcuuccuu

SEQ ID NO: 1057975 - RNA, 22 nt, Human
aaggcuccagugaaugcuggca

SEQ ID NO: 1057976 - RNA, 22 nt, Human
acugugacugugucuucugggc

SEQ ID NO: 1057977 - RNA, 22 nt, Human
uaucuagagccuggaagucuug

SEQ ID NO: 1057978 - RNA, 22 nt, Human
uggcauuggaauuuguguugca

SEQ ID NO: 1057979 - RNA, 22 nt, Human
acauucaugcaccuuccuaucc

SEQ ID NO: 1057980 - RNA, 22 nt, Human
agaugguucagaauuauaaaga

SEQ ID NO: 1057981 - RNA, 22 nt, Human
ucucuuugacccuuuagcucca

SEQ ID NO: 1057982 - RNA, 22 nt, Human
ccuuuuauauggcucaucacag

SEQ ID NO: 1057983 - RNA, 22 nt, Human
augguuuuguccucuuugguuc

SEQ ID NO: 1057984 - RNA, 22 nt, Human
ugucauauagaauguucuauga

SEQ ID NO: 1057985 - RNA, 22 nt, Human
uuucucuuucaaucugcaguac

SEQ ID NO: 1057986 - RNA, 22 nt, Human
agaguguguggggcugagguca

SEQ ID NO: 1057987 - RNA, 22 nt, Human
uuuguguuggaagaaaugcuac

SEQ ID NO: 1057988 - RNA, 22 nt, Human
uuaggauuugaaaaggggcaga

SEQ ID NO: 1057989 - RNA, 22 nt, Human
guucuucaaagugacaacuaaa

SEQ ID NO: 1057990 - RNA, 22 nt, Human
acauuuaaugauccuacuguga

SEQ ID NO: 1057991 - RNA, 22 nt, Human
caguuaaacagauugaguguua

SEQ ID NO: 1057992 - RNA, 22 nt, Human
uuugcuugauuaggauauggaa

SEQ ID NO: 1057993 - RNA, 22 nt, Human
cuuugugauaguguuaagacca

SEQ ID NO: 1057994 - RNA, 22 nt, Human
uauuuggugaaucuauggucag

SEQ ID NO: 1057995 - RNA, 23 nt, Human
auuuccuaaaagauaaucauuac

SEQ ID NO: 1057996 - RNA, 22 nt, Human
auguuuguguuucccauucagg

SEQ ID NO: 1057997 - RNA, 22 nt, Human
aaagugcugggauuacaggugu

SEQ ID NO: 1057998 - RNA, 22 nt, Human
gacuguggacucucaugauaga

SEQ ID NO: 1057999 - RNA, 22 nt, Human
auccauuugccgugcuaugugc

SEQ ID NO: 1058000 - RNA, 22 nt, Human
guugaguguugugcaugcacca

SEQ ID NO: 1058001 - RNA, 22 nt, Human
aauacagauggcaugugaagau

SEQ ID NO: 1058002 - RNA, 22 nt, Human
auccauuuuuucagaaugcucu

SEQ ID NO: 1058003 - RNA, 22 nt, Human
cauuguuggcagagggacagag

SEQ ID NO: 1058004 - RNA, 22 nt, Human
guguuuugugaggccuucuuuc

SEQ ID NO: 1058005 - RNA, 21 nt, Human
gacauugagcgugucgcagug

SEQ ID NO: 1058006 - RNA, 22 nt, Human
auguuguugaacucuuugcaug

SEQ ID NO: 1058007 - RNA, 22 nt, Human
caugcauuucuaccaaggaaua

SEQ ID NO: 1058008 - RNA, 22 nt, Human
auguuugaaauuguaaguauau

SEQ ID NO: 1058009 - RNA, 22 nt, Human
augcauugaggaugacaugagu

SEQ ID NO: 1058010 - RNA, 22 nt, Human
aaauugaauuugggaaacauug

SEQ ID NO: 1058011 - RNA, 22 nt, Human
auuucagaguagaucguuauuu

SEQ ID NO: 1058012 - RNA, 22 nt, Human
agcuauggguguggguuccauu

SEQ ID NO: 1058013 - RNA, 22 nt, Human
auguaugagagauucuuuuauu

SEQ ID NO: 1058014 - RNA, 22 nt, Human
ugcuuguauucauaucacagcu

SEQ ID NO: 1058015 - RNA, 22 nt, Human
aauggcuguucucugugauugg

SEQ ID NO: 1058016 - RNA, 17 nt, Human
aguuuuuggaccugugu

SEQ ID NO: 1058017 - RNA, 23 nt, Human
cuguuauauggguguuaugugcu

SEQ ID NO: 1058018 - RNA, 22 nt, Human
ugacuuuggacuagugauuuaa

SEQ ID NO: 1058019 - RNA, 22 nt, Human
agauuucaauggauauugcaag

SEQ ID NO: 1058020 - RNA, 22 nt, Human
auggugguagaagcacuaugug

SEQ ID NO: 1058021 - RNA, 22 nt, Human
agugaauuagccuauuuguaaa

SEQ ID NO: 1058022 - RNA, 22 nt, Human
cugguuuuuagugcuuaggagu

SEQ ID NO: 1058023 - RNA, 22 nt, Human
ucuauuaaugauucaauagugu

SEQ ID NO: 1058024 - RNA, 22 nt, Human
aaacuagguucugauuuccaag

SEQ ID NO: 1058025 - RNA, 22 nt, Human
gcuuuuauuucuucacaaaagu

SEQ ID NO: 1058026 - RNA, 22 nt, Human
aguguuaaggcugguugcuaua

SEQ ID NO: 1058027 - RNA, 22 nt, Human
ucacaguucaacuaguucagau

SEQ ID NO: 1058028 - RNA, 22 nt, Human
gugauuuucuccuccuagaagu

SEQ ID NO: 1058029 - RNA, 23 nt, Human
uggcuugcuaauguuccaaauaa

SEQ ID NO: 1058030 - RNA, 22 nt, Human
uagaucuuucacuacuguguag

SEQ ID NO: 1058031 - RNA, 19 nt, Human
uaugaaguugauaaaaguu

SEQ ID NO: 1058032 - RNA, 21 nt, Human
uaagaacauuaucuucuuccu

SEQ ID NO: 1058033 - RNA, 22 nt, Human
gggcuuggcuggggccaccaga

SEQ ID NO: 1058034 - RNA, 22 nt, Human
uuuaauuauaucugggcaguua

SEQ ID NO: 1058035 - RNA, 22 nt, Human
uaggcuccaguguguggcgagu

SEQ ID NO: 1058036 - RNA, 22 nt, Human
ugcugugagaccauuuguugag

SEQ ID NO: 1058037 - RNA, 23 nt, Human
acauuacacgcaguaauugcccc

SEQ ID NO: 1058038 - RNA, 22 nt, Human
aaucuguuuuaaaguuugugcc

SEQ ID NO: 1058039 - RNA, 22 nt, Human
ugcaugguuauauacuacuagu

SEQ ID NO: 1058040 - RNA, 22 nt, Human
uuauguauggauggcugaaagu

SEQ ID NO: 1058041 - RNA, 21 nt, Human
agaugcagugacccacugggg

SEQ ID NO: 1058042 - RNA, 22 nt, Human
ucauaggaguagcagugagagg

SEQ ID NO: 1058043 - RNA, 22 nt, Human
aguaccaucucugccucugccu

SEQ ID NO: 1058044 - RNA, 22 nt, Human
uuugaacuucuaccugucauau

SEQ ID NO: 1058045 - RNA, 21 nt, Human
uaagcuaaacauucaguuaac

SEQ ID NO: 1058046 - RNA, 22 nt, Human
ugcucccaggcauucucuguug

SEQ ID NO: 1058047 - RNA, 22 nt, Human
uuugccaguauuuuauugauga

SEQ ID NO: 1058048 - RNA, 22 nt, Human
gguguuguacauucuguggauu

SEQ ID NO: 1058049 - RNA, 22 nt, Human
cucaggcuaagaaggccaagug

SEQ ID NO: 1058050 - RNA, 22 nt, Human
caauaauugcuuuccagaguua

SEQ ID NO: 1058051 - RNA, 22 nt, Human
uuucaugauuaacuuagugaau

SEQ ID NO: 1058052 - RNA, 22 nt, Human
agaauguaagaaugcaaagauu

SEQ ID NO: 1058053 - RNA, 22 nt, Human
uaauucuagauugacauuuuga

SEQ ID NO: 1058054 - RNA, 20 nt, Human
caauaauuuacuucccuauu

SEQ ID NO: 1058055 - RNA, 15 nt, Human
uggugguguugagac

SEQ ID NO: 1058056 - RNA, 22 nt, Human
gguuuguugggguccaggccca

SEQ ID NO: 1058057 - RNA, 22 nt, Human
auuguugacuugauuacucaac

SEQ ID NO: 1058058 - RNA, 22 nt, Human
uuguaagacuguagaaugcaaa

SEQ ID NO: 1058059 - RNA, 22 nt, Human
auggaguguggccaggcaguaa

SEQ ID NO: 1058060 - RNA, 22 nt, Human
ucucugagguuguuuccagcac

SEQ ID NO: 1058061 - RNA, 22 nt, Human
uugggauuacagguguaagcca

SEQ ID NO: 1058062 - RNA, 22 nt, Human
cacaucauguuaauucauuaca

SEQ ID NO: 1058063 - RNA, 23 nt, Human
acaaguguuuccaauauggcugg

SEQ ID NO: 1058064 - RNA, 22 nt, Human
uucuucauucccuuacuuccga

SEQ ID NO: 1058065 - RNA, 22 nt, Human
uugauguaauacuuugcaacca

SEQ ID NO: 1058066 - RNA, 22 nt, Human
cuaguuuuaagcuccuugaggu

SEQ ID NO: 1058067 - RNA, 22 nt, Human
ugucuuuagccacuugccucuu

SEQ ID NO: 1058068 - RNA, 17 nt, Human
uuucugcaugauuggac

SEQ ID NO: 1058069 - RNA, 22 nt, Human
guucuucagcccucagguccua

SEQ ID NO: 1058070 - RNA, 22 nt, Human
agcagugugggcugcacgcugg

SEQ ID NO: 1058071 - RNA, 21 nt, Human
aauuucagacccauuuugccu

SEQ ID NO: 1058072 - RNA, 22 nt, Human
ucaaaaugccgagugcccaggu

SEQ ID NO: 1058073 - RNA, 22 nt, Human
guuauucuauuaaugugauugu

SEQ ID NO: 1058074 - RNA, 22 nt, Human
gucacucaggcuggaguucagu

SEQ ID NO: 1058075 - RNA, 22 nt, Human
uacauuguguuaaaacagaaga

SEQ ID NO: 1058076 - RNA, 22 nt, Human
aucauugaguaaaaugaauaca

SEQ ID NO: 1058077 - RNA, 22 nt, Human
acaguaaucugggaacuuguua

SEQ ID NO: 1058078 - RNA, 22 nt, Human
agauguuuauaacucaugagug

SEQ ID NO: 1058079 - RNA, 18 nt, Human
acccauuauauuuguagc

SEQ ID NO: 1058080 - RNA, 22 nt, Human
agauguuuuuccaggucuaauu

SEQ ID NO: 1058081 - RNA, 20 nt, Human
agugauuuguuaguacauug

SEQ ID NO: 1058082 - RNA, 21 nt, Human
uugauuuagcagaucuagcug

SEQ ID NO: 1058083 - RNA, 22 nt, Human
uaucaguagaacaauggacauu

SEQ ID NO: 1058084 - RNA, 22 nt, Human
guggcuaggcccaacggcagga

SEQ ID NO: 1058085 - RNA, 22 nt, Human
ugcaugguguaauucuaaugcu

SEQ ID NO: 1058086 - RNA, 22 nt, Human
ccugugcuucacucaacaagcc

SEQ ID NO: 1058087 - RNA, 22 nt, Human
uggugaagucagcggagcccgg

SEQ ID NO: 1058088 - RNA, 22 nt, Human
uuggcugacaaauggaaucucu

SEQ ID NO: 1058089 - RNA, 22 nt, Human
augauugaaaaugacauugcca

SEQ ID NO: 1058090 - RNA, 22 nt, Human
guuguuuuugaacggugguggc

SEQ ID NO: 1058091 - RNA, 22 nt, Human
agaguguggaaauguucagagu

SEQ ID NO: 1058092 - RNA, 18 nt, Human
uuugggauccucuuuucu

SEQ ID NO: 1058093 - RNA, 22 nt, Human
uggcuccacaggccagggugug

SEQ ID NO: 1058094 - RNA, 22 nt, Human
aagcaauucacaguucacuuaa

SEQ ID NO: 1058095 - RNA, 22 nt, Human
uaucauuuuacugugacauuuu

SEQ ID NO: 1058096 - RNA, 22 nt, Human
ccauuuguaccauuucuuugua

SEQ ID NO: 1058097 - RNA, 20 nt, Human
uuugauugccccucugacuu

SEQ ID NO: 1058098 - RNA, 22 nt, Human
aucaugugacuagguuuggcca

SEQ ID NO: 1058099 - RNA, 23 nt, Human
agugggcucaguccuccaacccc

SEQ ID NO: 1058100 - RNA, 22 nt, Human
gggcuccagccaggugucccca

SEQ ID NO: 1058101 - RNA, 22 nt, Human
uaacuugagcucucagugcuau

SEQ ID NO: 1058102 - RNA, 22 nt, Human
ugaaguuguuaagguugccauu

SEQ ID NO: 1058103 - RNA, 22 nt, Human
agugcuuuauguuguugugcaa

SEQ ID NO: 1058104 - RNA, 22 nt, Human
aauggagugguucuugcccucu

SEQ ID NO: 1058105 - RNA, 22 nt, Human
gucuuuuuuacaccuuacauca

SEQ ID NO: 1058106 - RNA, 22 nt, Human
guuuuaguggguggccacugau

SEQ ID NO: 1058107 - RNA, 22 nt, Human
acauuguugagccucuuguuca

SEQ ID NO: 1058108 - RNA, 22 nt, Human
cuaguucugccauucaguguca

SEQ ID NO: 1058109 - RNA, 22 nt, Human
uuaguuuccuguggugugaagu

SEQ ID NO: 1058110 - RNA, 22 nt, Human
uaagaaacauuuuuaugacagu

SEQ ID NO: 1058111 - RNA, 22 nt, Human
aguaacuuaagcaauuguguau

SEQ ID NO: 1058112 - RNA, 22 nt, Human
uaguuacuuuugcucuucauua

SEQ ID NO: 1058113 - RNA, 22 nt, Human
cauugcuuugugcauauuuaaa

SEQ ID NO: 1058114 - RNA, 20 nt, Human
caacacugcccauuguuugc

SEQ ID NO: 1058115 - RNA, 22 nt, Human
uguauauacacacucccauguu

SEQ ID NO: 1058116 - RNA, 17 nt, Human
gcuccagaauucuaguc

SEQ ID NO: 1058117 - RNA, 22 nt, Human
ucugagugggaacucucaugac

SEQ ID NO: 1058118 - RNA, 22 nt, Human
ugguuuguauauguuugugaga

SEQ ID NO: 1058119 - RNA, 22 nt, Human
cuuauuugcccauguuucuuua

SEQ ID NO: 1058120 - RNA, 22 nt, Human
ugguuggauggcucuuguggcu

SEQ ID NO: 1058121 - RNA, 20 nt, Human
ucuuuuauuggcagauccug

SEQ ID NO: 1058122 - RNA, 22 nt, Human
aacaugaugacauuguaagcuu

SEQ ID NO: 1058123 - RNA, 22 nt, Human
uugcuauuuugagagucauagu

SEQ ID NO: 1058124 - RNA, 22 nt, Human
uauaaacuccucuugcauuccu

SEQ ID NO: 1058125 - RNA, 22 nt, Human
uuuuucaagacaaccugcaugu

SEQ ID NO: 1058126 - RNA, 22 nt, Human
uucaguuuugcuuuuaaucaug

SEQ ID NO: 1058127 - RNA, 22 nt, Human
augauuuguuaacagacuuaau

SEQ ID NO: 1058128 - RNA, 22 nt, Human
ugcauguuucuguauguuaaug

SEQ ID NO: 1058129 - RNA, 22 nt, Human
uaguggguuuauacaauuuaaa

SEQ ID NO: 1058130 - RNA, 22 nt, Human
ugauuugaaaccuuuggcaaga

SEQ ID NO: 1058131 - RNA, 22 nt, Human
aaauacaguggcagcagauaau

SEQ ID NO: 1058132 - RNA, 22 nt, Human
cugauggagagugugauuuggg

SEQ ID NO: 1058133 - RNA, 22 nt, Human
uuggauggagguucaagcacua

SEQ ID NO: 1058134 - RNA, 22 nt, Human
ggacauugaagcuggaaaggga

SEQ ID NO: 1058135 - RNA, 21 nt, Human
gucuuuuuaauugcgauuucc

SEQ ID NO: 1058136 - RNA, 22 nt, Human
ugauuuacaguagugucuaaac

SEQ ID NO: 1058137 - RNA, 18 nt, Human
gugacugccccaaaaggc

SEQ ID NO: 1058138 - RNA, 22 nt, Human
agugacauuauuuuguguacua

SEQ ID NO: 1058139 - RNA, 21 nt, Human
cugugauguugccgggguagg

SEQ ID NO: 1058140 - RNA, 22 nt, Human
caucuuuguuuuggauauaauc

SEQ ID NO: 1058141 - RNA, 22 nt, Human
cugguuuuccaauguuuugacu

SEQ ID NO: 1058142 - RNA, 22 nt, Human
augcauaucuccuaucuccuca

SEQ ID NO: 1058143 - RNA, 22 nt, Human
ugagcagacuugaugaggcagc

SEQ ID NO: 1058144 - RNA, 22 nt, Human
aauuauguuugcuuuagaugga

SEQ ID NO: 1058145 - RNA, 23 nt, Human
cauuugauccucacaauaaaugg

SEQ ID NO: 1058146 - RNA, 20 nt, Human
auuugcuuaccuuguuucua

SEQ ID NO: 1058147 - RNA, 22 nt, Human
aaguuauugguggagagcacug

SEQ ID NO: 1058148 - RNA, 22 nt, Human
uaauuucagugcaagcucacgg

SEQ ID NO: 1058149 - RNA, 22 nt, Human
ggcuauguguccagcaucuuug

SEQ ID NO: 1058150 - RNA, 22 nt, Human
auuugugggacuauaaugcagg

SEQ ID NO: 1058151 - RNA, 22 nt, Human
gcuugcuuuguaaauaucugug

SEQ ID NO: 1058152 - RNA, 22 nt, Human
uucuuugcccauguuuccuaag

SEQ ID NO: 1058153 - RNA, 22 nt, Human
ugggaugagcuauauagaaagu

SEQ ID NO: 1058154 - RNA, 22 nt, Human
guucuucagauuccauuucagu

SEQ ID NO: 1058155 - RNA, 19 nt, Human
aggugaugugacucuagaa

SEQ ID NO: 1058156 - RNA, 22 nt, Human
acagaagugacaauuucuuggg

SEQ ID NO: 1058157 - RNA, 22 nt, Human
caaauguuugguggcauuuugu

SEQ ID NO: 1058158 - RNA, 22 nt, Human
gaauuguacugcaaucagggga

SEQ ID NO: 1058159 - RNA, 22 nt, Human
augaauuguccgauguugugca

SEQ ID NO: 1058160 - RNA, 22 nt, Human
agcuaugaagccacuuuuaaca

SEQ ID NO: 1058161 - RNA, 22 nt, Human
uuuggauugcuuggaugcuucg

SEQ ID NO: 1058162 - RNA, 22 nt, Human
cugggcuuucaggcccuaaggc

SEQ ID NO: 1058163 - RNA, 22 nt, Human
agaucugaggguccaagggagg

SEQ ID NO: 1058164 - RNA, 22 nt, Human
cauuuugugcuagacacuaugg

SEQ ID NO: 1058165 - RNA, 22 nt, Human
uuagggacagcucuguagguga

SEQ ID NO: 1058166 - RNA, 22 nt, Human
cuucuucagaggccagccucug

SEQ ID NO: 1058167 - RNA, 22 nt, Human
guaauucugugugaaucuauua

SEQ ID NO: 1058168 - RNA, 22 nt, Human
acuugguggcgaacgaggguca

SEQ ID NO: 1058169 - RNA, 22 nt, Human
agugauguagguggauucuggc

SEQ ID NO: 1058170 - RNA, 21 nt, Human
guucaauagcucuuugaaugc

SEQ ID NO: 1058171 - RNA, 22 nt, Human
ccacuuugagaagcugaugaaa

SEQ ID NO: 1058172 - RNA, 19 nt, Human
ugcagcuguaugagcuuaa

SEQ ID NO: 1058173 - RNA, 22 nt, Human
aaaugcaugugcuauagaugug

SEQ ID NO: 1058174 - RNA, 22 nt, Human
gcugaaguugccuauuuuaaua

SEQ ID NO: 1058175 - RNA, 22 nt, Human
uguuaguauuggcaaauuuguu

SEQ ID NO: 1058176 - RNA, 22 nt, Human
gugauugugaaaacauuaagaa

SEQ ID NO: 1058177 - RNA, 22 nt, Human
aauaucuagccuuuagcagcuu

SEQ ID NO: 1058178 - RNA, 22 nt, Human
gauguauagcuuuaacugaccc

SEQ ID NO: 1058179 - RNA, 20 nt, Human
aucaggcuuucuguugcgau

SEQ ID NO: 1058180 - RNA, 22 nt, Human
guuuuguucaugaacauugggu

SEQ ID NO: 1058181 - RNA, 22 nt, Human
ggauguggaccuugccugguga

SEQ ID NO: 1058182 - RNA, 22 nt, Human
guacacucccccugugaaguug

SEQ ID NO: 1058183 - RNA, 22 nt, Human
auuauguagcuaaaaauugugu

SEQ ID NO: 1058184 - RNA, 19 nt, Human
aucaggcuucuauuuucuc

SEQ ID NO: 1058185 - RNA, 19 nt, Human
uuacaugacauaugaagga

SEQ ID NO: 1058186 - RNA, 22 nt, Human
agugaaauaugcccauugcugu

SEQ ID NO: 1058187 - RNA, 22 nt, Human
cagggagccccaauuccaugcc

SEQ ID NO: 1058188 - RNA, 19 nt, Human
aaauccaagcucaggccuc

SEQ ID NO: 1058189 - RNA, 22 nt, Human
cuccagauuccguuuauucagg

SEQ ID NO: 1058190 - RNA, 22 nt, Human
uugcugugucauuuguuuaauc

SEQ ID NO: 1058191 - RNA, 22 nt, Human
ccaggcuccccaggaggcccuu

SEQ ID NO: 1058192 - RNA, 22 nt, Human
aguguugucaaacggcucagca

SEQ ID NO: 1058193 - RNA, 22 nt, Human
ugugugaacucucugauguaca

SEQ ID NO: 1058194 - RNA, 22 nt, Human
ugcucuguucaguguaucuugu

SEQ ID NO: 1058195 - RNA, 22 nt, Human
auuaauaucccccgccguucug

SEQ ID NO: 1058196 - RNA, 22 nt, Human
uccuuggcaugccgucuucucc

SEQ ID NO: 1058197 - RNA, 22 nt, Human
acaaaugcuuaguucaccaaaa

SEQ ID NO: 1058198 - RNA, 22 nt, Human
uggcuccaggggacacgcagua

SEQ ID NO: 1058199 - RNA, 22 nt, Human
auuucauccauuaagaguacuc

SEQ ID NO: 1058200 - RNA, 22 nt, Human
uguucauucugugaccugguuc

SEQ ID NO: 1058201 - RNA, 22 nt, Human
guguguggaaugcucauuuauu

SEQ ID NO: 1058202 - RNA, 23 nt, Human
ugucuccaucucauuacuugggg

SEQ ID NO: 1058203 - RNA, 22 nt, Human
agugugaguuacaaagugugaa

SEQ ID NO: 1058204 - RNA, 22 nt, Human
acauuuguuucucuagaguagg

SEQ ID NO: 1058205 - RNA, 22 nt, Human
aucauuaacccuugaugcuggg

SEQ ID NO: 1058206 - RNA, 22 nt, Human
ugcaauuagcguauuaguuuau

SEQ ID NO: 1058207 - RNA, 22 nt, Human
uuaguguccagaguuuuuauua

SEQ ID NO: 1058208 - RNA, 22 nt, Human
ugaaucaaugaauugcacuuca

SEQ ID NO: 1058209 - RNA, 19 nt, Human
ucucccaugccugugucua

SEQ ID NO: 1058210 - RNA, 22 nt, Human
uaaucuuagacauguauuuuuc

SEQ ID NO: 1058211 - RNA, 22 nt, Human
ugcagcaucuccuugugccaug

SEQ ID NO: 1058212 - RNA, 22 nt, Human
aacacuaaaggucaguuagaag

SEQ ID NO: 1058213 - RNA, 22 nt, Human
cauucauaggaggagaugauua

SEQ ID NO: 1058214 - RNA, 22 nt, Human
ugcuugacuuaguuucucauuu

SEQ ID NO: 1058215 - RNA, 22 nt, Human
ucuuucagaaacuuugucugcg

SEQ ID NO: 1058216 - RNA, 22 nt, Human
uacauguuauuucacuauuggu

SEQ ID NO: 1058217 - RNA, 22 nt, Human
uaaguugauuauaaccacugga

SEQ ID NO: 1058218 - RNA, 22 nt, Human
aguucaauuguuuuguaaaagu

SEQ ID NO: 1058219 - RNA, 22 nt, Human
aguaauggguugaaauuuaguu

SEQ ID NO: 1058220 - RNA, 22 nt, Human
cuuuaguucuagaaagugaaac

SEQ ID NO: 1058221 - RNA, 22 nt, Human
cuauuuucccauaugguugaca

SEQ ID NO: 1058222 - RNA, 22 nt, Human
aaggcucccucuucucgagugu

SEQ ID NO: 1058223 - RNA, 22 nt, Human
auuuuguaucuuacggggacua

SEQ ID NO: 1058224 - RNA, 22 nt, Human
uagugucuuccaggacauggua

SEQ ID NO: 1058225 - RNA, 21 nt, Human
ucugaugguagaugagaugug

SEQ ID NO: 1058226 - RNA, 22 nt, Human
uaaaugaaaggguuuaauuuau

SEQ ID NO: 1058227 - RNA, 22 nt, Human
guguaucaaagcacagacuuca

SEQ ID NO: 1058228 - RNA, 22 nt, Human
ugaaaacacuuuaguuuagguc

SEQ ID NO: 1058229 - RNA, 22 nt, Human
caauuuuuaaacuaugaaguug

SEQ ID NO: 1058230 - RNA, 22 nt, Human
uuuguaguuguggaugcugaag

SEQ ID NO: 1058231 - RNA, 22 nt, Human
uuugagaagcauggcuguauuc

SEQ ID NO: 1058232 - RNA, 22 nt, Human
aauaucaucucucuuuucugca

SEQ ID NO: 1058233 - RNA, 22 nt, Human
uuuaauuuucugggcccagcag

SEQ ID NO: 1058234 - RNA, 22 nt, Human
gugguuguuuccagguuugaaa

SEQ ID NO: 1058235 - RNA, 22 nt, Human
aucuguaaauaaaaagggaggu

SEQ ID NO: 1058236 - RNA, 22 nt, Human
uuugaaauguaucaguauaggu

SEQ ID NO: 1058237 - RNA, 22 nt, Human
uuucauuauaaaaaguuggcuu

SEQ ID NO: 1058238 - RNA, 22 nt, Human
caagucugaccucugggugaag

SEQ ID NO: 1058239 - RNA, 22 nt, Human
cacagaggaugcccaagcgauc

SEQ ID NO: 1058240 - RNA, 22 nt, Human
caugcaugccgggcugacagag

SEQ ID NO: 1058241 - RNA, 22 nt, Human
cacugggagcagcuccaacauu

SEQ ID NO: 1058242 - RNA, 19 nt, Human
caggauuguuuaaagcuuu

SEQ ID NO: 1058243 - RNA, 22 nt, Human
gacuacaggugugugccaccau

SEQ ID NO: 1058244 - RNA, 22 nt, Human
gaggugaguggggucuccaggg

SEQ ID NO: 1058245 - RNA, 22 nt, Human
uuccccuugauaaugcaguaag

SEQ ID NO: 1058246 - RNA, 22 nt, Human
acagugucuccugguacccagu

SEQ ID NO: 1058247 - RNA, 22 nt, Human
auuuggucuacauuuuccaaau

SEQ ID NO: 1058248 - RNA, 22 nt, Human
ucacacuuuauuuauuucaugc

SEQ ID NO: 1058249 - RNA, 22 nt, Human
ugugaagcgugugcaggggaca

SEQ ID NO: 1058250 - RNA, 22 nt, Human
agaaguaucaggaagauucuca

SEQ ID NO: 1058251 - RNA, 22 nt, Human
agcauuagguguguuucagagg

SEQ ID NO: 1058252 - RNA, 22 nt, Human
aucacuagaguuacauugccag

SEQ ID NO: 1058253 - RNA, 22 nt, Human
uuugacaggaauucucucuagg

SEQ ID NO: 1058254 - RNA, 22 nt, Human
ggagugggaacaaugacauggu

SEQ ID NO: 1058255 - RNA, 22 nt, Human
aaguguguauuuuucuucagug

SEQ ID NO: 1058256 - RNA, 22 nt, Human
uugcaguugcuguauuuaagga

SEQ ID NO: 1058257 - RNA, 22 nt, Human
acaguguuacuugauaguguau

SEQ ID NO: 1058258 - RNA, 22 nt, Human
auuuccuggaggaauggaagca

SEQ ID NO: 1058259 - RNA, 22 nt, Human
ccagaaugugugaaauuugaug

SEQ ID NO: 1058260 - RNA, 22 nt, Human
acagugcuaucaauagcuagaa

SEQ ID NO: 1058261 - RNA, 22 nt, Human
auaguguguaaagugcagugau

SEQ ID NO: 1058262 - RNA, 22 nt, Human
auauacacuguuucaguugaag

SEQ ID NO: 1058263 - RNA, 22 nt, Human
cucucuguuaugcuuucaugaa

SEQ ID NO: 1058264 - RNA, 22 nt, Human
auuaguguuguggcuucauggc

SEQ ID NO: 1058265 - RNA, 22 nt, Human
gagauuuccauauuuuguaaca

SEQ ID NO: 1058266 - RNA, 19 nt, Human
uuugauagggcauaauaua

SEQ ID NO: 1058267 - RNA, 22 nt, Human
gugaccaucaucucagcuaguu

SEQ ID NO: 1058268 - RNA, 22 nt, Human
agcaauguuggccuauauaccu

SEQ ID NO: 1058269 - RNA, 22 nt, Human
auggcauuugaaucugucuuuu

SEQ ID NO: 1058270 - RNA, 22 nt, Human
uuuacuguuuacagcuaaugca

SEQ ID NO: 1058271 - RNA, 22 nt, Human
aauguuugaacuuugcauauuu

SEQ ID NO: 1058272 - RNA, 22 nt, Human
cauaacauccuugcuacuuuga

SEQ ID NO: 1058273 - RNA, 22 nt, Human
ugagucauguaauaaugcugcu

SEQ ID NO: 1058274 - RNA, 22 nt, Human
aucaacuuguccuugauguuaa

SEQ ID NO: 1058275 - RNA, 22 nt, Respiratory syncytial virus
ugccuugauuucacagggugug

SEQ ID NO: 1058276 - RNA, 22 nt, Respiratory syncytial virus
ugccuugauuucacagggugug

SEQ ID NO: 1058277 - RNA, 22 nt, Human
cacuuuuaacaggagaauuccc

SEQ ID NO: 1058278 - RNA, 22 nt, Human
guucuuaaagauucaucaagca

SEQ ID NO: 1058279 - RNA, 22 nt, Human
ucuguuauaaaucacacugcau

SEQ ID NO: 1058280 - RNA, 22 nt, Human
acauuuaaugauccuacuguga

SEQ ID NO: 1058281 - RNA, 23 nt, Human
gggugcugccuguagucaugcug

SEQ ID NO: 1058282 - RNA, 22 nt, Human
gagcuguucugugauugaucua

SEQ ID NO: 1058283 - RNA, 22 nt, Human
uuaagagaagaguaucuagaac

SEQ ID NO: 1058284 - RNA, 22 nt, Human
uuuuccuucugauacuccauuu

SEQ ID NO: 1058285 - RNA, 22 nt, Human
ucugaauucuuagaauuaaagg

SEQ ID NO: 1058286 - RNA, 22 nt, Human
gcucgcuuagauuuuccucuga

SEQ ID NO: 1058287 - RNA, 22 nt, Human
aagcauuucagguagagauauu

SEQ ID NO: 1058288 - RNA, 22 nt, Human
agaaaucugacugcugugcaca

SEQ ID NO: 1058289 - RNA, 23 nt, Human
aguguucagcauguaguaaauac

SEQ ID NO: 1058290 - RNA, 21 nt, Human
ccacaauucuaguuacauaug

SEQ ID NO: 1058291 - RNA, 22 nt, Human
gaauaauugugaugcuugaagu

SEQ ID NO: 1058292 - RNA, 22 nt, Human
uagcauuuagaacaccuugaga

SEQ ID NO: 1058293 - RNA, 22 nt, Human
guguaucaaagcacagacuuca

SEQ ID NO: 1058294 - RNA, 22 nt, Human
caagcagauauuuuagucaaga

SEQ ID NO: 1058295 - RNA, 22 nt, Human
aaguuugucucauuugaucuuc

SEQ ID NO: 1058296 - RNA, 23 nt, Human
gguucugccgcuuacugcugugc

SEQ ID NO: 1058297 - RNA, 22 nt, Human
uacugcugagcuggguagaagg

SEQ ID NO: 1058298 - RNA, 22 nt, Human
uuugaagauaaauauggagaaa

SEQ ID NO: 1058299 - RNA, 22 nt, Human
uuugacaugugcuuauaacuuu

SEQ ID NO: 1058300 - RNA, 21 nt, Human
aauuucagacccauuuugccu

SEQ ID NO: 1058301 - RNA, 22 nt, Human
acaaucagcacugaguuuaucu

SEQ ID NO: 1058302 - RNA, 22 nt, Human
uagaugaacagaaagccacugu

SEQ ID NO: 1058303 - RNA, 22 nt, Human
uguguggcaagcuguaugcuag

SEQ ID NO: 1058304 - RNA, 22 nt, Human
uuugcuugauuaggauauggaa

SEQ ID NO: 1058305 - RNA, 22 nt, Human
uuacaauuacuugaucucagcu

SEQ ID NO: 1058306 - RNA, 22 nt, Human
uaucuuaaaaaucgaagcagau

SEQ ID NO: 1058307 - RNA, 22 nt, Human
auuucauccauuaagaguacuc

SEQ ID NO: 1058308 - RNA, 22 nt, Human
ugguggggccagacuucagcuc

SEQ ID NO: 1058309 - RNA, 22 nt, Human
uccuuagagugguugugcuaug

SEQ ID NO: 1058310 - RNA, 22 nt, Human
aagcagaaaaacugagcuccaa

SEQ ID NO: 1058311 - RNA, 22 nt, Human
gcauucuugguggagugcuaaa

SEQ ID NO: 1058312 - RNA, 22 nt, Human
aucauugaguaaaaugaauaca

SEQ ID NO: 1058313 - RNA, 22 nt, Human
cauucauaggaggagaugauua

SEQ ID NO: 1058314 - RNA, 21 nt, Human
ggccuuggcgggggccgaauu

SEQ ID NO: 1058315 - RNA, 22 nt, Human
auugagaaggagauuggcaucu

SEQ ID NO: 1058316 - RNA, 22 nt, Human
aucaucaucuaaauugugucgc

SEQ ID NO: 1058317 - RNA, 22 nt, Human
uguucuuagguauuugacaguc

SEQ ID NO: 1058318 - RNA, 22 nt, Human
gaugugugugcccugggccugc

SEQ ID NO: 1058319 - RNA, 22 nt, Human
gggcccuggacguggcggcaga

SEQ ID NO: 1058320 - RNA, 17 nt, Human
uagauuaaacacggcca

SEQ ID NO: 1058321 - RNA, 22 nt, Human
aucuucaaagcacaucguuugu

SEQ ID NO: 1058322 - RNA, 22 nt, Human
uuccuggugguggugacagcac

SEQ ID NO: 1058323 - RNA, 22 nt, Human
ccugggcugcucauggggauga

SEQ ID NO: 1058324 - RNA, 22 nt, Human
gguguuguacauucuguggauu

SEQ ID NO: 1058325 - RNA, 22 nt, Human
aucauccauggcugaucauaaa

SEQ ID NO: 1058326 - RNA, 22 nt, Human
aaaugcaugugcuauagaugug

SEQ ID NO: 1058327 - RNA, 23 nt, Human
uuguucuuggaucuuccugaagc

SEQ ID NO: 1058328 - RNA, 22 nt, Human
ccaguucuuucugugugcaaca

SEQ ID NO: 1058329 - RNA, 22 nt, Human
uuccugguaacaaucucaaagu

SEQ ID NO: 1058330 - RNA, 22 nt, Human
auccuggguaaguuccuuuuaa

SEQ ID NO: 1058331 - RNA, 22 nt, Human
uggaccugagccuggcccugcc

SEQ ID NO: 1058332 - RNA, 22 nt, Human
guuaauuuaguagaguccagau

SEQ ID NO: 1058333 - RNA, 22 nt, Human
uuucacauuuaggcgugaauug

SEQ ID NO: 1058334 - RNA, 22 nt, Human
uuucagauuaucucaacuuugg

SEQ ID NO: 1058335 - RNA, 22 nt, Human
gcucacagccggcuggcagggg

SEQ ID NO: 1058336 - RNA, 22 nt, Human
acacaucuuagacugaaauaug

SEQ ID NO: 1058337 - RNA, 22 nt, Human
ugcaggcuauaucuuauuugac

SEQ ID NO: 1058338 - RNA, 22 nt, Human
uaacacaugucugggaugugaa

SEQ ID NO: 1058339 - RNA, 22 nt, Human
aauuaguaaccuaauuccaucu

SEQ ID NO: 1058340 - RNA, 22 nt, Human
auccucuguggauuacaccuag

SEQ ID NO: 1058341 - RNA, 22 nt, Human
ucccacccccuccaaggaggaa

SEQ ID NO: 1058342 - RNA, 22 nt, Human
auuaaauuuucacuaggcuccc

SEQ ID NO: 1058343 - RNA, 22 nt, Human
ugggcuucuggaguggggcaga

SEQ ID NO: 1058344 - RNA, 22 nt, Human
agaggcuucucggauggggcag

SEQ ID NO: 1058345 - RNA, 22 nt, Human
cccaggcacacugaagugacau

SEQ ID NO: 1058346 - RNA, 22 nt, Human
acugggcugccugguucuucua

SEQ ID NO: 1058347 - RNA, 22 nt, Human
uccugcagguggaugauucucu

SEQ ID NO: 1058348 - RNA, 22 nt, Human
ggcuuuauuaagcaggguaagu

SEQ ID NO: 1058349 - RNA, 22 nt, Human
uguguugugacauucuuggaug

SEQ ID NO: 1058350 - RNA, 22 nt, Human
ucacuguaaaguaauacuguca

SEQ ID NO: 1058351 - RNA, 22 nt, Human
gagaccucuugguaucgcuagg

SEQ ID NO: 1058352 - RNA, 22 nt, Human
uuuucauuuacauuagggaaga

SEQ ID NO: 1058353 - RNA, 22 nt, Human
agauuuauguggucacacucag

SEQ ID NO: 1058354 - RNA, 22 nt, Human
gguucccggaucuccgaguccc

SEQ ID NO: 1058355 - RNA, 22 nt, Human
cuguaugaguugggaauagaau

SEQ ID NO: 1058356 - RNA, 22 nt, Human
uugugcaauuuaaaaucuuccu

SEQ ID NO: 1058357 - RNA, 22 nt, Human
guuuauuauucaacuucauguu

SEQ ID NO: 1058358 - RNA, 22 nt, Human
cgaggcagggaagcugcaaaag

SEQ ID NO: 1058359 - RNA, 22 nt, Human
ccugggcuccacuccaagagca

SEQ ID NO: 1058360 - RNA, 22 nt, Human
ugucuuuagaaagaagcagaca

SEQ ID NO: 1058361 - RNA, 22 nt, Human
ugcaggcugcucaagacuuagu

SEQ ID NO: 1058362 - RNA, 22 nt, Human
cccaggcaggagugugguggcu

SEQ ID NO: 1058363 - RNA, 22 nt, Human
gcuggcagggugguugagagag

SEQ ID NO: 1058364 - RNA, 22 nt, Human
cccaggcagugugugcaugcgu

SEQ ID NO: 1058365 - RNA, 22 nt, Human
cuuucauaaaggaaaugaugag

SEQ ID NO: 1058366 - RNA, 22 nt, Human
ccucuccuugcacccgucccgc

SEQ ID NO: 1058367 - RNA, 23 nt, Human
cauccaggagcugagucugacug

SEQ ID NO: 1058368 - RNA, 22 nt, Human
uagcuuuaaaaaucaucaaagc

SEQ ID NO: 1058369 - RNA, 23 nt, Human
agcuucauugaccuccgcagggg

SEQ ID NO: 1058370 - RNA, 22 nt, Human
gcagcuuuuuggaugucaguua

SEQ ID NO: 1058371 - RNA, 22 nt, Human
acaugauuuuaguaucauaaua

SEQ ID NO: 1058372 - RNA, 19 nt, Human
ccagcccacagugacuuuc

SEQ ID NO: 1058373 - RNA, 19 nt, Human
cucagagaggggcagugcc

SEQ ID NO: 1058374 - RNA, 22 nt, Human
ugcagggauuauguagggguug

SEQ ID NO: 1058375 - RNA, 22 nt, Human
uuucacaucagagguagauuag

SEQ ID NO: 1058376 - RNA, 22 nt, Human
cagguggccaguacucaaggau

SEQ ID NO: 1058377 - RNA, 21 nt, Human
ugcaggcuguuuaagaggcaa

SEQ ID NO: 1058378 - RNA, 22 nt, Human
uucacauaaugauacaaagcuu

SEQ ID NO: 1058379 - RNA, 22 nt, Human
agaaaguuuugugcuauauaug

SEQ ID NO: 1058380 - RNA, 22 nt, Human
acccagcaugacaccugcacau

SEQ ID NO: 1058381 - RNA, 21 nt, Human
ccuuuacaauuuugcauuccu

SEQ ID NO: 1058382 - RNA, 22 nt, Human
cuugggaaugcuaacagaugac

SEQ ID NO: 1058383 - RNA, 22 nt, Human
uaugaacucuggagucugagug

SEQ ID NO: 1058384 - RNA, 22 nt, Human
aacacauaggcagagcaugaca

SEQ ID NO: 1058385 - RNA, 22 nt, Human
aaauggauggaauugacauuua

SEQ ID NO: 1058386 - RNA, 22 nt, Human
cuggaucuguuugugcuugugg

SEQ ID NO: 1058387 - RNA, 22 nt, Human
ccuggcagguggcgcccucggc

SEQ ID NO: 1058388 - RNA, 22 nt, Human
gcagccuccgcacugcgagucc

SEQ ID NO: 1058389 - RNA, 22 nt, Human
uuguuaaagaugcagauuccau

SEQ ID NO: 1058390 - RNA, 22 nt, Human
uccugccuguuuaccuguacuu

SEQ ID NO: 1058391 - RNA, 22 nt, Human
uuugucauaucacacaauuuug

SEQ ID NO: 1058392 - RNA, 22 nt, Human
uucaguuccauuucaggugggu

SEQ ID NO: 1058393 - RNA, 22 nt, Human
agcuagaaguacagccauauga

SEQ ID NO: 1058394 - RNA, 18 nt, Human
aggaaagaaaggcaggug

SEQ ID NO: 1058395 - RNA, 22 nt, Human
uuuuucauauuccccucucugg

SEQ ID NO: 1058396 - RNA, 22 nt, Human
cacaggcuuccaguccccagcu

SEQ ID NO: 1058397 - RNA, 22 nt, Human
cugccugcuuaccaugcaucag

SEQ ID NO: 1058398 - RNA, 22 nt, Human
ccugggcuugcaucugugcugg

SEQ ID NO: 1058399 - RNA, 22 nt, Human
ugggcuccagcaccugugcucu

SEQ ID NO: 1058400 - RNA, 22 nt, Human
ccaggcucugcaaaaucaggcu

SEQ ID NO: 1058401 - RNA, 22 nt, Human
ugaaccacaugcaaagugaaua

SEQ ID NO: 1058402 - RNA, 22 nt, Human
agcaggcuaaauaauaauacau

SEQ ID NO: 1058403 - RNA, 22 nt, Human
cccagccugugacagccguccu

SEQ ID NO: 1058404 - RNA, 22 nt, Human
aaggcucccucuucucgagugu

SEQ ID NO: 1058405 - RNA, 22 nt, Human
aucuagcaguguuauaauugga

SEQ ID NO: 1058406 - RNA, 22 nt, Human
ccacccuaacaauccuuacugu

SEQ ID NO: 1058407 - RNA, 22 nt, Human
ucugcagaaggaaucagcugag

SEQ ID NO: 1058408 - RNA, 22 nt, Human
aucugucaucagcaccacaggu

SEQ ID NO: 1058409 - RNA, 22 nt, Human
cagcuucuucaguccuggagcu

SEQ ID NO: 1058410 - RNA, 22 nt, Human
ugcaggcuccaugaggacaggc

SEQ ID NO: 1058411 - RNA, 22 nt, Human
gccugcaggcuguaguuuguga

SEQ ID NO: 1058412 - RNA, 22 nt, Human
ucuggcaggaccaugaagcgua

SEQ ID NO: 1058413 - RNA, 22 nt, Human
uauuuguauguguguacauaua

SEQ ID NO: 1058414 - RNA, 22 nt, Human
acuggcagccacaacuggcagg

SEQ ID NO: 1058415 - RNA, 19 nt, Human
aaaguuuuauucucauuug

SEQ ID NO: 1058416 - RNA, 22 nt, Human
uaauuucaauagcuugcauaau

SEQ ID NO: 1058417 - RNA, 22 nt, Human
cauacuuuugcccugacauucu

SEQ ID NO: 1058418 - RNA, 22 nt, Human
cagguuggggacuuaggaugac

SEQ ID NO: 1058419 - RNA, 22 nt, Human
cccaggcagcccuucugacgca

SEQ ID NO: 1058420 - RNA, 22 nt, Human
agagagcauggcacagaggggu

SEQ ID NO: 1058421 - RNA, 22 nt, Human
cagguugguauucaucuccaca

SEQ ID NO: 1058422 - RNA, 22 nt, Human
ggcccagcgaggccaccuacag

SEQ ID NO: 1058423 - RNA, 20 nt, Human
ucagauuuuucuaacuuuga

SEQ ID NO: 1058424 - RNA, 22 nt, Human
uccagaccaugugagaggcgca

SEQ ID NO: 1058425 - RNA, 22 nt, Human
uguacuaaggcuguguagaugu

SEQ ID NO: 1058426 - RNA, 22 nt, Human
acagauuuaggacuguagcgau

SEQ ID NO: 1058427 - RNA, 22 nt, Human
uaguuaggguucugcagagaca

SEQ ID NO: 1058428 - RNA, 22 nt, Human
uuuaaagugcugcuccuauccu

SEQ ID NO: 1058429 - RNA, 22 nt, Human
gagggcucugaaaggaggucac

SEQ ID NO: 1058430 - RNA, 22 nt, Human
ugucuuuagccagcagucuucu

SEQ ID NO: 1058431 - RNA, 23 nt, Human
uccaggcacgcauuucuucuagc

SEQ ID NO: 1058432 - RNA, 22 nt, Human
accugcagcuaaagauguaggg

SEQ ID NO: 1058433 - RNA, 22 nt, Human
gcuuggccagcagccgggaugc

SEQ ID NO: 1058434 - RNA, 22 nt, Human
uuucacauaucaacucuauccu

SEQ ID NO: 1058435 - RNA, 22 nt, Human
uaaaggguagguuuuacuguaa

SEQ ID NO: 1058436 - RNA, 22 nt, Human
uccugugccaucucuagagacu

SEQ ID NO: 1058437 - RNA, 22 nt, Human
auuccacacaguaauacucaau

SEQ ID NO: 1058438 - RNA, 22 nt, Human
agggaccugcucacugccuggc

SEQ ID NO: 1058439 - RNA, 22 nt, Human
gagggaccuuuacacagacauu

SEQ ID NO: 1058440 - RNA, 22 nt, Human
cacagucacauaucuaugugug

SEQ ID NO: 1058441 - RNA, 22 nt, Human
ccuggcagcaggugggcccgug

SEQ ID NO: 1058442 - RNA, 22 nt, Human
aauaauuauuugagagcagacc

SEQ ID NO: 1058443 - RNA, 22 nt, Human
ucaucaguuuagaaaaaauaug

SEQ ID NO: 1058444 - RNA, 22 nt, Human
guuuauuaacugucaagugauu

SEQ ID NO: 1058445 - RNA, 22 nt, Human
cacauacauucauguuacucua

SEQ ID NO: 1058446 - RNA, 18 nt, Human
uagggcucuagggaguga

SEQ ID NO: 1058447 - RNA, 20 nt, Human
uauuuacaacuuagagccuc

SEQ ID NO: 1058448 - RNA, 22 nt, Human
auucacaugugcuucuuaucac

SEQ ID NO: 1058449 - RNA, 22 nt, Human
uuuuucaugagacuagaaguca

SEQ ID NO: 1058450 - RNA, 22 nt, Human
guccucuguuagaaaugugcuu

SEQ ID NO: 1058451 - RNA, 22 nt, Human
ugcaggcucacccuggagcuga

SEQ ID NO: 1058452 - RNA, 17 nt, Human
uuaagguggaucagcac

SEQ ID NO: 1058453 - RNA, 22 nt, Human
cuucuggggauggagcccagaa

SEQ ID NO: 1058454 - RNA, 22 nt, Human
augaucucauucuuucaaaggg

SEQ ID NO: 1058455 - RNA, 22 nt, Human
agagggugcuggagagacauug

SEQ ID NO: 1058456 - RNA, 22 nt, Human
aaaguuguucaguaagaaacuc

SEQ ID NO: 1058457 - RNA, 22 nt, Human
uccaagcuugcuuuagccacag

SEQ ID NO: 1058458 - RNA, 19 nt, Human
agcauuuggaauucuacac

SEQ ID NO: 1058459 - RNA, 22 nt, Human
gccaaugacagucucaguucug

SEQ ID NO: 1058460 - RNA, 22 nt, Human
caaauaguaugagcaaugauuc

SEQ ID NO: 1058461 - RNA, 22 nt, Human
uuucauugaugggugauagaaa

SEQ ID NO: 1058462 - RNA, 22 nt, Human
auguagaauggugauuggcagg

SEQ ID NO: 1058463 - RNA, 22 nt, Human
ugcuuuauucgacaucugguag

SEQ ID NO: 1058464 - RNA, 22 nt, Human
cauuuguauagugcuuagacca

SEQ ID NO: 1058465 - RNA, 22 nt, Human
gucacaggcaguaacuaggacc

SEQ ID NO: 1058466 - RNA, 22 nt, Human
augggcuggggaagcucacucc

SEQ ID NO: 1058467 - RNA, 22 nt, Human
aggaggcugcaacccugaggcc

SEQ ID NO: 1058468 - RNA, 22 nt, Human
gccuggaaucaugcagggguua

SEQ ID NO: 1058469 - RNA, 22 nt, Human
ugcuuuauucaggguuuacccc

SEQ ID NO: 1058470 - RNA, 22 nt, Human
ggcccagccucagacaugcccu

SEQ ID NO: 1058471 - RNA, 22 nt, Human
caagcuuguuucuccugggggu

SEQ ID NO: 1058472 - RNA, 22 nt, Human
acaggcucaguucacuggauuu

SEQ ID NO: 1058473 - RNA, 22 nt, Human
cuccugaggaaaagcuugguca

SEQ ID NO: 1058474 - RNA, 21 nt, Human
uuuagggaccaggucauaggc

SEQ ID NO: 1058475 - RNA, 22 nt, Human
gcuggcaguguauuguuagcug

SEQ ID NO: 1058476 - RNA, 22 nt, Human
ucuggggaugagugaugucgua

SEQ ID NO: 1058477 - RNA, 22 nt, Human
uccaggcaucccccaggacaga

SEQ ID NO: 1058478 - RNA, 22 nt, Human
agaauauugaaaguucuugaca

SEQ ID NO: 1058479 - RNA, 22 nt, Human
uaucaauugggccaaaugguac

SEQ ID NO: 1058480 - RNA, 22 nt, Human
uaugcacacauguaugcaugug

SEQ ID NO: 1058481 - RNA, 22 nt, Human
gccaagcuggaugaagagguug

SEQ ID NO: 1058482 - RNA, 22 nt, Human
ccugggcuguaccugugcgcgg

SEQ ID NO: 1058483 - RNA, 22 nt, Human
gcuggcagagagcuggugagga

SEQ ID NO: 1058484 - RNA, 22 nt, Human
acaggugguagaguggaaagag

SEQ ID NO: 1058485 - RNA, 23 nt, Human
gggaccugguaggaggugauugg

SEQ ID NO: 1058486 - RNA, 22 nt, Human
cuagaaauauuuuacagucaag

SEQ ID NO: 1058487 - RNA, 22 nt, Human
cuacugaguccuucagcugcca

SEQ ID NO: 1058488 - RNA, 22 nt, Human
gaggagcuggcagcgucuccgc

SEQ ID NO: 1058489 - RNA, 22 nt, Human
acugccaaugguaguuugaugg

SEQ ID NO: 1058490 - RNA, 22 nt, Human
ugggcuuccuggagccugugcu

SEQ ID NO: 1058491 - RNA, 22 nt, Human
guugggaaggcaagaaguagaa

SEQ ID NO: 1058492 - RNA, 20 nt, Human
ugggcugaggaucaggugcc

SEQ ID NO: 1058493 - RNA, 22 nt, Human
ugggcugaaaugcuguggacua

SEQ ID NO: 1058494 - RNA, 22 nt, Human
auccaggccccaagaccccgac

SEQ ID NO: 1058495 - RNA, 22 nt, Human
cuucuggguguggagugaggac

SEQ ID NO: 1058496 - RNA, 22 nt, Human
ucccagccuggacccugccagu

SEQ ID NO: 1058497 - RNA, 22 nt, Human
caguuuauagcucuagcagcuu

SEQ ID NO: 1058498 - RNA, 22 nt, Human
acugggcucccaggcuugucau

SEQ ID NO: 1058499 - RNA, 22 nt, Human
ucagcuuuugucagaaauugua

SEQ ID NO: 1058500 - RNA, 22 nt, Human
augcagcuucaggauuaugaug

SEQ ID NO: 1058501 - RNA, 22 nt, Human
ucagaaagaacacaggcaguag

SEQ ID NO: 1058502 - RNA, 22 nt, Human
cuggccucuguguucaccauag

SEQ ID NO: 1058503 - RNA, 22 nt, Human
uuuucuuauggugaagcacaaa

SEQ ID NO: 1058504 - RNA, 22 nt, Human
gcagagaccccgcagugaggcc

SEQ ID NO: 1058505 - RNA, 22 nt, Human
ucaggauggagggaagcacaga

SEQ ID NO: 1058506 - RNA, 22 nt, Human
gggacaauggaggccucucucc

SEQ ID NO: 1058507 - RNA, 22 nt, Human
gugaaacagaagcuccuggaau

SEQ ID NO: 1058508 - RNA, 22 nt, Human
uucucuuaucuggcauuauugg

SEQ ID NO: 1058509 - RNA, 22 nt, Human
cccaggcagaauuaguguuuca

SEQ ID NO: 1058510 - RNA, 22 nt, Human
ucccaggcugggggccugaagu

SEQ ID NO: 1058511 - RNA, 22 nt, Human
auuagagguacaaaccuucacu

SEQ ID NO: 1058512 - RNA, 22 nt, Human
acugggcuuauuucuugugaac

SEQ ID NO: 1058513 - RNA, 22 nt, Human
aaagauucgagcgauguauaaa

SEQ ID NO: 1058514 - RNA, 22 nt, Human
ccuggcagcgugccgagcugcg

SEQ ID NO: 1058515 - RNA, 18 nt, Human
gccugcaggcacgggggu

SEQ ID NO: 1058516 - RNA, 22 nt, Human
cacaugaugguggaagccauag

SEQ ID NO: 1058517 - RNA, 22 nt, Human
gugugagggacagagaaagggg

SEQ ID NO: 1058518 - RNA, 22 nt, Human
ucuggcaggucaaucauucuuu

SEQ ID NO: 1058519 - RNA, 18 nt, Human
cuguccaguagacucugc

SEQ ID NO: 1058520 - RNA, 22 nt, Human
gguauaaaugaucagaucgcug

SEQ ID NO: 1058521 - RNA, 20 nt, Human
cacaacuguccacaugcucc

SEQ ID NO: 1058522 - RNA, 22 nt, Human
auauuaggcaaggagauuauuu

SEQ ID NO: 1058523 - RNA, 17 nt, Human
gcccacccuuaggagcu

SEQ ID NO: 1058524 - RNA, 22 nt, Human
uaaucuguauuccuacuuugca

SEQ ID NO: 1058525 - RNA, 22 nt, Human
uaaguuuucuggaauaacuugg

SEQ ID NO: 1058526 - RNA, 22 nt, Human
caaagagcuguucagugucgcu

SEQ ID NO: 1058527 - RNA, 22 nt, Human
cccugcagagaccacugaccuu

SEQ ID NO: 1058528 - RNA, 22 nt, Human
aggaccuguaccucagcaucua

SEQ ID NO: 1058529 - RNA, 22 nt, Human
gcuucugguagaauucaauaga

SEQ ID NO: 1058530 - RNA, 22 nt, Human
uagaacauaagucauucauuug

SEQ ID NO: 1058531 - RNA, 22 nt, Human
ugcuucugacuaagcugcauga

SEQ ID NO: 1058532 - RNA, 22 nt, Human
cuuacaaauacacuuaggagag

SEQ ID NO: 1058533 - RNA, 22 nt, Human
agaucuuuagugaagcuaaauc

SEQ ID NO: 1058534 - RNA, 22 nt, Human
acagcuuuaguguggguggugc

SEQ ID NO: 1058535 - RNA, 22 nt, Human
uuuaaaauuuagaccucuccac

SEQ ID NO: 1058536 - RNA, 22 nt, Human
ccugccucccagagguccucua

SEQ ID NO: 1058537 - RNA, 22 nt, Human
uuguacaaaggauuuggaagag

SEQ ID NO: 1058538 - RNA, 22 nt, Human
ucugucaucucuaaaauagaaa

SEQ ID NO: 1058539 - RNA, 22 nt, Human
aaaguguugauaugugacaucc

SEQ ID NO: 1058540 - RNA, 22 nt, Human
cacacugucagguaaauaacac

SEQ ID NO: 1058541 - RNA, 19 nt, Human
ggcauccacgaaugcagag

SEQ ID NO: 1058542 - RNA, 22 nt, Human
guagggacaauauguuauuaga

SEQ ID NO: 1058543 - RNA, 18 nt, Human
cucugucauaagugucau

SEQ ID NO: 1058544 - RNA, 22 nt, Human
auguccaggaucuauccccaga

SEQ ID NO: 1058545 - RNA, 22 nt, Human
acaggacauguaccaggugguc

SEQ ID NO: 1058546 - RNA, 20 nt, Human
ucacacaugguaagcuauga

SEQ ID NO: 1058547 - RNA, 22 nt, Human
uguagaaagcucuucugaaauc

SEQ ID NO: 1058548 - RNA, 22 nt, Human
aucugucuugccuugcauauuu

SEQ ID NO: 1058549 - RNA, 22 nt, Human
ugugucaauuuucauuccuacu

SEQ ID NO: 1058550 - RNA, 22 nt, Human
uagcuuuaggcacguuugaauu

SEQ ID NO: 1058551 - RNA, 22 nt, Human
cucaucaccacauauaacaaag

SEQ ID NO: 1058552 - RNA, 22 nt, Human
gagaaagauuguccuucagggg

SEQ ID NO: 1058553 - RNA, 22 nt, Human
gcacacacuguuuuccucacau

SEQ ID NO: 1058554 - RNA, 22 nt, Human
ugcagggaauccagucuagggu

SEQ ID NO: 1058555 - RNA, 16 nt, Human
uucugucacguacggc

SEQ ID NO: 1058556 - RNA, 22 nt, Human
guccucugucccuggggcacgg

SEQ ID NO: 1058557 - RNA, 22 nt, Human
uccaggcauaaugcccaguggu

SEQ ID NO: 1058558 - RNA, 22 nt, Human
agcuuuauauuuaaugaauucu

SEQ ID NO: 1058559 - RNA, 22 nt, Human
aagggcucuucuauuuauggcc

SEQ ID NO: 1058560 - RNA, 19 nt, Human
gggagcugaggucuuuggu

SEQ ID NO: 1058561 - RNA, 22 nt, Human
uuucacauucagauauagacuu

SEQ ID NO: 1058562 - RNA, 22 nt, Human
ggcucugcagugacuugagggg

SEQ ID NO: 1058563 - RNA, 22 nt, Human
cuggcaguuggcauuggcaucu

SEQ ID NO: 1058564 - RNA, 22 nt, Human
ccuggcagggcugcaguaaugg

SEQ ID NO: 1058565 - RNA, 22 nt, Human
acuggcagguccaucgcccuuu

SEQ ID NO: 1058566 - RNA, 22 nt, Human
aauauuuguuaguguuuuaaug

SEQ ID NO: 1058567 - RNA, 22 nt, Human
cauuuauucaugaucuguagcu

SEQ ID NO: 1058568 - RNA, 22 nt, Human
gcaggcucagagcagauuagca

SEQ ID NO: 1058569 - RNA, 22 nt, Human
cuccuggcuuucccagaccagg

SEQ ID NO: 1058570 - RNA, 20 nt, Human
auguccagugacuggaccau

SEQ ID NO: 1058571 - RNA, 22 nt, Human
cccacccugggaagcuaggcag

SEQ ID NO: 1058572 - RNA, 22 nt, Human
cuuaggaacgcucugccuagug

SEQ ID NO: 1058573 - RNA, 20 nt, Human
ugccaggcacggagugcaug

SEQ ID NO: 1058574 - RNA, 22 nt, Human
cuucugggugccugugaguguu

SEQ ID NO: 1058575 - RNA, 21 nt, Human
agagucugagugugcaagggc

SEQ ID NO: 1058576 - RNA, 22 nt, Human
guccucuguuuccaucugacuu

SEQ ID NO: 1058577 - RNA, 22 nt, Human
uagggcucugcucaucaguugu

SEQ ID NO: 1058578 - RNA, 17 nt, Human
ugaauucaaucugcacu

SEQ ID NO: 1058579 - RNA, 19 nt, Human
gcuggggaauggauauuga

SEQ ID NO: 1058580 - RNA, 22 nt, Human
auuugcuuuuacuauguuaaaa

SEQ ID NO: 1058581 - RNA, 22 nt, Human
uggaccugcuggaugggcaggu

SEQ ID NO: 1058582 - RNA, 22 nt, Human
ugcauaaagugccauaguauua

SEQ ID NO: 1058583 - RNA, 22 nt, Human
cugcaggcccccuuccuggagu

SEQ ID NO: 1058584 - RNA, 22 nt, Human
ugccuacauuccuugcuuaugg

SEQ ID NO: 1058585 - RNA, 22 nt, Human
ugcucugcacaucccucacaaa

SEQ ID NO: 1058586 - RNA, 22 nt, Human
cauuuguauguuccuccuuagg

SEQ ID NO: 1058587 - RNA, 22 nt, Human
ccugggcucaagugauccuccu

SEQ ID NO: 1058588 - RNA, 22 nt, Human
aucuguuccccuaugcucucua

SEQ ID NO: 1058589 - RNA, 22 nt, Human
cacauuccuggugcucagcagc

SEQ ID NO: 1058590 - RNA, 22 nt, Human
cagcuuguuuuauuuggggacc

SEQ ID NO: 1058591 - RNA, 22 nt, Human
gauucuuacuucuaagcaagcu

SEQ ID NO: 1058592 - RNA, 22 nt, Human
ccccacacucuuuacauucaua

SEQ ID NO: 1058593 - RNA, 22 nt, Human
agagucccagggacacuccaga

SEQ ID NO: 1058594 - RNA, 22 nt, Human
augaaaaguucgaucuagaagg

SEQ ID NO: 1058595 - RNA, 19 nt, Human
ccaaaagcaauuccaagua

SEQ ID NO: 1058596 - RNA, 22 nt, Human
ugugugaaggaauauauacuca

SEQ ID NO: 1058597 - RNA, 22 nt, Human
ugaccaggauacugcagggaug

SEQ ID NO: 1058598 - RNA, 22 nt, Human
uacauaauugucuuuguccuca

SEQ ID NO: 1058599 - RNA, 22 nt, Human
uggaacacugaucauugccuuu

SEQ ID NO: 1058600 - RNA, 22 nt, Human
augaagcugaaaaaggcauaua

SEQ ID NO: 1058601 - RNA, 22 nt, Human
aauucuguaacuuuacugaauu

SEQ ID NO: 1058602 - RNA, 22 nt, Human
gagcuuuaggagaaggagguca

SEQ ID NO: 1058603 - RNA, 22 nt, Human
gcugcuaagcguuucuguucca

SEQ ID NO: 1058604 - RNA, 22 nt, Human
aggccuccuggcuccaggccuu

SEQ ID NO: 1058605 - RNA, 20 nt, Human
agcuuugguuaagccagugg

SEQ ID NO: 1058606 - RNA, 16 nt, Human
ugggaccuguggccaa

SEQ ID NO: 1058607 - RNA, 22 nt, Human
agaaagaggaugcagaucucau

SEQ ID NO: 1058608 - RNA, 22 nt, Human
augcuuuauuauuuugcaggga

SEQ ID NO: 1058609 - RNA, 22 nt, Human
gucuggaaggaggagauggagc

SEQ ID NO: 1058610 - RNA, 22 nt, Human
uggacuggaaugcugauccucu

SEQ ID NO: 1058611 - RNA, 22 nt, Human
uagucaaaccucagaauacccc

SEQ ID NO: 1058612 - RNA, 22 nt, Human
aucacauugccagugauuaccc

SEQ ID NO: 1058613 - RNA, 22 nt, Human
gacucugggcugagccagggcc

SEQ ID NO: 1058614 - RNA, 22 nt, Human
aucaaguuuucuuaguugacug

SEQ ID NO: 1058615 - RNA, 20 nt, Human
gcauccagacacccagcugc

SEQ ID NO: 1058616 - RNA, 22 nt, Human
cuuccucccccacacacucacu

SEQ ID NO: 1058617 - RNA, 22 nt, Human
uacagccacaggugacucucau

SEQ ID NO: 1058618 - RNA, 22 nt, Human
ugaaguuguuaagguugccauu

SEQ ID NO: 1058619 - RNA, 22 nt, Human
aaguaugacauuuaagacaauu

SEQ ID NO: 1058620 - RNA, 22 nt, Human
cucugggcacuguauggguucu

SEQ ID NO: 1058621 - RNA, 22 nt, Human
auauaauuguucugaaguguuu

SEQ ID NO: 1058622 - RNA, 22 nt, Human
aaacacaucauucaugucguca

SEQ ID NO: 1058623 - RNA, 22 nt, Human
acagacuggccugucucgcacc

SEQ ID NO: 1058624 - RNA, 22 nt, Human
ugcuuaaacccugaucaugugu

SEQ ID NO: 1058625 - RNA, 22 nt, Human
aagggcucugcugucucucccc

SEQ ID NO: 1058626 - RNA, 22 nt, Human
uuuuucuugugcuggaucuaau

SEQ ID NO: 1058627 - RNA, 22 nt, Human
cuagggaccucagcuccuggag

SEQ ID NO: 1058628 - RNA, 22 nt, Human
acugcuuacccggccugacuuc

SEQ ID NO: 1058629 - RNA, 22 nt, Human
gccaggcacaguucuaggugcu

SEQ ID NO: 1058630 - RNA, 22 nt, Human
cuggcaguauuaagagaaguga

SEQ ID NO: 1058631 - RNA, 22 nt, Human
uguaugaagacuucuucugugu

SEQ ID NO: 1058632 - RNA, 22 nt, Human
ccugggcuuugcuggcaaggcc

SEQ ID NO: 1058633 - RNA, 22 nt, Human
caggcauggugagaacucagcc

SEQ ID NO: 1058634 - RNA, 22 nt, Human
cagagcucagagcagggcacuc

SEQ ID NO: 1058635 - RNA, 22 nt, Human
gugcaggguagcgacggcagga

SEQ ID NO: 1058636 - RNA, 22 nt, Human
uuuaauuuuccucuuccuggag

SEQ ID NO: 1058637 - RNA, 22 nt, Human
ccuggcagaaagaguuacaccu

SEQ ID NO: 1058638 - RNA, 22 nt, Human
ggcacagggggcugaggacuag

SEQ ID NO: 1058639 - RNA, 21 nt, Human
agugccaguagguauggagga

SEQ ID NO: 1058640 - RNA, 22 nt, Human
guccucuggccuuucccaggac

SEQ ID NO: 1058641 - RNA, 22 nt, Human
cagauuuaccuaacuccaaguu

SEQ ID NO: 1058642 - RNA, 22 nt, Human
ucuaggagcaugaagggaaggc

SEQ ID NO: 1058643 - RNA, 22 nt, Human
uuggaacaugccgggguccagg

SEQ ID NO: 1058644 - RNA, 22 nt, Human
uauauguaaauaagucuaaugu

SEQ ID NO: 1058645 - RNA, 22 nt, Human
uguuuauuacaguucuuggaau

SEQ ID NO: 1058646 - RNA, 22 nt, Human
ggggcugauggaacucaggccu

SEQ ID NO: 1058647 - RNA, 22 nt, Human
uaauuuuacuuccugagcaccu

SEQ ID NO: 1058648 - RNA, 18 nt, Human
cuacauucauaggaaagg

SEQ ID NO: 1058649 - RNA, 22 nt, Human
ugcaggcuggcagugcugaaau

SEQ ID NO: 1058650 - RNA, 22 nt, Human
cuucugggcauggcagagccug

SEQ ID NO: 1058651 - RNA, 22 nt, Human
caagcucugggauagcagagag

SEQ ID NO: 1058652 - RNA, 22 nt, Human
agcuuuaucagaggagucucua

SEQ ID NO: 1058653 - RNA, 22 nt, Human
uccccacacagauacagaguag

SEQ ID NO: 1058654 - RNA, 22 nt, Human
ucaauauauuccauguuuucuc

SEQ ID NO: 1058655 - RNA, 22 nt, Human
ucuggggauaagacccagguau

SEQ ID NO: 1058656 - RNA, 22 nt, Human
uaugaagcuuugaaaagcuuac

SEQ ID NO: 1058657 - RNA, 22 nt, Human
gcagggacagggcagggccuuu

SEQ ID NO: 1058658 - RNA, 22 nt, Human
cuauuagguaugcagccuauuu

SEQ ID NO: 1058659 - RNA, 22 nt, Human
cagcuugaaauauuaggagaug

SEQ ID NO: 1058660 - RNA, 22 nt, Human
ucugggcugaaaugaaggccuu

SEQ ID NO: 1058661 - RNA, 22 nt, Human
aucacaauguacguuaaaaugu

SEQ ID NO: 1058662 - RNA, 22 nt, Human
agcaggcugccuuccaaagccu

SEQ ID NO: 1058663 - RNA, 22 nt, Human
ucacauuuucuacuacuguacg

SEQ ID NO: 1058664 - RNA, 22 nt, Human
ccacauacaaauggggugcugu

SEQ ID NO: 1058665 - RNA, 22 nt, Human
ggauuucuuccuuccucagaag

SEQ ID NO: 1058666 - RNA, 22 nt, Human
accaggcagcacuuuccuugca

SEQ ID NO: 1058667 - RNA, 22 nt, Human
cauuuauucauuugcuagggcu

SEQ ID NO: 1058668 - RNA, 22 nt, Human
cacauacaaggcacacuggagg

SEQ ID NO: 1058669 - RNA, 22 nt, Human
agaagaaaugaggccguucugc

SEQ ID NO: 1058670 - RNA, 22 nt, Human
augacugcucugggcucccaug

SEQ ID NO: 1058671 - RNA, 22 nt, Human
ucuuaaaccacaaaauucagag

SEQ ID NO: 1058672 - RNA, 22 nt, Human
aguaugaaccuggguucuggau

SEQ ID NO: 1058673 - RNA, 22 nt, Human
gggaccuggcgagggucacaca

SEQ ID NO: 1058674 - RNA, 22 nt, Human
gcacccagcccagggcgugaug

SEQ ID NO: 1058675 - RNA, 22 nt, Human
acuggggagugguuuugggaag

SEQ ID NO: 1058676 - RNA, 22 nt, Human
cagcuuuauuucacguguuugu

SEQ ID NO: 1058677 - RNA, 22 nt, Human
ccuacauucucugaguuuuccu

SEQ ID NO: 1058678 - RNA, 22 nt, Human
cugggcugcuguccacuagggu

SEQ ID NO: 1058679 - RNA, 22 nt, Human
ucaggagcucuucccuggugug

SEQ ID NO: 1058680 - RNA, 22 nt, Human
ucagcuuuccuugcuuuagauu

SEQ ID NO: 1058681 - RNA, 22 nt, Human
aucugucaggagcaaggacuac

SEQ ID NO: 1058682 - RNA, 22 nt, Human
aaguaugaaucaaagacuaucu

SEQ ID NO: 1058683 - RNA, 22 nt, Human
aucagagaaauggagggcgcuu

SEQ ID NO: 1058684 - RNA, 22 nt, Human
ccuggcagacugugagggcagg

SEQ ID NO: 1058685 - RNA, 22 nt, Human
gguuucaacuucaaccucucca

SEQ ID NO: 1058686 - RNA, 22 nt, Human
gccaggcagacaggucaucagg

SEQ ID NO: 1058687 - RNA, 22 nt, Human
ucugcucuguggcuucagcuaa

SEQ ID NO: 1058688 - RNA, 22 nt, Human
auuucucaguguacauuauguu

SEQ ID NO: 1058689 - RNA, 22 nt, Human
uggaccugggguggccuccucu

SEQ ID NO: 1058690 - RNA, 22 nt, Human
aagagcaucgguggagccccca

SEQ ID NO: 1058691 - RNA, 22 nt, Human
ccaggccuuccaguacgcagaa

SEQ ID NO: 1058692 - RNA, 21 nt, Human
acacacucugagucuucuauu

SEQ ID NO: 1058693 - RNA, 22 nt, Human
gccugcagggugaugggcugcc

SEQ ID NO: 1058694 - RNA, 17 nt, Human
gcauccaguaacaugcc

SEQ ID NO: 1058695 - RNA, 22 nt, Human
cuacauaaucuggauuugucug

SEQ ID NO: 1058696 - RNA, 20 nt, Human
ugcagggcugccucccagcu

SEQ ID NO: 1058697 - RNA, 22 nt, Human
ggcaggcugcuugggucauguc

SEQ ID NO: 1058698 - RNA, 22 nt, Human
ucccacauuacccugacugaca

SEQ ID NO: 1058699 - RNA, 22 nt, Human
ucuggcagguucccauguuaug

SEQ ID NO: 1058700 - RNA, 22 nt, Human
cuuuggaauauuuuauugagaa

SEQ ID NO: 1058701 - RNA, 22 nt, Human
uccaggaggccucauuuccugu

SEQ ID NO: 1058702 - RNA, 22 nt, Human
ccaggcucugcgcuggacaugg

SEQ ID NO: 1058703 - RNA, 22 nt, Human
ugucagagcaaugagguucagc

SEQ ID NO: 1058704 - RNA, 22 nt, Human
acuaaagaagccaaaguuuucu

SEQ ID NO: 1058705 - RNA, 22 nt, Human
ucccacccauccugcaucucuu

SEQ ID NO: 1058706 - RNA, 22 nt, Human
acuuaaaaccagacagcgucau

SEQ ID NO: 1058707 - RNA, 22 nt, Human
guuaacacaggacucucugccu

SEQ ID NO: 1058708 - RNA, 22 nt, Human
uuggaaauggcuguaguuauga

SEQ ID NO: 1058709 - RNA, 22 nt, Human
auaugauuccacuauuguaugg

SEQ ID NO: 1058710 - RNA, 22 nt, Human
ugaaagauugugauucaauaug

SEQ ID NO: 1058711 - RNA, 22 nt, Human
uggccucugugggagcugagca

SEQ ID NO: 1058712 - RNA, 22 nt, Human
gccuccggagucacagugucuu

SEQ ID NO: 1058713 - RNA, 22 nt, Human
uggcacagggcuuggucgcuca

SEQ ID NO: 1058714 - RNA, 22 nt, Human
cgaggcucagagagggugacuu

SEQ ID NO: 1058715 - RNA, 22 nt, Human
auuuauuaugggauuuggcuca

SEQ ID NO: 1058716 - RNA, 22 nt, Human
guuagggagucagguggcucuu

SEQ ID NO: 1058717 - RNA, 22 nt, Human
ucagagaguccuggucauuugc

SEQ ID NO: 1058718 - RNA, 22 nt, Human
cagucccaugagcccagaacau

SEQ ID NO: 1058719 - RNA, 22 nt, Human
uucacaguggcugugccauuug

SEQ ID NO: 1058720 - RNA, 22 nt, Human
uccaugagacagauacuguaag

SEQ ID NO: 1058721 - RNA, 22 nt, Human
cacacagaaccgcucgccacuu

SEQ ID NO: 1058722 - RNA, 17 nt, Human
gagccacccugugcgag

SEQ ID NO: 1058723 - RNA, 22 nt, Human
gcuaggaguggugggucaagga

SEQ ID NO: 1058724 - RNA, 22 nt, Human
gagagaaaagggggaauugauu

SEQ ID NO: 1058725 - RNA, 22 nt, Human
aucugcuuccugggcuccauga

SEQ ID NO: 1058726 - RNA, 22 nt, Human
aaagagucuggcacuguaccag

SEQ ID NO: 1058727 - RNA, 22 nt, Human
uggcagagucaucacaucugga

SEQ ID NO: 1058728 - RNA, 22 nt, Human
gcuuggaaguaggauugggaga

SEQ ID NO: 1058729 - RNA, 22 nt, Human
augggcuggcagccugaacagc

SEQ ID NO: 1058730 - RNA, 22 nt, Human
cagagcugcuucccaguuugug

SEQ ID NO: 1058731 - RNA, 22 nt, Human
agcaggcuuucaagagucuucu

SEQ ID NO: 1058732 - RNA, 22 nt, Human
agacaggcuuugcuguauauca

SEQ ID NO: 1058733 - RNA, 19 nt, Human
acauuuagaauguacuugc

SEQ ID NO: 1058734 - RNA, 22 nt, Human
cgcaggcuuuagaaucugcuac

SEQ ID NO: 1058735 - RNA, 22 nt, Human
uuaggaaaaucaugagagauga

SEQ ID NO: 1058736 - RNA, 22 nt, Human
cauuuauuggcauguaguaggu

SEQ ID NO: 1058737 - RNA, 22 nt, Human
uacauaauaaggggcauggugu

SEQ ID NO: 1058738 - RNA, 22 nt, Human
cacauaauacauguuccacuua

SEQ ID NO: 1058739 - RNA, 22 nt, Human
gaauccaggguuguuugagcua

SEQ ID NO: 1058740 - RNA, 22 nt, Human
ugaccugcguaggugguuucug

SEQ ID NO: 1058741 - RNA, 22 nt, Human
aaacacauuuuaggaaaaucua

SEQ ID NO: 1058742 - RNA, 20 nt, Human
aggcucugccugcaggccca

SEQ ID NO: 1058743 - RNA, 22 nt, Human
gaggggucacaugggcuggcuu

SEQ ID NO: 1058744 - RNA, 22 nt, Human
ugucuucaguaaaauacacuau

SEQ ID NO: 1058745 - RNA, 20 nt, Human
ucuggggaugaggucuagga

SEQ ID NO: 1058746 - RNA, 22 nt, Human
uguaacacucaaucuguuuaac

SEQ ID NO: 1058747 - RNA, 22 nt, Human
ugagcagaacacgggauccaug

SEQ ID NO: 1058748 - RNA, 20 nt, Human
aguguuugcucacagucucc

SEQ ID NO: 1058749 - RNA, 22 nt, Human
gcccacacagcagauccuuugg

SEQ ID NO: 1058750 - RNA, 22 nt, Human
auaucauuauguuaugagcaca

SEQ ID NO: 1058751 - RNA, 22 nt, Human
ucugucacccaggcuggagugc

SEQ ID NO: 1058752 - RNA, 22 nt, Human
guaaaauugcaauuacuuuugc

SEQ ID NO: 1058753 - RNA, 22 nt, Human
cccgagugucuacucacuccca

SEQ ID NO: 1058754 - RNA, 22 nt, Human
uucaaauacauucuuugccacu

SEQ ID NO: 1058755 - RNA, 22 nt, Human
ugcaggcucaucucaagaguag

SEQ ID NO: 1058756 - RNA, 22 nt, Human
gccuccuggccuuugcuccuca

SEQ ID NO: 1058757 - RNA, 17 nt, Human
uuuagaauacaauguuu

SEQ ID NO: 1058758 - RNA, 22 nt, Human
gcccucucuucugcagccucca

SEQ ID NO: 1058759 - RNA, 22 nt, Human
aucacagagauugcuuuuaaaa

SEQ ID NO: 1058760 - RNA, 22 nt, Human
augccaaauucucagccucuuu

SEQ ID NO: 1058761 - RNA, 22 nt, Human
cucagagauauagucccugcuu

SEQ ID NO: 1058762 - RNA, 20 nt, Human
auaaaauaacugccacaaga

SEQ ID NO: 1058763 - RNA, 22 nt, Human
aaauggaucuguggaauacauu

SEQ ID NO: 1058764 - RNA, 22 nt, Human
uaacacauuaguucuccuagau

SEQ ID NO: 1058765 - RNA, 22 nt, Human
ccuggcagaauauuaaagugca

SEQ ID NO: 1058766 - RNA, 22 nt, Human
uuauuaggaacucaggauuuuu

SEQ ID NO: 1058767 - RNA, 20 nt, Human
ccccacacuauugagcacuu

SEQ ID NO: 1058768 - RNA, 22 nt, Human
uacacagauuucaguaucauca

SEQ ID NO: 1058769 - RNA, 22 nt, Human
cugaaaauguuacacaggaaga

SEQ ID NO: 1058770 - RNA, 22 nt, Human
ggcuuuauuaacucauccguaa

SEQ ID NO: 1058771 - RNA, 22 nt, Human
uaggaagcugagcagcauuccu

SEQ ID NO: 1058772 - RNA, 22 nt, Human
aguguggcugcguagggcucuc

SEQ ID NO: 1058773 - RNA, 22 nt, Human
uuucaaacauagaucugaauau

SEQ ID NO: 1058774 - RNA, 22 nt, Human
ccuagaugggauggcggccggg

SEQ ID NO: 1058775 - RNA, 22 nt, Human
ugggcugaguggcagccagagu

SEQ ID NO: 1058776 - RNA, 22 nt, Human
acuauaaaaggauaaaccagaa

SEQ ID NO: 1058777 - RNA, 22 nt, Human
auguuugacugaguuuggcaga

SEQ ID NO: 1058778 - RNA, 22 nt, Human
gguggcagagaggagguaguuu

SEQ ID NO: 1058779 - RNA, 22 nt, Human
uccccacaucucugcaucaggc

SEQ ID NO: 1058780 - RNA, 22 nt, Human
ugaagcacaggcauacacaacc

SEQ ID NO: 1058781 - RNA, 22 nt, Human
gcuggcagguaaagccccgggg

SEQ ID NO: 1058782 - RNA, 22 nt, Human
agcaggcugcuggcguugaagu

SEQ ID NO: 1058783 - RNA, 22 nt, Human
aggacagugguguucuggagug

SEQ ID NO: 1058784 - RNA, 22 nt, Human
ggcacagagcuuugucccaguu

SEQ ID NO: 1058785 - RNA, 22 nt, Human
gcugggcucugucaugccuucc

SEQ ID NO: 1058786 - RNA, 22 nt, Human
auuuauuaugggauuuggcaca

SEQ ID NO: 1058787 - RNA, 22 nt, Human
gcagggaccagggccagaucca

SEQ ID NO: 1058788 - RNA, 22 nt, Human
uagacauuucugguuauugaca

SEQ ID NO: 1058789 - RNA, 22 nt, Human
aggaccugccaggugcaaagca

SEQ ID NO: 1058790 - RNA, 18 nt, Human
ccaaggccccugcugggg

SEQ ID NO: 1058791 - RNA, 18 nt, Human
ggacaucaucaggugcuu

SEQ ID NO: 1058792 - RNA, 22 nt, Human
uuggagagcaguaaaccacacu

SEQ ID NO: 1058793 - RNA, 22 nt, Human
auuuugcuggucugaauuacuu

SEQ ID NO: 1058794 - RNA, 22 nt, Human
cugcaggacgaccgccucaucu

SEQ ID NO: 1058795 - RNA, 22 nt, Human
cagcuuuaggacucauaauaaa

SEQ ID NO: 1058796 - RNA, 22 nt, Human
caauuucucuuuauaucucaca

SEQ ID NO: 1058797 - RNA, 22 nt, Human
uagaaacauguucuguucuguu

SEQ ID NO: 1058798 - RNA, 17 nt, Human
ucugggcuucagugguc

SEQ ID NO: 1058799 - RNA, 22 nt, Human
gcugcaggcggccgugguggcg

SEQ ID NO: 1058800 - RNA, 22 nt, Human
uaauuucacugauaugaaguca

SEQ ID NO: 1058801 - RNA, 22 nt, Human
ucccaggcaaaggcagcucauu

SEQ ID NO: 1058802 - RNA, 22 nt, Human
ucugggcuuuaguuuguuaucu

SEQ ID NO: 1058803 - RNA, 22 nt, Human
acagagagaaacaaucagcagc

SEQ ID NO: 1058804 - RNA, 22 nt, Human
uugauacaggccuucuagauga

SEQ ID NO: 1058805 - RNA, 22 nt, Human
uaucauuguguuauuucuucca

SEQ ID NO: 1058806 - RNA, 22 nt, Human
uacacacuuacuggagaugaag

SEQ ID NO: 1058807 - RNA, 22 nt, Human
uucugugcccauuuuaaaaugg

SEQ ID NO: 1058808 - RNA, 22 nt, Human
ucauuuguucucauucucuacu

SEQ ID NO: 1058809 - RNA, 20 nt, Human
uauaaauucagagcuuuggu

SEQ ID NO: 1058810 - RNA, 22 nt, Human
caagauaagaucauuuacacua

SEQ ID NO: 1058811 - RNA, 17 nt, Human
cagugaggccuuuccuc

SEQ ID NO: 1058812 - RNA, 22 nt, Human
aggugaguccugggcacaggua

SEQ ID NO: 1058813 - RNA, 22 nt, Human
ucagagaggauuuuaauaagug

SEQ ID NO: 1058814 - RNA, 22 nt, Human
aaagaucacgucccaggacucg

SEQ ID NO: 1058815 - RNA, 23 nt, Human
aauguauguuaguaucuuagaga

SEQ ID NO: 1058816 - RNA, 22 nt, Human
gccuccuguuaugccaugugcc

SEQ ID NO: 1058817 - RNA, 22 nt, Human
uaucaauacauguuaucagugu

SEQ ID NO: 1058818 - RNA, 22 nt, Human
ccugggcugcucauggggauga

SEQ ID NO: 1058819 - RNA, 22 nt, Human
aaguccuuggagaauagaaagg

SEQ ID NO: 1058820 - RNA, 22 nt, Human
ggagacucggguucuagccuug

SEQ ID NO: 1058821 - RNA, 22 nt, Human
uaacuacauuucacugcaauua

SEQ ID NO: 1058822 - RNA, 22 nt, Human
cagcuuugcaggcuggucagug

SEQ ID NO: 1058823 - RNA, 22 nt, Human
aggcuuuguaccuggggucuua

SEQ ID NO: 1058824 - RNA, 19 nt, Human
gagggcucauuugaacaau

SEQ ID NO: 1058825 - RNA, 22 nt, Human
auaucauucugauguauaucuu

SEQ ID NO: 1058826 - RNA, 22 nt, Human
ugcaggcucugugugugccugg

SEQ ID NO: 1058827 - RNA, 22 nt, Human
guccucugacucagccuuggga

SEQ ID NO: 1058828 - RNA, 22 nt, Human
uuuacacaaaagauagcacacc

SEQ ID NO: 1058829 - RNA, 22 nt, Human
gggcucucgauuagacccuggg

SEQ ID NO: 1058830 - RNA, 22 nt, Human
agugauuugggugucagaaagu

SEQ ID NO: 1058831 - RNA, 22 nt, Human
accacccauucagaaacacuga

SEQ ID NO: 1058832 - RNA, 22 nt, Human
gcuuuuaauuaguugcuuccau

SEQ ID NO: 1058833 - RNA, 22 nt, Human
caggcagcugcuggguucagcc

SEQ ID NO: 1058834 - RNA, 22 nt, Human
ccagcuuuccugcgaguugauu

SEQ ID NO: 1058835 - RNA, 22 nt, Human
gacugccagaaugugaggccug

SEQ ID NO: 1058836 - RNA, 22 nt, Human
agcuuuauuugucauucacggc

SEQ ID NO: 1058837 - RNA, 22 nt, Human
ccagagagagaggucaauggca

SEQ ID NO: 1058838 - RNA, 22 nt, Human
uugauaaaaugauaucuucuuu

SEQ ID NO: 1058839 - RNA, 22 nt, Human
aaaguuuguuauaugauaagga

SEQ ID NO: 1058840 - RNA, 22 nt, Human
uacauguuauuucacuauuggu

SEQ ID NO: 1058841 - RNA, 22 nt, Human
uuucaaacuuuacucuugaauc

SEQ ID NO: 1058842 - RNA, 22 nt, Human
gcagggguagugucuuccugag

SEQ ID NO: 1058843 - RNA, 22 nt, Human
guuagggaucaggaacaagagc

SEQ ID NO: 1058844 - RNA, 22 nt, Human
aacccaggagacagguugcagu

SEQ ID NO: 1058845 - RNA, 22 nt, Human
gccugcagggcccuuguggguc

SEQ ID NO: 1058846 - RNA, 22 nt, Human
uggcaggaaaguaacagagcac

SEQ ID NO: 1058847 - RNA, 22 nt, Human
ugcuuuauucagucucugccau

SEQ ID NO: 1058848 - RNA, 21 nt, Human
agaaaauggcguuuuagauuu

SEQ ID NO: 1058849 - RNA, 22 nt, Human
aaauaguuagcccugcauauau

SEQ ID NO: 1058850 - RNA, 22 nt, Human
cugggcuguuuguucuggucuc

SEQ ID NO: 1058851 - RNA, 22 nt, Human
gagaacucagacgcaggucaug

SEQ ID NO: 1058852 - RNA, 17 nt, Human
ccaggcuccaucacugu

SEQ ID NO: 1058853 - RNA, 22 nt, Human
uauggaaagcucuuuuugauug

SEQ ID NO: 1058854 - RNA, 22 nt, Human
agagcaauggcauccagcugau

SEQ ID NO: 1058855 - RNA, 22 nt, Human
ucugcucugggccagcuauuaa

SEQ ID NO: 1058856 - RNA, 22 nt, Human
caguguuuaaucauugugaauu

SEQ ID NO: 1058857 - RNA, 22 nt, Human
ugccaaauugcccuauaaauga

SEQ ID NO: 1058858 - RNA, 22 nt, Human
cgucacuucuuagucuauuuuc

SEQ ID NO: 1058859 - RNA, 22 nt, Human
aguaugaacggaaggccuggga

SEQ ID NO: 1058860 - RNA, 22 nt, Human
agaugguuuugucuuuaugauu

SEQ ID NO: 1058861 - RNA, 22 nt, Human
uaauuucuaauucauuuucagu

SEQ ID NO: 1058862 - RNA, 20 nt, Human
aguuuauuccaggagaacug

SEQ ID NO: 1058863 - RNA, 22 nt, Human
uuauuucauguaaaauuuaugu

SEQ ID NO: 1058864 - RNA, 22 nt, Human
cacacacuggagcaaggagaug

SEQ ID NO: 1058865 - RNA, 22 nt, Human
uaacuuucacaucacacugacu

SEQ ID NO: 1058866 - RNA, 19 nt, Human
agcaacaccguuuauuucc

SEQ ID NO: 1058867 - RNA, 22 nt, Human
ucuggcaggcaaucggcucugg

SEQ ID NO: 1058868 - RNA, 22 nt, Human
cauuagggacugaggaauaagg

SEQ ID NO: 1058869 - RNA, 22 nt, Human
gcuucuaucccuccacugcacu

SEQ ID NO: 1058870 - RNA, 22 nt, Human
gaggcuguuaggagggacucug

SEQ ID NO: 1058871 - RNA, 22 nt, Human
acugggcugcuugagugccuuc

SEQ ID NO: 1058872 - RNA, 22 nt, Human
auuuaaauuuucugauggagag

SEQ ID NO: 1058873 - RNA, 22 nt, Human
uccaggcaggguuaaggguccu

SEQ ID NO: 1058874 - RNA, 22 nt, Human
uuggaaaguuuuuacugaagac

SEQ ID NO: 1058875 - RNA, 18 nt, Human
acuggcuuuagcaucaga

SEQ ID NO: 1058876 - RNA, 22 nt, Human
uaauuuuaugacaguguauuuu

SEQ ID NO: 1058877 - RNA, 22 nt, Human
uuccaaguugagcgauuuuccu

SEQ ID NO: 1058878 - RNA, 22 nt, Human
ucccagccuuccagucugguuu

SEQ ID NO: 1058879 - RNA, 22 nt, Human
auucucuguuuccaagaugaaa

SEQ ID NO: 1058880 - RNA, 22 nt, Human
uccaagcuuuccaugcccucac

SEQ ID NO: 1058881 - RNA, 22 nt, Human
ugaauaaucuuggguauuaaua

SEQ ID NO: 1058882 - RNA, 22 nt, Human
ugggaccuguuacauugaguua

SEQ ID NO: 1058883 - RNA, 22 nt, Human
agguaugagauaaaucaaugaa

SEQ ID NO: 1058884 - RNA, 19 nt, Human
uucuggggccuggccuugg

SEQ ID NO: 1058885 - RNA, 22 nt, Human
uacaaaguagaaauucaguaaa

SEQ ID NO: 1058886 - RNA, 22 nt, Human
ccaggccugcaucugcugcgca

SEQ ID NO: 1058887 - RNA, 22 nt, Human
agcucccauuaucuucugaaac

SEQ ID NO: 1058888 - RNA, 22 nt, Human
uauaaaguuucgaaagauguau

SEQ ID NO: 1058889 - RNA, 21 nt, Human
acagauuuuauaucucugcug

SEQ ID NO: 1058890 - RNA, 22 nt, Human
ugcaggcuggaggagggacuaa

SEQ ID NO: 1058891 - RNA, 22 nt, Human
ccugggcuuuggaacaguacuu

SEQ ID NO: 1058892 - RNA, 22 nt, Human
uaauuucuagggacuaaggugc

SEQ ID NO: 1058893 - RNA, 22 nt, Human
ucaggcucuggguacaccugac

SEQ ID NO: 1058894 - RNA, 22 nt, Human
aauguaugaagguuccaguuuc

SEQ ID NO: 1058895 - RNA, 23 nt, Human
acagaaaguucugcuggacagag

SEQ ID NO: 1058896 - RNA, 22 nt, Human
cauguuaauaugcauugaguac

SEQ ID NO: 1058897 - RNA, 22 nt, Human
uuucuauugaucuaauaaacau

SEQ ID NO: 1058898 - RNA, 22 nt, Human
gccaagcuuggaaggaucaugg

SEQ ID NO: 1058899 - RNA, 22 nt, Human
ugaggccagugacauauauuaa

SEQ ID NO: 1058900 - RNA, 22 nt, Human
uuucacaugguacugccuguuu

SEQ ID NO: 1058901 - RNA, 22 nt, Human
augugaaagagguguucagugg

SEQ ID NO: 1058902 - RNA, 22 nt, Human
guacacacuauguauuguacac

SEQ ID NO: 1058903 - RNA, 22 nt, Human
ucagcuuuuaaaaacaagaagu

SEQ ID NO: 1058904 - RNA, 22 nt, Human
uggccaggccucuuggugccca

SEQ ID NO: 1058905 - RNA, 22 nt, Human
guauuagguuggugcaaaagua

SEQ ID NO: 1058906 - RNA, 22 nt, Human
agggcccuaaggaaggcacaca

SEQ ID NO: 1058907 - RNA, 22 nt, Human
ucccugccuccuggcagugcca

SEQ ID NO: 1058908 - RNA, 22 nt, Human
gggaccugcgccacucacuguc

SEQ ID NO: 1058909 - RNA, 22 nt, Human
ccaggcaggcuagaauguaaau

SEQ ID NO: 1058910 - RNA, 22 nt, Human
agagcaucuaacacauaagccu

SEQ ID NO: 1058911 - RNA, 22 nt, Human
gggcaaguccggugcccagagc

SEQ ID NO: 1058912 - RNA, 22 nt, Human
gagggugucugcguaacuggca

SEQ ID NO: 1058913 - RNA, 22 nt, Human
gcauacagagaggauguggcau

SEQ ID NO: 1058914 - RNA, 19 nt, Human
agcaggcuaggcugccucu

SEQ ID NO: 1058915 - RNA, 19 nt, Human
acacauuugcacaauccac

SEQ ID NO: 1058916 - RNA, 22 nt, Human
gggguggccaaggacucugacc

SEQ ID NO: 1058917 - RNA, 22 nt, Human
aagggcuccaagagguagcugg

SEQ ID NO: 1058918 - RNA, 22 nt, Human
aauaacuuuuaaaagacccugg

SEQ ID NO: 1058919 - RNA, 22 nt, Human
cagcccucaucucagcuucuuu

SEQ ID NO: 1058920 - RNA, 22 nt, Human
gaggagcugcagggggagucua

SEQ ID NO: 1058921 - RNA, 22 nt, Human
gggaccugaggcccugcuccac

SEQ ID NO: 1058922 - RNA, 22 nt, Human
cagcccagccuugucucuuuau

SEQ ID NO: 1058923 - RNA, 22 nt, Human
guaaacaucgacccaacagggg

SEQ ID NO: 1058924 - RNA, 22 nt, Human
accugccuucucaaggacauga

SEQ ID NO: 1058925 - RNA, 22 nt, Human
gcagcuuuaaaggaggcucuga

SEQ ID NO: 1058926 - RNA, 22 nt, Human
gacacagacaguuagagguaau

SEQ ID NO: 1058927 - RNA, 22 nt, Human
uuuccuuugcccaauacauguc

SEQ ID NO: 1058928 - RNA, 22 nt, Human
cagcuuuggcccagucgggagg

SEQ ID NO: 1058929 - RNA, 22 nt, Human
acaggugguaaaauggacuguc

SEQ ID NO: 1058930 - RNA, 22 nt, Human
ucacaggcuugugaacauugca

SEQ ID NO: 1058931 - RNA, 22 nt, Human
ggaagaaagcacacaaacuuga

SEQ ID NO: 1058932 - RNA, 18 nt, Human
acacacacaccuguguau

SEQ ID NO: 1058933 - RNA, 22 nt, Human
cagacagagucuucccaucagu

SEQ ID NO: 1058934 - RNA, 22 nt, Human
uuuauuagugcuuguaucacug

SEQ ID NO: 1058935 - RNA, 22 nt, Human
cagguggcuucucccuaggcca

SEQ ID NO: 1058936 - RNA, 22 nt, Human
gcagcucuuuucuuaaagagau

SEQ ID NO: 1058937 - RNA, 22 nt, Human
augggcugugagguccggcagg

SEQ ID NO: 1058938 - RNA, 22 nt, Human
cuguuuaucucuaaccuguuua

SEQ ID NO: 1058939 - RNA, 19 nt, Human
ccagagagcuagguacaga

SEQ ID NO: 1058940 - RNA, 22 nt, Human
guccuggcaccucacuggcuac

SEQ ID NO: 1058941 - RNA, 22 nt, Human
ucuggcagaagugcugucagua

SEQ ID NO: 1058942 - RNA, 22 nt, Human
uauugacaauuugugaaacuau

SEQ ID NO: 1058943 - RNA, 22 nt, Human
aaacucuguagcuaaacauaau

SEQ ID NO: 1058944 - RNA, 22 nt, Human
cuguuauuucugccaggugagu

SEQ ID NO: 1058945 - RNA, 22 nt, Human
ucaggagcugcacugggcccac

SEQ ID NO: 1058946 - RNA, 22 nt, Human
aaauccuaaugacaaguuuagu

SEQ ID NO: 1058947 - RNA, 21 nt, Human
ucuagaauccuguauaagacu

SEQ ID NO: 1058948 - RNA, 22 nt, Human
uggcuggagcauuccuugucuu

SEQ ID NO: 1058949 - RNA, 18 nt, Human
ucauuuguuuugcaugaa

SEQ ID NO: 1058950 - RNA, 22 nt, Human
uagauauguguuuauuaugcug

SEQ ID NO: 1058951 - RNA, 22 nt, Human
aaugaagcaagcugcuguguuu

SEQ ID NO: 1058952 - RNA, 22 nt, Human
uuguaugaauguauccuaauuu

SEQ ID NO: 1058953 - RNA, 22 nt, Human
ucuuuauuuuaugcuugugcaa

SEQ ID NO: 1058954 - RNA, 19 nt, Human
ccaggccucuggggccugu

SEQ ID NO: 1058955 - RNA, 22 nt, Human
aauauguugagucuaucuuuau

SEQ ID NO: 1058956 - RNA, 20 nt, Human
uggaaguucuguugcauugg

SEQ ID NO: 1058957 - RNA, 22 nt, Human
uccuggcauugugcagggugug

SEQ ID NO: 1058958 - RNA, 23 nt, Human
uccuuuaaugcuggaauggcuag

SEQ ID NO: 1058959 - RNA, 21 nt, Human
gaauaguucuguggcagcagu

SEQ ID NO: 1058960 - RNA, 20 nt, Human
aucugcuugccuguccucgg

SEQ ID NO: 1058961 - RNA, 22 nt, Human
aauuacuuaagagaaacuuuga

SEQ ID NO: 1058962 - RNA, 22 nt, Human
ggcugcagggcagcuggugugg

SEQ ID NO: 1058963 - RNA, 22 nt, Human
uauuacagaaucaggcauaacu

SEQ ID NO: 1058964 - RNA, 22 nt, Human
caugaaauugcuccuuuggugc

SEQ ID NO: 1058965 - RNA, 22 nt, Human
cagcucaggcucuccaugcucc

SEQ ID NO: 1058966 - RNA, 22 nt, Human
ggcaggcugggugucauggagu

SEQ ID NO: 1058967 - RNA, 22 nt, Human
ucagcuuucucucgccaucagg

SEQ ID NO: 1058968 - RNA, 22 nt, Human
gccuggggaacuugauccuguc

SEQ ID NO: 1058969 - RNA, 22 nt, Human
ucuggcaguuccuuguugauau

SEQ ID NO: 1058970 - RNA, 22 nt, Human
cagcauuuggaggagaggcuuu

SEQ ID NO: 1058971 - RNA, 22 nt, Human
augcauaauguauguauugacu

SEQ ID NO: 1058972 - RNA, 22 nt, Human
gccaggcaugggcuucugggcg

SEQ ID NO: 1058973 - RNA, 22 nt, Human
gagaaagacguaggcugggagg

SEQ ID NO: 1058974 - RNA, 22 nt, Human
ucuccgaucacagguuuucaau

SEQ ID NO: 1058975 - RNA, 22 nt, Human
aaauuagucgguuuaggaauuu

SEQ ID NO: 1058976 - RNA, 22 nt, Human
ccaggcccaggguacugaccaa

SEQ ID NO: 1058977 - RNA, 22 nt, Human
gaggagggagcuggaagcucuu

SEQ ID NO: 1058978 - RNA, 22 nt, Human
uauuaggguaaauuugacaugc

SEQ ID NO: 1058979 - RNA, 22 nt, Human
uacacagaaccugguguacagu

SEQ ID NO: 1058980 - RNA, 22 nt, Human
aggaccugacuggcuccugcuu

SEQ ID NO: 1058981 - RNA, 22 nt, Human
ugggaccugcccuggccccauc

SEQ ID NO: 1058982 - RNA, 22 nt, Human
gccaggcauguccucugcagaa

SEQ ID NO: 1058983 - RNA, 22 nt, Human
uucuuugcccuuaaugaaauaa

SEQ ID NO: 1058984 - RNA, 22 nt, Human
guggcuuggaccagucacagug

SEQ ID NO: 1058985 - RNA, 22 nt, Human
uuagaauuauuguuuccuucua

SEQ ID NO: 1058986 - RNA, 22 nt, Human
auuuauuauugugguuacuucu

SEQ ID NO: 1058987 - RNA, 22 nt, Human
ugcuggcacguggaccaggaga

SEQ ID NO: 1058988 - RNA, 22 nt, Human
ccuggcagccucagccaauucu

SEQ ID NO: 1058989 - RNA, 22 nt, Human
ucuggggagggagccacagguc

SEQ ID NO: 1058990 - RNA, 22 nt, Human
guggcagggcuuugcuguucuu

SEQ ID NO: 1058991 - RNA, 22 nt, Human
gacacuucaccuuucccagccu

SEQ ID NO: 1058992 - RNA, 23 nt, Human
cuguaugauguuaaguggaaagc

SEQ ID NO: 1058993 - RNA, 22 nt, Human
agaggccuccgaaaggugggcu

SEQ ID NO: 1058994 - RNA, 22 nt, Human
accaagcucucuucccggcucu

SEQ ID NO: 1058995 - RNA, 22 nt, Human
cccaggcacagauuaucccaau

SEQ ID NO: 1058996 - RNA, 22 nt, Human
aaugaucuggcucaggauauca

SEQ ID NO: 1058997 - RNA, 22 nt, Human
cagcacaggucaguuuuuuaag

SEQ ID NO: 1058998 - RNA, 22 nt, Human
uccugcagcugcagaccugggg

SEQ ID NO: 1058999 - RNA, 22 nt, Human
uuuaauuuucugggcccagcag

SEQ ID NO: 1059000 - RNA, 20 nt, Human
gcugggcuaccacuggcccu

SEQ ID NO: 1059001 - RNA, 22 nt, Human
guuuuacacaccuaugaaagac

SEQ ID NO: 1059002 - RNA, 22 nt, Human
aacaaucaaguuucuaaaugac

SEQ ID NO: 1059003 - RNA, 22 nt, Human
gguggcauaagaacacuaaaga

SEQ ID NO: 1059004 - RNA, 22 nt, Human
aagagcauauuaauaguggaga

SEQ ID NO: 1059005 - RNA, 22 nt, Human
ggccucucugagagcagacguu

SEQ ID NO: 1059006 - RNA, 22 nt, Human
acagguggaggcuuuaggaggu

SEQ ID NO: 1059007 - RNA, 22 nt, Human
gccuggcacucaaucaucugcu

SEQ ID NO: 1059008 - RNA, 22 nt, Human
uccccacacuuucacuccuggc

SEQ ID NO: 1059009 - RNA, 22 nt, Human
auuucuacaguacacaugcauu

SEQ ID NO: 1059010 - RNA, 22 nt, Human
gcagcuuucuuuuugcaugucu

SEQ ID NO: 1059011 - RNA, 22 nt, Human
ucagggacgugagcucagaguc

SEQ ID NO: 1059012 - RNA, 22 nt, Human
ugcuucuguuucauugaucuua

SEQ ID NO: 1059013 - RNA, 22 nt, Human
ucagagagaaauaguuuuugac

SEQ ID NO: 1059014 - RNA, 22 nt, Human
ccaaggcaggggaucaaaguuu

SEQ ID NO: 1059015 - RNA, 22 nt, Human
ugcuagaaaucugaaacuagca

SEQ ID NO: 1059016 - RNA, 22 nt, Human
cagccaagaaccacagacccag

SEQ ID NO: 1059017 - RNA, 22 nt, Human
ucuggggaauguucauuucuga

SEQ ID NO: 1059018 - RNA, 22 nt, Human
uccaggcaucuguauuuuuuaa

SEQ ID NO: 1059019 - RNA, 22 nt, Human
ucaaggagcccacagucuaaug

SEQ ID NO: 1059020 - RNA, 22 nt, Human
cucugucacuucuccagcugag

SEQ ID NO: 1059021 - RNA, 22 nt, Human
ccacaaaacugugugucaaaga

SEQ ID NO: 1059022 - RNA, 22 nt, Human
ucuggggagcagcccuggugag

SEQ ID NO: 1059023 - RNA, 22 nt, Human
aggugaguugguaggaaguuug

SEQ ID NO: 1059024 - RNA, 22 nt, Human
ucuccaagcagggcugcaaggc

SEQ ID NO: 1059025 - RNA, 22 nt, Human
uccaggcaaaaggaacugcuug

SEQ ID NO: 1059026 - RNA, 22 nt, Human
cuccagugagugagcaggcgac

SEQ ID NO: 1059027 - RNA, 22 nt, Human
ucagagaggcaauacuguuuaa

SEQ ID NO: 1059028 - RNA, 22 nt, Human
aacagcauaccaauguacauau

SEQ ID NO: 1059029 - RNA, 22 nt, Human
agguauuauuagcaucucuauu

SEQ ID NO: 1059030 - RNA, 17 nt, Human
ucugcagaggcaaaccu

SEQ ID NO: 1059031 - RNA, 22 nt, Human
uggaccugcguaggugcugggc

SEQ ID NO: 1059032 - RNA, 22 nt, Human
ugcaggcucucugcugccagau

SEQ ID NO: 1059033 - RNA, 20 nt, Human
uuaucugucaaucugucuca

SEQ ID NO: 1059034 - RNA, 22 nt, Human
uuucauaaccucaagcuacagu

SEQ ID NO: 1059035 - RNA, 22 nt, Human
uacccaggggcugagcagaggu

SEQ ID NO: 1059036 - RNA, 22 nt, Human
uggaaagagguagaggaucugg

SEQ ID NO: 1059037 - RNA, 22 nt, Human
caguagacacauuaauauggaa

SEQ ID NO: 1059038 - RNA, 22 nt, Human
uccacccugcuuucuuaucucc

SEQ ID NO: 1059039 - RNA, 22 nt, Human
ugcuuuaucugugagaaccuga

SEQ ID NO: 1059040 - RNA, 22 nt, Human
cagagccucagaauccugugga

SEQ ID NO: 1059041 - RNA, 17 nt, Human
gcuucuggagcuucugu

SEQ ID NO: 1059042 - RNA, 22 nt, Human
gagaagcaaucaguggccaccc

SEQ ID NO: 1059043 - RNA, 22 nt, Human
ucagagaguuacacaaauuguu

SEQ ID NO: 1059044 - RNA, 22 nt, Human
gguaugaaaugauuccauguua

SEQ ID NO: 1059045 - RNA, 22 nt, Human
ucucuuucuauugcaccaugcu

SEQ ID NO: 1059046 - RNA, 20 nt, Human
uccaggcagacagcuauggg

SEQ ID NO: 1059047 - RNA, 22 nt, Human
gggcugacucaaccuugcaaag

SEQ ID NO: 1059048 - RNA, 22 nt, Human
augggcugcuucuccagcaccu

SEQ ID NO: 1059049 - RNA, 22 nt, Human
cauaugaaauaugaguugaaca

SEQ ID NO: 1059050 - RNA, 22 nt, Human
ggcuuuauauuguuugagcaga

SEQ ID NO: 1059051 - RNA, 22 nt, Human
auguccagccaaccacuggauu

SEQ ID NO: 1059052 - RNA, 22 nt, Human
ccuggcagcccagagcgccgcu

SEQ ID NO: 1059053 - RNA, 22 nt, Human
ugcaggcuuggaucacaucucc

SEQ ID NO: 1059054 - RNA, 22 nt, Human
ugagagcacacagaaauauuuu

SEQ ID NO: 1059055 - RNA, 18 nt, Human
acaggcugugggaauggu

SEQ ID NO: 1059056 - RNA, 22 nt, Human
gcagcuuuguaaaguaugaagc

SEQ ID NO: 1059057 - RNA, 22 nt, Human
uucuaucauacuugaauacauu

SEQ ID NO: 1059058 - RNA, 22 nt, Human
ucaucccuaaggacagcucugc

SEQ ID NO: 1059059 - RNA, 22 nt, Human
cuccaggcucguccaagaucga

SEQ ID NO: 1059060 - RNA, 16 nt, Human
gcacacacaucaauga

SEQ ID NO: 1059061 - RNA, 22 nt, Human
uggaacacuggcuuuccacugu

SEQ ID NO: 1059062 - RNA, 22 nt, Human
gcuaggagauugagcucugaag

SEQ ID NO: 1059063 - RNA, 22 nt, Human
aaauccuaaaaguuugacuuaa

SEQ ID NO: 1059064 - RNA, 21 nt, Human
aggcucucauccagggaccca

SEQ ID NO: 1059065 - RNA, 22 nt, Human
ucugggcuuuuccaugccugug

SEQ ID NO: 1059066 - RNA, 19 nt, Human
cacaucagcagggcugugg

SEQ ID NO: 1059067 - RNA, 22 nt, Human
ugaccuuauuugaaaauagaga

SEQ ID NO: 1059068 - RNA, 22 nt, Human
uuugcuuguucaagauuucugu

SEQ ID NO: 1059069 - RNA, 22 nt, Human
cugccugcucaccagggcucug

SEQ ID NO: 1059070 - RNA, 22 nt, Human
agcuugauuucucugcagugug

SEQ ID NO: 1059071 - RNA, 22 nt, Human
uccaugagggacacuggaugcu

SEQ ID NO: 1059072 - RNA, 22 nt, Human
guuuuccugaaacugauggugu

SEQ ID NO: 1059073 - RNA, 22 nt, Human
augauugaaaaugacauugcca

SEQ ID NO: 1059074 - RNA, 22 nt, Human
gccccaccuugagagcagaaac

SEQ ID NO: 1059075 - RNA, 22 nt, Human
gggaccugccauugcucacagg

SEQ ID NO: 1059076 - RNA, 22 nt, Human
ugcagagagauccucaggguuu

SEQ ID NO: 1059077 - RNA, 22 nt, Human
cuggcacgcccacguaggcacu

SEQ ID NO: 1059078 - RNA, 22 nt, Human
ccuggcagcuguuuggcuuggc

SEQ ID NO: 1059079 - RNA, 22 nt, Human
uccugcaggccagaggggugag

SEQ ID NO: 1059080 - RNA, 21 nt, Human
guagggacagagaguugguga

SEQ ID NO: 1059081 - RNA, 22 nt, Human
ccaggcucugacauagauggga

SEQ ID NO: 1059082 - RNA, 22 nt, Human
ggcuucugcucagccugcacgc

SEQ ID NO: 1059083 - RNA, 22 nt, Human
acugggcuagaguggaagcugg

SEQ ID NO: 1059084 - RNA, 22 nt, Human
uaugaagcugauaaucacugau

SEQ ID NO: 1059085 - RNA, 22 nt, Human
auugggaugccggcugauaaga

SEQ ID NO: 1059086 - RNA, 22 nt, Human
ggggaccuggccacccauccuu

SEQ ID NO: 1059087 - RNA, 22 nt, Human
ugcuuuauaaccauuucugugg

SEQ ID NO: 1059088 - RNA, 22 nt, Human
cugggcugcaggaguggggcaa

SEQ ID NO: 1059089 - RNA, 22 nt, Human
guagggacuuguuuuacuagua

SEQ ID NO: 1059090 - RNA, 19 nt, Human
uggcagguagugagcaguc

SEQ ID NO: 1059091 - RNA, 23 nt, Human
ugugaaauuugaggucagugcuu

SEQ ID NO: 1059092 - RNA, 22 nt, Human
acagugugugcuuucccuuacg

SEQ ID NO: 1059093 - RNA, 22 nt, Human
auauuagggucucuaaauucua

SEQ ID NO: 1059094 - RNA, 22 nt, Human
cacccagggcugugccugccca

SEQ ID NO: 1059095 - RNA, 22 nt, Human
cucugcagauucaucccuucac

SEQ ID NO: 1059096 - RNA, 22 nt, Human
cagcacagugaccagacccacu

SEQ ID NO: 1059097 - RNA, 22 nt, Human
gccaagcuguuuuucagagacg

SEQ ID NO: 1059098 - RNA, 22 nt, Human
gagugcaggccugagcaccauc

SEQ ID NO: 1059099 - RNA, 22 nt, Human
ggcauccaaauaccaagaugua

SEQ ID NO: 1059100 - RNA, 22 nt, Human
agaccugcagggccaggccugc

SEQ ID NO: 1059101 - RNA, 22 nt, Human
gcccagcuuuucacuuccacac

SEQ ID NO: 1059102 - RNA, 19 nt, Human
guccuggcgccgccacacc

SEQ ID NO: 1059103 - RNA, 22 nt, Human
auacaaauuuauagaugcauuu

SEQ ID NO: 1059104 - RNA, 22 nt, Human
gaggccugucgcuaggccucug

SEQ ID NO: 1059105 - RNA, 22 nt, Human
ggcuuucuaugaacucaaaggc

SEQ ID NO: 1059106 - RNA, 22 nt, Human
ggccucaguuucuucaacugua

SEQ ID NO: 1059107 - RNA, 17 nt, Human
accaggcaacacgccca

SEQ ID NO: 1059108 - RNA, 22 nt, Human
auauuagguuggugcaaaagua

SEQ ID NO: 1059109 - RNA, 21 nt, Human
uucaaaguuugccuaaagauu

SEQ ID NO: 1059110 - RNA, 23 nt, Human
uuccaggcagagcagggauuaga

SEQ ID NO: 1059111 - RNA, 21 nt, Human
uagggcucuauuuuuauuuca

SEQ ID NO: 1059112 - RNA, 22 nt, Human
cuuagggaaucuuagagcugga

SEQ ID NO: 1059113 - RNA, 22 nt, Human
ccccacccaccuaagagaaacu

SEQ ID NO: 1059114 - RNA, 22 nt, Human
ccuggggauucugacacggagu

SEQ ID NO: 1059115 - RNA, 22 nt, Human
aaaaauaggucaaccguguaug

SEQ ID NO: 1059116 - RNA, 22 nt, Human
auuacucugucugccucugacc

SEQ ID NO: 1059117 - RNA, 22 nt, Human
gcuucuggaagcauaugcaaga

SEQ ID NO: 1059118 - RNA, 22 nt, Human
uagggacacugcucaugaguuc

SEQ ID NO: 1059119 - RNA, 17 nt, Human
ggagaucuggcagaggg

SEQ ID NO: 1059120 - RNA, 22 nt, Human
uauacacaaggugugcauuugu

SEQ ID NO: 1059121 - RNA, 22 nt, Human
cccaggcacauccacucuguga

SEQ ID NO: 1059122 - RNA, 22 nt, Human
uuuaacaugugaauuuuggaag

SEQ ID NO: 1059123 - RNA, 22 nt, Human
uuuaaauuauaguuaaugucug

SEQ ID NO: 1059124 - RNA, 22 nt, Human
uggcaggcgggagccauagagg

SEQ ID NO: 1059125 - RNA, 22 nt, Human
aacagccacugauacugaauag

SEQ ID NO: 1059126 - RNA, 22 nt, Human
acaggcaggcuucggccagagc

SEQ ID NO: 1059127 - RNA, 23 nt, Human
acacugucucauggauagacugc

SEQ ID NO: 1059128 - RNA, 22 nt, Human
aagugauuucugccugcauguu

SEQ ID NO: 1059129 - RNA, 22 nt, Human
uccaguggcaccuuggcccuca

SEQ ID NO: 1059130 - RNA, 22 nt, Human
uagaauucauguuacuguuagc

SEQ ID NO: 1059131 - RNA, 18 nt, Human
uccucucuuuccccaggg

SEQ ID NO: 1059132 - RNA, 22 nt, Human
gcuucuggugaggccucaggaa

SEQ ID NO: 1059133 - RNA, 22 nt, Human
uucugucacuugcaaucaagag

SEQ ID NO: 1059134 - RNA, 22 nt, Human
gggccccuuguaucucuggcuc

SEQ ID NO: 1059135 - RNA, 22 nt, Human
ccugggcuuugagggcaggaug

SEQ ID NO: 1059136 - RNA, 22 nt, Human
uauacaaugaguacauucuggg

SEQ ID NO: 1059137 - RNA, 22 nt, Human
aauuaugagguagauaucacau

SEQ ID NO: 1059138 - RNA, 22 nt, Human
ucuaggagaaccaucagggagg

SEQ ID NO: 1059139 - RNA, 22 nt, Human
cugggcucaccuguggcuggca

SEQ ID NO: 1059140 - RNA, 22 nt, Human
uacauugacuuggauuguuaga

SEQ ID NO: 1059141 - RNA, 22 nt, Human
agucacccuccaacucuccacu

SEQ ID NO: 1059142 - RNA, 22 nt, Human
uuccagcccgcgacuuguucag

SEQ ID NO: 1059143 - RNA, 22 nt, Human
ugaaacuucuaauaugaauagu

SEQ ID NO: 1059144 - RNA, 22 nt, Human
guaaacaugcuguguacucagc

SEQ ID NO: 1059145 - RNA, 22 nt, Human
uucugggggccaggacaguggu

SEQ ID NO: 1059146 - RNA, 22 nt, Human
gcagcuuucuugcccuaaucuu

SEQ ID NO: 1059147 - RNA, 22 nt, Human
cugccugcaggacaccucgcua

SEQ ID NO: 1059148 - RNA, 22 nt, Human
ccagcuuucucagaggcuucua

SEQ ID NO: 1059149 - RNA, 22 nt, Human
ucagcuuuccugcagcuaaggg

SEQ ID NO: 1059150 - RNA, 22 nt, Human
agggcgacaauggagagcguuu

SEQ ID NO: 1059151 - RNA, 22 nt, Human
gcaguccaaaguggcucucacc

SEQ ID NO: 1059152 - RNA, 22 nt, Human
ccuucuucuguguggcccaaga

SEQ ID NO: 1059153 - RNA, 22 nt, Human
ccuggcagcagcacaugccuuc

SEQ ID NO: 1059154 - RNA, 22 nt, Human
aguccaguguguucuggcagca

SEQ ID NO: 1059155 - RNA, 18 nt, Human
ucuggaacaacuucaugu

SEQ ID NO: 1059156 - RNA, 23 nt, Human
aaacaugcagcacaugaaugcua

SEQ ID NO: 1059157 - RNA, 21 nt, Human
aacacauccagaguauuugac

SEQ ID NO: 1059158 - RNA, 19 nt, Human
cacacccaugcuugccaag

SEQ ID NO: 1059159 - RNA, 22 nt, Human
aaaaugacauuccagugauauu

SEQ ID NO: 1059160 - RNA, 22 nt, Human
aacauaauguggccaaagucac

SEQ ID NO: 1059161 - RNA, 22 nt, Human
auuuagcaaaaaaugaugaagc

SEQ ID NO: 1059162 - RNA, 22 nt, Human
ggggcugagaauucagucucgg

SEQ ID NO: 1059163 - RNA, 22 nt, Human
agcuuugggcagaagaggauuc

SEQ ID NO: 1059164 - RNA, 22 nt, Human
cagccucuuuccacaucaggca

SEQ ID NO: 1059165 - RNA, 22 nt, Human
ucuggggacggggcccagcaau

SEQ ID NO: 1059166 - RNA, 22 nt, Human
ugcaggcuggauuugcuuuugu

SEQ ID NO: 1059167 - RNA, 22 nt, Human
uuaucauugucgcagucuaauu

SEQ ID NO: 1059168 - RNA, 20 nt, Human
cagcuuuagaucuuugauua

SEQ ID NO: 1059169 - RNA, 22 nt, Human
gguuucaaauuaaagucuuaag

SEQ ID NO: 1059170 - RNA, 22 nt, Human
uauaauuuuagaagagauggaa

SEQ ID NO: 1059171 - RNA, 18 nt, Human
uccugcagcuucuaugua

SEQ ID NO: 1059172 - RNA, 22 nt, Human
ucacaauauuuaucuuccaauu

SEQ ID NO: 1059173 - RNA, 22 nt, Human
agaaaauauucauugagaggcu

SEQ ID NO: 1059174 - RNA, 22 nt, Human
ucaggcccuuugcugcugcccc

SEQ ID NO: 1059175 - RNA, 22 nt, Human
uuaaaacugcaaauccuacuga

SEQ ID NO: 1059176 - RNA, 22 nt, Human
uggcuaggacucauccuguuuc

SEQ ID NO: 1059177 - RNA, 22 nt, Human
cucccaagcugugcugaacugu

SEQ ID NO: 1059178 - RNA, 22 nt, Human
ucccacaugugaauccucaggu

SEQ ID NO: 1059179 - RNA, 22 nt, Human
gcagcuuuaaacauuggaaaua

SEQ ID NO: 1059180 - RNA, 22 nt, Human
acacauuugcauaauaccucau

SEQ ID NO: 1059181 - RNA, 22 nt, Human
auuaauuuccaggcacugugcu

SEQ ID NO: 1059182 - RNA, 22 nt, Human
ugggcugaggggccuugaugac

SEQ ID NO: 1059183 - RNA, 22 nt, Human
gauuuauuuuuaaucagcaggg

SEQ ID NO: 1059184 - RNA, 22 nt, Human
ugggcuccggcggccucaggcu

SEQ ID NO: 1059185 - RNA, 22 nt, Human
aagaggucauaccagauaaggg

SEQ ID NO: 1059186 - RNA, 22 nt, Human
aaguauuucuggccugugaaag

SEQ ID NO: 1059187 - RNA, 23 nt, Human
acagugugguggacaaggagcag

SEQ ID NO: 1059188 - RNA, 22 nt, Human
ggcuuugggcccucaagucucc

SEQ ID NO: 1059189 - RNA, 23 nt, Human
uguaaacaucacccccuggaguu

SEQ ID NO: 1059190 - RNA, 22 nt, Human
cauuuguacagaacagcuuuau

SEQ ID NO: 1059191 - RNA, 22 nt, Human
cuucugggauuuuugaagacuc

SEQ ID NO: 1059192 - RNA, 23 nt, Human
agcuuuggugaugugacagauaa

SEQ ID NO: 1059193 - RNA, 22 nt, Human
uuauucagauuggcuacaggau

SEQ ID NO: 1059194 - RNA, 22 nt, Human
uaauaguuucauaaugugcuuc

SEQ ID NO: 1059195 - RNA, 22 nt, Human
uauguacaugauuucauuugcu

SEQ ID NO: 1059196 - RNA, 22 nt, Human
guggagcaggacuagcugagaa

SEQ ID NO: 1059197 - RNA, 22 nt, Human
augugaaacugaagcauccaua

SEQ ID NO: 1059198 - RNA, 22 nt, Human
gagcacccuuugcacaucaguc

SEQ ID NO: 1059199 - RNA, 22 nt, Human
ugcuucugcuuuacuugguuca

SEQ ID NO: 1059200 - RNA, 22 nt, Human
ugggaccugcucuuggaaugag

SEQ ID NO: 1059201 - RNA, 22 nt, Human
agugcuccuauggaucaguugu

SEQ ID NO: 1059202 - RNA, 22 nt, Human
cgacccuacagacagugcugag

SEQ ID NO: 1059203 - RNA, 19 nt, Human
caggucuucuuggaggacu

SEQ ID NO: 1059204 - RNA, 22 nt, Human
gguuuauuaaugugaacuguau

SEQ ID NO: 1059205 - RNA, 22 nt, Human
cugugggaugggaccucagcug

SEQ ID NO: 1059206 - RNA, 21 nt, Human
uccugcaggaggccugagagg

SEQ ID NO: 1059207 - RNA, 22 nt, Human
uagcuuuagaaauauucucaga

SEQ ID NO: 1059208 - RNA, 22 nt, Human
acauaugauauugaggaucuca

SEQ ID NO: 1059209 - RNA, 22 nt, Human
gcccagcuggcuuccagcacau

SEQ ID NO: 1059210 - RNA, 22 nt, Human
guauuagggccaaaggcaggaa

SEQ ID NO: 1059211 - RNA, 22 nt, Human
ccagcuuuucuuaucauuauaa

SEQ ID NO: 1059212 - RNA, 22 nt, Human
gcuucuggcagugcagccacca

SEQ ID NO: 1059213 - RNA, 22 nt, Human
acaaucauuccguucacaacag

SEQ ID NO: 1059214 - RNA, 19 nt, Human
cuuuucaucaacagccaau

SEQ ID NO: 1059215 - RNA, 22 nt, Human
ucacuguaccuuccauuucauu

SEQ ID NO: 1059216 - RNA, 22 nt, Human
uuauuuugguaaauguuugccu

SEQ ID NO: 1059217 - RNA, 22 nt, Human
ugcuuuauuggaaccucauccu

SEQ ID NO: 1059218 - RNA, 22 nt, Human
agaaucucuacucaaguacuug

SEQ ID NO: 1059219 - RNA, 22 nt, Human
cacacauuucagaugcuacaau

SEQ ID NO: 1059220 - RNA, 22 nt, Human
uucagagagaccaaguggcgug

SEQ ID NO: 1059221 - RNA, 23 nt, Human
aaaguuugaagcaacaguaguug

SEQ ID NO: 1059222 - RNA, 22 nt, Human
gaaagaagcuuuagauggcuau

SEQ ID NO: 1059223 - RNA, 22 nt, Human
ucccugccugacagcacccacc

SEQ ID NO: 1059224 - RNA, 21 nt, Human
agcaggcuuuggaguggggcu

SEQ ID NO: 1059225 - RNA, 22 nt, Human
aguuagaauagucagauuguag

SEQ ID NO: 1059226 - RNA, 19 nt, Human
uugaaauuguuugauaugg

SEQ ID NO: 1059227 - RNA, 22 nt, Human
uccccaccccagaacuacuagg

SEQ ID NO: 1059228 - RNA, 22 nt, Human
acccagcaaagauaaacuuaug

SEQ ID NO: 1059229 - RNA, 22 nt, Human
caggcccugggcaggcacagag

SEQ ID NO: 1059230 - RNA, 22 nt, Human
ucauauaacuggauauuuucaa

SEQ ID NO: 1059231 - RNA, 22 nt, Human
cagugggggggccaugcugcag

SEQ ID NO: 1059232 - RNA, 22 nt, Human
ucagcuuuggucacauugaguu

SEQ ID NO: 1059233 - RNA, 22 nt, Human
agcuuuauagaaaggaucagug

SEQ ID NO: 1059234 - RNA, 22 nt, Human
guccucuggugaaagcauuccc

SEQ ID NO: 1059235 - RNA, 22 nt, Human
uuaguuuucccaucuuuauggu

SEQ ID NO: 1059236 - RNA, 22 nt, Human
aaauaguucagcuuguaaaccc

SEQ ID NO: 1059237 - RNA, 22 nt, Human
cagaggcugccagccaugugca

SEQ ID NO: 1059238 - RNA, 18 nt, Human
gccugcucugcucucccc

SEQ ID NO: 1059239 - RNA, 22 nt, Human
ccugcaguuuguugugaccccg

SEQ ID NO: 1059240 - RNA, 22 nt, Human
caggcagcugacugucagauau

SEQ ID NO: 1059241 - RNA, 22 nt, Human
caggauggucucgaucuccuga

SEQ ID NO: 1059242 - RNA, 22 nt, Human
agucccagcuucccccaugcag

SEQ ID NO: 1059243 - RNA, 22 nt, Human
aaugaaugaaccacauauaaca

SEQ ID NO: 1059244 - RNA, 22 nt, Human
cugccugccuuggccuccagga

SEQ ID NO: 1059245 - RNA, 23 nt, Human
cuggggcuuucaaaucugggcag

SEQ ID NO: 1059246 - RNA, 22 nt, Human
agggagacacaugaggaaguca

SEQ ID NO: 1059247 - RNA, 22 nt, Human
ucccugugagaaaugaagcagg

SEQ ID NO: 1059248 - RNA, 22 nt, Human
gugcaguggcagauccuagcuc

SEQ ID NO: 1059249 - RNA, 22 nt, Human
uggcuaggaauccaugacucuc

SEQ ID NO: 1059250 - RNA, 22 nt, Human
auaauauaauccuacuucccau

SEQ ID NO: 1059251 - RNA, 22 nt, Human
uggaaacaucucugccuuuauu

SEQ ID NO: 1059252 - RNA, 22 nt, Human
ucucugaaggggagcuguuuaa

SEQ ID NO: 1059253 - RNA, 22 nt, Human
ccccaggcagggccuaacagag

SEQ ID NO: 1059254 - RNA, 22 nt, Human
uggggacccggacuccuggguc

SEQ ID NO: 1059255 - RNA, 22 nt, Human
ucccacaggaaaguagacauug

SEQ ID NO: 1059256 - RNA, 22 nt, Human
ugcuuuauagacaaggaaguag

SEQ ID NO: 1059257 - RNA, 22 nt, Human
uuagaacuuaagaauacugucu

SEQ ID NO: 1059258 - RNA, 20 nt, Human
agggcugagaagggacuagc

SEQ ID NO: 1059259 - RNA, 22 nt, Human
ucuaugaaaagucuauucauuc

SEQ ID NO: 1059260 - RNA, 22 nt, Human
aaauauuugucugaggcgguug

SEQ ID NO: 1059261 - RNA, 22 nt, Human
guuauuagaagugaaggauugu

SEQ ID NO: 1059262 - RNA, 22 nt, Human
augaccagccgagauaaacaga

SEQ ID NO: 1059263 - RNA, 22 nt, Human
aauguaugcugugguaucuucu

SEQ ID NO: 1059264 - RNA, 22 nt, Human
gcaggcuccaacuggaggaguu

SEQ ID NO: 1059265 - RNA, 22 nt, Human
acacacaugcaugcuugccauu

SEQ ID NO: 1059266 - RNA, 22 nt, Human
caccugcagggggagucaagag

SEQ ID NO: 1059267 - RNA, 22 nt, Human
uguccagguggccucugcugcu

SEQ ID NO: 1059268 - RNA, 22 nt, Human
guuucuuagguaaauucuuuga

SEQ ID NO: 1059269 - RNA, 22 nt, Human
auugaaaaauucacaauucugg

SEQ ID NO: 1059270 - RNA, 22 nt, Human
caggucuguuuccaucagugcu

SEQ ID NO: 1059271 - RNA, 23 nt, Human
uuucacaaugagcauuacagaau

SEQ ID NO: 1059272 - RNA, 19 nt, Human
agacaaguuuccagaagcc

SEQ ID NO: 1059273 - RNA, 22 nt, Human
uuccaggcucccuuggaggugu

SEQ ID NO: 1059274 - RNA, 22 nt, Human
aaaguuaguuucuuauaugucu

SEQ ID NO: 1059275 - RNA, 22 nt, Human
uuagcauuucaguacacauguu

SEQ ID NO: 1059276 - RNA, 22 nt, Human
gauggccuuguuuucucccuuc

SEQ ID NO: 1059277 - RNA, 22 nt, Human
gcuggcagguccaagauagagc

SEQ ID NO: 1059278 - RNA, 22 nt, Human
uguuuauugagugccuacuaua

SEQ ID NO: 1059279 - RNA, 22 nt, Human
uucaaaauuguucuaagcucug

SEQ ID NO: 1059280 - RNA, 22 nt, Human
agaggcuuggaggugcaagguu

SEQ ID NO: 1059281 - RNA, 22 nt, Human
gcaguguuuacauauuagaaac

SEQ ID NO: 1059282 - RNA, 22 nt, Human
uuauuuacaacucuucucuucc

SEQ ID NO: 1059283 - RNA, 22 nt, Human
ugggcugaacuucaucugauga

SEQ ID NO: 1059284 - RNA, 22 nt, Human
ccccacccucgcuccauuucgg

SEQ ID NO: 1059285 - RNA, 22 nt, Human
uccuaguucucugccagucgcu

SEQ ID NO: 1059286 - RNA, 22 nt, Human
acaggcucucagccaguuggca

SEQ ID NO: 1059287 - RNA, 22 nt, Human
aggcuccugcaggugaggugcu

SEQ ID NO: 1059288 - RNA, 22 nt, Human
uguagaaccuguuuauuauaga

SEQ ID NO: 1059289 - RNA, 22 nt, Human
uggaacacaagucauugagggg

SEQ ID NO: 1059290 - RNA, 22 nt, Human
uucacacacagcuuccuauugu

SEQ ID NO: 1059291 - RNA, 22 nt, Human
agggccucugacgcccccagcc

SEQ ID NO: 1059292 - RNA, 22 nt, Human
uuguaugaccacaaucugacgu

SEQ ID NO: 1059293 - RNA, 22 nt, Human
acuucacagaaauuuuaugagg

SEQ ID NO: 1059294 - RNA, 22 nt, Human
ucuuuuucugcacacguguccc

SEQ ID NO: 1059295 - RNA, 22 nt, Human
gggaccuggcaccuuugcucug

SEQ ID NO: 1059296 - RNA, 22 nt, Human
gggggcucugacucccucagcu

SEQ ID NO: 1059297 - RNA, 22 nt, Human
ccugcagggugcugccacagau

SEQ ID NO: 1059298 - RNA, 22 nt, Human
gauucacucauauuuuacguuu

SEQ ID NO: 1059299 - RNA, 22 nt, Human
ggggcugacgggcauguggcuu

SEQ ID NO: 1059300 - RNA, 23 nt, Human
uauuagggccaggacuggcaaau

SEQ ID NO: 1059301 - RNA, 22 nt, Human
ugcacaggugagacucaggaag

SEQ ID NO: 1059302 - RNA, 22 nt, Human
cagggcucgcucgcucgcucgc

SEQ ID NO: 1059303 - RNA, 23 nt, Human
ugagcaucacaggagaaccaggc

SEQ ID NO: 1059304 - RNA, 22 nt, Human
aggggugugcauccuggaggau

SEQ ID NO: 1059305 - RNA, 20 nt, Human
gcuccaggucagagaggacg

SEQ ID NO: 1059306 - RNA, 22 nt, Human
cccugcagaccaaugccauaga

SEQ ID NO: 1059307 - RNA, 22 nt, Human
ugggccagcugaagugccgccc

SEQ ID NO: 1059308 - RNA, 22 nt, Human
cccugcagagccagcccugacc

SEQ ID NO: 1059309 - RNA, 22 nt, Human
gacacauagaucuaucucacuc

SEQ ID NO: 1059310 - RNA, 22 nt, Human
guaguuuucugaaaauuacuuu

SEQ ID NO: 1059311 - RNA, 22 nt, Human
cagaagaguagcugaacaaguu

SEQ ID NO: 1059312 - RNA, 22 nt, Human
cuggcuuucauuucaagcacgu

SEQ ID NO: 1059313 - RNA, 22 nt, Human
guuuucauuacugcugugauuu

SEQ ID NO: 1059314 - RNA, 22 nt, Human
acuggcagugucguuuacauga

SEQ ID NO: 1059315 - RNA, 22 nt, Human
uguggagacuauagccauaaca

SEQ ID NO: 1059316 - RNA, 22 nt, Human
gcagagcacccugcagugguau

SEQ ID NO: 1059317 - RNA, 22 nt, Human
uucaugaaacuuaacuguuggg

SEQ ID NO: 1059318 - RNA, 22 nt, Human
uccugcagcugauaaauacagu

SEQ ID NO: 1059319 - RNA, 22 nt, Human
augcuacagaguuugaauaugu

SEQ ID NO: 1059320 - RNA, 22 nt, Human
uuccaaguccagccaggccaaa

SEQ ID NO: 1059321 - RNA, 22 nt, Human
ccugggcuguugcaucauccuu

SEQ ID NO: 1059322 - RNA, 22 nt, Human
caguguggcugagacagaggcu

SEQ ID NO: 1059323 - RNA, 22 nt, Human
ccuggcaggcuggggacagugc

SEQ ID NO: 1059324 - RNA, 18 nt, Human
ccuggcagccaugcgcgc

SEQ ID NO: 1059325 - RNA, 20 nt, Human
auacacaugcagacagaugc

SEQ ID NO: 1059326 - RNA, 22 nt, Human
ccacuguagagauuugaaugcc

SEQ ID NO: 1059327 - RNA, 22 nt, Human
aacacagcuaauuucugucaau

SEQ ID NO: 1059328 - RNA, 22 nt, Human
ugcuucuggguaggccucagga

SEQ ID NO: 1059329 - RNA, 22 nt, Human
gccugcagccagggaguucucu

SEQ ID NO: 1059330 - RNA, 22 nt, Human
acagguccucaagucagcuggg

SEQ ID NO: 1059331 - RNA, 22 nt, Human
gggccccuugcugcucugcugg

SEQ ID NO: 1059332 - RNA, 22 nt, Human
ucauaaaugcagugucauaaau

SEQ ID NO: 1059333 - RNA, 22 nt, Human
ccagccuuacugcccuucagug

SEQ ID NO: 1059334 - RNA, 22 nt, Human
uggccugccacugccacgccac

SEQ ID NO: 1059335 - RNA, 22 nt, Human
gcugggcuucucaaugcugccu

SEQ ID NO: 1059336 - RNA, 22 nt, Human
cuccaggccccuggccuucugc

SEQ ID NO: 1059337 - RNA, 22 nt, Human
augggcugaaagaguaagcugu

SEQ ID NO: 1059338 - RNA, 22 nt, Human
cccaggcagucuggcucuaaag

SEQ ID NO: 1059339 - RNA, 22 nt, Human
gagggcucuaccaaguaacucu

SEQ ID NO: 1059340 - RNA, 22 nt, Human
ccugggcuggaguacagcagug

SEQ ID NO: 1059341 - RNA, 22 nt, Human
ugaagcuugagugucaguuccu

SEQ ID NO: 1059342 - RNA, 23 nt, Human
ugccaaaguuuaccuaacacugg

SEQ ID NO: 1059343 - RNA, 22 nt, Human
guaugaaaauuguaaaguucuu

SEQ ID NO: 1059344 - RNA, 22 nt, Human
caucacagguccugaugacauu

SEQ ID NO: 1059345 - RNA, 22 nt, Human
gucacacagggccuccaaauca

SEQ ID NO: 1059346 - RNA, 22 nt, Human
cuggggacgucgggcaguguuc

SEQ ID NO: 1059347 - RNA, 22 nt, Human
uccaggaggaggaaggcugcca

SEQ ID NO: 1059348 - RNA, 22 nt, Human
augcuacauuuugguuuauaaa

SEQ ID NO: 1059349 - RNA, 22 nt, Human
ucagggacagggugcugcugcg

SEQ ID NO: 1059350 - RNA, 22 nt, Human
cugugggaacacugaggacuuc

SEQ ID NO: 1059351 - RNA, 22 nt, Human
cuucugggccauggccuuccuc

SEQ ID NO: 1059352 - RNA, 22 nt, Human
uucugucacagugcugguauca

SEQ ID NO: 1059353 - RNA, 22 nt, Human
gcacacagcuagauuaccauuc

SEQ ID NO: 1059354 - RNA, 22 nt, Human
auaugaagaauuccaauuugga

SEQ ID NO: 1059355 - RNA, 22 nt, Human
gagacugcauagauggccacaa

SEQ ID NO: 1059356 - RNA, 22 nt, Human
ggcuuuaugcacagcagauggu

SEQ ID NO: 1059357 - RNA, 22 nt, Human
acagagagguaaaauauauagu

SEQ ID NO: 1059358 - RNA, 22 nt, Human
acacacuguugcucauccaggc

SEQ ID NO: 1059359 - RNA, 22 nt, Human
augggcugaggugggauagaag

SEQ ID NO: 1059360 - RNA, 22 nt, Human
aauugucaaacacaaauaagag

SEQ ID NO: 1059361 - RNA, 22 nt, Human
aggccuuaccauagcuguagca

SEQ ID NO: 1059362 - RNA, 22 nt, Human
cagagggcucggcggccgcucc

SEQ ID NO: 1059363 - RNA, 18 nt, Human
ggcagggaaaagauaggg

SEQ ID NO: 1059364 - RNA, 22 nt, Human
cccaggcacaccccgaacggaa

SEQ ID NO: 1059365 - RNA, 22 nt, Human
uccaggccauugacugcauccu

SEQ ID NO: 1059366 - RNA, 22 nt, Human
ccugggcugggcgucucauggg

SEQ ID NO: 1059367 - RNA, 22 nt, Human
uuugcaaauauguguuucuauu

SEQ ID NO: 1059368 - RNA, 22 nt, Human
uuauucugcacuuuuaaaauau

SEQ ID NO: 1059369 - RNA, 21 nt, Human
aauguauguuuaucucacagu

SEQ ID NO: 1059370 - RNA, 22 nt, Human
gcuccuggguguggcugccccu

SEQ ID NO: 1059371 - RNA, 22 nt, Human
ccaggcaggcgauggugcagug

SEQ ID NO: 1059372 - RNA, 21 nt, Human
ccugggcugugguuuggagac

SEQ ID NO: 1059373 - RNA, 22 nt, Human
uuucauaauacuguacaugaaa

SEQ ID NO: 1059374 - RNA, 22 nt, Human
gcuucuggaagcugcuucugcc

SEQ ID NO: 1059375 - RNA, 19 nt, Human
cgcaggcuucgggucgcuc

SEQ ID NO: 1059376 - RNA, 22 nt, Human
guuuucaugucuauugggcaua

SEQ ID NO: 1059377 - RNA, 22 nt, Human
aaauacagauuccagggucuua

SEQ ID NO: 1059378 - RNA, 22 nt, Human
augugaaauagcuggauaugaa

SEQ ID NO: 1059379 - RNA, 22 nt, Human
auaugaagucagacaaacuggg

SEQ ID NO: 1059380 - RNA, 21 nt, Human
uaaaucucuguauucuucagu

SEQ ID NO: 1059381 - RNA, 22 nt, Human
cugccugcugcccuccagagcc

SEQ ID NO: 1059382 - RNA, 22 nt, Human
ccaggcucaccuggagccccug

SEQ ID NO: 1059383 - RNA, 22 nt, Human
aaaccaucagauaauucauacu

SEQ ID NO: 1059384 - RNA, 22 nt, Human
cagggcucaucugugugaccag

SEQ ID NO: 1059385 - RNA, 22 nt, Human
acagcuuuuuacuaauagauug

SEQ ID NO: 1059386 - RNA, 22 nt, Human
ccaggcuguaagagugauguug

SEQ ID NO: 1059387 - RNA, 22 nt, Human
uacauaaugagcuaguuaaguu

SEQ ID NO: 1059388 - RNA, 22 nt, Human
acaggcucgugcgcgcacgugu

SEQ ID NO: 1059389 - RNA, 22 nt, Human
gcacauaaagggcaugggaggu

SEQ ID NO: 1059390 - RNA, 22 nt, Human
acaucacagagcccagauaaag

SEQ ID NO: 1059391 - RNA, 22 nt, Human
aauguaugagcgugaaagcacu

SEQ ID NO: 1059392 - RNA, 22 nt, Human
gaugaagccccaguguaaguaa

SEQ ID NO: 1059393 - RNA, 22 nt, Human
agcuuuguggcuuugcaagacu

SEQ ID NO: 1059394 - RNA, 22 nt, Human
auuucauagauuguaaaucccu

SEQ ID NO: 1059395 - RNA, 22 nt, Human
gcacccagccagcaucucagag

SEQ ID NO: 1059396 - RNA, 22 nt, Human
uguauacaggauuacucauagc

SEQ ID NO: 1059397 - RNA, 22 nt, Human
agaauaugaugguuggagaauu

SEQ ID NO: 1059398 - RNA, 22 nt, Human
augauuucuauauaaacuuaaa

SEQ ID NO: 1059399 - RNA, 22 nt, Human
uuuaauuugaaaugaguaaccc

SEQ ID NO: 1059400 - RNA, 22 nt, Human
cuuagggagaaugccucugcag

SEQ ID NO: 1059401 - RNA, 22 nt, Human
ggcuuuaugcagggauagaaau

SEQ ID NO: 1059402 - RNA, 22 nt, Human
ugaaaucaaugucuucugucuc

SEQ ID NO: 1059403 - RNA, 20 nt, Human
guauuagguguuccucuuuc

SEQ ID NO: 1059404 - RNA, 18 nt, Human
ucaggcucucuggcuaga

SEQ ID NO: 1059405 - RNA, 22 nt, Human
acacacagcgccuaccaugugc

SEQ ID NO: 1059406 - RNA, 22 nt, Human
guggcagucgcugacagauaca

SEQ ID NO: 1059407 - RNA, 22 nt, Human
uguuucuuuguagauauucuuu

SEQ ID NO: 1059408 - RNA, 22 nt, Human
agggcuccugaggcccuucugg

SEQ ID NO: 1059409 - RNA, 22 nt, Human
ucagcuuucucuucuaucgaua

SEQ ID NO: 1059410 - RNA, 21 nt, Human
ccacucaugacuccacucacc

SEQ ID NO: 1059411 - RNA, 22 nt, Human
ugcacagcuggcucuccuuuuc

SEQ ID NO: 1059412 - RNA, 22 nt, Human
cuucuggguauuccagauaccu

SEQ ID NO: 1059413 - RNA, 22 nt, Human
accaggcagcaccaaagccggu

SEQ ID NO: 1059414 - RNA, 22 nt, Human
gguuucaacuaaaucaagaagg

SEQ ID NO: 1059415 - RNA, 22 nt, Human
uguauaaacuuaagcaggaacc

SEQ ID NO: 1059416 - RNA, 22 nt, Human
gccaggcauuuauugauugaau

SEQ ID NO: 1059417 - RNA, 22 nt, Human
ucaggcucugccaccuagauua

SEQ ID NO: 1059418 - RNA, 22 nt, Human
uccugaggcacaauccuagaau

SEQ ID NO: 1059419 - RNA, 22 nt, Human
cagaguuuuaucauacguggau

SEQ ID NO: 1059420 - RNA, 22 nt, Human
cccagccuuccacccuggacua

SEQ ID NO: 1059421 - RNA, 22 nt, Human
uuuuccuucugauacuccauuu

SEQ ID NO: 1059422 - RNA, 22 nt, Human
cagcccaggccgacaguuccuc

SEQ ID NO: 1059423 - RNA, 22 nt, Human
aaauuauuacaagcuaguuggc

SEQ ID NO: 1059424 - RNA, 22 nt, Human
ucaguuaacaacuauuuauuga

SEQ ID NO: 1059425 - RNA, 22 nt, Human
cugggcuuaggaccuggugcgg

SEQ ID NO: 1059426 - RNA, 22 nt, Human
acagaguccuagcugcaaagaa

SEQ ID NO: 1059427 - RNA, 22 nt, Human
aauacuauguagccaaaauaau

SEQ ID NO: 1059428 - RNA, 22 nt, Human
gacagccaucagcacacgcugc

SEQ ID NO: 1059429 - RNA, 22 nt, Human
uaacacauauuucaagaguagu

SEQ ID NO: 1059430 - RNA, 22 nt, Human
uuguaugaguaugguguauagg

SEQ ID NO: 1059431 - RNA, 22 nt, Human
cuuguuaaaaugcagauuccaa

SEQ ID NO: 1059432 - RNA, 22 nt, Human
uguaggaaaaacaaugaucugc

SEQ ID NO: 1059433 - RNA, 22 nt, Human
gcacacaguauaugcucauuaa

SEQ ID NO: 1059434 - RNA, 22 nt, Human
gcacccagagggcagggucucc

SEQ ID NO: 1059435 - RNA, 22 nt, Human
agcuuuauuaacucuccaggug

SEQ ID NO: 1059436 - RNA, 22 nt, Human
aaauacauacacuguacguggc

SEQ ID NO: 1059437 - RNA, 22 nt, Human
ggggaccuuuccauuucugaga

SEQ ID NO: 1059438 - RNA, 22 nt, Human
agggacuauuuacccaucucac

SEQ ID NO: 1059439 - RNA, 18 nt, Human
auccuugaugagaggucu

SEQ ID NO: 1059440 - RNA, 22 nt, Human
gaugaagcuuugaagucuaauc

SEQ ID NO: 1059441 - RNA, 22 nt, Human
gguuuccugcauugggaaauuu

SEQ ID NO: 1059442 - RNA, 22 nt, Human
cugcaggggcuggaguuggcuu

SEQ ID NO: 1059443 - RNA, 22 nt, Human
gcaggcuccaggccggccccuu

SEQ ID NO: 1059444 - RNA, 22 nt, Human
uuuucauuguuacuaugagcua

SEQ ID NO: 1059445 - RNA, 22 nt, Human
ggggcugagucagugggaagag

SEQ ID NO: 1059446 - RNA, 22 nt, Human
guggcagggugcucaucaugca

SEQ ID NO: 1059447 - RNA, 22 nt, Human
gaauuucuggacccuuugagaa

SEQ ID NO: 1059448 - RNA, 23 nt, Human
ucugcagacgcuguucuauuguc

SEQ ID NO: 1059449 - RNA, 22 nt, Human
cagggggugcaggcccugugac

SEQ ID NO: 1059450 - RNA, 22 nt, Human
auguuucaaauauauagaguug

SEQ ID NO: 1059451 - RNA, 20 nt, Human
ccugggcuccaggagccccg

SEQ ID NO: 1059452 - RNA, 22 nt, Human
acagcucuguugccagaucugc

SEQ ID NO: 1059453 - RNA, 22 nt, Human
uccaggcaaaaaccaacuacag

SEQ ID NO: 1059454 - RNA, 22 nt, Human
uuucacauaugguuguugauug

SEQ ID NO: 1059455 - RNA, 22 nt, Human
aauaauuuuagcucagaguugu

SEQ ID NO: 1059456 - RNA, 22 nt, Human
ccagauagaaaagaaggcagga

SEQ ID NO: 1059457 - RNA, 22 nt, Human
gagcucagauucuggugucaga

SEQ ID NO: 1059458 - RNA, 22 nt, Human
cuggggacugaaggauguugcu

SEQ ID NO: 1059459 - RNA, 22 nt, Human
acaauacuuaccaauguuuuug

SEQ ID NO: 1059460 - RNA, 22 nt, Human
caaagucagccagcuaguaggu

SEQ ID NO: 1059461 - RNA, 22 nt, Human
aucacuguuaucuagaagcaca

SEQ ID NO: 1059462 - RNA, 21 nt, Human
acacacugaguuuuccacugu

SEQ ID NO: 1059463 - RNA, 21 nt, Human
uggaccuguccuucucgcugu

SEQ ID NO: 1059464 - RNA, 22 nt, Human
aggcuguguggaugagucuuac

SEQ ID NO: 1059465 - RNA, 22 nt, Human
uggguaggggacguggaagaaa

SEQ ID NO: 1059466 - RNA, 22 nt, Human
aggcugugggaguugagagucu

SEQ ID NO: 1059467 - RNA, 22 nt, Human
ugcuucugcaggagcuccugau

SEQ ID NO: 1059468 - RNA, 22 nt, Human
ggaggugggcuaaggacucucu

SEQ ID NO: 1059469 - RNA, 22 nt, Human
aaguguuuggggaucauuuuaa

SEQ ID NO: 1059470 - RNA, 22 nt, Human
uuagggacagcucuguagguga

SEQ ID NO: 1059471 - RNA, 22 nt, Human
caaauauuccagguacaucccu

SEQ ID NO: 1059472 - RNA, 20 nt, Human
uuccacaucuuugcacaugc

SEQ ID NO: 1059473 - RNA, 22 nt, Human
aaaguuuguugcuuacaaagaa

SEQ ID NO: 1059474 - RNA, 22 nt, Human
gcuggcaggagccuuucccuuu

SEQ ID NO: 1059475 - RNA, 22 nt, Human
ugcuuuauaucucucuucuuag

SEQ ID NO: 1059476 - RNA, 22 nt, Human
aacauucaaaacccaguucagu

SEQ ID NO: 1059477 - RNA, 22 nt, Human
caucacagaaauaaacauaccu

SEQ ID NO: 1059478 - RNA, 22 nt, Human
augggcugacaagacaugcaua

SEQ ID NO: 1059479 - RNA, 22 nt, Human
gcugucugccgcaggcugccac

SEQ ID NO: 1059480 - RNA, 22 nt, Human
uucugggguuaugggugauucu

SEQ ID NO: 1059481 - RNA, 22 nt, Human
gccaggcagagccccgugcagc

SEQ ID NO: 1059482 - RNA, 22 nt, Human
acaaauuuauugaagggcauau

SEQ ID NO: 1059483 - RNA, 22 nt, Human
gagcuuuaagggauaaaaugau

SEQ ID NO: 1059484 - RNA, 22 nt, Human
ccugccuucagcccugaagucu

SEQ ID NO: 1059485 - RNA, 22 nt, Human
agggcugacagugaggagucaa

SEQ ID NO: 1059486 - RNA, 22 nt, Human
cauuugcagagggugacacucu

SEQ ID NO: 1059487 - RNA, 21 nt, Human
cacacagugaucuauccacau

SEQ ID NO: 1059488 - RNA, 22 nt, Human
uuugugaauagguuggcuucca

SEQ ID NO: 1059489 - RNA, 22 nt, Human
aauacugucuuucacagauauu

SEQ ID NO: 1059490 - RNA, 22 nt, Human
aagcuuuaugacuuggagacag

SEQ ID NO: 1059491 - RNA, 22 nt, Human
agcucccaggcagucaugagga

SEQ ID NO: 1059492 - RNA, 22 nt, Human
auuauuucucacucacauaaua

SEQ ID NO: 1059493 - RNA, 22 nt, Human
cagccaggauggagaacuguug

SEQ ID NO: 1059494 - RNA, 20 nt, Human
guggcaggcagugaaggagc

SEQ ID NO: 1059495 - RNA, 22 nt, Human
ccagagaggggaagggcuugcc

SEQ ID NO: 1059496 - RNA, 22 nt, Human
uaacacaugguuaguacacaau

SEQ ID NO: 1059497 - RNA, 22 nt, Human
cugccugccacguucagcugua

SEQ ID NO: 1059498 - RNA, 22 nt, Human
gaggacucugggcguguauggg

SEQ ID NO: 1059499 - RNA, 22 nt, Human
gcuucuggagucuucagaggaa

SEQ ID NO: 1059500 - RNA, 19 nt, Human
uggaccugugcccauggcu

SEQ ID NO: 1059501 - RNA, 22 nt, Human
ugcuucuguauuuugggcuuga

SEQ ID NO: 1059502 - RNA, 22 nt, Human
cccaggcauuuucaacuuuagu

SEQ ID NO: 1059503 - RNA, 22 nt, Human
ccuggggagaagagcuuccccc

SEQ ID NO: 1059504 - RNA, 22 nt, Human
ugugaaauauuuauauacucaa

SEQ ID NO: 1059505 - RNA, 22 nt, Human
ggggcucaguucggacagccug

SEQ ID NO: 1059506 - RNA, 22 nt, Human
uuauuugcccauguuuagcaga

SEQ ID NO: 1059507 - RNA, 22 nt, Human
cccagcaugcacgcugacacuc

SEQ ID NO: 1059508 - RNA, 22 nt, Human
gcuggggaccagcugucucuga

SEQ ID NO: 1059509 - RNA, 22 nt, Human
cuuuucaugagucuguuauggg

SEQ ID NO: 1059510 - RNA, 20 nt, Human
cugaaccaaggcuuucucag

SEQ ID NO: 1059511 - RNA, 22 nt, Human
uugucaaguaaggcugacauuu

SEQ ID NO: 1059512 - RNA, 22 nt, Human
cuuucauucuuagauauuagug

SEQ ID NO: 1059513 - RNA, 22 nt, Human
accugcaggcacaggugugcgc

SEQ ID NO: 1059514 - RNA, 22 nt, Human
acagauuuuauuauucagguau

SEQ ID NO: 1059515 - RNA, 22 nt, Human
ccaggcccugcuccucacacca

SEQ ID NO: 1059516 - RNA, 22 nt, Human
acgugcaggaucugguuggcga

SEQ ID NO: 1059517 - RNA, 22 nt, Human
aggaccuguagggccugcaucc

SEQ ID NO: 1059518 - RNA, 22 nt, Human
ggcucugcaugugagugggugg

SEQ ID NO: 1059519 - RNA, 23 nt, Human
acauacauggagauaaagugaug

SEQ ID NO: 1059520 - RNA, 22 nt, Human
cuucccacuaguaucacagagc

SEQ ID NO: 1059521 - RNA, 22 nt, Human
guccucuggaagaugaguucuu

SEQ ID NO: 1059522 - RNA, 22 nt, Human
gucuucuguucugugaggcuuc

SEQ ID NO: 1059523 - RNA, 21 nt, Human
acugggcuagccugacuucug

SEQ ID NO: 1059524 - RNA, 22 nt, Human
ccuggggaauagagucaagggg

SEQ ID NO: 1059525 - RNA, 22 nt, Human
aggccacaguacuuugcagacc

SEQ ID NO: 1059526 - RNA, 22 nt, Human
ucucuuaaaagauuuuaaugac

SEQ ID NO: 1059527 - RNA, 22 nt, Human
cagaagaggacuggguagcuca

SEQ ID NO: 1059528 - RNA, 22 nt, Human
aucucccagccacagcauucuu

SEQ ID NO: 1059529 - RNA, 22 nt, Human
cugagagaucaagccacaggau

SEQ ID NO: 1059530 - RNA, 22 nt, Human
caucaaauaggaauauuuggca

SEQ ID NO: 1059531 - RNA, 22 nt, Human
ucccuccccacuucugagcuuu

SEQ ID NO: 1059532 - RNA, 20 nt, Human
aaagagcccuuggagcaggc

SEQ ID NO: 1059533 - RNA, 22 nt, Human
aagggcucgguagcaguccuga

SEQ ID NO: 1059534 - RNA, 19 nt, Human
gcuggcagauguggccgug

SEQ ID NO: 1059535 - RNA, 23 nt, Human
ggccucagcgcacagaaacugcu

SEQ ID NO: 1059536 - RNA, 22 nt, Human
ucuggcagagugauaggauaag

SEQ ID NO: 1059537 - RNA, 22 nt, Human
aaucacuuuucucuaauguagc

SEQ ID NO: 1059538 - RNA, 22 nt, Human
uucucauggugucuuuauacau

SEQ ID NO: 1059539 - RNA, 22 nt, Human
ugugaaauucuugaaaugcaca

SEQ ID NO: 1059540 - RNA, 23 nt, Human
ugcaggcuaggaagagagccuuc

SEQ ID NO: 1059541 - RNA, 22 nt, Human
cugcaggggccucgagcacagg

SEQ ID NO: 1059542 - RNA, 22 nt, Human
agcaggcuccuuccuucucugg

SEQ ID NO: 1059543 - RNA, 22 nt, Human
guuuuauaggcuguugcuauau

SEQ ID NO: 1059544 - RNA, 22 nt, Human
cacaaaaguaggaggcaggcgg

SEQ ID NO: 1059545 - RNA, 18 nt, Human
guuaauuuugaaguucau

SEQ ID NO: 1059546 - RNA, 22 nt, Human
ugcuuaaacauacuauuuauau

SEQ ID NO: 1059547 - RNA, 22 nt, Human
cucugagauaguuucuaucaau

SEQ ID NO: 1059548 - RNA, 22 nt, Human
uuugaaaauuagacacaggcua

SEQ ID NO: 1059549 - RNA, 22 nt, Human
ugcaggcuguuugguggaucuc

SEQ ID NO: 1059550 - RNA, 22 nt, Human
aaugauugcaaacauugagaac

SEQ ID NO: 1059551 - RNA, 21 nt, Human
cauuagggcagaagcaggaag

SEQ ID NO: 1059552 - RNA, 22 nt, Human
acagcuuuaucucagggaucag

SEQ ID NO: 1059553 - RNA, 22 nt, Human
cacacacugacaccuuaucuug

SEQ ID NO: 1059554 - RNA, 22 nt, Human
aucagagauuguaguaugugca

SEQ ID NO: 1059555 - RNA, 22 nt, Human
uggcagugggaauggacaaaca

SEQ ID NO: 1059556 - RNA, 22 nt, Human
ggcaggcuguucaccugcuuuu

SEQ ID NO: 1059557 - RNA, 22 nt, Human
uccaggcaagggaggagcaugg

SEQ ID NO: 1059558 - RNA, 22 nt, Human
ucgggcucgcucuccuagcgga

SEQ ID NO: 1059559 - RNA, 22 nt, Human
auugcuuaucuaucuuuaaguc

SEQ ID NO: 1059560 - RNA, 22 nt, Human
cucagagaaaaggagcaagggu

SEQ ID NO: 1059561 - RNA, 22 nt, Human
gcugggcuugguuucccugcuu

SEQ ID NO: 1059562 - RNA, 22 nt, Human
ugggcuccuugggagcaaguga

SEQ ID NO: 1059563 - RNA, 22 nt, Human
uucucuuagcuguaaagucaau

SEQ ID NO: 1059564 - RNA, 22 nt, Human
gcuucuggaggagcugggcuga

SEQ ID NO: 1059565 - RNA, 22 nt, Human
auacauucaaaggaaggauaga

SEQ ID NO: 1059566 - RNA, 22 nt, Human
ucccaggcuggcaggcagcagu

SEQ ID NO: 1059567 - RNA, 22 nt, Human
aauuagggagagguagcuaggu

SEQ ID NO: 1059568 - RNA, 22 nt, Human
cccugcagcauucucuaacugg

SEQ ID NO: 1059569 - RNA, 22 nt, Human
ccacacagucaguuuccaagaa

SEQ ID NO: 1059570 - RNA, 22 nt, Human
uuucacauuuguuuuaagaagu

SEQ ID NO: 1059571 - RNA, 22 nt, Human
uccuggcaguaauuugauguug

SEQ ID NO: 1059572 - RNA, 22 nt, Human
cugggcuuugaagccaggcugc

SEQ ID NO: 1059573 - RNA, 22 nt, Human
accaggcaaaaccacaggagca

SEQ ID NO: 1059574 - RNA, 22 nt, Human
uguaaacauauguauguaugua

SEQ ID NO: 1059575 - RNA, 22 nt, Human
uuguuucaggaugguuuguuac

SEQ ID NO: 1059576 - RNA, 22 nt, Human
ugucuuuaaaauuaaacacauc

SEQ ID NO: 1059577 - RNA, 22 nt, Human
uggcagagaacacacaugauuc

SEQ ID NO: 1059578 - RNA, 22 nt, Human
uucccaguuagucauuuuuaca

SEQ ID NO: 1059579 - RNA, 22 nt, Human
ugcuucuguauugaaauuguua

SEQ ID NO: 1059580 - RNA, 22 nt, Human
gaggagcucugcuccauccuuc

SEQ ID NO: 1059581 - RNA, 22 nt, Human
uuccaaguguugagauuagagg

SEQ ID NO: 1059582 - RNA, 22 nt, Human
ucugggcugggagcguguggac

SEQ ID NO: 1059583 - RNA, 22 nt, Human
aaaguucuuucucuuauuuggu

SEQ ID NO: 1059584 - RNA, 22 nt, Human
auguuggagucguaaggcaugg

SEQ ID NO: 1059585 - RNA, 22 nt, Human
cuccuggcaguuccccuuguca

SEQ ID NO: 1059586 - RNA, 22 nt, Human
aguugggaguuauagacucuau

SEQ ID NO: 1059587 - RNA, 19 nt, Human
ccaggccugcgggcguugg

SEQ ID NO: 1059588 - RNA, 22 nt, Human
gccugcagaggugcugcuagcu

SEQ ID NO: 1059589 - RNA, 22 nt, Human
cugggcuugaguuccugcucgu

SEQ ID NO: 1059590 - RNA, 22 nt, Human
cucauaaugugacuguauuuga

SEQ ID NO: 1059591 - RNA, 22 nt, Human
cuaggaaugguaccucuuacaa

SEQ ID NO: 1059592 - RNA, 22 nt, Human
uaugagaaucugcaguaugcuu

SEQ ID NO: 1059593 - RNA, 22 nt, Human
uccaggcauuccagccauucca

SEQ ID NO: 1059594 - RNA, 22 nt, Human
cugggcugucaguuuuguuuua

SEQ ID NO: 1059595 - RNA, 22 nt, Human
aagggacccuggaucaaaugga

SEQ ID NO: 1059596 - RNA, 22 nt, Human
uccaagcucucuaugccaugau

SEQ ID NO: 1059597 - RNA, 22 nt, Human
uguuugaacugaauaacauagu

SEQ ID NO: 1059598 - RNA, 22 nt, Human
uuuuccuuucaucaggacaaag

SEQ ID NO: 1059599 - RNA, 22 nt, Human
gggaccuggucuagcacugagc

SEQ ID NO: 1059600 - RNA, 22 nt, Human
caauguaucaaccagaaaguuc

SEQ ID NO: 1059601 - RNA, 22 nt, Human
uacaaaugaguuguaugaacca

SEQ ID NO: 1059602 - RNA, 22 nt, Human
ucacuguagugagcagaauaua

SEQ ID NO: 1059603 - RNA, 22 nt, Human
acagcuuuucugauagauccug

SEQ ID NO: 1059604 - RNA, 22 nt, Human
aaacacaccuuuggaacuguga

SEQ ID NO: 1059605 - RNA, 22 nt, Human
uaacacauuuuccucauacgga

SEQ ID NO: 1059606 - RNA, 22 nt, Human
cagagaaagaagcccauucauu

SEQ ID NO: 1059607 - RNA, 22 nt, Human
uuggagagauuuaggucucagu

SEQ ID NO: 1059608 - RNA, 22 nt, Human
ucucuuaauuguaaugguuccu

SEQ ID NO: 1059609 - RNA, 22 nt, Human
uauugaggaucuccugcuaauu

SEQ ID NO: 1059610 - RNA, 22 nt, Human
ccuggcaggacuguuguaagaa

SEQ ID NO: 1059611 - RNA, 22 nt, Human
uuucuacagcuggugcaacuuu

SEQ ID NO: 1059612 - RNA, 21 nt, Human
aauuacagauggaauuacaga

SEQ ID NO: 1059613 - RNA, 22 nt, Human
ugcuauaaguagacauucaaca

SEQ ID NO: 1059614 - RNA, 23 nt, Human
cccagagcacagccuccagaugc

SEQ ID NO: 1059615 - RNA, 22 nt, Human
guccucugggagccuugagccu

SEQ ID NO: 1059616 - RNA, 22 nt, Human
guggcagugaaggucauagcau

SEQ ID NO: 1059617 - RNA, 22 nt, Human
auuuucauggcuucugcucagu

SEQ ID NO: 1059618 - RNA, 22 nt, Human
ugucaaagccugaaucacauag

SEQ ID NO: 1059619 - RNA, 22 nt, Human
uauguacuacacuagaacauuu

SEQ ID NO: 1059620 - RNA, 22 nt, Human
aucugggggagcugcucaugga

SEQ ID NO: 1059621 - RNA, 22 nt, Human
aagugccaucauagcauggcug

SEQ ID NO: 1059622 - RNA, 22 nt, Human
cccuuccuccucgccugucaga

SEQ ID NO: 1059623 - RNA, 22 nt, Human
uaugaacuguacuguacuaagc

SEQ ID NO: 1059624 - RNA, 22 nt, Human
uuucuacauucaaaaacuacca

SEQ ID NO: 1059625 - RNA, 22 nt, Human
acacagaugcauuacacaucua

SEQ ID NO: 1059626 - RNA, 22 nt, Human
cacaauuuuaauacacagucaa

SEQ ID NO: 1059627 - RNA, 22 nt, Human
cucugagcagaggccguggcua

SEQ ID NO: 1059628 - RNA, 22 nt, Human
ucaucacauguguagucauccc

SEQ ID NO: 1059629 - RNA, 23 nt, Human
uuuauuuauuuaggcugagggau

SEQ ID NO: 1059630 - RNA, 22 nt, Human
ggcuucuguccucuggaucugu

SEQ ID NO: 1059631 - RNA, 22 nt, Human
cgugagcaaaauggacacuccc

SEQ ID NO: 1059632 - RNA, 22 nt, Human
gcaaguacaaacgcaucggcug

SEQ ID NO: 1059633 - RNA, 22 nt, Human
ucuguggaaauuuccugaggca

SEQ ID NO: 1059634 - RNA, 22 nt, Human
cacccagcuuuugcauccuccg

SEQ ID NO: 1059635 - RNA, 22 nt, Human
aggagcugcagauucugccuug

SEQ ID NO: 1059636 - RNA, 22 nt, Human
acauaugugcuuauauccauga

SEQ ID NO: 1059637 - RNA, 22 nt, Human
ucaggcucugagcugaugcuaa

SEQ ID NO: 1059638 - RNA, 21 nt, Human
uggccaaaaccauauuauuaa

SEQ ID NO: 1059639 - RNA, 22 nt, Human
cuucugggauuaauuuuuccug

SEQ ID NO: 1059640 - RNA, 22 nt, Human
aaggcuuuugggaauuuucaac

SEQ ID NO: 1059641 - RNA, 22 nt, Human
gcagcuuuagaaacaagggcug

SEQ ID NO: 1059642 - RNA, 17 nt, Human
uguuuucauucauugcu

SEQ ID NO: 1059643 - RNA, 22 nt, Human
uguaugaaccuuuaauauagug

SEQ ID NO: 1059644 - RNA, 22 nt, Human
cucugaaagaguuuaguauuau

SEQ ID NO: 1059645 - RNA, 22 nt, Human
aauaacuucaguucuuacauua

SEQ ID NO: 1059646 - RNA, 22 nt, Human
acaggcucuggggcaggauggc

SEQ ID NO: 1059647 - RNA, 17 nt, Human
uugggagagaaagguau

SEQ ID NO: 1059648 - RNA, 22 nt, Human
aaucugucguaguaaaaagcag

SEQ ID NO: 1059649 - RNA, 22 nt, Human
ugcaggcuggggaggcagacuu

SEQ ID NO: 1059650 - RNA, 22 nt, Human
ucaggcucucagaccaacagca

SEQ ID NO: 1059651 - RNA, 22 nt, Human
aacaggcaggagaauucugccu

SEQ ID NO: 1059652 - RNA, 22 nt, Human
uucuuaaaacuuauggacaggu

SEQ ID NO: 1059653 - RNA, 22 nt, Human
uaacacaugaaagcaccuucuu

SEQ ID NO: 1059654 - RNA, 22 nt, Human
ucagagagccucaggcacugcc

SEQ ID NO: 1059655 - RNA, 22 nt, Human
ggcuuuauuugcagccauuguu

SEQ ID NO: 1059656 - RNA, 22 nt, Human
uggguaggaccagaaaugcacu

SEQ ID NO: 1059657 - RNA, 22 nt, Human
uagcuagaaugcuucgugauau

SEQ ID NO: 1059658 - RNA, 22 nt, Human
cagguuggucggcaaguacaca

SEQ ID NO: 1059659 - RNA, 22 nt, Human
ucucaaaucaaacuuugagcuu

SEQ ID NO: 1059660 - RNA, 22 nt, Human
accuggagaaagccucucccug

SEQ ID NO: 1059661 - RNA, 22 nt, Human
ccacuguaguuaugaugaaguu

SEQ ID NO: 1059662 - RNA, 22 nt, Human
uaauuuuaacugugcuguuugg

SEQ ID NO: 1059663 - RNA, 22 nt, Human
uguaugaaugggaaaaggaaac

SEQ ID NO: 1059664 - RNA, 22 nt, Human
auguaaacaagguuauugucca

SEQ ID NO: 1059665 - RNA, 23 nt, Human
auguaucucauccaaggaagcuc

SEQ ID NO: 1059666 - RNA, 22 nt, Human
cuggggcuggugaggcaggcuc

SEQ ID NO: 1059667 - RNA, 22 nt, Human
caguggugaagagcaggggcuc

SEQ ID NO: 1059668 - RNA, 22 nt, Human
guuucauuaccugacccaugag

SEQ ID NO: 1059669 - RNA, 22 nt, Human
uuuguacauccuaauucugagu

SEQ ID NO: 1059670 - RNA, 22 nt, Human
ccuucaaaacacuaguuuuuga

SEQ ID NO: 1059671 - RNA, 22 nt, Human
uguaugaagguuuaccugcugu

SEQ ID NO: 1059672 - RNA, 22 nt, Human
aggcaccuugagagcaggagcu

SEQ ID NO: 1059673 - RNA, 22 nt, Human
uccuggcacccuuggguuggag

SEQ ID NO: 1059674 - RNA, 22 nt, Human
guucacaagaguuacagacaga

SEQ ID NO: 1059675 - RNA, 22 nt, Human
agcaggcugaugggcaugcuug

SEQ ID NO: 1059676 - RNA, 22 nt, Human
uaggaaaugcuccauugcauaa

SEQ ID NO: 1059677 - RNA, 22 nt, Human
ggcaggcuugguggcaccgguu

SEQ ID NO: 1059678 - RNA, 22 nt, Human
ugcauacacaugugcacauacg

SEQ ID NO: 1059679 - RNA, 22 nt, Human
ugguccugccccgugcacagag

SEQ ID NO: 1059680 - RNA, 22 nt, Human
uguuaggguccugugcaggggc

SEQ ID NO: 1059681 - RNA, 22 nt, Human
cuucuggguugcaggucuuggc

SEQ ID NO: 1059682 - RNA, 22 nt, Human
ccagcuuuccaggguugacugg

SEQ ID NO: 1059683 - RNA, 22 nt, Human
auuucccuccagggaaagcuua

SEQ ID NO: 1059684 - RNA, 23 nt, Human
uugggcuggcucucgaugccucu

SEQ ID NO: 1059685 - RNA, 22 nt, Human
gaaagauauuuauuggcaacag

SEQ ID NO: 1059686 - RNA, 22 nt, Human
cuuuucaugccagcccaucaca

SEQ ID NO: 1059687 - RNA, 22 nt, Human
uuuuccuguccaggcaauuauu

SEQ ID NO: 1059688 - RNA, 22 nt, Human
aaacacauuagcccuguggaaa

SEQ ID NO: 1059689 - RNA, 22 nt, Human
aaagagucaaaggcaugucucu

SEQ ID NO: 1059690 - RNA, 22 nt, Human
agcacagggacaaugccaggug

SEQ ID NO: 1059691 - RNA, 22 nt, Human
acuuggcaaguaucuauaaagu

SEQ ID NO: 1059692 - RNA, 22 nt, Human
augaacugcaguauaaacuugg

SEQ ID NO: 1059693 - RNA, 22 nt, Human
gugugaaaaugugcacaauaug

SEQ ID NO: 1059694 - RNA, 22 nt, Human
acaguucccgucuugcacagcu

SEQ ID NO: 1059695 - RNA, 20 nt, Human
acuccagguggcaugaggac

SEQ ID NO: 1059696 - RNA, 22 nt, Human
uuguaaauaguaguaagaugcc

SEQ ID NO: 1059697 - RNA, 22 nt, Human
gguggccugaauuagcucaggg

SEQ ID NO: 1059698 - RNA, 22 nt, Human
uauucacaugaaaacaaauuuu

SEQ ID NO: 1059699 - RNA, 23 nt, Human
uugugggcagauuccauggggag

SEQ ID NO: 1059700 - RNA, 22 nt, Human
uuugaaaagaaccaucgccuua

SEQ ID NO: 1059701 - RNA, 22 nt, Human
caauuucuggaacuaauucuga

SEQ ID NO: 1059702 - RNA, 22 nt, Human
ugguuccuucugcauuuucagc

SEQ ID NO: 1059703 - RNA, 22 nt, Human
ucuucaaauccuacagugucug

SEQ ID NO: 1059704 - RNA, 22 nt, Human
agcaggcuacuccuguguucgu

SEQ ID NO: 1059705 - RNA, 23 nt, Human
gaggcagcuccugcagugcccug

SEQ ID NO: 1059706 - RNA, 22 nt, Human
ugggcugagcagugaagcucau

SEQ ID NO: 1059707 - RNA, 22 nt, Human
uuccagccaugguuucccuaug

SEQ ID NO: 1059708 - RNA, 22 nt, Human
ccaggcugggcggggaaccugg

SEQ ID NO: 1059709 - RNA, 22 nt, Human
acaggccugagauuuugcauuu

SEQ ID NO: 1059710 - RNA, 22 nt, Human
gaaucauuuagcucugcaugga

SEQ ID NO: 1059711 - RNA, 22 nt, Human
uuucacauguggaaugccaggu

SEQ ID NO: 1059712 - RNA, 22 nt, Human
ucauauaaguuuaaaacuaucu

SEQ ID NO: 1059713 - RNA, 22 nt, Human
ugauguucuguauaucauauag

SEQ ID NO: 1059714 - RNA, 22 nt, Human
cagcauuuagaauuugaagugu

SEQ ID NO: 1059715 - RNA, 22 nt, Human
uuguacaaguauuaugugaaca

SEQ ID NO: 1059716 - RNA, 22 nt, Human
aggacaagcuaaaggacuuccu

SEQ ID NO: 1059717 - RNA, 21 nt, Human
ucuggggaagacaucuaggau

SEQ ID NO: 1059718 - RNA, 23 nt, Human
uuuuaauuuggacauaagaagau

SEQ ID NO: 1059719 - RNA, 22 nt, Human
cuuucuuauaccugucagggcc

SEQ ID NO: 1059720 - RNA, 22 nt, Human
agguauaagaagauuauuuaua

SEQ ID NO: 1059721 - RNA, 22 nt, Human
aggcaggggagcuggaagggua

SEQ ID NO: 1059722 - RNA, 22 nt, Human
cuuauuagaaagaaaagacaug

SEQ ID NO: 1059723 - RNA, 22 nt, Human
cugcagggugacguugcccacc

SEQ ID NO: 1059724 - RNA, 22 nt, Human
uuauuagguuuacauaaagguu

SEQ ID NO: 1059725 - RNA, 22 nt, Human
gagcuuuaccuuagguucuguu

SEQ ID NO: 1059726 - RNA, 22 nt, Human
ccuacucugagcgccuccgcau

SEQ ID NO: 1059727 - RNA, 21 nt, Human
ccuagccucuuacccagcuuu

SEQ ID NO: 1059728 - RNA, 21 nt, Human
agaaaaacacgauauaagccc

SEQ ID NO: 1059729 - RNA, 22 nt, Human
augucaaaucaguuuuaucaga

SEQ ID NO: 1059730 - RNA, 22 nt, Human
ccccuuccuuccucagacagcc

SEQ ID NO: 1059731 - RNA, 22 nt, Human
ucuacuauguuucuuaaauaga

SEQ ID NO: 1059732 - RNA, 22 nt, Human
auaacuuucuucacccuugcug

SEQ ID NO: 1059733 - RNA, 22 nt, Human
ccaggcucugagccucacucuu

SEQ ID NO: 1059734 - RNA, 22 nt, Human
ugcuacaauucacaucuggaua

SEQ ID NO: 1059735 - RNA, 22 nt, Human
ucuccugggaggacaaggaagg

SEQ ID NO: 1059736 - RNA, 22 nt, Human
gaacugaguuuucugccuggac

SEQ ID NO: 1059737 - RNA, 22 nt, Human
uggguacuccuauuaguucagu

SEQ ID NO: 1059738 - RNA, 22 nt, Human
uucacaauagcuggcaucaucu

SEQ ID NO: 1059739 - RNA, 22 nt, Human
cuggcaggagcauucacagagg

SEQ ID NO: 1059740 - RNA, 22 nt, Human
ucugucaaaaguuuucaauaaa

SEQ ID NO: 1059741 - RNA, 22 nt, Human
cuccaaguccgagggcucucaa

SEQ ID NO: 1059742 - RNA, 22 nt, Human
acaagagcauugcagguguguu

SEQ ID NO: 1059743 - RNA, 22 nt, Human
caguguuuguauagaauaugca

SEQ ID NO: 1059744 - RNA, 22 nt, Human
gguguugggcucacugguccuu

SEQ ID NO: 1059745 - RNA, 22 nt, Human
cagcuuuaguaacccacugcuc

SEQ ID NO: 1059746 - RNA, 22 nt, Human
ccuggcaggcaagaggaaggga

SEQ ID NO: 1059747 - RNA, 22 nt, Human
gccagaagggguggauccaggc

SEQ ID NO: 1059748 - RNA, 19 nt, Human
uuuuccuucuauauguuuc

SEQ ID NO: 1059749 - RNA, 22 nt, Human
ccuggcagguuacaaccaguua

SEQ ID NO: 1059750 - RNA, 21 nt, Human
ccaggcugggagggcaguucc

SEQ ID NO: 1059751 - RNA, 22 nt, Human
guaaaauucuagcaucugaaag

SEQ ID NO: 1059752 - RNA, 22 nt, Human
ucagggacugcagagggaagcu

SEQ ID NO: 1059753 - RNA, 22 nt, Human
augggcugaggaagcuccugag

SEQ ID NO: 1059754 - RNA, 20 nt, Human
ucauuacagugcuaagaugu

SEQ ID NO: 1059755 - RNA, 22 nt, Human
cgcaggcuggcgcggaguggca

SEQ ID NO: 1059756 - RNA, 22 nt, Human
acacucacccucccacugccug

SEQ ID NO: 1059757 - RNA, 22 nt, Human
ucugggcuugguuagggcuguu

SEQ ID NO: 1059758 - RNA, 22 nt, Human
uuccuggcauagagagggcaca

SEQ ID NO: 1059759 - RNA, 22 nt, Human
cugguggagggacaggcuuagc

SEQ ID NO: 1059760 - RNA, 22 nt, Human
uccccacagcagaagaucugag

SEQ ID NO: 1059761 - RNA, 22 nt, Human
uauaauuuggggaaaguggugu

SEQ ID NO: 1059762 - RNA, 22 nt, Human
ucuucacaugaccuucaugucu

SEQ ID NO: 1059763 - RNA, 22 nt, Human
ggccucaggguugggcccauua

SEQ ID NO: 1059764 - RNA, 22 nt, Human
acagcucugcauggcaguuauu

SEQ ID NO: 1059765 - RNA, 23 nt, Human
ucuguacaauugagaagagaaca

SEQ ID NO: 1059766 - RNA, 22 nt, Human
ugaguacucggagugcuuugga

SEQ ID NO: 1059767 - RNA, 20 nt, Human
gcucugaccauaucaagaca

SEQ ID NO: 1059768 - RNA, 22 nt, Human
ugcuuuauggagcccaucucau

SEQ ID NO: 1059769 - RNA, 22 nt, Human
ccaggcucugucuggucagaag

SEQ ID NO: 1059770 - RNA, 22 nt, Human
ucugugcauuguaacaacuaaa

SEQ ID NO: 1059771 - RNA, 22 nt, Human
cuguaugauauccaaauugaua

SEQ ID NO: 1059772 - RNA, 22 nt, Human
aauguaugacaguucuaguggu

SEQ ID NO: 1059773 - RNA, 22 nt, Human
uuuucucuuguuaauguacuga

SEQ ID NO: 1059774 - RNA, 22 nt, Human
uucugucaaauuugccauaugg

SEQ ID NO: 1059775 - RNA, 22 nt, Human
ccuggcaggccccuccuggauu

SEQ ID NO: 1059776 - RNA, 22 nt, Human
agcccggcuuccccgguugcua

SEQ ID NO: 1059777 - RNA, 22 nt, Human
caucuuuucagaagccauucug

SEQ ID NO: 1059778 - RNA, 22 nt, Human
caguauuuguucccuaucaaug

SEQ ID NO: 1059779 - RNA, 22 nt, Human
ugcuucugggucccagccuggc

SEQ ID NO: 1059780 - RNA, 22 nt, Human
ccacccagaccagggaucuggg

SEQ ID NO: 1059781 - RNA, 22 nt, Human
guccuggcccacuggcaggcug

SEQ ID NO: 1059782 - RNA, 22 nt, Human
gaauaguucuauggcugcaggg

SEQ ID NO: 1059783 - RNA, 21 nt, Human
agcaacucugacuagaugagg

SEQ ID NO: 1059784 - RNA, 22 nt, Human
uaaacauuuguuauucuuguuu

SEQ ID NO: 1059785 - RNA, 22 nt, Human
cacaacuuuaggaaccacauuc

SEQ ID NO: 1059786 - RNA, 21 nt, Human
ucauuugugaucugauuucca

SEQ ID NO: 1059787 - RNA, 22 nt, Human
gaccaccagagguccgugggua

SEQ ID NO: 1059788 - RNA, 22 nt, Human
gccugcaguucugugcuaggca

SEQ ID NO: 1059789 - RNA, 22 nt, Human
gugggagaaauuagcucuaguu

SEQ ID NO: 1059790 - RNA, 15 nt, Human
cacacagacagcuug

SEQ ID NO: 1059791 - RNA, 22 nt, Human
guuucgucaggcuuauucuauc

SEQ ID NO: 1059792 - RNA, 22 nt, Human
ucccacaccugucuauuccuag

SEQ ID NO: 1059793 - RNA, 20 nt, Human
ucccucccuccagcucuggg

SEQ ID NO: 1059794 - RNA, 22 nt, Human
cccaggcagagagcuggugagc

SEQ ID NO: 1059795 - RNA, 22 nt, Human
uccugcagccuugggcuggagc

SEQ ID NO: 1059796 - RNA, 22 nt, Human
acuggaaaacacuacuacaugc

SEQ ID NO: 1059797 - RNA, 22 nt, Human
ucagccuccgaaagugcuggga

SEQ ID NO: 1059798 - RNA, 22 nt, Human
cccaggcagcggggucuccuug

SEQ ID NO: 1059799 - RNA, 19 nt, Human
acuggcagcuguagucugu

SEQ ID NO: 1059800 - RNA, 22 nt, Human
gggaccuggacaugugugugcu

SEQ ID NO: 1059801 - RNA, 22 nt, Human
cuccuggcucgcccccagcuga

SEQ ID NO: 1059802 - RNA, 22 nt, Human
acagcuuugggcaaugcuauga

SEQ ID NO: 1059803 - RNA, 22 nt, Human
auuuguagugaagugaaaauaa

SEQ ID NO: 1059804 - RNA, 22 nt, Human
ggccucaguuucuccauggguu

SEQ ID NO: 1059805 - RNA, 22 nt, Human
uguuagaauauuguaauauucg

SEQ ID NO: 1059806 - RNA, 22 nt, Human
gcuccugggcccugggcuaacu

SEQ ID NO: 1059807 - RNA, 22 nt, Human
gucugucacucaggggcuggag

SEQ ID NO: 1059808 - RNA, 22 nt, Human
uaacacaugguucugucaggaa

SEQ ID NO: 1059809 - RNA, 22 nt, Human
guccaaguacauguguguacau

SEQ ID NO: 1059810 - RNA, 22 nt, Human
ggagcugaaggggugggcucag

SEQ ID NO: 1059811 - RNA, 17 nt, Human
uuucagauucacuuucu

SEQ ID NO: 1059812 - RNA, 22 nt, Human
uauucacaggcacgaaauauug

SEQ ID NO: 1059813 - RNA, 22 nt, Human
aguguggcaggaaugacuagaa

SEQ ID NO: 1059814 - RNA, 22 nt, Human
uuccuggccaagcagaguggaa

SEQ ID NO: 1059815 - RNA, 21 nt, Human
ucacacacguuuccaagggca

SEQ ID NO: 1059816 - RNA, 22 nt, Human
uguguuuugaacucaucuacug

SEQ ID NO: 1059817 - RNA, 22 nt, Human
aaauacugcugcuauuccuuuu

SEQ ID NO: 1059818 - RNA, 22 nt, Human
uacaacauguaaagugguuuaa

SEQ ID NO: 1059819 - RNA, 22 nt, Human
aucagagacaaaaccagcacuu

SEQ ID NO: 1059820 - RNA, 22 nt, Human
agguuuaugccuuggagcuggg

SEQ ID NO: 1059821 - RNA, 22 nt, Human
uuccaggcugaugggccacagg

SEQ ID NO: 1059822 - RNA, 22 nt, Human
ugggcucagucugcuugguccu

SEQ ID NO: 1059823 - RNA, 20 nt, Human
uuucacaaugaacaugucuc

SEQ ID NO: 1059824 - RNA, 22 nt, Human
uaacacauaucuacaacaugug

SEQ ID NO: 1059825 - RNA, 22 nt, Human
cccugcaguccuuucuuggcuc

SEQ ID NO: 1059826 - RNA, 22 nt, Human
uuucaaauagaaucuuuccaaa

SEQ ID NO: 1059827 - RNA, 22 nt, Human
cauaauuuuuuuaagucagaac

SEQ ID NO: 1059828 - RNA, 22 nt, Human
ugugaaaagggcuuuguacaaa

SEQ ID NO: 1059829 - RNA, 22 nt, Human
auucucuggcuaaaaccugaag

SEQ ID NO: 1059830 - RNA, 16 nt, Human
uguaugaacgucucca

SEQ ID NO: 1059831 - RNA, 22 nt, Human
uauaauguuuuccauggacuga

SEQ ID NO: 1059832 - RNA, 22 nt, Human
uguguaaagcuuguuccagaaa

SEQ ID NO: 1059833 - RNA, 22 nt, Human
cagcauuuucuuaauguaggug

SEQ ID NO: 1059834 - RNA, 22 nt, Human
aauucuguuacuaaugugaugu

SEQ ID NO: 1059835 - RNA, 22 nt, Human
uccugcagcugaagcucaugug

SEQ ID NO: 1059836 - RNA, 22 nt, Human
gccuccuggguucaugccauuc

SEQ ID NO: 1059837 - RNA, 22 nt, Human
ugcuucugauucaugguuauug

SEQ ID NO: 1059838 - RNA, 22 nt, Human
augaaacagugaauuagucaag

SEQ ID NO: 1059839 - RNA, 22 nt, Human
cagugaggcucugcugagcggu

SEQ ID NO: 1059840 - RNA, 22 nt, Human
aaauacauaaagguuguaccag

SEQ ID NO: 1059841 - RNA, 22 nt, Human
uagaacacuugaccacugcucc

SEQ ID NO: 1059842 - RNA, 22 nt, Human
acagauuugacugguaccuggc

SEQ ID NO: 1059843 - RNA, 22 nt, Human
uacauucagaagaauggacacg

SEQ ID NO: 1059844 - RNA, 22 nt, Human
caugaagcuugaagcaguccac

SEQ ID NO: 1059845 - RNA, 22 nt, Human
ugcuuuauggauuuguguccug

SEQ ID NO: 1059846 - RNA, 22 nt, Human
uccagacccaugacccugggga

SEQ ID NO: 1059847 - RNA, 22 nt, Human
ggcuucuggugggagcaugacu

SEQ ID NO: 1059848 - RNA, 22 nt, Human
uuuguuuucaaugugucauuca

SEQ ID NO: 1059849 - RNA, 22 nt, Human
aguaugaagauuauaauuuuuc

SEQ ID NO: 1059850 - RNA, 21 nt, Human
aaaaagcuggggcaugcaugc

SEQ ID NO: 1059851 - RNA, 22 nt, Human
ucauuuguugcuguuaccugag

SEQ ID NO: 1059852 - RNA, 22 nt, Human
cacacaguaggcacucauuaau

SEQ ID NO: 1059853 - RNA, 22 nt, Human
uuugacaaaggaaaaaugcaca

SEQ ID NO: 1059854 - RNA, 22 nt, Human
caugagauaauuuuucuccagu

SEQ ID NO: 1059855 - RNA, 22 nt, Human
cccugcagccggccagcucauu

SEQ ID NO: 1059856 - RNA, 22 nt, Human
gacacauaugcguauaguuuag

SEQ ID NO: 1059857 - RNA, 22 nt, Human
auaugcauguacgugugcacaa

SEQ ID NO: 1059858 - RNA, 22 nt, Human
uaacacauagauauuuuaacuu

SEQ ID NO: 1059859 - RNA, 22 nt, Human
cuuccucuagccuaguaaugcc

SEQ ID NO: 1059860 - RNA, 22 nt, Human
aaauauguaagauuagcacuag

SEQ ID NO: 1059861 - RNA, 22 nt, Human
ugacaggaggcuugaggccagg

SEQ ID NO: 1059862 - RNA, 22 nt, Human
ugcuucugaaguggaugggugc

SEQ ID NO: 1059863 - RNA, 22 nt, Human
aucuccagauugugaucaucag

SEQ ID NO: 1059864 - RNA, 22 nt, Human
gaauauuuucaguacagauggu

SEQ ID NO: 1059865 - RNA, 22 nt, Human
uuccuugaaugagucauggaaa

SEQ ID NO: 1059866 - RNA, 22 nt, Human
uuggaaauacagcaguuacuuu

SEQ ID NO: 1059867 - RNA, 22 nt, Human
aggacaguguggaagagggugc

SEQ ID NO: 1059868 - RNA, 22 nt, Human
caggacaaagcccuuugagaaa

SEQ ID NO: 1059869 - RNA, 22 nt, Human
uccuggcacuuugggggcucgc

SEQ ID NO: 1059870 - RNA, 22 nt, Human
uagcuuuaggaugguucucuug

SEQ ID NO: 1059871 - RNA, 22 nt, Human
aagcacauuguacauuugugcu

SEQ ID NO: 1059872 - RNA, 22 nt, Human
gcuucugggguucuggcaugcu

SEQ ID NO: 1059873 - RNA, 22 nt, Human
uuccugggugguccugguagag

SEQ ID NO: 1059874 - RNA, 19 nt, Human
uuagggacaugaauucuag

SEQ ID NO: 1059875 - RNA, 22 nt, Human
uucauauaaauggaaucagaau

SEQ ID NO: 1059876 - RNA, 23 nt, Human
uggaccugaaccagugccucugu

SEQ ID NO: 1059877 - RNA, 22 nt, Human
cagcuuguuaccgagggagggu

SEQ ID NO: 1059878 - RNA, 22 nt, Human
ugcuucugacugggucaguuga

SEQ ID NO: 1059879 - RNA, 22 nt, Human
cuggauuuaauuaacuguugcu

SEQ ID NO: 1059880 - RNA, 22 nt, Human
acuggcagaacuggugauuguc

SEQ ID NO: 1059881 - RNA, 22 nt, Human
caggcccucaggcaagggcucu

SEQ ID NO: 1059882 - RNA, 22 nt, Human
ggugccagugggucucaggaua

SEQ ID NO: 1059883 - RNA, 22 nt, Human
aggccucugcuggaaagaguug

SEQ ID NO: 1059884 - RNA, 22 nt, Human
acacauaagaaacuacaaagag

SEQ ID NO: 1059885 - RNA, 22 nt, Human
ccagagaguaaacauuuuccgg

SEQ ID NO: 1059886 - RNA, 22 nt, Human
uaaaucuccuguuuuucaucua

SEQ ID NO: 1059887 - RNA, 22 nt, Human
agggcccaggacagcaucaggg

SEQ ID NO: 1059888 - RNA, 22 nt, Human
uuuaauuuguauuucuagaggg

SEQ ID NO: 1059889 - RNA, 22 nt, Human
guggcagugggaugcuaucagg

SEQ ID NO: 1059890 - RNA, 22 nt, Human
ccuggggaaaagcaggcauuua

SEQ ID NO: 1059891 - RNA, 22 nt, Human
auguuagaaucucugaaugugg

SEQ ID NO: 1059892 - RNA, 20 nt, Human
ucugugcaccugcuacaagg

SEQ ID NO: 1059893 - RNA, 23 nt, Human
cugcagagaacugagggacagcc

SEQ ID NO: 1059894 - RNA, 22 nt, Human
acaucacaguaguuaagccaga

SEQ ID NO: 1059895 - RNA, 22 nt, Human
cucugucaggcugcagaugcuc

SEQ ID NO: 1059896 - RNA, 22 nt, Human
ucuuugaugugguuaauuauga

SEQ ID NO: 1059897 - RNA, 18 nt, Human
cuccuccacagccccugc

SEQ ID NO: 1059898 - RNA, 22 nt, Human
ucuggcagaggaaggaggccug

SEQ ID NO: 1059899 - RNA, 22 nt, Human
aggaaagauggaaggaggauaa

SEQ ID NO: 1059900 - RNA, 22 nt, Human
uggcaucuccgacagucuugau

SEQ ID NO: 1059901 - RNA, 22 nt, Human
cugcagggcagaagggcauaga

SEQ ID NO: 1059902 - RNA, 22 nt, Human
guacccaggcacgccuugcuga

SEQ ID NO: 1059903 - RNA, 22 nt, Human
ugcagagaaaacuccuggguac

SEQ ID NO: 1059904 - RNA, 22 nt, Human
aaauaguuacuucugcugucuu

SEQ ID NO: 1059905 - RNA, 20 nt, Human
cagagaccaggccagguguc

SEQ ID NO: 1059906 - RNA, 22 nt, Human
gauuuuucaguauaaaauauau

SEQ ID NO: 1059907 - RNA, 22 nt, Human
uagaauaugauuaauuuucuua

SEQ ID NO: 1059908 - RNA, 17 nt, Human
uccaggcagcaacugag

SEQ ID NO: 1059909 - RNA, 22 nt, Human
cacucuccagcacaccccauuu

SEQ ID NO: 1059910 - RNA, 22 nt, Human
uccaggcuaauuuugcauuguu

SEQ ID NO: 1059911 - RNA, 22 nt, Human
gaggcacagucccgaggcaagg

SEQ ID NO: 1059912 - RNA, 19 nt, Human
gcuggcagaauuuugaacc

SEQ ID NO: 1059913 - RNA, 22 nt, Human
gcuccaggcagcauaguggaug

SEQ ID NO: 1059914 - RNA, 22 nt, Human
ugggcugagcacugaggaagga

SEQ ID NO: 1059915 - RNA, 19 nt, Human
agaugucuauuugacuauc

SEQ ID NO: 1059916 - RNA, 22 nt, Human
acuuuauuuccuauugcaucca

SEQ ID NO: 1059917 - RNA, 22 nt, Human
ugauucuauggaaggcauaagg

SEQ ID NO: 1059918 - RNA, 22 nt, Human
cagaugagaguggccaggguuc

SEQ ID NO: 1059919 - RNA, 22 nt, Human
accauuugacucucuaaggaua

SEQ ID NO: 1059920 - RNA, 22 nt, Human
ucccaaggccaggcaucuagaa

SEQ ID NO: 1059921 - RNA, 22 nt, Human
acagagcaugcucaguguguga

SEQ ID NO: 1059922 - RNA, 22 nt, Human
ugguaagaacccaucagagaag

SEQ ID NO: 1059923 - RNA, 22 nt, Human
ccugcagagccacgugccagcg

SEQ ID NO: 1059924 - RNA, 20 nt, Human
uuccagagaucugcauuuua

SEQ ID NO: 1059925 - RNA, 22 nt, Human
ccagcuuucauaucaugaggua

SEQ ID NO: 1059926 - RNA, 22 nt, Human
uacugacacaaagccaaucccu

SEQ ID NO: 1059927 - RNA, 22 nt, Human
uaggaaauggcucaguuacugc

SEQ ID NO: 1059928 - RNA, 22 nt, Human
ucacacacauaaucuaagauua

SEQ ID NO: 1059929 - RNA, 22 nt, Human
uaguauuuaaucacuuuugucu

SEQ ID NO: 1059930 - RNA, 22 nt, Human
uuccaagugggggaagcugagu

SEQ ID NO: 1059931 - RNA, 22 nt, Human
cagggcucccugcagccucugu

SEQ ID NO: 1059932 - RNA, 22 nt, Human
cuugggcucugugggccuuagu

SEQ ID NO: 1059933 - RNA, 22 nt, Human
agauaugugcgucuuagauuga

SEQ ID NO: 1059934 - RNA, 22 nt, Human
aucuguaaaugcaaauguagcu

SEQ ID NO: 1059935 - RNA, 22 nt, Human
acuagauaauuauaaaagguag

SEQ ID NO: 1059936 - RNA, 22 nt, Human
cuccaaguauguuaaaaucuaa

SEQ ID NO: 1059937 - RNA, 22 nt, Human
uagggacaaagagcugaggccu

SEQ ID NO: 1059938 - RNA, 23 nt, Human
guccucuggagagaaaggcagua

SEQ ID NO: 1059939 - RNA, 22 nt, Human
aaaguuagacagcaucauuucu

SEQ ID NO: 1059940 - RNA, 22 nt, Human
aauuugauucccugcaccuguu

SEQ ID NO: 1059941 - RNA, 23 nt, Human
uuuuccuguggagacaugacugg

SEQ ID NO: 1059942 - RNA, 22 nt, Human
cagcucuggguaggaggaaucu

SEQ ID NO: 1059943 - RNA, 22 nt, Human
aggcuuuggaaucagaguucug

SEQ ID NO: 1059944 - RNA, 22 nt, Human
uuguaaaugaccuuuucuaauu

SEQ ID NO: 1059945 - RNA, 22 nt, Human
uguuugaauuuugcuaacgugu

SEQ ID NO: 1059946 - RNA, 23 nt, Human
cugggcugcuugagucccuggcu

SEQ ID NO: 1059947 - RNA, 22 nt, Human
uacagagaguacagcauccaca

SEQ ID NO: 1059948 - RNA, 22 nt, Human
cuauuagguuggugcaaaagua

SEQ ID NO: 1059949 - RNA, 22 nt, Human
uguuuauucauggcuaaugaaa

SEQ ID NO: 1059950 - RNA, 17 nt, Human
uccaggcauaucuccua

SEQ ID NO: 1059951 - RNA, 20 nt, Human
gcaggcuccgggcuugggag

SEQ ID NO: 1059952 - RNA, 22 nt, Human
cucauuaaaggaaaucaccugc

SEQ ID NO: 1059953 - RNA, 22 nt, Human
ccaggccugugcaaggagggag

SEQ ID NO: 1059954 - RNA, 22 nt, Human
agggccccauagucacugcccg

SEQ ID NO: 1059955 - RNA, 22 nt, Human
aguaugaauacagauuuucucu

SEQ ID NO: 1059956 - RNA, 22 nt, Human
uuguaugaucaaaagaaaugua

SEQ ID NO: 1059957 - RNA, 22 nt, Human
cagggcucccucuggcucccag

SEQ ID NO: 1059958 - RNA, 22 nt, Human
aguaugaaucuuucagaccgua

SEQ ID NO: 1059959 - RNA, 21 nt, Human
gggagggauggaaaugauguu

SEQ ID NO: 1059960 - RNA, 22 nt, Human
ugggccaggcaugugaucagca

SEQ ID NO: 1059961 - RNA, 22 nt, Human
aauuagggaaaacauuugcuuu

SEQ ID NO: 1059962 - RNA, 19 nt, Human
ccuuccuccccagggccau

SEQ ID NO: 1059963 - RNA, 21 nt, Human
ugcaggcugugcgcuccugcc

SEQ ID NO: 1059964 - RNA, 22 nt, Human
cucuuaaagcuuccaguuucaa

SEQ ID NO: 1059965 - RNA, 22 nt, Human
acuggcagagacccugauggcc

SEQ ID NO: 1059966 - RNA, 22 nt, Human
acaggcucucuauugagugcag

SEQ ID NO: 1059967 - RNA, 22 nt, Human
cauaauaucuccgauuacuugc

SEQ ID NO: 1059968 - RNA, 22 nt, Human
auccaagucagggauaguuuga

SEQ ID NO: 1059969 - RNA, 22 nt, Human
aguuuucuguucuacaauuuga

SEQ ID NO: 1059970 - RNA, 22 nt, Human
aggaccauccuaagguaggcaa

SEQ ID NO: 1059971 - RNA, 22 nt, Human
cacaucagguagaccuacagag

SEQ ID NO: 1059972 - RNA, 21 nt, Human
ccacuguagacucauucugag

SEQ ID NO: 1059973 - RNA, 19 nt, Human
agaggccucagcagcuggc

SEQ ID NO: 1059974 - RNA, 19 nt, Human
ggcauccagaacuaccagu

SEQ ID NO: 1059975 - RNA, 19 nt, Human
cccagcuugaccaccugcu

SEQ ID NO: 1059976 - RNA, 22 nt, Human
cccagcuugcgggcggcaggag

SEQ ID NO: 1059977 - RNA, 22 nt, Human
cacccacauggaaauucacagu

SEQ ID NO: 1059978 - RNA, 22 nt, Human
guauuaggagguggagccuuug

SEQ ID NO: 1059979 - RNA, 22 nt, Human
uuaauuuuaaccuguuuguguc

SEQ ID NO: 1059980 - RNA, 22 nt, Human
uacagcauguccuuagcaaggc

SEQ ID NO: 1059981 - RNA, 20 nt, Human
auacacauauucuugcaacu

SEQ ID NO: 1059982 - RNA, 22 nt, Human
ugcuuuauuuauaaaauagcaa

SEQ ID NO: 1059983 - RNA, 22 nt, Human
uucugucaaagacuuuuucagg

SEQ ID NO: 1059984 - RNA, 22 nt, Human
uuguaugagcuccaggaacuca

SEQ ID NO: 1059985 - RNA, 22 nt, Human
aauggcagaggcaaagauggua

SEQ ID NO: 1059986 - RNA, 22 nt, Human
auuuucauuuugcagggugaga

SEQ ID NO: 1059987 - RNA, 22 nt, Human
gcugggcuggaaggccaaggca

SEQ ID NO: 1059988 - RNA, 22 nt, Human
cuaauguaucauggcucucagc

SEQ ID NO: 1059989 - RNA, 23 nt, Human
cucccuggcccuugggagaccug

SEQ ID NO: 1059990 - RNA, 22 nt, Human
gcagcuuuaaucugaauaagua

SEQ ID NO: 1059991 - RNA, 22 nt, Human
gcuggcaggagaccauacccua

SEQ ID NO: 1059992 - RNA, 22 nt, Human
uccaggcucuaggcugcucucc

SEQ ID NO: 1059993 - RNA, 17 nt, Human
agguauaaaaugguagc

SEQ ID NO: 1059994 - RNA, 22 nt, Human
uagcuuuaaugaguugguaaga

SEQ ID NO: 1059995 - RNA, 22 nt, Human
uuaucacuuaugagcuuuuugc

SEQ ID NO: 1059996 - RNA, 22 nt, Human
augggcugacuaaugguaaacu

SEQ ID NO: 1059997 - RNA, 22 nt, Human
cuuaauuuaaaauaguucaggc

SEQ ID NO: 1059998 - RNA, 22 nt, Human
uguucauaucauuuugaaagcu

SEQ ID NO: 1059999 - RNA, 22 nt, Human
cuccugaggacuucuauugggu

SEQ ID NO: 1060000 - RNA, 22 nt, Human
ggaccugcauuuuaacaagauc

SEQ ID NO: 1060001 - RNA, 22 nt, Human
gagggcucuacucaccacccug

SEQ ID NO: 1060002 - RNA, 22 nt, Human
ugaguagagaauucagcuaagg

SEQ ID NO: 1060003 - RNA, 22 nt, Human
agagaguugaggaagcaacacu

SEQ ID NO: 1060004 - RNA, 22 nt, Human
uucaagauggccccagugagcc

SEQ ID NO: 1060005 - RNA, 22 nt, Human
ccuggcagcuaagugcuuugag

SEQ ID NO: 1060006 - RNA, 21 nt, Human
acaaacugaaaugaguuuccu

SEQ ID NO: 1060007 - RNA, 22 nt, Human
guacacacuauuuaaaguguuu

SEQ ID NO: 1060008 - RNA, 21 nt, Human
uucucuccauaugcccagccc

SEQ ID NO: 1060009 - RNA, 20 nt, Human
gaggccucagccucagcucc

SEQ ID NO: 1060010 - RNA, 22 nt, Human
uccuccuccucacagucaccug

SEQ ID NO: 1060011 - RNA, 22 nt, Human
gcagcuuucugggacagaaagg

SEQ ID NO: 1060012 - RNA, 22 nt, Human
gcuggaguuggcaaggcaugua

SEQ ID NO: 1060013 - RNA, 22 nt, Human
aauagauacuacuuagauguag

SEQ ID NO: 1060014 - RNA, 22 nt, Human
uuggcuucuugugaaaucugag

SEQ ID NO: 1060015 - RNA, 23 nt, Human
ccucucucccuguuuggcaaaua

SEQ ID NO: 1060016 - RNA, 22 nt, Human
uuccaagugaaaguagcuuugu

SEQ ID NO: 1060017 - RNA, 22 nt, Human
ggaggacaggggcugcagcaca

SEQ ID NO: 1060018 - RNA, 22 nt, Human
uguaugaaagaacaagggcuua

SEQ ID NO: 1060019 - RNA, 22 nt, Human
ugcccccuuuucuuguuacacu

SEQ ID NO: 1060020 - RNA, 22 nt, Human
aauucugugcaggcagagcuau

SEQ ID NO: 1060021 - RNA, 22 nt, Human
acagguggcuuauuggcugauu

SEQ ID NO: 1060022 - RNA, 22 nt, Human
cauccagggcagccauggccug

SEQ ID NO: 1060023 - RNA, 22 nt, Human
uguaugaaguuacugagccucu

SEQ ID NO: 1060024 - RNA, 22 nt, Human
ucauuugugugagugauuugac

SEQ ID NO: 1060025 - RNA, 22 nt, Human
cacacacucuuccuggcaccua

SEQ ID NO: 1060026 - RNA, 22 nt, Human
ugaagccaaucugccaggcaga

SEQ ID NO: 1060027 - RNA, 22 nt, Human
cccccaaaguuugcacggauaa

SEQ ID NO: 1060028 - RNA, 22 nt, Human
acucugaaugugcauguaaauc

SEQ ID NO: 1060029 - RNA, 22 nt, Human
gucugucaucugagauggagug

SEQ ID NO: 1060030 - RNA, 22 nt, Human
gaagcacugcauuucaagauca

SEQ ID NO: 1060031 - RNA, 22 nt, Human
cuccucuggguccugguggcca

SEQ ID NO: 1060032 - RNA, 22 nt, Human
ugagaaaugggucugcugaaga

SEQ ID NO: 1060033 - RNA, 22 nt, Human
agcaggugggaucaagcuggca

SEQ ID NO: 1060034 - RNA, 22 nt, Human
aggaccugcuaaugugccaagu

SEQ ID NO: 1060035 - RNA, 22 nt, Human
ugaaugauacagaauuauguag

SEQ ID NO: 1060036 - RNA, 22 nt, Human
ccagcuuuaucaagucugagcu

SEQ ID NO: 1060037 - RNA, 22 nt, Human
caguguggagggagagagccug

SEQ ID NO: 1060038 - RNA, 22 nt, Human
aagcuuuaaggaauuuuaugga

SEQ ID NO: 1060039 - RNA, 22 nt, Human
ugcagggaggccccgcagcccu

SEQ ID NO: 1060040 - RNA, 22 nt, Human
gaaauauuguacuggagauguu

SEQ ID NO: 1060041 - RNA, 22 nt, Human
cacugucccuguuuccuggaaa

SEQ ID NO: 1060042 - RNA, 22 nt, Human
uauucauaguaaacaaaagugg

SEQ ID NO: 1060043 - RNA, 22 nt, Human
gagauggccagugccaggacaa

SEQ ID NO: 1060044 - RNA, 22 nt, Human
agcuuuauauaaaagaguacau

SEQ ID NO: 1060045 - RNA, 22 nt, Human
cccucucucaggcugacagccu

SEQ ID NO: 1060046 - RNA, 22 nt, Human
gccugcagcaugcuaggucuug

SEQ ID NO: 1060047 - RNA, 22 nt, Human
uuuauacuccacucugcaagcg

SEQ ID NO: 1060048 - RNA, 22 nt, Human
cggcuggugucgggcacagcaa

SEQ ID NO: 1060049 - RNA, 22 nt, Human
cagugagggaagaucucagcac

SEQ ID NO: 1060050 - RNA, 22 nt, Human
uucccacaguguugaauccucu

SEQ ID NO: 1060051 - RNA, 22 nt, Human
acaauacuauuuucaguauccu

SEQ ID NO: 1060052 - RNA, 19 nt, Human
acauauguggauauacaug

SEQ ID NO: 1060053 - RNA, 22 nt, Human
acagcuuuucaauucugcugag

SEQ ID NO: 1060054 - RNA, 19 nt, Human
aggugagugugggaaaggg

SEQ ID NO: 1060055 - RNA, 22 nt, Human
uacccagcccaugccuaccuca

SEQ ID NO: 1060056 - RNA, 22 nt, Human
ugaacacauaaggcuuuccugu

SEQ ID NO: 1060057 - RNA, 22 nt, Human
ugaauaugugacuuugauuuca

SEQ ID NO: 1060058 - RNA, 20 nt, Human
cugaacacagaauaagcaca

SEQ ID NO: 1060059 - RNA, 19 nt, Human
gggguggcuggggcuccag

SEQ ID NO: 1060060 - RNA, 22 nt, Human
cuuacacagucuggcacuucuu

SEQ ID NO: 1060061 - RNA, 22 nt, Human
gagccugaugaaacaggcagac

SEQ ID NO: 1060062 - RNA, 22 nt, Human
uacccagcuccucagaagacca

SEQ ID NO: 1060063 - RNA, 22 nt, Human
uaugacaagguggaguaugagu

SEQ ID NO: 1060064 - RNA, 22 nt, Human
agcuuuaccugccuuggggcac

SEQ ID NO: 1060065 - RNA, 22 nt, Human
agcaggcuaaucuugcugaaca

SEQ ID NO: 1060066 - RNA, 19 nt, Human
guuucauuaagauaggaaa

SEQ ID NO: 1060067 - RNA, 22 nt, Human
aaaguguggucguucauuuugu

SEQ ID NO: 1060068 - RNA, 22 nt, Human
cuuaauuuuuguaguagaugga

SEQ ID NO: 1060069 - RNA, 22 nt, Human
uaauaguuaugguugguucuca

SEQ ID NO: 1060070 - RNA, 22 nt, Human
guccucugaaguugugcaaugc

SEQ ID NO: 1060071 - RNA, 22 nt, Human
auacuucuuugauguucacagg

SEQ ID NO: 1060072 - RNA, 22 nt, Human
aaggcuuuuguuccuauuuagu

SEQ ID NO: 1060073 - RNA, 22 nt, Human
cccugccuugggguccacaccg

SEQ ID NO: 1060074 - RNA, 22 nt, Human
acaggcagagaacucagccaga

SEQ ID NO: 1060075 - RNA, 22 nt, Human
ucacacaugcuaagccagagau

SEQ ID NO: 1060076 - RNA, 22 nt, Human
gcccagccuccaagcuccaagg

SEQ ID NO: 1060077 - RNA, 22 nt, Human
aaaguuguaauggaagaaaugc

SEQ ID NO: 1060078 - RNA, 22 nt, Human
ucacauaaauuauacaauuuca

SEQ ID NO: 1060079 - RNA, 22 nt, Human
uuucugaauaacucuaugauau

SEQ ID NO: 1060080 - RNA, 22 nt, Human
gcccggcagucacacacccagg

SEQ ID NO: 1060081 - RNA, 22 nt, Human
auacuguacgucccagauagga

SEQ ID NO: 1060082 - RNA, 22 nt, Human
uuaauuuuuauguauagugugu

SEQ ID NO: 1060083 - RNA, 22 nt, Human
gggcugacucugcacugagcca

SEQ ID NO: 1060084 - RNA, 22 nt, Human
augaaaauguacauguguauaa

SEQ ID NO: 1060085 - RNA, 22 nt, Human
uucugggggaauacagcuauga

SEQ ID NO: 1060086 - RNA, 22 nt, Human
guagggacaugccauuaucuca

SEQ ID NO: 1060087 - RNA, 20 nt, Human
gcuccccuucucugggccuc

SEQ ID NO: 1060088 - RNA, 22 nt, Human
uccugcagugugucuccugcac

SEQ ID NO: 1060089 - RNA, 22 nt, Human
uagcuuuaagaugagaugugga

SEQ ID NO: 1060090 - RNA, 22 nt, Human
aaacaucaauugcaucucccaa

SEQ ID NO: 1060091 - RNA, 22 nt, Human
gcccaggccggagagcagugcu

SEQ ID NO: 1060092 - RNA, 22 nt, Human
ugagggacucccggcccugcca

SEQ ID NO: 1060093 - RNA, 22 nt, Human
uacauguuuacuccaagucagg

SEQ ID NO: 1060094 - RNA, 22 nt, Human
auuguugggucucacuccuaga

SEQ ID NO: 1060095 - RNA, 22 nt, Human
caaaugcagauucaggaguucu

SEQ ID NO: 1060096 - RNA, 22 nt, Human
uggcagagagacucuccuugau

SEQ ID NO: 1060097 - RNA, 22 nt, Human
augugaaaaauuucuuauuaca

SEQ ID NO: 1060098 - RNA, 22 nt, Human
cacauaagaaaugaauaugaga

SEQ ID NO: 1060099 - RNA, 22 nt, Human
caauuucugggccucacacaag

SEQ ID NO: 1060100 - RNA, 22 nt, Human
cagugagguggauggauggccu

SEQ ID NO: 1060101 - RNA, 22 nt, Human
ccaggcucuguuccccgaggag

SEQ ID NO: 1060102 - RNA, 23 nt, Human
uccaggagcaugcuggcuggcga

SEQ ID NO: 1060103 - RNA, 22 nt, Human
ccaggcuccccaggaggcccuu

SEQ ID NO: 1060104 - RNA, 22 nt, Human
caggccucuuccaugcagcagc

SEQ ID NO: 1060105 - RNA, 22 nt, Human
ucagagaguuuucacuagggug

SEQ ID NO: 1060106 - RNA, 22 nt, Human
gggcaaaaccugggcaucauga

SEQ ID NO: 1060107 - RNA, 22 nt, Human
cagcuuuguggccuugaccucg

SEQ ID NO: 1060108 - RNA, 22 nt, Human
gcaggcucacucuguuuggcuc

SEQ ID NO: 1060109 - RNA, 22 nt, Human
uuugugcagauguauauuugug

SEQ ID NO: 1060110 - RNA, 22 nt, Human
cuccaguggcaaguccgggcgg

SEQ ID NO: 1060111 - RNA, 22 nt, Human
gccagccuucuguggccugcaa

SEQ ID NO: 1060112 - RNA, 22 nt, Human
agagggcugcugcacagugcuc

SEQ ID NO: 1060113 - RNA, 22 nt, Human
aagaugcagcuuuacaauaagg

SEQ ID NO: 1060114 - RNA, 22 nt, Human
ccagccucacuggcaucaccua

SEQ ID NO: 1060115 - RNA, 22 nt, Human
gggguggcccuacccucuggaa

SEQ ID NO: 1060116 - RNA, 22 nt, Human
agggcuccaggggaccaucagu

SEQ ID NO: 1060117 - RNA, 22 nt, Human
uuucugaacaaagccauuauca

SEQ ID NO: 1060118 - RNA, 22 nt, Human
uuauucagucugucuagggagu

SEQ ID NO: 1060119 - RNA, 22 nt, Human
ccuucucucugaagaccccaaa

SEQ ID NO: 1060120 - RNA, 17 nt, Human
cucugggcagccugggg

SEQ ID NO: 1060121 - RNA, 19 nt, Human
ggcaggcuggauagagagg

SEQ ID NO: 1060122 - RNA, 22 nt, Human
cuggcagucugguggaaggccu

SEQ ID NO: 1060123 - RNA, 22 nt, Human
gccuggcaaggcccuguugacu

SEQ ID NO: 1060124 - RNA, 22 nt, Human
ccugggcuugguuguugagaac

SEQ ID NO: 1060125 - RNA, 22 nt, Human
acccagcuaacccuacccugga

SEQ ID NO: 1060126 - RNA, 22 nt, Human
uucauaguguuuccuuccagug

SEQ ID NO: 1060127 - RNA, 22 nt, Human
cuguaugaggaucagacuggac

SEQ ID NO: 1060128 - RNA, 22 nt, Human
aggcuggauuuauggggacuuc

SEQ ID NO: 1060129 - RNA, 22 nt, Human
cagggcucacucggcuggcguc

SEQ ID NO: 1060130 - RNA, 20 nt, Human
guauuaggagguaaauguaa

SEQ ID NO: 1060131 - RNA, 22 nt, Human
cagaggcucagauggcccuggc

SEQ ID NO: 1060132 - RNA, 22 nt, Human
uucauacacgaaaaugcaugca

SEQ ID NO: 1060133 - RNA, 22 nt, Human
uucuagaggggagauacuagua

SEQ ID NO: 1060134 - RNA, 22 nt, Human
ucuucauauauaaaguggaaua

SEQ ID NO: 1060135 - RNA, 22 nt, Human
acuuaaaaacagauccagcagg

SEQ ID NO: 1060136 - RNA, 22 nt, Human
ugaaugauguauaauauugaga

SEQ ID NO: 1060137 - RNA, 22 nt, Human
aaggcuuucagcuaacuugauu

SEQ ID NO: 1060138 - RNA, 22 nt, Human
ggcuccacugcugaccacucca

SEQ ID NO: 1060139 - RNA, 22 nt, Human
uuggaaagauuauuauuaugaa

SEQ ID NO: 1060140 - RNA, 22 nt, Human
gagccucguggcggccacugcg

SEQ ID NO: 1060141 - RNA, 22 nt, Human
uucugucuguaaacuucucaau

SEQ ID NO: 1060142 - RNA, 20 nt, Human
cccagccccuaccuguugcc

SEQ ID NO: 1060143 - RNA, 22 nt, Human
auucugucauuucaagaaaaac

SEQ ID NO: 1060144 - RNA, 22 nt, Human
uggaagagaaaauccacccuua

SEQ ID NO: 1060145 - RNA, 22 nt, Human
ucauaaaucauacuccauuugc

SEQ ID NO: 1060146 - RNA, 22 nt, Human
uacccaggaggaaacugaggcu

SEQ ID NO: 1060147 - RNA, 22 nt, Human
gcuggcagugugaaugacaagc

SEQ ID NO: 1060148 - RNA, 22 nt, Human
acacuaauuaagcugcuuuacu

SEQ ID NO: 1060149 - RNA, 22 nt, Human
aguguuugucccguuagaaaug

SEQ ID NO: 1060150 - RNA, 18 nt, Human
ucagagagaauaguaauu

SEQ ID NO: 1060151 - RNA, 22 nt, Human
ucccagccuccugacaguuuug

SEQ ID NO: 1060152 - RNA, 22 nt, Human
cagggcucagggacugcagaaa

SEQ ID NO: 1060153 - RNA, 22 nt, Human
acagugugguuugagcacuggg

SEQ ID NO: 1060154 - RNA, 22 nt, Human
aaguuucauuguucauguaaca

SEQ ID NO: 1060155 - RNA, 23 nt, Human
cccugcagucagggugagauggu

SEQ ID NO: 1060156 - RNA, 17 nt, Human
gcaucacagauaacacg

SEQ ID NO: 1060157 - RNA, 22 nt, Human
cauuuacacuucuaaccacaag

SEQ ID NO: 1060158 - RNA, 22 nt, Human
cucuggggaagcagccagcugg

SEQ ID NO: 1060159 - RNA, 21 nt, Human
aaagagcccgcugagagguuc

SEQ ID NO: 1060160 - RNA, 22 nt, Human
agcaggcugagcacccaggggg

SEQ ID NO: 1060161 - RNA, 22 nt, Human
cagacccugggccacagaggag

SEQ ID NO: 1060162 - RNA, 22 nt, Human
uguauaaaccauggacagcuuu

SEQ ID NO: 1060163 - RNA, 22 nt, Human
augugcaaauccaaugugaaug

SEQ ID NO: 1060164 - RNA, 22 nt, Human
ucaggcccuucucccaggacuc

SEQ ID NO: 1060165 - RNA, 22 nt, Human
gcauccaaaccauucaucagcc

SEQ ID NO: 1060166 - RNA, 22 nt, Human
aauacugccugugagguaacuc

SEQ ID NO: 1060167 - RNA, 22 nt, Human
uucagagaagcaaaggcagauu

SEQ ID NO: 1060168 - RNA, 22 nt, Human
auguaugaagcuuuguuuggga

SEQ ID NO: 1060169 - RNA, 22 nt, Human
gaauauuuguaauuacuguuga

SEQ ID NO: 1060170 - RNA, 22 nt, Human
acuguccauucacucauauuca

SEQ ID NO: 1060171 - RNA, 22 nt, Human
guccaguguguuuaucuuggau

SEQ ID NO: 1060172 - RNA, 16 nt, Human
ccugggcucuguugga

SEQ ID NO: 1060173 - RNA, 22 nt, Human
ggcagggaagcuggcaucacgg

SEQ ID NO: 1060174 - RNA, 22 nt, Human
auguagaaauuaggaugauagu

SEQ ID NO: 1060175 - RNA, 22 nt, Human
ugcuucugggccugguguuccc

SEQ ID NO: 1060176 - RNA, 22 nt, Human
aaguccaguuucauuugagguc

SEQ ID NO: 1060177 - RNA, 22 nt, Human
uuuaugaacuacagauauaacu

SEQ ID NO: 1060178 - RNA, 22 nt, Human
ugucagaugcgauaaacuagug

SEQ ID NO: 1060179 - RNA, 22 nt, Human
guccucuggagguuuuuaggug

SEQ ID NO: 1060180 - RNA, 22 nt, Human
aacaguaaaaaucauuuaguug

SEQ ID NO: 1060181 - RNA, 20 nt, Human
auuuggcaugaaguauugau

SEQ ID NO: 1060182 - RNA, 18 nt, Human
ugcaggcuguugaaacug

SEQ ID NO: 1060183 - RNA, 22 nt, Human
ucuuuauuucugaaucccccau

SEQ ID NO: 1060184 - RNA, 22 nt, Human
ccugggcucaggcuugggcagc

SEQ ID NO: 1060185 - RNA, 22 nt, Human
ugcuuuauaacuuaguuuaugg

SEQ ID NO: 1060186 - RNA, 22 nt, Human
ccugggcucugucagaauuggg

SEQ ID NO: 1060187 - RNA, 22 nt, Human
ugaaugaugcaguauaaugaua

SEQ ID NO: 1060188 - RNA, 22 nt, Human
gccaggcagccacccucugcga

SEQ ID NO: 1060189 - RNA, 22 nt, Human
uggcgucucucauaaguaugug

SEQ ID NO: 1060190 - RNA, 22 nt, Human
gggaccuggggacuccuuguuc

SEQ ID NO: 1060191 - RNA, 22 nt, Human
uuucuuucaauucuccuaaugc

SEQ ID NO: 1060192 - RNA, 22 nt, Human
gcuggggagaauuggguuaucu

SEQ ID NO: 1060193 - RNA, 22 nt, Human
acacacagaguuuauacaggca

SEQ ID NO: 1060194 - RNA, 21 nt, Human
agccugcaauguagguaccgg

SEQ ID NO: 1060195 - RNA, 22 nt, Human
ggccucagagaaggcugugcgg

SEQ ID NO: 1060196 - RNA, 22 nt, Human
gggcucucaugaguguguggua

SEQ ID NO: 1060197 - RNA, 23 nt, Human
uaaauuaccuuuccagugcaggg

SEQ ID NO: 1060198 - RNA, 22 nt, Human
ugcuucugucucuuaugccuug

SEQ ID NO: 1060199 - RNA, 22 nt, Human
uacaaagucagaauaacaggug

SEQ ID NO: 1060200 - RNA, 20 nt, Human
ggccucaguguccuuguuug

SEQ ID NO: 1060201 - RNA, 23 nt, Human
uuaggcacuuaguagggccagag

SEQ ID NO: 1060202 - RNA, 22 nt, Human
cuuucucaaugccggaaggcac

SEQ ID NO: 1060203 - RNA, 22 nt, Human
ccagagagaaauggauuugagu

SEQ ID NO: 1060204 - RNA, 22 nt, Human
cuaaaauuaccuaccaguuuag

SEQ ID NO: 1060205 - RNA, 22 nt, Human
guccucugagggggcugcacgc

SEQ ID NO: 1060206 - RNA, 22 nt, Human
acccagcuggaugcauggaggc

SEQ ID NO: 1060207 - RNA, 22 nt, Human
ucuggcagggguucugcacuug

SEQ ID NO: 1060208 - RNA, 21 nt, Human
cagaggcaggcucugugugug

SEQ ID NO: 1060209 - RNA, 20 nt, Human
uggaccugucucuuuaggga

SEQ ID NO: 1060210 - RNA, 22 nt, Human
agacaagaaacugggagucucu

SEQ ID NO: 1060211 - RNA, 22 nt, Human
aaagcagggaugaggcuagagg

SEQ ID NO: 1060212 - RNA, 22 nt, Human
gcagcuuucuacuuccuacagc

SEQ ID NO: 1060213 - RNA, 22 nt, Human
cagccucugacaccacagucgu

SEQ ID NO: 1060214 - RNA, 22 nt, Human
agucccuucucaaagugugcgg

SEQ ID NO: 1060215 - RNA, 22 nt, Human
ucuccaggccuuucccaucuua

SEQ ID NO: 1060216 - RNA, 22 nt, Human
ggguuccuccaguuccuagagc

SEQ ID NO: 1060217 - RNA, 22 nt, Human
uucugucagaagcuagcuccug

SEQ ID NO: 1060218 - RNA, 22 nt, Human
ggcugaguugagaggauuacuu

SEQ ID NO: 1060219 - RNA, 22 nt, Human
gaacacauuagucugaguuggc

SEQ ID NO: 1060220 - RNA, 22 nt, Human
gggaccugccaaggccacccag

SEQ ID NO: 1060221 - RNA, 22 nt, Human
aaauccuaccaagaaauucccu

SEQ ID NO: 1060222 - RNA, 22 nt, Human
ucacuguauuuggaagggaugg

SEQ ID NO: 1060223 - RNA, 22 nt, Human
ugccugccaugcagaaagcuga

SEQ ID NO: 1060224 - RNA, 22 nt, Human
cacacucauuagucauuucucu

SEQ ID NO: 1060225 - RNA, 22 nt, Human
cagcuauuuucucauuaaggau

SEQ ID NO: 1060226 - RNA, 23 nt, Human
uggccaggguacuacacccaccc

SEQ ID NO: 1060227 - RNA, 22 nt, Human
acuuugcagggcuugauaucca

SEQ ID NO: 1060228 - RNA, 22 nt, Human
guuaugaaauaaauauagauca

SEQ ID NO: 1060229 - RNA, 19 nt, Human
cugcagggaugugcagagu

SEQ ID NO: 1060230 - RNA, 22 nt, Human
cagggcuccaugcagggacucc

SEQ ID NO: 1060231 - RNA, 22 nt, Human
ucaagagaaggggaaauagacu

SEQ ID NO: 1060232 - RNA, 22 nt, Human
gggaccugaggagggguuucag

SEQ ID NO: 1060233 - RNA, 22 nt, Human
cugcagggagaggggacagccu

SEQ ID NO: 1060234 - RNA, 22 nt, Human
ucuggcagaucuucccacguuu

SEQ ID NO: 1060235 - RNA, 22 nt, Human
uuauucuucuucucuugccagg

SEQ ID NO: 1060236 - RNA, 19 nt, Human
cucuuaaauugucucuugc

SEQ ID NO: 1060237 - RNA, 22 nt, Human
gccagggaaacugcagaccagc

SEQ ID NO: 1060238 - RNA, 17 nt, Human
ugccagccugucccagg

SEQ ID NO: 1060239 - RNA, 22 nt, Human
cccaggacucuucacugcagcc

SEQ ID NO: 1060240 - RNA, 22 nt, Human
auaauucagguuuucuggcaca

SEQ ID NO: 1060241 - RNA, 22 nt, Human
auaugaagaaucuaggauaggc

SEQ ID NO: 1060242 - RNA, 22 nt, Human
acuggggagagucaugccagca

SEQ ID NO: 1060243 - RNA, 22 nt, Human
gcaggcucccuugcagagcagg

SEQ ID NO: 1060244 - RNA, 22 nt, Human
gggucuccauguuaacaucacu

SEQ ID NO: 1060245 - RNA, 19 nt, Human
guccaguguuuuccaguca

SEQ ID NO: 1060246 - RNA, 22 nt, Human
acuaaauacacacauuuguuca

SEQ ID NO: 1060247 - RNA, 22 nt, Human
agcagguguauauaaggcugag

SEQ ID NO: 1060248 - RNA, 22 nt, Human
acagagagggagugauaaaucc

SEQ ID NO: 1060249 - RNA, 22 nt, Human
gccuggaagugugucgugggaa

SEQ ID NO: 1060250 - RNA, 22 nt, Human
uuucuuauacuauauugucauc

SEQ ID NO: 1060251 - RNA, 22 nt, Human
agauuugcggcuuuacuuugca

SEQ ID NO: 1060252 - RNA, 22 nt, Human
ugcuagaauuugcagaagcaua

SEQ ID NO: 1060253 - RNA, 22 nt, Human
agguauauauucugguccuuau

SEQ ID NO: 1060254 - RNA, 22 nt, Human
gaaauauugggacucagagcuu

SEQ ID NO: 1060255 - RNA, 22 nt, Human
agacuucuuugugagcauuuuc

SEQ ID NO: 1060256 - RNA, 22 nt, Human
guguaugagccuccagcugggc

SEQ ID NO: 1060257 - RNA, 22 nt, Human
auccaggcgaaugcagaaggcc

SEQ ID NO: 1060258 - RNA, 22 nt, Human
uuucuugaccacuauguugaua

SEQ ID NO: 1060259 - RNA, 22 nt, Human
aucccacaccccuacaacauau

SEQ ID NO: 1060260 - RNA, 22 nt, Human
ucugaacagaaaagaugcacaa

SEQ ID NO: 1060261 - RNA, 22 nt, Human
uucacauuugaaaggaaagaua

SEQ ID NO: 1060262 - RNA, 22 nt, Human
uugugaaauguuucaaaauagu

SEQ ID NO: 1060263 - RNA, 22 nt, Human
agccauccuacuaccucagcau

SEQ ID NO: 1060264 - RNA, 22 nt, Human
ucuggcagcaagucuguuucuc

SEQ ID NO: 1060265 - RNA, 22 nt, Human
ggaccugccagaacucaggcua

SEQ ID NO: 1060266 - RNA, 22 nt, Human
gcaggggcuaaggacacagaga

SEQ ID NO: 1060267 - RNA, 22 nt, Human
uccaagaugguugguguggugg

SEQ ID NO: 1060268 - RNA, 20 nt, Human
aauuuacucacagaaugaau

SEQ ID NO: 1060269 - RNA, 22 nt, Human
auuuucaugacuaccuuaaaua

SEQ ID NO: 1060270 - RNA, 22 nt, Human
ucauuuauaaggaugcaauuaa

SEQ ID NO: 1060271 - RNA, 21 nt, Human
uuucugaaggcaacaucuauc

SEQ ID NO: 1060272 - RNA, 22 nt, Human
cuuacaaaggagaggagauagg

SEQ ID NO: 1060273 - RNA, 22 nt, Human
agagggcaugcuugguggccug

SEQ ID NO: 1060274 - RNA, 22 nt, Human
uuucaaaccuacuuguauguuu

SEQ ID NO: 1060275 - RNA, 21 nt, Human
ucuggcaguggucuuucaaau

SEQ ID NO: 1060276 - RNA, 22 nt, Human
ugggcacuguagcuggugcugg

SEQ ID NO: 1060277 - RNA, 22 nt, Human
uugaauuauaagugugucuacu

SEQ ID NO: 1060278 - RNA, 22 nt, Human
auuuagacuucccagcacugug

SEQ ID NO: 1060279 - RNA, 22 nt, Human
auccugugcaaugacugcaucu

SEQ ID NO: 1060280 - RNA, 22 nt, Human
aagagagaacucccuucgccag

SEQ ID NO: 1060281 - RNA, 22 nt, Human
uccugcagacauuuacaccuuu

SEQ ID NO: 1060282 - RNA, 23 nt, Human
gcugacugugaaauucuggagcu

SEQ ID NO: 1060283 - RNA, 21 nt, Human
cagugagguccccagccuagg

SEQ ID NO: 1060284 - RNA, 22 nt, Human
aucugcuuuugagaauuuacuu

SEQ ID NO: 1060285 - RNA, 22 nt, Human
ccucucccgggugccgcugggc

SEQ ID NO: 1060286 - RNA, 21 nt, Human
aaaugaaugugguagugcaag

SEQ ID NO: 1060287 - RNA, 22 nt, Human
agacaucauguuacagauuaag

SEQ ID NO: 1060288 - RNA, 18 nt, Human
ugagaggcuauuuuuugc

SEQ ID NO: 1060289 - RNA, 22 nt, Human
aggcagcaauugaaaucauugu

SEQ ID NO: 1060290 - RNA, 22 nt, Human
auuguuaugaaaauaagauguu

SEQ ID NO: 1060291 - RNA, 22 nt, Human
gcuggcagaauuucuucuugcu

SEQ ID NO: 1060292 - RNA, 22 nt, Human
uuauuuucuccucagaaagugg

SEQ ID NO: 1060293 - RNA, 22 nt, Human
cuuaauuucaaacugcuaguga

SEQ ID NO: 1060294 - RNA, 22 nt, Human
uuuuccuucuagagcagauuuc

SEQ ID NO: 1060295 - RNA, 22 nt, Human
caaaguuuuaguaaacauauau

SEQ ID NO: 1060296 - RNA, 22 nt, Human
acuccugggugcugaccagcgu

SEQ ID NO: 1060297 - RNA, 22 nt, Human
gugccaaaagcuauaauuuggu

SEQ ID NO: 1060298 - RNA, 22 nt, Human
cagcucuuugaguauuccauuu

SEQ ID NO: 1060299 - RNA, 22 nt, Human
aaauaguuguuuggaucaauaa

SEQ ID NO: 1060300 - RNA, 22 nt, Human
uguagaaacuacacaugcaaca

SEQ ID NO: 1060301 - RNA, 22 nt, Human
cugggagggguagccaauccua

SEQ ID NO: 1060302 - RNA, 22 nt, Human
gcacaggaugauggguugaggg

SEQ ID NO: 1060303 - RNA, 20 nt, Human
uccugcagucgcuagcgccc

SEQ ID NO: 1060304 - RNA, 22 nt, Human
uuaaauuccagccucauaauag

SEQ ID NO: 1060305 - RNA, 22 nt, Human
cuucuuaacuguauauacuaug

SEQ ID NO: 1060306 - RNA, 22 nt, Human
ccaggcucugccaggcccuuga

SEQ ID NO: 1060307 - RNA, 22 nt, Human
uccugagccugacaaucaccau

SEQ ID NO: 1060308 - RNA, 22 nt, Human
acugugauguucucuaucuugg

SEQ ID NO: 1060309 - RNA, 22 nt, Human
acacccaggcuggcgugcagug

SEQ ID NO: 1060310 - RNA, 22 nt, Human
cccacccugggcuacacaucca

SEQ ID NO: 1060311 - RNA, 22 nt, Human
uccaggcauagaaggcacgcac

SEQ ID NO: 1060312 - RNA, 19 nt, Human
uccuggcauuuguaggaaa

SEQ ID NO: 1060313 - RNA, 22 nt, Human
auuaaauuggacgcugggggaa

SEQ ID NO: 1060314 - RNA, 22 nt, Human
ccuggcagcuccguggccuucc

SEQ ID NO: 1060315 - RNA, 22 nt, Human
ucagcauaucuugagcuucaug

SEQ ID NO: 1060316 - RNA, 22 nt, Human
auaugcaagcacauagaauacu

SEQ ID NO: 1060317 - RNA, 22 nt, Human
agggcugacaaauggcagugac

SEQ ID NO: 1060318 - RNA, 22 nt, Human
caggagggcccgagacucuucc

SEQ ID NO: 1060319 - RNA, 22 nt, Human
acaugauuaaaagauuuuaaag

SEQ ID NO: 1060320 - RNA, 19 nt, Human
acauucccaucagcaaugu

SEQ ID NO: 1060321 - RNA, 22 nt, Human
gcuccaggagagggaagcagau

SEQ ID NO: 1060322 - RNA, 22 nt, Human
uguacaaagguacuuugauguu

SEQ ID NO: 1060323 - RNA, 22 nt, Human
gcagggcucaacaggacacccc

SEQ ID NO: 1060324 - RNA, 22 nt, Human
ucuggcaggacaugcugaccau

SEQ ID NO: 1060325 - RNA, 22 nt, Human
gcuccaggugucccagguaaaa

SEQ ID NO: 1060326 - RNA, 21 nt, Human
uuuagggaggauauuuaacuu

SEQ ID NO: 1060327 - RNA, 22 nt, Human
gugggcuggauuugcuugcaga

SEQ ID NO: 1060328 - RNA, 22 nt, Human
guauuaggugguggaauuguag

SEQ ID NO: 1060329 - RNA, 22 nt, Human
cauuacaaccccaaauuacaaa

SEQ ID NO: 1060330 - RNA, 22 nt, Human
aaagaucaaguaggcauggccu

SEQ ID NO: 1060331 - RNA, 22 nt, Human
ccuggcagacagcacugaagcu

SEQ ID NO: 1060332 - RNA, 22 nt, Human
gggaccugggccagaggacagu

SEQ ID NO: 1060333 - RNA, 22 nt, Human
gcaguguuaggaauaaaaauga

SEQ ID NO: 1060334 - RNA, 21 nt, Human
acagauauuucauugaacauu

SEQ ID NO: 1060335 - RNA, 22 nt, Human
aaccugcaguuuuuauucugag

SEQ ID NO: 1060336 - RNA, 22 nt, Human
caggaguggugugagggacucc

SEQ ID NO: 1060337 - RNA, 20 nt, Human
ugccuggccuuucucugccc

SEQ ID NO: 1060338 - RNA, 22 nt, Human
cugccucuauaggaguccacca

SEQ ID NO: 1060339 - RNA, 22 nt, Human
uuacaagauaaccugaugcugu

SEQ ID NO: 1060340 - RNA, 22 nt, Human
agggcucccgugaggugacugc

SEQ ID NO: 1060341 - RNA, 22 nt, Human
uccaggcaguuuuccagguugu

SEQ ID NO: 1060342 - RNA, 22 nt, Human
acuggcagcuguaggaugcaug

SEQ ID NO: 1060343 - RNA, 22 nt, Human
uuauauaucuugauuuguucca

SEQ ID NO: 1060344 - RNA, 22 nt, Human
uaaaguuuggcagacaauaaca

SEQ ID NO: 1060345 - RNA, 21 nt, Human
ccagagagagggaaguggguu

SEQ ID NO: 1060346 - RNA, 22 nt, Human
aggaccuggaucacagagaucu

SEQ ID NO: 1060347 - RNA, 22 nt, Human
aaaaaucuaugacugcuucucc

SEQ ID NO: 1060348 - RNA, 22 nt, Human
agagacaggguuuugucguguu

SEQ ID NO: 1060349 - RNA, 22 nt, Human
auggccuggggauuccugagca

SEQ ID NO: 1060350 - RNA, 22 nt, Human
aaacacagauuucuuuguccca

SEQ ID NO: 1060351 - RNA, 22 nt, Human
acaggcacugucaagucaugaa

SEQ ID NO: 1060352 - RNA, 16 nt, Human
gcagggguggguggag

SEQ ID NO: 1060353 - RNA, 22 nt, Human
ugcuuuauaggggauugcaggc

SEQ ID NO: 1060354 - RNA, 22 nt, Human
auucacaguuuccucauauucu

SEQ ID NO: 1060355 - RNA, 22 nt, Human
uagcuuuaauaagcugcugaau

SEQ ID NO: 1060356 - RNA, 22 nt, Human
cugggcugcaguuccugguccu

SEQ ID NO: 1060357 - RNA, 22 nt, Human
gcacacauucggauucuuaacc

SEQ ID NO: 1060358 - RNA, 22 nt, Human
caugaagcccucaucagucuga

SEQ ID NO: 1060359 - RNA, 22 nt, Human
uccaaguugauguuucuuaaau

SEQ ID NO: 1060360 - RNA, 22 nt, Human
auauauuuacucuccuguugca

SEQ ID NO: 1060361 - RNA, 22 nt, Human
gaaucauuggaaccacauccaa

SEQ ID NO: 1060362 - RNA, 22 nt, Human
ggccucagaggaggugugaguc

SEQ ID NO: 1060363 - RNA, 22 nt, Human
ugacaaaacugcaauuacuuuu

SEQ ID NO: 1060364 - RNA, 22 nt, Human
ugcuucugaaaugcaggucuuc

SEQ ID NO: 1060365 - RNA, 22 nt, Human
ucacacagcuccuuuccuuagu

SEQ ID NO: 1060366 - RNA, 22 nt, Human
gugcuaggauuacaggcauggg

SEQ ID NO: 1060367 - RNA, 22 nt, Human
aggugaguuacaggaggagguc

SEQ ID NO: 1060368 - RNA, 22 nt, Human
ggagagaauuccauggacaugu

SEQ ID NO: 1060369 - RNA, 22 nt, Human
uaugcauacaaugagauauucc

SEQ ID NO: 1060370 - RNA, 22 nt, Human
ugucagagagcaggcaguagaa

SEQ ID NO: 1060371 - RNA, 22 nt, Human
cuccaagucggcugcagcugga

SEQ ID NO: 1060372 - RNA, 18 nt, Human
cauaauuuucuuucuuua

SEQ ID NO: 1060373 - RNA, 22 nt, Human
agcauucauugcuagaauguaa

SEQ ID NO: 1060374 - RNA, 22 nt, Human
ugcagggauuagaggccgggga

SEQ ID NO: 1060375 - RNA, 22 nt, Human
uccaagcuguauguuccuagag

SEQ ID NO: 1060376 - RNA, 22 nt, Human
ugaaaaaccucaguccgcuuua

SEQ ID NO: 1060377 - RNA, 22 nt, Human
acaauguaggauauguacuugu

SEQ ID NO: 1060378 - RNA, 22 nt, Human
guccucugggcagcugccccac

SEQ ID NO: 1060379 - RNA, 21 nt, Human
aggcugcuggcucaggguccu

SEQ ID NO: 1060380 - RNA, 22 nt, Human
guuagggagggugcauaugugu

SEQ ID NO: 1060381 - RNA, 22 nt, Human
accaggcagagcugggccuuaa

SEQ ID NO: 1060382 - RNA, 22 nt, Human
auauacuuggagacuaucauug

SEQ ID NO: 1060383 - RNA, 22 nt, Human
uguaugaauauguuggggaggu

SEQ ID NO: 1060384 - RNA, 22 nt, Human
ugcuuuauguggcugauacuca

SEQ ID NO: 1060385 - RNA, 22 nt, Human
aaagaauagccuuuguccaaau

SEQ ID NO: 1060386 - RNA, 17 nt, Human
gcuaggagagggaggag

SEQ ID NO: 1060387 - RNA, 22 nt, Human
cugggagaggaaccucgagggu

SEQ ID NO: 1060388 - RNA, 22 nt, Human
cagagccuuccuagcagacucu

SEQ ID NO: 1060389 - RNA, 22 nt, Human
uguaaagaaagacgcagaguua

SEQ ID NO: 1060390 - RNA, 22 nt, Human
cccaggcacucuuggucauuuu

SEQ ID NO: 1060391 - RNA, 22 nt, Human
ucccaaggugcucggcaacagg

SEQ ID NO: 1060392 - RNA, 22 nt, Human
auggcagagggauugaacagcu

SEQ ID NO: 1060393 - RNA, 22 nt, Human
agcaggcuaggaaccucacugc

SEQ ID NO: 1060394 - RNA, 20 nt, Human
agccugccagcuggcccaga

SEQ ID NO: 1060395 - RNA, 22 nt, Human
auuauuaggugcucucugacaa

SEQ ID NO: 1060396 - RNA, 22 nt, Human
aaacuucagugaaugacuuaug

SEQ ID NO: 1060397 - RNA, 22 nt, Human
ucauuuguucaucugcucuucu

SEQ ID NO: 1060398 - RNA, 22 nt, Human
ggaccugcccuggcucagaugc

SEQ ID NO: 1060399 - RNA, 22 nt, Human
uaacuuucuucauaugugaacc

SEQ ID NO: 1060400 - RNA, 22 nt, Human
aaguuucaaauguugauuaugc

SEQ ID NO: 1060401 - RNA, 22 nt, Human
cauuguuaccaucuuuuaccua

SEQ ID NO: 1060402 - RNA, 22 nt, Human
cuuucacacacauacauuugga

SEQ ID NO: 1060403 - RNA, 22 nt, Human
ccagagagaguacugggcucug

SEQ ID NO: 1060404 - RNA, 22 nt, Human
gggucaggcucagcagggcagc

SEQ ID NO: 1060405 - RNA, 22 nt, Human
gccuggcaggccuguuggggcu

SEQ ID NO: 1060406 - RNA, 20 nt, Human
cucuuuugacucuuugcaag

SEQ ID NO: 1060407 - RNA, 22 nt, Human
gcuggcagagacaagaagacua

SEQ ID NO: 1060408 - RNA, 22 nt, Human
gugagagggcugggcucaugau

SEQ ID NO: 1060409 - RNA, 22 nt, Human
auucucaguucacuaguuucuu

SEQ ID NO: 1060410 - RNA, 22 nt, Human
aaucacaugugcucaauuuuaa

SEQ ID NO: 1060411 - RNA, 22 nt, Human
ggcugcagagcugggugggccu

SEQ ID NO: 1060412 - RNA, 22 nt, Human
uacaaaguaauguauaauaucg

SEQ ID NO: 1060413 - RNA, 22 nt, Human
agggcuccuccccggccuccac

SEQ ID NO: 1060414 - RNA, 22 nt, Human
aguaugaaaguuaaucaauuua

SEQ ID NO: 1060415 - RNA, 22 nt, Human
uccaggagguagugcuuaauuu

SEQ ID NO: 1060416 - RNA, 22 nt, Human
uuguaugaggauagcaagaagc

SEQ ID NO: 1060417 - RNA, 22 nt, Human
guauuagguuggugcaaaauug

SEQ ID NO: 1060418 - RNA, 22 nt, Human
cccugcaggggaccugcagccu

SEQ ID NO: 1060419 - RNA, 22 nt, Human
agggcuccgggcaggcgaugga

SEQ ID NO: 1060420 - RNA, 22 nt, Human
ugcaggcugcaccccugcccug

SEQ ID NO: 1060421 - RNA, 22 nt, Human
ucaaucacguguuccauguucu

SEQ ID NO: 1060422 - RNA, 22 nt, Human
uagaaacagaaaacuguaauag

SEQ ID NO: 1060423 - RNA, 22 nt, Human
ccaggcuccucaugaucuuguu

SEQ ID NO: 1060424 - RNA, 22 nt, Human
gucacaggccuggaugaggggc

SEQ ID NO: 1060425 - RNA, 19 nt, Human
ccuugccugucccugcagc

SEQ ID NO: 1060426 - RNA, 22 nt, Human
aaagacuuggcuuaugauuugc

SEQ ID NO: 1060427 - RNA, 22 nt, Human
cuggccucagagggucauggug

SEQ ID NO: 1060428 - RNA, 22 nt, Human
ucuggcagugagcaacuugaca

SEQ ID NO: 1060429 - RNA, 18 nt, Human
uuuuacucauagcaggcc

SEQ ID NO: 1060430 - RNA, 22 nt, Human
ccaaguacucucaccaaagcuu

SEQ ID NO: 1060431 - RNA, 22 nt, Human
ugagaauuuuuugucaugcauu

SEQ ID NO: 1060432 - RNA, 22 nt, Human
ggggaccuaggcucugucucuu

SEQ ID NO: 1060433 - RNA, 22 nt, Human
gggcugacagcacgccuucugu

SEQ ID NO: 1060434 - RNA, 22 nt, Human
cgcaggcuccggggugcccugg

SEQ ID NO: 1060435 - RNA, 22 nt, Human
ucuggcagcucuccucggcgga

SEQ ID NO: 1060436 - RNA, 22 nt, Human
aaacaaacauagguuugaaagu

SEQ ID NO: 1060437 - RNA, 22 nt, Human
acagguggccccgagggagugg

SEQ ID NO: 1060438 - RNA, 20 nt, Human
caccacagaauuggggacag

SEQ ID NO: 1060439 - RNA, 22 nt, Human
uccugagcccuguaggacccug

SEQ ID NO: 1060440 - RNA, 22 nt, Human
gcaggcucguuggaaguccccu

SEQ ID NO: 1060441 - RNA, 22 nt, Human
ccacacagggggaugaguuauu

SEQ ID NO: 1060442 - RNA, 22 nt, Human
cuauugaauuaacuauuaaagu

SEQ ID NO: 1060443 - RNA, 17 nt, Human
aggccucccuccaggcc

SEQ ID NO: 1060444 - RNA, 22 nt, Human
aguaugaagaauacauagauga

SEQ ID NO: 1060445 - RNA, 22 nt, Human
ggagcugaguucuucagccggg

SEQ ID NO: 1060446 - RNA, 22 nt, Human
gagccaccuucaacucaggaau

SEQ ID NO: 1060447 - RNA, 22 nt, Human
cccugagcgugaggaggaagua

SEQ ID NO: 1060448 - RNA, 22 nt, Human
aggguagggcccggagacagac

SEQ ID NO: 1060449 - RNA, 21 nt, Human
aaauuucugcaagccucaacu

SEQ ID NO: 1060450 - RNA, 22 nt, Human
gcuggggagcuagaccucagca

SEQ ID NO: 1060451 - RNA, 22 nt, Human
aaaguuugaaugauauauuagu

SEQ ID NO: 1060452 - RNA, 22 nt, Human
caucacagggggcuagaagucu

SEQ ID NO: 1060453 - RNA, 22 nt, Human
gccuggcauauaguaguugugc

SEQ ID NO: 1060454 - RNA, 22 nt, Human
cccugagcucaggcccuugggg

SEQ ID NO: 1060455 - RNA, 22 nt, Human
agggcuccuaugaugcucugcc

SEQ ID NO: 1060456 - RNA, 19 nt, Human
uccugcagguggcuugcag

SEQ ID NO: 1060457 - RNA, 22 nt, Human
ucaaagagcuauucaguugugg

SEQ ID NO: 1060458 - RNA, 21 nt, Human
ugcaggcuacuucugacucua

SEQ ID NO: 1060459 - RNA, 22 nt, Human
gaggagcucaugaaagcggugu

SEQ ID NO: 1060460 - RNA, 22 nt, Human
ccuggggagagaaagcccagcc

SEQ ID NO: 1060461 - RNA, 17 nt, Human
uauauguaugccucucc

SEQ ID NO: 1060462 - RNA, 22 nt, Human
cucucuggaagggggagcugau

SEQ ID NO: 1060463 - RNA, 23 nt, Human
gagugcagaauagacaugcagug

SEQ ID NO: 1060464 - RNA, 18 nt, Human
ccuagccuccaagcucau

SEQ ID NO: 1060465 - RNA, 22 nt, Human
ggcagggaguggagacucccua

SEQ ID NO: 1060466 - RNA, 22 nt, Human
gggcugaccccaccccucacuc

SEQ ID NO: 1060467 - RNA, 22 nt, Human
gagggcuccucacauucucuau

SEQ ID NO: 1060468 - RNA, 22 nt, Human
agggcucugagcuggaccaccu

SEQ ID NO: 1060469 - RNA, 22 nt, Human
uaaguuuuaagcaaucugauaa

SEQ ID NO: 1060470 - RNA, 22 nt, Human
uuccaaguagaagcauuugcau

SEQ ID NO: 1060471 - RNA, 22 nt, Human
cagguacauucguagacccauu

SEQ ID NO: 1060472 - RNA, 22 nt, Human
gugggcuuuggccucuuucucc

SEQ ID NO: 1060473 - RNA, 22 nt, Human
uucuggggccaauugccacugc

SEQ ID NO: 1060474 - RNA, 22 nt, Human
auucagugugagguuuucaagu

SEQ ID NO: 1060475 - RNA, 22 nt, Human
ucccucuaaacuguaagauucu

SEQ ID NO: 1060476 - RNA, 22 nt, Human
auguuucagauacagaucaaau

SEQ ID NO: 1060477 - RNA, 22 nt, Human
guuaggaacacuggagccuaaa

SEQ ID NO: 1060478 - RNA, 22 nt, Human
gaauuugaaaagugaugggaau

SEQ ID NO: 1060479 - RNA, 22 nt, Human
aucaguuauuuuuaagcuauaa

SEQ ID NO: 1060480 - RNA, 22 nt, Human
aaauccuaagcagaggaauuua

SEQ ID NO: 1060481 - RNA, 22 nt, Human
uccugcagaucaaagccuuuga

SEQ ID NO: 1060482 - RNA, 22 nt, Human
guaugaaggcgagagcccacua

SEQ ID NO: 1060483 - RNA, 22 nt, Human
uucugucaugcucauguaauug

SEQ ID NO: 1060484 - RNA, 23 nt, Human
auggaagucacuguuuucuuguc

SEQ ID NO: 1060485 - RNA, 22 nt, Human
auuucucaucaagugccaacuc

SEQ ID NO: 1060486 - RNA, 22 nt, Human
uuagaacuuaaacuucagaaag

SEQ ID NO: 1060487 - RNA, 22 nt, Human
cugccugcucuauccaggccug

SEQ ID NO: 1060488 - RNA, 20 nt, Human
cugcaggguuagaggcucca

SEQ ID NO: 1060489 - RNA, 22 nt, Human
ugcuuaaaaugaugauuauuuu

SEQ ID NO: 1060490 - RNA, 22 nt, Human
uuagaacugaagaagauuaagg

SEQ ID NO: 1060491 - RNA, 22 nt, Human
acacacuuuaaauuaaaccucu

SEQ ID NO: 1060492 - RNA, 22 nt, Human
accaagcuguauauuauugguu

SEQ ID NO: 1060493 - RNA, 22 nt, Human
ugggcuuaggucggaggcggcc

SEQ ID NO: 1060494 - RNA, 22 nt, Human
ccugggcuuucaaaaccagccu

SEQ ID NO: 1060495 - RNA, 20 nt, Human
cuggggacagcaauggcugu

SEQ ID NO: 1060496 - RNA, 22 nt, Human
gagcuuuacuucugacuggugc

SEQ ID NO: 1060497 - RNA, 22 nt, Human
accaggcacuccugaggucuga

SEQ ID NO: 1060498 - RNA, 22 nt, Human
uguaggcugaagaugaagugga

SEQ ID NO: 1060499 - RNA, 21 nt, Human
acaggcucuggggaugcuggg

SEQ ID NO: 1060500 - RNA, 22 nt, Human
aaagcagguugcaauuacagug

SEQ ID NO: 1060501 - RNA, 22 nt, Human
aaaugcuagggagaaacucucc

SEQ ID NO: 1060502 - RNA, 23 nt, Human
ucacauaauccuucauccacagg

SEQ ID NO: 1060503 - RNA, 22 nt, Human
uuuaauuuuccugguaggccug

SEQ ID NO: 1060504 - RNA, 22 nt, Human
ccuggcagcauugguagagauu

SEQ ID NO: 1060505 - RNA, 22 nt, Human
cuccuggcacugucuugaccca

SEQ ID NO: 1060506 - RNA, 22 nt, Human
uccaggcauguggccaguacuc

SEQ ID NO: 1060507 - RNA, 22 nt, Human
gcauguuuugcaacaagugacc

SEQ ID NO: 1060508 - RNA, 22 nt, Human
gggcugacgaaggccaugugug

SEQ ID NO: 1060509 - RNA, 22 nt, Human
caggggccaaggguccagaccu

SEQ ID NO: 1060510 - RNA, 22 nt, Human
ugucacuuuggggagaguuuug

SEQ ID NO: 1060511 - RNA, 22 nt, Human
cauuguuauagcauuacacacc

SEQ ID NO: 1060512 - RNA, 22 nt, Human
cacaggcugcccgcagcuggga

SEQ ID NO: 1060513 - RNA, 22 nt, Human
uuuuaccugaaccacacaguau

SEQ ID NO: 1060514 - RNA, 22 nt, Human
uaaauuguuuucuagaaguugu

SEQ ID NO: 1060515 - RNA, 22 nt, Human
uuuucauuuuuguagaugcaag

SEQ ID NO: 1060516 - RNA, 22 nt, Human
cccaggccagaacuugguugcu

SEQ ID NO: 1060517 - RNA, 22 nt, Human
ggccucagugggccgcugcagg

SEQ ID NO: 1060518 - RNA, 22 nt, Human
auuuaugauuagccuauuguug

SEQ ID NO: 1060519 - RNA, 22 nt, Human
uucuuuuacauuaagauuucag

SEQ ID NO: 1060520 - RNA, 22 nt, Human
agggcccuagggaaugagacau

SEQ ID NO: 1060521 - RNA, 22 nt, Human
uuauuauagauuaugcaagauu

SEQ ID NO: 1060522 - RNA, 23 nt, Human
ugaaacauuuaggguagaauuuc

SEQ ID NO: 1060523 - RNA, 22 nt, Human
aaccugcauguuucuaaaagca

SEQ ID NO: 1060524 - RNA, 20 nt, Human
augugaaagaucaguugucu

SEQ ID NO: 1060525 - RNA, 21 nt, Human
gggcagaggggccuccugggu

SEQ ID NO: 1060526 - RNA, 22 nt, Human
gggcugacaccacccaggcgca

SEQ ID NO: 1060527 - RNA, 18 nt, Human
ugucauaauauaucaccu

SEQ ID NO: 1060528 - RNA, 22 nt, Human
cugcucuaauaucagauagacu

SEQ ID NO: 1060529 - RNA, 22 nt, Human
augggcuggccuuucccgcucu

SEQ ID NO: 1060530 - RNA, 22 nt, Human
cuuggcaguuucggaaggauga

SEQ ID NO: 1060531 - RNA, 22 nt, Human
uccugcagccauuagaggucaa

SEQ ID NO: 1060532 - RNA, 22 nt, Human
aucagagaccggucaagucaug

SEQ ID NO: 1060533 - RNA, 23 nt, Human
uagaaugucauucaaugauaugg

SEQ ID NO: 1060534 - RNA, 19 nt, Human
cagcccucuuaccacugug

SEQ ID NO: 1060535 - RNA, 22 nt, Human
cuagaauugcauucuaugaaua

SEQ ID NO: 1060536 - RNA, 22 nt, Human
gccaaaucuugcacacucuugu

SEQ ID NO: 1060537 - RNA, 20 nt, Human
gccaggcacuguucucaaua

SEQ ID NO: 1060538 - RNA, 22 nt, Human
cacccaggacaggccagaugug

SEQ ID NO: 1060539 - RNA, 20 nt, Human
agguuccuuuguggagaauu

SEQ ID NO: 1060540 - RNA, 22 nt, Human
ucugcagauuuaucagcagcug

SEQ ID NO: 1060541 - RNA, 22 nt, Human
uacauugaauuuuuuagcaugu

SEQ ID NO: 1060542 - RNA, 22 nt, Human
caguuuauuuccaagaugacaa

SEQ ID NO: 1060543 - RNA, 22 nt, Human
uugcagcuuagugauguuaucu

SEQ ID NO: 1060544 - RNA, 22 nt, Human
cagagaaagggugaauuccuuc

SEQ ID NO: 1060545 - RNA, 22 nt, Human
cucccagguuccgacgccucuu

SEQ ID NO: 1060546 - RNA, 22 nt, Human
cauuaggguaauugaacacuua

SEQ ID NO: 1060547 - RNA, 22 nt, Human
uucuggggccccaguguccucg

SEQ ID NO: 1060548 - RNA, 19 nt, Human
gcagagugggguggagggu

SEQ ID NO: 1060549 - RNA, 22 nt, Human
acuggcagagguuggacaccau

SEQ ID NO: 1060550 - RNA, 22 nt, Human
cagcucugagacugaggcuaug

SEQ ID NO: 1060551 - RNA, 22 nt, Human
ucaaauauuggcuauuucacau

SEQ ID NO: 1060552 - RNA, 22 nt, Human
auuuucaucgcuagguuggccu

SEQ ID NO: 1060553 - RNA, 22 nt, Human
auguauuucuauguagugaaga

SEQ ID NO: 1060554 - RNA, 22 nt, Human
caggacugauguuccuccagcc

SEQ ID NO: 1060555 - RNA, 22 nt, Human
uucugucaaaugccaguagaga

SEQ ID NO: 1060556 - RNA, 22 nt, Human
uaugacauuggccaaguucugu

SEQ ID NO: 1060557 - RNA, 22 nt, Human
uugcagcuucuaccacuguuuc

SEQ ID NO: 1060558 - RNA, 22 nt, Human
uuggaaauugcaagugauuugc

SEQ ID NO: 1060559 - RNA, 22 nt, Human
ucugggcuggcuuuaugcugac

SEQ ID NO: 1060560 - RNA, 22 nt, Human
ucuuccagaaugcauucucuuu

SEQ ID NO: 1060561 - RNA, 22 nt, Human
cacaauguauauguauaucaaa

SEQ ID NO: 1060562 - RNA, 22 nt, Human
ucagcucuguguacaguuagca

SEQ ID NO: 1060563 - RNA, 22 nt, Human
ccacagaccuuggcuuccaccu

SEQ ID NO: 1060564 - RNA, 22 nt, Human
aaaauccucuaauucuagaaua

SEQ ID NO: 1060565 - RNA, 18 nt, Human
gcuuuauuucuuggggaa

SEQ ID NO: 1060566 - RNA, 22 nt, Human
cucaaauauaagcuaaaugugg

SEQ ID NO: 1060567 - RNA, 22 nt, Human
uaugacauugcuuuuuagaacu

SEQ ID NO: 1060568 - RNA, 22 nt, Human
cuguaugauuccauuucuauaa

SEQ ID NO: 1060569 - RNA, 22 nt, Human
ugcuccagugccugccccacag

SEQ ID NO: 1060570 - RNA, 22 nt, Human
agccagggucucucgcucuguu

SEQ ID NO: 1060571 - RNA, 22 nt, Human
cagggcucgcugccagcuucag

SEQ ID NO: 1060572 - RNA, 22 nt, Human
guauuaggaaauaugaagaaag

SEQ ID NO: 1060573 - RNA, 22 nt, Human
ggggccuuuucugaauguggaa

SEQ ID NO: 1060574 - RNA, 22 nt, Human
acuuaaaaagaaucuuuucacg

SEQ ID NO: 1060575 - RNA, 22 nt, Human
ucuuugaaaagauauuccuccu

SEQ ID NO: 1060576 - RNA, 17 nt, Human
gugaagagucauugaau

SEQ ID NO: 1060577 - RNA, 20 nt, Human
ccuggcaggcggguuacuua

SEQ ID NO: 1060578 - RNA, 22 nt, Human
aacccagccguguagcugccgc

SEQ ID NO: 1060579 - RNA, 22 nt, Human
aaauaguuuagcucucauuuca

SEQ ID NO: 1060580 - RNA, 22 nt, Human
caccugcaaggagcuuucauuu

SEQ ID NO: 1060581 - RNA, 22 nt, Human
cuggccucauagccaagcugug

SEQ ID NO: 1060582 - RNA, 22 nt, Human
ccauacacacaccaaauuugua

SEQ ID NO: 1060583 - RNA, 22 nt, Human
uauguacacacacaugcaugua

SEQ ID NO: 1060584 - RNA, 22 nt, Human
ucuggggauggucuacuuucug

SEQ ID NO: 1060585 - RNA, 22 nt, Human
ccccacaccugccgggcagcag

SEQ ID NO: 1060586 - RNA, 19 nt, Human
uccaggcauccuucaggcu

SEQ ID NO: 1060587 - RNA, 22 nt, Human
uacagcauauacagaaugaaca

SEQ ID NO: 1060588 - RNA, 22 nt, Human
cugugaucauucuugauuuaag

SEQ ID NO: 1060589 - RNA, 22 nt, Human
agggacccauagagagaccagu

SEQ ID NO: 1060590 - RNA, 22 nt, Human
ccugccugucuuuauccccugu

SEQ ID NO: 1060591 - RNA, 22 nt, Human
cuucuuaaucccuuauauauuu

SEQ ID NO: 1060592 - RNA, 22 nt, Human
ucugugcaggaagucauuauga

SEQ ID NO: 1060593 - RNA, 22 nt, Human
agcuuuauggugccucacuuga

SEQ ID NO: 1060594 - RNA, 19 nt, Human
acuggcaguuucugcaugg

SEQ ID NO: 1060595 - RNA, 21 nt, Human
acagagcauaaugguguggca

SEQ ID NO: 1060596 - RNA, 22 nt, Human
uacaaguaaauuguagauacca

SEQ ID NO: 1060597 - RNA, 22 nt, Human
uuuauucugugcuacaugaaga

SEQ ID NO: 1060598 - RNA, 22 nt, Human
uuauuuaggagaaggaacccug

SEQ ID NO: 1060599 - RNA, 22 nt, Human
acuggcagaacgugaugcgggu

SEQ ID NO: 1060600 - RNA, 22 nt, Human
ccaaguacagauuccuccacug

SEQ ID NO: 1060601 - RNA, 20 nt, Human
cuguuaaaagguaugaauuc

SEQ ID NO: 1060602 - RNA, 22 nt, Human
ccccuuccacagugcuuccuaa

SEQ ID NO: 1060603 - RNA, 22 nt, Human
ucagcuuucucaaagaagcugg

SEQ ID NO: 1060604 - RNA, 22 nt, Human
aacccaggguggagguugcagu

SEQ ID NO: 1060605 - RNA, 22 nt, Human
gcacacaugcaugcacaggagu

SEQ ID NO: 1060606 - RNA, 22 nt, Human
acagugugaugggccugccuga

SEQ ID NO: 1060607 - RNA, 22 nt, Human
ugcuuaaaauaguucauuuuug

SEQ ID NO: 1060608 - RNA, 22 nt, Human
guccucugggcuuugagcaguc

SEQ ID NO: 1060609 - RNA, 22 nt, Human
aagugugggaaguugcuaaaau

SEQ ID NO: 1060610 - RNA, 22 nt, Human
ugagaauuuucaguuucacuuu

SEQ ID NO: 1060611 - RNA, 22 nt, Human
ccaccccaaaugaagaccucuc

SEQ ID NO: 1060612 - RNA, 22 nt, Human
cagaggcagacccuccagggcg

SEQ ID NO: 1060613 - RNA, 22 nt, Human
agucacaguuucccugagagag

SEQ ID NO: 1060614 - RNA, 22 nt, Human
uuguaaacugcugcaggagugc

SEQ ID NO: 1060615 - RNA, 22 nt, Human
uuucacaaucaaauggugaaau

SEQ ID NO: 1060616 - RNA, 22 nt, Human
aaucuuucccuauuaaaugugg

SEQ ID NO: 1060617 - RNA, 22 nt, Human
cacauaaucaccaaguccuuuc

SEQ ID NO: 1060618 - RNA, 22 nt, Human
ucauuuugggguuugucaucuu

SEQ ID NO: 1060619 - RNA, 22 nt, Human
aaugaagccacugaagacaauc

SEQ ID NO: 1060620 - RNA, 23 nt, Human
gggcuccagucucugcucaguug

SEQ ID NO: 1060621 - RNA, 22 nt, Human
acagcuuuugaaaaauuacugg

SEQ ID NO: 1060622 - RNA, 22 nt, Human
gcuggcagggacagcugcgugu

SEQ ID NO: 1060623 - RNA, 22 nt, Human
aaaauccuuagccgagugaggu

SEQ ID NO: 1060624 - RNA, 23 nt, Human
gaauaguuuuagaaauuggagaa

SEQ ID NO: 1060625 - RNA, 22 nt, Human
uuuucguuuauuugacauguaa

SEQ ID NO: 1060626 - RNA, 22 nt, Human
cuauuacauuucuggacauuca

SEQ ID NO: 1060627 - RNA, 23 nt, Human
gcccacccucagcguccucacgg

SEQ ID NO: 1060628 - RNA, 22 nt, Human
cccaaguuaauuuguagcugaa

SEQ ID NO: 1060629 - RNA, 22 nt, Human
cucuccagaauaugccgccgug

SEQ ID NO: 1060630 - RNA, 22 nt, Human
uucacuuaacaucauaucauga

SEQ ID NO: 1060631 - RNA, 22 nt, Human
ggggcugaaccuggaggugguc

SEQ ID NO: 1060632 - RNA, 22 nt, Human
cauuuguaggaugcuucuuguu

SEQ ID NO: 1060633 - RNA, 22 nt, Human
auguuauuaaaguacagauucu

SEQ ID NO: 1060634 - RNA, 22 nt, Human
accaagcuucguggaggaaguu

SEQ ID NO: 1060635 - RNA, 22 nt, Human
cagcccaggucucucuuccagu

SEQ ID NO: 1060636 - RNA, 22 nt, Human
cauaauuugugguaguggggga

SEQ ID NO: 1060637 - RNA, 22 nt, Human
aaacaucaccauuuuaccuaau

SEQ ID NO: 1060638 - RNA, 22 nt, Human
auggcagacgaggcagcagggg

SEQ ID NO: 1060639 - RNA, 22 nt, Human
aauuagggagccaucauaaggu

SEQ ID NO: 1060640 - RNA, 22 nt, Human
uccaggcauuggagagauaaug

SEQ ID NO: 1060641 - RNA, 22 nt, Human
auaugagaauuggaaaauauca

SEQ ID NO: 1060642 - RNA, 23 nt, Human
cuucacaaucaaaaucaguucug

SEQ ID NO: 1060643 - RNA, 22 nt, Human
uucaagauggcaccagugagug

SEQ ID NO: 1060644 - RNA, 23 nt, Human
cgcccagccucagugaccugggc

SEQ ID NO: 1060645 - RNA, 22 nt, Human
ucucugaagauauuuauuauua

SEQ ID NO: 1060646 - RNA, 22 nt, Human
cccacacauuuuucacuuaccg

SEQ ID NO: 1060647 - RNA, 22 nt, Human
cguaugaaauuuuugacauuug

SEQ ID NO: 1060648 - RNA, 22 nt, Human
acugauuacacgaguucugacu

SEQ ID NO: 1060649 - RNA, 18 nt, Human
ggccucagccuggccgga

SEQ ID NO: 1060650 - RNA, 22 nt, Human
uuuaaauucugucugccgcuua

SEQ ID NO: 1060651 - RNA, 22 nt, Human
gaaacauaguugagacacugcu

SEQ ID NO: 1060652 - RNA, 23 nt, Human
ugagggacaugguggcuucugag

SEQ ID NO: 1060653 - RNA, 22 nt, Human
caguguggugagauuccaggug

SEQ ID NO: 1060654 - RNA, 22 nt, Human
uucacaaaacacuauuuucugg

SEQ ID NO: 1060655 - RNA, 20 nt, Human
cagcccuccaguggaggcag

SEQ ID NO: 1060656 - RNA, 22 nt, Human
cacuuagucucaccaguucagu

SEQ ID NO: 1060657 - RNA, 21 nt, Human
uccaaaucccauucuguaguc

SEQ ID NO: 1060658 - RNA, 21 nt, Human
acacagaggcaucaucacuuu

SEQ ID NO: 1060659 - RNA, 22 nt, Human
uccuggcaaagauguugguguu

SEQ ID NO: 1060660 - RNA, 22 nt, Human
ucccuccuggccgucaccgcug

SEQ ID NO: 1060661 - RNA, 22 nt, Human
gcacacacaugugaguacaugc

SEQ ID NO: 1060662 - RNA, 22 nt, Human
aguaugaagcugaaugauuuua

SEQ ID NO: 1060663 - RNA, 22 nt, Human
gccugcagggccugggccuacc

SEQ ID NO: 1060664 - RNA, 22 nt, Human
ugcaggcucaccugccagggcc

SEQ ID NO: 1060665 - RNA, 22 nt, Human
uuuugcuuuuguaacacagugu

SEQ ID NO: 1060666 - RNA, 23 nt, Human
accaugaugggagugcaaauaag

SEQ ID NO: 1060667 - RNA, 22 nt, Human
gccugcagaacugugaggcaau

SEQ ID NO: 1060668 - RNA, 22 nt, Human
accauugccuagaaaaauuccu

SEQ ID NO: 1060669 - RNA, 21 nt, Human
auuuucauuaauucagugugg

SEQ ID NO: 1060670 - RNA, 22 nt, Human
aggccuccagccacaugccagu

SEQ ID NO: 1060671 - RNA, 22 nt, Human
uguuagaaauuauuaguaauau

SEQ ID NO: 1060672 - RNA, 22 nt, Human
augggcugacccagucguggca

SEQ ID NO: 1060673 - RNA, 22 nt, Human
uggcagagcccagacuccaguc

SEQ ID NO: 1060674 - RNA, 22 nt, Human
aagcuuuaugaucucucagcua

SEQ ID NO: 1060675 - RNA, 22 nt, Human
uuuacauugcauuagguauuau

SEQ ID NO: 1060676 - RNA, 22 nt, Human
aaauauguauggaguucaugaa

SEQ ID NO: 1060677 - RNA, 22 nt, Human
cuaucauuuuacaugguuggug

SEQ ID NO: 1060678 - RNA, 22 nt, Human
ccuggcugguggcagcgacaag

SEQ ID NO: 1060679 - RNA, 17 nt, Human
aguguuuccuuaucauu

SEQ ID NO: 1060680 - RNA, 22 nt, Human
uauacaauggcugaaucaucca

SEQ ID NO: 1060681 - RNA, 22 nt, Human
aucugucagccugggauuaggg

SEQ ID NO: 1060682 - RNA, 22 nt, Human
ugcaggcuggcagauaucucau

SEQ ID NO: 1060683 - RNA, 20 nt, Human
ggcaggcuuuauauggaggg

SEQ ID NO: 1060684 - RNA, 22 nt, Human
uccugcaggcuugaguccucag

SEQ ID NO: 1060685 - RNA, 22 nt, Human
ucucuuaaaggucuucagcuga

SEQ ID NO: 1060686 - RNA, 22 nt, Human
cauccaggcaccacaaccagcu

SEQ ID NO: 1060687 - RNA, 20 nt, Human
ucaggcuccgcauuaacuua

SEQ ID NO: 1060688 - RNA, 22 nt, Human
cugcagccacgagucacagccc

SEQ ID NO: 1060689 - RNA, 22 nt, Human
aggaagcuuggggcagggcuac

SEQ ID NO: 1060690 - RNA, 20 nt, Human
cuaggaacuauggucuggcu

SEQ ID NO: 1060691 - RNA, 22 nt, Human
uggcagggugccaguugcgagu

SEQ ID NO: 1060692 - RNA, 22 nt, Human
auuauaaaccuuugaggguggg

SEQ ID NO: 1060693 - RNA, 18 nt, Human
ugcaggcugggguuccuc

SEQ ID NO: 1060694 - RNA, 23 nt, Human
aguguugguugggaagccaagca

SEQ ID NO: 1060695 - RNA, 22 nt, Human
uauaauuuaucaugucacaguu

SEQ ID NO: 1060696 - RNA, 22 nt, Human
cagcauuuggugaucaucuuaa

SEQ ID NO: 1060697 - RNA, 22 nt, Human
caugagauuugggaggggccag

SEQ ID NO: 1060698 - RNA, 22 nt, Human
auccccacgauauagccaaagc

SEQ ID NO: 1060699 - RNA, 22 nt, Human
gacacagaaggucacauguuca

SEQ ID NO: 1060700 - RNA, 22 nt, Human
cuccaggguuccccgauccacu

SEQ ID NO: 1060701 - RNA, 22 nt, Human
cccagccucuguuugcuccucu

SEQ ID NO: 1060702 - RNA, 22 nt, Human
gaaacaugucugacaauuuacc

SEQ ID NO: 1060703 - RNA, 22 nt, Human
uaugaccuuaggaagcaagaag

SEQ ID NO: 1060704 - RNA, 22 nt, Human
uggaacacuuuguugaaaugca

SEQ ID NO: 1060705 - RNA, 22 nt, Human
uuaggaauauuuucugaguagu

SEQ ID NO: 1060706 - RNA, 22 nt, Human
acaucccacagaaacauacaua

SEQ ID NO: 1060707 - RNA, 22 nt, Human
cuacaaugacagaauugaguag

SEQ ID NO: 1060708 - RNA, 22 nt, Human
cuugccucccucagcucacagc

SEQ ID NO: 1060709 - RNA, 22 nt, Human
ugcaggcugugucauuuaguga

SEQ ID NO: 1060710 - RNA, 22 nt, Human
auucugucuuuuuauacaucua

SEQ ID NO: 1060711 - RNA, 20 nt, Human
agaggcuuccuugggaggag

SEQ ID NO: 1060712 - RNA, 22 nt, Human
aaauuucuaagcagccacuucc

SEQ ID NO: 1060713 - RNA, 21 nt, Human
gaugaagcaaucuuucuguug

SEQ ID NO: 1060714 - RNA, 22 nt, Human
auuucucagugaaaugacaggc

SEQ ID NO: 1060715 - RNA, 22 nt, Human
uugcagcugcaguaaauguuca

SEQ ID NO: 1060716 - RNA, 22 nt, Human
cagggcucugccuugagggaug

SEQ ID NO: 1060717 - RNA, 22 nt, Human
guacccagaggcaugaucccag

SEQ ID NO: 1060718 - RNA, 22 nt, Human
uuuaauauucugcauucuccuu

SEQ ID NO: 1060719 - RNA, 22 nt, Human
ccaggcagagggaauagcaagu

SEQ ID NO: 1060720 - RNA, 22 nt, Human
agagggcuuugauucucaguuc

SEQ ID NO: 1060721 - RNA, 22 nt, Human
aucugucaagauagacucugca

SEQ ID NO: 1060722 - RNA, 22 nt, Human
ggcuccaagucucagagugaag

SEQ ID NO: 1060723 - RNA, 22 nt, Human
aaugucauugguaaagauuagg

SEQ ID NO: 1060724 - RNA, 22 nt, Human
acccacccuacuagcagugucc

SEQ ID NO: 1060725 - RNA, 22 nt, Human
ucccacauaugcaauccugaau

SEQ ID NO: 1060726 - RNA, 22 nt, Human
auauuaggaguuaaauguauua

SEQ ID NO: 1060727 - RNA, 22 nt, Human
cugggcugaaaguguuccuuga

SEQ ID NO: 1060728 - RNA, 22 nt, Human
cacccagcagcacuuaagacua

SEQ ID NO: 1060729 - RNA, 22 nt, Human
aggcaauccccugaggauacuu

SEQ ID NO: 1060730 - RNA, 22 nt, Human
ugcuucuggggacaggcugccu

SEQ ID NO: 1060731 - RNA, 22 nt, Human
aagggcucucugcauugaaauu

SEQ ID NO: 1060732 - RNA, 22 nt, Human
auuacaaucgagagaaacaaau

SEQ ID NO: 1060733 - RNA, 22 nt, Human
gccuccuggaagucacauguuu

SEQ ID NO: 1060734 - RNA, 22 nt, Human
acaguuugcccugacauucucc

SEQ ID NO: 1060735 - RNA, 22 nt, Human
cucugguuucgcaggaaauaga

SEQ ID NO: 1060736 - RNA, 22 nt, Human
cccagccuacucugccauagca

SEQ ID NO: 1060737 - RNA, 19 nt, Human
guccucucaacaacccggg

SEQ ID NO: 1060738 - RNA, 22 nt, Human
uauguaaaaauucaucaggcug

SEQ ID NO: 1060739 - RNA, 22 nt, Human
uaacacauaagcugagaccaug

SEQ ID NO: 1060740 - RNA, 22 nt, Human
ggaccugaacauaaaacgaggc

SEQ ID NO: 1060741 - RNA, 22 nt, Human
ccauaaucuggcuuugagagag

SEQ ID NO: 1060742 - RNA, 22 nt, Human
uccaggcucccucaggaugcac

SEQ ID NO: 1060743 - RNA, 22 nt, Human
cagccucuguggcugccacacc

SEQ ID NO: 1060744 - RNA, 22 nt, Human
cagaagucacccucagaauaac

SEQ ID NO: 1060745 - RNA, 22 nt, Human
uacacaucccagacucccagga

SEQ ID NO: 1060746 - RNA, 22 nt, Human
ucacacacauuugcugucugau

SEQ ID NO: 1060747 - RNA, 22 nt, Human
guccucuguguaggcugcagac

SEQ ID NO: 1060748 - RNA, 22 nt, Human
ucagagagugcaaaauauagcu

SEQ ID NO: 1060749 - RNA, 22 nt, Human
cauuuucagcacccaucugaaa

SEQ ID NO: 1060750 - RNA, 22 nt, Human
aaggcuuuuaacuacuguuuua

SEQ ID NO: 1060751 - RNA, 22 nt, Human
uuucauaauauccagagauuuu

SEQ ID NO: 1060752 - RNA, 22 nt, Human
auguagaacagguuaaugacag

SEQ ID NO: 1060753 - RNA, 22 nt, Human
auaugaaguuacagguaagaaa

SEQ ID NO: 1060754 - RNA, 22 nt, Human
aauauaaugcuguuuuaugcca

SEQ ID NO: 1060755 - RNA, 22 nt, Human
augggcugcuuggcuuccaccc

SEQ ID NO: 1060756 - RNA, 22 nt, Human
uugcaacaucugaacauuuauc

SEQ ID NO: 1060757 - RNA, 22 nt, Human
gaggcagcgggucaggaccgug

SEQ ID NO: 1060758 - RNA, 22 nt, Human
acuggcagggggagccccgaga

SEQ ID NO: 1060759 - RNA, 22 nt, Human
cuuaaauuggaugaguuaaguu

SEQ ID NO: 1060760 - RNA, 22 nt, Human
agcagguggacagaggaagaaa

SEQ ID NO: 1060761 - RNA, 22 nt, Human
uguagaaauuaguaagaucaac

SEQ ID NO: 1060762 - RNA, 22 nt, Human
ugugaucugccuuggaucugca

SEQ ID NO: 1060763 - RNA, 22 nt, Human
uccuggcauccgugggucugug

SEQ ID NO: 1060764 - RNA, 22 nt, Human
ucagcuuugcaaguuagaaaau

SEQ ID NO: 1060765 - RNA, 22 nt, Human
ggcaggcuccaagcauccuaug

SEQ ID NO: 1060766 - RNA, 22 nt, Human
guggccaggccgacugccaggc

SEQ ID NO: 1060767 - RNA, 22 nt, Human
ucagcuuucuauguugcuaaac

SEQ ID NO: 1060768 - RNA, 22 nt, Human
gaacacaucacauuuuacagug

SEQ ID NO: 1060769 - RNA, 22 nt, Human
ccuuuauucaauuaguccuaau

SEQ ID NO: 1060770 - RNA, 21 nt, Human
ucagagagucacagugaacug

SEQ ID NO: 1060771 - RNA, 17 nt, Human
cagcuuuaugcuacugu

SEQ ID NO: 1060772 - RNA, 22 nt, Human
gcaaggacucccugggucauuc

SEQ ID NO: 1060773 - RNA, 22 nt, Human
uacauuccuguuagcaucuaag

SEQ ID NO: 1060774 - RNA, 22 nt, Human
uuuguaaauagcaguacucaug

SEQ ID NO: 1060775 - RNA, 22 nt, Human
uguacauacauagauauacaca

SEQ ID NO: 1060776 - RNA, 22 nt, Human
ggaaccacagcccccagcaggc

SEQ ID NO: 1060777 - RNA, 21 nt, Human
ucacguggucacaugagcuuu

SEQ ID NO: 1060778 - RNA, 20 nt, Human
gcuggcagaugucuugagau

SEQ ID NO: 1060779 - RNA, 22 nt, Human
gauggccuggguccccuuccgg

SEQ ID NO: 1060780 - RNA, 22 nt, Human
agaauaugaucggaauacagau

SEQ ID NO: 1060781 - RNA, 22 nt, Human
ucaggcucaggaauguguuuau

SEQ ID NO: 1060782 - RNA, 22 nt, Human
uugaaauacugcauuguucagu

SEQ ID NO: 1060783 - RNA, 22 nt, Human
gguggccaggccagcucuggcc

SEQ ID NO: 1060784 - RNA, 22 nt, Human
gacacagauaucucugagauua

SEQ ID NO: 1060785 - RNA, 22 nt, Human
gcauagucaguaggauucucaa

SEQ ID NO: 1060786 - RNA, 22 nt, Human
augcaacaaaugcuacgaaucg

SEQ ID NO: 1060787 - RNA, 22 nt, Human
aaugauuuggcaaaggaaucca

SEQ ID NO: 1060788 - RNA, 22 nt, Human
cagagcauaauugacaugaggu

SEQ ID NO: 1060789 - RNA, 22 nt, Human
uacauugcuuucuaauacaucu

SEQ ID NO: 1060790 - RNA, 22 nt, Human
auuauucuuaugucaucauggc

SEQ ID NO: 1060791 - RNA, 22 nt, Human
uccaggcagucauuaaucucua

SEQ ID NO: 1060792 - RNA, 22 nt, Human
uuaacacaucccugcucuaccc

SEQ ID NO: 1060793 - RNA, 22 nt, Human
agcucccaauugacuugaacua

SEQ ID NO: 1060794 - RNA, 22 nt, Human
ugcuucugaugugagcagcccc

SEQ ID NO: 1060795 - RNA, 22 nt, Human
gugggcuucuguuagggaggcu

SEQ ID NO: 1060796 - RNA, 19 nt, Human
ugccuggcaccagcuccac

SEQ ID NO: 1060797 - RNA, 22 nt, Human
acacucucagcuuuucaacuua

SEQ ID NO: 1060798 - RNA, 22 nt, Human
uccacacacauuucuaugugca

SEQ ID NO: 1060799 - RNA, 22 nt, Human
uggccagguugggcuuugcagc

SEQ ID NO: 1060800 - RNA, 22 nt, Human
ugggaccugaagcagguuggca

SEQ ID NO: 1060801 - RNA, 22 nt, Human
ggcauccaguucugaucaacaa

SEQ ID NO: 1060802 - RNA, 22 nt, Human
cugcucuaacugcauuaguuuu

SEQ ID NO: 1060803 - RNA, 22 nt, Human
augcuauacauaugacaucaca

SEQ ID NO: 1060804 - RNA, 22 nt, Human
ggaaucagaauuaggauuugaa

SEQ ID NO: 1060805 - RNA, 22 nt, Human
ugguauaaaacuuuuuauugaa

SEQ ID NO: 1060806 - RNA, 22 nt, Human
ccagcccugaacccugcugcau

SEQ ID NO: 1060807 - RNA, 22 nt, Human
cacacagacagcucucugaaga

SEQ ID NO: 1060808 - RNA, 22 nt, Human
uccaagcuacugaagguuuggg

SEQ ID NO: 1060809 - RNA, 22 nt, Human
uugugcucuguguuauuuaagg

SEQ ID NO: 1060810 - RNA, 22 nt, Human
gccaggcacugcucuaagcccu

SEQ ID NO: 1060811 - RNA, 22 nt, Human
uauuaggguuuugaagguuugu

SEQ ID NO: 1060812 - RNA, 22 nt, Human
uucucagugaaguuuagaacau

SEQ ID NO: 1060813 - RNA, 22 nt, Human
aggaccugaaauucuugcuuuu

SEQ ID NO: 1060814 - RNA, 22 nt, Human
uacauguuugguaaaugauggc

SEQ ID NO: 1060815 - RNA, 22 nt, Human
aagagcaucuauuucacagugg

SEQ ID NO: 1060816 - RNA, 21 nt, Human
uuuaauuugcauguaugacgc

SEQ ID NO: 1060817 - RNA, 22 nt, Human
ggcuuuauaggguagaggauca

SEQ ID NO: 1060818 - RNA, 22 nt, Human
uccuggcagcccgcaggugcug

SEQ ID NO: 1060819 - RNA, 22 nt, Human
uauguacuaacuuucauucuag

SEQ ID NO: 1060820 - RNA, 22 nt, Human
guuagggaagcgcuguguucuu

SEQ ID NO: 1060821 - RNA, 22 nt, Human
acaagauagcuuagaagauuca

SEQ ID NO: 1060822 - RNA, 23 nt, Human
ccaggccucucagagggugugcc

SEQ ID NO: 1060823 - RNA, 22 nt, Human
gcuggcaggguucucacugaaa

SEQ ID NO: 1060824 - RNA, 19 nt, Human
uuugugaagaaaaugaugc

SEQ ID NO: 1060825 - RNA, 22 nt, Human
agacacagcugcaggagguggg

SEQ ID NO: 1060826 - RNA, 22 nt, Human
uaggccauucuuggagcuuacu

SEQ ID NO: 1060827 - RNA, 22 nt, Human
ucaggagcuugguagugugauu

SEQ ID NO: 1060828 - RNA, 22 nt, Human
acacaucagaaauaugaaugag

SEQ ID NO: 1060829 - RNA, 22 nt, Human
ccaggaccuggagcucuaugaa

SEQ ID NO: 1060830 - RNA, 22 nt, Human
cccugcagagagugcuuuugug

SEQ ID NO: 1060831 - RNA, 22 nt, Human
ucagcuuugaucucaggcaauc

SEQ ID NO: 1060832 - RNA, 22 nt, Human
uguauaaauuuaaauuccugcu

SEQ ID NO: 1060833 - RNA, 22 nt, Human
gccaggcagcuagcaaccccug

SEQ ID NO: 1060834 - RNA, 22 nt, Human
cccagcccccgagugucuggaa

SEQ ID NO: 1060835 - RNA, 22 nt, Human
ugcagggaagcaaggguggcuc

SEQ ID NO: 1060836 - RNA, 22 nt, Human
cucagagaaccuaagcggagga

SEQ ID NO: 1060837 - RNA, 22 nt, Human
aagucucucauggcugacagca

SEQ ID NO: 1060838 - RNA, 22 nt, Human
auauuauucuagcucuugugug

SEQ ID NO: 1060839 - RNA, 22 nt, Human
agggacucccugggccgacacg

SEQ ID NO: 1060840 - RNA, 22 nt, Human
ucugucaauauaugugcugcag

SEQ ID NO: 1060841 - RNA, 22 nt, Human
cucugauuuccuuauucuguca

SEQ ID NO: 1060842 - RNA, 21 nt, Human
cagcuucuucugugaccuggu

SEQ ID NO: 1060843 - RNA, 19 nt, Human
ugcauaaauuauauacuuu

SEQ ID NO: 1060844 - RNA, 21 nt, Human
caguguggugaccagggucuc

SEQ ID NO: 1060845 - RNA, 21 nt, Human
guacacacagguggaugggcu

SEQ ID NO: 1060846 - RNA, 22 nt, Human
aguuagaaaguaaaucauuuga

SEQ ID NO: 1060847 - RNA, 22 nt, Human
aucuuuuacauuacugcccaga

SEQ ID NO: 1060848 - RNA, 22 nt, Human
auauuucaugggguuccauacu

SEQ ID NO: 1060849 - RNA, 20 nt, Human
aagagucuuuacugagcuaa

SEQ ID NO: 1060850 - RNA, 22 nt, Human
gguaugaauucacuacuuccaa

SEQ ID NO: 1060851 - RNA, 22 nt, Human
ugggcuccaauuuguccuuuca

SEQ ID NO: 1060852 - RNA, 20 nt, Human
ccagcuuucccugcagcauc

SEQ ID NO: 1060853 - RNA, 22 nt, Human
uggcagagaacacggcugaucu

SEQ ID NO: 1060854 - RNA, 22 nt, Human
ccuggcagguggagguugcagu

SEQ ID NO: 1060855 - RNA, 22 nt, Human
gccacagguacuaugggagaga

SEQ ID NO: 1060856 - RNA, 22 nt, Human
gcuggcagccaagugaagaggg

SEQ ID NO: 1060857 - RNA, 22 nt, Human
cuuaauuuaagccuagaaugca

SEQ ID NO: 1060858 - RNA, 22 nt, Human
cgcauacauagaaacacacaga

SEQ ID NO: 1060859 - RNA, 22 nt, Human
ucauuuguggaagugauugugg

SEQ ID NO: 1060860 - RNA, 23 nt, Human
aacagccaacuuuagcggguggc

SEQ ID NO: 1060861 - RNA, 22 nt, Human
ccagagagucgaugggggacac

SEQ ID NO: 1060862 - RNA, 22 nt, Human
ugugcauguauugauuuguacc

SEQ ID NO: 1060863 - RNA, 20 nt, Human
uccaugaguuagagacuaua

SEQ ID NO: 1060864 - RNA, 22 nt, Human
aguccggggucuggacaccugg

SEQ ID NO: 1060865 - RNA, 22 nt, Human
gugggcuuugcuggauccuucc

SEQ ID NO: 1060866 - RNA, 22 nt, Human
uucuuucaauagcuggcauaug

SEQ ID NO: 1060867 - RNA, 22 nt, Human
uuuaucuuuaggacuuugcaga

SEQ ID NO: 1060868 - RNA, 18 nt, Human
gccaggcaggguggggaa

SEQ ID NO: 1060869 - RNA, 22 nt, Human
agcuuuauauguuguuucucca

SEQ ID NO: 1060870 - RNA, 22 nt, Human
gacaggcuuugagucccagaac

SEQ ID NO: 1060871 - RNA, 22 nt, Human
gacaggcuuccuaagugccaga

SEQ ID NO: 1060872 - RNA, 22 nt, Human
caguuuauaugucagagcugua

SEQ ID NO: 1060873 - RNA, 22 nt, Human
auaauggccgggggcugaaugc

SEQ ID NO: 1060874 - RNA, 22 nt, Human
ucuggcaguuugagaaaggcua

SEQ ID NO: 1060875 - RNA, 20 nt, Human
gagucacagaagaagcugaa

SEQ ID NO: 1060876 - RNA, 22 nt, Human
auuaauuuuaccuuuguaaaca

SEQ ID NO: 1060877 - RNA, 22 nt, Human
uacauauguaaacauguauaaa

SEQ ID NO: 1060878 - RNA, 22 nt, Human
gcacccaggccggcgacugcag

SEQ ID NO: 1060879 - RNA, 22 nt, Human
ugcuuuauuaagagagaaauuu

SEQ ID NO: 1060880 - RNA, 20 nt, Human
ggcugcaggacucauuggcu

SEQ ID NO: 1060881 - RNA, 22 nt, Human
caaauacuacgauucuugcagu

SEQ ID NO: 1060882 - RNA, 22 nt, Human
gaaauauuucucuugagccccu

SEQ ID NO: 1060883 - RNA, 22 nt, Human
uugcagcuucgagucuaucugu

SEQ ID NO: 1060884 - RNA, 22 nt, Human
cauuuguaguaucuguuuauau

SEQ ID NO: 1060885 - RNA, 22 nt, Human
acagguggggcacuuggagccu

SEQ ID NO: 1060886 - RNA, 22 nt, Human
accugcaggggugcucucuggg

SEQ ID NO: 1060887 - RNA, 22 nt, Human
agcaaucaccaccucuauauuu

SEQ ID NO: 1060888 - RNA, 22 nt, Human
uggcacucacucucagagucug

SEQ ID NO: 1060889 - RNA, 22 nt, Human
ggugccaggcuguagucagggu

SEQ ID NO: 1060890 - RNA, 22 nt, Human
ucuggcagcagcaucaguggcu

SEQ ID NO: 1060891 - RNA, 22 nt, Human
ggcaggcucagcagccaaggag

SEQ ID NO: 1060892 - RNA, 22 nt, Human
cagggcuccccagagagccucu

SEQ ID NO: 1060893 - RNA, 22 nt, Human
aaucaagaaaaugaggauucuu

SEQ ID NO: 1060894 - RNA, 22 nt, Human
uccaaguccauuaugguggucu

SEQ ID NO: 1060895 - RNA, 22 nt, Human
ugcauaaacagauacuucaugu

SEQ ID NO: 1060896 - RNA, 22 nt, Human
ugcuucuggcacuugagggggu

SEQ ID NO: 1060897 - RNA, 22 nt, Human
gaaauauucuugucuuguuuuc

SEQ ID NO: 1060898 - RNA, 22 nt, Human
uccaaggcuccggcccuggcgu

SEQ ID NO: 1060899 - RNA, 22 nt, Human
cucagagaaaugucacaacaau

SEQ ID NO: 1060900 - RNA, 22 nt, Human
uguacauagaucuugaaaauua

SEQ ID NO: 1060901 - RNA, 22 nt, Human
cacauacugagaaucacaccca

SEQ ID NO: 1060902 - RNA, 20 nt, Human
gagggcucguggauggauaa

SEQ ID NO: 1060903 - RNA, 22 nt, Human
gggcucucaaggcagggcccca

SEQ ID NO: 1060904 - RNA, 23 nt, Human
aucuguucaucugacacagauuc

SEQ ID NO: 1060905 - RNA, 22 nt, Human
aaacuucauggauaauauaaag

SEQ ID NO: 1060906 - RNA, 22 nt, Human
aagggcucacccaacucacuuc

SEQ ID NO: 1060907 - RNA, 22 nt, Human
ucuggcagcgaagcguguacuu

SEQ ID NO: 1060908 - RNA, 17 nt, Human
agccugccccaugcugc

SEQ ID NO: 1060909 - RNA, 22 nt, Human
gcagcuuugucacggagugucg

SEQ ID NO: 1060910 - RNA, 23 nt, Human
gagggcucugagugcuugggcca

SEQ ID NO: 1060911 - RNA, 20 nt, Human
cugcagggugagugggcgau

SEQ ID NO: 1060912 - RNA, 22 nt, Human
cuggccuggggggacacauccc

SEQ ID NO: 1060913 - RNA, 22 nt, Human
acaguaaaucaacagaauaucu

SEQ ID NO: 1060914 - RNA, 22 nt, Human
uuucauugucuacauaugacau

SEQ ID NO: 1060915 - RNA, 22 nt, Human
cacuguccaauagauacauaau

SEQ ID NO: 1060916 - RNA, 22 nt, Human
acugggcucaagugauuguccu

SEQ ID NO: 1060917 - RNA, 22 nt, Human
acugggcugguuaguuuuacua

SEQ ID NO: 1060918 - RNA, 22 nt, Human
ucugaaauagaagugucuuucu

SEQ ID NO: 1060919 - RNA, 18 nt, Human
ucagcuuuugaaaaccaa

SEQ ID NO: 1060920 - RNA, 22 nt, Human
acuggcagagggaaaaccauuc

SEQ ID NO: 1060921 - RNA, 22 nt, Human
ugucaagucucugaaugaaaug

SEQ ID NO: 1060922 - RNA, 22 nt, Human
gcaguguuuguguucucacaug

SEQ ID NO: 1060923 - RNA, 21 nt, Human
ucagcuuugcaacugcacauc

SEQ ID NO: 1060924 - RNA, 22 nt, Human
uccugcagagccgcccucaggu

SEQ ID NO: 1060925 - RNA, 21 nt, Human
ccagcuuucccaagucccuuu

SEQ ID NO: 1060926 - RNA, 21 nt, Human
guuuucaugauagagucugua

SEQ ID NO: 1060927 - RNA, 22 nt, Human
uaugaacuguaacccucaccgc

SEQ ID NO: 1060928 - RNA, 22 nt, Human
accaggcagucaccguccagga

SEQ ID NO: 1060929 - RNA, 22 nt, Human
acagauuuauugaagcugcugc

SEQ ID NO: 1060930 - RNA, 21 nt, Human
uccagaccucccucuccuagc

SEQ ID NO: 1060931 - RNA, 22 nt, Human
cugggcuuagcagcuccugguc

SEQ ID NO: 1060932 - RNA, 22 nt, Human
cuguaaaacacuguaguaucug

SEQ ID NO: 1060933 - RNA, 18 nt, Human
uccuggcagucagagagg

SEQ ID NO: 1060934 - RNA, 22 nt, Human
aaagcuuuucaguauguucaug

SEQ ID NO: 1060935 - RNA, 22 nt, Human
aagagcacuaacagagcugaua

SEQ ID NO: 1060936 - RNA, 22 nt, Human
gacuguggggggcggacacaag

SEQ ID NO: 1060937 - RNA, 19 nt, Human
guagggacagugguucuga

SEQ ID NO: 1060938 - RNA, 22 nt, Human
uagauauggccgucuguuuuaa

SEQ ID NO: 1060939 - RNA, 22 nt, Human
cacauugcagcuucuuuuggcu

SEQ ID NO: 1060940 - RNA, 22 nt, Human
uucauugcaguucuucagguua

SEQ ID NO: 1060941 - RNA, 22 nt, Human
aagagccagcuagugaagaggc

SEQ ID NO: 1060942 - RNA, 22 nt, Human
aguggcugccaagagcaaugcu

SEQ ID NO: 1060943 - RNA, 22 nt, Human
accugccuauggagccacaugg

SEQ ID NO: 1060944 - RNA, 22 nt, Human
cugaaccacuaauauuuugauu

SEQ ID NO: 1060945 - RNA, 22 nt, Human
cuuuucacaggaggauaagccc

SEQ ID NO: 1060946 - RNA, 22 nt, Human
guuacucuuccccggggucugg

SEQ ID NO: 1060947 - RNA, 22 nt, Human
auaaacagaguaguugcuacug

SEQ ID NO: 1060948 - RNA, 22 nt, Human
ucacauaaauuuaccagaugau

SEQ ID NO: 1060949 - RNA, 19 nt, Human
ugcuucuggggcuucucca

SEQ ID NO: 1060950 - RNA, 22 nt, Human
cagccucugagccuuggcagau

SEQ ID NO: 1060951 - RNA, 22 nt, Human
uuuaaaaucagaugggaguugg

SEQ ID NO: 1060952 - RNA, 22 nt, Human
uagacacaucuucauccacaau

SEQ ID NO: 1060953 - RNA, 22 nt, Human
ugcagggacaggcucuggggau

SEQ ID NO: 1060954 - RNA, 22 nt, Human
acacagaguuugacacauggga

SEQ ID NO: 1060955 - RNA, 22 nt, Human
auauuugucaauucacuguuca

SEQ ID NO: 1060956 - RNA, 22 nt, Human
auucugucuuuuuaaaauaaua

SEQ ID NO: 1060957 - RNA, 22 nt, Human
auguguuuguaccuuuaaauau

SEQ ID NO: 1060958 - RNA, 22 nt, Human
uagcaauagaaacauauaaagu

SEQ ID NO: 1060959 - RNA, 22 nt, Human
uuaguuaguggggcugucaguc

SEQ ID NO: 1060960 - RNA, 22 nt, Human
aagggcucccugccugaggugg

SEQ ID NO: 1060961 - RNA, 19 nt, Human
ggcggguggacuggagccc

SEQ ID NO: 1060962 - RNA, 22 nt, Human
ucauuuaauugguuuugcucgu

SEQ ID NO: 1060963 - RNA, 22 nt, Human
gaaacugaguaggcuagagcac

SEQ ID NO: 1060964 - RNA, 22 nt, Human
uacacacagaggccaugggauu

SEQ ID NO: 1060965 - RNA, 22 nt, Human
caggcucuuuugguggcaagga

SEQ ID NO: 1060966 - RNA, 22 nt, Human
auucagcaaugagcuuggauuu

SEQ ID NO: 1060967 - RNA, 22 nt, Human
aagcuuuaagugucagucagcc

SEQ ID NO: 1060968 - RNA, 21 nt, Human
uccuguaagcuuggguggcuc

SEQ ID NO: 1060969 - RNA, 22 nt, Human
ucuagaauuuugccauauagcu

SEQ ID NO: 1060970 - RNA, 22 nt, Human
aggaaacuguccccucauccua

SEQ ID NO: 1060971 - RNA, 22 nt, Human
uauuagggaacugcaagacuaa

SEQ ID NO: 1060972 - RNA, 22 nt, Human
uccugagcaacacagcuaagug

SEQ ID NO: 1060973 - RNA, 22 nt, Human
ccucccuucaguagagcccaau

SEQ ID NO: 1060974 - RNA, 22 nt, Human
ugcuagaagauagcuagaagau

SEQ ID NO: 1060975 - RNA, 22 nt, Human
agaauccucuucaguaaauucu

SEQ ID NO: 1060976 - RNA, 22 nt, Human
aauguauuccucaugcaagagu

SEQ ID NO: 1060977 - RNA, 22 nt, Human
ucugugacugauggaggcuuuu

SEQ ID NO: 1060978 - RNA, 22 nt, Human
ccagcuuuauagcuucaaagga

SEQ ID NO: 1060979 - RNA, 22 nt, Human
uccugcagagucccacugauuu

SEQ ID NO: 1060980 - RNA, 22 nt, Human
gguuucaaugagaagugcuugu

SEQ ID NO: 1060981 - RNA, 22 nt, Human
ugggcugagaguaccuuauaaa

SEQ ID NO: 1060982 - RNA, 22 nt, Human
gagacaucauaaugaaguuucc

SEQ ID NO: 1060983 - RNA, 22 nt, Human
ucccaccccuugacucuuuaag

SEQ ID NO: 1060984 - RNA, 22 nt, Human
ugcagccccugaaaauggcagc

SEQ ID NO: 1060985 - RNA, 19 nt, Human
gccugcagaaaaggcaggg

SEQ ID NO: 1060986 - RNA, 22 nt, Human
uuugacaaauccuucagcaaug

SEQ ID NO: 1060987 - RNA, 22 nt, Human
guuauuaguaagacucgcacau

SEQ ID NO: 1060988 - RNA, 18 nt, Human
agacccucuaagggcagu

SEQ ID NO: 1060989 - RNA, 16 nt, Human
uccaggcauaucugag

SEQ ID NO: 1060990 - RNA, 23 nt, Human
aaauaugucugagggcaaagaau

SEQ ID NO: 1060991 - RNA, 22 nt, Human
ucuaggaguaaugagcuagcac

SEQ ID NO: 1060992 - RNA, 22 nt, Human
ucaucacaauuuuaugacccuc

SEQ ID NO: 1060993 - RNA, 22 nt, Human
agggcuccaggggcugggugac

SEQ ID NO: 1060994 - RNA, 22 nt, Human
uggcuagguagcuuucugcugu

SEQ ID NO: 1060995 - RNA, 22 nt, Human
uccgccaggacugagggcccau

SEQ ID NO: 1060996 - RNA, 22 nt, Human
aggcuuuaaguggccuacagcu

SEQ ID NO: 1060997 - RNA, 23 nt, Human
cagcuuucagggcuuuagggaag

SEQ ID NO: 1060998 - RNA, 22 nt, Human
auguccagagccggccugcuga

SEQ ID NO: 1060999 - RNA, 22 nt, Human
gauuuucugagccuucaaauuu

SEQ ID NO: 1061000 - RNA, 22 nt, Human
gccaggcagauaugugagcuua

SEQ ID NO: 1061001 - RNA, 22 nt, Human
guagggacccacagucuauauu

SEQ ID NO: 1061002 - RNA, 22 nt, Human
ugaguguauaucaggagagagc

SEQ ID NO: 1061003 - RNA, 22 nt, Human
ccucugugucuugguuucaaga

SEQ ID NO: 1061004 - RNA, 22 nt, Human
cagggccagagagggcuggcug

SEQ ID NO: 1061005 - RNA, 22 nt, Human
uggcacaguccugggugccugc

SEQ ID NO: 1061006 - RNA, 22 nt, Human
uuugaaauaugaggcauuauga

SEQ ID NO: 1061007 - RNA, 20 nt, Human
uauuuguauuugggaaaguu

SEQ ID NO: 1061008 - RNA, 22 nt, Human
uaguuaggaaaguccagggagc

SEQ ID NO: 1061009 - RNA, 22 nt, Human
cuagguauucauguuucguggc

SEQ ID NO: 1061010 - RNA, 22 nt, Human
ugggccagcaauugcugcucag

SEQ ID NO: 1061011 - RNA, 22 nt, Human
gcagcuuucugcaaugucaucc

SEQ ID NO: 1061012 - RNA, 22 nt, Human
aauacuuuccuauauaaggugc

SEQ ID NO: 1061013 - RNA, 19 nt, Human
aauuagggagucgguuaag

SEQ ID NO: 1061014 - RNA, 22 nt, Human
gaugggcguggcgcguuuggug

SEQ ID NO: 1061015 - RNA, 22 nt, Human
cagcuucuggcguggagccuga

SEQ ID NO: 1061016 - RNA, 22 nt, Human
ggguaccaagcugcuugggggc

SEQ ID NO: 1061017 - RNA, 22 nt, Human
cauaauauacuacauugaugaa

SEQ ID NO: 1061018 - RNA, 22 nt, Human
uucugucucuguguuuacauua

SEQ ID NO: 1061019 - RNA, 19 nt, Human
uucuaccuuacuguaggcu

SEQ ID NO: 1061020 - RNA, 22 nt, Human
cagggcucagaagacagaccuc

SEQ ID NO: 1061021 - RNA, 22 nt, Human
cagaggcugcucuggguggcau

SEQ ID NO: 1061022 - RNA, 22 nt, Human
ggcaggcuggcuuuguuccagg

SEQ ID NO: 1061023 - RNA, 23 nt, Human
uguggcugagaaauugacaacuu

SEQ ID NO: 1061024 - RNA, 22 nt, Human
gcacauaacugaccacaucuaa

SEQ ID NO: 1061025 - RNA, 21 nt, Human
ucuggcaggaagacggauggg

SEQ ID NO: 1061026 - RNA, 22 nt, Human
aaugaagccagguagaagagaa

SEQ ID NO: 1061027 - RNA, 22 nt, Human
gccuggaaugcaaugugacgaa

SEQ ID NO: 1061028 - RNA, 22 nt, Human
caggcugccgugaagcaggccu

SEQ ID NO: 1061029 - RNA, 22 nt, Human
uuacaauaccacaucaccucau

SEQ ID NO: 1061030 - RNA, 22 nt, Human
aaaguuugcaauuuauguuaau

SEQ ID NO: 1061031 - RNA, 22 nt, Human
uagcuuuacaaagugcugcacc

SEQ ID NO: 1061032 - RNA, 22 nt, Human
auguuagaaggaauguuaaaag

SEQ ID NO: 1061033 - RNA, 21 nt, Human
uccagcucuuauguucaugaa

SEQ ID NO: 1061034 - RNA, 18 nt, Human
gaugaagcugcuggggau

SEQ ID NO: 1061035 - RNA, 22 nt, Human
ugcaaaauaaugaacgauuuuu

SEQ ID NO: 1061036 - RNA, 22 nt, Human
uuuucauuguaaaucaggaaac

SEQ ID NO: 1061037 - RNA, 20 nt, Human
cccagagccauagccagaca

SEQ ID NO: 1061038 - RNA, 22 nt, Human
ucuggcaguugccgcuucaguc

SEQ ID NO: 1061039 - RNA, 22 nt, Human
cuguggcuucugcuugggccuc

SEQ ID NO: 1061040 - RNA, 22 nt, Human
gcuaggagccgcugcacuaggu

SEQ ID NO: 1061041 - RNA, 22 nt, Human
uuccuggccccaccccuggaga

SEQ ID NO: 1061042 - RNA, 22 nt, Human
agcaaacuaauugcaguucugg

SEQ ID NO: 1061043 - RNA, 22 nt, Human
ugaauccagagcuauuucgucc

SEQ ID NO: 1061044 - RNA, 22 nt, Human
aacuuucaggcaaugaauauuu

SEQ ID NO: 1061045 - RNA, 22 nt, Human
uaccugcaaaguuccuuuugcc

SEQ ID NO: 1061046 - RNA, 22 nt, Human
cagaaagaccugggcucaagag

SEQ ID NO: 1061047 - RNA, 22 nt, Human
acacucuguaaugucacacucc

SEQ ID NO: 1061048 - RNA, 22 nt, Human
ccagcuuuugcacuggacuggg

SEQ ID NO: 1061049 - RNA, 22 nt, Human
caugaagcucuugcaccucuag

SEQ ID NO: 1061050 - RNA, 22 nt, Human
ugcuucuggaguaacaggguga

SEQ ID NO: 1061051 - RNA, 22 nt, Human
ggccucucagggcagagacccu

SEQ ID NO: 1061052 - RNA, 22 nt, Human
ucuccaggagcaagucacccag

SEQ ID NO: 1061053 - RNA, 23 nt, Human
uuccaagugcuuuacuuaauccu

SEQ ID NO: 1061054 - RNA, 23 nt, Human
ugggaccuguuugcccacagaug

SEQ ID NO: 1061055 - RNA, 22 nt, Human
ucaucaguguccuuaucacuua

SEQ ID NO: 1061056 - RNA, 22 nt, Human
uccuggcagggucuaggucuag

SEQ ID NO: 1061057 - RNA, 22 nt, Human
cauuuguagcuauuuacuguau

SEQ ID NO: 1061058 - RNA, 19 nt, Human
uccuggcacaguggaacca

SEQ ID NO: 1061059 - RNA, 22 nt, Human
auguaugaugcuaggcucucag

SEQ ID NO: 1061060 - RNA, 22 nt, Human
ggcaggcuagcacugauguccu

SEQ ID NO: 1061061 - RNA, 22 nt, Human
gaaagacuuccuuugagaguac

SEQ ID NO: 1061062 - RNA, 22 nt, Human
uaaauucugaucaaguuccuuc

SEQ ID NO: 1061063 - RNA, 23 nt, Human
acaggcucuuaaucagugcuccu

SEQ ID NO: 1061064 - RNA, 22 nt, Human
aacaguaacgagauguccuaac

SEQ ID NO: 1061065 - RNA, 22 nt, Human
gcagccucaaacuccccagcuc

SEQ ID NO: 1061066 - RNA, 23 nt, Human
ugcagggcaaguuagagacccca

SEQ ID NO: 1061067 - RNA, 22 nt, Human
gcugcgccggaucccacguucc

SEQ ID NO: 1061068 - RNA, 22 nt, Human
caauacugaguuuacauucauc

SEQ ID NO: 1061069 - RNA, 22 nt, Human
cuuaaauucuuaaugcccucau

SEQ ID NO: 1061070 - RNA, 22 nt, Human
agcuuuaucccuugcccaucga

SEQ ID NO: 1061071 - RNA, 22 nt, Human
ugggcuucauaauugguccuag

SEQ ID NO: 1061072 - RNA, 22 nt, Human
agccagaguugaaugugagucu

SEQ ID NO: 1061073 - RNA, 22 nt, Human
ugcuuuaucaaagcuauaguga

SEQ ID NO: 1061074 - RNA, 22 nt, Human
ccugggcucacagccaaggcuc

SEQ ID NO: 1061075 - RNA, 22 nt, Human
aggaccugagaguuggaaaucc

SEQ ID NO: 1061076 - RNA, 22 nt, Human
ccagagcccagggucaugcagg

SEQ ID NO: 1061077 - RNA, 22 nt, Human
uauggaaacuaauucauuuuuc

SEQ ID NO: 1061078 - RNA, 22 nt, Human
aucagagaaguuucacuggcau

SEQ ID NO: 1061079 - RNA, 22 nt, Human
ggaccugcucucccaguucucu

SEQ ID NO: 1061080 - RNA, 22 nt, Human
agcaggcuuaugguugaaggga

SEQ ID NO: 1061081 - RNA, 22 nt, Human
accugccucagugcagcuggau

SEQ ID NO: 1061082 - RNA, 22 nt, Human
ugggcugaguguggaacuaguu

SEQ ID NO: 1061083 - RNA, 22 nt, Human
gcaguguuguuaaaagauuaga

SEQ ID NO: 1061084 - RNA, 22 nt, Human
aggaggcuguggagcacuccau

SEQ ID NO: 1061085 - RNA, 22 nt, Human
uagggcuccacucccagagauu

SEQ ID NO: 1061086 - RNA, 22 nt, Human
aauaucuucuaaggauagaacu

SEQ ID NO: 1061087 - RNA, 22 nt, Human
acuggcuugaaguagauucaaa

SEQ ID NO: 1061088 - RNA, 22 nt, Human
cccaggcagccugcagggaagg

SEQ ID NO: 1061089 - RNA, 22 nt, Human
guuagguagaaguuuacuuuga

SEQ ID NO: 1061090 - RNA, 22 nt, Human
ugcucuguauucuauggcaguu

SEQ ID NO: 1061091 - RNA, 22 nt, Human
gaccugccugagcugccucugc

SEQ ID NO: 1061092 - RNA, 22 nt, Human
uacuuacagaaggaagcaauug

SEQ ID NO: 1061093 - RNA, 22 nt, Human
uaugaaacauucauacaaauaa

SEQ ID NO: 1061094 - RNA, 22 nt, Human
cagcuuuagagaaaacauauuu

SEQ ID NO: 1061095 - RNA, 22 nt, Human
uggccucugggaaagcagauuc

SEQ ID NO: 1061096 - RNA, 22 nt, Human
cagggcucaccacugggauccu

SEQ ID NO: 1061097 - RNA, 22 nt, Human
agcagcuccugccaugagugcu

SEQ ID NO: 1061098 - RNA, 22 nt, Human
auguccaguuucuacacacaua

SEQ ID NO: 1061099 - RNA, 22 nt, Human
gugugggaaggcuaggaugcug

SEQ ID NO: 1061100 - RNA, 22 nt, Human
uuucacauuggcuucuauuucu

SEQ ID NO: 1061101 - RNA, 22 nt, Human
cucugggcaaguuucuucauga

SEQ ID NO: 1061102 - RNA, 22 nt, Human
cccagggaagggcuaccugagg

SEQ ID NO: 1061103 - RNA, 22 nt, Human
ugucuucaucuccaugcacaga

SEQ ID NO: 1061104 - RNA, 22 nt, Human
ggcagaccucuccagccccaca

SEQ ID NO: 1061105 - RNA, 22 nt, Human
auuugaaaucccuucuacugua

SEQ ID NO: 1061106 - RNA, 22 nt, Human
caguguuugcuuaaguuauaug

SEQ ID NO: 1061107 - RNA, 20 nt, Human
cccaggcagagcuagcggca

SEQ ID NO: 1061108 - RNA, 22 nt, Human
ccugcaggcugcaggccaguuc

SEQ ID NO: 1061109 - RNA, 22 nt, Human
aaaaguauuuauggcuauguaa

SEQ ID NO: 1061110 - RNA, 22 nt, Human
aggacaguccgggguccuccac

SEQ ID NO: 1061111 - RNA, 22 nt, Human
ugccaggcacgugagaguggcc

SEQ ID NO: 1061112 - RNA, 17 nt, Human
ucgguuugccaggcuuc

SEQ ID NO: 1061113 - RNA, 22 nt, Human
ccuccagcgcgauccacuccgg

SEQ ID NO: 1061114 - RNA, 22 nt, Human
cagagcauugagggucugccaa

SEQ ID NO: 1061115 - RNA, 21 nt, Human
gccugcaguuuugaagcccuu

SEQ ID NO: 1061116 - RNA, 22 nt, Human
augcuucagugcuaccuucaaa

SEQ ID NO: 1061117 - RNA, 22 nt, Human
ccuggcaguuuugcccaggauu

SEQ ID NO: 1061118 - RNA, 21 nt, Human
augugaaauaucaucagagca

SEQ ID NO: 1061119 - RNA, 22 nt, Human
uauugaaauucuucauguccuc

SEQ ID NO: 1061120 - RNA, 22 nt, Human
ucauacaauucaaucucugauu

SEQ ID NO: 1061121 - RNA, 23 nt, Human
ccaggcucuuucaccugcuauuc

SEQ ID NO: 1061122 - RNA, 22 nt, Human
uuucuugacugcuuaggaaugc

SEQ ID NO: 1061123 - RNA, 22 nt, Human
ggcuuuauguuuuucauguggu

SEQ ID NO: 1061124 - RNA, 22 nt, Human
uccaggcuuuuucaugcugucu

SEQ ID NO: 1061125 - RNA, 22 nt, Human
cucuccagccuuuagcccacgc

SEQ ID NO: 1061126 - RNA, 22 nt, Human
cagaagagaugaaauaguauua

SEQ ID NO: 1061127 - RNA, 22 nt, Human
cgcaggcugcagccaagaagag

SEQ ID NO: 1061128 - RNA, 22 nt, Human
gagcucagccugaggccuggcu

SEQ ID NO: 1061129 - RNA, 23 nt, Human
agggcuccuuguugauuagcauu

SEQ ID NO: 1061130 - RNA, 20 nt, Human
gcugggcuuugacugacaca

SEQ ID NO: 1061131 - RNA, 18 nt, Human
cccacacagcaguagcuc

SEQ ID NO: 1061132 - RNA, 22 nt, Human
cccugccucugaagcugcucag

SEQ ID NO: 1061133 - RNA, 22 nt, Human
cagucuggaggucagcuggcuu

SEQ ID NO: 1061134 - RNA, 22 nt, Human
uacauguauguguacgugcaug

SEQ ID NO: 1061135 - RNA, 22 nt, Human
uagcuuuaagacauggugaaug

SEQ ID NO: 1061136 - RNA, 22 nt, Human
augacucuuagcuaaagguaag

SEQ ID NO: 1061137 - RNA, 22 nt, Human
uaugaacuagcugauuuaguuu

SEQ ID NO: 1061138 - RNA, 19 nt, Human
gcugggcuuggguuuguag

SEQ ID NO: 1061139 - RNA, 22 nt, Human
ccagcuuuuagugggcuuauua

SEQ ID NO: 1061140 - RNA, 22 nt, Human
gaggagcugagccacguccugg

SEQ ID NO: 1061141 - RNA, 22 nt, Human
ugagcagagucgcuccagagug

SEQ ID NO: 1061142 - RNA, 22 nt, Human
ucccagccaggcucuaccacuu

SEQ ID NO: 1061143 - RNA, 22 nt, Human
aaguuuaacuugaauucuuucu

SEQ ID NO: 1061144 - RNA, 22 nt, Human
ccaucuccaaauaccaucacau

SEQ ID NO: 1061145 - RNA, 22 nt, Human
gcucugagaggaugcugagcag

SEQ ID NO: 1061146 - RNA, 22 nt, Human
accaggcacucuuguggcagug

SEQ ID NO: 1061147 - RNA, 22 nt, Human
ugcuucuguucuuucaccuacg

SEQ ID NO: 1061148 - RNA, 22 nt, Human
gccaggcaggugucggagcccu

SEQ ID NO: 1061149 - RNA, 20 nt, Human
acuggcagccugccugcugu

SEQ ID NO: 1061150 - RNA, 22 nt, Human
ucuggcaguggaugagggcagc

SEQ ID NO: 1061151 - RNA, 22 nt, Human
agccuauuccaggaugagcuca

SEQ ID NO: 1061152 - RNA, 22 nt, Human
cacagcuucccaaaguggaccu

SEQ ID NO: 1061153 - RNA, 22 nt, Human
ucagagagguuaaauaucuugu

SEQ ID NO: 1061154 - RNA, 22 nt, Human
aauuaggggaggacguaucaua

SEQ ID NO: 1061155 - RNA, 22 nt, Human
ucuggucaguaauaagaagugg

SEQ ID NO: 1061156 - RNA, 22 nt, Human
acagauauuuggggaaagacgu

SEQ ID NO: 1061157 - RNA, 22 nt, Human
uaauaucuggcauucaaacaug

SEQ ID NO: 1061158 - RNA, 18 nt, Human
ggccucuggacuggcagc

SEQ ID NO: 1061159 - RNA, 22 nt, Human
ccuggcaguucaucaaauggca

SEQ ID NO: 1061160 - RNA, 22 nt, Human
acauuucacuguucacagcagg

SEQ ID NO: 1061161 - RNA, 22 nt, Human
guaugaaguaagauauuguuca

SEQ ID NO: 1061162 - RNA, 22 nt, Human
gaaugaauucagcacauggaau

SEQ ID NO: 1061163 - RNA, 22 nt, Human
cagucucucuuguagugcagcu

SEQ ID NO: 1061164 - RNA, 22 nt, Human
gcuuucuugguucugcaggggc

SEQ ID NO: 1061165 - RNA, 22 nt, Human
ucagagaguuagugucuuagcu

SEQ ID NO: 1061166 - RNA, 22 nt, Human
gucaaaaaguagucauuucugu

SEQ ID NO: 1061167 - RNA, 22 nt, Human
aggaagaaccuaagaaagucuc

SEQ ID NO: 1061168 - RNA, 18 nt, Human
gacacauccccaggccuc

SEQ ID NO: 1061169 - RNA, 22 nt, Human
gcaggcucuucuuucugcccag

SEQ ID NO: 1061170 - RNA, 22 nt, Human
aaauuucuugaggcucucuagc

SEQ ID NO: 1061171 - RNA, 22 nt, Human
gcagcucugacaaugccuggaa

SEQ ID NO: 1061172 - RNA, 22 nt, Human
uggcaguggcucagagugcaga

SEQ ID NO: 1061173 - RNA, 22 nt, Human
ccagagagaaaauggagggcca

SEQ ID NO: 1061174 - RNA, 22 nt, Human
gcaaacuggcaaaccugucugu

SEQ ID NO: 1061175 - RNA, 22 nt, Human
ggguuucaugguucucacaaug

SEQ ID NO: 1061176 - RNA, 22 nt, Human
aacaaccaaaaagaugaaugua

SEQ ID NO: 1061177 - RNA, 22 nt, Human
caugaaugcuggguucauguaa

SEQ ID NO: 1061178 - RNA, 18 nt, Human
uaaauauauuucccccuu

SEQ ID NO: 1061179 - RNA, 22 nt, Human
uccugcagaccucagucagguc

SEQ ID NO: 1061180 - RNA, 22 nt, Human
ccuggcagcgccgaagcuggcc

SEQ ID NO: 1061181 - RNA, 22 nt, Human
aucaaauauaauaauuuucgcu

SEQ ID NO: 1061182 - RNA, 18 nt, Human
gcagcuuuugauucaccc

SEQ ID NO: 1061183 - RNA, 22 nt, Human
cagcccaaagccccaggcuaga

SEQ ID NO: 1061184 - RNA, 21 nt, Human
uuacaaagcaagugcuguguc

SEQ ID NO: 1061185 - RNA, 22 nt, Human
ggcuuuauuucacuguaccaua

SEQ ID NO: 1061186 - RNA, 23 nt, Human
acugggcuuaugaggaggcuugu

SEQ ID NO: 1061187 - RNA, 22 nt, Human
gaggcuccccaugaggccccag

SEQ ID NO: 1061188 - RNA, 22 nt, Human
uacacaacugacaaccauucug

SEQ ID NO: 1061189 - RNA, 21 nt, Human
aguuugaugcaauuucugaga

SEQ ID NO: 1061190 - RNA, 22 nt, Human
cacagagacagaagcacuuaug

SEQ ID NO: 1061191 - RNA, 22 nt, Human
ucugggcugguugugcuugcuu

SEQ ID NO: 1061192 - RNA, 22 nt, Human
uauuucccagggagcaacaagc

SEQ ID NO: 1061193 - RNA, 21 nt, Human
uccugcagaaugccuuccuac

SEQ ID NO: 1061194 - RNA, 22 nt, Human
agagcagauggagcuggaagag

SEQ ID NO: 1061195 - RNA, 22 nt, Human
uggcagggccuaccccaauauc

SEQ ID NO: 1061196 - RNA, 22 nt, Human
cugggcuguucugccccugggu

SEQ ID NO: 1061197 - RNA, 22 nt, Human
ugucuuuagagucacaaaacca

SEQ ID NO: 1061198 - RNA, 22 nt, Human
aauauaauuuuauuccuagagu

SEQ ID NO: 1061199 - RNA, 22 nt, Human
guaugcaucgacucaagucuga

SEQ ID NO: 1061200 - RNA, 22 nt, Human
cagaugaggggcauauaacaau

SEQ ID NO: 1061201 - RNA, 22 nt, Human
cauguuuuguguacagaauauu

SEQ ID NO: 1061202 - RNA, 22 nt, Human
agugaaccaggcugcgucccug

SEQ ID NO: 1061203 - RNA, 20 nt, Human
ugcaggcuucgcucuaggag

SEQ ID NO: 1061204 - RNA, 22 nt, Human
uuaugggagcaauuggggaggu

SEQ ID NO: 1061205 - RNA, 22 nt, Human
uggccaggcuggucuggaacgc

SEQ ID NO: 1061206 - RNA, 22 nt, Human
acugggcuguaaagagaggcaa

SEQ ID NO: 1061207 - RNA, 22 nt, Human
uuuaaauuuguguuuagagggu

SEQ ID NO: 1061208 - RNA, 22 nt, Human
cauguacaaaaggcaaaugccu

SEQ ID NO: 1061209 - RNA, 22 nt, Human
cuggaaagaccugcuugcuuuu

SEQ ID NO: 1061210 - RNA, 22 nt, Human
acuggggaguugaagcacuuuc

SEQ ID NO: 1061211 - RNA, 22 nt, Human
uuccaagucacccuuaggguca

SEQ ID NO: 1061212 - RNA, 22 nt, Human
ugcagggaaaacccaggaugcu

SEQ ID NO: 1061213 - RNA, 22 nt, Human
uucuugaaucacuuuagagaua

SEQ ID NO: 1061214 - RNA, 21 nt, Human
auaaaguuuuacaggaaugca

SEQ ID NO: 1061215 - RNA, 22 nt, Human
aacaugauuuaguauaaugcag

SEQ ID NO: 1061216 - RNA, 22 nt, Human
augcauugucugguuucauuuu

SEQ ID NO: 1061217 - RNA, 22 nt, Human
cagauuuagaguggggcuugga

SEQ ID NO: 1061218 - RNA, 23 nt, Human
ucagggacaugaugugucauauc

SEQ ID NO: 1061219 - RNA, 22 nt, Human
gcaaaucaccaccuagcuggau

SEQ ID NO: 1061220 - RNA, 22 nt, Human
acccaggcugcuucucaguggc

SEQ ID NO: 1061221 - RNA, 22 nt, Human
ccacuguauuuuggaagcagau

SEQ ID NO: 1061222 - RNA, 22 nt, Human
gucaggacucugacccgucccg

SEQ ID NO: 1061223 - RNA, 22 nt, Human
acaggcucacagucauuucauu

SEQ ID NO: 1061224 - RNA, 22 nt, Human
gcacacaguagggauucaauga

SEQ ID NO: 1061225 - RNA, 22 nt, Human
aaggaccuauauugucagagga

SEQ ID NO: 1061226 - RNA, 22 nt, Human
aauuaugauuggucuaaaccag

SEQ ID NO: 1061227 - RNA, 22 nt, Human
caggucuuuucuacugguggag

SEQ ID NO: 1061228 - RNA, 22 nt, Human
gccaggcaguucaaguacacca

SEQ ID NO: 1061229 - RNA, 22 nt, Human
cuguccagaaagggggcaacaa

SEQ ID NO: 1061230 - RNA, 22 nt, Human
uuccaaguuaggcgagcuggug

SEQ ID NO: 1061231 - RNA, 22 nt, Human
agauuucugucaccuucuaugc

SEQ ID NO: 1061232 - RNA, 22 nt, Human
auggcagauggcuggagcaggu

SEQ ID NO: 1061233 - RNA, 21 nt, Human
uugaccaagggugcgugcucc

SEQ ID NO: 1061234 - RNA, 21 nt, Human
ugcauaaagaaauacaaauac

SEQ ID NO: 1061235 - RNA, 22 nt, Human
ccaggcucagggcagacuuuca

SEQ ID NO: 1061236 - RNA, 22 nt, Human
agggcugaaguuauggcugagc

SEQ ID NO: 1061237 - RNA, 22 nt, Human
ccacaucauggauacaguuaug

SEQ ID NO: 1061238 - RNA, 22 nt, Human
guccuggcugguucuguggggc

SEQ ID NO: 1061239 - RNA, 22 nt, Human
augugagggaaaucagucagaa

SEQ ID NO: 1061240 - RNA, 22 nt, Human
auucugucuaagcuggcuacgu

SEQ ID NO: 1061241 - RNA, 23 nt, Human
auauuagggagauuagcccucua

SEQ ID NO: 1061242 - RNA, 22 nt, Human
accugcaguggccacuccuaau

SEQ ID NO: 1061243 - RNA, 22 nt, Human
aaaaagucugcaaaggagguug

SEQ ID NO: 1061244 - RNA, 22 nt, Human
ggggucccugcaccagcauguc

SEQ ID NO: 1061245 - RNA, 22 nt, Human
cagcuuugccaaguaaggucuu

SEQ ID NO: 1061246 - RNA, 22 nt, Human
guggggacgggauggcucacug

SEQ ID NO: 1061247 - RNA, 22 nt, Human
gaacacaugauuauaaaugcua

SEQ ID NO: 1061248 - RNA, 22 nt, Human
uuccagcuaacucacaucccuu

SEQ ID NO: 1061249 - RNA, 22 nt, Human
ucuggcagagucagugcacaca

SEQ ID NO: 1061250 - RNA, 22 nt, Human
gcagcuuugaagacuuauuugc

SEQ ID NO: 1061251 - RNA, 22 nt, Human
agccuccaucucccaucuguga

SEQ ID NO: 1061252 - RNA, 22 nt, Human
auguccagggcacacagcagug

SEQ ID NO: 1061253 - RNA, 22 nt, Human
cccaggcagggacgugcucugg

SEQ ID NO: 1061254 - RNA, 22 nt, Human
ugcuucugacauguucuugguu

SEQ ID NO: 1061255 - RNA, 22 nt, Human
uuaguuagucccugguaccuuu

SEQ ID NO: 1061256 - RNA, 22 nt, Human
cccagcucugcagaccugcccu

SEQ ID NO: 1061257 - RNA, 22 nt, Human
cagggagcuuucccaggacccu

SEQ ID NO: 1061258 - RNA, 22 nt, Human
cauuuacuuaaaucuuuacaag

SEQ ID NO: 1061259 - RNA, 22 nt, Human
uccugcaguuacaucccagcca

SEQ ID NO: 1061260 - RNA, 23 nt, Human
ucuuuucaaugguucuuuaugug

SEQ ID NO: 1061261 - RNA, 19 nt, Human
accugcaguaauaauuccu

SEQ ID NO: 1061262 - RNA, 22 nt, Human
caacuuuaugauugguuuguca

SEQ ID NO: 1061263 - RNA, 22 nt, Human
ccaaugauggugcccacgauga

SEQ ID NO: 1061264 - RNA, 20 nt, Human
uggccucugagaugccacgg

SEQ ID NO: 1061265 - RNA, 22 nt, Human
uagcuuuaccauagaagaguau

SEQ ID NO: 1061266 - RNA, 22 nt, Human
ccagcccuugcugaaggguggc

SEQ ID NO: 1061267 - RNA, 21 nt, Human
ugcuuuaugggaaaaauguca

SEQ ID NO: 1061268 - RNA, 22 nt, Human
ccacccagccagaugcaggaag

SEQ ID NO: 1061269 - RNA, 22 nt, Human
cagcucugcugggaggaugcag

SEQ ID NO: 1061270 - RNA, 22 nt, Human
gaaauauuacaguggaggggau

SEQ ID NO: 1061271 - RNA, 22 nt, Human
ucugauuagcaguuuagggaaa

SEQ ID NO: 1061272 - RNA, 21 nt, Human
ucuggcagcaguuuguugagu

SEQ ID NO: 1061273 - RNA, 22 nt, Human
gagauggagucuuuuucuguca

SEQ ID NO: 1061274 - RNA, 22 nt, Human
uaugaaaugguaguaggaaggg

SEQ ID NO: 1061275 - RNA, 22 nt, Human
agauuucucuuucccuggcuga

SEQ ID NO: 1061276 - RNA, 22 nt, Human
acauauuuugaaagcuuucuaa

SEQ ID NO: 1061277 - RNA, 22 nt, Human
cagcuuauucaguaagcacaua

SEQ ID NO: 1061278 - RNA, 19 nt, Human
gacuccaacuuuaagcaug

SEQ ID NO: 1061279 - RNA, 22 nt, Human
cucagagagggcaccagggcca

SEQ ID NO: 1061280 - RNA, 22 nt, Human
uuuauuuggcauccagggagaa

SEQ ID NO: 1061281 - RNA, 22 nt, Human
gaacaucagucauaauuuaacg

SEQ ID NO: 1061282 - RNA, 22 nt, Human
ccaguguucauaauuuuacacu

SEQ ID NO: 1061283 - RNA, 22 nt, Human
aggcuuuggggcauucuguguu

SEQ ID NO: 1061284 - RNA, 22 nt, Human
agggggucguccggaagaccug

SEQ ID NO: 1061285 - RNA, 22 nt, Human
uccugagcuacaguaguaugau

SEQ ID NO: 1061286 - RNA, 23 nt, Human
agcuuugugaaagcagacauggg

SEQ ID NO: 1061287 - RNA, 22 nt, Human
agccagagcagggaauuggaca

SEQ ID NO: 1061288 - RNA, 22 nt, Human
gcauaugaucacgugugucggu

SEQ ID NO: 1061289 - RNA, 22 nt, Human
gcuggggagcaagaguagugag

SEQ ID NO: 1061290 - RNA, 22 nt, Human
auguuauggcucaaacauuugg

SEQ ID NO: 1061291 - RNA, 22 nt, Human
uuccaggcuauccggugaaggg

SEQ ID NO: 1061292 - RNA, 21 nt, Human
ccuggcagaagccugauaugc

SEQ ID NO: 1061293 - RNA, 22 nt, Human
ggcuucugaaccaggcccugga

SEQ ID NO: 1061294 - RNA, 22 nt, Human
agaauaauacugaaaugcugaa

SEQ ID NO: 1061295 - RNA, 22 nt, Human
cagcuuuuuagaaucuagggca

SEQ ID NO: 1061296 - RNA, 22 nt, Human
ucuguguugauaauuuuggaga

SEQ ID NO: 1061297 - RNA, 22 nt, Human
ccagagaggccuuggcaagaca

SEQ ID NO: 1061298 - RNA, 20 nt, Human
accccacagaguccauugca

SEQ ID NO: 1061299 - RNA, 22 nt, Human
uuccaggcaugucagacauagg

SEQ ID NO: 1061300 - RNA, 22 nt, Human
cuguagaacgauccaggcauuu

SEQ ID NO: 1061301 - RNA, 22 nt, Human
gccaaaguaccuagcccucugc

SEQ ID NO: 1061302 - RNA, 22 nt, Human
uacuuacacagcuguagaaggu

SEQ ID NO: 1061303 - RNA, 20 nt, Human
uuuacauuuugaaacaguga

SEQ ID NO: 1061304 - RNA, 22 nt, Human
cccaggcaguagaaagaagagg

SEQ ID NO: 1061305 - RNA, 22 nt, Human
gcugggcuguaguuugcugacc

SEQ ID NO: 1061306 - RNA, 22 nt, Human
auugaaaaaugacuauugcuua

SEQ ID NO: 1061307 - RNA, 22 nt, Human
auguccagaguaaagcacauuc

SEQ ID NO: 1061308 - RNA, 22 nt, Human
agcucccagcagagcuggccac

SEQ ID NO: 1061309 - RNA, 19 nt, Human
ccacacagugugcaauuua

SEQ ID NO: 1061310 - RNA, 22 nt, Human
ugcugagcgcauccggcggccg

SEQ ID NO: 1061311 - RNA, 22 nt, Human
agacacauaggaccacacugug

SEQ ID NO: 1061312 - RNA, 22 nt, Human
uuuagggaagaagcccauggcc

SEQ ID NO: 1061313 - RNA, 22 nt, Human
auaaaauuugcuacuguuaaau

SEQ ID NO: 1061314 - RNA, 22 nt, Human
ccagcuuuuccucucauugcuu

SEQ ID NO: 1061315 - RNA, 22 nt, Human
uguaaacauaccagagccaagu

SEQ ID NO: 1061316 - RNA, 22 nt, Human
uucuuaaagaggcaaaacacag

SEQ ID NO: 1061317 - RNA, 22 nt, Human
cuuggcaggguggaggaugcag

SEQ ID NO: 1061318 - RNA, 22 nt, Human
uggaaauauacaaugugucucu

SEQ ID NO: 1061319 - RNA, 22 nt, Human
ucauuucuguugugcaucacug

SEQ ID NO: 1061320 - RNA, 22 nt, Human
gcugccacauuuucaggacuaa

SEQ ID NO: 1061321 - RNA, 22 nt, Human
guucuuaagaccacaauaaaaa

SEQ ID NO: 1061322 - RNA, 22 nt, Human
cacacaucaaccuagacauugu

SEQ ID NO: 1061323 - RNA, 22 nt, Human
cugaaccaucucuguucuguau

SEQ ID NO: 1061324 - RNA, 21 nt, Human
augugaaaccuuccacgcuga

SEQ ID NO: 1061325 - RNA, 21 nt, Human
uccugccuuaguccagagcag

SEQ ID NO: 1061326 - RNA, 18 nt, Human
ucucugaauauuuuaugu

SEQ ID NO: 1061327 - RNA, 22 nt, Human
aacagcauaaguauuuauuuca

SEQ ID NO: 1061328 - RNA, 22 nt, Human
cauucacaucuuguuccaucac

SEQ ID NO: 1061329 - RNA, 22 nt, Human
gccaggggugcccacccaagga

SEQ ID NO: 1061330 - RNA, 22 nt, Human
acaccauacucauguugguucc

SEQ ID NO: 1061331 - RNA, 22 nt, Human
cuguaugaacccauauacuuau

SEQ ID NO: 1061332 - RNA, 22 nt, Human
uccugcagccacugcaggcaga

SEQ ID NO: 1061333 - RNA, 22 nt, Human
ggcuccaaagggcagugugagg

SEQ ID NO: 1061334 - RNA, 22 nt, Human
uucagugucaauuuuuaaauau

SEQ ID NO: 1061335 - RNA, 22 nt, Human
uaugaacauguucauugacuua

SEQ ID NO: 1061336 - RNA, 22 nt, Human
cagggcucaggcucugggauuc

SEQ ID NO: 1061337 - RNA, 22 nt, Human
cccacccucaagggugucuaua

SEQ ID NO: 1061338 - RNA, 22 nt, Human
aaauuugauaagccauuguuac

SEQ ID NO: 1061339 - RNA, 22 nt, Human
auaugcauuuaccuggcauaua

SEQ ID NO: 1061340 - RNA, 18 nt, Human
cccucuugcacaaagcaa

SEQ ID NO: 1061341 - RNA, 18 nt, Human
gacccagcagaugggcuu

SEQ ID NO: 1061342 - RNA, 22 nt, Human
ccuggggaccugccucagcccu

SEQ ID NO: 1061343 - RNA, 22 nt, Human
ugcauaaacuucucugguguga

SEQ ID NO: 1061344 - RNA, 22 nt, Human
ucacauacugaaaguccaguga

SEQ ID NO: 1061345 - RNA, 22 nt, Human
ccaggccucaccugcccaccua

SEQ ID NO: 1061346 - RNA, 22 nt, Human
aggaccugacauuguguuuucu

SEQ ID NO: 1061347 - RNA, 22 nt, Human
aaauuacagaucaccaaugcau

SEQ ID NO: 1061348 - RNA, 22 nt, Human
auauuaggugcucaauacaugc

SEQ ID NO: 1061349 - RNA, 22 nt, Human
agcucccagaaggcccugcgcc

SEQ ID NO: 1061350 - RNA, 22 nt, Human
gccaggcaaauuaaggaaugca

SEQ ID NO: 1061351 - RNA, 22 nt, Human
gccaggcagcagcgaggauggu

SEQ ID NO: 1061352 - RNA, 22 nt, Human
uugggaaguuuaaugacagacu

SEQ ID NO: 1061353 - RNA, 22 nt, Human
uuuuucuuaaauguggguuggc

SEQ ID NO: 1061354 - RNA, 22 nt, Human
agcuuuaugggagcuuagauaa

SEQ ID NO: 1061355 - RNA, 22 nt, Human
ucaggcccagagucacggaucc

SEQ ID NO: 1061356 - RNA, 22 nt, Human
ugcaggcucugguuuauagugc

SEQ ID NO: 1061357 - RNA, 22 nt, Human
uggaacacuguggaugagaaga

SEQ ID NO: 1061358 - RNA, 22 nt, Human
auggccugcagugcugccacag

SEQ ID NO: 1061359 - RNA, 22 nt, Human
accaagcuagaacauuacaggc

SEQ ID NO: 1061360 - RNA, 22 nt, Human
augggcugagaaucaagaauau

SEQ ID NO: 1061361 - RNA, 22 nt, Human
ccagcuuuagguugccugccag

SEQ ID NO: 1061362 - RNA, 17 nt, Human
gccugcaggcccgcaga

SEQ ID NO: 1061363 - RNA, 22 nt, Human
aggcugugacagggucauggag

SEQ ID NO: 1061364 - RNA, 22 nt, Human
uacaaaaggaagagggaucuua

SEQ ID NO: 1061365 - RNA, 22 nt, Human
augugaaaauccaauggcagca

SEQ ID NO: 1061366 - RNA, 22 nt, Human
ugcaggcugaggcuggcucaac

SEQ ID NO: 1061367 - RNA, 22 nt, Human
ggcuuuauuauguggccaugug

SEQ ID NO: 1061368 - RNA, 22 nt, Human
cuguaaauaugaagaauauaug

SEQ ID NO: 1061369 - RNA, 22 nt, Human
uucuagauagagugcaaauuau

SEQ ID NO: 1061370 - RNA, 22 nt, Human
gacccagcuuaagucacauguu

SEQ ID NO: 1061371 - RNA, 22 nt, Human
auaugagaguaaaugccgaucu

SEQ ID NO: 1061372 - RNA, 22 nt, Human
cauuuguaauacugacuugcag

SEQ ID NO: 1061373 - RNA, 22 nt, Human
cucugucagaguguugucccca

SEQ ID NO: 1061374 - RNA, 22 nt, Human
gccccacagccugcggucucag

SEQ ID NO: 1061375 - RNA, 22 nt, Human
ucaugaacauggaauaucuuuu

SEQ ID NO: 1061376 - RNA, 22 nt, Human
aaaacaggugucagcaaacuau

SEQ ID NO: 1061377 - RNA, 22 nt, Human
gccuggcacaguagggacccaa

SEQ ID NO: 1061378 - RNA, 22 nt, Human
ucugggcuuuguaaugggaggu

SEQ ID NO: 1061379 - RNA, 22 nt, Human
uuuguucaugccuauauucuca

SEQ ID NO: 1061380 - RNA, 22 nt, Human
cauuagggccaccauaacaaaa

SEQ ID NO: 1061381 - RNA, 19 nt, Human
ccaggccuggcgucuccgc

SEQ ID NO: 1061382 - RNA, 22 nt, Human
gccaggcagcaggaagccagug

SEQ ID NO: 1061383 - RNA, 22 nt, Human
uuugucaucccuuuugaaacug

SEQ ID NO: 1061384 - RNA, 22 nt, Human
caccagggccccaggcugugcc

SEQ ID NO: 1061385 - RNA, 22 nt, Human
ugggcucucaaagugcggcuug

SEQ ID NO: 1061386 - RNA, 22 nt, Human
gaacuguaguuaauacuacaca

SEQ ID NO: 1061387 - RNA, 22 nt, Human
agagcacagaagaauaggugcu

SEQ ID NO: 1061388 - RNA, 22 nt, Human
aauuuagauugauaaacaugga

SEQ ID NO: 1061389 - RNA, 22 nt, Human
ccaggcucugugugggcuagag

SEQ ID NO: 1061390 - RNA, 22 nt, Human
uccugggguuuuggccgcagcu

SEQ ID NO: 1061391 - RNA, 22 nt, Human
gcuccaagguauccaccagggu

SEQ ID NO: 1061392 - RNA, 22 nt, Human
gaaacauauuaauccagugaaa

SEQ ID NO: 1061393 - RNA, 22 nt, Human
gccugcagugagugcagaaggu

SEQ ID NO: 1061394 - RNA, 22 nt, Human
cucaccccacuaccccuuggug

SEQ ID NO: 1061395 - RNA, 22 nt, Human
cuuaaaaucuggcaguuagcua

SEQ ID NO: 1061396 - RNA, 22 nt, Human
gagggaccccaggcuggcccuu

SEQ ID NO: 1061397 - RNA, 22 nt, Human
uuucucuugcgauaugcuacac

SEQ ID NO: 1061398 - RNA, 21 nt, Human
gcaaguacuaucaucauuauc

SEQ ID NO: 1061399 - RNA, 22 nt, Human
auuagggcuggaugcaaggaaa

SEQ ID NO: 1061400 - RNA, 22 nt, Human
aggcacaggaggugguaagaag

SEQ ID NO: 1061401 - RNA, 22 nt, Human
ugcaggcugcuggcaguagcuu

SEQ ID NO: 1061402 - RNA, 22 nt, Human
gaaacauacgauuuaggagaaa

SEQ ID NO: 1061403 - RNA, 22 nt, Human
uuguaugaucccauuuagugaa

SEQ ID NO: 1061404 - RNA, 22 nt, Human
acacacuguaaggacuaucacu

SEQ ID NO: 1061405 - RNA, 19 nt, Human
cauuuagaaguacauauua

SEQ ID NO: 1061406 - RNA, 22 nt, Human
cccagcuucugagggggccuug

SEQ ID NO: 1061407 - RNA, 22 nt, Human
cagggcacggagaagucacccc

SEQ ID NO: 1061408 - RNA, 22 nt, Human
ucugggcuuggauuggcucugc

SEQ ID NO: 1061409 - RNA, 23 nt, Human
acaagauagggauaaaaagauaa

SEQ ID NO: 1061410 - RNA, 22 nt, Human
aggccccaaagcagugcaagua

SEQ ID NO: 1061411 - RNA, 22 nt, Human
uuauuagggugguuuauguucu

SEQ ID NO: 1061412 - RNA, 22 nt, Human
guggccagccagggugcugaug

SEQ ID NO: 1061413 - RNA, 22 nt, Human
auucauuuagguauucacuuac

SEQ ID NO: 1061414 - RNA, 22 nt, Human
aaacagcaggaacaucuugcca

SEQ ID NO: 1061415 - RNA, 22 nt, Human
uacauucagcaaaagaaugguu

SEQ ID NO: 1061416 - RNA, 22 nt, Human
ccagcccugucaccaacuggag

SEQ ID NO: 1061417 - RNA, 22 nt, Human
gacccggcuccaggcccagcag

SEQ ID NO: 1061418 - RNA, 22 nt, Human
uccagaccauggauggcugcaa

SEQ ID NO: 1061419 - RNA, 22 nt, Human
ucacacacauggauaguauuuu

SEQ ID NO: 1061420 - RNA, 22 nt, Human
gauauguauugaaugaucauuu

SEQ ID NO: 1061421 - RNA, 22 nt, Human
gagcucagcaaaggucugugug

SEQ ID NO: 1061422 - RNA, 22 nt, Human
cagcuuuaccaauauuuggaaa

SEQ ID NO: 1061423 - RNA, 19 nt, Human
aggcugugagggaggacuc

SEQ ID NO: 1061424 - RNA, 22 nt, Human
ugcuucugggcaaaugugugug

SEQ ID NO: 1061425 - RNA, 22 nt, Human
ucuugggauagugucucauggc

SEQ ID NO: 1061426 - RNA, 22 nt, Human
agcacugugauuuauaacauuu

SEQ ID NO: 1061427 - RNA, 22 nt, Human
cauuuauugaguggccacagug

SEQ ID NO: 1061428 - RNA, 22 nt, Human
uucuacaauaugaauaaugaag

SEQ ID NO: 1061429 - RNA, 22 nt, Human
acacacucaauugcauaagcac

SEQ ID NO: 1061430 - RNA, 22 nt, Human
cagggcucuuccggagcaggga

SEQ ID NO: 1061431 - RNA, 22 nt, Human
ucugaacauccagcaaugcaca

SEQ ID NO: 1061432 - RNA, 22 nt, Human
ucuccaagaaaagaucucagcu

SEQ ID NO: 1061433 - RNA, 22 nt, Human
uacacagacucuucaauucaga

SEQ ID NO: 1061434 - RNA, 22 nt, Human
cucagcucugacaggaggcauc

SEQ ID NO: 1061435 - RNA, 22 nt, Human
ugcauguuaagaaaauauugag

SEQ ID NO: 1061436 - RNA, 22 nt, Human
uucacauuucauaccacagcuu

SEQ ID NO: 1061437 - RNA, 22 nt, Human
cagggacccuacuagcucacac

SEQ ID NO: 1061438 - RNA, 22 nt, Human
agggcuccaaggaaguguagcu

SEQ ID NO: 1061439 - RNA, 20 nt, Human
ucuggcaggugaacgagcug

SEQ ID NO: 1061440 - RNA, 22 nt, Human
uuccacauuccuuacauucaua

SEQ ID NO: 1061441 - RNA, 22 nt, Human
acuggcagcagcagcccuuggg

SEQ ID NO: 1061442 - RNA, 22 nt, Human
ucuggcaggguguguauuuaca

SEQ ID NO: 1061443 - RNA, 22 nt, Human
uuucaaauaccauaaaccuaau

SEQ ID NO: 1061444 - RNA, 22 nt, Human
agauauguuuguauauauuugu

SEQ ID NO: 1061445 - RNA, 22 nt, Human
gcagcucuccucugugaggaac

SEQ ID NO: 1061446 - RNA, 22 nt, Human
uuaauacaagcauaugcacaca

SEQ ID NO: 1061447 - RNA, 23 nt, Human
caggcucccggaccaggauccgc

SEQ ID NO: 1061448 - RNA, 22 nt, Human
agaggcucugccgccucaggua

SEQ ID NO: 1061449 - RNA, 22 nt, Human
gugggcuuguuuugaugagauc

SEQ ID NO: 1061450 - RNA, 22 nt, Human
acagauauaaacuauaguagug

SEQ ID NO: 1061451 - RNA, 22 nt, Human
gccaaaucacagggccaaaagc

SEQ ID NO: 1061452 - RNA, 22 nt, Human
uuuagggacaagggucuggggu

SEQ ID NO: 1061453 - RNA, 17 nt, Human
cucuggggacaguucua

SEQ ID NO: 1061454 - RNA, 22 nt, Human
caggccuccacuccacgcagac

SEQ ID NO: 1061455 - RNA, 22 nt, Human
auuucauacuaaggcucaaaaa

SEQ ID NO: 1061456 - RNA, 22 nt, Human
ccugaccuauuuuucucagcug

SEQ ID NO: 1061457 - RNA, 22 nt, Human
cuguggcucauucuugguggca

SEQ ID NO: 1061458 - RNA, 22 nt, Human
aauaguauuuauuuggaaaaag

SEQ ID NO: 1061459 - RNA, 22 nt, Human
uaaucuguguaccuucaucgga

SEQ ID NO: 1061460 - RNA, 22 nt, Human
uguaugaauauguauuuucaua

SEQ ID NO: 1061461 - RNA, 22 nt, Human
uauuagguaaaggacuugcagg

SEQ ID NO: 1061462 - RNA, 22 nt, Human
cugguggaggugccaggauuug

SEQ ID NO: 1061463 - RNA, 22 nt, Human
agcaggcuuguuaugucugaga

SEQ ID NO: 1061464 - RNA, 22 nt, Human
uuucuuuguuguuaucacauca

SEQ ID NO: 1061465 - RNA, 20 nt, Human
agaaauauugaguucagagg

SEQ ID NO: 1061466 - RNA, 22 nt, Human
gguuucaacucagcuaguaagg

SEQ ID NO: 1061467 - RNA, 22 nt, Human
ucacacauuucucaaguguagg

SEQ ID NO: 1061468 - RNA, 22 nt, Human
cagcuuuauugagguauaauug

SEQ ID NO: 1061469 - RNA, 22 nt, Human
ccuggggagccgccugagcccc

SEQ ID NO: 1061470 - RNA, 21 nt, Human
uagggcucucugugucaggug

SEQ ID NO: 1061471 - RNA, 22 nt, Human
gaaacaauuuuuguugucuaag

SEQ ID NO: 1061472 - RNA, 22 nt, Human
aagcuuuagagaugaguuccuu

SEQ ID NO: 1061473 - RNA, 22 nt, Human
acaucacacgccuuccaggagg

SEQ ID NO: 1061474 - RNA, 22 nt, Human
uucacuuauagggauguuauug

SEQ ID NO: 1061475 - RNA, 22 nt, Human
ugcuucuguuacauaccagaac

SEQ ID NO: 1061476 - RNA, 22 nt, Human
auucaagagcccauguuuccug

SEQ ID NO: 1061477 - RNA, 22 nt, Human
cagguuuagguggacgugcagg

SEQ ID NO: 1061478 - RNA, 22 nt, Human
ucuggcagcaagauaacaaugg

SEQ ID NO: 1061479 - RNA, 22 nt, Human
uguuugaaacuuugaucacuaa

SEQ ID NO: 1061480 - RNA, 21 nt, Human
gccugcagaccccaccaggcu

SEQ ID NO: 1061481 - RNA, 22 nt, Human
cagccucuugcacuuugaaggc

SEQ ID NO: 1061482 - RNA, 22 nt, Human
caugaagcauguuuugucauga

SEQ ID NO: 1061483 - RNA, 22 nt, Human
agcucugacauugauucucagc

SEQ ID NO: 1061484 - RNA, 22 nt, Human
uauucccagccucuuucuaucu

SEQ ID NO: 1061485 - RNA, 22 nt, Human
gcagcucucuggccugcccugg

SEQ ID NO: 1061486 - RNA, 22 nt, Human
ccuccccaugacccggugcugg

SEQ ID NO: 1061487 - RNA, 22 nt, Human
uggcagaaagaaccaugugcaa

SEQ ID NO: 1061488 - RNA, 18 nt, Human
aguuccuuaaauuggugu

SEQ ID NO: 1061489 - RNA, 22 nt, Human
ugcuucuggcuuaucucgugcc

SEQ ID NO: 1061490 - RNA, 22 nt, Human
aauugcaauuuucuuaaggucu

SEQ ID NO: 1061491 - RNA, 22 nt, Human
auuaagggccaauccuccagcc

SEQ ID NO: 1061492 - RNA, 22 nt, Human
cuagggacugggaccuuaguua

SEQ ID NO: 1061493 - RNA, 22 nt, Human
auguaauuugcccucaaguuaa

SEQ ID NO: 1061494 - RNA, 22 nt, Human
agggaccucuucuugcagcuga

SEQ ID NO: 1061495 - RNA, 17 nt, Human
agcaggcugcagaggcc

SEQ ID NO: 1061496 - RNA, 19 nt, Human
cugagagaugcuucacaca

SEQ ID NO: 1061497 - RNA, 17 nt, Human
cccaggccgccgggagc

SEQ ID NO: 1061498 - RNA, 22 nt, Human
agggaccuugauggguuuggga

SEQ ID NO: 1061499 - RNA, 22 nt, Human
aguaugaagaugaugaaaaaua

SEQ ID NO: 1061500 - RNA, 22 nt, Human
ucucacagugcaggucugucuc

SEQ ID NO: 1061501 - RNA, 22 nt, Human
gccaagcucuuuaaaggccaaa

SEQ ID NO: 1061502 - RNA, 22 nt, Human
aaaagagucuuaggcagucaua

SEQ ID NO: 1061503 - RNA, 20 nt, Human
uuaagaaaagcacauccugc

SEQ ID NO: 1061504 - RNA, 22 nt, Human
ggaggacacuggcucugccuuc

SEQ ID NO: 1061505 - RNA, 22 nt, Human
ggcuuuaucaaaugagacccug

SEQ ID NO: 1061506 - RNA, 22 nt, Human
aacagcaugcuggguaacauug

SEQ ID NO: 1061507 - RNA, 22 nt, Human
uguuagaaguuaaucacuaauu

SEQ ID NO: 1061508 - RNA, 22 nt, Human
ggcuuuggggugugcagagaug

SEQ ID NO: 1061509 - RNA, 22 nt, Human
uagcauuaucugucuuaucauu

SEQ ID NO: 1061510 - RNA, 22 nt, Human
ugucagagcaaggccaggccag

SEQ ID NO: 1061511 - RNA, 22 nt, Human
uucugucacuuuuuuggaaucu

SEQ ID NO: 1061512 - RNA, 22 nt, Human
ccaggcucagcgcgcacgucug

SEQ ID NO: 1061513 - RNA, 22 nt, Human
uuagggacaaauuugcagaacc

SEQ ID NO: 1061514 - RNA, 22 nt, Human
uuauuagguuauucucuguacu

SEQ ID NO: 1061515 - RNA, 21 nt, Human
auuuucauuuccaggggagga

SEQ ID NO: 1061516 - RNA, 18 nt, Human
acauuucuccuucugacc

SEQ ID NO: 1061517 - RNA, 22 nt, Human
uuaugaaggaucagguacuugg

SEQ ID NO: 1061518 - RNA, 22 nt, Human
auuuaaaugcuuaagaggguuu

SEQ ID NO: 1061519 - RNA, 22 nt, Human
uuuugagauggagucuugcucu

SEQ ID NO: 1061520 - RNA, 22 nt, Human
uaugagguagguauuauacuua

SEQ ID NO: 1061521 - RNA, 22 nt, Human
guugggaaggugaacaugaugc

SEQ ID NO: 1061522 - RNA, 23 nt, Human
ccuggggagcuguauccagagug

SEQ ID NO: 1061523 - RNA, 22 nt, Human
uguaggaauguuuuuaaguugg

SEQ ID NO: 1061524 - RNA, 22 nt, Human
ccaggcucagcuauuaagaaac

SEQ ID NO: 1061525 - RNA, 22 nt, Human
cacaggccugucucuuucuaac

SEQ ID NO: 1061526 - RNA, 22 nt, Human
ucauuuguaccauuuuuuaaga

SEQ ID NO: 1061527 - RNA, 22 nt, Human
ccagcuuuucagaaucugccug

SEQ ID NO: 1061528 - RNA, 22 nt, Human
ugcuuuauguuaucagaagggu

SEQ ID NO: 1061529 - RNA, 22 nt, Human
gcuaggagugggauggaagucg

SEQ ID NO: 1061530 - RNA, 22 nt, Human
cugccuggccacaacccagggu

SEQ ID NO: 1061531 - RNA, 22 nt, Human
aaggccaucuacuuacggaauu

SEQ ID NO: 1061532 - RNA, 22 nt, Human
guccucugcccaggucaagguu

SEQ ID NO: 1061533 - RNA, 22 nt, Human
auuucucagcacuuccuaucuc

SEQ ID NO: 1061534 - RNA, 22 nt, Human
augugguugaagaauuacaucu

SEQ ID NO: 1061535 - RNA, 22 nt, Human
aauugcaacagguagacuuuuc

SEQ ID NO: 1061536 - RNA, 22 nt, Human
acuggcaggcugcuggccggcg

SEQ ID NO: 1061537 - RNA, 22 nt, Human
ugggagaaacugucucucccac

SEQ ID NO: 1061538 - RNA, 22 nt, Human
ccagcucucagcgggagacuca

SEQ ID NO: 1061539 - RNA, 22 nt, Human
cuaggaauccuuuuagaguugg

SEQ ID NO: 1061540 - RNA, 22 nt, Human
gaagcacugccauaauucagac

SEQ ID NO: 1061541 - RNA, 22 nt, Human
gaggggcuggguagggcaaccc

SEQ ID NO: 1061542 - RNA, 22 nt, Human
acacacaauuaguuuuaugcuu

SEQ ID NO: 1061543 - RNA, 22 nt, Human
ugucuuuauauauuuggaaaau

SEQ ID NO: 1061544 - RNA, 22 nt, Human
uggaccugaagaauaggaagua

SEQ ID NO: 1061545 - RNA, 22 nt, Human
ucuucaaacugaaaauuuagaa

SEQ ID NO: 1061546 - RNA, 22 nt, Human
ucuaggagcuuaaaggaggcca

SEQ ID NO: 1061547 - RNA, 22 nt, Human
ucacacagcugacagagccuuu

SEQ ID NO: 1061548 - RNA, 22 nt, Human
ccacaggcugcugcaggucccg

SEQ ID NO: 1061549 - RNA, 22 nt, Human
gagggcuccacacgggcccagc

SEQ ID NO: 1061550 - RNA, 22 nt, Human
ugaacacugccauauuuaagaa

SEQ ID NO: 1061551 - RNA, 22 nt, Human
uagggcucacugagaugaauau

SEQ ID NO: 1061552 - RNA, 23 nt, Human
agagcaucaugaugcuaagucug

SEQ ID NO: 1061553 - RNA, 22 nt, Human
uugaagcagagaaauacuugaa

SEQ ID NO: 1061554 - RNA, 22 nt, Human
uccagaccuagggcaccccagu

SEQ ID NO: 1061555 - RNA, 22 nt, Human
acaaguaccaaaugcucaagua

SEQ ID NO: 1061556 - RNA, 22 nt, Human
gaggguggccuuuagagcccau

SEQ ID NO: 1061557 - RNA, 22 nt, Human
ggagcugaggcugaggccucac

SEQ ID NO: 1061558 - RNA, 22 nt, Human
cccuuccuugugacuggugggg

SEQ ID NO: 1061559 - RNA, 22 nt, Human
uuucugaagggcagcagacucu

SEQ ID NO: 1061560 - RNA, 22 nt, Human
guccagugacaaguagcuggcc

SEQ ID NO: 1061561 - RNA, 22 nt, Human
agagggaucacccuguuucugg

SEQ ID NO: 1061562 - RNA, 22 nt, Human
uccaggcaugucugaguccuuc

SEQ ID NO: 1061563 - RNA, 22 nt, Human
acuggcaguuugagaaugcauu

SEQ ID NO: 1061564 - RNA, 22 nt, Human
cagaguggcgacccccucagcu

SEQ ID NO: 1061565 - RNA, 22 nt, Human
acccacacaucucuaauucagu

SEQ ID NO: 1061566 - RNA, 22 nt, Human
agagugaaguucaucgugcagc

SEQ ID NO: 1061567 - RNA, 22 nt, Human
auaugugaaguggguuauuuug

SEQ ID NO: 1061568 - RNA, 22 nt, Human
guuuagaacacggaaauacuga

SEQ ID NO: 1061569 - RNA, 22 nt, Human
gccuccggaguugcagugucuu

SEQ ID NO: 1061570 - RNA, 22 nt, Human
cuuucauuugauaagaaugcca

SEQ ID NO: 1061571 - RNA, 22 nt, Human
ccagcccuuagauaaaccuggc

SEQ ID NO: 1061572 - RNA, 22 nt, Human
ccugcagggaaucgaggcagaa

SEQ ID NO: 1061573 - RNA, 20 nt, Human
auacacauucauagaaaaau

SEQ ID NO: 1061574 - RNA, 18 nt, Human
ugaggcagucagugaugg

SEQ ID NO: 1061575 - RNA, 23 nt, Human
cagugugacgaggugaggcaggc

SEQ ID NO: 1061576 - RNA, 22 nt, Human
ucugcagaauucgaggaagaaa

SEQ ID NO: 1061577 - RNA, 22 nt, Human
guggcagguuccguagacagca

SEQ ID NO: 1061578 - RNA, 22 nt, Human
uuccuggcagaggccccgacag

SEQ ID NO: 1061579 - RNA, 22 nt, Human
cuucaaaugugauuuuaauaac

SEQ ID NO: 1061580 - RNA, 22 nt, Human
ccagcccugccagagagagcug

SEQ ID NO: 1061581 - RNA, 22 nt, Human
agucuacaaagaaaaguuauug

SEQ ID NO: 1061582 - RNA, 22 nt, Human
ucagcuuuuuggauugcccaag

SEQ ID NO: 1061583 - RNA, 22 nt, Human
cagggcucccaaauaucucuuc

SEQ ID NO: 1061584 - RNA, 20 nt, Human
ccuuuauuauuuguaugaug

SEQ ID NO: 1061585 - RNA, 19 nt, Human
auauauguauacaaugugg

SEQ ID NO: 1061586 - RNA, 23 nt, Human
ccuggcagcaaacgaggagguua

SEQ ID NO: 1061587 - RNA, 22 nt, Human
cugggaggcagucucucuagaa

SEQ ID NO: 1061588 - RNA, 22 nt, Human
cagugagggcccccuuccaggu

SEQ ID NO: 1061589 - RNA, 22 nt, Human
aguguugggucuuuagaauuua

SEQ ID NO: 1061590 - RNA, 22 nt, Human
gcucugagacaguagagauggc

SEQ ID NO: 1061591 - RNA, 22 nt, Human
uauaauuuuaagugguaaauua

SEQ ID NO: 1061592 - RNA, 22 nt, Human
cagagcauuaaaaccagcucug

SEQ ID NO: 1061593 - RNA, 22 nt, Human
uuaugcaacaggugagcagaca

SEQ ID NO: 1061594 - RNA, 22 nt, Human
cauacauuuauacacaucuaug

SEQ ID NO: 1061595 - RNA, 22 nt, Human
cgcugauaaacgucacguuccc

SEQ ID NO: 1061596 - RNA, 22 nt, Human
ugcaggcugccuucacagagcc

SEQ ID NO: 1061597 - RNA, 22 nt, Human
gccugcagccucagagaauuuu

SEQ ID NO: 1061598 - RNA, 20 nt, Human
gauacacagcacagagggcc

SEQ ID NO: 1061599 - RNA, 22 nt, Human
gacccagaaggagugcccuaga

SEQ ID NO: 1061600 - RNA, 22 nt, Human
gugaaacacccuccaaugcaca

SEQ ID NO: 1061601 - RNA, 22 nt, Human
ccugggcugcaugauggcauuu

SEQ ID NO: 1061602 - RNA, 22 nt, Human
augacaugaccugguagagaca

SEQ ID NO: 1061603 - RNA, 22 nt, Human
ugguuuaccccuguccuauauc

SEQ ID NO: 1061604 - RNA, 22 nt, Human
ccaggccuggaccaugccaggg

SEQ ID NO: 1061605 - RNA, 22 nt, Human
cuauuagguaugugguugcuau

SEQ ID NO: 1061606 - RNA, 22 nt, Human
gacaaaaguguuuugaacaagg

SEQ ID NO: 1061607 - RNA, 22 nt, Human
uuccugccccugagagcuccca

SEQ ID NO: 1061608 - RNA, 22 nt, Human
gcuggggacuccccaccauagc

SEQ ID NO: 1061609 - RNA, 23 nt, Human
agcaggcugcuucuccacagcug

SEQ ID NO: 1061610 - RNA, 22 nt, Human
ucuggggaccauggcaucuaaa

SEQ ID NO: 1061611 - RNA, 22 nt, Human
agucuagggugggguccacagg

SEQ ID NO: 1061612 - RNA, 22 nt, Human
aggcccaaaagaaaccacuggg

SEQ ID NO: 1061613 - RNA, 22 nt, Human
ucuccaggaagcccucccugac

SEQ ID NO: 1061614 - RNA, 22 nt, Human
guguaugauuucaaauggcuag

SEQ ID NO: 1061615 - RNA, 22 nt, Human
cuuuauuagauguagacuuucu

SEQ ID NO: 1061616 - RNA, 22 nt, Human
ccuggcaguggugaagaagagg

SEQ ID NO: 1061617 - RNA, 19 nt, Human
gugggacagacauuacaua

SEQ ID NO: 1061618 - RNA, 22 nt, Human
gagcacugauuuauuuuugucu

SEQ ID NO: 1061619 - RNA, 22 nt, Human
uauauguaagcuauguaagagu

SEQ ID NO: 1061620 - RNA, 22 nt, Human
guguaugaggggagaauguuuu

SEQ ID NO: 1061621 - RNA, 22 nt, Human
gccaggcagcugggagggugcc

SEQ ID NO: 1061622 - RNA, 22 nt, Human
guggcaguuuugacaucacaaa

SEQ ID NO: 1061623 - RNA, 22 nt, Human
gugggcuuuugacagugccugg

SEQ ID NO: 1061624 - RNA, 22 nt, Human
cugagggucaacuugauuguau

SEQ ID NO: 1061625 - RNA, 22 nt, Human
gcuggcagcauuagacccuggg

SEQ ID NO: 1061626 - RNA, 22 nt, Human
ugcagggcuaagucagagccug

SEQ ID NO: 1061627 - RNA, 22 nt, Human
uauuccuauuucuaaacauaug

SEQ ID NO: 1061628 - RNA, 22 nt, Human
ugagugugcagggaaguggcgg

SEQ ID NO: 1061629 - RNA, 22 nt, Human
gacacagagggcaccagauaug

SEQ ID NO: 1061630 - RNA, 22 nt, Human
gagaggcugaaaucacaggagc

SEQ ID NO: 1061631 - RNA, 22 nt, Human
gcuugggaagggcccuguguac

SEQ ID NO: 1061632 - RNA, 22 nt, Human
cugagcagugguucuugagcgc

SEQ ID NO: 1061633 - RNA, 18 nt, Human
ugaccugcgcuucacggu

SEQ ID NO: 1061634 - RNA, 22 nt, Human
aguaaaauuucugcugaggaga

SEQ ID NO: 1061635 - RNA, 22 nt, Human
gcauuauuaauagcugcaugag

SEQ ID NO: 1061636 - RNA, 22 nt, Human
guccagagauggacgagcagau

SEQ ID NO: 1061637 - RNA, 17 nt, Human
acaggcagaucaccuga

SEQ ID NO: 1061638 - RNA, 22 nt, Human
gauuuauugucccuguccugcu

SEQ ID NO: 1061639 - RNA, 22 nt, Human
aaagaaucagaagucucaaaca

SEQ ID NO: 1061640 - RNA, 22 nt, Human
cgggcuccgggucuuugcaguc

SEQ ID NO: 1061641 - RNA, 22 nt, Human
agcacaggaccaaggaagcugu

SEQ ID NO: 1061642 - RNA, 22 nt, Human
gcccacacaccagcucaggagg

SEQ ID NO: 1061643 - RNA, 22 nt, Human
cagcauuuaucuuguagcagga

SEQ ID NO: 1061644 - RNA, 21 nt, Human
ugggaccuauuucaacuggau

SEQ ID NO: 1061645 - RNA, 22 nt, Human
aggcuccauaccaucuccggag

SEQ ID NO: 1061646 - RNA, 22 nt, Human
cuucugggcauucagcugcaca

SEQ ID NO: 1061647 - RNA, 22 nt, Human
uauucacaguugauuuacaguu

SEQ ID NO: 1061648 - RNA, 22 nt, Human
ccccuguguuguucaaggguca

SEQ ID NO: 1061649 - RNA, 22 nt, Human
agaaaauuagauuuuacugugu

SEQ ID NO: 1061650 - RNA, 22 nt, Human
cagagagcaugggaggcccgag

SEQ ID NO: 1061651 - RNA, 22 nt, Human
ucugauuagagcauucuugagu

SEQ ID NO: 1061652 - RNA, 22 nt, Human
cccagcccaucucaaaggucua

SEQ ID NO: 1061653 - RNA, 21 nt, Human
ccagcccagcugugucccagc

SEQ ID NO: 1061654 - RNA, 22 nt, Human
uucaauaucauuguuuagucuc

SEQ ID NO: 1061655 - RNA, 19 nt, Human
ucuggcagguaauuaggga

SEQ ID NO: 1061656 - RNA, 22 nt, Human
ugcagggaaugcuugcagcaug

SEQ ID NO: 1061657 - RNA, 22 nt, Human
ugcuucugcaacuugaauguac

SEQ ID NO: 1061658 - RNA, 22 nt, Human
ugccugacugcugccaccacua

SEQ ID NO: 1061659 - RNA, 22 nt, Human
ccugcagaaaggguccccagga

SEQ ID NO: 1061660 - RNA, 22 nt, Human
aaccucaggcucucuggacaau

SEQ ID NO: 1061661 - RNA, 22 nt, Human
acagauuuguucuuuugggcua

SEQ ID NO: 1061662 - RNA, 22 nt, Human
cuccugcaagccuccccaagca

SEQ ID NO: 1061663 - RNA, 22 nt, Human
caggcugccuggaagaggacug

SEQ ID NO: 1061664 - RNA, 20 nt, Human
cagggcucugggccuggccu

SEQ ID NO: 1061665 - RNA, 22 nt, Human
uggaacacaucuaaggaagcag

SEQ ID NO: 1061666 - RNA, 23 nt, Human
uccaggcaugagcucuggaugga

SEQ ID NO: 1061667 - RNA, 22 nt, Human
caguguuucugaguuccagcuc

SEQ ID NO: 1061668 - RNA, 22 nt, Human
acaauucugaugguuucccagu

SEQ ID NO: 1061669 - RNA, 22 nt, Human
ccuggggaagucacuucucuuu

SEQ ID NO: 1061670 - RNA, 22 nt, Human
uaauuucuggagggagaaagag

SEQ ID NO: 1061671 - RNA, 22 nt, Human
cacauaauugaacgugaugagu

SEQ ID NO: 1061672 - RNA, 22 nt, Human
uccuggcagugcuuguuuugga

SEQ ID NO: 1061673 - RNA, 22 nt, Human
ucaagagauugaauaauaacug

SEQ ID NO: 1061674 - RNA, 22 nt, Human
uucucuuuuagaggcuccauga

SEQ ID NO: 1061675 - RNA, 20 nt, Human
aaaagagugcuucaacugcu

SEQ ID NO: 1061676 - RNA, 22 nt, Human
cugguggagagugggcucugga

SEQ ID NO: 1061677 - RNA, 22 nt, Human
uuggaagacagugaaacagcac

SEQ ID NO: 1061678 - RNA, 22 nt, Human
uaucuguuaugggcugaauugc

SEQ ID NO: 1061679 - RNA, 22 nt, Human
uuucauaaacaguagaagacua

SEQ ID NO: 1061680 - RNA, 22 nt, Human
accaggcaacugugaaugggcu

SEQ ID NO: 1061681 - RNA, 22 nt, Human
uguaugaaaaggaauagauuga

SEQ ID NO: 1061682 - RNA, 22 nt, Human
aaauuauuaugccccucuauaa

SEQ ID NO: 1061683 - RNA, 22 nt, Human
uuucucauagucaugccucuua

SEQ ID NO: 1061684 - RNA, 22 nt, Human
aagcaacucccuccucauuuuu

SEQ ID NO: 1061685 - RNA, 22 nt, Human
ccagcuuuuggggugacaauuu

SEQ ID NO: 1061686 - RNA, 22 nt, Human
caugaaaucugaguauguuucc

SEQ ID NO: 1061687 - RNA, 22 nt, Human
aauacuauguugugacacauga

SEQ ID NO: 1061688 - RNA, 22 nt, Human
gcagagaguugggcugcgccag

SEQ ID NO: 1061689 - RNA, 21 nt, Human
ucuggcaggcacgggcccagc

SEQ ID NO: 1061690 - RNA, 22 nt, Human
auaugugaaugauaucacuuug

SEQ ID NO: 1061691 - RNA, 22 nt, Human
ucacauacacuaggauauuuuu

SEQ ID NO: 1061692 - RNA, 22 nt, Human
agggcucccgcgguguccggga

SEQ ID NO: 1061693 - RNA, 22 nt, Human
cuguggcugcguaggucuggca

SEQ ID NO: 1061694 - RNA, 22 nt, Human
ggcaggcugggagucaucagag

SEQ ID NO: 1061695 - RNA, 22 nt, Human
ucuggggaugaggaccuagaug

SEQ ID NO: 1061696 - RNA, 22 nt, Human
uccaggcaugguguaauuuugc

SEQ ID NO: 1061697 - RNA, 22 nt, Human
auaguguuacccuucuuaaagu

SEQ ID NO: 1061698 - RNA, 22 nt, Human
gccugcagcugcuuccacacac

SEQ ID NO: 1061699 - RNA, 20 nt, Human
uguucugucgucuuucuuca

SEQ ID NO: 1061700 - RNA, 22 nt, Human
acaauauuguacccagaaguuu

SEQ ID NO: 1061701 - RNA, 22 nt, Human
cauguuaaaauauacauucuga

SEQ ID NO: 1061702 - RNA, 22 nt, Human
gccugcagacguguuuuccuca

SEQ ID NO: 1061703 - RNA, 22 nt, Human
ccuaggaacccccaggcuucug

SEQ ID NO: 1061704 - RNA, 22 nt, Human
ccagugcauaaucaauacagcc

SEQ ID NO: 1061705 - RNA, 22 nt, Human
ggggaccugggcuucaaggguu

SEQ ID NO: 1061706 - RNA, 22 nt, Human
gugcagggcuggcaccggaggc

SEQ ID NO: 1061707 - RNA, 20 nt, Human
agggucugaugugguggccc

SEQ ID NO: 1061708 - RNA, 22 nt, Human
aauaacuuaagaaauuucccca

SEQ ID NO: 1061709 - RNA, 22 nt, Human
ugggcugcuucuauuggugguc

SEQ ID NO: 1061710 - RNA, 22 nt, Human
uacacauccauguuuugacuuu

SEQ ID NO: 1061711 - RNA, 22 nt, Human
uccuuucccuuuccauccuggc

SEQ ID NO: 1061712 - RNA, 22 nt, Human
ucuguuuaggcaaaauagcuac

SEQ ID NO: 1061713 - RNA, 22 nt, Human
ugcuucuggaaacaguggcugu

SEQ ID NO: 1061714 - RNA, 20 nt, Human
uucaugggagcaaagaggcc

SEQ ID NO: 1061715 - RNA, 22 nt, Human
cuuauaaaguccaucugaacaa

SEQ ID NO: 1061716 - RNA, 22 nt, Human
agagccaggugcugcuguuuga

SEQ ID NO: 1061717 - RNA, 21 nt, Human
gaaaagcaagggaguagaaca

SEQ ID NO: 1061718 - RNA, 21 nt, Human
caauaaacugcacauugagac

SEQ ID NO: 1061719 - RNA, 22 nt, Human
cccuuccuugauuuuaacugga

SEQ ID NO: 1061720 - RNA, 22 nt, Human
ccugggcucaagugaugguccc

SEQ ID NO: 1061721 - RNA, 22 nt, Human
aacaaacaaacauuuugucauc

SEQ ID NO: 1061722 - RNA, 22 nt, Human
aaaguugugaaaccgaacaugu

SEQ ID NO: 1061723 - RNA, 22 nt, Human
gaaacuuacuuacucacauuuc

SEQ ID NO: 1061724 - RNA, 19 nt, Human
cuccaaguuaagagggagg

SEQ ID NO: 1061725 - RNA, 22 nt, Human
aagcgccaugguuccugcgcag

SEQ ID NO: 1061726 - RNA, 22 nt, Human
aagauauagauaaaacuaugca

SEQ ID NO: 1061727 - RNA, 22 nt, Human
ccugggcuucugucuagauguu

SEQ ID NO: 1061728 - RNA, 22 nt, Human
uccugcagccaagggucaucga

SEQ ID NO: 1061729 - RNA, 22 nt, Human
auguggcugguaguugacaacu

SEQ ID NO: 1061730 - RNA, 22 nt, Human
aucagagauggcuccagugcuc

SEQ ID NO: 1061731 - RNA, 22 nt, Human
uucagagagaaaccagugggaa

SEQ ID NO: 1061732 - RNA, 21 nt, Human
gcccccuggacuccucaucca

SEQ ID NO: 1061733 - RNA, 20 nt, Human
uuucacaucugucccuuuaa

SEQ ID NO: 1061734 - RNA, 22 nt, Human
uauuugauagagauaaaugaua

SEQ ID NO: 1061735 - RNA, 22 nt, Human
cugggcuuugguacugugauua

SEQ ID NO: 1061736 - RNA, 22 nt, Human
uccugagcacagagacaaggaa

SEQ ID NO: 1061737 - RNA, 22 nt, Human
ucccacacuacacgguuguugg

SEQ ID NO: 1061738 - RNA, 22 nt, Human
gggcugacaguuuccccugaaa

SEQ ID NO: 1061739 - RNA, 22 nt, Human
agcucccagaagccagagucgg

SEQ ID NO: 1061740 - RNA, 22 nt, Human
acagcuuuuaugggaccagcca

SEQ ID NO: 1061741 - RNA, 22 nt, Human
ggcucccugccuguccucaguc

SEQ ID NO: 1061742 - RNA, 20 nt, Human
agcaggcugcagggugaaau

SEQ ID NO: 1061743 - RNA, 22 nt, Human
uacauuccuucguuuagagauu

SEQ ID NO: 1061744 - RNA, 22 nt, Human
aucucauaacucauuugaagac

SEQ ID NO: 1061745 - RNA, 22 nt, Human
gcuggcagacugggggcagaac

SEQ ID NO: 1061746 - RNA, 22 nt, Human
cuuucacagcacaagccugccu

SEQ ID NO: 1061747 - RNA, 22 nt, Human
aaugaagccagcugggaugcga

SEQ ID NO: 1061748 - RNA, 22 nt, Human
augcagcugugggcaagaaaug

SEQ ID NO: 1061749 - RNA, 22 nt, Human
ccagagagauugcuucuaaaga

SEQ ID NO: 1061750 - RNA, 22 nt, Human
ugcccccugguggccagagccg

SEQ ID NO: 1061751 - RNA, 22 nt, Human
aaucuucagugucuaaaaagca

SEQ ID NO: 1061752 - RNA, 22 nt, Human
uguaaagguaggugcaaaauga

SEQ ID NO: 1061753 - RNA, 22 nt, Human
acauacacaagcguacaugaac

SEQ ID NO: 1061754 - RNA, 22 nt, Human
uuuagggaaauugaggguuaag

SEQ ID NO: 1061755 - RNA, 22 nt, Human
accugcagcugagaaaaugacu

SEQ ID NO: 1061756 - RNA, 22 nt, Human
gagcucagacucgggccugggg

SEQ ID NO: 1061757 - RNA, 22 nt, Human
gagggcucacugagaaagcagu

SEQ ID NO: 1061758 - RNA, 22 nt, Human
ugcagggagggcccagcaaucu

SEQ ID NO: 1061759 - RNA, 22 nt, Human
aagggcucugggcuacgcacug

SEQ ID NO: 1061760 - RNA, 22 nt, Human
uuuaaaaaacuagucugagucu

SEQ ID NO: 1061761 - RNA, 22 nt, Human
auuuuccucaagccucuggaag

SEQ ID NO: 1061762 - RNA, 18 nt, Human
cccagcuuagcgccccuc

SEQ ID NO: 1061763 - RNA, 22 nt, Human
uuauuagcugggcuucagggug

SEQ ID NO: 1061764 - RNA, 22 nt, Human
cagggacaauggcagagccuga

SEQ ID NO: 1061765 - RNA, 22 nt, Human
acuggcaguggcagcagaaaga

SEQ ID NO: 1061766 - RNA, 22 nt, Human
ugcagggaaucuguggcuggac

SEQ ID NO: 1061767 - RNA, 22 nt, Human
uuccaagugcugaggacaguag

SEQ ID NO: 1061768 - RNA, 22 nt, Human
cuggggacucauucagagcaua

SEQ ID NO: 1061769 - RNA, 17 nt, Human
aaguccagaguugagca

SEQ ID NO: 1061770 - RNA, 22 nt, Human
agcuuuaugcuuccuacaagcu

SEQ ID NO: 1061771 - RNA, 22 nt, Human
uuagccauguugaagauuuaga

SEQ ID NO: 1061772 - RNA, 22 nt, Human
uggaaagaggaagugcccagca

SEQ ID NO: 1061773 - RNA, 22 nt, Human
gcuggcaggauaacuucuaagc

SEQ ID NO: 1061774 - RNA, 23 nt, Human
ucagagagcuguugagagcugcc

SEQ ID NO: 1061775 - RNA, 22 nt, Human
uguaaaauaauucuccauguuu

SEQ ID NO: 1061776 - RNA, 22 nt, Human
uuacauuuugggguaaggauaa

SEQ ID NO: 1061777 - RNA, 20 nt, Human
uuucuggguacucucccucu

SEQ ID NO: 1061778 - RNA, 22 nt, Human
cugccugcaugcugccauagcu

SEQ ID NO: 1061779 - RNA, 22 nt, Human
gccagguugcugacgacgaucu

SEQ ID NO: 1061780 - RNA, 22 nt, Human
aaaauccugcugacucgagaug

SEQ ID NO: 1061781 - RNA, 22 nt, Human
uuauuuuuaaaaguucacacag

SEQ ID NO: 1061782 - RNA, 19 nt, Human
ugcuucuggaaugcaaggc

SEQ ID NO: 1061783 - RNA, 18 nt, Human
acaaaugugucacaggaa

SEQ ID NO: 1061784 - RNA, 22 nt, Human
ggccucucaugcccagagccaa

SEQ ID NO: 1061785 - RNA, 22 nt, Human
ucuuccaggagggcauuucuuu

SEQ ID NO: 1061786 - RNA, 22 nt, Human
cauuagggucucucagcugaau

SEQ ID NO: 1061787 - RNA, 22 nt, Human
gccacauagaggaggauauuaa

SEQ ID NO: 1061788 - RNA, 23 nt, Human
uccugcugaaagcuccagcuggc

SEQ ID NO: 1061789 - RNA, 22 nt, Human
uggggaccagauuagaccaugg

SEQ ID NO: 1061790 - RNA, 22 nt, Human
cagggagcuggugccagccgac

SEQ ID NO: 1061791 - RNA, 22 nt, Human
gcuggcaggagaaacggggugc

SEQ ID NO: 1061792 - RNA, 22 nt, Human
aaaauuuugcccuauccuucau

SEQ ID NO: 1061793 - RNA, 19 nt, Human
aggcuuggcuagauuuacu

SEQ ID NO: 1061794 - RNA, 22 nt, Human
uucugucagcugcuuugucuca

SEQ ID NO: 1061795 - RNA, 22 nt, Human
uuguuucauggggauguuuauu

SEQ ID NO: 1061796 - RNA, 22 nt, Human
aauuauguagccauaugaaaca

SEQ ID NO: 1061797 - RNA, 22 nt, Human
auaacuuagaguaggcaaaagu

SEQ ID NO: 1061798 - RNA, 22 nt, Human
ggagcugaaccccaucgugcug

SEQ ID NO: 1061799 - RNA, 22 nt, Human
agggacuugaugucagggagau

SEQ ID NO: 1061800 - RNA, 22 nt, Human
uaauacuguauacugcaaauuu

SEQ ID NO: 1061801 - RNA, 22 nt, Human
gacccagccugguuuuuauagg

SEQ ID NO: 1061802 - RNA, 22 nt, Human
gcuccaggaggaugaccuuccu

SEQ ID NO: 1061803 - RNA, 22 nt, Human
cccuuccucccaggcuucugug

SEQ ID NO: 1061804 - RNA, 22 nt, Human
gaaguucuuagucucauuugca

SEQ ID NO: 1061805 - RNA, 22 nt, Human
aaguguuuacuuaaagucaugg

SEQ ID NO: 1061806 - RNA, 22 nt, Human
ggcaggcuuugagaaagagcau

SEQ ID NO: 1061807 - RNA, 22 nt, Human
cugagccagggccacacaugga

SEQ ID NO: 1061808 - RNA, 22 nt, Human
uuacaguuuaguccaagccaga

SEQ ID NO: 1061809 - RNA, 22 nt, Human
agggccucuaccauccaagguu

SEQ ID NO: 1061810 - RNA, 23 nt, Human
cacacccaucacuaagagcuccu

SEQ ID NO: 1061811 - RNA, 22 nt, Human
caugaagcacagcucucuuuuu

SEQ ID NO: 1061812 - RNA, 22 nt, Human
gguuucaacuuuugugaggaau

SEQ ID NO: 1061813 - RNA, 22 nt, Human
uauucccauuccacuuaucaag

SEQ ID NO: 1061814 - RNA, 22 nt, Human
ucaggguugcugugaucagucc

SEQ ID NO: 1061815 - RNA, 22 nt, Human
gagguggcuccuucagggaaua

SEQ ID NO: 1061816 - RNA, 22 nt, Human
ucccaggcuaggccucugcguu

SEQ ID NO: 1061817 - RNA, 22 nt, Human
cuuaaauuuucaucuacaagaa

SEQ ID NO: 1061818 - RNA, 22 nt, Human
uucccacauucuuuacauucau

SEQ ID NO: 1061819 - RNA, 22 nt, Human
aaguauuucguucugaaaaagu

SEQ ID NO: 1061820 - RNA, 22 nt, Human
agagcauccaucggccaggacc

SEQ ID NO: 1061821 - RNA, 22 nt, Human
uucucuuuucaccaguugcuaa

SEQ ID NO: 1061822 - RNA, 22 nt, Human
cuguccuccagacgacaguccc

SEQ ID NO: 1061823 - RNA, 22 nt, Human
accugcagccacuucucuccuu

SEQ ID NO: 1061824 - RNA, 22 nt, Human
aggaggcugaacuagggucugg

SEQ ID NO: 1061825 - RNA, 21 nt, Human
agaugcugaugcugcaggucc

SEQ ID NO: 1061826 - RNA, 22 nt, Human
cuucuacacaucccucuugcuu

SEQ ID NO: 1061827 - RNA, 22 nt, Human
ugcacaggaggcuguggagaag

SEQ ID NO: 1061828 - RNA, 22 nt, Human
uacacaucucugucaguaguga

SEQ ID NO: 1061829 - RNA, 22 nt, Human
uuccaggcuucucuggggcguc

SEQ ID NO: 1061830 - RNA, 22 nt, Human
cagagcauuuggaagccacgug

SEQ ID NO: 1061831 - RNA, 22 nt, Human
uccuggcagaaauggggcugug

SEQ ID NO: 1061832 - RNA, 22 nt, Human
ccuugcucaagcuagugacggg

SEQ ID NO: 1061833 - RNA, 22 nt, Human
auuauuagugauguuguuacug

SEQ ID NO: 1061834 - RNA, 22 nt, Human
guccucugauuucuagguauau

SEQ ID NO: 1061835 - RNA, 22 nt, Human
cagucucuuuauccaccaagcc

SEQ ID NO: 1061836 - RNA, 22 nt, Human
aagggcucccaacucaucuuuu

SEQ ID NO: 1061837 - RNA, 22 nt, Human
aaauuucaguuggaaugagcuc

SEQ ID NO: 1061838 - RNA, 22 nt, Human
uuggaaaaacacgauagugguu

SEQ ID NO: 1061839 - RNA, 23 nt, Human
acuccccagucucuucuugccaa

SEQ ID NO: 1061840 - RNA, 22 nt, Human
uucacaauggcaaaccauuaaa

SEQ ID NO: 1061841 - RNA, 22 nt, Human
ucuggcaguaauaggggagaga

SEQ ID NO: 1061842 - RNA, 22 nt, Human
cuggggacuuugguucuccaug

SEQ ID NO: 1061843 - RNA, 22 nt, Human
uggcaggcaaguucagcuccac

SEQ ID NO: 1061844 - RNA, 22 nt, Human
acacaucucaggggacacucuc

SEQ ID NO: 1061845 - RNA, 22 nt, Human
ucauggcacuuagcacaguccu

SEQ ID NO: 1061846 - RNA, 22 nt, Human
cuccuggcaggcugagugaaau

SEQ ID NO: 1061847 - RNA, 18 nt, Human
uuucacagauucaugacu

SEQ ID NO: 1061848 - RNA, 22 nt, Human
agguuuauguuuggugcaggag

SEQ ID NO: 1061849 - RNA, 22 nt, Human
acugauacgguuuuagagucca

SEQ ID NO: 1061850 - RNA, 22 nt, Human
uucauaaugagguccuagaggc

SEQ ID NO: 1061851 - RNA, 22 nt, Human
agggcuccgggccaccggccug

SEQ ID NO: 1061852 - RNA, 21 nt, Human
cuguccaguaauuccuggcac

SEQ ID NO: 1061853 - RNA, 22 nt, Human
gcagggacaucuucagaucacu

SEQ ID NO: 1061854 - RNA, 22 nt, Human
cuuuucauuguuuguacaugca

SEQ ID NO: 1061855 - RNA, 22 nt, Human
ggcaggcucuuggccuuaugag

SEQ ID NO: 1061856 - RNA, 22 nt, Human
ucagggaccccucugaguggag

SEQ ID NO: 1061857 - RNA, 22 nt, Human
uuguuucaaauauuucagaaua

SEQ ID NO: 1061858 - RNA, 22 nt, Human
acccagccacagcauugaggga

SEQ ID NO: 1061859 - RNA, 22 nt, Human
ccucugccaccucccacgaggc

SEQ ID NO: 1061860 - RNA, 23 nt, Human
ucagagaggcccccugcagagau

SEQ ID NO: 1061861 - RNA, 22 nt, Human
cuuggcagagggcugggcucag

SEQ ID NO: 1061862 - RNA, 22 nt, Human
ggugccagaguggcccaggggc

SEQ ID NO: 1061863 - RNA, 22 nt, Human
auguuaaaugguuuauuauuaa

SEQ ID NO: 1061864 - RNA, 22 nt, Human
acagcucuguguauugucaucu

SEQ ID NO: 1061865 - RNA, 22 nt, Human
aauguauggauucaugucugug

SEQ ID NO: 1061866 - RNA, 22 nt, Human
ccaucacaguccccaucgugau

SEQ ID NO: 1061867 - RNA, 22 nt, Human
ggccucagaccggagcuggcca

SEQ ID NO: 1061868 - RNA, 22 nt, Human
cagcucagucuugaagcacugg

SEQ ID NO: 1061869 - RNA, 22 nt, Human
caggacauugauccauuggcac

SEQ ID NO: 1061870 - RNA, 22 nt, Human
uucugucauccuuucuagaugu

SEQ ID NO: 1061871 - RNA, 22 nt, Human
aaauauagcaauuaugccuacu

SEQ ID NO: 1061872 - RNA, 22 nt, Human
aacaugauggggaagaacaaga

SEQ ID NO: 1061873 - RNA, 19 nt, Human
ugcuucuggaaccaugauc

SEQ ID NO: 1061874 - RNA, 20 nt, Human
guguuucaugugauacaaug

SEQ ID NO: 1061875 - RNA, 23 nt, Human
ugaaauauucuuuugcaugagcu

SEQ ID NO: 1061876 - RNA, 22 nt, Human
ugcaggcuccaggugcacauau

SEQ ID NO: 1061877 - RNA, 18 nt, Human
gaguguggcacugggccc

SEQ ID NO: 1061878 - RNA, 22 nt, Human
ccugggcugaagucaagugugg

SEQ ID NO: 1061879 - RNA, 23 nt, Human
cuuuucauugccuuagcgcagag

SEQ ID NO: 1061880 - RNA, 22 nt, Human
uugggaagaauggaggugguua

SEQ ID NO: 1061881 - RNA, 22 nt, Human
auccuggcccagguguggaggg

SEQ ID NO: 1061882 - RNA, 22 nt, Human
uccaggcaaggauaauaaacau

SEQ ID NO: 1061883 - RNA, 22 nt, Human
ggcaaggggucaggcugagaca

SEQ ID NO: 1061884 - RNA, 22 nt, Human
gcuuuauuuugugagggauuac

SEQ ID NO: 1061885 - RNA, 22 nt, Human
ucaggcucagguuaggggccaa

SEQ ID NO: 1061886 - RNA, 22 nt, Human
ucuggcagugauuucugugauc

SEQ ID NO: 1061887 - RNA, 17 nt, Human
ugcuggcaacauacaaa

SEQ ID NO: 1061888 - RNA, 22 nt, Human
ccucugcaaagaauuugucucc

SEQ ID NO: 1061889 - RNA, 22 nt, Human
gacccaggguggucaccugaaa

SEQ ID NO: 1061890 - RNA, 22 nt, Human
aguaugaaucucuuuauucugc

SEQ ID NO: 1061891 - RNA, 22 nt, Human
ccagcucucuuugaagcauaaa

SEQ ID NO: 1061892 - RNA, 22 nt, Human
cuccagggggcauccacacagc

SEQ ID NO: 1061893 - RNA, 22 nt, Human
uccugcagcucugagaagcauc

SEQ ID NO: 1061894 - RNA, 22 nt, Human
augcuacagcaucucucaucag

SEQ ID NO: 1061895 - RNA, 22 nt, Human
gacccugccaugagugacaggg

SEQ ID NO: 1061896 - RNA, 22 nt, Human
aauaaucucccuuuuuguaugu

SEQ ID NO: 1061897 - RNA, 22 nt, Human
uuaugaaguuccuguuacagug

SEQ ID NO: 1061898 - RNA, 22 nt, Human
aagauaauauucauuaacuaga

SEQ ID NO: 1061899 - RNA, 22 nt, Human
aaugaagcaguccaucugcucu

SEQ ID NO: 1061900 - RNA, 22 nt, Human
uugguuccuucugaaaguauug

SEQ ID NO: 1061901 - RNA, 22 nt, Human
aaauuucuggaagugucagagu

SEQ ID NO: 1061902 - RNA, 22 nt, Human
cugagggagcugcuggccuugg

SEQ ID NO: 1061903 - RNA, 23 nt, Human
acuuuauugaccccaggucaguu

SEQ ID NO: 1061904 - RNA, 22 nt, Human
uuccuggcgccacggagccggu

SEQ ID NO: 1061905 - RNA, 22 nt, Human
cucucugggcccaguuggcacc

SEQ ID NO: 1061906 - RNA, 22 nt, Human
uagcuuuagugaaaaauaucag

SEQ ID NO: 1061907 - RNA, 22 nt, Human
uguuggaauuaggauacagagg

SEQ ID NO: 1061908 - RNA, 22 nt, Human
ccagagagguagcuuacccucu

SEQ ID NO: 1061909 - RNA, 22 nt, Human
gcaaauacauguugagcaccua

SEQ ID NO: 1061910 - RNA, 22 nt, Human
gcuaggaaucggacccaggaag

SEQ ID NO: 1061911 - RNA, 22 nt, Human
gugugaaagcuuguccucugua

SEQ ID NO: 1061912 - RNA, 22 nt, Human
guccucuguagggcugggccac

SEQ ID NO: 1061913 - RNA, 22 nt, Human
augggcuguccuaguccagccc

SEQ ID NO: 1061914 - RNA, 22 nt, Human
guuuuauaauugcuucauaaga

SEQ ID NO: 1061915 - RNA, 22 nt, Human
ugcuucugaacucagcaugugg

SEQ ID NO: 1061916 - RNA, 22 nt, Human
uucuggggacauaacaguaagc

SEQ ID NO: 1061917 - RNA, 22 nt, Human
aaguguuuauuuauaacgaucu

SEQ ID NO: 1061918 - RNA, 22 nt, Human
cauuuguaucugggcugcugug

SEQ ID NO: 1061919 - RNA, 22 nt, Human
gaugaagccugacuucucggug

SEQ ID NO: 1061920 - RNA, 22 nt, Human
agucacaguuccuacccaguaa

SEQ ID NO: 1061921 - RNA, 22 nt, Human
agggaccugucaaugacaguua

SEQ ID NO: 1061922 - RNA, 22 nt, Human
acacauaagccuaaucaucucc

SEQ ID NO: 1061923 - RNA, 22 nt, Human
ugggccaggucugugucagcug

SEQ ID NO: 1061924 - RNA, 22 nt, Human
aaaguucuaaaacucuuuguga

SEQ ID NO: 1061925 - RNA, 22 nt, Human
uaugacuuauuucaucaguucu

SEQ ID NO: 1061926 - RNA, 22 nt, Human
uuaggaaguguguccagaagcg

SEQ ID NO: 1061927 - RNA, 21 nt, Human
ggcuaggaugcugggguuucc

SEQ ID NO: 1061928 - RNA, 22 nt, Human
guggcaggggcgggcuguuccg

SEQ ID NO: 1061929 - RNA, 22 nt, Human
acuguccaagcaugccuggcuu

SEQ ID NO: 1061930 - RNA, 22 nt, Human
ccagacccugcucuggggcucu

SEQ ID NO: 1061931 - RNA, 22 nt, Human
cugggcugcggugguagguugu

SEQ ID NO: 1061932 - RNA, 22 nt, Human
aaguuucaugauguaauuauug

SEQ ID NO: 1061933 - RNA, 22 nt, Human
guuuuauaugucucugcugaca

SEQ ID NO: 1061934 - RNA, 22 nt, Human
uccugcaggggcugaggaacca

SEQ ID NO: 1061935 - RNA, 22 nt, Human
ugucagaggcucagggucucag

SEQ ID NO: 1061936 - RNA, 17 nt, Human
ugcaggcuccugucccu

SEQ ID NO: 1061937 - RNA, 22 nt, Human
agaauccuguuuuacuucauca

SEQ ID NO: 1061938 - RNA, 22 nt, Human
gauaauauuagaagauacaaau

SEQ ID NO: 1061939 - RNA, 22 nt, Human
agacaaguucugugggucaccu

SEQ ID NO: 1061940 - RNA, 22 nt, Human
ucacauuuuuuacuggacuuaa

SEQ ID NO: 1061941 - RNA, 22 nt, Human
uccaggcacgaggcccugugca

SEQ ID NO: 1061942 - RNA, 22 nt, Human
accaggcaugauguggagcaca

SEQ ID NO: 1061943 - RNA, 22 nt, Human
auguaugagagauucuuuuauu

SEQ ID NO: 1061944 - RNA, 20 nt, Human
acaauauguagaugaauagc

SEQ ID NO: 1061945 - RNA, 22 nt, Human
ccagagaguaggaggcauuauu

SEQ ID NO: 1061946 - RNA, 20 nt, Human
uaacuuucuaugcuuucagc

SEQ ID NO: 1061947 - RNA, 22 nt, Human
uaauauuucuacccugcugccu

SEQ ID NO: 1061948 - RNA, 22 nt, Human
ccagagaguaucauggagagua

SEQ ID NO: 1061949 - RNA, 22 nt, Human
uucccacagagauuacauugaa

SEQ ID NO: 1061950 - RNA, 23 nt, Human
aaauuauugcucuucaauugccu

SEQ ID NO: 1061951 - RNA, 22 nt, Human
ucccugcccucagugcacccgg

SEQ ID NO: 1061952 - RNA, 22 nt, Human
ccaggccucuggcugcuuaguc

SEQ ID NO: 1061953 - RNA, 22 nt, Human
auugguggugaggacaugccag

SEQ ID NO: 1061954 - RNA, 22 nt, Human
acaggcaggcgggacagcccga

SEQ ID NO: 1061955 - RNA, 22 nt, Human
aaguaugugauacauguuaauu

SEQ ID NO: 1061956 - RNA, 22 nt, Human
ugccucucuaacccaugcccaa

SEQ ID NO: 1061957 - RNA, 22 nt, Human
gacacagaauuuacucccgaua

SEQ ID NO: 1061958 - RNA, 22 nt, Human
ugcagagagaccccugggccag

SEQ ID NO: 1061959 - RNA, 22 nt, Human
uccuucccaggugucgccgccu

SEQ ID NO: 1061960 - RNA, 22 nt, Human
acaugauuuuuaaagagauaau

SEQ ID NO: 1061961 - RNA, 22 nt, Human
aagagagagugcgcucacagaa

SEQ ID NO: 1061962 - RNA, 22 nt, Human
cagugagggcauucagugcugg

SEQ ID NO: 1061963 - RNA, 22 nt, Human
uucugucauuuagcauugucau

SEQ ID NO: 1061964 - RNA, 22 nt, Human
cccagcuugcaaauggguugcu

SEQ ID NO: 1061965 - RNA, 22 nt, Human
ccagagacgucggucagggcgc

SEQ ID NO: 1061966 - RNA, 22 nt, Human
cuggccagagguuccucugccc

SEQ ID NO: 1061967 - RNA, 22 nt, Human
acacagccgugaaucugcuucu

SEQ ID NO: 1061968 - RNA, 22 nt, Human
auguuucaugacugagcaaaau

SEQ ID NO: 1061969 - RNA, 22 nt, Human
ugucaacacaccuaucucaauu

SEQ ID NO: 1061970 - RNA, 22 nt, Human
ccugggcuuucggcggcuuccu

SEQ ID NO: 1061971 - RNA, 22 nt, Human
aggaggcugggcacaguggccu

SEQ ID NO: 1061972 - RNA, 22 nt, Human
gcuggggaggcagcagagaaca

SEQ ID NO: 1061973 - RNA, 22 nt, Human
ugcauacacaagcauacaugua

SEQ ID NO: 1061974 - RNA, 22 nt, Human
ccagcucucaaggcucccuggg

SEQ ID NO: 1061975 - RNA, 22 nt, Human
auuuauuaccucggaguuucug

SEQ ID NO: 1061976 - RNA, 22 nt, Human
agucacuuccagacaccugccu

SEQ ID NO: 1061977 - RNA, 22 nt, Human
ccaggcagggcucaaggaaccu

SEQ ID NO: 1061978 - RNA, 22 nt, Human
augggcugugggacccuggacc

SEQ ID NO: 1061979 - RNA, 22 nt, Human
ucucuuaauuuuggaauagugu

SEQ ID NO: 1061980 - RNA, 22 nt, Human
ggccucagaaauagaguaaaau

SEQ ID NO: 1061981 - RNA, 22 nt, Human
acaugacuuuucucuuccagag

SEQ ID NO: 1061982 - RNA, 22 nt, Human
uacagagacuuuauggcacaaa

SEQ ID NO: 1061983 - RNA, 22 nt, Human
cccugcagaucagugagaacuu

SEQ ID NO: 1061984 - RNA, 22 nt, Human
gcugggcugagcuagacuuggc

SEQ ID NO: 1061985 - RNA, 22 nt, Human
guaugaaguuggacuguauaaa

SEQ ID NO: 1061986 - RNA, 22 nt, Human
acacacuggcccccaguacuga

SEQ ID NO: 1061987 - RNA, 22 nt, Human
ccugggcucuauccugacccag

SEQ ID NO: 1061988 - RNA, 22 nt, Human
cucagccccaauucuccccauu

SEQ ID NO: 1061989 - RNA, 22 nt, Human
ucuggggaugagguccagugau

SEQ ID NO: 1061990 - RNA, 22 nt, Human
ucuggcagaaggcagaaauuca

SEQ ID NO: 1061991 - RNA, 21 nt, Human
ugucagagcuuguaggacauu

SEQ ID NO: 1061992 - RNA, 22 nt, Human
ucacauuucugauuauaccaaa

SEQ ID NO: 1061993 - RNA, 22 nt, Human
acagaccaaguuuccagcaggu

SEQ ID NO: 1061994 - RNA, 22 nt, Human
gaggugagaagggggucagaug

SEQ ID NO: 1061995 - RNA, 22 nt, Human
acagagagcugugauugaguua

SEQ ID NO: 1061996 - RNA, 21 nt, Human
auucagaaagggaauaaacuc

SEQ ID NO: 1061997 - RNA, 22 nt, Human
ucuggggagugccuaaguggaa

SEQ ID NO: 1061998 - RNA, 21 nt, Human
cccugcaggccagggcugagc

SEQ ID NO: 1061999 - RNA, 22 nt, Human
aggcaguguguagcuggaagag

SEQ ID NO: 1062000 - RNA, 22 nt, Human
gagcuuuaagggcacuggucuu

SEQ ID NO: 1062001 - RNA, 22 nt, Human
aaaauauuuuagggccaggaga

SEQ ID NO: 1062002 - RNA, 22 nt, Human
uggcaguggauaggggagcggu

SEQ ID NO: 1062003 - RNA, 21 nt, Human
ggccucagccaccuggcucug

SEQ ID NO: 1062004 - RNA, 22 nt, Human
agcaggggcuccuccacagcca

SEQ ID NO: 1062005 - RNA, 22 nt, Human
ugcagggagcucuggggugcag

SEQ ID NO: 1062006 - RNA, 22 nt, Human
gcugggcucaccaggccacuag

SEQ ID NO: 1062007 - RNA, 22 nt, Human
uuagacauguuugcuaaaauga

SEQ ID NO: 1062008 - RNA, 22 nt, Human
cuggcagggugggcuuugcuuu

SEQ ID NO: 1062009 - RNA, 23 nt, Human
caggacaugggaggaaguauggc

SEQ ID NO: 1062010 - RNA, 22 nt, Human
gcacccaguuugucucaggguu

SEQ ID NO: 1062011 - RNA, 22 nt, Human
aggacacacagaauacaaaucc

SEQ ID NO: 1062012 - RNA, 22 nt, Human
auagauauuugaguuguuucca

SEQ ID NO: 1062013 - RNA, 22 nt, Human
ucuccugucuucucagcacccc

SEQ ID NO: 1062014 - RNA, 22 nt, Human
gcuggcaguuuccucaccgagg

SEQ ID NO: 1062015 - RNA, 22 nt, Human
aaugauuggcacuagauacaca

SEQ ID NO: 1062016 - RNA, 22 nt, Human
uucuaccuacccucugcauaca

SEQ ID NO: 1062017 - RNA, 22 nt, Human
auuaaauuagcaaacugugaaa

SEQ ID NO: 1062018 - RNA, 22 nt, Human
agaggccggccgagcccauggg

SEQ ID NO: 1062019 - RNA, 22 nt, Human
aacuacauuguccuuucugaag

SEQ ID NO: 1062020 - RNA, 22 nt, Human
cuccucuguauugauugggacu

SEQ ID NO: 1062021 - RNA, 22 nt, Human
aaaagagugacugauaaguaua

SEQ ID NO: 1062022 - RNA, 22 nt, Human
cuuuauuccuacaagauuuucu

SEQ ID NO: 1062023 - RNA, 22 nt, Human
acugggcuguuuuuugagugga

SEQ ID NO: 1062024 - RNA, 22 nt, Human
cuccuggcacucaguguggaag

SEQ ID NO: 1062025 - RNA, 22 nt, Human
uccugcagcauccgucgucugu

SEQ ID NO: 1062026 - RNA, 22 nt, Human
aagucuguuugagugucacacu

SEQ ID NO: 1062027 - RNA, 22 nt, Human
uccugcagucugcacucugccu

SEQ ID NO: 1062028 - RNA, 22 nt, Human
gcuggcagaagagcugguucaa

SEQ ID NO: 1062029 - RNA, 22 nt, Human
agucucuuuaaucacagugucu

SEQ ID NO: 1062030 - RNA, 22 nt, Human
guccaggucuggacccugagcc

SEQ ID NO: 1062031 - RNA, 22 nt, Human
cuucuuaaauuggauugcuauu

SEQ ID NO: 1062032 - RNA, 22 nt, Human
cauauguauuucucauaauuag

SEQ ID NO: 1062033 - RNA, 22 nt, Human
auagggccuaaaaaguauugcu

SEQ ID NO: 1062034 - RNA, 22 nt, Human
aagaacuuccuaauauauuuuc

SEQ ID NO: 1062035 - RNA, 22 nt, Human
aaucuuuuaggggauccugagg

SEQ ID NO: 1062036 - RNA, 22 nt, Human
cccugcagugugaccucaccua

SEQ ID NO: 1062037 - RNA, 22 nt, Human
aauguaugugauuauuccucua

SEQ ID NO: 1062038 - RNA, 22 nt, Human
gggacccugggaggcuggcgca

SEQ ID NO: 1062039 - RNA, 19 nt, Human
ccaggccuccugggagguc

SEQ ID NO: 1062040 - RNA, 22 nt, Human
cuugggaggagaacaaagcucc

SEQ ID NO: 1062041 - RNA, 22 nt, Human
agggacccugaugacugaggag

SEQ ID NO: 1062042 - RNA, 22 nt, Human
cacauacauacguauguauaca

SEQ ID NO: 1062043 - RNA, 22 nt, Human
ccagcucugcauguuucccuug

SEQ ID NO: 1062044 - RNA, 22 nt, Human
ucccacacagcccgcucaccgg

SEQ ID NO: 1062045 - RNA, 22 nt, Human
cccuggcagagggggcaggugc

SEQ ID NO: 1062046 - RNA, 22 nt, Human
uuuuucauugcagccucucucc

SEQ ID NO: 1062047 - RNA, 22 nt, Human
gaaugaauagguguccagaugg

SEQ ID NO: 1062048 - RNA, 22 nt, Human
uagaaacaaugacaugcuugua

SEQ ID NO: 1062049 - RNA, 22 nt, Human
uuuccuaagguagugauaauuu

SEQ ID NO: 1062050 - RNA, 22 nt, Human
cuucugggcagaaguuuugaga

SEQ ID NO: 1062051 - RNA, 22 nt, Human
uccaggcaaagccuuguagacg

SEQ ID NO: 1062052 - RNA, 22 nt, Human
guguauaaugcuguuuguacau

SEQ ID NO: 1062053 - RNA, 22 nt, Human
ggagaagaggagcuggaagccu

SEQ ID NO: 1062054 - RNA, 22 nt, Human
cucuuaaagaauguuccagcug

SEQ ID NO: 1062055 - RNA, 22 nt, Human
gcuggcagagcucugggcuggg

SEQ ID NO: 1062056 - RNA, 20 nt, Human
acccagcucugugcccuggg

SEQ ID NO: 1062057 - RNA, 22 nt, Human
ccagccacugggccacugccag

SEQ ID NO: 1062058 - RNA, 22 nt, Human
uccugcaggccuguucccagua

SEQ ID NO: 1062059 - RNA, 22 nt, Human
ucuggcaggauaucgaagugaa

SEQ ID NO: 1062060 - RNA, 22 nt, Human
acuggaaaugagaugauaucag

SEQ ID NO: 1062061 - RNA, 22 nt, Human
gcagagaggauauuauugucca

SEQ ID NO: 1062062 - RNA, 22 nt, Human
uugauuucuuacucuuccaagg

SEQ ID NO: 1062063 - RNA, 22 nt, Human
cuuauuagaguuguguucuguu

SEQ ID NO: 1062064 - RNA, 20 nt, Human
ugcuuuaugcuauacuuugu

SEQ ID NO: 1062065 - RNA, 22 nt, Human
guuuauuagaguuuucugucug

SEQ ID NO: 1062066 - RNA, 22 nt, Human
cuugggcucagacuugaggaca

SEQ ID NO: 1062067 - RNA, 22 nt, Human
auguaugauauuuccaguauca

SEQ ID NO: 1062068 - RNA, 22 nt, Human
auacaugacucacacauucugc

SEQ ID NO: 1062069 - RNA, 22 nt, Human
acagagagaauuggguuuacag

SEQ ID NO: 1062070 - RNA, 23 nt, Human
gcugggcuuacucuuucagugag

SEQ ID NO: 1062071 - RNA, 22 nt, Human
ugcagggaaaguguuggcagca

SEQ ID NO: 1062072 - RNA, 22 nt, Human
acaucuucacugguuucuggaa

SEQ ID NO: 1062073 - RNA, 22 nt, Human
ugggcagggagcuggaaccaca

SEQ ID NO: 1062074 - RNA, 22 nt, Human
uuauuuaaaagugguaagauuc

SEQ ID NO: 1062075 - RNA, 22 nt, Human
caggcccucgcccgcagcgacc

SEQ ID NO: 1062076 - RNA, 22 nt, Human
acccacaccuccguauaucacu

SEQ ID NO: 1062077 - RNA, 18 nt, Human
cuccagggaacucaguca

SEQ ID NO: 1062078 - RNA, 22 nt, Human
ucuggggagucaaagagaccug

SEQ ID NO: 1062079 - RNA, 22 nt, Human
ccagagagcuacaaggcauaaa

SEQ ID NO: 1062080 - RNA, 22 nt, Human
ugaccugcagucaagaggggaa

SEQ ID NO: 1062081 - RNA, 22 nt, Human
uuguucaugguuguaaguuuga

SEQ ID NO: 1062082 - RNA, 22 nt, Human
ucccagggcacucacccucccu

SEQ ID NO: 1062083 - RNA, 22 nt, Human
aguaugaauggaaacuaccuau

SEQ ID NO: 1062084 - RNA, 20 nt, Human
uuuuccuucugaguauguug

SEQ ID NO: 1062085 - RNA, 22 nt, Human
uaugaagcucucacuguguguc

SEQ ID NO: 1062086 - RNA, 22 nt, Human
agcacaggcuuuggugugaggg

SEQ ID NO: 1062087 - RNA, 22 nt, Human
uucugucaaacucacaggccga

SEQ ID NO: 1062088 - RNA, 22 nt, Human
cccaggcaucccauuaaggagc

SEQ ID NO: 1062089 - RNA, 22 nt, Human
uuaugacaggaaaaucacagaa

SEQ ID NO: 1062090 - RNA, 22 nt, Human
cucugaauggacacuccagugu

SEQ ID NO: 1062091 - RNA, 22 nt, Human
ugcuuuauucccuucugaugug

SEQ ID NO: 1062092 - RNA, 22 nt, Human
ccuuuaaagacugcauaacuuc

SEQ ID NO: 1062093 - RNA, 19 nt, Human
uuuacucuccaaggugagu

SEQ ID NO: 1062094 - RNA, 22 nt, Human
gagccuccuccuggugugccga

SEQ ID NO: 1062095 - RNA, 22 nt, Human
uaccugcagcgggaauccauua

SEQ ID NO: 1062096 - RNA, 22 nt, Human
agucuucugaauaagaaucacu

SEQ ID NO: 1062097 - RNA, 22 nt, Human
cuguccagcuuggcuccugggg

SEQ ID NO: 1062098 - RNA, 22 nt, Human
auuuucaucauggguuuaacau

SEQ ID NO: 1062099 - RNA, 22 nt, Human
gccaggcaauguguuagaagcg

SEQ ID NO: 1062100 - RNA, 22 nt, Human
uuccaagucuaaguuauaaauc

SEQ ID NO: 1062101 - RNA, 22 nt, Human
uguaugaaucucauuuguuuaa

SEQ ID NO: 1062102 - RNA, 22 nt, Human
gaggccagaaugagcugaaugc

SEQ ID NO: 1062103 - RNA, 22 nt, Human
auuucacaaagaacagaugcag

SEQ ID NO: 1062104 - RNA, 22 nt, Human
accaugaucugcucugguguuu

SEQ ID NO: 1062105 - RNA, 22 nt, Human
gcagcuuuguggagaggcccau

SEQ ID NO: 1062106 - RNA, 22 nt, Human
gguuucaaaguggacaguuagu

SEQ ID NO: 1062107 - RNA, 22 nt, Human
ccugggcucaagcgaucuuguc

SEQ ID NO: 1062108 - RNA, 22 nt, Human
uacaaaaguaauuacgguuuuu

SEQ ID NO: 1062109 - RNA, 22 nt, Human
cccugcaggcucagacuggagu

SEQ ID NO: 1062110 - RNA, 22 nt, Human
cugcagggaacugaggcccaga

SEQ ID NO: 1062111 - RNA, 22 nt, Human
guuucauucggcagcucauaag

SEQ ID NO: 1062112 - RNA, 22 nt, Human
auguagaauuccuucuacuuug

SEQ ID NO: 1062113 - RNA, 22 nt, Human
ugggcuccguugccuggggcag

SEQ ID NO: 1062114 - RNA, 22 nt, Human
uguaaaaccaaaucaaucuagu

SEQ ID NO: 1062115 - RNA, 20 nt, Human
ucccaggcuccacccuagac

SEQ ID NO: 1062116 - RNA, 22 nt, Human
cuucauuaaccaaaaugcaaua

SEQ ID NO: 1062117 - RNA, 22 nt, Human
ccugggcuuacgaccucugacu

SEQ ID NO: 1062118 - RNA, 19 nt, Human
cuuauuagagugagagcuu

SEQ ID NO: 1062119 - RNA, 22 nt, Human
ugaagccacuuuccagaaucac

SEQ ID NO: 1062120 - RNA, 22 nt, Human
gcccacaccauuuauucuuugu

SEQ ID NO: 1062121 - RNA, 17 nt, Human
ugcuucuguauugcugg

SEQ ID NO: 1062122 - RNA, 22 nt, Human
gugcuaaaggguuaugaacaag

SEQ ID NO: 1062123 - RNA, 22 nt, Human
cagggcuccccgcaccgcagcc

SEQ ID NO: 1062124 - RNA, 22 nt, Human
uaugcacauucacacaaaaaug

SEQ ID NO: 1062125 - RNA, 22 nt, Human
gcuggcagcuggaaguugggcu

SEQ ID NO: 1062126 - RNA, 22 nt, Human
aauuugcaugaugagaacaaua

SEQ ID NO: 1062127 - RNA, 22 nt, Human
ucaggcucccugcugggcucug

SEQ ID NO: 1062128 - RNA, 22 nt, Human
uaugacauuauaaaggauuauu

SEQ ID NO: 1062129 - RNA, 22 nt, Human
gcuucugggcaccugaacagga

SEQ ID NO: 1062130 - RNA, 22 nt, Human
auuuauuaagcaucugcuaugu

SEQ ID NO: 1062131 - RNA, 22 nt, Human
ccuccuggcuuuucccauugaa

SEQ ID NO: 1062132 - RNA, 22 nt, Human
uaugaacugugagugugauggg

SEQ ID NO: 1062133 - RNA, 20 nt, Human
uucuuaaagaccucacuuug

SEQ ID NO: 1062134 - RNA, 22 nt, Human
gccaaaucuggauuuagcaaga

SEQ ID NO: 1062135 - RNA, 22 nt, Human
acaagguauccacauuaaaugu

SEQ ID NO: 1062136 - RNA, 22 nt, Human
gaagccucaacaucucugcguc

SEQ ID NO: 1062137 - RNA, 22 nt, Human
ccagagaccagaacauggggau

SEQ ID NO: 1062138 - RNA, 22 nt, Human
auuucauugaaguuaauucuuc

SEQ ID NO: 1062139 - RNA, 22 nt, Human
ggcuuugguagacacagauuga

SEQ ID NO: 1062140 - RNA, 20 nt, Human
uccaggcagcucagaguguc

SEQ ID NO: 1062141 - RNA, 22 nt, Human
uuccaagugcccauauuucauc

SEQ ID NO: 1062142 - RNA, 22 nt, Human
gaaaacuaacggaaaaguuagg

SEQ ID NO: 1062143 - RNA, 22 nt, Human
uuaaauuagucaagcuucucug

SEQ ID NO: 1062144 - RNA, 22 nt, Human
uagcauuucccaaaugcauuug

SEQ ID NO: 1062145 - RNA, 22 nt, Human
uucaaauuaccacauuugcuua

SEQ ID NO: 1062146 - RNA, 22 nt, Human
uaacacauauuugcaguaagca

SEQ ID NO: 1062147 - RNA, 22 nt, Human
gcacucuccuggcugccacagu

SEQ ID NO: 1062148 - RNA, 22 nt, Human
ggaccaggccagccucccugcg

SEQ ID NO: 1062149 - RNA, 22 nt, Human
gcuucuauuauuuggagcugag

SEQ ID NO: 1062150 - RNA, 22 nt, Human
caggcccugccuugagggaccu

SEQ ID NO: 1062151 - RNA, 22 nt, Human
gcacacaggggaguucucagaa

SEQ ID NO: 1062152 - RNA, 22 nt, Human
uccaggaggguuuucugccuuc

SEQ ID NO: 1062153 - RNA, 22 nt, Human
gugggcuucccuuaagccagag

SEQ ID NO: 1062154 - RNA, 16 nt, Human
ucacauacuuccuugc

SEQ ID NO: 1062155 - RNA, 22 nt, Human
gcagcuuucuaagcuuuauugc

SEQ ID NO: 1062156 - RNA, 22 nt, Human
aaagaguucuaugaucuuucca

SEQ ID NO: 1062157 - RNA, 22 nt, Human
ccaggcucaggccugcucguug

SEQ ID NO: 1062158 - RNA, 22 nt, Human
gguggcagaggugcaucagccc

SEQ ID NO: 1062159 - RNA, 22 nt, Human
acuggcagaggauagcacuaau

SEQ ID NO: 1062160 - RNA, 22 nt, Human
ucuggcagcucaguucaggucu

SEQ ID NO: 1062161 - RNA, 22 nt, Human
uuaacauuguccuuagcagauu

SEQ ID NO: 1062162 - RNA, 22 nt, Human
ugaacuuagugggaauaucucu

SEQ ID NO: 1062163 - RNA, 22 nt, Human
ucacaauacucacucaauggcu

SEQ ID NO: 1062164 - RNA, 22 nt, Human
ugugugaaggagccacuguuca

SEQ ID NO: 1062165 - RNA, 22 nt, Human
caauaguucgguccugaaggcc

SEQ ID NO: 1062166 - RNA, 22 nt, Human
ucagagagcuggugggcagagg

SEQ ID NO: 1062167 - RNA, 22 nt, Human
uaacacauuuuaagccauuuua

SEQ ID NO: 1062168 - RNA, 22 nt, Human
accaugaugcauccuuaaggaa

SEQ ID NO: 1062169 - RNA, 22 nt, Human
cuggcaugaaauggcaucucau

SEQ ID NO: 1062170 - RNA, 22 nt, Human
ugagcaucuuuuuacagguuua

SEQ ID NO: 1062171 - RNA, 22 nt, Human
ucaauaaaauuguuuuccuauc

SEQ ID NO: 1062172 - RNA, 22 nt, Human
cccaguuucaacuuuccagugg

SEQ ID NO: 1062173 - RNA, 22 nt, Human
acauuuuaauaugcuuagugug

SEQ ID NO: 1062174 - RNA, 22 nt, Human
uggaaauacuugccauaaaacu

SEQ ID NO: 1062175 - RNA, 22 nt, Human
acauuuuuauucaucaaagcag

SEQ ID NO: 1062176 - RNA, 20 nt, Human
uaguauuugcauaaggauag

SEQ ID NO: 1062177 - RNA, 22 nt, Human
ucugucaaaugagcaaguaacu

SEQ ID NO: 1062178 - RNA, 22 nt, Human
ugggcuuuaucaugggucuggu

SEQ ID NO: 1062179 - RNA, 22 nt, Human
auggcuagcaccgcguugcugg

SEQ ID NO: 1062180 - RNA, 22 nt, Human
ugcaggcuguaaucugaggcua

SEQ ID NO: 1062181 - RNA, 22 nt, Human
acaaaguuugugguauuccaag

SEQ ID NO: 1062182 - RNA, 22 nt, Human
aaacaucauaggcaugcaugau

SEQ ID NO: 1062183 - RNA, 20 nt, Human
aacacagauaccaaagguug

SEQ ID NO: 1062184 - RNA, 22 nt, Human
cucugaccauucccuugauuuu

SEQ ID NO: 1062185 - RNA, 22 nt, Human
cuccagggaugagacagaguag

SEQ ID NO: 1062186 - RNA, 22 nt, Human
acacaucaugccaaguuucacc

SEQ ID NO: 1062187 - RNA, 22 nt, Human
auguccagaguguccuggaaag

SEQ ID NO: 1062188 - RNA, 22 nt, Human
ugcuucugaguugcaggacuug

SEQ ID NO: 1062189 - RNA, 22 nt, Human
gagcauuuuugucugcauuuua

SEQ ID NO: 1062190 - RNA, 22 nt, Human
ugggcuucugauguugagugcu

SEQ ID NO: 1062191 - RNA, 22 nt, Human
cuguugcaucauggcucuuaau

SEQ ID NO: 1062192 - RNA, 22 nt, Human
guuguuuuuguucucuauagcu

SEQ ID NO: 1062193 - RNA, 22 nt, Human
uagcauuuauuccagauuugga

SEQ ID NO: 1062194 - RNA, 22 nt, Human
ucuggcagugaagucaugaggu

SEQ ID NO: 1062195 - RNA, 22 nt, Human
acauuuagaguucuuuacucca

SEQ ID NO: 1062196 - RNA, 22 nt, Human
cacacagaugguaagggaggga

SEQ ID NO: 1062197 - RNA, 22 nt, Human
aaauaguucagccacggugacu

SEQ ID NO: 1062198 - RNA, 22 nt, Human
gccaggcaggccacgcuguguu

SEQ ID NO: 1062199 - RNA, 19 nt, Human
ccagagacauuggcaucuu

SEQ ID NO: 1062200 - RNA, 22 nt, Human
ucacauuuuauaucucugguuu

SEQ ID NO: 1062201 - RNA, 22 nt, Human
ugcuccagugagcuggccaucc

SEQ ID NO: 1062202 - RNA, 22 nt, Human
ggcucccacccauagggcgagu

SEQ ID NO: 1062203 - RNA, 22 nt, Human
accaggcagcugggggugaugu

SEQ ID NO: 1062204 - RNA, 22 nt, Human
ccugggcucgcgcacuucaccc

SEQ ID NO: 1062205 - RNA, 22 nt, Human
caguguggugugcacagcuuag

SEQ ID NO: 1062206 - RNA, 22 nt, Human
uccaggcaugucccaagccgga

SEQ ID NO: 1062207 - RNA, 18 nt, Human
uccugccugugccccagg

SEQ ID NO: 1062208 - RNA, 22 nt, Human
ccuggggaaucuugcaggggaa

SEQ ID NO: 1062209 - RNA, 22 nt, Human
ugcauuuuuaacaaggcuaauu

SEQ ID NO: 1062210 - RNA, 22 nt, Human
uuggcaggaauauugcagaggu

SEQ ID NO: 1062211 - RNA, 22 nt, Human
uguaaacagccccauggagagc

SEQ ID NO: 1062212 - RNA, 22 nt, Human
cauaauuugauaugcuugaugg

SEQ ID NO: 1062213 - RNA, 22 nt, Human
aucucuguaaaccauaaauuga

SEQ ID NO: 1062214 - RNA, 22 nt, Human
acacacaugccuuuccuaagua

SEQ ID NO: 1062215 - RNA, 22 nt, Human
ccaggcuccgcauagaccccac

SEQ ID NO: 1062216 - RNA, 22 nt, Human
uuuaguagaaugauacagggca

SEQ ID NO: 1062217 - RNA, 15 nt, Human
uccaggcauucauuc

SEQ ID NO: 1062218 - RNA, 22 nt, Human
ucuggcaggccuugucaaucug

SEQ ID NO: 1062219 - RNA, 22 nt, Human
guuucauuuacaucuguaggua

SEQ ID NO: 1062220 - RNA, 22 nt, Human
ccacacuaaacugcucaaacca

SEQ ID NO: 1062221 - RNA, 19 nt, Human
uggccagguacugucugcu

SEQ ID NO: 1062222 - RNA, 22 nt, Human
cagggacccgcacagguagcau

SEQ ID NO: 1062223 - RNA, 22 nt, Human
acuggagcugagagcaugggua

SEQ ID NO: 1062224 - RNA, 22 nt, Human
cucuugcagauaccuugaagga

SEQ ID NO: 1062225 - RNA, 22 nt, Human
ggcaagagggcagauggagugc

SEQ ID NO: 1062226 - RNA, 22 nt, Human
uuuacucuugcuacacaacugu

SEQ ID NO: 1062227 - RNA, 22 nt, Human
guggcagguggagccuccugca

SEQ ID NO: 1062228 - RNA, 22 nt, Human
gccuggcaggggccugggagug

SEQ ID NO: 1062229 - RNA, 22 nt, Human
guuuuuaucuaauagcaguuau

SEQ ID NO: 1062230 - RNA, 17 nt, Human
gggcugacaguggccuc

SEQ ID NO: 1062231 - RNA, 22 nt, Human
aaagaucaauagauaaagcuac

SEQ ID NO: 1062232 - RNA, 22 nt, Human
cuggggaccgagcaagcucugg

SEQ ID NO: 1062233 - RNA, 22 nt, Human
uguugauuaguguuuagacuua

SEQ ID NO: 1062234 - RNA, 22 nt, Human
auugaaaauauaauucuaggag

SEQ ID NO: 1062235 - RNA, 22 nt, Human
cccugcagacgucuugaugccu

SEQ ID NO: 1062236 - RNA, 22 nt, Human
ucacuguaauagguuugaagau

SEQ ID NO: 1062237 - RNA, 22 nt, Human
uauguaaaguagauggcaggua

SEQ ID NO: 1062238 - RNA, 22 nt, Human
uucagagacagcaaccaggaca

SEQ ID NO: 1062239 - RNA, 22 nt, Human
uuccaagugucagaucagauuu

SEQ ID NO: 1062240 - RNA, 22 nt, Human
agcaggcuccaggcuggccauc

SEQ ID NO: 1062241 - RNA, 22 nt, Human
guuaaccaaggcaccaagugua

SEQ ID NO: 1062242 - RNA, 22 nt, Human
ugcagugguugagagcccagac

SEQ ID NO: 1062243 - RNA, 22 nt, Human
uccucuccaugucucacgccac

SEQ ID NO: 1062244 - RNA, 22 nt, Human
ucuagggaacaugggucaagcu

SEQ ID NO: 1062245 - RNA, 22 nt, Human
uccaggcuagguuuacaggaca

SEQ ID NO: 1062246 - RNA, 22 nt, Human
cuggaaaggguccucauucugu

SEQ ID NO: 1062247 - RNA, 22 nt, Human
gacugccucaguuucccugcag

SEQ ID NO: 1062248 - RNA, 22 nt, Human
uagggcucgggcacaggacagg

SEQ ID NO: 1062249 - RNA, 22 nt, Human
ggcggguguaaguaggacagcg

SEQ ID NO: 1062250 - RNA, 22 nt, Human
agcaggcuuuccacagaaggag

SEQ ID NO: 1062251 - RNA, 22 nt, Human
gaggguggggaauagacugcua

SEQ ID NO: 1062252 - RNA, 22 nt, Human
uucugcaucugaauuuaaguac

SEQ ID NO: 1062253 - RNA, 22 nt, Human
uuucugaagauacagcuuugcu

SEQ ID NO: 1062254 - RNA, 22 nt, Human
uuacuucuuacaaaagaaauau

SEQ ID NO: 1062255 - RNA, 22 nt, Human
cugcaggguuuuucaaggacaa

SEQ ID NO: 1062256 - RNA, 22 nt, Human
gacuuuggcaucuagacauugu

SEQ ID NO: 1062257 - RNA, 22 nt, Human
caauuucucgaacucuaaucca

SEQ ID NO: 1062258 - RNA, 17 nt, Human
uauacacagacagacug

SEQ ID NO: 1062259 - RNA, 22 nt, Human
ggcagugagaggucuccugguc

SEQ ID NO: 1062260 - RNA, 19 nt, Human
acuggcagggcugcggugg

SEQ ID NO: 1062261 - RNA, 22 nt, Human
aagaauacguaucaacaauggu

SEQ ID NO: 1062262 - RNA, 22 nt, Human
gggcuccaccuagggacacugg

SEQ ID NO: 1062263 - RNA, 22 nt, Human
cauuuguaucauauguaucuua

SEQ ID NO: 1062264 - RNA, 22 nt, Human
aacacaaagaagcugcaggauc

SEQ ID NO: 1062265 - RNA, 22 nt, Human
uugaauuagacuuugcuacagg

SEQ ID NO: 1062266 - RNA, 22 nt, Human
gccucaggccgcccugcugcuc

SEQ ID NO: 1062267 - RNA, 22 nt, Human
gcaggcuccaaggccugggaga

SEQ ID NO: 1062268 - RNA, 21 nt, Human
uaacacauuuugguacuuugg

SEQ ID NO: 1062269 - RNA, 22 nt, Human
aaauccuaauaaugcacuagug

SEQ ID NO: 1062270 - RNA, 22 nt, Human
auccugucaucauaguacuuga

SEQ ID NO: 1062271 - RNA, 22 nt, Human
uccaggcacuauauauacuuuu

SEQ ID NO: 1062272 - RNA, 22 nt, Human
ggcugcaggcagaggcugucug

SEQ ID NO: 1062273 - RNA, 22 nt, Human
gccaggcauuuguuaggugcug

SEQ ID NO: 1062274 - RNA, 22 nt, Human
accugcagguguuuccacacuu

SEQ ID NO: 1062275 - RNA, 22 nt, Human
ucagcucuaaguuuuaugcaaa

SEQ ID NO: 1062276 - RNA, 22 nt, Human
acacacagguaaaggagccugg

SEQ ID NO: 1062277 - RNA, 22 nt, Human
gucacuguauccagguuccagc

SEQ ID NO: 1062278 - RNA, 22 nt, Human
ugugaagauuuggcaugcagaa

SEQ ID NO: 1062279 - RNA, 22 nt, Human
ucccagccuuucuuuucugcug

SEQ ID NO: 1062280 - RNA, 22 nt, Human
cccugcagccuugcaugccuuc

SEQ ID NO: 1062281 - RNA, 22 nt, Human
cccugcagcuuuugcauaguca

SEQ ID NO: 1062282 - RNA, 22 nt, Human
accaugaugggaagcucagggc

SEQ ID NO: 1062283 - RNA, 22 nt, Human
aauuagggaggacaaagguaca

SEQ ID NO: 1062284 - RNA, 22 nt, Human
aaucuucauuuugacaagauuc

SEQ ID NO: 1062285 - RNA, 22 nt, Human
auacuuuggucacuauuauugg

SEQ ID NO: 1062286 - RNA, 22 nt, Human
uggccuccccuaacagccucuu

SEQ ID NO: 1062287 - RNA, 22 nt, Human
gggcugacaaccaucugacaag

SEQ ID NO: 1062288 - RNA, 22 nt, Human
agcacaggaacauggagauggg

SEQ ID NO: 1062289 - RNA, 22 nt, Human
ugcagggaaagggcacugggcu

SEQ ID NO: 1062290 - RNA, 22 nt, Human
uuuucauugagcaccugaguaa

SEQ ID NO: 1062291 - RNA, 22 nt, Human
ccaggcucacugacuaccacau

SEQ ID NO: 1062292 - RNA, 22 nt, Human
uaaacaucugucauguguuuau

SEQ ID NO: 1062293 - RNA, 22 nt, Human
ggagugugggauggagcucagg

SEQ ID NO: 1062294 - RNA, 22 nt, Human
ucauguuauugacucauaauau

SEQ ID NO: 1062295 - RNA, 22 nt, Human
cuacccagcaccuaggcugccu

SEQ ID NO: 1062296 - RNA, 22 nt, Human
ggcaggcaggucuucauggccc

SEQ ID NO: 1062297 - RNA, 20 nt, Human
aguguacagacacuagaaau

SEQ ID NO: 1062298 - RNA, 22 nt, Human
ucuucuuaugugccauuaucuc

SEQ ID NO: 1062299 - RNA, 22 nt, Human
ugagagucucagaccuccuggu

SEQ ID NO: 1062300 - RNA, 22 nt, Human
uccaggcagcccuuccugacuc

SEQ ID NO: 1062301 - RNA, 22 nt, Human
cucuuaaauaacaucauugcuu

SEQ ID NO: 1062302 - RNA, 21 nt, Human
ggcuuuaugcucacccagccu

SEQ ID NO: 1062303 - RNA, 22 nt, Human
gacccagcuaaccaggugggga

SEQ ID NO: 1062304 - RNA, 22 nt, Human
ugcaggcuauccuuugcugcaa

SEQ ID NO: 1062305 - RNA, 22 nt, Human
acaguguuuuagaaaagcuuga

SEQ ID NO: 1062306 - RNA, 22 nt, Human
uuuagacauggcuugcucacuu

SEQ ID NO: 1062307 - RNA, 22 nt, Human
auguagaagcugacagugcugu

SEQ ID NO: 1062308 - RNA, 22 nt, Human
augucaaacacaacaccagugg

SEQ ID NO: 1062309 - RNA, 22 nt, Human
aauguaugugcaucauuuacau

SEQ ID NO: 1062310 - RNA, 22 nt, Human
uuucagauggagguuuaggaca

SEQ ID NO: 1062311 - RNA, 22 nt, Human
guuaaauucgaugauggauaaa

SEQ ID NO: 1062312 - RNA, 22 nt, Human
cauaauuucccaagagauugaa

SEQ ID NO: 1062313 - RNA, 21 nt, Human
agaauaaugguaucauuugcu

SEQ ID NO: 1062314 - RNA, 22 nt, Human
gagaaagauguaggcugggagg

SEQ ID NO: 1062315 - RNA, 22 nt, Human
cagugaggugcccagccugccc

SEQ ID NO: 1062316 - RNA, 19 nt, Human
ucugcagaaggcauacaug

SEQ ID NO: 1062317 - RNA, 22 nt, Human
caacacauugaagcuaugauga

SEQ ID NO: 1062318 - RNA, 22 nt, Human
ccucagcugcuucccuggagcc

SEQ ID NO: 1062319 - RNA, 22 nt, Human
cacaucagggcugcuugggggu

SEQ ID NO: 1062320 - RNA, 22 nt, Human
cuggaaagugucuccauccugg

SEQ ID NO: 1062321 - RNA, 22 nt, Human
gaugccuggcacccagcaagga

SEQ ID NO: 1062322 - RNA, 22 nt, Human
cccaaggccuucaagccagcuc

SEQ ID NO: 1062323 - RNA, 20 nt, Human
uagggcucauuaugaucucc

SEQ ID NO: 1062324 - RNA, 22 nt, Human
gcagggguuuucugacuugagu

SEQ ID NO: 1062325 - RNA, 19 nt, Human
auguaugaggucuucugcu

SEQ ID NO: 1062326 - RNA, 22 nt, Human
uuuuauuaucuuugaaugggac

SEQ ID NO: 1062327 - RNA, 22 nt, Human
cacaugcaucugucauguuugg

SEQ ID NO: 1062328 - RNA, 22 nt, Human
auuagggaaggauuuggccuga

SEQ ID NO: 1062329 - RNA, 22 nt, Human
ucagagaguuggaaagaauuaa

SEQ ID NO: 1062330 - RNA, 21 nt, Human
uccugcagggcagcagagugg

SEQ ID NO: 1062331 - RNA, 22 nt, Human
gacacagagcucacagucuccu

SEQ ID NO: 1062332 - RNA, 22 nt, Human
aagagcauggaauggagaucca

SEQ ID NO: 1062333 - RNA, 22 nt, Human
guggccagcaagugcugccucu

SEQ ID NO: 1062334 - RNA, 22 nt, Human
ucuccacacuuucucucccagg

SEQ ID NO: 1062335 - RNA, 22 nt, Human
aacaaagucguugccuagaaga

SEQ ID NO: 1062336 - RNA, 22 nt, Human
gcuggggagggcgucaaggcca

SEQ ID NO: 1062337 - RNA, 22 nt, Human
ucugggcuuuugcacuggccau

SEQ ID NO: 1062338 - RNA, 22 nt, Human
gaauauuuuuaaagggacuaau

SEQ ID NO: 1062339 - RNA, 22 nt, Human
ucuggcagggucagggcccagg

SEQ ID NO: 1062340 - RNA, 22 nt, Human
aaagagucguguuccagguuug

SEQ ID NO: 1062341 - RNA, 22 nt, Human
ccagugcccagcugcccaggca

SEQ ID NO: 1062342 - RNA, 22 nt, Human
aggcugcuucagcugcagggag

SEQ ID NO: 1062343 - RNA, 19 nt, Human
ccagucccauacaggagau

SEQ ID NO: 1062344 - RNA, 22 nt, Human
uucuggggcuaauacagagguc

SEQ ID NO: 1062345 - RNA, 22 nt, Human
ugggcuccucgucacucgcugu

SEQ ID NO: 1062346 - RNA, 22 nt, Human
gaaaagaguccugugugaggag

SEQ ID NO: 1062347 - RNA, 19 nt, Human
ucuuuucacgcauuuugaa

SEQ ID NO: 1062348 - RNA, 22 nt, Human
cagcucagucuggagagaugca

SEQ ID NO: 1062349 - RNA, 22 nt, Human
uagggcucugagaguucagccu

SEQ ID NO: 1062350 - RNA, 22 nt, Human
augcugucgaaaccaaacaucu

SEQ ID NO: 1062351 - RNA, 22 nt, Human
ugcuuuauuuuaaauaugccau

SEQ ID NO: 1062352 - RNA, 22 nt, Human
agggcugaagggaggugcucau

SEQ ID NO: 1062353 - RNA, 22 nt, Human
gcucucagaugcuccagcagcc

SEQ ID NO: 1062354 - RNA, 20 nt, Human
gccugcagguuggaugggau

SEQ ID NO: 1062355 - RNA, 22 nt, Human
gacccaggcccaaggcugccag

SEQ ID NO: 1062356 - RNA, 22 nt, Human
ccagccacagcuuccagcuccu

SEQ ID NO: 1062357 - RNA, 22 nt, Human
cagaggcauacucccagucuug

SEQ ID NO: 1062358 - RNA, 19 nt, Human
agugcagggagcacccuca

SEQ ID NO: 1062359 - RNA, 22 nt, Human
aaguccagcucuaaauaucuga

SEQ ID NO: 1062360 - RNA, 22 nt, Human
uuggcagggccaggcucucucu

SEQ ID NO: 1062361 - RNA, 22 nt, Human
gcuggcagucccaucagcuggg

SEQ ID NO: 1062362 - RNA, 22 nt, Human
ccuggcuccugccucugcaggg

SEQ ID NO: 1062363 - RNA, 22 nt, Human
cacccacauuccaucacucugc

SEQ ID NO: 1062364 - RNA, 18 nt, Human
acacugcagcagucugcu

SEQ ID NO: 1062365 - RNA, 22 nt, Human
uuucagaugugugucucugaag

SEQ ID NO: 1062366 - RNA, 22 nt, Human
cagagcaucgcgcagagagccu

SEQ ID NO: 1062367 - RNA, 17 nt, Human
ccauacugacauauuga

SEQ ID NO: 1062368 - RNA, 22 nt, Human
uuuccacaauguuuuugcagga

SEQ ID NO: 1062369 - RNA, 22 nt, Human
acccaggccugagagacaggag

SEQ ID NO: 1062370 - RNA, 22 nt, Human
uuucacauaaauauuaugccua

SEQ ID NO: 1062371 - RNA, 22 nt, Human
uugugaaacauucauggauuug

SEQ ID NO: 1062372 - RNA, 22 nt, Human
agucagugaaaacuagaauguu

SEQ ID NO: 1062373 - RNA, 22 nt, Human
auuagggaaacugacuugucuc

SEQ ID NO: 1062374 - RNA, 22 nt, Human
aagggcucuguugccauuucag

SEQ ID NO: 1062375 - RNA, 22 nt, Human
agggaagaagcugguaguaggu

SEQ ID NO: 1062376 - RNA, 22 nt, Human
ucaggcucaaagggccggauga

SEQ ID NO: 1062377 - RNA, 22 nt, Human
caguauuuauggcuugaguauu

SEQ ID NO: 1062378 - RNA, 21 nt, Human
uccccacauuucuaaacagac

SEQ ID NO: 1062379 - RNA, 22 nt, Human
agcugccaaguuucucaguuua

SEQ ID NO: 1062380 - RNA, 22 nt, Human
cuucugggagagcuuuugcuuc

SEQ ID NO: 1062381 - RNA, 21 nt, Human
cuugggcuuguagauggugga

SEQ ID NO: 1062382 - RNA, 22 nt, Human
ugcuuuauugcaucaguguggg

SEQ ID NO: 1062383 - RNA, 22 nt, Human
uccuggcagagggcggccucga

SEQ ID NO: 1062384 - RNA, 22 nt, Human
ucccagccuuccuuguggugaa

SEQ ID NO: 1062385 - RNA, 22 nt, Human
ucuggggcaguuacuggggccu

SEQ ID NO: 1062386 - RNA, 22 nt, Human
uucauagagcagcucacugaau

SEQ ID NO: 1062387 - RNA, 22 nt, Human
acuggggauuagggacucagug

SEQ ID NO: 1062388 - RNA, 22 nt, Human
ugcuucugcucagcuuccuacu

SEQ ID NO: 1062389 - RNA, 22 nt, Human
ugacuagaccuauaucuuuuug

SEQ ID NO: 1062390 - RNA, 22 nt, Human
gccaagcuuugcaggaguguug

SEQ ID NO: 1062391 - RNA, 22 nt, Human
acaugauucuugauaggcauug

SEQ ID NO: 1062392 - RNA, 22 nt, Human
uacacaucacuguaucuuucag

SEQ ID NO: 1062393 - RNA, 22 nt, Human
auguuugaaauuguaaguauau

SEQ ID NO: 1062394 - RNA, 22 nt, Human
uagaauucaagauucaacaggc

SEQ ID NO: 1062395 - RNA, 22 nt, Human
cacaucccuggaguuacccagu

SEQ ID NO: 1062396 - RNA, 22 nt, Human
acugggcuccaaggaccuggag

SEQ ID NO: 1062397 - RNA, 22 nt, Human
uuuagggaauagaagaucugaa

SEQ ID NO: 1062398 - RNA, 22 nt, Human
ucuggcagcuauccucuggcca

SEQ ID NO: 1062399 - RNA, 18 nt, Human
agcagguggcgucugcag

SEQ ID NO: 1062400 - RNA, 22 nt, Human
uggcagugucuuaucaggagug

SEQ ID NO: 1062401 - RNA, 22 nt, Human
uuuauugacccaaagcgagagu

SEQ ID NO: 1062402 - RNA, 22 nt, Human
cauguuaaugaauuuuugcagu

SEQ ID NO: 1062403 - RNA, 22 nt, Human
aaacacagggauauauauucca

SEQ ID NO: 1062404 - RNA, 22 nt, Human
uuucugaaaucucuuuugagga

SEQ ID NO: 1062405 - RNA, 22 nt, Human
aaauuaguacauugcaaagucc

SEQ ID NO: 1062406 - RNA, 22 nt, Human
ugcagggccuucuagaccaugg

SEQ ID NO: 1062407 - RNA, 22 nt, Human
ccaggccuggccaggggaugcc

SEQ ID NO: 1062408 - RNA, 22 nt, Human
caggcagcccugcaccaagugu

SEQ ID NO: 1062409 - RNA, 22 nt, Human
ccagggggcuuggugaggccau

SEQ ID NO: 1062410 - RNA, 22 nt, Human
gggagcuguaagggacagguag

SEQ ID NO: 1062411 - RNA, 22 nt, Human
ggcccaaacggguccagugaaa

SEQ ID NO: 1062412 - RNA, 22 nt, Human
guauuaggaggaacacaggccu

SEQ ID NO: 1062413 - RNA, 23 nt, Human
uuggagagggugaguagugucag

SEQ ID NO: 1062414 - RNA, 22 nt, Human
auuacaguaacagcuacaaugc

SEQ ID NO: 1062415 - RNA, 22 nt, Human
agacacagucugucuggaggag

SEQ ID NO: 1062416 - RNA, 19 nt, Human
aaacacagauuucuuacca

SEQ ID NO: 1062417 - RNA, 22 nt, Human
cccugcagaucuaggguccuuc

SEQ ID NO: 1062418 - RNA, 22 nt, Human
cacccagcauuggcuaagagag

SEQ ID NO: 1062419 - RNA, 22 nt, Human
gagcuuuagcugagaccugcuu

SEQ ID NO: 1062420 - RNA, 22 nt, Human
aggcuuuaauuaucuacaggag

SEQ ID NO: 1062421 - RNA, 22 nt, Human
auuacaauaagguuuauuugua

SEQ ID NO: 1062422 - RNA, 22 nt, Human
acacauacauggggaagaugag

SEQ ID NO: 1062423 - RNA, 22 nt, Human
uccaggcagagcaacaaaauau

SEQ ID NO: 1062424 - RNA, 22 nt, Human
gccugcagccucaagggcugag

SEQ ID NO: 1062425 - RNA, 22 nt, Human
ucccagccacaguuuccaccug

SEQ ID NO: 1062426 - RNA, 22 nt, Human
ucuuugaaaagggagauagaaa

SEQ ID NO: 1062427 - RNA, 22 nt, Human
uuaugcaaaggggccucuuccu

SEQ ID NO: 1062428 - RNA, 22 nt, Human
gagggguccaggaggcacuuac

SEQ ID NO: 1062429 - RNA, 22 nt, Human
gagaggcuggcagugccagguu

SEQ ID NO: 1062430 - RNA, 22 nt, Human
uccaggcuugagaccaggcucu

SEQ ID NO: 1062431 - RNA, 23 nt, Human
ggacacauuuauuucagaauuca

SEQ ID NO: 1062432 - RNA, 22 nt, Human
uuauuaggaaaaggucagaugu

SEQ ID NO: 1062433 - RNA, 23 nt, Human
cuuucauugugguuucacagagc

SEQ ID NO: 1062434 - RNA, 22 nt, Human
ugaaugauuugggugcauucag

SEQ ID NO: 1062435 - RNA, 22 nt, Human
uuucuagagugggcaugucuua

SEQ ID NO: 1062436 - RNA, 22 nt, Human
cugcagccuccuccagcuacgu

SEQ ID NO: 1062437 - RNA, 22 nt, Human
cacacacaguuuuguauucugu

SEQ ID NO: 1062438 - RNA, 22 nt, Human
cugcaggagcaaagccucugcu

SEQ ID NO: 1062439 - RNA, 22 nt, Human
ucagcuuuuuacaugugaaaua

SEQ ID NO: 1062440 - RNA, 22 nt, Human
aaacaccagucccaguauacac

SEQ ID NO: 1062441 - RNA, 22 nt, Human
augggcugggaauacacagggg

SEQ ID NO: 1062442 - RNA, 22 nt, Human
ucuccugcucagaacagccuca

SEQ ID NO: 1062443 - RNA, 22 nt, Human
cauucccacguguucuuugcuu

SEQ ID NO: 1062444 - RNA, 21 nt, Human
uucauaaaccauucucaugca

SEQ ID NO: 1062445 - RNA, 22 nt, Human
acaguguguuggaggagacugu

SEQ ID NO: 1062446 - RNA, 19 nt, Human
ccugccugagcugucccuc

SEQ ID NO: 1062447 - RNA, 22 nt, Human
cacaugaagagagucuaguaau

SEQ ID NO: 1062448 - RNA, 22 nt, Human
uccacccugcuuuugucuuuga

SEQ ID NO: 1062449 - RNA, 22 nt, Human
gccgggaccaaggccacggagc

SEQ ID NO: 1062450 - RNA, 22 nt, Human
aucauuuuuaagagacucuucu

SEQ ID NO: 1062451 - RNA, 17 nt, Human
aggcauggucuggggug

SEQ ID NO: 1062452 - RNA, 22 nt, Human
auuauuagauucuuaauuguaa

SEQ ID NO: 1062453 - RNA, 22 nt, Human
cacccagcacagagggaggcga

SEQ ID NO: 1062454 - RNA, 22 nt, Human
uacacacaugcauuugccuuau

SEQ ID NO: 1062455 - RNA, 23 nt, Human
acucacaaagcaggaucauguug

SEQ ID NO: 1062456 - RNA, 23 nt, Human
uugggaaauaguuaagacaugag

SEQ ID NO: 1062457 - RNA, 22 nt, Human
caggaguccagagugucauuuu

SEQ ID NO: 1062458 - RNA, 22 nt, Human
aguucacauaucuguuuuauuu

SEQ ID NO: 1062459 - RNA, 22 nt, Human
uuaaacauuuauggaggcagca

SEQ ID NO: 1062460 - RNA, 22 nt, Human
aauaacuucauguaacauuuaa

SEQ ID NO: 1062461 - RNA, 22 nt, Human
gacccauauaggacccuccaaa

SEQ ID NO: 1062462 - RNA, 22 nt, Human
cuuccuccgaagaaguugcugg

SEQ ID NO: 1062463 - RNA, 22 nt, Human
aauuucuccaagaaugcuuaga

SEQ ID NO: 1062464 - RNA, 22 nt, Human
uccauucuaugcuuacauuuau

SEQ ID NO: 1062465 - RNA, 22 nt, Human
agguagggaagaaggcaugaaa

SEQ ID NO: 1062466 - RNA, 22 nt, Human
acacacaugguauuguucagaa

SEQ ID NO: 1062467 - RNA, 22 nt, Human
agcaggugggcaugaaagcuga

SEQ ID NO: 1062468 - RNA, 21 nt, Human
guccagagagccggcuccuga

SEQ ID NO: 1062469 - RNA, 23 nt, Human
aaacuacauuuauaguuuuucuc

SEQ ID NO: 1062470 - RNA, 22 nt, Human
auaaagauuucuuuuucucuac

SEQ ID NO: 1062471 - RNA, 22 nt, Human
aagggcucugugugccucccca

SEQ ID NO: 1062472 - RNA, 22 nt, Human
uuucauaauagugcaguuuguu

SEQ ID NO: 1062473 - RNA, 22 nt, Human
ggagccugaaaagucugcauuu

SEQ ID NO: 1062474 - RNA, 22 nt, Human
cuucacauguuggaguccuuug

SEQ ID NO: 1062475 - RNA, 22 nt, Human
cauaauuuuccaugguuugcua

SEQ ID NO: 1062476 - RNA, 22 nt, Human
uucuagcagagggcaucugcug

SEQ ID NO: 1062477 - RNA, 22 nt, Human
cccagcccacgguccugggugg

SEQ ID NO: 1062478 - RNA, 22 nt, Human
ucuauuuuauacucaaaucuuc

SEQ ID NO: 1062479 - RNA, 22 nt, Human
uuuguaaaggccugaauuucag

SEQ ID NO: 1062480 - RNA, 22 nt, Human
cauuuauucucagauccuuguc

SEQ ID NO: 1062481 - RNA, 22 nt, Human
ucuucaaagaauuuuaguaauu

SEQ ID NO: 1062482 - RNA, 22 nt, Human
cugggcuggauaauucuuugcu

SEQ ID NO: 1062483 - RNA, 22 nt, Human
aaauauacuagaugaugaccca

SEQ ID NO: 1062484 - RNA, 22 nt, Human
agcuuuggagacugacuccauc

SEQ ID NO: 1062485 - RNA, 22 nt, Human
gacauaauccuccucaccuacu

SEQ ID NO: 1062486 - RNA, 22 nt, Human
cagggccagcgcccaggcccag

SEQ ID NO: 1062487 - RNA, 22 nt, Human
ggcaggcuccguguuccauucc

SEQ ID NO: 1062488 - RNA, 22 nt, Human
uuuguuagagugugggaggcug

SEQ ID NO: 1062489 - RNA, 22 nt, Human
uucauacaaugggauauuauga

SEQ ID NO: 1062490 - RNA, 22 nt, Human
guucugggaagguggaccuguu

SEQ ID NO: 1062491 - RNA, 22 nt, Human
aacuuaaacccacucauguaga

SEQ ID NO: 1062492 - RNA, 22 nt, Human
augcuuuuccaggagaaauaua

SEQ ID NO: 1062493 - RNA, 23 nt, Human
uccugcagauaagcugguugaca

SEQ ID NO: 1062494 - RNA, 22 nt, Human
ccuggcagguagcauugaggag

SEQ ID NO: 1062495 - RNA, 22 nt, Human
caaugauugcuauuuacauaaa

SEQ ID NO: 1062496 - RNA, 22 nt, Human
cucccaagauaaauaaggcagu

SEQ ID NO: 1062497 - RNA, 22 nt, Human
uaauuucaccguugcuagaaau

SEQ ID NO: 1062498 - RNA, 22 nt, Human
guggccagccccauggacaguu

SEQ ID NO: 1062499 - RNA, 22 nt, Human
uccaggcuccccugcgugcucc

SEQ ID NO: 1062500 - RNA, 22 nt, Human
guguaugaacgaaagaauggau

SEQ ID NO: 1062501 - RNA, 22 nt, Human
cagcaaucgggugauaugcaau

SEQ ID NO: 1062502 - RNA, 22 nt, Human
cccugcagggaggauucugaag

SEQ ID NO: 1062503 - RNA, 22 nt, Human
auuucucaguuccuacuguuua

SEQ ID NO: 1062504 - RNA, 22 nt, Human
auuaaauuaaguggcuaauuua

SEQ ID NO: 1062505 - RNA, 22 nt, Human
ccacacagauaaguguuuucua

SEQ ID NO: 1062506 - RNA, 22 nt, Human
cuguccagucuuuagcaagcug

SEQ ID NO: 1062507 - RNA, 22 nt, Human
uccaggcaaagugcugggcugc

SEQ ID NO: 1062508 - RNA, 22 nt, Human
ugugaaaagcguguguucuagg

SEQ ID NO: 1062509 - RNA, 22 nt, Human
gccaggcauucuagaaguagug

SEQ ID NO: 1062510 - RNA, 22 nt, Human
gcacacaggcaguuuccagcca

SEQ ID NO: 1062511 - RNA, 22 nt, Human
ugaagccauaggacagaggaua

SEQ ID NO: 1062512 - RNA, 22 nt, Human
cacccaggcagguggcugagaa

SEQ ID NO: 1062513 - RNA, 22 nt, Human
uuaaauauuuucagcaggguca

SEQ ID NO: 1062514 - RNA, 22 nt, Human
cagcuugugcaaagguccuggg

SEQ ID NO: 1062515 - RNA, 22 nt, Human
uuccaggccgggcaggaaacac

SEQ ID NO: 1062516 - RNA, 22 nt, Human
agacaucaaugaucagagguag

SEQ ID NO: 1062517 - RNA, 22 nt, Human
cacuguccaugcuugcuaaccc

SEQ ID NO: 1062518 - RNA, 22 nt, Human
cuucuggguaauucuucuucau

SEQ ID NO: 1062519 - RNA, 22 nt, Human
gaauacauuggaaaucagaaua

SEQ ID NO: 1062520 - RNA, 22 nt, Human
ucuauaaauuaugcagucucag

SEQ ID NO: 1062521 - RNA, 22 nt, Human
ugcuucugcauucaauguugga

SEQ ID NO: 1062522 - RNA, 22 nt, Human
cuuccucccggcccaugcucug

SEQ ID NO: 1062523 - RNA, 22 nt, Human
cacauacuuguguguacauaug

SEQ ID NO: 1062524 - RNA, 20 nt, Human
cucuuaaauguaaaguaggc

SEQ ID NO: 1062525 - RNA, 22 nt, Human
cuggggacuugcagacacaauu

SEQ ID NO: 1062526 - RNA, 22 nt, Human
ugucauaacuuagugacaaauc

SEQ ID NO: 1062527 - RNA, 22 nt, Human
agggcacccucucugcaguacc

SEQ ID NO: 1062528 - RNA, 22 nt, Human
uccaggaggugaggggaccaaa

SEQ ID NO: 1062529 - RNA, 22 nt, Human
ggcaggcuccagagcccucucc

SEQ ID NO: 1062530 - RNA, 22 nt, Human
gagaaagaugaagaguggcguu

SEQ ID NO: 1062531 - RNA, 20 nt, Human
cugcuccacccggcucucag

SEQ ID NO: 1062532 - RNA, 22 nt, Human
ccaggcucugagaggaauguga

SEQ ID NO: 1062533 - RNA, 22 nt, Human
gcagggacaacugugcaccuga

SEQ ID NO: 1062534 - RNA, 22 nt, Human
ccagcuuucugggugguuucug

SEQ ID NO: 1062535 - RNA, 22 nt, Human
cccaggaguaagugacauuguu

SEQ ID NO: 1062536 - RNA, 22 nt, Human
aaaguucuggggguguuucugg

SEQ ID NO: 1062537 - RNA, 22 nt, Human
cuguacaaguccuucaucaggg

SEQ ID NO: 1062538 - RNA, 22 nt, Human
ugggacucacucuuuuggccag

SEQ ID NO: 1062539 - RNA, 20 nt, Human
uucugucagauuauauggga

SEQ ID NO: 1062540 - RNA, 22 nt, Human
ccucucagcgauuccucuugga

SEQ ID NO: 1062541 - RNA, 22 nt, Human
agagugaaaagcuagagcagua

SEQ ID NO: 1062542 - RNA, 22 nt, Human
auaaaguuuaaaagucaauagu

SEQ ID NO: 1062543 - RNA, 22 nt, Human
gcguccagggaaggcccagcug

SEQ ID NO: 1062544 - RNA, 22 nt, Human
acaguguucacuuaacaaugga

SEQ ID NO: 1062545 - RNA, 22 nt, Human
acagagagaggcccgaggcugc

SEQ ID NO: 1062546 - RNA, 22 nt, Human
agcaccaucacagcuguauguc

SEQ ID NO: 1062547 - RNA, 22 nt, Human
agauacaaaagauaagauuuag

SEQ ID NO: 1062548 - RNA, 22 nt, Human
gggacccagguaauccugugcu

SEQ ID NO: 1062549 - RNA, 22 nt, Human
gggcugcaaugcuucaguuguu

SEQ ID NO: 1062550 - RNA, 22 nt, Human
ggagucugcucccagacaugau

SEQ ID NO: 1062551 - RNA, 21 nt, Human
auucugucaucccagcuacuu

SEQ ID NO: 1062552 - RNA, 22 nt, Human
ugccugccucuggcagcccugc

SEQ ID NO: 1062553 - RNA, 22 nt, Human
gugggguagaucuuucucagga

SEQ ID NO: 1062554 - RNA, 22 nt, Human
aggcucccaagcacugacccca

SEQ ID NO: 1062555 - RNA, 20 nt, Human
augggcugguuaggaagugu

SEQ ID NO: 1062556 - RNA, 18 nt, Human
cucucuuuccacucuuug

SEQ ID NO: 1062557 - RNA, 22 nt, Human
aaggcucuggguuucauaggug

SEQ ID NO: 1062558 - RNA, 22 nt, Human
aguccagucucacucuuggcag

SEQ ID NO: 1062559 - RNA, 22 nt, Human
uuucacacugcagcaucagaga

SEQ ID NO: 1062560 - RNA, 22 nt, Human
ugcuucugcugauauuuuguga

SEQ ID NO: 1062561 - RNA, 22 nt, Human
agauauauuuaagguaauaagu

SEQ ID NO: 1062562 - RNA, 22 nt, Human
acaaacugaauggguuuucugu

SEQ ID NO: 1062563 - RNA, 22 nt, Human
gaggagcuguucccucaccucu

SEQ ID NO: 1062564 - RNA, 22 nt, Human
gugauaaaauucaaauagcucu

SEQ ID NO: 1062565 - RNA, 22 nt, Human
acacacagaaggaagccccacu

SEQ ID NO: 1062566 - RNA, 22 nt, Human
aagacauugucauuuuauaauu

SEQ ID NO: 1062567 - RNA, 22 nt, Human
uuguaauuugcaaauguauugu

SEQ ID NO: 1062568 - RNA, 22 nt, Human
agggcuccuaugccccauggac

SEQ ID NO: 1062569 - RNA, 22 nt, Human
acuggcaguagagggagcgcau

SEQ ID NO: 1062570 - RNA, 22 nt, Human
ggcugccacgucgaggguccaa

SEQ ID NO: 1062571 - RNA, 16 nt, Human
cuacccagugagaagg

SEQ ID NO: 1062572 - RNA, 15 nt, Human
ccaggcucugcacuc

SEQ ID NO: 1062573 - RNA, 20 nt, Human
agcauuugaaauaugacuau

SEQ ID NO: 1062574 - RNA, 22 nt, Human
acagcuuuguguuaaugggaag

SEQ ID NO: 1062575 - RNA, 22 nt, Human
auuauuaggacuacugggguug

SEQ ID NO: 1062576 - RNA, 22 nt, Human
aaugaucuacucucauuaucuc

SEQ ID NO: 1062577 - RNA, 22 nt, Human
acaggacaggcugggcuagacu

SEQ ID NO: 1062578 - RNA, 18 nt, Human
uguuuauuuuucucuuac

SEQ ID NO: 1062579 - RNA, 22 nt, Human
uuucuuagcgaugcuugauaaa

SEQ ID NO: 1062580 - RNA, 22 nt, Human
uuuuucaucugauugauaacuc

SEQ ID NO: 1062581 - RNA, 22 nt, Human
agcuuuaucacaauauuggcua

SEQ ID NO: 1062582 - RNA, 22 nt, Human
gcugggcugcgucggggaagcc

SEQ ID NO: 1062583 - RNA, 22 nt, Human
aagguuaaauagguauuuucca

SEQ ID NO: 1062584 - RNA, 22 nt, Human
auuuguuccacacauauuuacu

SEQ ID NO: 1062585 - RNA, 22 nt, Human
cagucacauagguauacacaua

SEQ ID NO: 1062586 - RNA, 22 nt, Human
cugcucuagagagcauuaguca

SEQ ID NO: 1062587 - RNA, 22 nt, Human
augacacuuggugauacuuugu

SEQ ID NO: 1062588 - RNA, 19 nt, Human
cccucuugcacaaagcaaa

SEQ ID NO: 1062589 - RNA, 22 nt, Human
cauaauuucacugucguauggc

SEQ ID NO: 1062590 - RNA, 22 nt, Human
accagugggaaguggaaaauga

SEQ ID NO: 1062591 - RNA, 18 nt, Human
cuccuggcugauggugag

SEQ ID NO: 1062592 - RNA, 22 nt, Human
auuauaaagaacaugugugugg

SEQ ID NO: 1062593 - RNA, 22 nt, Human
cccacacacauuuaugauagga

SEQ ID NO: 1062594 - RNA, 23 nt, Human
uguaugaauaugccacaguuuaa

SEQ ID NO: 1062595 - RNA, 22 nt, Human
guacacacuguuugaucauuuc

SEQ ID NO: 1062596 - RNA, 22 nt, Human
ccuggcagucaggggaguccuu

SEQ ID NO: 1062597 - RNA, 22 nt, Human
ucccaccccggucaagggcuga

SEQ ID NO: 1062598 - RNA, 22 nt, Human
uggcaguagauccagucucucu

SEQ ID NO: 1062599 - RNA, 22 nt, Human
auguuucaucaguaagguuuug

SEQ ID NO: 1062600 - RNA, 22 nt, Human
uguuuuucaaauauugcucugu

SEQ ID NO: 1062601 - RNA, 22 nt, Human
aaggccacacuugcuggccagc

SEQ ID NO: 1062602 - RNA, 22 nt, Human
cagcuuuauuaaugauugucuu

SEQ ID NO: 1062603 - RNA, 21 nt, Human
aggcucccagaaaugggcauc

SEQ ID NO: 1062604 - RNA, 22 nt, Human
cagagcaugaauaaaaguuaca

SEQ ID NO: 1062605 - RNA, 22 nt, Human
ucagagagguuggugauaagaa

SEQ ID NO: 1062606 - RNA, 17 nt, Human
gaauuucuuggucaaaa

SEQ ID NO: 1062607 - RNA, 22 nt, Human
uuggguaggagaaagaacagau

SEQ ID NO: 1062608 - RNA, 22 nt, Human
uagggacccucccugcucuaac

SEQ ID NO: 1062609 - RNA, 22 nt, Human
aauuagggaaaauuuacuugua

SEQ ID NO: 1062610 - RNA, 21 nt, Human
acagugugcuucucucccucc

SEQ ID NO: 1062611 - RNA, 22 nt, Human
gaacacauguccuccuuggauu

SEQ ID NO: 1062612 - RNA, 22 nt, Human
cugggcuucucccccuggcaga

SEQ ID NO: 1062613 - RNA, 22 nt, Human
uuuaccaguguuaaacaccagc

SEQ ID NO: 1062614 - RNA, 22 nt, Human
uaugucaaaguuaagaaauagg

SEQ ID NO: 1062615 - RNA, 22 nt, Human
gugcaggggccuccccuugcug

SEQ ID NO: 1062616 - RNA, 22 nt, Human
aaaguuugucacuuggcuagaa

SEQ ID NO: 1062617 - RNA, 22 nt, Human
auuaaaauuccaagguaugcca

SEQ ID NO: 1062618 - RNA, 22 nt, Human
ucucuuaauaaguaaauacuga

SEQ ID NO: 1062619 - RNA, 19 nt, Human
cuccaagugccaaggacag

SEQ ID NO: 1062620 - RNA, 22 nt, Human
aggaggcuuuugcaggugccac

SEQ ID NO: 1062621 - RNA, 22 nt, Human
ugcaggcugggaagagggacaa

SEQ ID NO: 1062622 - RNA, 21 nt, Human
ugggaccuagcuuugcacagg

SEQ ID NO: 1062623 - RNA, 19 nt, Human
gcaucagagcagaaggggu

SEQ ID NO: 1062624 - RNA, 22 nt, Human
cugcagagcagccaguccccca

SEQ ID NO: 1062625 - RNA, 22 nt, Human
ugaaacuuauaagaauaugaau

SEQ ID NO: 1062626 - RNA, 22 nt, Human
aagucguggcaggcuugcacga

SEQ ID NO: 1062627 - RNA, 22 nt, Human
uuagacauagaauauugucuag

SEQ ID NO: 1062628 - RNA, 22 nt, Human
ggcuccacccugcuuccagaag

SEQ ID NO: 1062629 - RNA, 22 nt, Human
aggaagaacagauaauggacgc

SEQ ID NO: 1062630 - RNA, 22 nt, Human
agagucagcuuaugacacaguc

SEQ ID NO: 1062631 - RNA, 22 nt, Human
aucuacauaaaacgaauacaua

SEQ ID NO: 1062632 - RNA, 22 nt, Human
ggcucccaggagggccuggagg

SEQ ID NO: 1062633 - RNA, 22 nt, Human
caguaaaagauggaaauagaau

SEQ ID NO: 1062634 - RNA, 22 nt, Human
uguaugaagccagaaucuguuu

SEQ ID NO: 1062635 - RNA, 22 nt, Human
cauacaagcguucaauagaugu

SEQ ID NO: 1062636 - RNA, 22 nt, Human
cugggccugucagggcuuuuug

SEQ ID NO: 1062637 - RNA, 22 nt, Human
ugcaggcuccacguuguugucc

SEQ ID NO: 1062638 - RNA, 22 nt, Human
ccaggcucaggugcgagagaca

SEQ ID NO: 1062639 - RNA, 19 nt, Human
gucuucugaauguggcugc

SEQ ID NO: 1062640 - RNA, 22 nt, Human
cauuuguaguuaaaaaugucuc

SEQ ID NO: 1062641 - RNA, 22 nt, Human
agacccucuccaugcccacugc

SEQ ID NO: 1062642 - RNA, 22 nt, Human
cccacacaaaucauggggagaa

SEQ ID NO: 1062643 - RNA, 22 nt, Human
ugguuccucaagcgcuggcggc

SEQ ID NO: 1062644 - RNA, 22 nt, Human
guacacacaaucucuggucagu

SEQ ID NO: 1062645 - RNA, 17 nt, Human
uuauuuuuugggcugag

SEQ ID NO: 1062646 - RNA, 22 nt, Human
gugcauuugugcaugcacaugu

SEQ ID NO: 1062647 - RNA, 22 nt, Human
agcuuuaugaggagaccuuagu

SEQ ID NO: 1062648 - RNA, 22 nt, Human
auuaaauuggaucugcauaguu

SEQ ID NO: 1062649 - RNA, 22 nt, Human
uagggcucuggugggcucuguu

SEQ ID NO: 1062650 - RNA, 22 nt, Human
cagcauuuaaugcagugcuucc

SEQ ID NO: 1062651 - RNA, 22 nt, Human
ggcaggguuuacaauagcaaua

SEQ ID NO: 1062652 - RNA, 22 nt, Human
uuucaaaugcaugucuuuccuc

SEQ ID NO: 1062653 - RNA, 22 nt, Human
caauuucuuguuaauucucagg

SEQ ID NO: 1062654 - RNA, 22 nt, Human
ugcagagaagaggacaguucua

SEQ ID NO: 1062655 - RNA, 22 nt, Human
uauauauucuuaaguaguguag

SEQ ID NO: 1062656 - RNA, 22 nt, Human
accugccuaucagcugccugcu

SEQ ID NO: 1062657 - RNA, 22 nt, Human
aguuauuucaguaacauaauag

SEQ ID NO: 1062658 - RNA, 22 nt, Human
ccagguccuguuuucaccacag

SEQ ID NO: 1062659 - RNA, 22 nt, Human
ggggaccuucccagagcaguug

SEQ ID NO: 1062660 - RNA, 22 nt, Human
ucaggcucuacacuugacacac

SEQ ID NO: 1062661 - RNA, 22 nt, Human
acugggcuuaugcuguggagua

SEQ ID NO: 1062662 - RNA, 22 nt, Human
aauuagggaaguauuuaguagu

SEQ ID NO: 1062663 - RNA, 22 nt, Human
ugcuucuggcagauugagugag

SEQ ID NO: 1062664 - RNA, 22 nt, Human
ccugccuguacuagagacccag

SEQ ID NO: 1062665 - RNA, 22 nt, Human
cuauuaggcuuccauuucaugc

SEQ ID NO: 1062666 - RNA, 22 nt, Human
agcccagcuuugaaccauauca

SEQ ID NO: 1062667 - RNA, 22 nt, Human
ugcuagaauuagguuaaacaaa

SEQ ID NO: 1062668 - RNA, 22 nt, Human
gcaggugaugugaugugagcau

SEQ ID NO: 1062669 - RNA, 22 nt, Human
auauucuuccaaaacaucauuu

SEQ ID NO: 1062670 - RNA, 22 nt, Human
guagggacuguucucaccugag

SEQ ID NO: 1062671 - RNA, 22 nt, Human
guuaauuugcagcuuucgagcu

SEQ ID NO: 1062672 - RNA, 21 nt, Human
acauacauaccuuaccaccuu

SEQ ID NO: 1062673 - RNA, 22 nt, Human
gccaagcucaccuucugaugga

SEQ ID NO: 1062674 - RNA, 22 nt, Human
uagggcucagagaaguggggcc

SEQ ID NO: 1062675 - RNA, 22 nt, Human
cugggcuuucaggcccuaaggc

SEQ ID NO: 1062676 - RNA, 22 nt, Human
gggcugacuccuauuggaugaa

SEQ ID NO: 1062677 - RNA, 22 nt, Human
cugcuuuagacaacugcuggga

SEQ ID NO: 1062678 - RNA, 22 nt, Human
aacacagaucaaaauauuuccu

SEQ ID NO: 1062679 - RNA, 22 nt, Human
auggcagaccuccuggccacaa

SEQ ID NO: 1062680 - RNA, 22 nt, Human
uaugaacuuuugaugugacaug

SEQ ID NO: 1062681 - RNA, 22 nt, Human
cagugaggaguccagggcagag

SEQ ID NO: 1062682 - RNA, 22 nt, Human
uucacaauaggagcaugcaaau

SEQ ID NO: 1062683 - RNA, 22 nt, Human
ccaggcucacagcaucccagga

SEQ ID NO: 1062684 - RNA, 22 nt, Human
agggcuacugccugccuucagg

SEQ ID NO: 1062685 - RNA, 22 nt, Human
uuaaagaugcagcuuuagagaa

SEQ ID NO: 1062686 - RNA, 22 nt, Human
cagguggguguaugaaugcaaa

SEQ ID NO: 1062687 - RNA, 22 nt, Human
acauuucucuugaugucucuau

SEQ ID NO: 1062688 - RNA, 22 nt, Human
gggcugacaaucucuuuacuua

SEQ ID NO: 1062689 - RNA, 22 nt, Human
aaugaagcaguuuucaucaagu

SEQ ID NO: 1062690 - RNA, 22 nt, Human
gagccagguuugaaucucaguc

SEQ ID NO: 1062691 - RNA, 22 nt, Human
uccugagcugccgcaucagcag

SEQ ID NO: 1062692 - RNA, 22 nt, Human
uucugucagcgucagaaauucu

SEQ ID NO: 1062693 - RNA, 22 nt, Human
uugggaucucaaauccagcuau

SEQ ID NO: 1062694 - RNA, 22 nt, Human
cagggcucuucaucacacagua

SEQ ID NO: 1062695 - RNA, 22 nt, Human
cugggcugagccugggcugugu

SEQ ID NO: 1062696 - RNA, 19 nt, Human
gggaccugacuaauuggca

SEQ ID NO: 1062697 - RNA, 22 nt, Human
cuuugaaaggaagccacacagc

SEQ ID NO: 1062698 - RNA, 22 nt, Human
auaaacaguaaaugugagcagu

SEQ ID NO: 1062699 - RNA, 22 nt, Human
auugacuuccauagcuaccugg

SEQ ID NO: 1062700 - RNA, 22 nt, Human
agucuacaaucuuaaaugaacu

SEQ ID NO: 1062701 - RNA, 22 nt, Human
uagggcucagaguccaguuucu

SEQ ID NO: 1062702 - RNA, 22 nt, Human
caggucccugcgccccggccuc

SEQ ID NO: 1062703 - RNA, 21 nt, Human
uauuugcugccaucuuugagg

SEQ ID NO: 1062704 - RNA, 22 nt, Human
aagggcuccauccuuauaaaug

SEQ ID NO: 1062705 - RNA, 21 nt, Human
uggccaaacuggagcauuuga

SEQ ID NO: 1062706 - RNA, 19 nt, Human
uuaugaaggcuggggggag

SEQ ID NO: 1062707 - RNA, 22 nt, Human
aggaccuguguuuuccuugaau

SEQ ID NO: 1062708 - RNA, 22 nt, Human
acuggggaauggaacugggaau

SEQ ID NO: 1062709 - RNA, 21 nt, Human
acaggcucacgauccauuucu

SEQ ID NO: 1062710 - RNA, 22 nt, Human
gaggagcugggacccugucauc

SEQ ID NO: 1062711 - RNA, 22 nt, Human
cccaggccuggucugggccagu

SEQ ID NO: 1062712 - RNA, 22 nt, Human
uaaaauagcaugugcagugaaa

SEQ ID NO: 1062713 - RNA, 22 nt, Human
gaggcugcggggaggagccugc

SEQ ID NO: 1062714 - RNA, 22 nt, Human
ccacccagcagaggaggcaaga

SEQ ID NO: 1062715 - RNA, 22 nt, Human
uaguuaggaauagcagcgacuc

SEQ ID NO: 1062716 - RNA, 22 nt, Human
ucuuugaaguugaaguaguugg

SEQ ID NO: 1062717 - RNA, 22 nt, Human
agcuagaauauugaucugaaau

SEQ ID NO: 1062718 - RNA, 22 nt, Human
gaaaacuauuggccuagaacaa

SEQ ID NO: 1062719 - RNA, 22 nt, Human
gccugcagccccucugcaguag

SEQ ID NO: 1062720 - RNA, 22 nt, Human
caggcagcugcgacaagagagc

SEQ ID NO: 1062721 - RNA, 22 nt, Human
guguuuuaucagacaaaguaua

SEQ ID NO: 1062722 - RNA, 22 nt, Human
uguuucaggaccuaucuuuuag

SEQ ID NO: 1062723 - RNA, 22 nt, Human
cuuagggaauugggaggaugcc

SEQ ID NO: 1062724 - RNA, 22 nt, Human
ccugaggggcugcaggccagcu

SEQ ID NO: 1062725 - RNA, 22 nt, Human
cacauaauaaauguuccugaug

SEQ ID NO: 1062726 - RNA, 22 nt, Human
cagaguuuugugaacaacuugg

SEQ ID NO: 1062727 - RNA, 22 nt, Human
ugagagucuguuccucuugcag

SEQ ID NO: 1062728 - RNA, 22 nt, Human
aauauuucuguagcuauguucu

SEQ ID NO: 1062729 - RNA, 22 nt, Human
agcccaggucuggcccagccug

SEQ ID NO: 1062730 - RNA, 22 nt, Human
ccacacugucuaacaaggcaua

SEQ ID NO: 1062731 - RNA, 22 nt, Human
ccuggcagcuccuccccggcgg

SEQ ID NO: 1062732 - RNA, 22 nt, Human
ucaccagggcuccagccagccu

SEQ ID NO: 1062733 - RNA, 22 nt, Human
cugcagggaugugaggcccguu

SEQ ID NO: 1062734 - RNA, 22 nt, Human
acccagcuguuucccgugucau

SEQ ID NO: 1062735 - RNA, 22 nt, Human
gagggcuccauuccccgugccc

SEQ ID NO: 1062736 - RNA, 22 nt, Human
uacauaugaacuuuauaacuug

SEQ ID NO: 1062737 - RNA, 22 nt, Human
gcagcuuuggagguggaacucu

SEQ ID NO: 1062738 - RNA, 22 nt, Human
cguguggucccggcaaggcaag

SEQ ID NO: 1062739 - RNA, 22 nt, Human
aaaguaguuagucaugugaaaa

SEQ ID NO: 1062740 - RNA, 22 nt, Human
ggccagggggcuucagacucca

SEQ ID NO: 1062741 - RNA, 22 nt, Human
gaacacauuucucugacuguag

SEQ ID NO: 1062742 - RNA, 22 nt, Human
auucacagaauaguuuuaccag

SEQ ID NO: 1062743 - RNA, 22 nt, Human
ucaugaacaucucaaauaacca

SEQ ID NO: 1062744 - RNA, 22 nt, Human
gcagggaccuugcccacccucc

SEQ ID NO: 1062745 - RNA, 22 nt, Human
uccaggcaaagggacuagcagg

SEQ ID NO: 1062746 - RNA, 20 nt, Human
agacccucuggacugggccc

SEQ ID NO: 1062747 - RNA, 22 nt, Human
aaacaugcauucaagaaaaucu

SEQ ID NO: 1062748 - RNA, 22 nt, Human
uuggcaggaggcuucaguuccu

SEQ ID NO: 1062749 - RNA, 22 nt, Human
acauacacaugaauauauuuuu

SEQ ID NO: 1062750 - RNA, 22 nt, Human
uuccagagaaaagguuuauuuc

SEQ ID NO: 1062751 - RNA, 22 nt, Human
uauuaaauuauggauuuaggag

SEQ ID NO: 1062752 - RNA, 22 nt, Human
ugcagggauuguuggcauccau

SEQ ID NO: 1062753 - RNA, 22 nt, Human
aguuagaauauaauuauguuaa

SEQ ID NO: 1062754 - RNA, 22 nt, Human
agggaccucauguaaguggauu

SEQ ID NO: 1062755 - RNA, 22 nt, Human
uuuauuagauuaucaaagaggu

SEQ ID NO: 1062756 - RNA, 23 nt, Human
ucugggcugagacuuggaagguc

SEQ ID NO: 1062757 - RNA, 22 nt, Human
cucugggcugccuuuuagcucu

SEQ ID NO: 1062758 - RNA, 22 nt, Human
cccaggcagugcugaucccuca

SEQ ID NO: 1062759 - RNA, 22 nt, Human
acauccagaucucagcauggcu

SEQ ID NO: 1062760 - RNA, 22 nt, Human
aauauguuccacuuaaagcugg

SEQ ID NO: 1062761 - RNA, 22 nt, Human
uuaaauuuuagaaacagacucu

SEQ ID NO: 1062762 - RNA, 22 nt, Human
ugugaaaagcaggcuacuuucu

SEQ ID NO: 1062763 - RNA, 23 nt, Human
auguuauuauuagcagucuugcc

SEQ ID NO: 1062764 - RNA, 22 nt, Human
agguggcucugacagcucuggu

SEQ ID NO: 1062765 - RNA, 22 nt, Human
aggacuuagaacauuauguacu

SEQ ID NO: 1062766 - RNA, 22 nt, Human
cccacacucugagaaaugcuga

SEQ ID NO: 1062767 - RNA, 22 nt, Human
gcacccagaggucagcagugcu

SEQ ID NO: 1062768 - RNA, 22 nt, Human
agcuuuaucuucaccugggaau

SEQ ID NO: 1062769 - RNA, 22 nt, Human
guccaagucuuccuucccaaac

SEQ ID NO: 1062770 - RNA, 22 nt, Human
ccugggcucaccaugccuugga

SEQ ID NO: 1062771 - RNA, 22 nt, Human
guccacagagggcugggcaggc

SEQ ID NO: 1062772 - RNA, 22 nt, Human
acucacuuuccauucaagcacc

SEQ ID NO: 1062773 - RNA, 22 nt, Human
uaauuucuucaucucugcagcu

SEQ ID NO: 1062774 - RNA, 19 nt, Human
uccugcagaccagaccugu

SEQ ID NO: 1062775 - RNA, 22 nt, Human
uccaggcagggcagccaucaag

SEQ ID NO: 1062776 - RNA, 22 nt, Human
acagcuuuguuuucccugcuga

SEQ ID NO: 1062777 - RNA, 22 nt, Human
ugauugacuuuagaauagcacu

SEQ ID NO: 1062778 - RNA, 22 nt, Human
ggcaggcuuucagcaucaaguc

SEQ ID NO: 1062779 - RNA, 22 nt, Human
acaggccuuggcaggcauguga

SEQ ID NO: 1062780 - RNA, 22 nt, Human
uuucacaagacagcuacuguug

SEQ ID NO: 1062781 - RNA, 22 nt, Human
uggcaugggcaaaccagggaaa

SEQ ID NO: 1062782 - RNA, 22 nt, Human
cagggcuagugacaccccaguc

SEQ ID NO: 1062783 - RNA, 20 nt, Human
gauuacaaaaugaaaugcau

SEQ ID NO: 1062784 - RNA, 22 nt, Human
uacccagcaaucccuagagguu

SEQ ID NO: 1062785 - RNA, 22 nt, Human
gaugaagcuauuugguuggcac

SEQ ID NO: 1062786 - RNA, 18 nt, Human
ucagagagcagcuuuauu

SEQ ID NO: 1062787 - RNA, 23 nt, Human
aguaugaauucauuguuuuaguu

SEQ ID NO: 1062788 - RNA, 22 nt, Human
augauugcagcccuacagcugu

SEQ ID NO: 1062789 - RNA, 22 nt, Human
gaggcugcuuugaugacaggag

SEQ ID NO: 1062790 - RNA, 22 nt, Human
cugcagggaccacaagcagguu

SEQ ID NO: 1062791 - RNA, 21 nt, Human
uaaauaauaaguugcugagau

SEQ ID NO: 1062792 - RNA, 22 nt, Human
agaggcuuggccucaguucugu

SEQ ID NO: 1062793 - RNA, 18 nt, Human
gggcucacacaggucauc

SEQ ID NO: 1062794 - RNA, 22 nt, Human
uugggcucaggaguuugagacc

SEQ ID NO: 1062795 - RNA, 22 nt, Human
aagggcuccacuugaaucacac

SEQ ID NO: 1062796 - RNA, 19 nt, Human
agaaucaggucaggugaca

SEQ ID NO: 1062797 - RNA, 21 nt, Human
aauuagggugccucuuauaau

SEQ ID NO: 1062798 - RNA, 22 nt, Human
auuuggcaacauuaauugaauc

SEQ ID NO: 1062799 - RNA, 22 nt, Human
uuuaaauuuagaagaaacacug

SEQ ID NO: 1062800 - RNA, 22 nt, Human
uggaacacagugauugauagcg

SEQ ID NO: 1062801 - RNA, 22 nt, Human
auucucaauggcuacuuucaua

SEQ ID NO: 1062802 - RNA, 22 nt, Human
ugcaguggaaagacucagacuu

SEQ ID NO: 1062803 - RNA, 22 nt, Human
gaagagaaaggcaaggaguuuu

SEQ ID NO: 1062804 - RNA, 22 nt, Human
cagcuuugugcaaugcagucuc

SEQ ID NO: 1062805 - RNA, 22 nt, Human
gacccaggguauccagagcugc

SEQ ID NO: 1062806 - RNA, 22 nt, Human
gccuggcacaggaauuaggagg

SEQ ID NO: 1062807 - RNA, 22 nt, Human
cacccagccuucacacaggagu

SEQ ID NO: 1062808 - RNA, 20 nt, Human
ccagagaguagguuagugau

SEQ ID NO: 1062809 - RNA, 22 nt, Human
cacucugaugguuucuguucaa

SEQ ID NO: 1062810 - RNA, 22 nt, Human
gacauaauaaucugaccuagau

SEQ ID NO: 1062811 - RNA, 22 nt, Human
gcacauacccacugucaagcac

SEQ ID NO: 1062812 - RNA, 22 nt, Human
ucagcucuguuuugaguggaac

SEQ ID NO: 1062813 - RNA, 22 nt, Human
auguagaaaguucauagaugcg

SEQ ID NO: 1062814 - RNA, 22 nt, Human
uccugcagagacagaggccuca

SEQ ID NO: 1062815 - RNA, 22 nt, Human
cauaauuucuguaucagcacca

SEQ ID NO: 1062816 - RNA, 22 nt, Human
augaacuuauuucugaacuuuu

SEQ ID NO: 1062817 - RNA, 22 nt, Human
ccagcuuuggaguguuguugcu

SEQ ID NO: 1062818 - RNA, 22 nt, Human
ucccaggccauaaaacucagag

SEQ ID NO: 1062819 - RNA, 17 nt, Human
ugcaggcuguuauagcc

SEQ ID NO: 1062820 - RNA, 18 nt, Human
uuucacaaccuccagagg

SEQ ID NO: 1062821 - RNA, 22 nt, Human
cauucacaaagcugauugaugg

SEQ ID NO: 1062822 - RNA, 22 nt, Human
cuucauuaaugucuauaaguuu

SEQ ID NO: 1062823 - RNA, 22 nt, Human
auacacauauguguguauaugu

SEQ ID NO: 1062824 - RNA, 22 nt, Human
ccaggccucccuuuuccagcca

SEQ ID NO: 1062825 - RNA, 17 nt, Human
acaggccugcuugcacu

SEQ ID NO: 1062826 - RNA, 22 nt, Human
agcaggcuaagggaccuguuua

SEQ ID NO: 1062827 - RNA, 22 nt, Human
gaggcacauauauacagagccc

SEQ ID NO: 1062828 - RNA, 22 nt, Human
gcccaggcuggagugcaguagc

SEQ ID NO: 1062829 - RNA, 22 nt, Human
cucuccaggacuuuggcccaau

SEQ ID NO: 1062830 - RNA, 22 nt, Human
gaaaacacuuugaucugaaagu

SEQ ID NO: 1062831 - RNA, 22 nt, Human
cccagcuugucugauucagccu

SEQ ID NO: 1062832 - RNA, 18 nt, Human
ggcaggcucucuggguca

SEQ ID NO: 1062833 - RNA, 22 nt, Human
guugggaagcagauggaugagc

SEQ ID NO: 1062834 - RNA, 22 nt, Human
ggcuucugagugcucugcuguu

SEQ ID NO: 1062835 - RNA, 22 nt, Human
uacacagauaugugaucaauca

SEQ ID NO: 1062836 - RNA, 22 nt, Human
auccacagucuuagccaucaaa

SEQ ID NO: 1062837 - RNA, 16 nt, Human
cagcuuuaugucagug

SEQ ID NO: 1062838 - RNA, 22 nt, Human
ugguccuggaagguccugaggg

SEQ ID NO: 1062839 - RNA, 22 nt, Human
ugggaccucucuugagagagca

SEQ ID NO: 1062840 - RNA, 21 nt, Human
uguguuuuaaugauauucugu

SEQ ID NO: 1062841 - RNA, 22 nt, Human
aauguauguguauaucaaauca

SEQ ID NO: 1062842 - RNA, 22 nt, Human
ucuuuauuuaagucuguuguaa

SEQ ID NO: 1062843 - RNA, 22 nt, Human
cuccagugagcgcggggcaugg

SEQ ID NO: 1062844 - RNA, 22 nt, Human
uuuugagauggugucucgcucc

SEQ ID NO: 1062845 - RNA, 22 nt, Human
gaggcucugugaugugccaggc

SEQ ID NO: 1062846 - RNA, 22 nt, Human
uuuucauuguuccucgagcauu

SEQ ID NO: 1062847 - RNA, 22 nt, Human
gcagggacgcagcacucuccgu

SEQ ID NO: 1062848 - RNA, 20 nt, Human
aaaggaauauaugaaguaua

SEQ ID NO: 1062849 - RNA, 21 nt, Human
uccacccucucugcucccagu

SEQ ID NO: 1062850 - RNA, 22 nt, Human
ugggaccugcuccuggaaugag

SEQ ID NO: 1062851 - RNA, 22 nt, Human
cuggcagguuuggugucuggug

SEQ ID NO: 1062852 - RNA, 22 nt, Human
uuaauuuucucaucugugaaau

SEQ ID NO: 1062853 - RNA, 22 nt, Human
augggcugggaucugaguguca

SEQ ID NO: 1062854 - RNA, 22 nt, Human
aagagcaucaaugacucgcagu

SEQ ID NO: 1062855 - RNA, 22 nt, Human
acugagagucaagauagcaugg

SEQ ID NO: 1062856 - RNA, 22 nt, Human
aauguaugggugagaaaguuga

SEQ ID NO: 1062857 - RNA, 22 nt, Human
acaugauauuaaugucuuauuu

SEQ ID NO: 1062858 - RNA, 22 nt, Human
agcaggcuugguccccagccuc

SEQ ID NO: 1062859 - RNA, 22 nt, Human
cuaggaaucaccaagauucuag

SEQ ID NO: 1062860 - RNA, 22 nt, Human
acauuuagcuguacaaucuaug

SEQ ID NO: 1062861 - RNA, 22 nt, Human
acccaggguagaaccucagagc

SEQ ID NO: 1062862 - RNA, 21 nt, Human
cccuugccugcacuccucggc

SEQ ID NO: 1062863 - RNA, 22 nt, Human
auuccacagcuacaucaaucua

SEQ ID NO: 1062864 - RNA, 22 nt, Human
acaguaaaaagccuuagaauuu

SEQ ID NO: 1062865 - RNA, 22 nt, Human
ucagcuuugggggucucaggag

SEQ ID NO: 1062866 - RNA, 23 nt, Human
acugggcugaaauuuuucauggc

SEQ ID NO: 1062867 - RNA, 22 nt, Human
ucuggcagagauauccauccca

SEQ ID NO: 1062868 - RNA, 22 nt, Human
uuccuggcucacagcagugggg

SEQ ID NO: 1062869 - RNA, 22 nt, Human
ucagccucagguguucagauuu

SEQ ID NO: 1062870 - RNA, 22 nt, Human
auuauuagacuuauaugguagu

SEQ ID NO: 1062871 - RNA, 22 nt, Human
ccugggcucugaggagggaguc

SEQ ID NO: 1062872 - RNA, 22 nt, Human
gguuccuucugaggucccugua

SEQ ID NO: 1062873 - RNA, 22 nt, Human
cagggcucccuugcaaggaggg

SEQ ID NO: 1062874 - RNA, 22 nt, Human
acaguguguucugggaccucca

SEQ ID NO: 1062875 - RNA, 22 nt, Human
gugauaaagacgugucauaauu

SEQ ID NO: 1062876 - RNA, 22 nt, Human
gagcauuugguuauaguaauuu

SEQ ID NO: 1062877 - RNA, 22 nt, Human
ugauucacagacuucacaaggc

SEQ ID NO: 1062878 - RNA, 22 nt, Human
uguccaggucagcagcagggac

SEQ ID NO: 1062879 - RNA, 22 nt, Human
guccuggcccaggaguacacau

SEQ ID NO: 1062880 - RNA, 22 nt, Human
aaauuucuguuguuuugagcca

SEQ ID NO: 1062881 - RNA, 22 nt, Human
gacuacucaaacuuucucuaua

SEQ ID NO: 1062882 - RNA, 20 nt, Human
cauauauaccuagaagugga

SEQ ID NO: 1062883 - RNA, 22 nt, Human
ucacacaugaguaaauacaggg

SEQ ID NO: 1062884 - RNA, 20 nt, Human
uccugcaguuccuaggaggg

SEQ ID NO: 1062885 - RNA, 22 nt, Human
aaacagauaaugcuauaaaugg

SEQ ID NO: 1062886 - RNA, 22 nt, Human
cucucuccuuagcugcagacca

SEQ ID NO: 1062887 - RNA, 22 nt, Human
aacacauauuuauauaugcaca

SEQ ID NO: 1062888 - RNA, 22 nt, Human
aaccccgcucaggcugggugag

SEQ ID NO: 1062889 - RNA, 22 nt, Human
cccagcuugcccaggacugagg

SEQ ID NO: 1062890 - RNA, 22 nt, Human
gagacagaguuucacucuuguu

SEQ ID NO: 1062891 - RNA, 22 nt, Human
uaccugcacagccagccaugug

SEQ ID NO: 1062892 - RNA, 22 nt, Human
agcaggcugggcaauaugggca

SEQ ID NO: 1062893 - RNA, 22 nt, Human
uggucucugcaggccaggcuca

SEQ ID NO: 1062894 - RNA, 21 nt, Human
uccaagcucaacucccuuccu

SEQ ID NO: 1062895 - RNA, 22 nt, Human
cagagcagggguuucccagguu

SEQ ID NO: 1062896 - RNA, 22 nt, Human
ggcaggcuugauauggggggac

SEQ ID NO: 1062897 - RNA, 22 nt, Human
gcaggcucaaaagcugguagga

SEQ ID NO: 1062898 - RNA, 22 nt, Human
uugggaagaaacauguccauca

SEQ ID NO: 1062899 - RNA, 22 nt, Human
cacaccagagguuaccugcaaa

SEQ ID NO: 1062900 - RNA, 22 nt, Human
ucaaaguuacuugugguuuucu

SEQ ID NO: 1062901 - RNA, 21 nt, Human
ccaggcuccugaggcugguca

SEQ ID NO: 1062902 - RNA, 22 nt, Human
uacaauauguggccuuuuguga

SEQ ID NO: 1062903 - RNA, 22 nt, Human
cuuauuagugucugucugaguu

SEQ ID NO: 1062904 - RNA, 22 nt, Human
acuuuacaagcuuauagccuag

SEQ ID NO: 1062905 - RNA, 22 nt, Human
caccuaggguuucgccuuucuu

SEQ ID NO: 1062906 - RNA, 22 nt, Human
agcucugacugaagagaugcaa

SEQ ID NO: 1062907 - RNA, 22 nt, Human
aaacauuguaauuuuagcaugg

SEQ ID NO: 1062908 - RNA, 22 nt, Human
cauuuauugguuaggccagcag

SEQ ID NO: 1062909 - RNA, 22 nt, Human
acuccaggcaucugcuucugcu

SEQ ID NO: 1062910 - RNA, 22 nt, Human
gcagggaccucacuacccccag

SEQ ID NO: 1062911 - RNA, 20 nt, Human
cccugcagccaugggagugg

SEQ ID NO: 1062912 - RNA, 22 nt, Human
uuauuacacugaaagaauugcg

SEQ ID NO: 1062913 - RNA, 22 nt, Human
uacccagggcuuuucugaugca

SEQ ID NO: 1062914 - RNA, 22 nt, Human
uguggggaagaguaugacuugg

SEQ ID NO: 1062915 - RNA, 22 nt, Human
aauacauauggaauuccauguu

SEQ ID NO: 1062916 - RNA, 23 nt, Human
uccuuccuuugagaggcuccauc

SEQ ID NO: 1062917 - RNA, 22 nt, Human
uggcagagagagugcagucgac

SEQ ID NO: 1062918 - RNA, 22 nt, Human
cuagggacagaaagaggguaga

SEQ ID NO: 1062919 - RNA, 22 nt, Human
accaggcaguauggugcugcaa

SEQ ID NO: 1062920 - RNA, 22 nt, Human
cccacacacuggcugcugccaa

SEQ ID NO: 1062921 - RNA, 22 nt, Human
aucugcuugaguuugaagucag

SEQ ID NO: 1062922 - RNA, 22 nt, Human
ucagcuuucucagaggccuaac

SEQ ID NO: 1062923 - RNA, 20 nt, Human
gcaaaauaggcucuguuggu

SEQ ID NO: 1062924 - RNA, 22 nt, Human
gccuggcaauggccucaggaag

SEQ ID NO: 1062925 - RNA, 22 nt, Human
gccaagcuuauaugaugcuuga

SEQ ID NO: 1062926 - RNA, 22 nt, Human
agcaguccaacugagguggcau

SEQ ID NO: 1062927 - RNA, 22 nt, Human
uucacauugugcagauuauggu

SEQ ID NO: 1062928 - RNA, 22 nt, Human
ccagagagggcgccaccuggag

SEQ ID NO: 1062929 - RNA, 22 nt, Human
caguauagaaaguuuuaaauug

SEQ ID NO: 1062930 - RNA, 22 nt, Human
auuucucacucacaguccaugu

SEQ ID NO: 1062931 - RNA, 22 nt, Human
cccagccuuugcuuccugguuc

SEQ ID NO: 1062932 - RNA, 18 nt, Human
uguagagccagguuugcc

SEQ ID NO: 1062933 - RNA, 22 nt, Human
ugccagccagggaagcucaccc

SEQ ID NO: 1062934 - RNA, 22 nt, Human
auauauuugagaauauucauga

SEQ ID NO: 1062935 - RNA, 22 nt, Human
ccauucauacaauuuuguucua

SEQ ID NO: 1062936 - RNA, 22 nt, Human
ccaggccuagccccugagggua

SEQ ID NO: 1062937 - RNA, 22 nt, Human
uuaacacagggggagacaaagu

SEQ ID NO: 1062938 - RNA, 22 nt, Human
ggccucagggucacucuguaga

SEQ ID NO: 1062939 - RNA, 22 nt, Human
uagggaccuuagaauuguaugu

SEQ ID NO: 1062940 - RNA, 20 nt, Human
ucagagagagggugccacuu

SEQ ID NO: 1062941 - RNA, 22 nt, Human
acauacuuaugcuaaaaauaua

SEQ ID NO: 1062942 - RNA, 22 nt, Human
ugcuucuguuuguuucugucau

SEQ ID NO: 1062943 - RNA, 22 nt, Human
ggggcuccagucuucacauuuu

SEQ ID NO: 1062944 - RNA, 22 nt, Human
gcacauacugcaaagauuacua

SEQ ID NO: 1062945 - RNA, 22 nt, Human
acccagccuacaaagcucaccu

SEQ ID NO: 1062946 - RNA, 22 nt, Human
aguccagugucaaggugccauu

SEQ ID NO: 1062947 - RNA, 22 nt, Human
cgcaggcucgguucacagagca

SEQ ID NO: 1062948 - RNA, 22 nt, Human
cacacaucuuaucccaguuauu

SEQ ID NO: 1062949 - RNA, 22 nt, Human
gcacccagggacuuggcuggcc

SEQ ID NO: 1062950 - RNA, 22 nt, Human
gagggcucugucuggaagggaa

SEQ ID NO: 1062951 - RNA, 20 nt, Human
ucacuguaauugccuacauu

SEQ ID NO: 1062952 - RNA, 22 nt, Human
agaggccugugugcuccagugg

SEQ ID NO: 1062953 - RNA, 22 nt, Human
uccaggcauguugggaagauga

SEQ ID NO: 1062954 - RNA, 22 nt, Human
ccaggccuucugaggacacucu

SEQ ID NO: 1062955 - RNA, 22 nt, Human
ucauuacaguguuuauaugucu

SEQ ID NO: 1062956 - RNA, 20 nt, Human
ccugggcucaaagcauccuc

SEQ ID NO: 1062957 - RNA, 22 nt, Human
ucagcuuugccaccagcuguaa

SEQ ID NO: 1062958 - RNA, 22 nt, Human
gaugaagcuaaaucuaagguuu

SEQ ID NO: 1062959 - RNA, 22 nt, Human
guccucugcuucaugcccugau

SEQ ID NO: 1062960 - RNA, 21 nt, Human
uaugaacaugaccaauagucc

SEQ ID NO: 1062961 - RNA, 22 nt, Human
agccaccuucuccaaggccuag

SEQ ID NO: 1062962 - RNA, 22 nt, Human
agcaggcuuacuuucugauuag

SEQ ID NO: 1062963 - RNA, 19 nt, Human
uccaggaggcugccauuga

SEQ ID NO: 1062964 - RNA, 22 nt, Human
cuguaugaaauuaaguaaacag

SEQ ID NO: 1062965 - RNA, 22 nt, Human
aauguuguuuuucugcaugucu

SEQ ID NO: 1062966 - RNA, 22 nt, Human
aaacaugagcauuucuguuuaa

SEQ ID NO: 1062967 - RNA, 20 nt, Human
ucuguacacucaucuucugc

SEQ ID NO: 1062968 - RNA, 22 nt, Human
uacccagcuucaagucaggacu

SEQ ID NO: 1062969 - RNA, 22 nt, Human
aauuugauuuucuuaaaccaua

SEQ ID NO: 1062970 - RNA, 22 nt, Human
uacauucccccaauuaccaaug

SEQ ID NO: 1062971 - RNA, 22 nt, Human
uucagagauggaaggcagaaug

SEQ ID NO: 1062972 - RNA, 22 nt, Human
auaaucuuucuuuuccagauag

SEQ ID NO: 1062973 - RNA, 20 nt, Human
ucccaaggaugccugggugu

SEQ ID NO: 1062974 - RNA, 22 nt, Human
ugaaauuaugcauuguuguacc

SEQ ID NO: 1062975 - RNA, 22 nt, Human
ccaggcucuaucccuccuucuu

SEQ ID NO: 1062976 - RNA, 22 nt, Human
cuaugagaagaaaacaagauua

SEQ ID NO: 1062977 - RNA, 22 nt, Human
uacuuuuagccuauuugauucu

SEQ ID NO: 1062978 - RNA, 22 nt, Human
ugaaauaucauuuucaucuccc

SEQ ID NO: 1062979 - RNA, 22 nt, Human
gagacacacauucuggagagaa

SEQ ID NO: 1062980 - RNA, 18 nt, Human
ucuaggagaguaccuacc

SEQ ID NO: 1062981 - RNA, 22 nt, Human
auacacacugcuauccuuuuuu

SEQ ID NO: 1062982 - RNA, 22 nt, Human
agugccccaugggugccugggg

SEQ ID NO: 1062983 - RNA, 22 nt, Human
gcacacugcggugaugugaguc

SEQ ID NO: 1062984 - RNA, 22 nt, Human
agcuuuauucaugauuucaggg

SEQ ID NO: 1062985 - RNA, 22 nt, Human
ggcuuuauuuugcaugaaugcu

SEQ ID NO: 1062986 - RNA, 22 nt, Human
ucccacacuugaaacaaggcug

SEQ ID NO: 1062987 - RNA, 22 nt, Human
ggaaacugcuuacacuagaggg

SEQ ID NO: 1062988 - RNA, 22 nt, Human
uccaggagaggccugaccaggu

SEQ ID NO: 1062989 - RNA, 22 nt, Human
cccugcagagggaugggggcag

SEQ ID NO: 1062990 - RNA, 22 nt, Human
aggcaguggagcuggaauaggc

SEQ ID NO: 1062991 - RNA, 22 nt, Human
aaucuuagguuuggcuucaucu

SEQ ID NO: 1062992 - RNA, 22 nt, Human
uuucaugauuaacuuagugaau

SEQ ID NO: 1062993 - RNA, 22 nt, Human
cagcucuguucauagauggugc

SEQ ID NO: 1062994 - RNA, 22 nt, Human
cuguaugaaauugucauuuuua

SEQ ID NO: 1062995 - RNA, 22 nt, Human
cuccaggccauggcugcggagg

SEQ ID NO: 1062996 - RNA, 22 nt, Human
uuaacacauauuuaucaauugc

SEQ ID NO: 1062997 - RNA, 22 nt, Human
caugaguucaucugcuucucuu

SEQ ID NO: 1062998 - RNA, 22 nt, Human
ccugcagguugcagaggcggaa

SEQ ID NO: 1062999 - RNA, 22 nt, Human
cuggcaguuugccaggagcucg

SEQ ID NO: 1063000 - RNA, 22 nt, Human
gggcugaccaaugccuugcuuu

SEQ ID NO: 1063001 - RNA, 23 nt, Human
uggccagguagaggagguaguga

SEQ ID NO: 1063002 - RNA, 22 nt, Human
uguuccaauaaggaguugaaau

SEQ ID NO: 1063003 - RNA, 22 nt, Human
uuuaugagcaaugcugagggga

SEQ ID NO: 1063004 - RNA, 22 nt, Human
auuucacaucuaucucagauuu

SEQ ID NO: 1063005 - RNA, 22 nt, Human
acaggcagguccugucccagcu

SEQ ID NO: 1063006 - RNA, 22 nt, Human
aaaguucuggcauuuucugucu

SEQ ID NO: 1063007 - RNA, 22 nt, Human
uagggcucagcucuagcuccug

SEQ ID NO: 1063008 - RNA, 22 nt, Human
gggcuguaggagcuggaauggg

SEQ ID NO: 1063009 - RNA, 22 nt, Human
aaaagguuuugaguacaaauau

SEQ ID NO: 1063010 - RNA, 22 nt, Human
uugaaaaaauugguagaggaug

SEQ ID NO: 1063011 - RNA, 22 nt, Human
aucacagagcucccuuccacug

SEQ ID NO: 1063012 - RNA, 22 nt, Human
uacauaauuaaucuuuaaguuc

SEQ ID NO: 1063013 - RNA, 22 nt, Human
acacauuucucuuuuuguaagu

SEQ ID NO: 1063014 - RNA, 22 nt, Human
uagauacaggcucucugagccu

SEQ ID NO: 1063015 - RNA, 22 nt, Human
cagggcucgcucuugcccuucg

SEQ ID NO: 1063016 - RNA, 22 nt, Human
agagggcugccucagucagcua

SEQ ID NO: 1063017 - RNA, 22 nt, Human
aagggcucugugcuugucccau

SEQ ID NO: 1063018 - RNA, 22 nt, Human
aacaaaagccgaaguagguguc

SEQ ID NO: 1063019 - RNA, 22 nt, Human
auuaauuuuucugacagccaca

SEQ ID NO: 1063020 - RNA, 22 nt, Human
gcccaagcuggacugcaguggc

SEQ ID NO: 1063021 - RNA, 20 nt, Human
cccacacccuucccacuugg

SEQ ID NO: 1063022 - RNA, 22 nt, Human
cccuuccugggugucccggagu

SEQ ID NO: 1063023 - RNA, 22 nt, Human
gcaaggaccuuugagcgugcca

SEQ ID NO: 1063024 - RNA, 22 nt, Human
ugcaggcuuuagccccauggcu

SEQ ID NO: 1063025 - RNA, 22 nt, Human
uuugauuuacuggauauucuca

SEQ ID NO: 1063026 - RNA, 20 nt, Human
ccaggccugggccugcucua

SEQ ID NO: 1063027 - RNA, 22 nt, Human
auguagaagugggcauuauaga

SEQ ID NO: 1063028 - RNA, 22 nt, Human
gucugucauacggcuuauguaa

SEQ ID NO: 1063029 - RNA, 22 nt, Human
cagagacuggagugcaguggcg

SEQ ID NO: 1063030 - RNA, 22 nt, Human
ccugggcuuccacgagcagagg

SEQ ID NO: 1063031 - RNA, 22 nt, Human
acacacacaagcagguugugga

SEQ ID NO: 1063032 - RNA, 22 nt, Human
aaagucuuuauuuuguaucuuu

SEQ ID NO: 1063033 - RNA, 20 nt, Human
ugcaaacacagaguguauga

SEQ ID NO: 1063034 - RNA, 19 nt, Human
cagguggcgcucuacaggg

SEQ ID NO: 1063035 - RNA, 22 nt, Human
cagcuuuccagagaccugcccc

SEQ ID NO: 1063036 - RNA, 22 nt, Human
cuuccaagaugaacagcaagcg

SEQ ID NO: 1063037 - RNA, 22 nt, Human
gagggcucaacuacuacuaggc

SEQ ID NO: 1063038 - RNA, 22 nt, Human
uuugauaagagcugcugaaacu

SEQ ID NO: 1063039 - RNA, 22 nt, Human
aagcuuccugaaugcucauuua

SEQ ID NO: 1063040 - RNA, 22 nt, Human
caggcuggagugcaauggcaca

SEQ ID NO: 1063041 - RNA, 22 nt, Human
gcagagaggaaugaagccaucc

SEQ ID NO: 1063042 - RNA, 22 nt, Human
ggacuccucuagaaguugaggc

SEQ ID NO: 1063043 - RNA, 22 nt, Human
uguuuucauuugauguaacaaa

SEQ ID NO: 1063044 - RNA, 22 nt, Human
gcaaacuguuggaguagagucu

SEQ ID NO: 1063045 - RNA, 22 nt, Human
cagagagcuuagugugcugcau

SEQ ID NO: 1063046 - RNA, 22 nt, Human
gcuggcaggauagaagucuaau

SEQ ID NO: 1063047 - RNA, 22 nt, Human
uaauaguugugacuuuguaaag

SEQ ID NO: 1063048 - RNA, 22 nt, Human
acuggcagaauugaauaguugu

SEQ ID NO: 1063049 - RNA, 18 nt, Human
ugcuuuaugcuuauauaa

SEQ ID NO: 1063050 - RNA, 22 nt, Human
uacaaagucacauugaaaugaa

SEQ ID NO: 1063051 - RNA, 22 nt, Human
uuuuggaaugaggaacauccag

SEQ ID NO: 1063052 - RNA, 22 nt, Human
ugcaggcugcagucucaggugg

SEQ ID NO: 1063053 - RNA, 22 nt, Human
ccagagaggcaaaacuccuucc

SEQ ID NO: 1063054 - RNA, 22 nt, Human
ugcuuuaucugacuuggcgcug

SEQ ID NO: 1063055 - RNA, 22 nt, Human
agguauaagucucauuucuguu

SEQ ID NO: 1063056 - RNA, 23 nt, Human
gccaggcacaugguggacacgca

SEQ ID NO: 1063057 - RNA, 22 nt, Human
cccugcagaaccacagacaaac

SEQ ID NO: 1063058 - RNA, 22 nt, Human
ccugcagaggucaggccagaaa

SEQ ID NO: 1063059 - RNA, 22 nt, Human
ucuuuauugcuacugguuuguc

SEQ ID NO: 1063060 - RNA, 21 nt, Human
acauucacaggauauuaucau

SEQ ID NO: 1063061 - RNA, 22 nt, Human
acaucugaggagaccagccucu

SEQ ID NO: 1063062 - RNA, 22 nt, Human
ucugggcugcuaugaggcagag

SEQ ID NO: 1063063 - RNA, 19 nt, Human
ugcuagaaauucugugacu

SEQ ID NO: 1063064 - RNA, 22 nt, Human
uuuagggaugucagaacaggga

SEQ ID NO: 1063065 - RNA, 22 nt, Human
aguauaaagugguuuucagcac

SEQ ID NO: 1063066 - RNA, 22 nt, Human
gcuggcaguaaaggguuuggca

SEQ ID NO: 1063067 - RNA, 22 nt, Human
uuuguacauauauaaaaucugu

SEQ ID NO: 1063068 - RNA, 22 nt, Human
uuuuauuaguggcuagaugggg

SEQ ID NO: 1063069 - RNA, 17 nt, Human
gccuucucugcccucac

SEQ ID NO: 1063070 - RNA, 22 nt, Human
acagauuuuaaaugacacuccc

SEQ ID NO: 1063071 - RNA, 18 nt, Human
cucagagaugcccuuauu

SEQ ID NO: 1063072 - RNA, 22 nt, Human
cacacacuguuaauguaggagu

SEQ ID NO: 1063073 - RNA, 21 nt, Human
cagacccucuagaggccaccu

SEQ ID NO: 1063074 - RNA, 22 nt, Human
cccaggcagccccagaagcuug

SEQ ID NO: 1063075 - RNA, 22 nt, Human
guccucugaaagaugaaccaug

SEQ ID NO: 1063076 - RNA, 21 nt, Human
caugaagccgguucccuguuu

SEQ ID NO: 1063077 - RNA, 22 nt, Human
acaaauccagugaacuccagug

SEQ ID NO: 1063078 - RNA, 22 nt, Human
aaaguuugagugauuugacaca

SEQ ID NO: 1063079 - RNA, 22 nt, Human
uccaggcacagaguuggucagu

SEQ ID NO: 1063080 - RNA, 22 nt, Human
uuccuggccuaagguaggugac

SEQ ID NO: 1063081 - RNA, 22 nt, Human
cagggcucaggaaaucagacgu

SEQ ID NO: 1063082 - RNA, 22 nt, Human
cuacauaaauauuuaugugucu

SEQ ID NO: 1063083 - RNA, 22 nt, Human
ccacuguaaguuugaaaauaac

SEQ ID NO: 1063084 - RNA, 22 nt, Human
augcuuuuaugucacaugguca

SEQ ID NO: 1063085 - RNA, 23 nt, Human
agaccugcaucugauaggcccug

SEQ ID NO: 1063086 - RNA, 20 nt, Human
ucccaggcugggcuccagcu

SEQ ID NO: 1063087 - RNA, 22 nt, Human
ugaaacaaugugaaguugcuga

SEQ ID NO: 1063088 - RNA, 22 nt, Human
guccaagagucaagaagggggc

SEQ ID NO: 1063089 - RNA, 22 nt, Human
aguaugaauugcuuugccugua

SEQ ID NO: 1063090 - RNA, 22 nt, Human
gccugcagauauauaggauggu

SEQ ID NO: 1063091 - RNA, 22 nt, Human
ugggggcugugcacaggcucac

SEQ ID NO: 1063092 - RNA, 22 nt, Human
uuucacauggaagcucucgaga

SEQ ID NO: 1063093 - RNA, 22 nt, Human
uuuucauuagaaugacugagaa

SEQ ID NO: 1063094 - RNA, 22 nt, Human
gaccucagugaauggucaugua

SEQ ID NO: 1063095 - RNA, 22 nt, Human
ucaucacauaugucaugauuug

SEQ ID NO: 1063096 - RNA, 22 nt, Human
acauaaugagcucuuuauaaau

SEQ ID NO: 1063097 - RNA, 22 nt, Human
uauuuaaaaagaggccagcugg

SEQ ID NO: 1063098 - RNA, 22 nt, Human
auggccugaugcaccuguccca

SEQ ID NO: 1063099 - RNA, 22 nt, Human
cuccagugcacccagaggauuu

SEQ ID NO: 1063100 - RNA, 22 nt, Human
agacaucagcuugugugcaggg

SEQ ID NO: 1063101 - RNA, 22 nt, Human
uuagggaaggcugcugucagcu

SEQ ID NO: 1063102 - RNA, 22 nt, Human
cagcuuuaccuuuaggaguaac

SEQ ID NO: 1063103 - RNA, 18 nt, Human
acucugcggaggccccag

SEQ ID NO: 1063104 - RNA, 20 nt, Human
gccucagccaacccaugggg

SEQ ID NO: 1063105 - RNA, 22 nt, Human
ccagagaggccaaggucguggu

SEQ ID NO: 1063106 - RNA, 23 nt, Human
ccagcccuccaccagcucuaggc

SEQ ID NO: 1063107 - RNA, 17 nt, Human
ccagagaguaguuagga

SEQ ID NO: 1063108 - RNA, 22 nt, Human
aaauccuaaggagaauaugauu

SEQ ID NO: 1063109 - RNA, 22 nt, Human
cagucucucuccuugcaggcgu

SEQ ID NO: 1063110 - RNA, 22 nt, Human
ucugggcugcugugcagugacc

SEQ ID NO: 1063111 - RNA, 22 nt, Human
uucugucacuuaggaggucaua

SEQ ID NO: 1063112 - RNA, 22 nt, Human
gcacccaggcuugggcagcaac

SEQ ID NO: 1063113 - RNA, 22 nt, Human
guuuauuauacaacaaaagcua

SEQ ID NO: 1063114 - RNA, 22 nt, Human
ucauuuguugaacuuuagugcg

SEQ ID NO: 1063115 - RNA, 22 nt, Human
cuaaaauuaucaagauaauucc

SEQ ID NO: 1063116 - RNA, 22 nt, Human
augaaugcugggacaaauauau

SEQ ID NO: 1063117 - RNA, 22 nt, Human
caggagcaaggagcagugggau

SEQ ID NO: 1063118 - RNA, 22 nt, Human
uuuuacuuaauucuuggucaug

SEQ ID NO: 1063119 - RNA, 21 nt, Human
aggucccagguuugggcagca

SEQ ID NO: 1063120 - RNA, 22 nt, Human
gcuaggaggaagaaugugaauu

SEQ ID NO: 1063121 - RNA, 22 nt, Human
ucauuguuucugcuuuucauga

SEQ ID NO: 1063122 - RNA, 22 nt, Human
acacauauauacauauuugugc

SEQ ID NO: 1063123 - RNA, 22 nt, Human
uaagaacaguagaacaguaggu

SEQ ID NO: 1063124 - RNA, 22 nt, Human
gccaggcauuauuccgaucccu

SEQ ID NO: 1063125 - RNA, 22 nt, Human
cgcuaggauuaggauuaauccu

SEQ ID NO: 1063126 - RNA, 22 nt, Human
uacauugcuagaaauguauuuu

SEQ ID NO: 1063127 - RNA, 22 nt, Human
uagcauuucacugaucuucacu

SEQ ID NO: 1063128 - RNA, 22 nt, Human
caggcuccuucccagggauggu

SEQ ID NO: 1063129 - RNA, 22 nt, Human
agcucugcuucuugggaagaug

SEQ ID NO: 1063130 - RNA, 22 nt, Human
ggcagagguagcuggaaccagg

SEQ ID NO: 1063131 - RNA, 20 nt, Human
gccugcagagaaggucagag

SEQ ID NO: 1063132 - RNA, 22 nt, Human
uggccaggaggcugcuucugac

SEQ ID NO: 1063133 - RNA, 22 nt, Human
uggcagugguaccggcucucag

SEQ ID NO: 1063134 - RNA, 22 nt, Human
aaggcuuuaugugaccaaaaga

SEQ ID NO: 1063135 - RNA, 22 nt, Human
ucagagagcagaacuuuuuuac

SEQ ID NO: 1063136 - RNA, 22 nt, Human
ugauuucuuccuugucauuaga

SEQ ID NO: 1063137 - RNA, 22 nt, Human
agccauccucccaccucagccu

SEQ ID NO: 1063138 - RNA, 22 nt, Human
acuucacagauauuuauuuggu

SEQ ID NO: 1063139 - RNA, 22 nt, Human
gagugaugucuguagugaagaa

SEQ ID NO: 1063140 - RNA, 22 nt, Human
gauggcagguaguggucucauc

SEQ ID NO: 1063141 - RNA, 22 nt, Human
uccccaccuaagauacccaucu

SEQ ID NO: 1063142 - RNA, 22 nt, Human
agcagguugugauacacucaga

SEQ ID NO: 1063143 - RNA, 22 nt, Human
cuggggaccagugucuguuugu

SEQ ID NO: 1063144 - RNA, 22 nt, Human
ugaaacauugcacuguaugaau

SEQ ID NO: 1063145 - RNA, 22 nt, Human
gggcugacauauuuggugcucu

SEQ ID NO: 1063146 - RNA, 22 nt, Human
uccaggcauaagccuugagugu

SEQ ID NO: 1063147 - RNA, 22 nt, Human
gggcuaggcuuggccagcacug

SEQ ID NO: 1063148 - RNA, 22 nt, Human
caaugaaaauuuaaguugcagc

SEQ ID NO: 1063149 - RNA, 22 nt, Human
agugugagccuacaggccaaag

SEQ ID NO: 1063150 - RNA, 22 nt, Human
cuacauggagaagaaaauucuu

SEQ ID NO: 1063151 - RNA, 22 nt, Human
cucuuaaaaacuugauauauuu

SEQ ID NO: 1063152 - RNA, 21 nt, Human
cagcccagcccauugacagug

SEQ ID NO: 1063153 - RNA, 18 nt, Human
gacaaaaguacagacaga

SEQ ID NO: 1063154 - RNA, 21 nt, Human
ugacugaggcuucuucacaca

SEQ ID NO: 1063155 - RNA, 22 nt, Human
uuguauuucuccacuuucuguu

SEQ ID NO: 1063156 - RNA, 21 nt, Human
uagcuuuaauauucccacauu

SEQ ID NO: 1063157 - RNA, 20 nt, Human
acaaagacuggaaaagcaag

SEQ ID NO: 1063158 - RNA, 21 nt, Human
acugugauaaugcuuuuucug

SEQ ID NO: 1063159 - RNA, 22 nt, Human
ucacuguauuugcugaugcaua

SEQ ID NO: 1063160 - RNA, 22 nt, Human
uucaguaugcugaaugauuuuu

SEQ ID NO: 1063161 - RNA, 22 nt, Human
uggaauuaucugaagugauuug

SEQ ID NO: 1063162 - RNA, 22 nt, Human
guaaaucagugucauuuuagaa

SEQ ID NO: 1063163 - RNA, 22 nt, Human
cuuugggcacugaaguaugggu

SEQ ID NO: 1063164 - RNA, 22 nt, Human
guccuggugcuggucauugucg

SEQ ID NO: 1063165 - RNA, 22 nt, Human
uggugcugccaccuccucugcu

SEQ ID NO: 1063166 - RNA, 22 nt, Human
gaagaaguguaagucuguuuca

SEQ ID NO: 1063167 - RNA, 22 nt, Human
auuuacucgugcuucauugaau

SEQ ID NO: 1063168 - RNA, 22 nt, Human
gacucugguugcggguucugcu

SEQ ID NO: 1063169 - RNA, 22 nt, Human
uuccuggggacuuaccgucauu

SEQ ID NO: 1063170 - RNA, 22 nt, Human
agugauguagguggauucuggc

SEQ ID NO: 1063171 - RNA, 22 nt, Human
uggcccgggaguuuugaagagu

SEQ ID NO: 1063172 - RNA, 22 nt, Human
ugugaagaucaggguccuagag

SEQ ID NO: 1063173 - RNA, 22 nt, Human
auccucagagaacgaacacaau

SEQ ID NO: 1063174 - RNA, 22 nt, Human
guaauucugugugaaucuauua

SEQ ID NO: 1063175 - RNA, 22 nt, Human
auugaagcauggagaugaggca

SEQ ID NO: 1063176 - RNA, 22 nt, Human
uuacuaguggagaaacugaggc

SEQ ID NO: 1063177 - RNA, 22 nt, Human
accuuguuguagguacaaaaga

SEQ ID NO: 1063178 - RNA, 22 nt, Human
gguuauuaguuucaccuggacu

SEQ ID NO: 1063179 - RNA, 22 nt, Human
acauucaugcaccuuccuaucc

SEQ ID NO: 1063180 - RNA, 22 nt, Human
agcaguuuauccucauaaugga

SEQ ID NO: 1063181 - RNA, 22 nt, Human
aucuaugugggaaucauaauag

SEQ ID NO: 1063182 - RNA, 22 nt, Human
acaauuucuaauauagaucuua

SEQ ID NO: 1063183 - RNA, 22 nt, Human
ucuauuaaugauucaauagugu

SEQ ID NO: 1063184 - RNA, 22 nt, Human
aaugagauggaggacucuuaau

SEQ ID NO: 1063185 - RNA, 22 nt, Human
ccugggacuuggucugggguuu

SEQ ID NO: 1063186 - RNA, 22 nt, Human
ugguccugagcaccagccugac

SEQ ID NO: 1063187 - RNA, 22 nt, Human
aaagucuuaauguaaguuuagu

SEQ ID NO: 1063188 - RNA, 23 nt, Human
uggccucuccccaccuggcagaa

SEQ ID NO: 1063189 - RNA, 22 nt, Human
guggucaucuaacuaaauuuuc

SEQ ID NO: 1063190 - RNA, 22 nt, Human
cugggucccggcuucuauccac

SEQ ID NO: 1063191 - RNA, 22 nt, Human
ucugcuugugucuguccagccu

SEQ ID NO: 1063192 - RNA, 22 nt, Human
ugguuggauggcucuuguggcu

SEQ ID NO: 1063193 - RNA, 20 nt, Human
uguauuuaaugaaggcuuuu

SEQ ID NO: 1063194 - RNA, 22 nt, Human
guccuggugccaccugcgggau

SEQ ID NO: 1063195 - RNA, 22 nt, Human
aguaaaaucaccaucucuuugu

SEQ ID NO: 1063196 - RNA, 22 nt, Human
agauugucauugacgaugagca

SEQ ID NO: 1063197 - RNA, 22 nt, Human
auugaagacuugguauccgugg

SEQ ID NO: 1063198 - RNA, 22 nt, Human
aauuagaagcuguuagcaaaau

SEQ ID NO: 1063199 - RNA, 22 nt, Human
caauguuuuuccuuccuuaaua

SEQ ID NO: 1063200 - RNA, 21 nt, Human
agcauucaaaagaugccauaa

SEQ ID NO: 1063201 - RNA, 22 nt, Human
cugggcuguuuguucuggucuc

SEQ ID NO: 1063202 - RNA, 22 nt, Human
ugcuggccucggcgcugggccu

SEQ ID NO: 1063203 - RNA, 22 nt, Human
ucuguccauucagaauggcccu

SEQ ID NO: 1063204 - RNA, 22 nt, Human
auuaguagcacacagagaucag

SEQ ID NO: 1063205 - RNA, 23 nt, Human
aguacauuugacccaaauaagcu

SEQ ID NO: 1063206 - RNA, 22 nt, Human
auguuugaaauuguaaguauau

SEQ ID NO: 1063207 - RNA, 22 nt, Human
uucugauugcugaugaggccca

SEQ ID NO: 1063208 - RNA, 22 nt, Human
uccuggguccauggcagccgaa

SEQ ID NO: 1063209 - RNA, 18 nt, Human
gguccugggccuggcuca

SEQ ID NO: 1063210 - RNA, 22 nt, Human
ccaaaauauuagugcuuaagua

SEQ ID NO: 1063211 - RNA, 22 nt, Human
uuaaguauauccauuugacugg

SEQ ID NO: 1063212 - RNA, 22 nt, Human
ugucauauagaauguucuauga

SEQ ID NO: 1063213 - RNA, 22 nt, Human
acaguuaguugaggaguguuug

SEQ ID NO: 1063214 - RNA, 22 nt, Human
gaaccuguccugagugaggagu

SEQ ID NO: 1063215 - RNA, 22 nt, Human
aucuucaaggaaaaaauacagu

SEQ ID NO: 1063216 - RNA, 22 nt, Human
aaauugcuugagauuagucucc

SEQ ID NO: 1063217 - RNA, 22 nt, Human
gggcccugcgacucgcggcgga

SEQ ID NO: 1063218 - RNA, 22 nt, Human
auucuugauauagauaguuaau

SEQ ID NO: 1063219 - RNA, 22 nt, Human
agauguuuuuccaggucuaauu

SEQ ID NO: 1063220 - RNA, 22 nt, Human
uaaccuguuaagggcugaccca

SEQ ID NO: 1063221 - RNA, 22 nt, Human
cuccuuagugccucugcacgag

SEQ ID NO: 1063222 - RNA, 22 nt, Human
uaaguauuggccuauagcuaga

SEQ ID NO: 1063223 - RNA, 22 nt, Human
auuacugaggcaaaguaguuuu

SEQ ID NO: 1063224 - RNA, 23 nt, Human
acucugacuuaguuauagcuauu

SEQ ID NO: 1063225 - RNA, 23 nt, Human
uuaagacuggcugaacuuaguag

SEQ ID NO: 1063226 - RNA, 20 nt, Human
caucaacaccuugucagccu

SEQ ID NO: 1063227 - RNA, 19 nt, Human
ccauucugucucugccaca

SEQ ID NO: 1063228 - RNA, 22 nt, Human
cugcucaauuccggcacgcugg

SEQ ID NO: 1063229 - RNA, 22 nt, Human
uccuggcucaggccccuggugc

SEQ ID NO: 1063230 - RNA, 22 nt, Human
gugggaguggagcucagcaugu

SEQ ID NO: 1063231 - RNA, 22 nt, Human
caaagaagagauuuacagagcu

SEQ ID NO: 1063232 - RNA, 22 nt, Human
guuuuguucaugaacauugggu

SEQ ID NO: 1063233 - RNA, 22 nt, Human
aaauucuguccugaaugccauu

SEQ ID NO: 1063234 - RNA, 22 nt, Human
guuauacuuaugugcaaaaaua

SEQ ID NO: 1063235 - RNA, 22 nt, Human
uuccaauaaaauguuauuugca

SEQ ID NO: 1063236 - RNA, 22 nt, Human
auccugggaaguggccuccucc

SEQ ID NO: 1063237 - RNA, 22 nt, Human
aacaguaugugagauuuacaca

SEQ ID NO: 1063238 - RNA, 22 nt, Human
uucauuacauucaaaaggcauu

SEQ ID NO: 1063239 - RNA, 22 nt, Human
guuuuaguggguggccacugau

SEQ ID NO: 1063240 - RNA, 22 nt, Human
guugggcugaagugugugcuua

SEQ ID NO: 1063241 - RNA, 22 nt, Human
cagcgguggcaaggugacugug

SEQ ID NO: 1063242 - RNA, 22 nt, Human
gcugacugguucaggucccgcu

SEQ ID NO: 1063243 - RNA, 22 nt, Human
uaauucuagauugacauuuuga

SEQ ID NO: 1063244 - RNA, 22 nt, Human
gcugggucucucccugguccug

SEQ ID NO: 1063245 - RNA, 22 nt, Human
uucuucauucccuuacuuccga

SEQ ID NO: 1063246 - RNA, 22 nt, Human
gucuguggaguugcuugcugga

SEQ ID NO: 1063247 - RNA, 17 nt, Human
uuuguucguuaguccgg

SEQ ID NO: 1063248 - RNA, 22 nt, Human
aaaucaugguggaagaaacaga

SEQ ID NO: 1063249 - RNA, 21 nt, Human
ucuuggggaggagggcugcac

SEQ ID NO: 1063250 - RNA, 22 nt, Human
acuuggucguggugcagcaugg

SEQ ID NO: 1063251 - RNA, 22 nt, Human
uccugggcccuccggaucaggu

SEQ ID NO: 1063252 - RNA, 22 nt, Human
gauuugucuauauucaaauaug

SEQ ID NO: 1063253 - RNA, 22 nt, Human
uaaaaucaugacagauugacau

SEQ ID NO: 1063254 - RNA, 22 nt, Human
ggccuugguaaauuggcauuug

SEQ ID NO: 1063255 - RNA, 22 nt, Human
aaaccuguuaauagagcgaugc

SEQ ID NO: 1063256 - RNA, 22 nt, Human
ucaauuuauguggcuauucauu

SEQ ID NO: 1063257 - RNA, 22 nt, Human
agagaauuaacauuccauggcu

SEQ ID NO: 1063258 - RNA, 22 nt, Human
cuucacugcagucauggcucug

SEQ ID NO: 1063259 - RNA, 22 nt, Human
uuguacuuaaauaugcaaauag

SEQ ID NO: 1063260 - RNA, 22 nt, Human
ugguaaaugucuaacaaucacu

SEQ ID NO: 1063261 - RNA, 20 nt, Human
ucagugggaaagugagagug

SEQ ID NO: 1063262 - RNA, 22 nt, Human
uggguccuggaaggcgacaggu

SEQ ID NO: 1063263 - RNA, 22 nt, Human
caugcauuucuaccaaggaaua

SEQ ID NO: 1063264 - RNA, 22 nt, Human
caugucaagacugaagauccag

SEQ ID NO: 1063265 - RNA, 22 nt, Human
agaaaagaggcuuucuaagcau

SEQ ID NO: 1063266 - RNA, 22 nt, Human
ggcuuccuccuuccugcuguca

SEQ ID NO: 1063267 - RNA, 22 nt, Human
cauuuacauuuaagguuaauau

SEQ ID NO: 1063268 - RNA, 20 nt, Human
cugggcagguguuugaucuc

SEQ ID NO: 1063269 - RNA, 22 nt, Human
gucuccugaggcauccauugaa

SEQ ID NO: 1063270 - RNA, 22 nt, Human
auccauuugccgugcuaugugc

SEQ ID NO: 1063271 - RNA, 22 nt, Human
ggccuugggauguggcugcagc

SEQ ID NO: 1063272 - RNA, 22 nt, Human
gcugcugcuugaaggcucggag

SEQ ID NO: 1063273 - RNA, 22 nt, Human
uuauuuaaaagugguaagauuc

SEQ ID NO: 1063274 - RNA, 22 nt, Human
uagcauuucacugaucuucacu

SEQ ID NO: 1063275 - RNA, 22 nt, Human
auguuguugaacucuuugcaug

SEQ ID NO: 1063276 - RNA, 22 nt, Human
uuaguuuccuguggugugaagu

SEQ ID NO: 1063277 - RNA, 22 nt, Human
auagcaaaggacaauagucagu

SEQ ID NO: 1063278 - RNA, 22 nt, Human
gcugguggcagagcuccgcggc

SEQ ID NO: 1063279 - RNA, 22 nt, Human
auauaguuggguuucauucuac

SEQ ID NO: 1063280 - RNA, 22 nt, Human
cucugguuucgcaggaaauaga

SEQ ID NO: 1063281 - RNA, 22 nt, Human
aauaaguacuuggggauaacuu

SEQ ID NO: 1063282 - RNA, 22 nt, Human
cccuuguuuuugaguacaauag

SEQ ID NO: 1063283 - RNA, 22 nt, Human
ugcauguuucuguauguuaaug

SEQ ID NO: 1063284 - RNA, 22 nt, Human
ggugggugagcccugggagcug

SEQ ID NO: 1063285 - RNA, 22 nt, Human
aauggcuguucucugugauugg

SEQ ID NO: 1063286 - RNA, 22 nt, Human
cuguggcugcgcccugggggag

SEQ ID NO: 1063287 - RNA, 22 nt, Human
auccauuuuuucagaaugcucu

SEQ ID NO: 1063288 - RNA, 22 nt, Human
uaaaguuggaccugauuuuauu

SEQ ID NO: 1063289 - RNA, 21 nt, Human
agggaaaaggcugagugaggg

SEQ ID NO: 1063290 - RNA, 22 nt, Human
ccugugggcgcagcuggaguca

SEQ ID NO: 1063291 - RNA, 22 nt, Human
auuguuacuggguuaauuugga

SEQ ID NO: 1063292 - RNA, 22 nt, Human
ccuggguccaauucuggcuugu

SEQ ID NO: 1063293 - RNA, 22 nt, Human
gagcuuuucccgucuuucucgu

SEQ ID NO: 1063294 - RNA, 22 nt, Human
uaauuucagugcaagcucacgg

SEQ ID NO: 1063295 - RNA, 22 nt, Human
gcugcuggcuuccugcuguuuu

SEQ ID NO: 1063296 - RNA, 22 nt, Human
cucugugaaccccuccuuucuu

SEQ ID NO: 1063297 - RNA, 22 nt, Human
gauccacagcugcgguaggaga

SEQ ID NO: 1063298 - RNA, 22 nt, Human
uuacuugauuguggagucugag

SEQ ID NO: 1063299 - RNA, 22 nt, Human
aaagucaucuguccuaggcucu

SEQ ID NO: 1063300 - RNA, 22 nt, Human
aucagaauacuaucaacaguga

SEQ ID NO: 1063301 - RNA, 22 nt, Human
gcccccagaagggccacagauu

SEQ ID NO: 1063302 - RNA, 22 nt, Human
uuacacaacagugcaucagcag

SEQ ID NO: 1063303 - RNA, 22 nt, Human
aaacugaagccuuggagugaca

SEQ ID NO: 1063304 - RNA, 17 nt, Human
auuuguaacuagcucuu

SEQ ID NO: 1063305 - RNA, 20 nt, Human
ugucaugcauuagaugaaga

SEQ ID NO: 1063306 - RNA, 22 nt, Human
acacucucagcuuuucaacuua

SEQ ID NO: 1063307 - RNA, 22 nt, Human
uggaagccaggcccgcuccuaa

SEQ ID NO: 1063308 - RNA, 21 nt, Human
ggucuuccaaauaaggagaaa

SEQ ID NO: 1063309 - RNA, 22 nt, Human
ucuugauuuacucuaauagcuu

SEQ ID NO: 1063310 - RNA, 20 nt, Human
ugcucaggauggagaggugu

SEQ ID NO: 1063311 - RNA, 22 nt, Human
uugaagcacaaugucuuuuauc

SEQ ID NO: 1063312 - RNA, 22 nt, Human
uaggaagcugagcagcauuccu

SEQ ID NO: 1063313 - RNA, 22 nt, Human
cuuaaugaaagguugcacaugg

SEQ ID NO: 1063314 - RNA, 22 nt, Human
uuucaacuagccccuaaguccu

SEQ ID NO: 1063315 - RNA, 18 nt, Human
acaaaggucugcaagacc

SEQ ID NO: 1063316 - RNA, 22 nt, Human
auuuaacaagacagagaacugg

SEQ ID NO: 1063317 - RNA, 22 nt, Human
uauuuugacgauuuuaugcaaa

SEQ ID NO: 1063318 - RNA, 22 nt, Human
uugcuauuuugagagucauagu

SEQ ID NO: 1063319 - RNA, 22 nt, Human
uaaaaucauucuggugucagua

SEQ ID NO: 1063320 - RNA, 21 nt, Human
aggcucucauccagggaccca

SEQ ID NO: 1063321 - RNA, 22 nt, Human
cagucucuggugaguugacagu

SEQ ID NO: 1063322 - RNA, 22 nt, Human
ccugccugucccucaguccaca

SEQ ID NO: 1063323 - RNA, 22 nt, Human
uucacaguggcccucucugagu

SEQ ID NO: 1063324 - RNA, 21 nt, Human
aggcagaaagagcccaggcug

SEQ ID NO: 1063325 - RNA, 22 nt, Human
uggcucagcgcggccuggucuu

SEQ ID NO: 1063326 - RNA, 22 nt, Human
gaaauauuguacuggagauguu

SEQ ID NO: 1063327 - RNA, 22 nt, Human
uugaagacuaauuuagauaaug

SEQ ID NO: 1063328 - RNA, 22 nt, Human
ucacacauuucucaaguguagg

SEQ ID NO: 1063329 - RNA, 22 nt, Human
aaguuucaaauauaaaauuaca

SEQ ID NO: 1063330 - RNA, 22 nt, Human
gacagguguguguauauuaggg

SEQ ID NO: 1063331 - RNA, 22 nt, Human
ugguaucaaacaauuaauuaga

SEQ ID NO: 1063332 - RNA, 22 nt, Human
aaauuuuagaccaggcaaaacu

SEQ ID NO: 1063333 - RNA, 22 nt, Human
uauccaaaguuucucagaaacu

SEQ ID NO: 1063334 - RNA, 22 nt, Human
aagcagcagcaggauuaaagag

SEQ ID NO: 1063335 - RNA, 22 nt, Human
ggagccaggcaaucuguacuuu

SEQ ID NO: 1063336 - RNA, 22 nt, Human
gccucugcaucuucgccgcacu

SEQ ID NO: 1063337 - RNA, 21 nt, Human
uugaaaguaaauucagcagcu

SEQ ID NO: 1063338 - RNA, 18 nt, Human
aaauuauucuuccuuuuc

SEQ ID NO: 1063339 - RNA, 22 nt, Human
ccugccagcauggcuuaucucc

SEQ ID NO: 1063340 - RNA, 22 nt, Human
ucauugcagugauguuguaugu

SEQ ID NO: 1063341 - RNA, 22 nt, Human
ugcacuccaggcugggugacag

SEQ ID NO: 1063342 - RNA, 22 nt, Human
gggaagcagcauugugcuggcu

SEQ ID NO: 1063343 - RNA, 22 nt, Human
acacacaacucauuguguaaua

SEQ ID NO: 1063344 - RNA, 22 nt, Human
gccuggccgcuccgagcuccgc

SEQ ID NO: 1063345 - RNA, 22 nt, Human
uguacaaagguacuuugauguu

SEQ ID NO: 1063346 - RNA, 22 nt, Human
cauaucccauuggccaggacau

SEQ ID NO: 1063347 - RNA, 22 nt, Human
aauagaauuuaaaugcaguggc

SEQ ID NO: 1063348 - RNA, 22 nt, Human
augauugaaaaugacauugcca

SEQ ID NO: 1063349 - RNA, 22 nt, Human
acuuucucccacccacccgucu

SEQ ID NO: 1063350 - RNA, 22 nt, Human
acuugaaaagcucagcaguagu

SEQ ID NO: 1063351 - RNA, 22 nt, Human
ucauagaaugaguuaaugaacu

SEQ ID NO: 1063352 - RNA, 22 nt, Human
aaugcaaacagcccagaaucca

SEQ ID NO: 1063353 - RNA, 22 nt, Human
cauguguaaggcucacaggcag

SEQ ID NO: 1063354 - RNA, 22 nt, Human
gcacagggcaacaggucuguua

SEQ ID NO: 1063355 - RNA, 22 nt, Human
cagcagagaccaagugauuuga

SEQ ID NO: 1063356 - RNA, 22 nt, Human
ugauuuuuaaaauucuccuugc

SEQ ID NO: 1063357 - RNA, 22 nt, Human
aaaauugaggcucauguuaaau

SEQ ID NO: 1063358 - RNA, 22 nt, Human
uaaagcauguguuagaagugca

SEQ ID NO: 1063359 - RNA, 22 nt, Human
uccuggagaauccugccaccug

SEQ ID NO: 1063360 - RNA, 22 nt, Human
gugccgcuggagcuggaauuga

SEQ ID NO: 1063361 - RNA, 21 nt, Human
gccauuguuuucuaccuggag

SEQ ID NO: 1063362 - RNA, 22 nt, Human
ggagccuggcaaugcugcgucc

SEQ ID NO: 1063363 - RNA, 22 nt, Human
cuguauuuaguuaaaaugcuaa

SEQ ID NO: 1063364 - RNA, 22 nt, Human
gaugaagcuuugaagucuaauc

SEQ ID NO: 1063365 - RNA, 22 nt, Human
cauucacaauggauugcuucaa

SEQ ID NO: 1063366 - RNA, 20 nt, Human
ggguggaguugcggucugug

SEQ ID NO: 1063367 - RNA, 22 nt, Human
agugccuagauauuguuugaac

SEQ ID NO: 1063368 - RNA, 20 nt, Human
ggccucaguguccuuguuug

SEQ ID NO: 1063369 - RNA, 22 nt, Human
gauaccagacagggagggagaa

SEQ ID NO: 1063370 - RNA, 20 nt, Human
gggcagccucgggagugggu

SEQ ID NO: 1063371 - RNA, 22 nt, Human
caggcagauauguucgcuuuaa

SEQ ID NO: 1063372 - RNA, 22 nt, Human
uugauaaaaugaugaaaucacu

SEQ ID NO: 1063373 - RNA, 20 nt, Human
uuucagugguuugugccuag

SEQ ID NO: 1063374 - RNA, 22 nt, Human
uggggcucaccuaggcuggaag

SEQ ID NO: 1063375 - RNA, 22 nt, Human
uacacauguuuggcaaguaugu

SEQ ID NO: 1063376 - RNA, 22 nt, Human
caggagaaacauaauuuucugg

SEQ ID NO: 1063377 - RNA, 22 nt, Human
ggaaccacagcccccagcaggc

SEQ ID NO: 1063378 - RNA, 23 nt, Human
cuucucagaagucugugccagga

SEQ ID NO: 1063379 - RNA, 20 nt, Human
ucucaggguucagcaaagua

SEQ ID NO: 1063380 - RNA, 21 nt, Human
agaaggcaccagcaaggacug

SEQ ID NO: 1063381 - RNA, 22 nt, Human
cagaggcagaauggagauuugg

SEQ ID NO: 1063382 - RNA, 22 nt, Human
ugcaggcugcaccccugcccug

SEQ ID NO: 1063383 - RNA, 22 nt, Human
cucugggcuuguugaccugcac

SEQ ID NO: 1063384 - RNA, 22 nt, Human
ucuguuuaugugucuaaauaaa

SEQ ID NO: 1063385 - RNA, 19 nt, Human
aaggaacccuggguugcuc

SEQ ID NO: 1063386 - RNA, 22 nt, Human
aguaacaaauagcugccuuuaa

SEQ ID NO: 1063387 - RNA, 22 nt, Human
uuugacaugugcuuauaacuuu

SEQ ID NO: 1063388 - RNA, 22 nt, Human
ucacugggcccugaggugggac

SEQ ID NO: 1063389 - RNA, 20 nt, Human
cccugcagccaugggagugg

SEQ ID NO: 1063390 - RNA, 22 nt, Human
ucacaucugaaaaaauauugag

SEQ ID NO: 1063391 - RNA, 22 nt, Human
gaaucagccugaguuugcagcu

SEQ ID NO: 1063392 - RNA, 22 nt, Human
aagcagaggguauggccagguu

SEQ ID NO: 1063393 - RNA, 22 nt, Human
gccaggcuccaggcccuccuga

SEQ ID NO: 1063394 - RNA, 21 nt, Human
acaguacuugagaucuuuuga

SEQ ID NO: 1063395 - RNA, 22 nt, Human
uugcugaaaacaguggguauug

SEQ ID NO: 1063396 - RNA, 22 nt, Human
uccugggaagagaccugagcau

SEQ ID NO: 1063397 - RNA, 22 nt, Human
ucuggggagucaaagagaccug

SEQ ID NO: 1063398 - RNA, 22 nt, Human
uucuuucugaauacaguugagu

SEQ ID NO: 1063399 - RNA, 22 nt, Human
aucaggaucugggagccugaaa

SEQ ID NO: 1063400 - RNA, 22 nt, Human
ucuccacacuuucucucccagg

SEQ ID NO: 1063401 - RNA, 22 nt, Human
gcugcccugcaucugugccuuc

SEQ ID NO: 1063402 - RNA, 18 nt, Human
uggagcugagugcugugc

SEQ ID NO: 1063403 - RNA, 22 nt, Human
ggccagguggcuguccuggcgu

SEQ ID NO: 1063404 - RNA, 22 nt, Human
gcagaugccugaaggagcuggg

SEQ ID NO: 1063405 - RNA, 20 nt, Human
cuccccucuacagagggcug

SEQ ID NO: 1063406 - RNA, 22 nt, Human
agggagacacaugaggaaguca

SEQ ID NO: 1063407 - RNA, 22 nt, Human
gacagcagggacauguaggaag

SEQ ID NO: 1063408 - RNA, 20 nt, Human
gcugucuggauuagaagccu

SEQ ID NO: 1063409 - RNA, 22 nt, Human
cugagccuugaugucccuuguc

SEQ ID NO: 1063410 - RNA, 22 nt, Human
uggaggaauaacagcaaccuua

SEQ ID NO: 1063411 - RNA, 22 nt, Human
ccagcuccgggaguugcugcug

SEQ ID NO: 1063412 - RNA, 22 nt, Human
ccagaagaggacacagugugga

SEQ ID NO: 1063413 - RNA, 22 nt, Human
ugcuucugaugugagcagcccc

SEQ ID NO: 1063414 - RNA, 22 nt, Human
cauuuuguagcaaugacuguug

SEQ ID NO: 1063415 - RNA, 22 nt, Human
aguucaaacucuauaagaacuu

SEQ ID NO: 1063416 - RNA, 22 nt, Human
ucuacuuucacucauacuuauu

SEQ ID NO: 1063417 - RNA, 22 nt, Human
ugcuccagcgcugccaccaguu

SEQ ID NO: 1063418 - RNA, 22 nt, Human
gaagaccauauucagcaggcau

SEQ ID NO: 1063419 - RNA, 22 nt, Human
uguaauuuccugauguuagaac

SEQ ID NO: 1063420 - RNA, 22 nt, Human
ggaugcuggggaccaaucucug

SEQ ID NO: 1063421 - RNA, 22 nt, Human
cugaagauagugucugaucaug

SEQ ID NO: 1063422 - RNA, 22 nt, Human
ucccagccuggacccugccagu

SEQ ID NO: 1063423 - RNA, 22 nt, Human
agcaggcugggcaauaugggca

SEQ ID NO: 1063424 - RNA, 22 nt, Human
caugaaaaauuuacuguuaaca

SEQ ID NO: 1063425 - RNA, 22 nt, Human
cucaaauagaacugaucuauaa

SEQ ID NO: 1063426 - RNA, 22 nt, Human
gcccugucggaacugcgaccuc

SEQ ID NO: 1063427 - RNA, 22 nt, Human
uaguggaggggaugcaaagcuu

SEQ ID NO: 1063428 - RNA, 22 nt, Human
cuggcuggcaaguagaacacaa

SEQ ID NO: 1063429 - RNA, 22 nt, Human
agcagccauccuuagagaaaga

SEQ ID NO: 1063430 - RNA, 23 nt, Human
ugucacauuuaguuggcauuguu

SEQ ID NO: 1063431 - RNA, 22 nt, Human
ucuccugcuucaacugauggac

SEQ ID NO: 1063432 - RNA, 22 nt, Human
ggaaaugucauagaaauauaag

SEQ ID NO: 1063433 - RNA, 22 nt, Human
ugcccugcuguggcucugccca

SEQ ID NO: 1063434 - RNA, 19 nt, Human
ggcccaaguacugagugcc

SEQ ID NO: 1063435 - RNA, 22 nt, Human
gcugaggcuccucgggaggaca

SEQ ID NO: 1063436 - RNA, 22 nt, Human
cugucuguuuuaccuucuccag

SEQ ID NO: 1063437 - RNA, 22 nt, Human
ccugccuguacuagagacccag

SEQ ID NO: 1063438 - RNA, 18 nt, Human
ugcaggcugggguuccuc

SEQ ID NO: 1063439 - RNA, 22 nt, Human
uccugccuucauacugcuguau

SEQ ID NO: 1063440 - RNA, 22 nt, Human
augggcugggaucugaguguca

SEQ ID NO: 1063441 - RNA, 22 nt, Human
aguuuuucugggaggcacugcu

SEQ ID NO: 1063442 - RNA, 22 nt, Human
aguuguaacagauucuaacaua

SEQ ID NO: 1063443 - RNA, 22 nt, Human
caucauuuuuguaagcugguag

SEQ ID NO: 1063444 - RNA, 22 nt, Human
uagaaucccagccagcuggaag

SEQ ID NO: 1063445 - RNA, 22 nt, Human
uaucuuguuuaggugcacaggu

SEQ ID NO: 1063446 - RNA, 22 nt, Human
gggcugacucaaccuugcaaag

SEQ ID NO: 1063447 - RNA, 22 nt, Human
uccucagucguuugagccaaaa

SEQ ID NO: 1063448 - RNA, 22 nt, Human
auacaucaugcuccauauauuu

SEQ ID NO: 1063449 - RNA, 22 nt, Human
uucaaagauaauuaccaaacau

SEQ ID NO: 1063450 - RNA, 19 nt, Human
gaggaggaaaacuagugua

SEQ ID NO: 1063451 - RNA, 22 nt, Human
uaaguaaauuuauaaugugauu

SEQ ID NO: 1063452 - RNA, 22 nt, Human
ccugcuggcauucuugcucccu

SEQ ID NO: 1063453 - RNA, 22 nt, Human
aucaguuuuguucacuacuaua

SEQ ID NO: 1063454 - RNA, 22 nt, Human
gucacacuagggccaaguggag

SEQ ID NO: 1063455 - RNA, 21 nt, Human
uagagaaaagaagcuguuccu

SEQ ID NO: 1063456 - RNA, 22 nt, Human
ugucauucauuuaaguauguuu

SEQ ID NO: 1063457 - RNA, 22 nt, Human
gucauuauaccauuauaauugu

SEQ ID NO: 1063458 - RNA, 22 nt, Human
acaguguugaggugcuuguuuc

SEQ ID NO: 1063459 - RNA, 22 nt, Human
ccucuucuaggacguccuugug

SEQ ID NO: 1063460 - RNA, 20 nt, Human
gcugggcuuugacugacaca

SEQ ID NO: 1063461 - RNA, 22 nt, Human
aggccagagaggggaccagccu

SEQ ID NO: 1063462 - RNA, 22 nt, Human
ccaggccuguguuguguggagg

SEQ ID NO: 1063463 - RNA, 20 nt, Human
gccagaguuaugaugagagg

SEQ ID NO: 1063464 - RNA, 22 nt, Human
uuuguaacaucccaacaaauuu

SEQ ID NO: 1063465 - RNA, 22 nt, Human
agugccagcuccacacagcagc

SEQ ID NO: 1063466 - RNA, 22 nt, Human
acaguguaauaugggagucagu

SEQ ID NO: 1063467 - RNA, 21 nt, Human
auuucauggugcuuuuaagaa

SEQ ID NO: 1063468 - RNA, 22 nt, Human
gcugcaggcauuuuccugggca

SEQ ID NO: 1063469 - RNA, 22 nt, Human
gcaccugauugauuucacugcu

SEQ ID NO: 1063470 - RNA, 22 nt, Human
uggcagaaguucacuaguagcu

SEQ ID NO: 1063471 - RNA, 22 nt, Human
cuuagaaaucgaacucagguua

SEQ ID NO: 1063472 - RNA, 22 nt, Human
auaacagagagcuacugaacug

SEQ ID NO: 1063473 - RNA, 22 nt, Human
cuuacauacugagaaaauaucc

SEQ ID NO: 1063474 - RNA, 22 nt, Human
uaagaauuguguugaauagagu

SEQ ID NO: 1063475 - RNA, 22 nt, Human
cccucucucaggcugacagccu

SEQ ID NO: 1063476 - RNA, 22 nt, Human
uucuuacauuacuuuacaugug

SEQ ID NO: 1063477 - RNA, 22 nt, Human
uaguggagaggauguggagaaa

SEQ ID NO: 1063478 - RNA, 22 nt, Human
ugguggggccagacuucagcuc

SEQ ID NO: 1063479 - RNA, 22 nt, Human
gaaauacagaaagggcugaaug

SEQ ID NO: 1063480 - RNA, 22 nt, Human
gaaguggaauuacugggucaua

SEQ ID NO: 1063481 - RNA, 22 nt, Human
cacccaggcuggagugcagggg

SEQ ID NO: 1063482 - RNA, 22 nt, Human
ugugagcagagccugacaugag

SEQ ID NO: 1063483 - RNA, 22 nt, Human
ucaaagaugauaggaaaucaua

SEQ ID NO: 1063484 - RNA, 22 nt, Human
uuaaaaccaucagcuguaagau

SEQ ID NO: 1063485 - RNA, 22 nt, Human
gcuccaagguauccaccagggu

SEQ ID NO: 1063486 - RNA, 22 nt, Human
uaucagaaaugccuuaaauugg

SEQ ID NO: 1063487 - RNA, 22 nt, Human
aaauguuagguuguacugaguc

SEQ ID NO: 1063488 - RNA, 22 nt, Human
uccucugccccagaugaaauuu

SEQ ID NO: 1063489 - RNA, 22 nt, Human
aagcuggccuguaccugcugag

SEQ ID NO: 1063490 - RNA, 22 nt, Human
aggggcaguuccaaguuuugug

SEQ ID NO: 1063491 - RNA, 18 nt, Human
agaacacuugguuagauc

SEQ ID NO: 1063492 - RNA, 22 nt, Human
ugaggggagguuggggcacauc

SEQ ID NO: 1063493 - RNA, 22 nt, Human
agcuggccuuagugagcaccug

SEQ ID NO: 1063494 - RNA, 22 nt, Human
ggcagaggaagcuggaaguggg

SEQ ID NO: 1063495 - RNA, 22 nt, Human
ggugaagccagggcaucaauau

SEQ ID NO: 1063496 - RNA, 22 nt, Human
aaucagcagaagagaggucuua

SEQ ID NO: 1063497 - RNA, 22 nt, Human
ggccuguccagccugccuggcu

SEQ ID NO: 1063498 - RNA, 22 nt, Human
ccacaggggcccacgagccgcu

SEQ ID NO: 1063499 - RNA, 22 nt, Human
aucagaaauugcccagcuguuu

SEQ ID NO: 1063500 - RNA, 22 nt, Human
ggcaggguguggaguugggaca

SEQ ID NO: 1063501 - RNA, 22 nt, Human
uucuuuuccuacacagcgauuu

SEQ ID NO: 1063502 - RNA, 22 nt, Human
cucacuggcaagacuacaggug

SEQ ID NO: 1063503 - RNA, 22 nt, Human
uuuccucuaaacgcauuugcuu

SEQ ID NO: 1063504 - RNA, 22 nt, Human
uacuuugaauuaaauauuucag

SEQ ID NO: 1063505 - RNA, 18 nt, Human
aauguuuguccucucuaa

SEQ ID NO: 1063506 - RNA, 22 nt, Human
caggcacaguuccaagcauuuu

SEQ ID NO: 1063507 - RNA, 22 nt, Human
ccagcuggaagagugcagaacu

SEQ ID NO: 1063508 - RNA, 22 nt, Human
uuuguacauauaaaucuuguau

SEQ ID NO: 1063509 - RNA, 22 nt, Human
aacaaguuacucuuaaaguaua

SEQ ID NO: 1063510 - RNA, 22 nt, Human
uaaagcagugcaaaagcguuuu

SEQ ID NO: 1063511 - RNA, 22 nt, Human
agcuuugugacuuugagcuagu

SEQ ID NO: 1063512 - RNA, 22 nt, Human
caggggacauuaaagcuccaua

SEQ ID NO: 1063513 - RNA, 22 nt, Human
aggcucagucccggcccgcgcc

SEQ ID NO: 1063514 - RNA, 22 nt, Human
caggaacccccacucucagcuc

SEQ ID NO: 1063515 - RNA, 22 nt, Human
gacccugauaggaguagaagaa

SEQ ID NO: 1063516 - RNA, 22 nt, Human
cagggacaaggaauaagauuag

SEQ ID NO: 1063517 - RNA, 22 nt, Human
cugcuuuaaguauucaacaaag

SEQ ID NO: 1063518 - RNA, 22 nt, Human
auguuuaaggaacugguuugcu

SEQ ID NO: 1063519 - RNA, 22 nt, Human
uuuccuuugggcacccgagcuc

SEQ ID NO: 1063520 - RNA, 22 nt, Human
gccugcccugaaagaggugaag

SEQ ID NO: 1063521 - RNA, 22 nt, Human
ucucuguggugggaggcugagu

SEQ ID NO: 1063522 - RNA, 22 nt, Human
agcuugaguuuuggaugaagug

SEQ ID NO: 1063523 - RNA, 22 nt, Human
acauauguguuguacaugcaug

SEQ ID NO: 1063524 - RNA, 22 nt, Human
aaacaaccuaaaguuacugauc

SEQ ID NO: 1063525 - RNA, 22 nt, Human
uggcucaguuugggggauugaa

SEQ ID NO: 1063526 - RNA, 22 nt, Human
uccugugauggcuugcgaugug

SEQ ID NO: 1063527 - RNA, 22 nt, Human
aaugaagaaauggacaucuuua

SEQ ID NO: 1063528 - RNA, 22 nt, Human
aggagcugcuuaaaugguuggu

SEQ ID NO: 1063529 - RNA, 19 nt, Human
uuucccagcccuugcugug

SEQ ID NO: 1063530 - RNA, 20 nt, Human
agguggcuccugcugggggu

SEQ ID NO: 1063531 - RNA, 22 nt, Human
uuuucuucuaccugcuguccaa

SEQ ID NO: 1063532 - RNA, 22 nt, Human
cugcuuuagugugguguuagag

SEQ ID NO: 1063533 - RNA, 22 nt, Human
cacuuguagaggcauuauucca

SEQ ID NO: 1063534 - RNA, 22 nt, Human
ugaaaguucaauaccaauuugg

SEQ ID NO: 1063535 - RNA, 22 nt, Human
gggcucuguccauuccuucaua

SEQ ID NO: 1063536 - RNA, 22 nt, Human
auuugugggacuauaaugcagg

SEQ ID NO: 1063537 - RNA, 22 nt, Human
ccaggcaauucugaaagcauuu

SEQ ID NO: 1063538 - RNA, 22 nt, Human
agaugaaaagauaagcagcaau

SEQ ID NO: 1063539 - RNA, 22 nt, Human
ucagcucuguguacaguuagca

SEQ ID NO: 1063540 - RNA, 22 nt, Human
gcuguucuagcuucaguuucgc

SEQ ID NO: 1063541 - RNA, 22 nt, Human
aaauacauaaagguuguaccag

SEQ ID NO: 1063542 - RNA, 22 nt, Human
ggccugaggcgucccagcugug

SEQ ID NO: 1063543 - RNA, 22 nt, Human
agggaccugcucacugccuggc

SEQ ID NO: 1063544 - RNA, 22 nt, Human
uuagccauuuuauacaagugua

SEQ ID NO: 1063545 - RNA, 20 nt, Human
uccuugaaagugggguauau

SEQ ID NO: 1063546 - RNA, 22 nt, Human
ucuuucuugugggugcccuuuu

SEQ ID NO: 1063547 - RNA, 22 nt, Human
acuuccagccccugucagcaaa

SEQ ID NO: 1063548 - RNA, 22 nt, Human
gggaguggagagcaauggauga

SEQ ID NO: 1063549 - RNA, 22 nt, Human
agugcagggggaaagggugucu

SEQ ID NO: 1063550 - RNA, 22 nt, Human
aacaaaguagcugcuguucuua

SEQ ID NO: 1063551 - RNA, 22 nt, Human
acacuauaagacagauacagca

SEQ ID NO: 1063552 - RNA, 22 nt, Human
gggcaggugccagcucccuguc

SEQ ID NO: 1063553 - RNA, 22 nt, Human
ugcugccuuagcagccaggcaa

SEQ ID NO: 1063554 - RNA, 19 nt, Human
gagaggccugugcuugaag

SEQ ID NO: 1063555 - RNA, 22 nt, Human
aucaguuugagugcugugucaa

SEQ ID NO: 1063556 - RNA, 22 nt, Human
augcccugggagugcuguacca

SEQ ID NO: 1063557 - RNA, 22 nt, Human
cuuuaucauggagguaaauaug

SEQ ID NO: 1063558 - RNA, 22 nt, Human
uguuacaguacuacaauucugc

SEQ ID NO: 1063559 - RNA, 21 nt, Human
gccagccuguuuaccuguggu

SEQ ID NO: 1063560 - RNA, 22 nt, Human
auauucuuccaaaacaucauuu

SEQ ID NO: 1063561 - RNA, 22 nt, Human
ugaaggcauugaugaaggaauc

SEQ ID NO: 1063562 - RNA, 23 nt, Human
gccucugcagccuaguuaguguc

SEQ ID NO: 1063563 - RNA, 22 nt, Human
gccacccugagcugggccaggg

SEQ ID NO: 1063564 - RNA, 22 nt, Human
aaguugagaugucauaggagac

SEQ ID NO: 1063565 - RNA, 22 nt, Human
gugcccuggagggguugaaggg

SEQ ID NO: 1063566 - RNA, 22 nt, Human
uaaaugucaaugugauuuauaa

SEQ ID NO: 1063567 - RNA, 22 nt, Human
ugaagcugugggcaguggagcc

SEQ ID NO: 1063568 - RNA, 22 nt, Human
agagagaacacccucggcaugg

SEQ ID NO: 1063569 - RNA, 22 nt, Human
gaguggguccacagaggugaca

SEQ ID NO: 1063570 - RNA, 22 nt, Human
agaaugcauuuuguguagcuau

SEQ ID NO: 1063571 - RNA, 19 nt, Human
gcagagugggguggagggu

SEQ ID NO: 1063572 - RNA, 22 nt, Human
aaccaggaaaaguuaugaauag

SEQ ID NO: 1063573 - RNA, 22 nt, Human
uaauauacuucccauaguuuga

SEQ ID NO: 1063574 - RNA, 22 nt, Human
acucuucagggcagugagcggg

SEQ ID NO: 1063575 - RNA, 21 nt, Human
uugcaacaaccuauauauuuu

SEQ ID NO: 1063576 - RNA, 22 nt, Human
aauccagguggcggagguugug

SEQ ID NO: 1063577 - RNA, 22 nt, Human
ucagaggauugccucagcgagc

SEQ ID NO: 1063578 - RNA, 22 nt, Human
uucacagaauggcaaguuaugg

SEQ ID NO: 1063579 - RNA, 22 nt, Human
cagugcagacguggagggggca

SEQ ID NO: 1063580 - RNA, 22 nt, Human
guguccagagaaacucacagcu

SEQ ID NO: 1063581 - RNA, 22 nt, Human
cagcacugcugcuguacacaca

SEQ ID NO: 1063582 - RNA, 22 nt, Human
aagugauucauugaugaugagg

SEQ ID NO: 1063583 - RNA, 22 nt, Human
caguggaagcuggcugugaaga

SEQ ID NO: 1063584 - RNA, 22 nt, Human
ucuaaaaugcagaucuacuggu

SEQ ID NO: 1063585 - RNA, 22 nt, Human
uucaaagauuagcauacgcaau

SEQ ID NO: 1063586 - RNA, 22 nt, Human
uuucacaaucaaauggugaaau

SEQ ID NO: 1063587 - RNA, 22 nt, Human
aggugcagaaaaaaguccuuua

SEQ ID NO: 1063588 - RNA, 20 nt, Human
ugucauuuauuuaucaaaug

SEQ ID NO: 1063589 - RNA, 22 nt, Human
ccagcuggagccaagguggacu

SEQ ID NO: 1063590 - RNA, 17 nt, Human
aauagcugcucagagag

SEQ ID NO: 1063591 - RNA, 23 nt, Human
cagggcccugcucaauuucucca

SEQ ID NO: 1063592 - RNA, 22 nt, Human
uuucccaggcccucagggcugc

SEQ ID NO: 1063593 - RNA, 21 nt, Human
uuacaaagcuacagauguugc

SEQ ID NO: 1063594 - RNA, 22 nt, Human
ggcuggcucagggcuugagaga

SEQ ID NO: 1063595 - RNA, 22 nt, Human
auuuauuauugugguuacuucu

SEQ ID NO: 1063596 - RNA, 22 nt, Human
acacaguaaauauguauugaau

SEQ ID NO: 1063597 - RNA, 22 nt, Human
agccugugacauugacuaugaa

SEQ ID NO: 1063598 - RNA, 22 nt, Human
caagcagagaggucaacuaaua

SEQ ID NO: 1063599 - RNA, 22 nt, Human
aagggcuggagacugggucuuc

SEQ ID NO: 1063600 - RNA, 22 nt, Human
ggaagaggcugagccagguccc

SEQ ID NO: 1063601 - RNA, 22 nt, Human
aguucccaggugaugcugaugu

SEQ ID NO: 1063602 - RNA, 22 nt, Human
ccugccagcccgcguucaugcc

SEQ ID NO: 1063603 - RNA, 22 nt, Human
uguguuccugccuggcucuggu

SEQ ID NO: 1063604 - RNA, 22 nt, Human
uuaucuagauguguuaucagac

SEQ ID NO: 1063605 - RNA, 22 nt, Human
cugagcaguagagggucucuuu

SEQ ID NO: 1063606 - RNA, 22 nt, Human
gaucaacauguauuuaagaguu

SEQ ID NO: 1063607 - RNA, 22 nt, Human
aagugcuaggauuacaggugug

SEQ ID NO: 1063608 - RNA, 22 nt, Human
ggugccagccuagugcaguggu

SEQ ID NO: 1063609 - RNA, 22 nt, Human
aguguauuugccuauaaaaaug

SEQ ID NO: 1063610 - RNA, 22 nt, Human
aaagaggaaccaagagcacgug

SEQ ID NO: 1063611 - RNA, 22 nt, Human
ggaggaccugcuggcccugcaa

SEQ ID NO: 1063612 - RNA, 22 nt, Human
gcagagccugugucugagcaaa

SEQ ID NO: 1063613 - RNA, 22 nt, Human
gcuccugucuuggggcacuggc

SEQ ID NO: 1063614 - RNA, 22 nt, Human
aaaguuuucugccuucauuaga

SEQ ID NO: 1063615 - RNA, 22 nt, Human
cugggcucugcggugucgcucu

SEQ ID NO: 1063616 - RNA, 22 nt, Human
agugucugcuuaucaguucuug

SEQ ID NO: 1063617 - RNA, 22 nt, Human
ugagagucuguuccucuugcag

SEQ ID NO: 1063618 - RNA, 22 nt, Human
uaaacaucaggaaugaaaaccu

SEQ ID NO: 1063619 - RNA, 22 nt, Human
cuguacucaagguaaaccagga

SEQ ID NO: 1063620 - RNA, 22 nt, Human
ucaggcaguagaauugcuugaa

SEQ ID NO: 1063621 - RNA, 22 nt, Human
uaccauuucaguaaaaacuuag

SEQ ID NO: 1063622 - RNA, 22 nt, Human
aaaggucaagcuggacucaggu

SEQ ID NO: 1063623 - RNA, 22 nt, Human
gacacagaauuccccuccaagu

SEQ ID NO: 1063624 - RNA, 22 nt, Human
ucagagugggagaaugugccaa

SEQ ID NO: 1063625 - RNA, 20 nt, Human
ccugucugcaauggagguca

SEQ ID NO: 1063626 - RNA, 22 nt, Human
ugaaggaauggaggaucagagc

SEQ ID NO: 1063627 - RNA, 22 nt, Human
ucucuggccccauggcugagcu

SEQ ID NO: 1063628 - RNA, 22 nt, Human
acacaguaccccaaggcugggc

SEQ ID NO: 1063629 - RNA, 22 nt, Human
accugcuuuguaguguuugcug

SEQ ID NO: 1063630 - RNA, 22 nt, Human
ucaaagucucugcuucuguaac

SEQ ID NO: 1063631 - RNA, 22 nt, Human
uggcugagggggcaguucagga

SEQ ID NO: 1063632 - RNA, 22 nt, Human
ggcagaagauaggacagggaau

SEQ ID NO: 1063633 - RNA, 22 nt, Human
uagcagaaacuguuacagaagg

SEQ ID NO: 1063634 - RNA, 22 nt, Human
uaggccaguggcagguugugug

SEQ ID NO: 1063635 - RNA, 22 nt, Human
uccugagaaggcacagcuugca

SEQ ID NO: 1063636 - RNA, 21 nt, Human
agggucaggaaccaggguacc

SEQ ID NO: 1063637 - RNA, 22 nt, Human
aaauguauccuacuuccugagu

SEQ ID NO: 1063638 - RNA, 22 nt, Human
ggcuagaauaauugacuucauu

SEQ ID NO: 1063639 - RNA, 22 nt, Human
uugaagagugccuuccagacau

SEQ ID NO: 1063640 - RNA, 22 nt, Human
uggucacaguguauugaucagg

SEQ ID NO: 1063641 - RNA, 22 nt, Human
agaaguaggcagggcuguauca

SEQ ID NO: 1063642 - RNA, 22 nt, Human
gcuguucugcaccagacuucag

SEQ ID NO: 1063643 - RNA, 22 nt, Human
auuauccaacacccaguuacau

SEQ ID NO: 1063644 - RNA, 22 nt, Human
uggcagcuacagacagagguga

SEQ ID NO: 1063645 - RNA, 22 nt, Human
cacauugcagcuucuuuuggcu

SEQ ID NO: 1063646 - RNA, 22 nt, Human
ggaggaaggguagcauaaugua

SEQ ID NO: 1063647 - RNA, 22 nt, Human
gccagguguccucacagugagg

SEQ ID NO: 1063648 - RNA, 20 nt, Human
cugggcugcccagcuauggg

SEQ ID NO: 1063649 - RNA, 22 nt, Human
uggaugaaaaaugagaauuuuc

SEQ ID NO: 1063650 - RNA, 22 nt, Human
gaccauuugcuaguaaauugca

SEQ ID NO: 1063651 - RNA, 22 nt, Human
aagaaacaaccacugcucuccu

SEQ ID NO: 1063652 - RNA, 22 nt, Human
gaggagagaugguagauugggu

SEQ ID NO: 1063653 - RNA, 22 nt, Human
caugcagugccucuggauucuu

SEQ ID NO: 1063654 - RNA, 22 nt, Human
aaaucaugguggaagaaacaga

SEQ ID NO: 1063655 - RNA, 22 nt, Human
uuuuaaaggauagcucugguug

SEQ ID NO: 1063656 - RNA, 22 nt, Human
agucaguguagaaagcccaggc

SEQ ID NO: 1063657 - RNA, 22 nt, Human
cuggcaggcagacuucugcaag

SEQ ID NO: 1063658 - RNA, 22 nt, Human
aggcagagcugauguucuguga

SEQ ID NO: 1063659 - RNA, 22 nt, Human
gcugccugcucggcuccuggga

SEQ ID NO: 1063660 - RNA, 22 nt, Human
agaugcauguuuaugucuuucc

SEQ ID NO: 1063661 - RNA, 22 nt, Human
ugauuuucaugggugaucuuug

SEQ ID NO: 1063662 - RNA, 22 nt, Human
gaaaagaacugcaugggauuaa

SEQ ID NO: 1063663 - RNA, 19 nt, Human
gggcucucgagcaaccaac

SEQ ID NO: 1063664 - RNA, 22 nt, Human
uauagcaagcaggacagucuca

SEQ ID NO: 1063665 - RNA, 22 nt, Human
gucaggauuggggucaugaguc

SEQ ID NO: 1063666 - RNA, 22 nt, Human
agugggggcagagccucucucg

SEQ ID NO: 1063667 - RNA, 22 nt, Human
gaaugaaagauuugcauucuau

SEQ ID NO: 1063668 - RNA, 22 nt, Human
uacaauagggcuuuuguuuaug

SEQ ID NO: 1063669 - RNA, 22 nt, Human
ugagccccggaguuucaggcug

SEQ ID NO: 1063670 - RNA, 22 nt, Human
auguaaaguaucugaaaugcug

SEQ ID NO: 1063671 - RNA, 22 nt, Human
aguggggagguccaggccaccc

SEQ ID NO: 1063672 - RNA, 22 nt, Human
accaaaggcagagcugaacacu

SEQ ID NO: 1063673 - RNA, 22 nt, Human
agucucugucguagaucagcgu

SEQ ID NO: 1063674 - RNA, 22 nt, Human
ggagagugggagcaacuguugc

SEQ ID NO: 1063675 - RNA, 22 nt, Human
aaauggauggaauugacauuua

SEQ ID NO: 1063676 - RNA, 22 nt, Human
acuaaagaugucuaaauauauu

SEQ ID NO: 1063677 - RNA, 22 nt, Human
ggggccuuggaucugugccccg

SEQ ID NO: 1063678 - RNA, 22 nt, Human
aggguagggccguagggccaug

SEQ ID NO: 1063679 - RNA, 22 nt, Human
agcagagccaggucucucugua

SEQ ID NO: 1063680 - RNA, 22 nt, Human
uuucuggaaccacaaaaguaug

SEQ ID NO: 1063681 - RNA, 22 nt, Human
agugcuuugugcucucacugca

SEQ ID NO: 1063682 - RNA, 22 nt, Human
cagagccccucagcucucuccc

SEQ ID NO: 1063683 - RNA, 22 nt, Human
gcagggccuuggucaucuuuuu

SEQ ID NO: 1063684 - RNA, 22 nt, Human
aaacauguagugcaugaggauc

SEQ ID NO: 1063685 - RNA, 22 nt, Human
aaggcacugcuuugcugcgccc

SEQ ID NO: 1063686 - RNA, 22 nt, Human
uaucuguuggcuccuaguugua

SEQ ID NO: 1063687 - RNA, 22 nt, Human
acauacacaugaauauauuuuu

SEQ ID NO: 1063688 - RNA, 22 nt, Human
aacaugcuggguguuuuugaug

SEQ ID NO: 1063689 - RNA, 22 nt, Human
gcugguuuccuuaucuauaaag

SEQ ID NO: 1063690 - RNA, 22 nt, Human
guuauuuuaacuucucaguaau

SEQ ID NO: 1063691 - RNA, 22 nt, Human
ucuggcuccacucugugcaugc

SEQ ID NO: 1063692 - RNA, 22 nt, Human
uguuuuuuuauauaccugaagu

SEQ ID NO: 1063693 - RNA, 22 nt, Human
uucaagaaagaguggcuauucc

SEQ ID NO: 1063694 - RNA, 22 nt, Human
cuauuuuaagaggccauuaggu

SEQ ID NO: 1063695 - RNA, 22 nt, Human
acaaugaguuugauguaguuug

SEQ ID NO: 1063696 - RNA, 22 nt, Human
caggcacucauucagagaggug

SEQ ID NO: 1063697 - RNA, 22 nt, Human
uccucaggcggugaggaggggc

SEQ ID NO: 1063698 - RNA, 22 nt, Human
acacauuaucucauuaaauacu

SEQ ID NO: 1063699 - RNA, 22 nt, Human
cagugcccaagaugugccaugc

SEQ ID NO: 1063700 - RNA, 22 nt, Human
acagccaggaauucuggagaag

SEQ ID NO: 1063701 - RNA, 22 nt, Human
cugggccugggaggccaggucu

SEQ ID NO: 1063702 - RNA, 22 nt, Human
ucaacacuauccaggcaaucuu

SEQ ID NO: 1063703 - RNA, 22 nt, Human
cuccccagguucaggagguggg

SEQ ID NO: 1063704 - RNA, 22 nt, Human
ucuuagcacagcuauauaaguu

SEQ ID NO: 1063705 - RNA, 22 nt, Human
ugguaauuuacgcauuucugua

SEQ ID NO: 1063706 - RNA, 22 nt, Human
ggccucucuggcauggcugccc

SEQ ID NO: 1063707 - RNA, 22 nt, Human
uacaaaguauauuucuagcugu

SEQ ID NO: 1063708 - RNA, 22 nt, Human
ugucuuaauaguauccagguuc

SEQ ID NO: 1063709 - RNA, 16 nt, Human
acuuccaggggagccc

SEQ ID NO: 1063710 - RNA, 21 nt, Human
uccaggaaugucuguucaucu

SEQ ID NO: 1063711 - RNA, 22 nt, Human
uucaauucaauucuaaauauau

SEQ ID NO: 1063712 - RNA, 22 nt, Human
cacucucacaugcccugucagu

SEQ ID NO: 1063713 - RNA, 22 nt, Human
uugauacaggcucuauuucauc

SEQ ID NO: 1063714 - RNA, 22 nt, Human
gcagccugaugaucuggguugu

SEQ ID NO: 1063715 - RNA, 22 nt, Human
caggaugggugucggccagcac

SEQ ID NO: 1063716 - RNA, 22 nt, Human
cuucucuguguagagauucaga

SEQ ID NO: 1063717 - RNA, 22 nt, Human
uuguaaacaucuguugcuuaga

SEQ ID NO: 1063718 - RNA, 22 nt, Human
acuuuucuaagcaauggucuug

SEQ ID NO: 1063719 - RNA, 22 nt, Human
ggagggcucaauugacuccuga

SEQ ID NO: 1063720 - RNA, 22 nt, Human
gcugggcaaugccagagaggag

SEQ ID NO: 1063721 - RNA, 22 nt, Human
caaauacuaaacauaagauuuu

SEQ ID NO: 1063722 - RNA, 19 nt, Human
cuuuuucaccuucuagaag

SEQ ID NO: 1063723 - RNA, 22 nt, Human
agcagcagcucauucuuccugu

SEQ ID NO: 1063724 - RNA, 22 nt, Human
uggccuguggcuuaaggucugu

SEQ ID NO: 1063725 - RNA, 22 nt, Human
acagaggcagugugagauacug

SEQ ID NO: 1063726 - RNA, 22 nt, Human
uaagacuuccaggaaaaggugg

SEQ ID NO: 1063727 - RNA, 21 nt, Human
ccuggcacuggccugcugagc

SEQ ID NO: 1063728 - RNA, 22 nt, Human
gugagaguguuuggaaauagaa

SEQ ID NO: 1063729 - RNA, 22 nt, Human
auucucugugcagauuuaagac

SEQ ID NO: 1063730 - RNA, 22 nt, Human
aaggccuggauuuagguuguga

SEQ ID NO: 1063731 - RNA, 22 nt, Human
uuauguaauuuguuugcucuuc

SEQ ID NO: 1063732 - RNA, 22 nt, Human
agcaggugggcaugaaagcuga

SEQ ID NO: 1063733 - RNA, 22 nt, Human
cuggugggaagauggaaaacau

SEQ ID NO: 1063734 - RNA, 22 nt, Human
ccuggagcuuuuccauccugga

SEQ ID NO: 1063735 - RNA, 22 nt, Human
gugccagggggcacugaacaga

SEQ ID NO: 1063736 - RNA, 22 nt, Human
guccucuguuuccaucugacuu

SEQ ID NO: 1063737 - RNA, 22 nt, Human
uuuuacuucauuccugacuuca

SEQ ID NO: 1063738 - RNA, 19 nt, Human
caggaugaucccaugacac

SEQ ID NO: 1063739 - RNA, 22 nt, Human
cugggcuugaguuccugcucgu

SEQ ID NO: 1063740 - RNA, 23 nt, Human
gccaggcuccggucuguggccac

SEQ ID NO: 1063741 - RNA, 22 nt, Human
ugcaauauguugcauuguaugg

SEQ ID NO: 1063742 - RNA, 22 nt, Human
uugaagcauuugcuauagcauu

SEQ ID NO: 1063743 - RNA, 22 nt, Human
ggccucucuccagucagugcag

SEQ ID NO: 1063744 - RNA, 22 nt, Human
uuucaagaacagcagcauucca

SEQ ID NO: 1063745 - RNA, 22 nt, Human
caccaggugcuggaggacauca

SEQ ID NO: 1063746 - RNA, 22 nt, Human
agugucaaugcucuguuaaaaa

SEQ ID NO: 1063747 - RNA, 21 nt, Human
uuuuaacaaggauuucccuag

SEQ ID NO: 1063748 - RNA, 22 nt, Human
cagugcugagagccuggccagg

SEQ ID NO: 1063749 - RNA, 22 nt, Human
ccccagccuuccaugggaauug

SEQ ID NO: 1063750 - RNA, 22 nt, Human
agggccugggccagcacccuuu

SEQ ID NO: 1063751 - RNA, 22 nt, Human
aguugcagacgcagagauguug

SEQ ID NO: 1063752 - RNA, 22 nt, Human
gcugcucuggcucugcaguguc

SEQ ID NO: 1063753 - RNA, 22 nt, Human
ucagagucuaugcaacagaauu

SEQ ID NO: 1063754 - RNA, 23 nt, Human
acagacauuccauaauguacacc

SEQ ID NO: 1063755 - RNA, 22 nt, Human
uuagauaauguagagauaugag

SEQ ID NO: 1063756 - RNA, 22 nt, Human
uucaguuuccacuuacauuuaa

SEQ ID NO: 1063757 - RNA, 22 nt, Human
uuaagcauggaagugaaauaau

SEQ ID NO: 1063758 - RNA, 18 nt, Human
ccuggcuuccaucuuggu

SEQ ID NO: 1063759 - RNA, 22 nt, Human
uuuuuaucuuguaugugucucu

SEQ ID NO: 1063760 - RNA, 22 nt, Human
uugccugugucagcagguggaa

SEQ ID NO: 1063761 - RNA, 22 nt, Human
acaaagugaaaagcaucgaauu

SEQ ID NO: 1063762 - RNA, 22 nt, Human
uaaauucugaucaaguuccuuc

SEQ ID NO: 1063763 - RNA, 22 nt, Human
guucaugcuacccuuuccuaau

SEQ ID NO: 1063764 - RNA, 22 nt, Human
ucuuaguuguuugcugucuaac

SEQ ID NO: 1063765 - RNA, 22 nt, Human
aggaaagaaguacauucucaug

SEQ ID NO: 1063766 - RNA, 22 nt, Human
cgcaggugaacuguucugcagu

SEQ ID NO: 1063767 - RNA, 22 nt, Human
uauuuggagauaagggcuuuaa

SEQ ID NO: 1063768 - RNA, 22 nt, Human
ggagcagagcugggcuuggcug

SEQ ID NO: 1063769 - RNA, 22 nt, Human
cuggggaaggcggugacugcgc

SEQ ID NO: 1063770 - RNA, 22 nt, Human
ggcucccugccuguccucaguc

SEQ ID NO: 1063771 - RNA, 22 nt, Human
uguacacaauucuuaacauaca

SEQ ID NO: 1063772 - RNA, 22 nt, Human
aaggagaauuuggcuugugaug

SEQ ID NO: 1063773 - RNA, 22 nt, Human
ugaagauuuuguagcuuucagc

SEQ ID NO: 1063774 - RNA, 22 nt, Human
ucauauauuuuggcagugauca

SEQ ID NO: 1063775 - RNA, 22 nt, Human
gcccaggauggagaauaguggu

SEQ ID NO: 1063776 - RNA, 22 nt, Human
ucuguuuuggucaccuuuauau

SEQ ID NO: 1063777 - RNA, 22 nt, Human
gcugugagggcuucugaggcau

SEQ ID NO: 1063778 - RNA, 22 nt, Human
gugggccugaugcugccaugag

SEQ ID NO: 1063779 - RNA, 22 nt, Human
cuggggggcuacugacagagga

SEQ ID NO: 1063780 - RNA, 22 nt, Human
ucaggcugugggcacuggccau

SEQ ID NO: 1063781 - RNA, 17 nt, Human
cugaggggagugcugug

SEQ ID NO: 1063782 - RNA, 22 nt, Human
aaacucuaaucaaauauagcau

SEQ ID NO: 1063783 - RNA, 18 nt, Human
guucaaggucaagagaga

SEQ ID NO: 1063784 - RNA, 23 nt, Human
auuccugaggcuccuuaugcacc

SEQ ID NO: 1063785 - RNA, 22 nt, Human
cugccuccugccgugcagcuuc

SEQ ID NO: 1063786 - RNA, 22 nt, Human
aggauuucccauauagcuccau

SEQ ID NO: 1063787 - RNA, 22 nt, Human
ccugucuguucugacuggucag

SEQ ID NO: 1063788 - RNA, 20 nt, Human
gacaucauguacacauugcc

SEQ ID NO: 1063789 - RNA, 22 nt, Human
uaaggcagugagaagaaacagg

SEQ ID NO: 1063790 - RNA, 22 nt, Human
ugggcagagaguagaggcaacg

SEQ ID NO: 1063791 - RNA, 22 nt, Human
uuagugucuuucaaaagguuua

SEQ ID NO: 1063792 - RNA, 22 nt, Human
agcagagucugugugcacuuua

SEQ ID NO: 1063793 - RNA, 22 nt, Human
cucagaaucugccaaguucagg

SEQ ID NO: 1063794 - RNA, 20 nt, Human
aaagauacuuuuuguaaugg

SEQ ID NO: 1063795 - RNA, 22 nt, Human
agagaagggccuguauguaauc

SEQ ID NO: 1063796 - RNA, 22 nt, Human
cuucagaacuauaaaaaguacu

SEQ ID NO: 1063797 - RNA, 18 nt, Human
ggccucagccuggccgga

SEQ ID NO: 1063798 - RNA, 22 nt, Human
uagaaacagaauaugagugaga

SEQ ID NO: 1063799 - RNA, 22 nt, Human
uuugaagucaggcuuucuaccc

SEQ ID NO: 1063800 - RNA, 20 nt, Human
aauguauuguuuuguuucag

SEQ ID NO: 1063801 - RNA, 22 nt, Human
ggcaggugcucugugggccugg

SEQ ID NO: 1063802 - RNA, 22 nt, Human
gaaaugcauaaucuuaguagau

SEQ ID NO: 1063803 - RNA, 22 nt, Human
ugggccagcugaagugccgccc

SEQ ID NO: 1063804 - RNA, 22 nt, Human
uccuuuguugagauaaauuggg

SEQ ID NO: 1063805 - RNA, 22 nt, Human
ugucaauaguuuugaguucucu

SEQ ID NO: 1063806 - RNA, 22 nt, Human
cuguuuucccuggaguucagca

SEQ ID NO: 1063807 - RNA, 22 nt, Human
guggcugcagagccagcaagcu

SEQ ID NO: 1063808 - RNA, 22 nt, Human
ccugacgaaaggcgugcuggag

SEQ ID NO: 1063809 - RNA, 22 nt, Human
agcugccaaguuggaguagcaa

SEQ ID NO: 1063810 - RNA, 22 nt, Human
ugucauuuccugaaugcugagu

SEQ ID NO: 1063811 - RNA, 22 nt, Human
acaagcuguggugggacaagag

SEQ ID NO: 1063812 - RNA, 22 nt, Human
auauuucuccaaauguuuucaa

SEQ ID NO: 1063813 - RNA, 22 nt, Human
uaagaauaguguuugccuuugg

SEQ ID NO: 1063814 - RNA, 22 nt, Human
aagaaagugcuuuguaaauuau

SEQ ID NO: 1063815 - RNA, 22 nt, Human
agacagcaauaugggagacgga

SEQ ID NO: 1063816 - RNA, 22 nt, Human
caacuacauccacacuuuguua

SEQ ID NO: 1063817 - RNA, 22 nt, Human
cacccacauggaaauucacagu

SEQ ID NO: 1063818 - RNA, 22 nt, Human
gaaaggaaauauucuaagcacu

SEQ ID NO: 1063819 - RNA, 22 nt, Human
ggcccaaacggguccagugaaa

SEQ ID NO: 1063820 - RNA, 22 nt, Human
gagaugcuuuguguauagacaa

SEQ ID NO: 1063821 - RNA, 22 nt, Human
acagccagaggugguccugggu

SEQ ID NO: 1063822 - RNA, 22 nt, Human
ccuuuucuggccaccaagcgcu

SEQ ID NO: 1063823 - RNA, 20 nt, Human
ccaggcacugucccaugcag

SEQ ID NO: 1063824 - RNA, 22 nt, Human
aucagaaauagucauguuacuu

SEQ ID NO: 1063825 - RNA, 22 nt, Human
acauuugugcacaugugcaugg

SEQ ID NO: 1063826 - RNA, 20 nt, Human
uuuuuccuucucuacaggca

SEQ ID NO: 1063827 - RNA, 22 nt, Human
agcaccugcuaugugucaggga

SEQ ID NO: 1063828 - RNA, 20 nt, Human
ugcacacagaaauuugcauu

SEQ ID NO: 1063829 - RNA, 22 nt, Human
ugucaacacaccuaucucaauu

SEQ ID NO: 1063830 - RNA, 21 nt, Human
ggcagccugacccccagagag

SEQ ID NO: 1063831 - RNA, 22 nt, Human
aagccaugguagaaaacucagu

SEQ ID NO: 1063832 - RNA, 22 nt, Human
cauacagaaaauauauuuugau

SEQ ID NO: 1063833 - RNA, 22 nt, Human
aggcacuguucccaguuauccu

SEQ ID NO: 1063834 - RNA, 22 nt, Human
cauccacuagaaugacagaguu

SEQ ID NO: 1063835 - RNA, 22 nt, Human
uuuacaauugguuuucucuaau

SEQ ID NO: 1063836 - RNA, 18 nt, Human
aacaguuuccagauucuc

SEQ ID NO: 1063837 - RNA, 22 nt, Human
gaggggcagagguagagaacaa

SEQ ID NO: 1063838 - RNA, 22 nt, Human
cagaaggcauagaugaaggccu

SEQ ID NO: 1063839 - RNA, 22 nt, Human
ugggggacugcacuggcgucag

SEQ ID NO: 1063840 - RNA, 22 nt, Human
cauugcacuccaucuugggcaa

SEQ ID NO: 1063841 - RNA, 22 nt, Human
agggucaguucugugagguguu

SEQ ID NO: 1063842 - RNA, 22 nt, Human
cauuccuacaugauaagaauua

SEQ ID NO: 1063843 - RNA, 22 nt, Human
uggcauuuuccaaugauauguu

SEQ ID NO: 1063844 - RNA, 22 nt, Human
aaccucaggcucucuggacaau

SEQ ID NO: 1063845 - RNA, 22 nt, Human
ucaaacauaucugauuuuccau

SEQ ID NO: 1063846 - RNA, 23 nt, Human
cuccucguaacucuguggugggu

SEQ ID NO: 1063847 - RNA, 22 nt, Human
aaugaaugaaccacauauaaca

SEQ ID NO: 1063848 - RNA, 22 nt, Human
uggcuaggcuccaagagcugga

SEQ ID NO: 1063849 - RNA, 22 nt, Human
uggcugcagacaccuauggcag

SEQ ID NO: 1063850 - RNA, 22 nt, Human
acugccugcuccuggcuccaca

SEQ ID NO: 1063851 - RNA, 22 nt, Human
cuucaagaagacagcagagcau

SEQ ID NO: 1063852 - RNA, 17 nt, Human
gaccaggagaaaccagg

SEQ ID NO: 1063853 - RNA, 22 nt, Human
gaacuuaguagucuacuucuua

SEQ ID NO: 1063854 - RNA, 22 nt, Human
caucuugccugcuauucuguug

SEQ ID NO: 1063855 - RNA, 22 nt, Human
uaacaagaaauacauugguucu

SEQ ID NO: 1063856 - RNA, 22 nt, Human
aacaaaguuucaggaagauaga

SEQ ID NO: 1063857 - RNA, 22 nt, Human
aucauacauguaacuaaguaaa

SEQ ID NO: 1063858 - RNA, 22 nt, Human
gcaggcagucaucuuucauauu

SEQ ID NO: 1063859 - RNA, 22 nt, Human
gcugagggcuggucacauuugu

SEQ ID NO: 1063860 - RNA, 23 nt, Human
uccaagggcuacaaacacagacc

SEQ ID NO: 1063861 - RNA, 23 nt, Human
acauuucaauacugagggucuga

SEQ ID NO: 1063862 - RNA, 22 nt, Human
gcugugugacugagagccuggc

SEQ ID NO: 1063863 - RNA, 22 nt, Human
ugccaggaggaggugggacaga

SEQ ID NO: 1063864 - RNA, 22 nt, Human
aaaaauuuaugguucuucucug

SEQ ID NO: 1063865 - RNA, 22 nt, Human
uacugaaagaauacauaauuuc

SEQ ID NO: 1063866 - RNA, 23 nt, Human
ugggggugcacgggccacaucuu

SEQ ID NO: 1063867 - RNA, 20 nt, Human
ggcagagggccugggagaag

SEQ ID NO: 1063868 - RNA, 22 nt, Human
uuauuauuuuguguacagcaaa

SEQ ID NO: 1063869 - RNA, 22 nt, Human
uauuuaauuagugauuguagag

SEQ ID NO: 1063870 - RNA, 22 nt, Human
agggaggucuuugaggggcuua

SEQ ID NO: 1063871 - RNA, 20 nt, Human
uacagaaacaggacuuuugg

SEQ ID NO: 1063872 - RNA, 22 nt, Human
augcugaacugagauguaacuu

SEQ ID NO: 1063873 - RNA, 21 nt, Human
acaugucuggucauuuuuagc

SEQ ID NO: 1063874 - RNA, 21 nt, Human
ccccauggaguacaguugggc

SEQ ID NO: 1063875 - RNA, 22 nt, Human
augaacacauguacacauuucu

SEQ ID NO: 1063876 - RNA, 22 nt, Human
uucuggcucuccccugcugggu

SEQ ID NO: 1063877 - RNA, 20 nt, Human
gcagcagugcaaguccucuu

SEQ ID NO: 1063878 - RNA, 22 nt, Human
cacuccaagaccuacuuucucu

SEQ ID NO: 1063879 - RNA, 22 nt, Human
agcagcaggcuguguggacuga

SEQ ID NO: 1063880 - RNA, 22 nt, Human
aaauaagcacuuaacuguauca

SEQ ID NO: 1063881 - RNA, 22 nt, Human
uuaguuagaauaauacaaguaa

SEQ ID NO: 1063882 - RNA, 22 nt, Human
agaggcugugcccaccaggcaa

SEQ ID NO: 1063883 - RNA, 22 nt, Human
cccaagaucuaggacagaaaga

SEQ ID NO: 1063884 - RNA, 22 nt, Human
uuaauaugcugcuucuugaaaa

SEQ ID NO: 1063885 - RNA, 22 nt, Human
uggcagaggaggcucagauuga

SEQ ID NO: 1063886 - RNA, 21 nt, Human
aucuuuagccauccaaucaga

SEQ ID NO: 1063887 - RNA, 22 nt, Human
cagaaauguuuaugcuuuugaa

SEQ ID NO: 1063888 - RNA, 22 nt, Human
aaagaaucagaagucucaaaca

SEQ ID NO: 1063889 - RNA, 22 nt, Human
ccaggcucaggccugcucguug

SEQ ID NO: 1063890 - RNA, 19 nt, Human
ggagaagcaucuagaaaua

SEQ ID NO: 1063891 - RNA, 22 nt, Human
auucagcuaagugcuucaugcu

SEQ ID NO: 1063892 - RNA, 22 nt, Human
auucaagaggaacaaugaagau

SEQ ID NO: 1063893 - RNA, 22 nt, Human
cgaggcaggcaggcggaggaua

SEQ ID NO: 1063894 - RNA, 22 nt, Human
uaucuucacuuauaucuuucuu

SEQ ID NO: 1063895 - RNA, 22 nt, Human
aggcagcagcuugcugguugcc

SEQ ID NO: 1063896 - RNA, 22 nt, Human
ggagcaggagucucuugaauuu

SEQ ID NO: 1063897 - RNA, 18 nt, Human
ugcuggguaacuguaugg

SEQ ID NO: 1063898 - RNA, 22 nt, Human
aaguaacacggaacuugaagca

SEQ ID NO: 1063899 - RNA, 22 nt, Human
ggaggccaaggcaggcggauca

SEQ ID NO: 1063900 - RNA, 20 nt, Human
agacaggagcccccauucag

SEQ ID NO: 1063901 - RNA, 22 nt, Human
acaccagggccuagccagggcg

SEQ ID NO: 1063902 - RNA, 23 nt, Human
ugcaugugaauucauacuuguuu

SEQ ID NO: 1063903 - RNA, 22 nt, Human
gacagagugcagggcuagaaga

SEQ ID NO: 1063904 - RNA, 22 nt, Human
cacauuuacuuuuaucccuugg

SEQ ID NO: 1063905 - RNA, 22 nt, Human
ugggggcagccaggcugucaag

SEQ ID NO: 1063906 - RNA, 22 nt, Human
ucuggccagugaaaugcagaau

SEQ ID NO: 1063907 - RNA, 22 nt, Human
agggccaggaucacagccaaga

SEQ ID NO: 1063908 - RNA, 20 nt, Human
agggccugcucugugguguc

SEQ ID NO: 1063909 - RNA, 22 nt, Human
uuggaugaagucuagcuuuagu

SEQ ID NO: 1063910 - RNA, 22 nt, Human
ccagccuggagggcaguggugg

SEQ ID NO: 1063911 - RNA, 22 nt, Human
uaacaagucauuuuaaauuaug

SEQ ID NO: 1063912 - RNA, 22 nt, Human
gauggcaggcaggugaguagag

SEQ ID NO: 1063913 - RNA, 23 nt, Human
uugugggcagauuccauggggag

SEQ ID NO: 1063914 - RNA, 22 nt, Human
gccaggcugacucccccggccu

SEQ ID NO: 1063915 - RNA, 22 nt, Human
accuggcacacacuggggagug

SEQ ID NO: 1063916 - RNA, 22 nt, Human
gcuucugggcaccugaacagga

SEQ ID NO: 1063917 - RNA, 23 nt, Human
gccucagagaaacagcugcacac

SEQ ID NO: 1063918 - RNA, 22 nt, Human
agcuguggcagcagccguggca

SEQ ID NO: 1063919 - RNA, 21 nt, Human
ccaaaggcuauguaucuucug

SEQ ID NO: 1063920 - RNA, 22 nt, Human
ugcuggguagaaguauuagucu

SEQ ID NO: 1063921 - RNA, 21 nt, Human
gagugcaggucugaugccauc

SEQ ID NO: 1063922 - RNA, 22 nt, Human
auggcagccugagcagaggaau

SEQ ID NO: 1063923 - RNA, 22 nt, Human
ccugggcugcaugauggcauuu

SEQ ID NO: 1063924 - RNA, 23 nt, Human
uauacacauguggcaguauagug

SEQ ID NO: 1063925 - RNA, 22 nt, Human
gauguguuuccaggauuuguuu

SEQ ID NO: 1063926 - RNA, 22 nt, Human
uccuguggucuggaaggaaugg

SEQ ID NO: 1063927 - RNA, 22 nt, Human
gaggaagaaagcauaggugggg

SEQ ID NO: 1063928 - RNA, 22 nt, Human
gcacuuaacuggaaaagaauuu

SEQ ID NO: 1063929 - RNA, 22 nt, Human
acugggccugauugggucggag

SEQ ID NO: 1063930 - RNA, 22 nt, Human
aguaaacauuuucauauuuucu

SEQ ID NO: 1063931 - RNA, 22 nt, Human
uuuagaggucuguuucacauca

SEQ ID NO: 1063932 - RNA, 22 nt, Human
aguguacauaguuaggaacauc

SEQ ID NO: 1063933 - RNA, 22 nt, Human
ucacaccuguaaucccaggccu

SEQ ID NO: 1063934 - RNA, 22 nt, Human
gauuuuuauauaaagugagaaa

SEQ ID NO: 1063935 - RNA, 22 nt, Human
ugggcaggugcuauuuuccaug

SEQ ID NO: 1063936 - RNA, 21 nt, Human
aaggggcaaacccaggacacc

SEQ ID NO: 1063937 - RNA, 22 nt, Human
aucaggauuacacggggaugcu

SEQ ID NO: 1063938 - RNA, 19 nt, Human
cagucccaaauucuuguca

SEQ ID NO: 1063939 - RNA, 22 nt, Human
ggcugccuccacugcuuguccc

SEQ ID NO: 1063940 - RNA, 22 nt, Human
augaaacaguguguauagcaaa

SEQ ID NO: 1063941 - RNA, 22 nt, Human
cuguaugaguugggaauagaau

SEQ ID NO: 1063942 - RNA, 22 nt, Human
aagcagacaucccauacuuuug

SEQ ID NO: 1063943 - RNA, 22 nt, Human
auaauauuugcauuacugugau

SEQ ID NO: 1063944 - RNA, 22 nt, Human
ugacaguugagcauguaagaga

SEQ ID NO: 1063945 - RNA, 22 nt, Human
ugauuauauuaacuauguuccu

SEQ ID NO: 1063946 - RNA, 22 nt, Human
ucucuggaagcgcagaucuguu

SEQ ID NO: 1063947 - RNA, 22 nt, Human
aaaucaguuagugguaggauug

SEQ ID NO: 1063948 - RNA, 22 nt, Human
aaagaccugugguagcucuaaa

SEQ ID NO: 1063949 - RNA, 22 nt, Human
auauucuugaaagauccuggua

SEQ ID NO: 1063950 - RNA, 22 nt, Human
ccugcuggaccucaacacauuu

SEQ ID NO: 1063951 - RNA, 22 nt, Human
uucauuaguucugaagaugucu

SEQ ID NO: 1063952 - RNA, 22 nt, Human
cucagacuugcuuuuuauggaa

SEQ ID NO: 1063953 - RNA, 21 nt, Human
agaagccaugugguggagaac

SEQ ID NO: 1063954 - RNA, 22 nt, Human
accagaguuggaauaauuuuga

SEQ ID NO: 1063955 - RNA, 21 nt, Human
ccugggcugugguuuggagac

SEQ ID NO: 1063956 - RNA, 22 nt, Human
ugcuguagcccugcacagugca

SEQ ID NO: 1063957 - RNA, 22 nt, Human
caaggaagacccacgcagauau

SEQ ID NO: 1063958 - RNA, 22 nt, Human
acaguggaaagaacauggauuu

SEQ ID NO: 1063959 - RNA, 22 nt, Human
aaagacuuggcuuaugauuugc

SEQ ID NO: 1063960 - RNA, 22 nt, Human
cugcugagccgcacccaggagc

SEQ ID NO: 1063961 - RNA, 22 nt, Human
ggggaccuuuccauuucugaga

SEQ ID NO: 1063962 - RNA, 22 nt, Human
ggcuccacccugcuuccagaag

SEQ ID NO: 1063963 - RNA, 22 nt, Human
agugugaguaauucagggaggg

SEQ ID NO: 1063964 - RNA, 22 nt, Human
ugguggcagucuccuggcugug

SEQ ID NO: 1063965 - RNA, 22 nt, Human
ugaaagcagcaccaauaccauu

SEQ ID NO: 1063966 - RNA, 22 nt, Human
gaugaagcuauuugguuggcac

SEQ ID NO: 1063967 - RNA, 22 nt, Human
ucuuaugggaaagauguaauua

SEQ ID NO: 1063968 - RNA, 22 nt, Human
cauaauauacuacauugaugaa

SEQ ID NO: 1063969 - RNA, 18 nt, Human
ucucuuuccucaguggag

SEQ ID NO: 1063970 - RNA, 22 nt, Human
cugugacaguuucucagacuuu

SEQ ID NO: 1063971 - RNA, 22 nt, Human
uccucuggcccagcugccucug

SEQ ID NO: 1063972 - RNA, 23 nt, Human
cugggcugcuugagucccuggcu

SEQ ID NO: 1063973 - RNA, 22 nt, Human
caaauagaacucacagacaaga

SEQ ID NO: 1063974 - RNA, 22 nt, Human
acacacaugccuuuccuaagua

SEQ ID NO: 1063975 - RNA, 20 nt, Human
augcaaaucccaaaaucagg

SEQ ID NO: 1063976 - RNA, 22 nt, Human
caggaagcugugaaggagacgg

SEQ ID NO: 1063977 - RNA, 22 nt, Human
aucugccuccaaguccaugugu

SEQ ID NO: 1063978 - RNA, 22 nt, Human
ucugcuggccuuagcaggucua

SEQ ID NO: 1063979 - RNA, 21 nt, Human
aggugcagagccagggaccag

SEQ ID NO: 1063980 - RNA, 22 nt, Human
uuugagauggagucuugcucug

SEQ ID NO: 1063981 - RNA, 22 nt, Human
agcaccuguggcucaugcucgu

SEQ ID NO: 1063982 - RNA, 22 nt, Human
aggccacaguacuuugcagacc

SEQ ID NO: 1063983 - RNA, 22 nt, Human
uggcacuguggauuucacaagu

SEQ ID NO: 1063984 - RNA, 22 nt, Human
gaggccuggaauuccagccugg

SEQ ID NO: 1063985 - RNA, 19 nt, Human
uagcagagaugacuccagc

SEQ ID NO: 1063986 - RNA, 22 nt, Human
gaccauuuuuacagagcauuca

SEQ ID NO: 1063987 - RNA, 22 nt, Human
cugggcucaguggcucauggcu

SEQ ID NO: 1063988 - RNA, 22 nt, Human
ucucagagaagugaugagcaau

SEQ ID NO: 1063989 - RNA, 21 nt, Human
agcaugcacuacuucaucuua

SEQ ID NO: 1063990 - RNA, 22 nt, Human
gcccagaaagacugccuaacag

SEQ ID NO: 1063991 - RNA, 22 nt, Human
cucuucucugcagccuuugaag

SEQ ID NO: 1063992 - RNA, 22 nt, Human
cagggccacccucugcugggug

SEQ ID NO: 1063993 - RNA, 22 nt, Human
acuagucugcauuacaaaauag

SEQ ID NO: 1063994 - RNA, 22 nt, Human
uacaaaguaauguauaauaucg

SEQ ID NO: 1063995 - RNA, 22 nt, Human
ggcuccugggagauagagguca

SEQ ID NO: 1063996 - RNA, 22 nt, Human
ucagcugccucucccuggaaga

SEQ ID NO: 1063997 - RNA, 22 nt, Human
uggcagcuguguccagguagaa

SEQ ID NO: 1063998 - RNA, 22 nt, Human
uaacaacucaguuuguuccuug

SEQ ID NO: 1063999 - RNA, 23 nt, Human
acacagaagaagacccaaggaag

SEQ ID NO: 1064000 - RNA, 22 nt, Human
uuucacaggaguuguaccauuu

SEQ ID NO: 1064001 - RNA, 22 nt, Human
aaagcaauugugguuuuugcca

SEQ ID NO: 1064002 - RNA, 22 nt, Human
uuauggcuuaaauacuacaggg

SEQ ID NO: 1064003 - RNA, 19 nt, Human
cagaggcaccagguauaga

SEQ ID NO: 1064004 - RNA, 22 nt, Human
uuucaauguaacauuuccaggc

SEQ ID NO: 1064005 - RNA, 22 nt, Human
auagacuugguuaguaaauuug

SEQ ID NO: 1064006 - RNA, 22 nt, Human
gcagggacaaggcagguguucu

SEQ ID NO: 1064007 - RNA, 22 nt, Human
ccaguguuuaggaauaaaaugu

SEQ ID NO: 1064008 - RNA, 22 nt, Human
uggaagagaaaggaguggaucu

SEQ ID NO: 1064009 - RNA, 23 nt, Human
uuauugcaagguaaaauugcuga

SEQ ID NO: 1064010 - RNA, 22 nt, Human
acauagcacgucucaauuugga

SEQ ID NO: 1064011 - RNA, 22 nt, Human
cugcucugagaggcucuuccua

SEQ ID NO: 1064012 - RNA, 22 nt, Human
uuucacagagaaauauaacagg

SEQ ID NO: 1064013 - RNA, 22 nt, Human
uguaaacaaaugcauucuugcu

SEQ ID NO: 1064014 - RNA, 19 nt, Human
gaucagagugucagcuugu

SEQ ID NO: 1064015 - RNA, 22 nt, Human
uggacuggaaugcugauccucu

SEQ ID NO: 1064016 - RNA, 22 nt, Human
guccucuccaggaggcucugau

SEQ ID NO: 1064017 - RNA, 22 nt, Human
ggaaugcacuagacugugaaac

SEQ ID NO: 1064018 - RNA, 22 nt, Human
gcugucacacauggccccagcu

SEQ ID NO: 1064019 - RNA, 22 nt, Human
ugccaggccucaggagucucca

SEQ ID NO: 1064020 - RNA, 22 nt, Human
cuggagugaagcuuauuuuuca

SEQ ID NO: 1064021 - RNA, 23 nt, Human
gggaccagcuagggcugugaccu

SEQ ID NO: 1064022 - RNA, 22 nt, Human
ccucaugcugcaucucugaggu

SEQ ID NO: 1064023 - RNA, 22 nt, Human
aagagagaguuccuaggcaaaa

SEQ ID NO: 1064024 - RNA, 22 nt, Human
acuuuguuguuccuugucuaaa

SEQ ID NO: 1064025 - RNA, 22 nt, Human
ugggccuccaauuccagcggga

SEQ ID NO: 1064026 - RNA, 20 nt, Human
gccuggaggcagagauaaag

SEQ ID NO: 1064027 - RNA, 22 nt, Human
augcccuguggcaguacauauu

SEQ ID NO: 1064028 - RNA, 22 nt, Human
uugaggcagggcaugguggccc

SEQ ID NO: 1064029 - RNA, 18 nt, Human
uggcagcaggaagccauu

SEQ ID NO: 1064030 - RNA, 21 nt, Human
agaggcaggcauuaaguacac

SEQ ID NO: 1064031 - RNA, 22 nt, Human
uccugagaugcugauuucgggg

SEQ ID NO: 1064032 - RNA, 22 nt, Human
caggaaugacugcagauggggc

SEQ ID NO: 1064033 - RNA, 22 nt, Human
aagucaggcuggggucuggcag

SEQ ID NO: 1064034 - RNA, 22 nt, Human
caaggagaguaauugaaugaga

SEQ ID NO: 1064035 - RNA, 22 nt, Human
uuugaaaccuaguuauaugacu

SEQ ID NO: 1064036 - RNA, 22 nt, Human
uguccagguggccucugcugcu

SEQ ID NO: 1064037 - RNA, 22 nt, Human
gcccccucaaagaggaagcucu

SEQ ID NO: 1064038 - RNA, 22 nt, Human
gggcucuguguucuagcucucg

SEQ ID NO: 1064039 - RNA, 22 nt, Human
agcugggcgcaguggcugguga

SEQ ID NO: 1064040 - RNA, 21 nt, Human
agaagccuggguggagguggg

SEQ ID NO: 1064041 - RNA, 22 nt, Human
uccucuucugccuauaucugcc

SEQ ID NO: 1064042 - RNA, 22 nt, Human
gccagggaaacugcagaccagc

SEQ ID NO: 1064043 - RNA, 22 nt, Human
gugugcagcagagacaggacuc

SEQ ID NO: 1064044 - RNA, 18 nt, Human
aggaagcaggaggaaggc

SEQ ID NO: 1064045 - RNA, 22 nt, Human
ccccugaagacaauggagaggu

SEQ ID NO: 1064046 - RNA, 22 nt, Human
ucagaaguaggagacauucuug

SEQ ID NO: 1064047 - RNA, 22 nt, Human
ccagggugagugucauggguua

SEQ ID NO: 1064048 - RNA, 22 nt, Human
aacacagaguauuugaagcauu

SEQ ID NO: 1064049 - RNA, 22 nt, Human
ucuaaggccuucaugucaguau

SEQ ID NO: 1064050 - RNA, 22 nt, Human
ugggagcacccugaggagcuuc

SEQ ID NO: 1064051 - RNA, 22 nt, Human
acaagauuuuaugacucuuuuu

SEQ ID NO: 1064052 - RNA, 22 nt, Human
uuugaaaguguuuacuugggaa

SEQ ID NO: 1064053 - RNA, 22 nt, Human
ugacauuucgguguaugugaug

SEQ ID NO: 1064054 - RNA, 22 nt, Human
agcaccugcuuaaugugcagug

SEQ ID NO: 1064055 - RNA, 22 nt, Human
caagcagaagccucaggggcau

SEQ ID NO: 1064056 - RNA, 22 nt, Human
uaacauuuagaaaguguccauu

SEQ ID NO: 1064057 - RNA, 22 nt, Human
uacaagguuguacuuucucucu

SEQ ID NO: 1064058 - RNA, 22 nt, Human
caggcaggagaggaggauuucu

SEQ ID NO: 1064059 - RNA, 22 nt, Human
ggcauguuucaucacaucaaga

SEQ ID NO: 1064060 - RNA, 23 nt, Human
acugggcugaaauuuuucauggc

SEQ ID NO: 1064061 - RNA, 18 nt, Human
gcccagaggucugggccc

SEQ ID NO: 1064062 - RNA, 22 nt, Human
uacagccacaggugacucucau

SEQ ID NO: 1064063 - RNA, 22 nt, Human
uuugcugacuggaugcaguugg

SEQ ID NO: 1064064 - RNA, 22 nt, Human
cagcuggggcagccacgugcgg

SEQ ID NO: 1064065 - RNA, 22 nt, Human
ugaauaaauugagagcgaaugu

SEQ ID NO: 1064066 - RNA, 22 nt, Human
gaaggagaggauugugaggcug

SEQ ID NO: 1064067 - RNA, 22 nt, Human
aaagcaaugcccguucauuauc

SEQ ID NO: 1064068 - RNA, 21 nt, Human
uuacaacauuuguguucuaug

SEQ ID NO: 1064069 - RNA, 22 nt, Human
cuggcuuucauuucaagcacgu

SEQ ID NO: 1064070 - RNA, 22 nt, Human
gggccuggcaugcagccccguu

SEQ ID NO: 1064071 - RNA, 22 nt, Human
aggaaaaaagucugugauuaua

SEQ ID NO: 1064072 - RNA, 22 nt, Human
ugcauuuucuuccaccaauauc

SEQ ID NO: 1064073 - RNA, 22 nt, Human
gccccucucccuugaggcaggc

SEQ ID NO: 1064074 - RNA, 22 nt, Human
aucuaagauguauugagcacuu

SEQ ID NO: 1064075 - RNA, 22 nt, Human
aggaagaacagauaauggacgc

SEQ ID NO: 1064076 - RNA, 22 nt, Human
aaacaguguuuuuaugauuuau

SEQ ID NO: 1064077 - RNA, 22 nt, Human
agucugucagucauucuaacaa

SEQ ID NO: 1064078 - RNA, 22 nt, Human
aaguccagaacuccugugauag

SEQ ID NO: 1064079 - RNA, 22 nt, Human
agcucucaagauaagaaagaac

SEQ ID NO: 1064080 - RNA, 23 nt, Human
ucuugaaaagccuacagcaguuc

SEQ ID NO: 1064081 - RNA, 22 nt, Human
ucuguggaaauuuccugaggca

SEQ ID NO: 1064082 - RNA, 22 nt, Human
ugaggcagugcugggaagccug

SEQ ID NO: 1064083 - RNA, 22 nt, Human
aguuucacuaaggucugugugu

SEQ ID NO: 1064084 - RNA, 22 nt, Human
caaagcaggaagcuccugacag

SEQ ID NO: 1064085 - RNA, 22 nt, Human
cagggagcuauuaggguuagug

SEQ ID NO: 1064086 - RNA, 22 nt, Human
gcccauggcagaacugugagca

SEQ ID NO: 1064087 - RNA, 22 nt, Human
agaaaacucuacaucuguaugu

SEQ ID NO: 1064088 - RNA, 22 nt, Human
acaaagguggaccauguggcuu

SEQ ID NO: 1064089 - RNA, 22 nt, Human
gggccucuccggccuuugcauc

SEQ ID NO: 1064090 - RNA, 19 nt, Human
uucuccaggcugcagaggg

SEQ ID NO: 1064091 - RNA, 21 nt, Human
aggagggcacaaggccaggaa

SEQ ID NO: 1064092 - RNA, 20 nt, Human
uacaguguauguauuuaggc

SEQ ID NO: 1064093 - RNA, 22 nt, Human
uuucugugguggguaguucaga

SEQ ID NO: 1064094 - RNA, 22 nt, Human
caagaaucuugcagcuuagacu

SEQ ID NO: 1064095 - RNA, 22 nt, Human
gagguggcagaggccuggaccu

SEQ ID NO: 1064096 - RNA, 22 nt, Human
agccuggcuaaauucucccaug

SEQ ID NO: 1064097 - RNA, 22 nt, Human
cuggagguaauguuauuuuugu

SEQ ID NO: 1064098 - RNA, 22 nt, Human
ugcugucuuccaggauggugaa

SEQ ID NO: 1064099 - RNA, 22 nt, Human
agagcagagggcucugggacaa

SEQ ID NO: 1064100 - RNA, 22 nt, Human
ccuuuguucacuggagagugga

SEQ ID NO: 1064101 - RNA, 22 nt, Human
uccagaguacggaagagucauc

SEQ ID NO: 1064102 - RNA, 22 nt, Human
gcuuugcccaagggcccuaccc

SEQ ID NO: 1064103 - RNA, 22 nt, Human
augcuugaaaguuauuucauuu

SEQ ID NO: 1064104 - RNA, 22 nt, Human
agagccagagaccuggguucac

SEQ ID NO: 1064105 - RNA, 20 nt, Human
ugcagaagaacguucugguu

SEQ ID NO: 1064106 - RNA, 22 nt, Human
acaggcucgugcgcgcacgugu

SEQ ID NO: 1064107 - RNA, 22 nt, Human
ccaggaggaugaggggcauaga

SEQ ID NO: 1064108 - RNA, 22 nt, Human
cucucuggcuuggcacggagau

SEQ ID NO: 1064109 - RNA, 22 nt, Human
gagguggcuggcucagagccag

SEQ ID NO: 1064110 - RNA, 22 nt, Human
cucccucucaccggagcccugg

SEQ ID NO: 1064111 - RNA, 22 nt, Human
gagugcaggccugagcaccauc

SEQ ID NO: 1064112 - RNA, 22 nt, Human
ucuacauuuuaacaagaugccc

SEQ ID NO: 1064113 - RNA, 22 nt, Human
aaauggcauucagcaaccuuuc

SEQ ID NO: 1064114 - RNA, 22 nt, Human
ucaggaagcucuugcugauucu

SEQ ID NO: 1064115 - RNA, 22 nt, Human
aagagucacuccauaaauccca

SEQ ID NO: 1064116 - RNA, 22 nt, Human
ucagggcagguuaacuugggug

SEQ ID NO: 1064117 - RNA, 22 nt, Human
accucuggccuucaggcaucau

SEQ ID NO: 1064118 - RNA, 19 nt, Human
gcaggcagcugggguaucc

SEQ ID NO: 1064119 - RNA, 22 nt, Human
cugcccaggggagugcugucgg

SEQ ID NO: 1064120 - RNA, 22 nt, Human
gcaggaguguggugggacaucc

SEQ ID NO: 1064121 - RNA, 22 nt, Human
uaacaucuaagggagagaaagu

SEQ ID NO: 1064122 - RNA, 22 nt, Human
ucacagacuggucagucaacuu

SEQ ID NO: 1064123 - RNA, 22 nt, Human
guggccugaugccagcccugug

SEQ ID NO: 1064124 - RNA, 22 nt, Human
caaggaaacaugaaaugcauug

SEQ ID NO: 1064125 - RNA, 22 nt, Human
agggcugcaccggggcuucgcg

SEQ ID NO: 1064126 - RNA, 22 nt, Human
guucauaauuugaaggaauagg

SEQ ID NO: 1064127 - RNA, 22 nt, Human
aaaagcagagacucuggagcua

SEQ ID NO: 1064128 - RNA, 22 nt, Human
guuuuuauuguguaaauguggg

SEQ ID NO: 1064129 - RNA, 22 nt, Human
gcugagagcaguguggccuuaa

SEQ ID NO: 1064130 - RNA, 22 nt, Human
cacucugcgcugggcgccagcg

SEQ ID NO: 1064131 - RNA, 22 nt, Human
cagugauguuucugcaucagag

SEQ ID NO: 1064132 - RNA, 22 nt, Human
acucacaggacucugcauauag

SEQ ID NO: 1064133 - RNA, 22 nt, Human
acugggcucccaggcuugucau

SEQ ID NO: 1064134 - RNA, 22 nt, Human
gcauggaauucccuuaugggcc

SEQ ID NO: 1064135 - RNA, 22 nt, Human
aggcucagacaggaaaaguaac

SEQ ID NO: 1064136 - RNA, 22 nt, Human
uucuuucuuuguaguccugaac

SEQ ID NO: 1064137 - RNA, 22 nt, Human
uauuucuucgggauucaagcua

SEQ ID NO: 1064138 - RNA, 22 nt, Human
aaucaguuucuuggcaaguuua

SEQ ID NO: 1064139 - RNA, 22 nt, Human
ugucuucgcuacaaugaaaagg

SEQ ID NO: 1064140 - RNA, 22 nt, Human
acacuuuaucucaucucagaca

SEQ ID NO: 1064141 - RNA, 22 nt, Human
ugucuucuguauucaagucuau

SEQ ID NO: 1064142 - RNA, 22 nt, Human
uagugcuuuaaguuuacagaga

SEQ ID NO: 1064143 - RNA, 22 nt, Human
aaaaaauuaucauaguuccuga

SEQ ID NO: 1064144 - RNA, 22 nt, Human
cagagagaaucuuggcagcuga

SEQ ID NO: 1064145 - RNA, 22 nt, Human
aacagaaaucauuuagggcucu

SEQ ID NO: 1064146 - RNA, 22 nt, Human
ugaagcaacuggacaaguuggc

SEQ ID NO: 1064147 - RNA, 22 nt, Human
uccuauugguagacauuucugu

SEQ ID NO: 1064148 - RNA, 22 nt, Human
agagacaggguuuugucguguu

SEQ ID NO: 1064149 - RNA, 22 nt, Human
acacacagcgccuaccaugugc

SEQ ID NO: 1064150 - RNA, 23 nt, Human
cagggcugggcuugguguuaggc

SEQ ID NO: 1064151 - RNA, 22 nt, Human
caucuuuaaaggggagacaccc

SEQ ID NO: 1064152 - RNA, 20 nt, Human
uuacaaagaggcaucgcuuu

SEQ ID NO: 1064153 - RNA, 23 nt, Human
uuguuucuuuguauugucucuau

SEQ ID NO: 1064154 - RNA, 20 nt, Human
agccagaagaaggcuggaga

SEQ ID NO: 1064155 - RNA, 22 nt, Human
gauguacuugccuuaucuaucc

SEQ ID NO: 1064156 - RNA, 22 nt, Human
caggauggucagaugcauuguc

SEQ ID NO: 1064157 - RNA, 22 nt, Human
ggcuggcuggcugguagacaag

SEQ ID NO: 1064158 - RNA, 21 nt, Human
gucuuuuaagugaagagaggc

SEQ ID NO: 1064159 - RNA, 22 nt, Human
ucagaacagaagaaggaacacg

SEQ ID NO: 1064160 - RNA, 22 nt, Human
aacuacauuguccuuucugaag

SEQ ID NO: 1064161 - RNA, 22 nt, Human
gaguccaguucuuuccagcagu

SEQ ID NO: 1064162 - RNA, 22 nt, Human
ccucugagucucacuguaaccu

SEQ ID NO: 1064163 - RNA, 22 nt, Human
ugggaagggccugcccuuccuc

SEQ ID NO: 1064164 - RNA, 22 nt, Human
acagcugugaaaauccacagga

SEQ ID NO: 1064165 - RNA, 22 nt, Human
cagcuucugagcaagccagggg

SEQ ID NO: 1064166 - RNA, 22 nt, Human
ccagguggacuugauuugaaua

SEQ ID NO: 1064167 - RNA, 22 nt, Human
ccuggcagcuccuccccggcgg

SEQ ID NO: 1064168 - RNA, 22 nt, Human
gcucccaguucccaaagugacc

SEQ ID NO: 1064169 - RNA, 16 nt, Human
gcagggguggguggag

SEQ ID NO: 1064170 - RNA, 22 nt, Human
ccauuugucaccucugcacucc

SEQ ID NO: 1064171 - RNA, 22 nt, Human
gagaugguagccucagaagagu

SEQ ID NO: 1064172 - RNA, 22 nt, Human
gacaaagagaaguaacaguacc

SEQ ID NO: 1064173 - RNA, 18 nt, Human
ggcaugugagugcugagg

SEQ ID NO: 1064174 - RNA, 22 nt, Human
uuucuaaguguauugagcuugg

SEQ ID NO: 1064175 - RNA, 22 nt, Human
gucccaggcagagucaggaggg

SEQ ID NO: 1064176 - RNA, 22 nt, Human
ugcugcagguguguucagugag

SEQ ID NO: 1064177 - RNA, 22 nt, Human
ugaagcccugugucagcuucca

SEQ ID NO: 1064178 - RNA, 22 nt, Human
aacaguuucaguuacugaugag

SEQ ID NO: 1064179 - RNA, 22 nt, Human
ucacacaugaguaaauacaggg

SEQ ID NO: 1064180 - RNA, 22 nt, Human
gcccaggagguggaggugcagu

SEQ ID NO: 1064181 - RNA, 22 nt, Human
uugguucaguaggcaugccugg

SEQ ID NO: 1064182 - RNA, 22 nt, Human
aagcagccagccaucaugcccg

SEQ ID NO: 1064183 - RNA, 22 nt, Human
cuucucucccuggcacucagac

SEQ ID NO: 1064184 - RNA, 19 nt, Human
aggucugcagcugcaguuu

SEQ ID NO: 1064185 - RNA, 22 nt, Human
ugcagggacacgaagacaaaua

SEQ ID NO: 1064186 - RNA, 22 nt, Human
uuagccauuaaauuacaaggug

SEQ ID NO: 1064187 - RNA, 22 nt, Human
uggcagagguauauugggagga

SEQ ID NO: 1064188 - RNA, 18 nt, Human
ucuaggagaguaccuacc

SEQ ID NO: 1064189 - RNA, 21 nt, Human
uggcucaguugcugggcacag

SEQ ID NO: 1064190 - RNA, 22 nt, Human
aauauagauuuacucaagagaa

SEQ ID NO: 1064191 - RNA, 22 nt, Human
cuggacagaucccuuguagcuu

SEQ ID NO: 1064192 - RNA, 22 nt, Human
cccugcuuagcacccuugcacc

SEQ ID NO: 1064193 - RNA, 22 nt, Human
ccucauucuuuccugggccccu

SEQ ID NO: 1064194 - RNA, 22 nt, Human
uuaauacuauaauuugaaguac

SEQ ID NO: 1064195 - RNA, 22 nt, Human
cagaaugagauaacccagauug

SEQ ID NO: 1064196 - RNA, 22 nt, Human
ggaaaauacugauucaugccau

SEQ ID NO: 1064197 - RNA, 22 nt, Human
uagcucuucaaucacugucucc

SEQ ID NO: 1064198 - RNA, 22 nt, Human
ugaacacauaaaagcaaagggu

SEQ ID NO: 1064199 - RNA, 22 nt, Human
auuauucauggucuuccacaau

SEQ ID NO: 1064200 - RNA, 22 nt, Human
ccuggcugcuuucacuauggag

SEQ ID NO: 1064201 - RNA, 22 nt, Human
uaaacagagaagacuuugagca

SEQ ID NO: 1064202 - RNA, 22 nt, Human
agaagaaagauugaagguuccu

SEQ ID NO: 1064203 - RNA, 22 nt, Human
uuucacauccugaagccccacu

SEQ ID NO: 1064204 - RNA, 22 nt, Human
ucuguuccauguuuuguuccau

SEQ ID NO: 1064205 - RNA, 22 nt, Human
uugcaaggcuagguucacccac

SEQ ID NO: 1064206 - RNA, 22 nt, Human
gcaaagcaagcugucagccuca

SEQ ID NO: 1064207 - RNA, 19 nt, Human
uggggcuguguuuugaccc

SEQ ID NO: 1064208 - RNA, 22 nt, Human
uuuauccauucaccaguugaac

SEQ ID NO: 1064209 - RNA, 22 nt, Human
gcauuuuauaaagaguuauuug

SEQ ID NO: 1064210 - RNA, 22 nt, Human
aaaauuuucagcuugacuugau

SEQ ID NO: 1064211 - RNA, 22 nt, Human
aaggcugaguaaaacagagaac

SEQ ID NO: 1064212 - RNA, 22 nt, Human
uaugaacuuuaagcucuguguc

SEQ ID NO: 1064213 - RNA, 22 nt, Human
ggagccuguuaguugagugcuc

SEQ ID NO: 1064214 - RNA, 22 nt, Human
accauguguuuuacacauggua

SEQ ID NO: 1064215 - RNA, 22 nt, Human
uccugccucuuuucuuauucca

SEQ ID NO: 1064216 - RNA, 22 nt, Human
gauaaaauaacuauggaauacu

SEQ ID NO: 1064217 - RNA, 22 nt, Human
ucugaaauggcgauggccguug

SEQ ID NO: 1064218 - RNA, 22 nt, Human
gcuuucuuaguguguuaauugg

SEQ ID NO: 1064219 - RNA, 22 nt, Human
caaaguaugaaccaguuucucu

SEQ ID NO: 1064220 - RNA, 22 nt, Human
cauaucuuaugguuuucuaagu

SEQ ID NO: 1064221 - RNA, 22 nt, Human
agucucuugcacauuguauuaa

SEQ ID NO: 1064222 - RNA, 22 nt, Human
auguacaguuucuagacucaaa

SEQ ID NO: 1064223 - RNA, 22 nt, Human
cagcugaauucuucagacucca

SEQ ID NO: 1064224 - RNA, 22 nt, Human
cuggugggagauaauugaauca

SEQ ID NO: 1064225 - RNA, 22 nt, Human
gccagagucuucugacccugug

SEQ ID NO: 1064226 - RNA, 22 nt, Human
gcaggccagcugugcagauggg

SEQ ID NO: 1064227 - RNA, 22 nt, Human
uccaaguucuaggaacugcugc

SEQ ID NO: 1064228 - RNA, 22 nt, Human
aauucauugccagaaucuauga

SEQ ID NO: 1064229 - RNA, 22 nt, Human
aagccaguguccagaaugggca

SEQ ID NO: 1064230 - RNA, 22 nt, Human
gcucaggagcucuugguggcgc

SEQ ID NO: 1064231 - RNA, 22 nt, Human
uaggaaaagcacaggauguucu

SEQ ID NO: 1064232 - RNA, 22 nt, Human
gcauuuuagaauauuggagcaa

SEQ ID NO: 1064233 - RNA, 22 nt, Human
uaauuuugucacagugacaugc

SEQ ID NO: 1064234 - RNA, 22 nt, Human
cuggaugcuuccucucugcuag

SEQ ID NO: 1064235 - RNA, 22 nt, Human
uauuagguuggugcaaaaguaa

SEQ ID NO: 1064236 - RNA, 22 nt, Human
agacaucucuaugcaggaucuc

SEQ ID NO: 1064237 - RNA, 22 nt, Human
ucuggcucuaacuaggcaucag

SEQ ID NO: 1064238 - RNA, 22 nt, Human
aaucuccauuuacccugcaucu

SEQ ID NO: 1064239 - RNA, 22 nt, Human
cuuauucuacuccacaagcucu

SEQ ID NO: 1064240 - RNA, 22 nt, Human
ggcugcugguagggguaggaag

SEQ ID NO: 1064241 - RNA, 22 nt, Human
gaauuuaaaggccagaccugag

SEQ ID NO: 1064242 - RNA, 22 nt, Human
ucacagugaugacgugggagca

SEQ ID NO: 1064243 - RNA, 22 nt, Human
gcuucuggagucuucagaggaa

SEQ ID NO: 1064244 - RNA, 22 nt, Human
ucacuguagugagcagaauaua

SEQ ID NO: 1064245 - RNA, 22 nt, Human
auggggugagacuaggauuaaa

SEQ ID NO: 1064246 - RNA, 22 nt, Human
cauaagaaauuuaacagaacuu

SEQ ID NO: 1064247 - RNA, 22 nt, Human
gcgagugccgagagggcagggc

SEQ ID NO: 1064248 - RNA, 22 nt, Human
gcaggugaugugaugugagcau

SEQ ID NO: 1064249 - RNA, 22 nt, Human
ugacaauagcgauuuaucuugc

SEQ ID NO: 1064250 - RNA, 22 nt, Human
ugcaggcuccacguuguugucc

SEQ ID NO: 1064251 - RNA, 22 nt, Human
ucacucucuaagcaugacagac

SEQ ID NO: 1064252 - RNA, 22 nt, Human
uggacuaaagaggaaagaugua

SEQ ID NO: 1064253 - RNA, 20 nt, Human
uccuuuggccuuagagcugu

SEQ ID NO: 1064254 - RNA, 22 nt, Human
cugggggcaagcagacagcugu

SEQ ID NO: 1064255 - RNA, 19 nt, Human
agccacagaacuugcagga

SEQ ID NO: 1064256 - RNA, 22 nt, Human
gcauuccuacaggcugcuauga

SEQ ID NO: 1064257 - RNA, 22 nt, Human
ucaguggauugacaugaaaaag

SEQ ID NO: 1064258 - RNA, 22 nt, Human
uuagcaucugcuguaagcuuau

SEQ ID NO: 1064259 - RNA, 23 nt, Human
uugcauagacauccucauagauu

SEQ ID NO: 1064260 - RNA, 22 nt, Human
uccagcagggaauuaguagucu

SEQ ID NO: 1064261 - RNA, 22 nt, Human
cugcucuguucccccaucaucu

SEQ ID NO: 1064262 - RNA, 22 nt, Human
cgugcccugcgcaagugcugcu

SEQ ID NO: 1064263 - RNA, 22 nt, Human
ccuuuccuuuuuagugugggag

SEQ ID NO: 1064264 - RNA, 22 nt, Human
guuucaaaaugaugcuguaacu

SEQ ID NO: 1064265 - RNA, 22 nt, Human
gugaauauucuuugugcaguau

SEQ ID NO: 1064266 - RNA, 22 nt, Human
ugaagauaacaguaagguauug

SEQ ID NO: 1064267 - RNA, 22 nt, Human
uggaaagacauucagccgcugg

SEQ ID NO: 1064268 - RNA, 22 nt, Human
auacauauaugguacuuccugg

SEQ ID NO: 1064269 - RNA, 22 nt, Human
gcaaggaccuuugagcgugcca

SEQ ID NO: 1064270 - RNA, 18 nt, Human
cuccuuucccuacaccuc

SEQ ID NO: 1064271 - RNA, 20 nt, Human
ucugucucugagcuagacuu

SEQ ID NO: 1064272 - RNA, 22 nt, Human
cuguaaauaugaagaauauaug

SEQ ID NO: 1064273 - RNA, 22 nt, Human
acagagagaaacaaucagcagc

SEQ ID NO: 1064274 - RNA, 22 nt, Human
ucagcaauccucccacaggugg

SEQ ID NO: 1064275 - RNA, 22 nt, Human
gcacacagccagcugagggcua

SEQ ID NO: 1064276 - RNA, 22 nt, Human
gggagagagagcucauguugaa

SEQ ID NO: 1064277 - RNA, 22 nt, Human
acacaucuuagacugaaauaug

SEQ ID NO: 1064278 - RNA, 20 nt, Human
augugagggguugaaguggg

SEQ ID NO: 1064279 - RNA, 22 nt, Human
ugugcuucugcagagacuauuu

SEQ ID NO: 1064280 - RNA, 22 nt, Human
agauggaguuaguaccagaguc

SEQ ID NO: 1064281 - RNA, 22 nt, Human
agaggugacauaggagaggcuc

SEQ ID NO: 1064282 - RNA, 22 nt, Human
cucagacuuucaggguaggcca

SEQ ID NO: 1064283 - RNA, 22 nt, Human
gacagagaggcugagcaguaca

SEQ ID NO: 1064284 - RNA, 17 nt, Human
ugcaggcuguuauagcc

SEQ ID NO: 1064285 - RNA, 22 nt, Human
aaugucugagucucuguauccc

SEQ ID NO: 1064286 - RNA, 22 nt, Human
cugagcuggucuauggacuugg

SEQ ID NO: 1064287 - RNA, 22 nt, Human
aggcucugugacaaucaagcug

SEQ ID NO: 1064288 - RNA, 22 nt, Human
cugccaggccuccgcugucccc

SEQ ID NO: 1064289 - RNA, 22 nt, Human
guuaaauaaccucauguccguu

SEQ ID NO: 1064290 - RNA, 19 nt, Human
agucuuucccacucgucuu

SEQ ID NO: 1064291 - RNA, 22 nt, Human
aacaaguguauuaauggaaaua

SEQ ID NO: 1064292 - RNA, 22 nt, Human
agcugcucucacuggacgccug

SEQ ID NO: 1064293 - RNA, 22 nt, Human
ugaagacacauacaagggaaug

SEQ ID NO: 1064294 - RNA, 22 nt, Human
ugagaacaaaguugaaaguuug

SEQ ID NO: 1064295 - RNA, 22 nt, Human
cacauuuaauccuuuauaagua

SEQ ID NO: 1064296 - RNA, 22 nt, Human
gcuggcuguguuucaucucuga

SEQ ID NO: 1064297 - RNA, 22 nt, Human
gugcuucucuucacacccaacu

SEQ ID NO: 1064298 - RNA, 22 nt, Human
gcccucagaaugggcucuaauc

SEQ ID NO: 1064299 - RNA, 22 nt, Human
uugucuaaugagcuccacuuca

SEQ ID NO: 1064300 - RNA, 22 nt, Human
auacagaauucacuacaguuuc

SEQ ID NO: 1064301 - RNA, 22 nt, Human
auacaaagacaaaucucaaucu

SEQ ID NO: 1064302 - RNA, 20 nt, Human
uggaccacccuccucuuugc

SEQ ID NO: 1064303 - RNA, 22 nt, Human
ucucuucuugauuuucacugga

SEQ ID NO: 1064304 - RNA, 22 nt, Human
gagagggccgggggccagcucc

SEQ ID NO: 1064305 - RNA, 22 nt, Human
cugcugggucccccugcugauu

SEQ ID NO: 1064306 - RNA, 22 nt, Human
cugaaaucaauuuugauuaucu

SEQ ID NO: 1064307 - RNA, 22 nt, Human
cucuucaggauggcuugugaug

SEQ ID NO: 1064308 - RNA, 17 nt, Human
uuccucucacauuuuuu

SEQ ID NO: 1064309 - RNA, 22 nt, Human
ucccugccaaugauuggagcaa

SEQ ID NO: 1064310 - RNA, 22 nt, Human
ugcuuaaaggauaguuuaaacu

SEQ ID NO: 1064311 - RNA, 22 nt, Human
aaggugugaagagaugggaaga

SEQ ID NO: 1064312 - RNA, 22 nt, Human
accuccuggugcccaaguguuu

SEQ ID NO: 1064313 - RNA, 22 nt, Human
ucacauauuuaagaaaguuaaa

SEQ ID NO: 1064314 - RNA, 22 nt, Human
cugucuuuuacuaucauuuacu

SEQ ID NO: 1064315 - RNA, 22 nt, Human
uuacagagaggugauugugaag

SEQ ID NO: 1064316 - RNA, 22 nt, Human
ugaagccagucaauguuaaguu

SEQ ID NO: 1064317 - RNA, 22 nt, Human
ggucucagaucuuuauuaaggc

SEQ ID NO: 1064318 - RNA, 22 nt, Human
ccagagcaauucucacagaacu

SEQ ID NO: 1064319 - RNA, 22 nt, Human
cucaggauagauuguccucuca

SEQ ID NO: 1064320 - RNA, 22 nt, Human
agagcuggggcauaaaugccac

SEQ ID NO: 1064321 - RNA, 20 nt, Human
uuugauuucacaaggccagu

SEQ ID NO: 1064322 - RNA, 22 nt, Human
ucacagaaggaccuuguuucau

SEQ ID NO: 1064323 - RNA, 21 nt, Human
ccagcugucuguccuuaggca

SEQ ID NO: 1064324 - RNA, 22 nt, Human
gccuggaagugugucgugggaa

SEQ ID NO: 1064325 - RNA, 22 nt, Human
gcucuguaccugcggagaugag

SEQ ID NO: 1064326 - RNA, 22 nt, Human
ucuacaagucaagucuaucaag

SEQ ID NO: 1064327 - RNA, 21 nt, Human
uggcugaguggaugcaugaau

SEQ ID NO: 1064328 - RNA, 18 nt, Human
ucuuccaacacugacacc

SEQ ID NO: 1064329 - RNA, 22 nt, Human
agucuucucauuucacaugcuu

SEQ ID NO: 1064330 - RNA, 22 nt, Human
caaagaaugagugaguacauaa

SEQ ID NO: 1064331 - RNA, 22 nt, Human
gaggagcacaugaggcugaggg

SEQ ID NO: 1064332 - RNA, 22 nt, Human
caggaggcuccuagggcucugu

SEQ ID NO: 1064333 - RNA, 22 nt, Human
aaagacauauuucuaaguuuau

SEQ ID NO: 1064334 - RNA, 22 nt, Human
cagggcaggaauuugacauugc

SEQ ID NO: 1064335 - RNA, 22 nt, Human
ggggcugggauuugaacccagg

SEQ ID NO: 1064336 - RNA, 18 nt, Human
agggaucaucacugcagc

SEQ ID NO: 1064337 - RNA, 22 nt, Human
ugagccugguugcagugucugg

SEQ ID NO: 1064338 - RNA, 22 nt, Human
gugcccugggccuucagggcca

SEQ ID NO: 1064339 - RNA, 22 nt, Human
acaugauuugcaugauuuguaa

SEQ ID NO: 1064340 - RNA, 23 nt, Human
uaguuauuuucucuguaauuugc

SEQ ID NO: 1064341 - RNA, 22 nt, Human
acagagccacuuuggugccuac

SEQ ID NO: 1064342 - RNA, 22 nt, Human
ucuacaaagccauucaggaucu

SEQ ID NO: 1064343 - RNA, 22 nt, Human
caguucuggaguuucauucuuu

SEQ ID NO: 1064344 - RNA, 22 nt, Human
aaacucuagggcuccacauucc

SEQ ID NO: 1064345 - RNA, 22 nt, Human
ugacuuuagaauuuuauccaga

SEQ ID NO: 1064346 - RNA, 22 nt, Human
ucccaagagcaagaacuugcug

SEQ ID NO: 1064347 - RNA, 22 nt, Human
agcagggcuuugucucugugaa

SEQ ID NO: 1064348 - RNA, 20 nt, Human
gugcuucagaagccauugcu

SEQ ID NO: 1064349 - RNA, 22 nt, Human
cccauggguuuuccucccugcc

SEQ ID NO: 1064350 - RNA, 22 nt, Human
auaucacaguaguuguuuaguu

SEQ ID NO: 1064351 - RNA, 22 nt, Human
aagagcuggcccaaucugagca

SEQ ID NO: 1064352 - RNA, 22 nt, Human
gcaaggcugcugccacccaucu

SEQ ID NO: 1064353 - RNA, 22 nt, Human
gggcagcauaacaaucacugaa

SEQ ID NO: 1064354 - RNA, 22 nt, Human
aacagacucacagcuagagaag

SEQ ID NO: 1064355 - RNA, 22 nt, Human
cuggagggugagccucaucucu

SEQ ID NO: 1064356 - RNA, 22 nt, Human
ggggcugagaauucagucucgg

SEQ ID NO: 1064357 - RNA, 22 nt, Human
agugccuaaccccuuguaugaa

SEQ ID NO: 1064358 - RNA, 22 nt, Human
ugucacauaggcaaaauguuuu

SEQ ID NO: 1064359 - RNA, 22 nt, Human
ccugcuguagggccccuggggc

SEQ ID NO: 1064360 - RNA, 22 nt, Human
guuuauuagaguuuucugucug

SEQ ID NO: 1064361 - RNA, 22 nt, Human
cuguucaauuuguuucaguuau

SEQ ID NO: 1064362 - RNA, 22 nt, Human
caaacuuuuccuggaaaagauu

SEQ ID NO: 1064363 - RNA, 21 nt, Human
agcugggccucagccugcagu

SEQ ID NO: 1064364 - RNA, 22 nt, Human
gaaauguaggcauaauuauuuu

SEQ ID NO: 1064365 - RNA, 22 nt, Human
aauuucuucagcucuaaaaugg

SEQ ID NO: 1064366 - RNA, 23 nt, Human
ugucugucauggaauuucaaggu

SEQ ID NO: 1064367 - RNA, 22 nt, Human
uuuaguuauugcacagaauuag

SEQ ID NO: 1064368 - RNA, 18 nt, Human
uggagcaggaagccuggc

SEQ ID NO: 1064369 - RNA, 22 nt, Human
cugcccagaagccagaugggca

SEQ ID NO: 1064370 - RNA, 22 nt, Human
ucacaauuuggauacagcuaug

SEQ ID NO: 1064371 - RNA, 22 nt, Human
ggagccugugcccaagcccaga

SEQ ID NO: 1064372 - RNA, 22 nt, Human
auucaaguggcugcuauguuaa

SEQ ID NO: 1064373 - RNA, 19 nt, Human
uaugacaaguacuaguucu

SEQ ID NO: 1064374 - RNA, 22 nt, Human
gcucccagucugauggaggaga

SEQ ID NO: 1064375 - RNA, 22 nt, Human
uagcagaggcuacugcuccuug

SEQ ID NO: 1064376 - RNA, 22 nt, Human
gcagcagagcuuuguccuggcu

SEQ ID NO: 1064377 - RNA, 22 nt, Human
gcuauaggguacauuuguguuu

SEQ ID NO: 1064378 - RNA, 20 nt, Human
cagcuuggaugagaggcuga

SEQ ID NO: 1064379 - RNA, 22 nt, Human
uaccaggagcccccuucugguc

SEQ ID NO: 1064380 - RNA, 22 nt, Human
aggaagaggguggcagauaauc

SEQ ID NO: 1064381 - RNA, 22 nt, Human
cagagccaaaugcugugguuau

SEQ ID NO: 1064382 - RNA, 17 nt, Human
gcucugccucucccacc

SEQ ID NO: 1064383 - RNA, 21 nt, Human
acagacaguccagagaaaaga

SEQ ID NO: 1064384 - RNA, 22 nt, Human
guccaaggaugcaggaugcugu

SEQ ID NO: 1064385 - RNA, 20 nt, Human
agucugucaauuuacagugg

SEQ ID NO: 1064386 - RNA, 22 nt, Human
accagagauggggcuucucugu

SEQ ID NO: 1064387 - RNA, 22 nt, Human
gcagagcucaugccugcaccuc

SEQ ID NO: 1064388 - RNA, 23 nt, Human
ccucagggucuagcagagagaag

SEQ ID NO: 1064389 - RNA, 22 nt, Human
agguggggaguauauguaauug

SEQ ID NO: 1064390 - RNA, 22 nt, Human
aauaggacuuugguccuagcuc

SEQ ID NO: 1064391 - RNA, 22 nt, Human
uuaggaaaucacuuugcucacc

SEQ ID NO: 1064392 - RNA, 22 nt, Human
gaaaucuuuuccaauuguuuag

SEQ ID NO: 1064393 - RNA, 22 nt, Human
uggaccaacauucacuggcaua

SEQ ID NO: 1064394 - RNA, 19 nt, Human
ccucugcgcuguccugcuc

SEQ ID NO: 1064395 - RNA, 22 nt, Human
caagacuuuggaggaauuugga

SEQ ID NO: 1064396 - RNA, 22 nt, Human
cuauuuaucuauuucugaauga

SEQ ID NO: 1064397 - RNA, 22 nt, Human
ugggcuggcguggagaguuuag

SEQ ID NO: 1064398 - RNA, 22 nt, Human
cugugcuggcagaccuggaguu

SEQ ID NO: 1064399 - RNA, 22 nt, Human
acacauaugguugcugcaguga

SEQ ID NO: 1064400 - RNA, 22 nt, Human
uaccuuggaaaugcuagaguaa

SEQ ID NO: 1064401 - RNA, 22 nt, Human
aauuaggaauaaaugaguacuu

SEQ ID NO: 1064402 - RNA, 22 nt, Human
uacauaauuaaucuuuaaguuc

SEQ ID NO: 1064403 - RNA, 22 nt, Human
caugauaacuucauuacacaau

SEQ ID NO: 1064404 - RNA, 22 nt, Human
cagaauaugacucgggcacuac

SEQ ID NO: 1064405 - RNA, 22 nt, Human
aagaggcagcccgcugaggcug

SEQ ID NO: 1064406 - RNA, 22 nt, Human
auauacacauguguauacauuu

SEQ ID NO: 1064407 - RNA, 22 nt, Human
aguauacugaaaguaaauauga

SEQ ID NO: 1064408 - RNA, 22 nt, Human
gucaggaaaaauugauaauuuu

SEQ ID NO: 1064409 - RNA, 22 nt, Human
ugaaagcacucacuucugcucu

SEQ ID NO: 1064410 - RNA, 22 nt, Human
ccuuuucuauccuucuagguuc

SEQ ID NO: 1064411 - RNA, 22 nt, Human
uggggccagguggcugcagguc

SEQ ID NO: 1064412 - RNA, 22 nt, Human
guauuuuucaguuaggagcuua

SEQ ID NO: 1064413 - RNA, 22 nt, Human
cagguggccaguacucaaggau

SEQ ID NO: 1064414 - RNA, 22 nt, Human
ggcucaggccagaccacgacuc

SEQ ID NO: 1064415 - RNA, 22 nt, Human
uccuugagauuaauuaaucacc

SEQ ID NO: 1064416 - RNA, 22 nt, Human
uuucacagguaagcaauacagg

SEQ ID NO: 1064417 - RNA, 22 nt, Human
auguaaauuguacugacacacg

SEQ ID NO: 1064418 - RNA, 22 nt, Human
ucugagagccucuagccuaagu

SEQ ID NO: 1064419 - RNA, 22 nt, Human
uuucauaaugucacagucaaaa

SEQ ID NO: 1064420 - RNA, 22 nt, Human
cuguuucaagugaagucagaca

SEQ ID NO: 1064421 - RNA, 22 nt, Human
ucagagucucccccaguuuggg

SEQ ID NO: 1064422 - RNA, 22 nt, Human
acagccugcagccccaggucgc

SEQ ID NO: 1064423 - RNA, 22 nt, Human
cuuuacaaagcaauuuugucuc

SEQ ID NO: 1064424 - RNA, 22 nt, Human
agaaguaugugagaaauuaucc

SEQ ID NO: 1064425 - RNA, 22 nt, Human
auauuugucaucugccuuaguu

SEQ ID NO: 1064426 - RNA, 22 nt, Human
cuuuaauuaggaaguauaauga

SEQ ID NO: 1064427 - RNA, 22 nt, Human
ugcccccagacagaauccaguu

SEQ ID NO: 1064428 - RNA, 22 nt, Human
cccugcaggggaccugcagccu

SEQ ID NO: 1064429 - RNA, 22 nt, Human
ggcaggcuuugagaaagagcau

SEQ ID NO: 1064430 - RNA, 22 nt, Human
uuugacuucuaucuaguaagaa

SEQ ID NO: 1064431 - RNA, 18 nt, Human
caauuucauccuuaagcc

SEQ ID NO: 1064432 - RNA, 17 nt, Human
uguuccauuugaccacc

SEQ ID NO: 1064433 - RNA, 22 nt, Human
uauacaguuaaguuucuucagu

SEQ ID NO: 1064434 - RNA, 22 nt, Human
ccaaggaggccccaggucagcu

SEQ ID NO: 1064435 - RNA, 22 nt, Human
acagcagagugugagauagcca

SEQ ID NO: 1064436 - RNA, 22 nt, Human
ugaggugguccaaagacuguuu

SEQ ID NO: 1064437 - RNA, 22 nt, Human
uuugcauuuguuuagaaccuga

SEQ ID NO: 1064438 - RNA, 22 nt, Human
caguggcagagaacagagaccu

SEQ ID NO: 1064439 - RNA, 22 nt, Human
ugaaaauucaucucauagcaga

SEQ ID NO: 1064440 - RNA, 22 nt, Human
uggagcugauacagcuggcuuu

SEQ ID NO: 1064441 - RNA, 22 nt, Human
gaggccuggaccagccacagag

SEQ ID NO: 1064442 - RNA, 22 nt, Human
acguagcacugagagaugcagg

SEQ ID NO: 1064443 - RNA, 22 nt, Human
aggagccauggaggugaggcgg

SEQ ID NO: 1064444 - RNA, 22 nt, Human
uucagaaggauuuuaacacaug

SEQ ID NO: 1064445 - RNA, 22 nt, Human
agccagggauggcagugcccag

SEQ ID NO: 1064446 - RNA, 22 nt, Human
uguggccugggagcugaggucu

SEQ ID NO: 1064447 - RNA, 22 nt, Human
acucacuuuccauucaagcacc

SEQ ID NO: 1064448 - RNA, 22 nt, Human
uccuuaaaugaacucugcauga

SEQ ID NO: 1064449 - RNA, 22 nt, Human
gccuggagaggaagccggugga

SEQ ID NO: 1064450 - RNA, 22 nt, Human
ggagucaccaaguaggagucuu

SEQ ID NO: 1064451 - RNA, 20 nt, Human
cacagcuugccuuuuaugac

SEQ ID NO: 1064452 - RNA, 22 nt, Human
aaucuauaugcuuuucacauac

SEQ ID NO: 1064453 - RNA, 22 nt, Human
aaauaaacugaagcacagagag

SEQ ID NO: 1064454 - RNA, 22 nt, Human
aaaugucuguaugagaaagaga

SEQ ID NO: 1064455 - RNA, 22 nt, Human
ugguccuggaagguccugaggg

SEQ ID NO: 1064456 - RNA, 22 nt, Human
ugcauacacaagcauacaugua

SEQ ID NO: 1064457 - RNA, 18 nt, Human
ugaggaaggggaaguauu

SEQ ID NO: 1064458 - RNA, 21 nt, Human
aacaaagggaugcucaucuuu

SEQ ID NO: 1064459 - RNA, 22 nt, Human
caggaaauuuaagaguguacaa

SEQ ID NO: 1064460 - RNA, 22 nt, Human
uuugggaagaggaaucucugga

SEQ ID NO: 1064461 - RNA, 22 nt, Human
cuggaagguucuuugugugccu

SEQ ID NO: 1064462 - RNA, 22 nt, Human
caagauggguguugugaugguu

SEQ ID NO: 1064463 - RNA, 22 nt, Human
aaaaguauuuuggaucucagau

SEQ ID NO: 1064464 - RNA, 21 nt, Human
caucacaggaugauuuuuuca

SEQ ID NO: 1064465 - RNA, 22 nt, Human
ucacauuucuuuauguagucuu

SEQ ID NO: 1064466 - RNA, 22 nt, Human
uacaaacuguuauuauuauugu

SEQ ID NO: 1064467 - RNA, 22 nt, Human
ccuccagcgcgauccacuccgg

SEQ ID NO: 1064468 - RNA, 22 nt, Human
ugccugucagggggagugggaa

SEQ ID NO: 1064469 - RNA, 22 nt, Human
ucugagacaacuuagcccucga

SEQ ID NO: 1064470 - RNA, 22 nt, Human
aacuuccagcuuucugucuaau

SEQ ID NO: 1064471 - RNA, 22 nt, Human
gauauugccagauguccccgga

SEQ ID NO: 1064472 - RNA, 22 nt, Human
ucugagaggcagaccuuccuaa

SEQ ID NO: 1064473 - RNA, 22 nt, Human
gaaaauaggcugcaucuccuuc

SEQ ID NO: 1064474 - RNA, 22 nt, Human
uacaacaggaauuucaacuuug

SEQ ID NO: 1064475 - RNA, 22 nt, Human
cacuuaaaacuccuggaauugu

SEQ ID NO: 1064476 - RNA, 22 nt, Human
gucuuuuucuacgauagcgccu

SEQ ID NO: 1064477 - RNA, 22 nt, Human
agagccugggaauuugcauguu

SEQ ID NO: 1064478 - RNA, 22 nt, Human
aaucuggcauuugagaguagga

SEQ ID NO: 1064479 - RNA, 22 nt, Human
agauacauagcugugagcacac

SEQ ID NO: 1064480 - RNA, 22 nt, Human
ucggagcuguagaugaaacccu

SEQ ID NO: 1064481 - RNA, 22 nt, Human
caggugcugcguggcggagcug

SEQ ID NO: 1064482 - RNA, 22 nt, Human
agcagguggauuuagacgggag

SEQ ID NO: 1064483 - RNA, 22 nt, Human
acagaugguuauugucauuucu

SEQ ID NO: 1064484 - RNA, 22 nt, Human
aagcccuccguacgugcuagcu

SEQ ID NO: 1064485 - RNA, 22 nt, Human
aaagaugucauacacauuaaga

SEQ ID NO: 1064486 - RNA, 22 nt, Human
gcacccagaauaaggacaggac

SEQ ID NO: 1064487 - RNA, 22 nt, Human
uagcugccagaccauucuuacu

SEQ ID NO: 1064488 - RNA, 22 nt, Human
acauaugcucaucugcauuccc

SEQ ID NO: 1064489 - RNA, 22 nt, Human
agccugagccccauccagcuga

SEQ ID NO: 1064490 - RNA, 22 nt, Human
acaauuucuuauaguucaauuc

SEQ ID NO: 1064491 - RNA, 22 nt, Human
auauuauagacagagucuucug

SEQ ID NO: 1064492 - RNA, 22 nt, Human
uguucauuauucuucaucugcc

SEQ ID NO: 1064493 - RNA, 22 nt, Human
ccucaggauccgcaggugcagu

SEQ ID NO: 1064494 - RNA, 22 nt, Human
uuuuaaaggauacucuugucua

SEQ ID NO: 1064495 - RNA, 22 nt, Human
auuaaucauuucugcauuaucu

SEQ ID NO: 1064496 - RNA, 22 nt, Human
auuuugcuuuauguaaauaugu

SEQ ID NO: 1064497 - RNA, 22 nt, Human
gggcagauggggcacaggcuga

SEQ ID NO: 1064498 - RNA, 22 nt, Human
gaggcucagagugguuaaauaa

SEQ ID NO: 1064499 - RNA, 19 nt, Human
agugucaucagcuacucag

SEQ ID NO: 1064500 - RNA, 22 nt, Human
ccuggagauuauuugguccaau

SEQ ID NO: 1064501 - RNA, 22 nt, Human
uuuauguacauauccacaagga

SEQ ID NO: 1064502 - RNA, 22 nt, Human
agguagcauauuccagacuugu

SEQ ID NO: 1064503 - RNA, 22 nt, Human
uggcucagugacauuccuccca

SEQ ID NO: 1064504 - RNA, 22 nt, Human
gaguccaguuagugaggcuggg

SEQ ID NO: 1064505 - RNA, 22 nt, Human
uggaagaauuuggggauaaauu

SEQ ID NO: 1064506 - RNA, 22 nt, Human
aaggcacucauucaaggagaua

SEQ ID NO: 1064507 - RNA, 22 nt, Human
accugccuauggagccacaugg

SEQ ID NO: 1064508 - RNA, 20 nt, Human
acccugccaggcaugugaau

SEQ ID NO: 1064509 - RNA, 19 nt, Human
agugguagaugagcaggag

SEQ ID NO: 1064510 - RNA, 22 nt, Human
augggcugugggacccuggacc

SEQ ID NO: 1064511 - RNA, 22 nt, Human
auuguauuagcacaauacaauu

SEQ ID NO: 1064512 - RNA, 22 nt, Human
uguucccuccuccccacugggu

SEQ ID NO: 1064513 - RNA, 22 nt, Human
ccugagugaauucccucacugu

SEQ ID NO: 1064514 - RNA, 22 nt, Human
uuaugacauaugaguacaagua

SEQ ID NO: 1064515 - RNA, 22 nt, Human
uuacugauuuuugggcccuacc

SEQ ID NO: 1064516 - RNA, 22 nt, Human
augcaaauaaagcaacuauaca

SEQ ID NO: 1064517 - RNA, 22 nt, Human
ggcuggcagaagugugcuggcu

SEQ ID NO: 1064518 - RNA, 21 nt, Human
ugggcagauggcaguguggcu

SEQ ID NO: 1064519 - RNA, 23 nt, Human
aaugauuucaugaugauagcagc

SEQ ID NO: 1064520 - RNA, 22 nt, Human
caggagcucuuaaggaugugau

SEQ ID NO: 1064521 - RNA, 22 nt, Human
uuaaaagucugaugauuuacau

SEQ ID NO: 1064522 - RNA, 22 nt, Human
agagccagguguagucucggag

SEQ ID NO: 1064523 - RNA, 22 nt, Human
ucagacagagaaguacaaugag

SEQ ID NO: 1064524 - RNA, 22 nt, Human
guuucauauauaguaacugaaa

SEQ ID NO: 1064525 - RNA, 22 nt, Human
caggcuggagugcaguugugca

SEQ ID NO: 1064526 - RNA, 22 nt, Human
aaauaaagguccacuuuagggc

SEQ ID NO: 1064527 - RNA, 22 nt, Human
uuuacagcaacagugcagaggu

SEQ ID NO: 1064528 - RNA, 22 nt, Human
agauuucagguuggggcagaag

SEQ ID NO: 1064529 - RNA, 22 nt, Human
auucuuggagcagucaaagaag

SEQ ID NO: 1064530 - RNA, 22 nt, Human
auuaguaaaacauuguauaugu

SEQ ID NO: 1064531 - RNA, 22 nt, Human
aucuucucauguguaaugaggu

SEQ ID NO: 1064532 - RNA, 22 nt, Human
ugccugugacccaaggaugcga

SEQ ID NO: 1064533 - RNA, 22 nt, Human
augcccuggacuucuaguauuc

SEQ ID NO: 1064534 - RNA, 22 nt, Human
cugccccuggcuggugaagcag

SEQ ID NO: 1064535 - RNA, 22 nt, Human
gaggaggcacuugagcagaugu

SEQ ID NO: 1064536 - RNA, 22 nt, Human
aagauuuccauuucuagcucau

SEQ ID NO: 1064537 - RNA, 19 nt, Human
cucuggccucuggaugcug

SEQ ID NO: 1064538 - RNA, 22 nt, Human
uggaggcauuuuagguugucac

SEQ ID NO: 1064539 - RNA, 20 nt, Human
ggaacaugaaugugaguggc

SEQ ID NO: 1064540 - RNA, 22 nt, Human
acauuugacauuuaguaucagc

SEQ ID NO: 1064541 - RNA, 22 nt, Human
agugcuggcccauagcugcugg

SEQ ID NO: 1064542 - RNA, 22 nt, Human
gaacccaggcuuuugaggcugu

SEQ ID NO: 1064543 - RNA, 22 nt, Human
ugagcaguaacagcucacaggg

SEQ ID NO: 1064544 - RNA, 22 nt, Human
aaggagcucccggcagaccagg

SEQ ID NO: 1064545 - RNA, 22 nt, Human
uaaacuacccaugacaguuuca

SEQ ID NO: 1064546 - RNA, 22 nt, Human
aaaacuuagcuaggcaaguuuu

SEQ ID NO: 1064547 - RNA, 22 nt, Human
guggcagagguuccucagugug

SEQ ID NO: 1064548 - RNA, 22 nt, Human
aagugacaaaaggguauccaaa

SEQ ID NO: 1064549 - RNA, 22 nt, Human
gauguuuucuggaaaaugaaug

SEQ ID NO: 1064550 - RNA, 22 nt, Human
gcugaugucccacugacagcca

SEQ ID NO: 1064551 - RNA, 22 nt, Human
gggcuggagccuggcggugguu

SEQ ID NO: 1064552 - RNA, 23 nt, Human
uuggacaaggccagagccagcac

SEQ ID NO: 1064553 - RNA, 22 nt, Human
uggcagucgaucauauucagca

SEQ ID NO: 1064554 - RNA, 22 nt, Human
ggcuggguuauuuauggccaag

SEQ ID NO: 1064555 - RNA, 21 nt, Human
uccauuguuuucccaggguuu

SEQ ID NO: 1064556 - RNA, 22 nt, Human
ucacugaagacugggcucuaaa

SEQ ID NO: 1064557 - RNA, 22 nt, Human
acugaguguaggacuuugaguu

SEQ ID NO: 1064558 - RNA, 22 nt, Human
ugaaacuucuaauaugaauagu

SEQ ID NO: 1064559 - RNA, 22 nt, Human
uugggcucaggaguuugagacc

SEQ ID NO: 1064560 - RNA, 22 nt, Human
cagagacagaaaauggaucuag

SEQ ID NO: 1064561 - RNA, 20 nt, Human
gcugggggugugcugaguga

SEQ ID NO: 1064562 - RNA, 22 nt, Human
acauuucucagguaagucauuu

SEQ ID NO: 1064563 - RNA, 22 nt, Human
gggcuuggcacaugggcucagc

SEQ ID NO: 1064564 - RNA, 22 nt, Human
guuacaaaggacugggggccac

SEQ ID NO: 1064565 - RNA, 22 nt, Human
uuugaauauacuucaaacaaag

SEQ ID NO: 1064566 - RNA, 22 nt, Human
agggaagaggaccagagucucu

SEQ ID NO: 1064567 - RNA, 22 nt, Human
uaacacauauuucaagaguagu

SEQ ID NO: 1064568 - RNA, 22 nt, Human
gauggccuggguccccuuccgg

SEQ ID NO: 1064569 - RNA, 22 nt, Human
gaaauauuacaguggaggggau

SEQ ID NO: 1064570 - RNA, 22 nt, Human
uuccaaauguuggacaacugua

SEQ ID NO: 1064571 - RNA, 22 nt, Human
guggccagccccauggacaguu

SEQ ID NO: 1064572 - RNA, 22 nt, Human
uggccucugggaaagcagauuc

SEQ ID NO: 1064573 - RNA, 22 nt, Human
ugucuagggagcugcucaggcu

SEQ ID NO: 1064574 - RNA, 22 nt, Human
cuccucacuuuccagacugggc

SEQ ID NO: 1064575 - RNA, 21 nt, Human
gcaugccugcaucuuaguguu

SEQ ID NO: 1064576 - RNA, 22 nt, Human
caaaacauucagagagcucacu

SEQ ID NO: 1064577 - RNA, 20 nt, Human
uggggccuguuucugugguu

SEQ ID NO: 1064578 - RNA, 22 nt, Human
ucuaaacaguuucacucuuaau

SEQ ID NO: 1064579 - RNA, 22 nt, Human
gugcugccggcauagcagugaa

SEQ ID NO: 1064580 - RNA, 22 nt, Human
uaccacaguuuaucuauucagc

SEQ ID NO: 1064581 - RNA, 21 nt, Human
uccaaaucccauucuguaguc

SEQ ID NO: 1064582 - RNA, 22 nt, Human
ucucaggaauagaguggcagca

SEQ ID NO: 1064583 - RNA, 22 nt, Human
acaguggaugugauguccaggu

SEQ ID NO: 1064584 - RNA, 22 nt, Human
ccacuguagagauuugaaugcc

SEQ ID NO: 1064585 - RNA, 22 nt, Human
ucccucagggugcaguugcuuu

SEQ ID NO: 1064586 - RNA, 18 nt, Human
aggcagcagcaucuucuc

SEQ ID NO: 1064587 - RNA, 22 nt, Human
uguuuacuagccaacauggaga

SEQ ID NO: 1064588 - RNA, 22 nt, Human
ccuggaaggugaugguacagca

SEQ ID NO: 1064589 - RNA, 20 nt, Human
ggaccagguggggcgguggc

SEQ ID NO: 1064590 - RNA, 22 nt, Human
aacacaaaaauucucaggggca

SEQ ID NO: 1064591 - RNA, 22 nt, Human
ggcucugcuucagaaggcucau

SEQ ID NO: 1064592 - RNA, 22 nt, Human
guccucaggaaggcuuucugac

SEQ ID NO: 1064593 - RNA, 22 nt, Human
uugaaacaguagcucauagacc

SEQ ID NO: 1064594 - RNA, 22 nt, Human
gaaaggagaggguuaaggagcu

SEQ ID NO: 1064595 - RNA, 22 nt, Human
cugagcccuugucuuccugguc

SEQ ID NO: 1064596 - RNA, 18 nt, Human
gugagcagagagcaucac

SEQ ID NO: 1064597 - RNA, 22 nt, Human
uagucagugaucaguggaguug

SEQ ID NO: 1064598 - RNA, 22 nt, Human
uaagaccaauccuguguaccuc

SEQ ID NO: 1064599 - RNA, 22 nt, Human
agagcccuuucuccaggcaccu

SEQ ID NO: 1064600 - RNA, 22 nt, Human
gcuucuggaagcugcuucugcc

SEQ ID NO: 1064601 - RNA, 22 nt, Human
cugcugaucgaaucagucaccc

SEQ ID NO: 1064602 - RNA, 22 nt, Human
uuuaaaaaacuagucugagucu

SEQ ID NO: 1064603 - RNA, 22 nt, Human
uagucccauuuugagguauuug

SEQ ID NO: 1064604 - RNA, 22 nt, Human
cagagcugcgcuuuuuccuggu

SEQ ID NO: 1064605 - RNA, 22 nt, Human
aaugucugcucuacucaggagg

SEQ ID NO: 1064606 - RNA, 22 nt, Human
aaaugcugcagcuaguguguuu

SEQ ID NO: 1064607 - RNA, 22 nt, Human
gcccugccugccgguguggguc

SEQ ID NO: 1064608 - RNA, 22 nt, Human
auugucgcuuauuuaggugcuu

SEQ ID NO: 1064609 - RNA, 19 nt, Human
ucuuuucacgcauuuugaa

SEQ ID NO: 1064610 - RNA, 22 nt, Human
uccuuuguggaaauacuugugg

SEQ ID NO: 1064611 - RNA, 22 nt, Human
uuauuuaaaagugguaagauuc

SEQ ID NO: 1064612 - RNA, 22 nt, Human
gcacugagucugucaugcugca

SEQ ID NO: 1064613 - RNA, 22 nt, Human
agcacacaucacuucugcucau

SEQ ID NO: 1064614 - RNA, 22 nt, Human
aauuucuugggagcucagagaa

SEQ ID NO: 1064615 - RNA, 18 nt, Human
uggaggaaucacaauggc

SEQ ID NO: 1064616 - RNA, 22 nt, Human
aaaaaaucagaucuuugguuaa

SEQ ID NO: 1064617 - RNA, 22 nt, Human
gaaauauacauugcaggaagag

SEQ ID NO: 1064618 - RNA, 22 nt, Human
aguggaccagaagacugaagcu

SEQ ID NO: 1064619 - RNA, 22 nt, Human
gcagugaaucuggcaagaauuu

SEQ ID NO: 1064620 - RNA, 19 nt, Human
uucuguaaggacauuaauc

SEQ ID NO: 1064621 - RNA, 22 nt, Human
gcaaaguuccuacuuuacugga

SEQ ID NO: 1064622 - RNA, 22 nt, Human
aauaucuguggccauacaauuu

SEQ ID NO: 1064623 - RNA, 22 nt, Human
cuggagccauguauagccuaug

SEQ ID NO: 1064624 - RNA, 21 nt, Human
acugccuggggugcuggccaa

SEQ ID NO: 1064625 - RNA, 22 nt, Human
ucacagugagccaugucagaga

SEQ ID NO: 1064626 - RNA, 22 nt, Human
agcuuuaaaaauccaauaucca

SEQ ID NO: 1064627 - RNA, 22 nt, Human
caggugggcugccucuccagcu

SEQ ID NO: 1064628 - RNA, 22 nt, Human
ugcagccaucuuucuuggagga

SEQ ID NO: 1064629 - RNA, 22 nt, Human
acauacuaugaauacauguguc

SEQ ID NO: 1064630 - RNA, 22 nt, Human
auacauuauuguuaaagaacau

SEQ ID NO: 1064631 - RNA, 22 nt, Human
cuacauuuugugauuaugaaau

SEQ ID NO: 1064632 - RNA, 22 nt, Human
aaugguuuguaccuguccuugg

SEQ ID NO: 1064633 - RNA, 16 nt, Human
ggcaccagugaacaca

SEQ ID NO: 1064634 - RNA, 22 nt, Human
gagaccucuugguaucgcuagg

SEQ ID NO: 1064635 - RNA, 19 nt, Human
ccugggagucagcugaagg

SEQ ID NO: 1064636 - RNA, 22 nt, Human
gaauguuugacuaaagguagcu

SEQ ID NO: 1064637 - RNA, 22 nt, Human
cuggggugagcagaaacagggg

SEQ ID NO: 1064638 - RNA, 22 nt, Human
uccuccugccuuugcuucuugu

SEQ ID NO: 1064639 - RNA, 22 nt, Human
agcuaacacauuccagcuauuu

SEQ ID NO: 1064640 - RNA, 22 nt, Human
ucugugaacaucacauugacag

SEQ ID NO: 1064641 - RNA, 22 nt, Human
augcaguauaaaucauuucugg

SEQ ID NO: 1064642 - RNA, 22 nt, Human
cuccaaguauguuaaaaucuaa

SEQ ID NO: 1064643 - RNA, 22 nt, Human
gcacugaaauuauaugcauuug

SEQ ID NO: 1064644 - RNA, 22 nt, Human
caggaaagggaugggcugccac

SEQ ID NO: 1064645 - RNA, 22 nt, Human
uuaguuuccuguggugugaagu

SEQ ID NO: 1064646 - RNA, 22 nt, Human
acaaauuuggugagaguaaaua

SEQ ID NO: 1064647 - RNA, 22 nt, Human
ucuggcuccaccuccuuuacua

SEQ ID NO: 1064648 - RNA, 22 nt, Human
ucagaggcuucuggccagucug

SEQ ID NO: 1064649 - RNA, 22 nt, Human
acacaagugaauauuuuaagga

SEQ ID NO: 1064650 - RNA, 22 nt, Human
ucaaguauuauuacagauguag

SEQ ID NO: 1064651 - RNA, 22 nt, Human
auguauuuuaagauuugccuca

SEQ ID NO: 1064652 - RNA, 22 nt, Human
ccucagaggugaacaucagugc

SEQ ID NO: 1064653 - RNA, 22 nt, Human
uucugaauccucgaaacauagc

SEQ ID NO: 1064654 - RNA, 21 nt, Human
aguuuuauauuauaagcuaaa

SEQ ID NO: 1064655 - RNA, 21 nt, Human
gccuggcagguggaagggcuc

SEQ ID NO: 1064656 - RNA, 22 nt, Human
uucugaaagucuuuuuaaguua

SEQ ID NO: 1064657 - RNA, 22 nt, Human
cuggaaaguacagugugucaca

SEQ ID NO: 1064658 - RNA, 22 nt, Human
uagcagcaauuucagaaguuug

SEQ ID NO: 1064659 - RNA, 22 nt, Human
ccagcccugaacccugcugcau

SEQ ID NO: 1064660 - RNA, 22 nt, Human
agaggcagaaguguucaaaccc

SEQ ID NO: 1064661 - RNA, 22 nt, Human
cccuuccuugugacuggugggg

SEQ ID NO: 1064662 - RNA, 21 nt, Human
cagcuuugucugucuucgggg

SEQ ID NO: 1064663 - RNA, 22 nt, Human
gacacagggggauguguggacg

SEQ ID NO: 1064664 - RNA, 22 nt, Human
agggagcaugggugaagcaggc

SEQ ID NO: 1064665 - RNA, 22 nt, Human
guggcuucacauggcauuuggc

SEQ ID NO: 1064666 - RNA, 22 nt, Human
agucccagcccaguccuguaag

SEQ ID NO: 1064667 - RNA, 22 nt, Human
ucugaagaacugaguaaacaug

SEQ ID NO: 1064668 - RNA, 22 nt, Human
gauauugcauauuggaugaguu

SEQ ID NO: 1064669 - RNA, 22 nt, Human
uauuuccugcauggugauguaa

SEQ ID NO: 1064670 - RNA, 22 nt, Human
ccagucugugugccagccugcg

SEQ ID NO: 1064671 - RNA, 22 nt, Human
uuuggaauguaguuuaaucauc

SEQ ID NO: 1064672 - RNA, 22 nt, Human
ugcucugugguccaagauggcu

SEQ ID NO: 1064673 - RNA, 22 nt, Human
ucugagggugggagaaggagcu

SEQ ID NO: 1064674 - RNA, 22 nt, Human
gagaaagauuguccuucagggg

SEQ ID NO: 1064675 - RNA, 22 nt, Human
gugaagauaaggaugcugcagu

SEQ ID NO: 1064676 - RNA, 22 nt, Human
cacaggaacaaagaagacaauu

SEQ ID NO: 1064677 - RNA, 22 nt, Human
aguaucaaucacccuuugaagu

SEQ ID NO: 1064678 - RNA, 22 nt, Human
uucuucuccuaaggagaguccu

SEQ ID NO: 1064679 - RNA, 18 nt, Human
gcauuuuaaucugaggca

SEQ ID NO: 1064680 - RNA, 20 nt, Human
cacguuuuuccacuagcaaa

SEQ ID NO: 1064681 - RNA, 22 nt, Human
agagccccugguggagugagaa

SEQ ID NO: 1064682 - RNA, 23 nt, Human
auuuuacaggucaguuccuugaa

SEQ ID NO: 1064683 - RNA, 22 nt, Human
aggacacaacaucauuucugug

SEQ ID NO: 1064684 - RNA, 22 nt, Human
uucauuagaaaaguaaaaaugc

SEQ ID NO: 1064685 - RNA, 22 nt, Human
uaaaaguuuuaguuguacauaa

SEQ ID NO: 1064686 - RNA, 22 nt, Human
cagagcugcucaugguggccag

SEQ ID NO: 1064687 - RNA, 23 nt, Human
ugagcccaggaggucaaggcugc

SEQ ID NO: 1064688 - RNA, 22 nt, Human
ccuucaugucauuggacaccuu

SEQ ID NO: 1064689 - RNA, 22 nt, Human
uggcccugaggacccagugugg

SEQ ID NO: 1064690 - RNA, 22 nt, Human
uccaaauauucaucuacuucug

SEQ ID NO: 1064691 - RNA, 22 nt, Human
ucagaugguuccaucauuuuuc

SEQ ID NO: 1064692 - RNA, 22 nt, Human
ggaaagagcccagcagugcuug

SEQ ID NO: 1064693 - RNA, 22 nt, Human
uuuccaauucaagcuuuuacgu

SEQ ID NO: 1064694 - RNA, 22 nt, Human
acauuuuuacugggcaucugca

SEQ ID NO: 1064695 - RNA, 19 nt, Human
uuaagcuaagauacuagua

SEQ ID NO: 1064696 - RNA, 22 nt, Human
ugaagcuuguauuuaaauaagu

SEQ ID NO: 1064697 - RNA, 22 nt, Human
uugcuuuuaauuaaucauugcu

SEQ ID NO: 1064698 - RNA, 22 nt, Human
uuuguaugugauaagacuauuc

SEQ ID NO: 1064699 - RNA, 22 nt, Human
ucaucacauguguagucauccc

SEQ ID NO: 1064700 - RNA, 22 nt, Human
cuuauucagcacuugcucugua

SEQ ID NO: 1064701 - RNA, 22 nt, Human
aggacagagccugugcagaccg

SEQ ID NO: 1064702 - RNA, 22 nt, Human
caagggcagcagccucaagcgg

SEQ ID NO: 1064703 - RNA, 22 nt, Human
uggcagagugcggcauccccug

SEQ ID NO: 1064704 - RNA, 22 nt, Human
aaacagcugcacugcugauguc

SEQ ID NO: 1064705 - RNA, 22 nt, Human
ucuggcucacuucaggcuucac

SEQ ID NO: 1064706 - RNA, 22 nt, Human
acagcuggcaggggggcaugaa

SEQ ID NO: 1064707 - RNA, 18 nt, Human
ugucucugaauuccagug

SEQ ID NO: 1064708 - RNA, 23 nt, Human
uggaaacauucugaauguccauc

SEQ ID NO: 1064709 - RNA, 22 nt, Human
uggcccugacagguccugggca

SEQ ID NO: 1064710 - RNA, 22 nt, Human
agggcagcuaaggugcugacug

SEQ ID NO: 1064711 - RNA, 22 nt, Human
uguaaauuggaaaucaaucaag

SEQ ID NO: 1064712 - RNA, 22 nt, Human
guggcauuugaacaaucacaua

SEQ ID NO: 1064713 - RNA, 22 nt, Human
gacccaggguuucugcacaggg

SEQ ID NO: 1064714 - RNA, 22 nt, Human
cccaggcagagagcuggugagc

SEQ ID NO: 1064715 - RNA, 22 nt, Human
uguuuacaaggaguuuauauug

SEQ ID NO: 1064716 - RNA, 22 nt, Human
ggcacugaaguggguguugggu

SEQ ID NO: 1064717 - RNA, 22 nt, Human
ucaguguucuuauuuaauuagg

SEQ ID NO: 1064718 - RNA, 22 nt, Human
gggcagcauucugugggcaggu

SEQ ID NO: 1064719 - RNA, 22 nt, Human
uggacccuggacugcccuggcc

SEQ ID NO: 1064720 - RNA, 22 nt, Human
acagaacagaggguuuuagaau

SEQ ID NO: 1064721 - RNA, 22 nt, Human
uuauguuugaguauaugacuca

SEQ ID NO: 1064722 - RNA, 22 nt, Human
gccaggaagucagccaagccca

SEQ ID NO: 1064723 - RNA, 17 nt, Human
cugggccucugcccuuu

SEQ ID NO: 1064724 - RNA, 22 nt, Human
acagggcagugucuugaaaaau

SEQ ID NO: 1064725 - RNA, 22 nt, Human
uuucacaggaugcuguuuuaua

SEQ ID NO: 1064726 - RNA, 21 nt, Human
gcugggccuguacuugcccug

SEQ ID NO: 1064727 - RNA, 22 nt, Human
cuggagccuucaccaggggaaa

SEQ ID NO: 1064728 - RNA, 22 nt, Human
ugggggagaguuuagaugauuu

SEQ ID NO: 1064729 - RNA, 22 nt, Human
ugcuucuguuucauugaucuua

SEQ ID NO: 1064730 - RNA, 22 nt, Human
gggaugcagucagagccccugu

SEQ ID NO: 1064731 - RNA, 22 nt, Human
caguuucuuuccauuguuaccu

SEQ ID NO: 1064732 - RNA, 22 nt, Human
acacagggucuagaguuaggcc

SEQ ID NO: 1064733 - RNA, 22 nt, Human
ccugcuggcggggacccaguga

SEQ ID NO: 1064734 - RNA, 22 nt, Human
gcugugcaguaguagguacagu

SEQ ID NO: 1064735 - RNA, 22 nt, Human
caaguuauuccuuuacacuaua

SEQ ID NO: 1064736 - RNA, 22 nt, Human
aagaucaccuugacaugaaaag

SEQ ID NO: 1064737 - RNA, 22 nt, Human
agauaacuaaagaaagggauua

SEQ ID NO: 1064738 - RNA, 22 nt, Human
cuggcacuuggcacccaugaaa

SEQ ID NO: 1064739 - RNA, 22 nt, Human
guccugguuuucacagaccuuu

SEQ ID NO: 1064740 - RNA, 22 nt, Human
ggguccagacacuccagaggaa

SEQ ID NO: 1064741 - RNA, 22 nt, Human
ucgcuugaacccaggaagugga

SEQ ID NO: 1064742 - RNA, 22 nt, Human
auguuucaccaguuuuauaaga

SEQ ID NO: 1064743 - RNA, 22 nt, Human
auuuguaucaaucucaauauau

SEQ ID NO: 1064744 - RNA, 22 nt, Human
gagagugagauaauuucacaua

SEQ ID NO: 1064745 - RNA, 22 nt, Human
gcagaaagcuccuugcgaucug

SEQ ID NO: 1064746 - RNA, 22 nt, Human
auagccuugguccuugcuccac

SEQ ID NO: 1064747 - RNA, 22 nt, Human
ugggccuguugggguugaguua

SEQ ID NO: 1064748 - RNA, 22 nt, Human
uuguaugaccacaaucugacgu

SEQ ID NO: 1064749 - RNA, 22 nt, Human
cacauaaauggugccauguuuu

SEQ ID NO: 1064750 - RNA, 22 nt, Human
guggaaggugcuagaacaagga

SEQ ID NO: 1064751 - RNA, 22 nt, Human
acagagcaugauggaagaucga

SEQ ID NO: 1064752 - RNA, 22 nt, Human
cugcugagcccuggcacaggug

SEQ ID NO: 1064753 - RNA, 22 nt, Human
ugucucugugacuccuuccgcc

SEQ ID NO: 1064754 - RNA, 22 nt, Human
ugcuggcuacugauggcaggcc

SEQ ID NO: 1064755 - RNA, 22 nt, Human
agagccaggaucuguuuugggg

SEQ ID NO: 1064756 - RNA, 22 nt, Human
uguguacagcaugguccagcag

SEQ ID NO: 1064757 - RNA, 22 nt, Human
uguggggcuuacaaaggcagau

SEQ ID NO: 1064758 - RNA, 22 nt, Human
ggcucuggugugaagcagccuc

SEQ ID NO: 1064759 - RNA, 22 nt, Human
cuaagaaggaggaaaagugcca

SEQ ID NO: 1064760 - RNA, 22 nt, Human
ccaggagguggagauugcagug

SEQ ID NO: 1064761 - RNA, 22 nt, Human
aaugaagcaguuuucaucaagu

SEQ ID NO: 1064762 - RNA, 22 nt, Human
ugaguggaguagugaaugcauu

SEQ ID NO: 1064763 - RNA, 22 nt, Human
gcugcugggagggaucguaaau

SEQ ID NO: 1064764 - RNA, 22 nt, Human
caguguccucagccagcagcua

SEQ ID NO: 1064765 - RNA, 22 nt, Human
uggggcuggcuauugucucccu

SEQ ID NO: 1064766 - RNA, 22 nt, Human
agggacagucuacuguucacug

SEQ ID NO: 1064767 - RNA, 22 nt, Human
aaaauacuguggaguguugaaa

SEQ ID NO: 1064768 - RNA, 22 nt, Human
ugucccagauacuggacauaga

SEQ ID NO: 1064769 - RNA, 22 nt, Human
caucuacaggagaaugucacug

SEQ ID NO: 1064770 - RNA, 22 nt, Human
auuugacauugacacaccuaug

SEQ ID NO: 1064771 - RNA, 22 nt, Human
aaauguuucuacuugugagcau

SEQ ID NO: 1064772 - RNA, 22 nt, Human
ggcacacagcuuggcaggagau

SEQ ID NO: 1064773 - RNA, 19 nt, Human
aagcuccagcagauccuuu

SEQ ID NO: 1064774 - RNA, 22 nt, Human
cacugcccagcgucuuaggcac

SEQ ID NO: 1064775 - RNA, 22 nt, Human
guaauaauuugcuaccuggugg

SEQ ID NO: 1064776 - RNA, 22 nt, Human
uuugucaucaguuauuaauaug

SEQ ID NO: 1064777 - RNA, 22 nt, Human
cuccagugcgcaggacagcccc

SEQ ID NO: 1064778 - RNA, 22 nt, Human
cucugggccaccgcugguguau

SEQ ID NO: 1064779 - RNA, 22 nt, Human
uucacaaaacacuauuuucugg

SEQ ID NO: 1064780 - RNA, 22 nt, Human
ccacugggcguuucuguccaau

SEQ ID NO: 1064781 - RNA, 22 nt, Human
agggccugucuguagaacugaa

SEQ ID NO: 1064782 - RNA, 22 nt, Human
aauuaauucaguuuuuaaggga

SEQ ID NO: 1064783 - RNA, 22 nt, Human
uggaagagaaaauccacccuua

SEQ ID NO: 1064784 - RNA, 22 nt, Human
uaccauuucauucuuuccucau

SEQ ID NO: 1064785 - RNA, 22 nt, Human
ucuuuguacaggaaggcacugu

SEQ ID NO: 1064786 - RNA, 22 nt, Human
uuggaacagaaacagacaaaua

SEQ ID NO: 1064787 - RNA, 22 nt, Human
caccaggagccaucaggagucc

SEQ ID NO: 1064788 - RNA, 22 nt, Human
aggcaacacuugcauuuuuuag

SEQ ID NO: 1064789 - RNA, 22 nt, Human
uaucacacucggaaaucuagga

SEQ ID NO: 1064790 - RNA, 22 nt, Human
guucacagaaggccagauggua

SEQ ID NO: 1064791 - RNA, 22 nt, Human
acuuuaacuguuauuacucacc

SEQ ID NO: 1064792 - RNA, 22 nt, Human
cagggcucaccacugggauccu

SEQ ID NO: 1064793 - RNA, 22 nt, Human
ccaggcuguuuucaaacuuggg

SEQ ID NO: 1064794 - RNA, 19 nt, Human
agacacacuugauaugugu

SEQ ID NO: 1064795 - RNA, 22 nt, Human
cagcagcuguuuacggaacacc

SEQ ID NO: 1064796 - RNA, 22 nt, Human
gggauggggagcuggaaagggg

SEQ ID NO: 1064797 - RNA, 22 nt, Human
agagaagggguaaagaguccug

SEQ ID NO: 1064798 - RNA, 22 nt, Human
acacuuuuaagacuuuaaugaa

SEQ ID NO: 1064799 - RNA, 22 nt, Human
acccaggaugauaauguucaca

SEQ ID NO: 1064800 - RNA, 22 nt, Human
ccuuuacaucugacuucuuuca

SEQ ID NO: 1064801 - RNA, 22 nt, Human
aacauacagugagcaguggacu

SEQ ID NO: 1064802 - RNA, 22 nt, Human
uggcucagugcauucacaguaa

SEQ ID NO: 1064803 - RNA, 22 nt, Human
uucaaguuaccuuuaaacagcu

SEQ ID NO: 1064804 - RNA, 22 nt, Human
ccuuuccuguguccuuuuaagg

SEQ ID NO: 1064805 - RNA, 22 nt, Human
ucuuucaauccauucauauguc

SEQ ID NO: 1064806 - RNA, 22 nt, Human
aaauguuuaaguguaggagcaa

SEQ ID NO: 1064807 - RNA, 22 nt, Human
ggccucagaaauagaguaaaau

SEQ ID NO: 1064808 - RNA, 22 nt, Human
uuaguucucaugaauuuuaagu

SEQ ID NO: 1064809 - RNA, 22 nt, Human
acauaauggacaauaaugcauc

SEQ ID NO: 1064810 - RNA, 23 nt, Human
ucguugaauagcaauagcacaac

SEQ ID NO: 1064811 - RNA, 22 nt, Human
uguccugugaccuggcaccaca

SEQ ID NO: 1064812 - RNA, 22 nt, Human
ucaugcacaugugucaccauca

SEQ ID NO: 1064813 - RNA, 16 nt, Human
aaagaaacaggugucc

SEQ ID NO: 1064814 - RNA, 22 nt, Human
aaagcugcugccaaucaggcuu

SEQ ID NO: 1064815 - RNA, 22 nt, Human
aagccagggguugguaugcuau

SEQ ID NO: 1064816 - RNA, 22 nt, Human
uccaggccuugacaggucaguu

SEQ ID NO: 1064817 - RNA, 22 nt, Human
ucaguuuucauuucaugagcag

SEQ ID NO: 1064818 - RNA, 22 nt, Human
augaaaagggagugauauuugu

SEQ ID NO: 1064819 - RNA, 23 nt, Human
gugugccaagcacugugccagga

SEQ ID NO: 1064820 - RNA, 22 nt, Human
aggcgugggaggaucugaggcc

SEQ ID NO: 1064821 - RNA, 22 nt, Human
cauuacaugguccaggauauau

SEQ ID NO: 1064822 - RNA, 22 nt, Human
aggcagaauguuggaaaggaag

SEQ ID NO: 1064823 - RNA, 22 nt, Human
uaacuaagugacucaagugauc

SEQ ID NO: 1064824 - RNA, 22 nt, Human
aaaaguguucaggaagaauaau

SEQ ID NO: 1064825 - RNA, 22 nt, Human
augcagcuucaggauuaugaug

SEQ ID NO: 1064826 - RNA, 22 nt, Human
cugcagggaccacaagcagguu

SEQ ID NO: 1064827 - RNA, 22 nt, Human
uggaagaauauggggguacaga

SEQ ID NO: 1064828 - RNA, 22 nt, Human
cuagagugaagggucuugaggc

SEQ ID NO: 1064829 - RNA, 22 nt, Human
ucuuuauuucugaaucccccau

SEQ ID NO: 1064830 - RNA, 18 nt, Human
auugcuuuuguaccaacc

SEQ ID NO: 1064831 - RNA, 22 nt, Human
gcuguguuggugaagcuguagc

SEQ ID NO: 1064832 - RNA, 22 nt, Human
cuucagggugacgcaggcugca

SEQ ID NO: 1064833 - RNA, 22 nt, Human
cuguugauuagaauuucacauc

SEQ ID NO: 1064834 - RNA, 22 nt, Human
uuauguacaauguuaauguaaa

SEQ ID NO: 1064835 - RNA, 22 nt, Human
cuguacagaccuauuagcccag

SEQ ID NO: 1064836 - RNA, 22 nt, Human
cuugccuucuguuccuauagaa

SEQ ID NO: 1064837 - RNA, 22 nt, Human
gcaaggcugagcacauuugcau

SEQ ID NO: 1064838 - RNA, 23 nt, Human
cauguacagaguuugauaaagug

SEQ ID NO: 1064839 - RNA, 22 nt, Human
gcagcaguacucaauauccugg

SEQ ID NO: 1064840 - RNA, 22 nt, Human
ucacauuuucuuaggaaacuua

SEQ ID NO: 1064841 - RNA, 22 nt, Human
uugcaucuaccauaucaaagau

SEQ ID NO: 1064842 - RNA, 22 nt, Human
ugcaaacaauuuccuauaaagu

SEQ ID NO: 1064843 - RNA, 22 nt, Human
ucaaguaugacaucaaguuucu

SEQ ID NO: 1064844 - RNA, 22 nt, Human
aggacucaucccugcuugucag

SEQ ID NO: 1064845 - RNA, 22 nt, Human
ggcugggcaaacaagacucuuc

SEQ ID NO: 1064846 - RNA, 22 nt, Human
acucacagggccucaguuuucc

SEQ ID NO: 1064847 - RNA, 22 nt, Human
agaaagaggaugcagaucucau

SEQ ID NO: 1064848 - RNA, 19 nt, Human
uaguggagugacaaguucu

SEQ ID NO: 1064849 - RNA, 22 nt, Human
gcacagaacacuggugaguccc

SEQ ID NO: 1064850 - RNA, 22 nt, Human
aaauacuagaauucagaguuga

SEQ ID NO: 1064851 - RNA, 22 nt, Human
acugcuggcaugcauauacaaa

SEQ ID NO: 1064852 - RNA, 22 nt, Human
ccugcagagccacgugccagcg

SEQ ID NO: 1064853 - RNA, 22 nt, Human
agggaggaaggauguuccaaag

SEQ ID NO: 1064854 - RNA, 22 nt, Human
uggccugccccgagauccuggc

SEQ ID NO: 1064855 - RNA, 22 nt, Human
agggucccgaaggagacagcaa

SEQ ID NO: 1064856 - RNA, 22 nt, Human
ugucauuuauuuugcugucugu

SEQ ID NO: 1064857 - RNA, 19 nt, Human
ucaaagcaagcauguucug

SEQ ID NO: 1064858 - RNA, 22 nt, Human
guggcaggagagacacagccau

SEQ ID NO: 1064859 - RNA, 22 nt, Human
uucuuuugggaauuacguaugc

SEQ ID NO: 1064860 - RNA, 20 nt, Human
ccuccaggcacacccaugug

SEQ ID NO: 1064861 - RNA, 22 nt, Human
aauggcugccagggcaggaggu

SEQ ID NO: 1064862 - RNA, 22 nt, Human
ugaaaacuccaaguuucaucag

SEQ ID NO: 1064863 - RNA, 22 nt, Human
uuacaauguaaggcaugguucu

SEQ ID NO: 1064864 - RNA, 22 nt, Human
agccuauuccaggaugagcuca

SEQ ID NO: 1064865 - RNA, 22 nt, Human
ucuggucuccaggagugguggu

SEQ ID NO: 1064866 - RNA, 18 nt, Human
ggcuuugcugggguuucu

SEQ ID NO: 1064867 - RNA, 22 nt, Human
aaaguuaguaaaaugggauaua

SEQ ID NO: 1064868 - RNA, 22 nt, Human
ugcugccauggucgcugguguc

SEQ ID NO: 1064869 - RNA, 22 nt, Human
agcuuuauauuuaaugaauucu

SEQ ID NO: 1064870 - RNA, 22 nt, Human
cugcuuugggcagcuuuguggc

SEQ ID NO: 1064871 - RNA, 22 nt, Human
aggccuuccucggagacaggga

SEQ ID NO: 1064872 - RNA, 22 nt, Human
uuucuuccuuaccuuacuagag

SEQ ID NO: 1064873 - RNA, 22 nt, Human
ucuucaguugucauacugccuu

SEQ ID NO: 1064874 - RNA, 23 nt, Human
cugcagccgcguggggacgugga

SEQ ID NO: 1064875 - RNA, 22 nt, Human
aguaacaaauauucauuggauu

SEQ ID NO: 1064876 - RNA, 22 nt, Human
gaugauauuuugacuggagaau

SEQ ID NO: 1064877 - RNA, 22 nt, Human
caauuucugggccucacacaag

SEQ ID NO: 1064878 - RNA, 22 nt, Human
caggcagcugaggacuuugcua

SEQ ID NO: 1064879 - RNA, 22 nt, Human
ggcucagagaccugcgaucuga

SEQ ID NO: 1064880 - RNA, 22 nt, Human
cuggagugacuuuguuccuuuu

SEQ ID NO: 1064881 - RNA, 22 nt, Human
uuacaauuacuugaucucagcu

SEQ ID NO: 1064882 - RNA, 22 nt, Human
auauuuuuccaugugggacucu

SEQ ID NO: 1064883 - RNA, 22 nt, Human
uacaguuaaaaaguucaauggu

SEQ ID NO: 1064884 - RNA, 22 nt, Human
ccucugggcagguagcagcagc

SEQ ID NO: 1064885 - RNA, 20 nt, Human
ugggaaagucuaagugccuc

SEQ ID NO: 1064886 - RNA, 22 nt, Human
caguuucuauggcugggcucug

SEQ ID NO: 1064887 - RNA, 22 nt, Human
gcugcuggcgcugggcguccgg

SEQ ID NO: 1064888 - RNA, 20 nt, Human
uucuuaguagagcauguauu

SEQ ID NO: 1064889 - RNA, 20 nt, Human
cccuggccuguuucaugccc

SEQ ID NO: 1064890 - RNA, 22 nt, Human
aaaacacaagaagcaggguaca

SEQ ID NO: 1064891 - RNA, 22 nt, Human
aaucuguuuaguucugcguaug

SEQ ID NO: 1064892 - RNA, 22 nt, Human
aaggucauugguucugaauucu

SEQ ID NO: 1064893 - RNA, 22 nt, Human
ccacaaggaggacagcaguugg

SEQ ID NO: 1064894 - RNA, 22 nt, Human
cagaauaaagguacaauugagu

SEQ ID NO: 1064895 - RNA, 22 nt, Human
ggcagguggccaagugucuaag

SEQ ID NO: 1064896 - RNA, 22 nt, Human
aaacagaguuugguaaauagcc

SEQ ID NO: 1064897 - RNA, 22 nt, Human
cuugauguauaaguugauaugu

SEQ ID NO: 1064898 - RNA, 22 nt, Human
uuguccuaauuuauggccugga

SEQ ID NO: 1064899 - RNA, 22 nt, Human
acacuuuagaaaaaagaauggu

SEQ ID NO: 1064900 - RNA, 22 nt, Human
aauaccuuuccugccauucacu

SEQ ID NO: 1064901 - RNA, 18 nt, Human
ucaaaauauuucugugga

SEQ ID NO: 1064902 - RNA, 22 nt, Human
agagccaggaaguggcgugggg

SEQ ID NO: 1064903 - RNA, 22 nt, Human
caggcuugcugcuagagcacuu

SEQ ID NO: 1064904 - RNA, 22 nt, Human
accaucagucauugucaguggg

SEQ ID NO: 1064905 - RNA, 22 nt, Human
aggggcagccucacaauccucu

SEQ ID NO: 1064906 - RNA, 22 nt, Human
auaauaaaccaggaugggucug

SEQ ID NO: 1064907 - RNA, 22 nt, Human
gagggagagugauggaccauug

SEQ ID NO: 1064908 - RNA, 22 nt, Human
ucagcaaccaggggcacagucc

SEQ ID NO: 1064909 - RNA, 22 nt, Human
ucuuugaacuuggcugaucucu

SEQ ID NO: 1064910 - RNA, 22 nt, Human
aaacagcaauuacuuuugcacc

SEQ ID NO: 1064911 - RNA, 17 nt, Human
auccccagcaucuagaa

SEQ ID NO: 1064912 - RNA, 22 nt, Human
ugcucagccgugagcagagccg

SEQ ID NO: 1064913 - RNA, 22 nt, Human
aaacaugaguuaaaaguaacug

SEQ ID NO: 1064914 - RNA, 22 nt, Human
ggcuccuguccccucagcugcu

SEQ ID NO: 1064915 - RNA, 22 nt, Human
caacauaugcuuucaugaggua

SEQ ID NO: 1064916 - RNA, 22 nt, Human
ccaaggcuggagugcaguggcg

SEQ ID NO: 1064917 - RNA, 22 nt, Human
ucagagucuaaauagaagaaua

SEQ ID NO: 1064918 - RNA, 22 nt, Human
gggaucagaaacauagcccuga

SEQ ID NO: 1064919 - RNA, 22 nt, Human
acugaauuccucuuucuuaucc

SEQ ID NO: 1064920 - RNA, 22 nt, Human
uaagaaacauuuuuaugacagu

SEQ ID NO: 1064921 - RNA, 22 nt, Human
ccucugaguccucccugguugc

SEQ ID NO: 1064922 - RNA, 22 nt, Human
auagaauagcauagaaaauuga

SEQ ID NO: 1064923 - RNA, 22 nt, Human
ggaggccaccugaccugcuguu

SEQ ID NO: 1064924 - RNA, 22 nt, Human
accugagccuagggagguugag

SEQ ID NO: 1064925 - RNA, 22 nt, Human
gucuuguuugggauguggaugg

SEQ ID NO: 1064926 - RNA, 22 nt, Human
ucaaaaucaaagauacuugaaa

SEQ ID NO: 1064927 - RNA, 22 nt, Human
cucugagaggugagaagcagca

SEQ ID NO: 1064928 - RNA, 22 nt, Human
auaaaugauucagcaggaaaua

SEQ ID NO: 1064929 - RNA, 22 nt, Human
acugcuuuucagagucugccug

SEQ ID NO: 1064930 - RNA, 22 nt, Human
aagagaauaucgauagcacucu

SEQ ID NO: 1064931 - RNA, 22 nt, Human
uuauuuguaucaaggacgguug

SEQ ID NO: 1064932 - RNA, 23 nt, Human
ucugagagaacaaugccuccuau

SEQ ID NO: 1064933 - RNA, 22 nt, Human
auacaacugccuuagaaggaaa

SEQ ID NO: 1064934 - RNA, 22 nt, Human
cuuuucuucucacggcugucag

SEQ ID NO: 1064935 - RNA, 22 nt, Human
ccaggcugcuguugguguccgc

SEQ ID NO: 1064936 - RNA, 22 nt, Human
uuccuauccuuuuauguuuaug

SEQ ID NO: 1064937 - RNA, 22 nt, Human
ggcuccugggaugggacugagc

SEQ ID NO: 1064938 - RNA, 22 nt, Human
ucuuuggaucccaacuggcugg

SEQ ID NO: 1064939 - RNA, 22 nt, Human
ugcuccagaaccugaccaugcu

SEQ ID NO: 1064940 - RNA, 22 nt, Human
caggcugggcagccuccccggc

SEQ ID NO: 1064941 - RNA, 22 nt, Human
ucaggcuaacccuaggcagaag

SEQ ID NO: 1064942 - RNA, 22 nt, Human
acuucauguugcucuuggcuau

SEQ ID NO: 1064943 - RNA, 22 nt, Human
caaacugagcaucagaaaguuu

SEQ ID NO: 1064944 - RNA, 22 nt, Human
cacccacccacugcucauuggc

SEQ ID NO: 1064945 - RNA, 19 nt, Human
cugcagggaugugcagagu

SEQ ID NO: 1064946 - RNA, 22 nt, Human
aucaaaguuucccagaaguugu

SEQ ID NO: 1064947 - RNA, 22 nt, Human
aacugcaaaauaaucaaguugu

SEQ ID NO: 1064948 - RNA, 22 nt, Human
uccuguggcguuaucaugugau

SEQ ID NO: 1064949 - RNA, 22 nt, Human
gugugcagggggccagcgcagc

SEQ ID NO: 1064950 - RNA, 22 nt, Human
ucuggcucucucaucacccaau

SEQ ID NO: 1064951 - RNA, 22 nt, Human
accaagcuguauauuauugguu

SEQ ID NO: 1064952 - RNA, 22 nt, Human
gccaggagccagcuucuuagca

SEQ ID NO: 1064953 - RNA, 22 nt, Human
uggcucuguuuuaugaguacca

SEQ ID NO: 1064954 - RNA, 22 nt, Human
auuugugccaaauuauuucuaa

SEQ ID NO: 1064955 - RNA, 22 nt, Human
gugcagcugagggccucuucua

SEQ ID NO: 1064956 - RNA, 22 nt, Human
gcaagcugcuuaagcucauugu

SEQ ID NO: 1064957 - RNA, 22 nt, Human
aagcaguguucccagcuggccc

SEQ ID NO: 1064958 - RNA, 22 nt, Human
gccaggagugucccacucauuu

SEQ ID NO: 1064959 - RNA, 22 nt, Human
agucccagcuucccccaugcag

SEQ ID NO: 1064960 - RNA, 21 nt, Human
uuacuaaacaaaacaugcagg

SEQ ID NO: 1064961 - RNA, 22 nt, Human
gcucuucauucucccaaauagg

SEQ ID NO: 1064962 - RNA, 22 nt, Human
cuauucuagauuacaguauaaa

SEQ ID NO: 1064963 - RNA, 22 nt, Human
cagcugccuucugcgggaaguc

SEQ ID NO: 1064964 - RNA, 22 nt, Human
gggcuacagacaugcucuaagc

SEQ ID NO: 1064965 - RNA, 22 nt, Human
caggauccccaggucgccgucc

SEQ ID NO: 1064966 - RNA, 22 nt, Human
aguauuuucaaccauagccugg

SEQ ID NO: 1064967 - RNA, 22 nt, Human
gaaaucaguucugaaauuuaca

SEQ ID NO: 1064968 - RNA, 22 nt, Human
agcagguggccuccugucuguc

SEQ ID NO: 1064969 - RNA, 22 nt, Human
uucacauaaauagaucacauca

SEQ ID NO: 1064970 - RNA, 22 nt, Human
gcuggccuuugaggaagcugcg

SEQ ID NO: 1064971 - RNA, 22 nt, Human
gggggcaguaaggauauggaaa

SEQ ID NO: 1064972 - RNA, 22 nt, Human
uauuagguuagugcaaaaguuu

SEQ ID NO: 1064973 - RNA, 22 nt, Human
ucacugcaaucucugccuucca

SEQ ID NO: 1064974 - RNA, 22 nt, Human
ccagagccugcugagccccauu

SEQ ID NO: 1064975 - RNA, 22 nt, Human
aagccaguguuuuugagaguug

SEQ ID NO: 1064976 - RNA, 22 nt, Human
ggugaggcuggcuugccuucuu

SEQ ID NO: 1064977 - RNA, 22 nt, Human
gcagcagagaacacaaugaugg

SEQ ID NO: 1064978 - RNA, 19 nt, Human
gugggacagacauuacaua

SEQ ID NO: 1064979 - RNA, 18 nt, Human
gagcccugagucugcaca

SEQ ID NO: 1064980 - RNA, 22 nt, Human
agccaaggagugcagguggcuu

SEQ ID NO: 1064981 - RNA, 22 nt, Human
auuaauauccugcuggcuaaau

SEQ ID NO: 1064982 - RNA, 22 nt, Human
cuccugggcuaugucugcuugg

SEQ ID NO: 1064983 - RNA, 21 nt, Human
acagaugggaugagcacacug

SEQ ID NO: 1064984 - RNA, 22 nt, Human
guuuaauaauguugaauuacua

SEQ ID NO: 1064985 - RNA, 19 nt, Human
ucuggcuccugccaggcug

SEQ ID NO: 1064986 - RNA, 22 nt, Human
guuucuuaaauguagcaggacc

SEQ ID NO: 1064987 - RNA, 22 nt, Human
acauguggucaaucuguguagg

SEQ ID NO: 1064988 - RNA, 22 nt, Human
agcaggcuaagggaccuguuua

SEQ ID NO: 1064989 - RNA, 22 nt, Human
gcccaucaucacuguggaggcu

SEQ ID NO: 1064990 - RNA, 22 nt, Human
guacaguuuucaguguucacug

SEQ ID NO: 1064991 - RNA, 22 nt, Human
aggggaugccuaguggagucuc

SEQ ID NO: 1064992 - RNA, 22 nt, Human
uacaagaaggaaaacuagcaau

SEQ ID NO: 1064993 - RNA, 22 nt, Human
ggagcugcuuugaucugaagaa

SEQ ID NO: 1064994 - RNA, 18 nt, Human
gcuuugcagaaauacaga

SEQ ID NO: 1064995 - RNA, 22 nt, Human
guucacagaaauuguguaccuc

SEQ ID NO: 1064996 - RNA, 22 nt, Human
aaaucaguaaauguucauuaac

SEQ ID NO: 1064997 - RNA, 22 nt, Human
gaggcagccucaguggaccucg

SEQ ID NO: 1064998 - RNA, 22 nt, Human
aggcugaggcgggaggaucacu

SEQ ID NO: 1064999 - RNA, 22 nt, Human
cauugcacugcagcccgggcaa

SEQ ID NO: 1065000 - RNA, 22 nt, Human
cagggagaaaucuccaggaggu

SEQ ID NO: 1065001 - RNA, 22 nt, Human
cacagggcuuugauggcugagu

SEQ ID NO: 1065002 - RNA, 22 nt, Human
ucauugcacuccagccugggca

SEQ ID NO: 1065003 - RNA, 22 nt, Human
ccugggagagucuguggucucc

SEQ ID NO: 1065004 - RNA, 22 nt, Human
uguguuccuucgucuucccuuc

SEQ ID NO: 1065005 - RNA, 22 nt, Human
cugaggcuuggaggggucuggu

SEQ ID NO: 1065006 - RNA, 22 nt, Human
uucauucccuuauauuagcauu

SEQ ID NO: 1065007 - RNA, 22 nt, Human
guuuuucuagacugggaguuug

SEQ ID NO: 1065008 - RNA, 22 nt, Human
auauucuucuuguucagacuau

SEQ ID NO: 1065009 - RNA, 22 nt, Human
uaggccaggacagagcuuccag

SEQ ID NO: 1065010 - RNA, 20 nt, Human
aggaagauccuuucuuuuaa

SEQ ID NO: 1065011 - RNA, 22 nt, Human
ggcaggugcuaagagagguaaa

SEQ ID NO: 1065012 - RNA, 22 nt, Human
uuguaacacucccacucuucuu

SEQ ID NO: 1065013 - RNA, 22 nt, Human
gaguguggugaacaggagcacc

SEQ ID NO: 1065014 - RNA, 22 nt, Human
auuugcaugaccuuugcaagug

SEQ ID NO: 1065015 - RNA, 20 nt, Human
aagaaaacgucuucagggga

SEQ ID NO: 1065016 - RNA, 22 nt, Human
uucagaaugagaauggaugggu

SEQ ID NO: 1065017 - RNA, 22 nt, Human
ugcucuucggggccacugcuug

SEQ ID NO: 1065018 - RNA, 22 nt, Human
guuucaaauagguuucagcaaa

SEQ ID NO: 1065019 - RNA, 23 nt, Human
agcagccauagggaagcaauaca

SEQ ID NO: 1065020 - RNA, 22 nt, Human
agcccugcgaucgugauuucuu

SEQ ID NO: 1065021 - RNA, 22 nt, Human
uaugagaacugacagagugcca

SEQ ID NO: 1065022 - RNA, 22 nt, Human
gccuggagacaaggacaaaggg

SEQ ID NO: 1065023 - RNA, 21 nt, Human
agccugccugaacucuguggc

SEQ ID NO: 1065024 - RNA, 22 nt, Human
ugaggcagggaguuuaauuguc

SEQ ID NO: 1065025 - RNA, 23 nt, Human
uucauuugucuacuucacuuguu

SEQ ID NO: 1065026 - RNA, 22 nt, Human
uugaacaguuuugucagguuca

SEQ ID NO: 1065027 - RNA, 22 nt, Human
cauaauuaaauucugggcaaga

SEQ ID NO: 1065028 - RNA, 18 nt, Human
ucaguauuaccucaggca

SEQ ID NO: 1065029 - RNA, 22 nt, Human
ugugggcccagauucugaggcu

SEQ ID NO: 1065030 - RNA, 22 nt, Human
gcagagcauguccucaggacag

SEQ ID NO: 1065031 - RNA, 22 nt, Human
ucaaucuagagauuaaaauagg

SEQ ID NO: 1065032 - RNA, 22 nt, Human
ugacagcugagccccaggcaag

SEQ ID NO: 1065033 - RNA, 22 nt, Human
aaaauugaagugaucaggaacu

SEQ ID NO: 1065034 - RNA, 22 nt, Human
ucuuuccuuagaauaauucuuu

SEQ ID NO: 1065035 - RNA, 22 nt, Human
uaaaaucgcacugcuguuguua

SEQ ID NO: 1065036 - RNA, 22 nt, Human
aaggcccugucuccaaauacag

SEQ ID NO: 1065037 - RNA, 22 nt, Human
aggaaugguuauggggauagua

SEQ ID NO: 1065038 - RNA, 22 nt, Human
acagcagcgucaacuuaaaauu

SEQ ID NO: 1065039 - RNA, 22 nt, Human
agggugggcuagacucuucccc

SEQ ID NO: 1065040 - RNA, 22 nt, Human
cagcuugggaguuugguuuuau

SEQ ID NO: 1065041 - RNA, 19 nt, Human
ggcagcuggacgcuguuca

SEQ ID NO: 1065042 - RNA, 22 nt, Human
ugaaaugaaacagaacauauca

SEQ ID NO: 1065043 - RNA, 22 nt, Human
cagaugcuuuugauucuggggu

SEQ ID NO: 1065044 - RNA, 22 nt, Human
uaugaagauauaucugaucucu

SEQ ID NO: 1065045 - RNA, 23 nt, Human
ggggaaguggcagugagugaggc

SEQ ID NO: 1065046 - RNA, 22 nt, Human
uucuuucucacucuuuaggaag

SEQ ID NO: 1065047 - RNA, 22 nt, Human
aagagcuggagcugcuacagga

SEQ ID NO: 1065048 - RNA, 22 nt, Human
uacauggugguggcacuugacu

SEQ ID NO: 1065049 - RNA, 22 nt, Human
ucaucugucccaggcuuuuuuc

SEQ ID NO: 1065050 - RNA, 22 nt, Human
uuuguaagugguagaucuaaga

SEQ ID NO: 1065051 - RNA, 19 nt, Human
ugagugggccccugcagac

SEQ ID NO: 1065052 - RNA, 22 nt, Human
uucuggaucagcaucaugagau

SEQ ID NO: 1065053 - RNA, 22 nt, Human
cacugaaggcuaggauuagaug

SEQ ID NO: 1065054 - RNA, 22 nt, Human
agcagguggugggccagauuug

SEQ ID NO: 1065055 - RNA, 22 nt, Human
acuggggagugguuuugggaag

SEQ ID NO: 1065056 - RNA, 22 nt, Human
aaucaacauuguuuuaagucaa

SEQ ID NO: 1065057 - RNA, 22 nt, Human
guccucuggccuuucccaggac

SEQ ID NO: 1065058 - RNA, 22 nt, Human
gagccugggacugggggucaug

SEQ ID NO: 1065059 - RNA, 22 nt, Human
caggcuggaguuaccuuuaggg

SEQ ID NO: 1065060 - RNA, 22 nt, Human
uacaguaacauguuguacaagc

SEQ ID NO: 1065061 - RNA, 22 nt, Human
cuccaaguccgagggcucucaa

SEQ ID NO: 1065062 - RNA, 22 nt, Human
uacauucauggugacuuguaug

SEQ ID NO: 1065063 - RNA, 22 nt, Human
auuugaaguaaguaaugaguau

SEQ ID NO: 1065064 - RNA, 22 nt, Human
caggccugacccugagcuucac

SEQ ID NO: 1065065 - RNA, 22 nt, Human
auuuaagauugcguauucaugu

SEQ ID NO: 1065066 - RNA, 22 nt, Human
auaucaaagcuaguggaaauuu

SEQ ID NO: 1065067 - RNA, 22 nt, Human
agggcugacagugaggagucaa

SEQ ID NO: 1065068 - RNA, 18 nt, Human
agaggggagguaagucug

SEQ ID NO: 1065069 - RNA, 18 nt, Human
ggucuuuaggucaguguc

SEQ ID NO: 1065070 - RNA, 22 nt, Human
ccagagccuggcaucugcauaa

SEQ ID NO: 1065071 - RNA, 22 nt, Human
agcagagguguuuauuauggga

SEQ ID NO: 1065072 - RNA, 22 nt, Human
uugagaagaaauaguuugcaau

SEQ ID NO: 1065073 - RNA, 22 nt, Human
ccagggugaggaggcucccacg

SEQ ID NO: 1065074 - RNA, 22 nt, Human
gacacaaaguuugucagaaauu

SEQ ID NO: 1065075 - RNA, 22 nt, Human
ucaauucaauugaacaguuacu

SEQ ID NO: 1065076 - RNA, 19 nt, Human
caggaacauggagggaggg

SEQ ID NO: 1065077 - RNA, 22 nt, Human
uaguaaagugucuuaacacaua

SEQ ID NO: 1065078 - RNA, 22 nt, Human
guuacaauguccuuacaugaaa

SEQ ID NO: 1065079 - RNA, 22 nt, Human
augauggugagguugagcacag

SEQ ID NO: 1065080 - RNA, 22 nt, Human
ggcauauguagcguguguucug

SEQ ID NO: 1065081 - RNA, 22 nt, Human
cccacgucgaacuugcuccaga

SEQ ID NO: 1065082 - RNA, 20 nt, Human
uguggcaggaugagggcgga

SEQ ID NO: 1065083 - RNA, 22 nt, Human
aggcaggcaaccaccugggaag

SEQ ID NO: 1065084 - RNA, 22 nt, Human
auuguggcuagacagucacaau

SEQ ID NO: 1065085 - RNA, 22 nt, Human
ucauuuuuagcgcgcaaaaguu

SEQ ID NO: 1065086 - RNA, 22 nt, Human
aaucaguuguucacucugaaaa

SEQ ID NO: 1065087 - RNA, 22 nt, Human
uccuugaagcuuguaucuaaua

SEQ ID NO: 1065088 - RNA, 22 nt, Human
ugaaaugagauaauuuaagugc

SEQ ID NO: 1065089 - RNA, 22 nt, Human
auucacaaaaugauauagauac

SEQ ID NO: 1065090 - RNA, 22 nt, Human
auuugcauuuagaaagaucacu

SEQ ID NO: 1065091 - RNA, 22 nt, Human
auugacaaauggauguugacau

SEQ ID NO: 1065092 - RNA, 22 nt, Human
uggcuagcccuuguggggagag

SEQ ID NO: 1065093 - RNA, 22 nt, Human
agacauggauuucuuacauaaa

SEQ ID NO: 1065094 - RNA, 22 nt, Human
ccuggguggcagagguugcagu

SEQ ID NO: 1065095 - RNA, 22 nt, Human
gaccauuuguugaaaagauuau

SEQ ID NO: 1065096 - RNA, 22 nt, Human
agugucugcuuugagucaggug

SEQ ID NO: 1065097 - RNA, 22 nt, Human
ugaguccacuuuaaaaugucag

SEQ ID NO: 1065098 - RNA, 22 nt, Human
ugaggcuugucucagauggggg

SEQ ID NO: 1065099 - RNA, 22 nt, Human
uguucaauccccagguccugaa

SEQ ID NO: 1065100 - RNA, 22 nt, Human
ccaggcaaggacaugaaacuga

SEQ ID NO: 1065101 - RNA, 20 nt, Human
ccaauguuuacagauuacuu

SEQ ID NO: 1065102 - RNA, 22 nt, Human
agcaccuugcucuuggccuucc

SEQ ID NO: 1065103 - RNA, 21 nt, Human
auuugcauuaaaauauuacgc

SEQ ID NO: 1065104 - RNA, 22 nt, Human
aucagaaaaaugagaagagcug

SEQ ID NO: 1065105 - RNA, 22 nt, Human
cuuccagcugauuacaggcuau

SEQ ID NO: 1065106 - RNA, 22 nt, Human
aauaguacaaucuacagacaua

SEQ ID NO: 1065107 - RNA, 22 nt, Human
agggccugggguagcuuacugc

SEQ ID NO: 1065108 - RNA, 22 nt, Human
gaggaaccaaucugugauauuc

SEQ ID NO: 1065109 - RNA, 22 nt, Human
ugcuccugagguuggagaucca

SEQ ID NO: 1065110 - RNA, 22 nt, Human
aacuuucuaauuuuggcugagc

SEQ ID NO: 1065111 - RNA, 21 nt, Human
cagaggcagguccugggacgg

SEQ ID NO: 1065112 - RNA, 20 nt, Human
ugugcccaauguccagguuc

SEQ ID NO: 1065113 - RNA, 23 nt, Human
uggcucagcuaguuuuccauuuc

SEQ ID NO: 1065114 - RNA, 22 nt, Human
uggagauggguuaauggagaga

SEQ ID NO: 1065115 - RNA, 22 nt, Human
ugccuuuugaagccucacaggu

SEQ ID NO: 1065116 - RNA, 22 nt, Human
gggguccuggaggccagcugga

SEQ ID NO: 1065117 - RNA, 22 nt, Human
guuauucaauggcuuauaagga

SEQ ID NO: 1065118 - RNA, 22 nt, Human
cagucccaccaggaucgcucuu

SEQ ID NO: 1065119 - RNA, 22 nt, Human
ggcacacagauggagcacuagc

SEQ ID NO: 1065120 - RNA, 22 nt, Human
cacagaaguuucauagucucga

SEQ ID NO: 1065121 - RNA, 22 nt, Human
ucuucagugcaugcccucaggc

SEQ ID NO: 1065122 - RNA, 22 nt, Human
agaauacaauuguucaguaaua

SEQ ID NO: 1065123 - RNA, 22 nt, Human
caggcacuucugcugcuugucu

SEQ ID NO: 1065124 - RNA, 22 nt, Human
gacuauuuaguuucagauuagu

SEQ ID NO: 1065125 - RNA, 22 nt, Human
ucaagagaaggggaaauagacu

SEQ ID NO: 1065126 - RNA, 22 nt, Human
cucuggaggccguuggcccuua

SEQ ID NO: 1065127 - RNA, 22 nt, Human
gguccagggaacuuugaaggau

SEQ ID NO: 1065128 - RNA, 22 nt, Human
agcugagcuaguaguuccagug

SEQ ID NO: 1065129 - RNA, 20 nt, Human
uggagguggucugcuguccu

SEQ ID NO: 1065130 - RNA, 22 nt, Human
uaugcuuuaacccucuuauauu

SEQ ID NO: 1065131 - RNA, 22 nt, Human
uucugggcauguuacauucugu

SEQ ID NO: 1065132 - RNA, 22 nt, Human
auggagugggccaauuuuagug

SEQ ID NO: 1065133 - RNA, 22 nt, Human
caggaugugaggaggccauuug

SEQ ID NO: 1065134 - RNA, 20 nt, Human
gaagauggguagaggcacag

SEQ ID NO: 1065135 - RNA, 22 nt, Human
uugcaauugcuauggagagcgu

SEQ ID NO: 1065136 - RNA, 22 nt, Human
cuccucuguauugauugggacu

SEQ ID NO: 1065137 - RNA, 22 nt, Human
ucuggcucugacacuacuguua

SEQ ID NO: 1065138 - RNA, 18 nt, Human
ccagagcuggcuccucgc

SEQ ID NO: 1065139 - RNA, 22 nt, Human
ugaaacauugcacuguaugaau

SEQ ID NO: 1065140 - RNA, 22 nt, Human
acaguggauauauuaaaugaga

SEQ ID NO: 1065141 - RNA, 19 nt, Human
gaauuuuaggacuucagca

SEQ ID NO: 1065142 - RNA, 22 nt, Human
guauuuggugaugccuccaaac

SEQ ID NO: 1065143 - RNA, 22 nt, Human
cagaaaauaaaguuucuacgca

SEQ ID NO: 1065144 - RNA, 22 nt, Human
uuuguaaaggccugaauuucag

SEQ ID NO: 1065145 - RNA, 22 nt, Human
gacacagauaucucugagauua

SEQ ID NO: 1065146 - RNA, 22 nt, Human
ugcuggaguaacaagacacuca

SEQ ID NO: 1065147 - RNA, 22 nt, Human
gcagaggacagggauuuagauu

SEQ ID NO: 1065148 - RNA, 22 nt, Human
cuuuggcaaugaaacacaagaa

SEQ ID NO: 1065149 - RNA, 22 nt, Human
acagccuugcuuauuugucucu

SEQ ID NO: 1065150 - RNA, 22 nt, Human
gggcucuucucaggagcuaucu

SEQ ID NO: 1065151 - RNA, 21 nt, Human
caguuacacaaguguuaccag

SEQ ID NO: 1065152 - RNA, 22 nt, Human
aagacuuucccucaucagaacg

SEQ ID NO: 1065153 - RNA, 22 nt, Human
gauuucaccugaucuugucauc

SEQ ID NO: 1065154 - RNA, 22 nt, Human
uuaauacagucuccagaaguaa

SEQ ID NO: 1065155 - RNA, 22 nt, Human
gggaagguauuuagcugcugaa

SEQ ID NO: 1065156 - RNA, 22 nt, Human
agcagaugaaucccagauaaag

SEQ ID NO: 1065157 - RNA, 22 nt, Human
uagcagggguagauagagugug

SEQ ID NO: 1065158 - RNA, 22 nt, Human
agaaugauuuuggacaauaugg

SEQ ID NO: 1065159 - RNA, 22 nt, Human
ugugggccucagcaggacucca

SEQ ID NO: 1065160 - RNA, 22 nt, Human
gaugggcugucugagcgcugug

SEQ ID NO: 1065161 - RNA, 22 nt, Human
uucauagaaagugcuuagauug

SEQ ID NO: 1065162 - RNA, 22 nt, Human
acacucuucucacagucaguuu

SEQ ID NO: 1065163 - RNA, 22 nt, Human
cccuggaggcggauguugcagu

SEQ ID NO: 1065164 - RNA, 22 nt, Human
uuucuucucaucccugaaauca

SEQ ID NO: 1065165 - RNA, 22 nt, Human
gaaguauaggagacaaacaaga

SEQ ID NO: 1065166 - RNA, 22 nt, Human
cacagagaauucccauauguga

SEQ ID NO: 1065167 - RNA, 22 nt, Human
gcagcuguucagcuggccagau

SEQ ID NO: 1065168 - RNA, 19 nt, Human
ccauggcaaugaucugaug

SEQ ID NO: 1065169 - RNA, 22 nt, Human
uggaagaggcccaugacugccu

SEQ ID NO: 1065170 - RNA, 22 nt, Human
cagggagcuggcuggcugugcc

SEQ ID NO: 1065171 - RNA, 22 nt, Human
ggagguggcagggaacauaauu

SEQ ID NO: 1065172 - RNA, 22 nt, Human
uguagaaaauuggagcauucau

SEQ ID NO: 1065173 - RNA, 23 nt, Human
ucuuuuuaagagaucuagugacg

SEQ ID NO: 1065174 - RNA, 22 nt, Human
ugggcucuccuggaggacaaca

SEQ ID NO: 1065175 - RNA, 22 nt, Human
aggccuguuccuuccugggcac

SEQ ID NO: 1065176 - RNA, 22 nt, Human
agggaggucuggcugcccugag

SEQ ID NO: 1065177 - RNA, 22 nt, Human
uaagguuuggcugucucuuggu

SEQ ID NO: 1065178 - RNA, 22 nt, Human
cccuggcucugccucagagccc

SEQ ID NO: 1065179 - RNA, 22 nt, Human
acaguggaagcaugaugcuauc

SEQ ID NO: 1065180 - RNA, 22 nt, Human
agacuucucuccuugacuugca

SEQ ID NO: 1065181 - RNA, 22 nt, Human
gaggcagagaccuucaggaccu

SEQ ID NO: 1065182 - RNA, 23 nt, Human
ugagcagcuaaaggugaugcggg

SEQ ID NO: 1065183 - RNA, 22 nt, Human
acuuugaaacuaaaauucauua

SEQ ID NO: 1065184 - RNA, 23 nt, Human
acugccugugccgaucucucuca

SEQ ID NO: 1065185 - RNA, 23 nt, Human
agcccugcugagacccagcuccc

SEQ ID NO: 1065186 - RNA, 22 nt, Human
aagggaggggauguaagccugg

SEQ ID NO: 1065187 - RNA, 22 nt, Human
aacauugauugcaucuguucac

SEQ ID NO: 1065188 - RNA, 22 nt, Human
aaucaaaaccuacagagguaau

SEQ ID NO: 1065189 - RNA, 22 nt, Human
uugccuuuaaccccugaaaggc

SEQ ID NO: 1065190 - RNA, 22 nt, Human
ucugagccaauuucugugucca

SEQ ID NO: 1065191 - RNA, 22 nt, Human
ucagaggaugcuguucuuuaau

SEQ ID NO: 1065192 - RNA, 22 nt, Human
agaugcuucaguguuuaauuua

SEQ ID NO: 1065193 - RNA, 22 nt, Human
ccugccagcugugggccagccu

SEQ ID NO: 1065194 - RNA, 22 nt, Human
aaucuugguugcaguauauccg

SEQ ID NO: 1065195 - RNA, 22 nt, Human
uauauuuaaauccagguugaaa

SEQ ID NO: 1065196 - RNA, 22 nt, Human
uguaugaaaaggaauagauuga

SEQ ID NO: 1065197 - RNA, 22 nt, Human
aaagguuuucugacccuuagua

SEQ ID NO: 1065198 - RNA, 22 nt, Human
gaucauuuugaugcccuuuuag

SEQ ID NO: 1065199 - RNA, 22 nt, Human
gucccuggucuaccguggcuuc

SEQ ID NO: 1065200 - RNA, 22 nt, Human
cauggcccucuucuggagcaau

SEQ ID NO: 1065201 - RNA, 22 nt, Human
caugauauaaaguaguagauaa

SEQ ID NO: 1065202 - RNA, 22 nt, Human
aauggccagcugggagaguuga

SEQ ID NO: 1065203 - RNA, 22 nt, Human
ugcucuggguccugggccuccu

SEQ ID NO: 1065204 - RNA, 22 nt, Human
agggacaguuacaucaucagac

SEQ ID NO: 1065205 - RNA, 22 nt, Human
uugguucauuauugaaugugcu

SEQ ID NO: 1065206 - RNA, 23 nt, Human
ucacuaaaguguuuagugcagau

SEQ ID NO: 1065207 - RNA, 22 nt, Human
cucugagauaguuucuaucaau

SEQ ID NO: 1065208 - RNA, 22 nt, Human
caaaguauauuucauagucuca

SEQ ID NO: 1065209 - RNA, 22 nt, Human
agauuucccaaauacuuguuau

SEQ ID NO: 1065210 - RNA, 22 nt, Human
ugaagccacacuagcuuguccu

SEQ ID NO: 1065211 - RNA, 22 nt, Human
gcuaggagugggauggaagucg

SEQ ID NO: 1065212 - RNA, 22 nt, Human
ucuaacuugaacucaugacugu

SEQ ID NO: 1065213 - RNA, 22 nt, Human
ggcacugagaacaggcugacuu

SEQ ID NO: 1065214 - RNA, 22 nt, Human
uaacuuuuacuuaccaucugag

SEQ ID NO: 1065215 - RNA, 23 nt, Human
ucuucauggccaucugguucuuc

SEQ ID NO: 1065216 - RNA, 22 nt, Human
ccuaggaaggaguauaguaaau

SEQ ID NO: 1065217 - RNA, 22 nt, Human
caucuuaccccugcuaaugacc

SEQ ID NO: 1065218 - RNA, 22 nt, Human
augcauaauguauguauugacu

SEQ ID NO: 1065219 - RNA, 22 nt, Human
ucaauauagcaguguacuugag

SEQ ID NO: 1065220 - RNA, 22 nt, Human
gaggcaggcacuguuaucagca

SEQ ID NO: 1065221 - RNA, 22 nt, Human
ccuggcacaugcaguacucaag

SEQ ID NO: 1065222 - RNA, 22 nt, Human
acucaggaaauugagauaaugg

SEQ ID NO: 1065223 - RNA, 22 nt, Human
uuagccaugugggaaaaacagc

SEQ ID NO: 1065224 - RNA, 22 nt, Human
cagggccucauccucagagauu

SEQ ID NO: 1065225 - RNA, 22 nt, Human
augggagugacagggccacugg

SEQ ID NO: 1065226 - RNA, 22 nt, Human
caggcagauuugcugcccucca

SEQ ID NO: 1065227 - RNA, 22 nt, Human
agaagccagauuguagugggac

SEQ ID NO: 1065228 - RNA, 23 nt, Human
ucugagaagguuucagccagacu

SEQ ID NO: 1065229 - RNA, 22 nt, Human
cauuuacauaacaguaacgcug

SEQ ID NO: 1065230 - RNA, 22 nt, Human
gggcugacagcacgccuucugu

SEQ ID NO: 1065231 - RNA, 22 nt, Human
cagcuuucaucagugacacuca

SEQ ID NO: 1065232 - RNA, 22 nt, Human
cugcugugauugggagaaaccg

SEQ ID NO: 1065233 - RNA, 22 nt, Human
accuugugagguuacauaaugu

SEQ ID NO: 1065234 - RNA, 22 nt, Human
aauugugcuaugauuaugaaag

SEQ ID NO: 1065235 - RNA, 22 nt, Human
cagcuguuccugguugguggga

SEQ ID NO: 1065236 - RNA, 22 nt, Human
gguuugaacagcuuuggagaag

SEQ ID NO: 1065237 - RNA, 22 nt, Human
agcugcaggcgccggggccgau

SEQ ID NO: 1065238 - RNA, 19 nt, Human
ucugcccaguugucugccc

SEQ ID NO: 1065239 - RNA, 21 nt, Human
ggcagugaugugaagugcauc

SEQ ID NO: 1065240 - RNA, 22 nt, Human
agcaaguugaaugauaauacuc

SEQ ID NO: 1065241 - RNA, 21 nt, Human
cuuauucacuguuauuuauca

SEQ ID NO: 1065242 - RNA, 22 nt, Human
ggccugagucccaccuggcugu

SEQ ID NO: 1065243 - RNA, 22 nt, Human
ccugugaggucaucugugguaa

SEQ ID NO: 1065244 - RNA, 22 nt, Human
agaucagaaauguaauggcagu

SEQ ID NO: 1065245 - RNA, 22 nt, Human
auggagacgcaagggaccuagg

SEQ ID NO: 1065246 - RNA, 20 nt, Human
ccugucuccucuuaccuggc

SEQ ID NO: 1065247 - RNA, 22 nt, Human
agcagguggccacgaggaggag

SEQ ID NO: 1065248 - RNA, 21 nt, Human
uucucuccauaugcccagccc

SEQ ID NO: 1065249 - RNA, 22 nt, Human
gggucuggacggcugcaggaag

SEQ ID NO: 1065250 - RNA, 22 nt, Human
gugggcuggauuugcuugcaga

SEQ ID NO: 1065251 - RNA, 22 nt, Human
uucugggguuaugggugauucu

SEQ ID NO: 1065252 - RNA, 22 nt, Human
aguuacaugugaauagaaagua

SEQ ID NO: 1065253 - RNA, 22 nt, Human
aaggagaaggguaaucaacaca

SEQ ID NO: 1065254 - RNA, 22 nt, Human
caggcccugggcaggaucagcc

SEQ ID NO: 1065255 - RNA, 22 nt, Human
ucacagaagaaguagauugcau

SEQ ID NO: 1065256 - RNA, 22 nt, Human
aguguuccuugcuuucccagag

SEQ ID NO: 1065257 - RNA, 22 nt, Human
gggaguguugagcgcccugcca

SEQ ID NO: 1065258 - RNA, 22 nt, Human
ucagaggaauaaugcugcauuu

SEQ ID NO: 1065259 - RNA, 22 nt, Human
caggugucuaauucucaccccc

SEQ ID NO: 1065260 - RNA, 22 nt, Human
gcagagaguugggcugcgccag

SEQ ID NO: 1065261 - RNA, 22 nt, Human
agaguccagaaaacagugugcu

SEQ ID NO: 1065262 - RNA, 22 nt, Human
agcagugaaacagcugcauaug

SEQ ID NO: 1065263 - RNA, 19 nt, Human
uuucaauggcuuagagaaa

SEQ ID NO: 1065264 - RNA, 19 nt, Human
gguuaauguuaggauacuu

SEQ ID NO: 1065265 - RNA, 22 nt, Human
aggacagcaguuggugagguuc

SEQ ID NO: 1065266 - RNA, 22 nt, Human
uuaagugccucuaaaacaagcc

SEQ ID NO: 1065267 - RNA, 22 nt, Human
gcauggcagugaggauggugcu

SEQ ID NO: 1065268 - RNA, 22 nt, Human
auacacagccauuaugaauuag

SEQ ID NO: 1065269 - RNA, 22 nt, Human
gugcugaguagaaugaaugccu

SEQ ID NO: 1065270 - RNA, 22 nt, Human
ugcaccauuaauuuaugugaga

SEQ ID NO: 1065271 - RNA, 22 nt, Human
ucagaaagcuauaugguguguc

SEQ ID NO: 1065272 - RNA, 20 nt, Human
cagauggcacgucagggcau

SEQ ID NO: 1065273 - RNA, 22 nt, Human
gaccugccugagcugccucugc

SEQ ID NO: 1065274 - RNA, 22 nt, Human
cugcacuguguaacagauaacu

SEQ ID NO: 1065275 - RNA, 22 nt, Human
aagguggucuuacugaugguau

SEQ ID NO: 1065276 - RNA, 22 nt, Human
ggcagcugggucacaccgaucu

SEQ ID NO: 1065277 - RNA, 22 nt, Human
acaaagucuuuuacaacaguca

SEQ ID NO: 1065278 - RNA, 22 nt, Human
aaugggagguaguaugggaggu

SEQ ID NO: 1065279 - RNA, 22 nt, Human
agcugguguccuccuggagcug

SEQ ID NO: 1065280 - RNA, 22 nt, Human
uguuucaacuguuaagauaugc

SEQ ID NO: 1065281 - RNA, 22 nt, Human
gccuggagcccaguguggggcu

SEQ ID NO: 1065282 - RNA, 22 nt, Human
uuugcauugcauacaaggaacu

SEQ ID NO: 1065283 - RNA, 22 nt, Human
gggcagagagcuggaacuccuu

SEQ ID NO: 1065284 - RNA, 22 nt, Human
gagguggcugggaguagggaau

SEQ ID NO: 1065285 - RNA, 18 nt, Human
ugugcaauauuaaccacc

SEQ ID NO: 1065286 - RNA, 16 nt, Human
gcacacagccagccuu

SEQ ID NO: 1065287 - RNA, 22 nt, Human
ggaaggucgagcugcaucuggc

SEQ ID NO: 1065288 - RNA, 22 nt, Human
uaauagcauuaucaucaaaacu

SEQ ID NO: 1065289 - RNA, 22 nt, Human
agaggggagagcuaagcaauuc

SEQ ID NO: 1065290 - RNA, 22 nt, Human
ucuggcccagccccugagguca

SEQ ID NO: 1065291 - RNA, 22 nt, Human
gugccugugcggacucagggaa

SEQ ID NO: 1065292 - RNA, 22 nt, Human
agugaggauaccaauguguaga

SEQ ID NO: 1065293 - RNA, 22 nt, Human
ugcugggcuagaagcugaggcc

SEQ ID NO: 1065294 - RNA, 22 nt, Human
guaauuuuggaguauaaccugg

SEQ ID NO: 1065295 - RNA, 22 nt, Human
cagggccuuauccugccauuga

SEQ ID NO: 1065296 - RNA, 22 nt, Human
agaauacaguaggagccugggc

SEQ ID NO: 1065297 - RNA, 22 nt, Human
cugaaauguuaaauacuuggcu

SEQ ID NO: 1065298 - RNA, 22 nt, Human
uguggcugucuguucuccuagg

SEQ ID NO: 1065299 - RNA, 22 nt, Human
uucuaauacacgguaugacuuu

SEQ ID NO: 1065300 - RNA, 22 nt, Human
caccuggcagcuguuggccacg

SEQ ID NO: 1065301 - RNA, 22 nt, Human
uucuggcucauaugcuaagaag

SEQ ID NO: 1065302 - RNA, 22 nt, Human
ugggcagggucucuguuaucag

SEQ ID NO: 1065303 - RNA, 22 nt, Human
acuuguaaguaacaagugagaa

SEQ ID NO: 1065304 - RNA, 22 nt, Human
gaagcccuauccucuccuggga

SEQ ID NO: 1065305 - RNA, 18 nt, Human
ccaggacaggcaaaaggu

SEQ ID NO: 1065306 - RNA, 22 nt, Human
ucaugacaacuauauuauucca

SEQ ID NO: 1065307 - RNA, 22 nt, Human
ucuccuucgaggcccagcuccc

SEQ ID NO: 1065308 - RNA, 22 nt, Human
aagacuuauagucaguaauucu

SEQ ID NO: 1065309 - RNA, 22 nt, Human
agggccagagucuguguagaua

SEQ ID NO: 1065310 - RNA, 22 nt, Human
uuuaggagucaaauguuuuagg

SEQ ID NO: 1065311 - RNA, 22 nt, Human
uucaaagugcauguuccucaga

SEQ ID NO: 1065312 - RNA, 22 nt, Human
ugugaguacugcuauuuauaua

SEQ ID NO: 1065313 - RNA, 22 nt, Human
gcucaggaucccaggggugugc

SEQ ID NO: 1065314 - RNA, 22 nt, Human
ucugcuggaaaaccagggaauu

SEQ ID NO: 1065315 - RNA, 22 nt, Human
gauucauucucaguuucuagag

SEQ ID NO: 1065316 - RNA, 22 nt, Human
aaauuauucaaaaagcuguguu

SEQ ID NO: 1065317 - RNA, 22 nt, Human
caggccucagagaguggcgggg

SEQ ID NO: 1065318 - RNA, 22 nt, Human
gcacccagggacuuggcuggcc

SEQ ID NO: 1065319 - RNA, 22 nt, Human
uucaacaaggcugucaaaaguu

SEQ ID NO: 1065320 - RNA, 22 nt, Human
guggccagugggaaugggcuca

SEQ ID NO: 1065321 - RNA, 22 nt, Human
auagauguacguauguaaauca

SEQ ID NO: 1065322 - RNA, 22 nt, Human
accugccucagugcagcuggau

SEQ ID NO: 1065323 - RNA, 21 nt, Human
gccuggcuagaagcuccuagc

SEQ ID NO: 1065324 - RNA, 22 nt, Human
agcccuucaaccugccuacucc

SEQ ID NO: 1065325 - RNA, 22 nt, Human
aggggcugcuggguccgccccu

SEQ ID NO: 1065326 - RNA, 22 nt, Human
guucacaguguuuucuuugcau

SEQ ID NO: 1065327 - RNA, 22 nt, Human
ugagaaagugggugccuagcaa

SEQ ID NO: 1065328 - RNA, 22 nt, Human
ggaggaccccagcagcucccca

SEQ ID NO: 1065329 - RNA, 23 nt, Human
agaaaaacaggauuguguuccua

SEQ ID NO: 1065330 - RNA, 22 nt, Human
agugcaaacuuuauugugaccu

SEQ ID NO: 1065331 - RNA, 17 nt, Human
ggcagcugugugcaugc

SEQ ID NO: 1065332 - RNA, 22 nt, Human
cucacaggcaucucaucaggcu

SEQ ID NO: 1065333 - RNA, 22 nt, Human
uggcucaggcuugaaaauagau

SEQ ID NO: 1065334 - RNA, 22 nt, Human
gucauaaaaggaccaccuauug

SEQ ID NO: 1065335 - RNA, 22 nt, Human
caggaacaccugcagcuagugg

SEQ ID NO: 1065336 - RNA, 22 nt, Human
cugugaauuaaguauuguuauc

SEQ ID NO: 1065337 - RNA, 22 nt, Human
ucacuguaccuuccauuucauu

SEQ ID NO: 1065338 - RNA, 20 nt, Human
acuggagccaucucagccua

SEQ ID NO: 1065339 - RNA, 22 nt, Human
caguacuuugaagauauuuuag

SEQ ID NO: 1065340 - RNA, 22 nt, Human
aggugccagugcuguggucccc

SEQ ID NO: 1065341 - RNA, 22 nt, Human
acuugauuuugaaccuuucuac

SEQ ID NO: 1065342 - RNA, 22 nt, Human
uacaaaguuugggguccucaaa

SEQ ID NO: 1065343 - RNA, 22 nt, Human
uuaaaugaacgagauaugcaac

SEQ ID NO: 1065344 - RNA, 22 nt, Human
ugguccugcccacgcccaucug

SEQ ID NO: 1065345 - RNA, 22 nt, Human
aggcccuguccauggugcugaa

SEQ ID NO: 1065346 - RNA, 22 nt, Human
cuggggcugcggacgggagccc

SEQ ID NO: 1065347 - RNA, 23 nt, Human
aagaauaaaugacauuaaaggug

SEQ ID NO: 1065348 - RNA, 22 nt, Human
auggaaauacagccagagcaga

SEQ ID NO: 1065349 - RNA, 22 nt, Human
gucccucaguagugcacagugg

SEQ ID NO: 1065350 - RNA, 21 nt, Human
aaaaagcuggggcaugcaugc

SEQ ID NO: 1065351 - RNA, 18 nt, Human
guccugagcucugcugua

SEQ ID NO: 1065352 - RNA, 22 nt, Human
cagagcugggaucccaugggcg

SEQ ID NO: 1065353 - RNA, 22 nt, Human
ggcacagcaggagcuaugugaa

SEQ ID NO: 1065354 - RNA, 22 nt, Human
gcucaggggaaugggcugccgu

SEQ ID NO: 1065355 - RNA, 18 nt, Human
cucagggcaucagucugg

SEQ ID NO: 1065356 - RNA, 19 nt, Human
cuuuucaucaacagccaau

SEQ ID NO: 1065357 - RNA, 22 nt, Human
agagauauuauuuaccaaguua

SEQ ID NO: 1065358 - RNA, 22 nt, Human
aggacugggugcagagggcauc

SEQ ID NO: 1065359 - RNA, 18 nt, Human
aggccugggaagcugagg

SEQ ID NO: 1065360 - RNA, 22 nt, Human
gugcagcugugugagagcucca

SEQ ID NO: 1065361 - RNA, 22 nt, Human
aucuucaacuugaucauuugaa

SEQ ID NO: 1065362 - RNA, 22 nt, Human
agccagccaguucacuaggaaa

SEQ ID NO: 1065363 - RNA, 22 nt, Human
augcccugugguucaugugaga

SEQ ID NO: 1065364 - RNA, 22 nt, Human
auauuaauuauuuacacaugag

SEQ ID NO: 1065365 - RNA, 22 nt, Human
ugugaaaugaagauaauucuug

SEQ ID NO: 1065366 - RNA, 22 nt, Human
uugauucuacuuaaaacauaug

SEQ ID NO: 1065367 - RNA, 22 nt, Human
ugaaauauccagcccagcagga

SEQ ID NO: 1065368 - RNA, 22 nt, Human
gccaggcucagcagucaaccug

SEQ ID NO: 1065369 - RNA, 22 nt, Human
gaaauacaguugggaggaggua

SEQ ID NO: 1065370 - RNA, 22 nt, Human
ccagcuucucucugaugcagcu

SEQ ID NO: 1065371 - RNA, 22 nt, Human
gcugccaguaguuggagcucca

SEQ ID NO: 1065372 - RNA, 22 nt, Human
acuccugggugcugaccagcgu

SEQ ID NO: 1065373 - RNA, 22 nt, Human
uggcaggaaaaagggccagagg

SEQ ID NO: 1065374 - RNA, 22 nt, Human
agggagcuguggucagcucagu

SEQ ID NO: 1065375 - RNA, 20 nt, Human
gaggccucagccucagcucc

SEQ ID NO: 1065376 - RNA, 23 nt, Human
gguggcaggaguggaugcugagc

SEQ ID NO: 1065377 - RNA, 22 nt, Human
caguacaauguugaaaaggagu

SEQ ID NO: 1065378 - RNA, 22 nt, Human
ugaguccauguggaggggaggu

SEQ ID NO: 1065379 - RNA, 22 nt, Human
ggcucaggacugcagcguagag

SEQ ID NO: 1065380 - RNA, 22 nt, Human
ucccagcauuaaugccugucag

SEQ ID NO: 1065381 - RNA, 22 nt, Human
gccagagccggcuucacaggau

SEQ ID NO: 1065382 - RNA, 22 nt, Human
aggcugaguuucucauucucgc

SEQ ID NO: 1065383 - RNA, 22 nt, Human
gcucacugccauucucuagaug

SEQ ID NO: 1065384 - RNA, 22 nt, Human
uuacaugacucaauagaagggc

SEQ ID NO: 1065385 - RNA, 22 nt, Human
ggcaggugggaacccuccccac

SEQ ID NO: 1065386 - RNA, 18 nt, Human
ucugccugcagggcaucu

SEQ ID NO: 1065387 - RNA, 22 nt, Human
guagaauaaauguacacaucug

SEQ ID NO: 1065388 - RNA, 22 nt, Human
agagccaaguugucaaggcacu

SEQ ID NO: 1065389 - RNA, 22 nt, Human
ccagaaaaugcagaacauagaa

SEQ ID NO: 1065390 - RNA, 22 nt, Human
uugcuguguaacuccuggccug

SEQ ID NO: 1065391 - RNA, 22 nt, Human
cuuaaugaaugcugcuguauuu

SEQ ID NO: 1065392 - RNA, 22 nt, Human
auuaacaugcagccagacacac

SEQ ID NO: 1065393 - RNA, 22 nt, Human
aggacagcauaugggaaccagu

SEQ ID NO: 1065394 - RNA, 21 nt, Human
uuuguucauagcucacucuuu

SEQ ID NO: 1065395 - RNA, 22 nt, Human
ugggcuccuugggagcaaguga

SEQ ID NO: 1065396 - RNA, 22 nt, Human
auucauucugaccucaagagaa

SEQ ID NO: 1065397 - RNA, 22 nt, Human
uggaagaagcuacaagcgguga

SEQ ID NO: 1065398 - RNA, 22 nt, Human
ggaagaggcugguagugcccgu

SEQ ID NO: 1065399 - RNA, 22 nt, Human
aagcugccauagaacgagaggu

SEQ ID NO: 1065400 - RNA, 22 nt, Human
aacaucuuuguaguguucuccu

SEQ ID NO: 1065401 - RNA, 22 nt, Human
gcagagaggaaugaagccaucc

SEQ ID NO: 1065402 - RNA, 22 nt, Human
uacacauauguccauuaaucag

SEQ ID NO: 1065403 - RNA, 17 nt, Human
cuggagccaagagggcc

SEQ ID NO: 1065404 - RNA, 22 nt, Human
acuuucucaaaucagacuuuaa

SEQ ID NO: 1065405 - RNA, 22 nt, Human
agcagcugaucaaagcacuuau

SEQ ID NO: 1065406 - RNA, 22 nt, Human
ugagggaguuggguguauagga

SEQ ID NO: 1065407 - RNA, 22 nt, Human
uuuaaaaggcagcuucuuuugu

SEQ ID NO: 1065408 - RNA, 22 nt, Human
ugugcccaucccucuggagugu

SEQ ID NO: 1065409 - RNA, 18 nt, Human
gcccugguggagcuggug

SEQ ID NO: 1065410 - RNA, 22 nt, Human
ggcucugcgcgguaaagugacu

SEQ ID NO: 1065411 - RNA, 22 nt, Human
gauuucaaaaguagauccauca

SEQ ID NO: 1065412 - RNA, 22 nt, Human
ggccucaguuucuccauggguu

SEQ ID NO: 1065413 - RNA, 22 nt, Human
cuauucaacuugacuguuucac

SEQ ID NO: 1065414 - RNA, 21 nt, Human
ggugcucgcugaugaggagug

SEQ ID NO: 1065415 - RNA, 23 nt, Human
aguuucacauuuuacauguggcu

SEQ ID NO: 1065416 - RNA, 22 nt, Human
agaaggaguguacaggucaugc

SEQ ID NO: 1065417 - RNA, 22 nt, Human
auauucacugagcauaaagcca

SEQ ID NO: 1065418 - RNA, 22 nt, Human
ugcuucugggucccagccuggc

SEQ ID NO: 1065419 - RNA, 22 nt, Human
gaggagagggcugcgggcccac

SEQ ID NO: 1065420 - RNA, 22 nt, Human
uauaaaacagaaagcacuaccu

SEQ ID NO: 1065421 - RNA, 20 nt, Human
acauccuggugacuagaacu

SEQ ID NO: 1065422 - RNA, 22 nt, Human
ccuggcugaggggccaaggacc

SEQ ID NO: 1065423 - RNA, 23 nt, Human
gcuuuauaguucucccaacauua

SEQ ID NO: 1065424 - RNA, 22 nt, Human
gcaggccucuguugagggccuu

SEQ ID NO: 1065425 - RNA, 22 nt, Human
uccuuaauaaguacuucauugu

SEQ ID NO: 1065426 - RNA, 22 nt, Human
gaguggcuuuggagaaguaggg

SEQ ID NO: 1065427 - RNA, 22 nt, Human
uaagaaacuaaugcaauaagag

SEQ ID NO: 1065428 - RNA, 22 nt, Human
uucuuaagaggguuaagugaag

SEQ ID NO: 1065429 - RNA, 22 nt, Human
agagugucugguagcugcucug

SEQ ID NO: 1065430 - RNA, 22 nt, Human
uuuguaaauagcaguacucaug

SEQ ID NO: 1065431 - RNA, 22 nt, Human
aucauuuugugacaaugccugu

SEQ ID NO: 1065432 - RNA, 22 nt, Human
caaggccagagccagcgauaag

SEQ ID NO: 1065433 - RNA, 21 nt, Human
uaaggccaagucuauuucugu

SEQ ID NO: 1065434 - RNA, 22 nt, Human
auacugaaaaaugauuugcugu

SEQ ID NO: 1065435 - RNA, 23 nt, Human
agaaaucaucuccaccccauguc

SEQ ID NO: 1065436 - RNA, 22 nt, Human
ucuucaugcaccucacagcuag

SEQ ID NO: 1065437 - RNA, 22 nt, Human
gcccugagggguggugucugua

SEQ ID NO: 1065438 - RNA, 23 nt, Human
ugggccuggccucccaguccagc

SEQ ID NO: 1065439 - RNA, 22 nt, Human
gcagggcagaaggugcugagga

SEQ ID NO: 1065440 - RNA, 22 nt, Human
uuuaguagcuacaguuagaagg

SEQ ID NO: 1065441 - RNA, 22 nt, Human
uuacagagguauguaugucucu

SEQ ID NO: 1065442 - RNA, 23 nt, Human
acauuucauauaaaagggaucag

SEQ ID NO: 1065443 - RNA, 22 nt, Human
aaauguacgggaguagaauuag

SEQ ID NO: 1065444 - RNA, 22 nt, Human
cugggcuuaggaccuggugcgg

SEQ ID NO: 1065445 - RNA, 22 nt, Human
aauaucagcucugucacuuacu

SEQ ID NO: 1065446 - RNA, 22 nt, Human
ugccugcucuuaccacucuccc

SEQ ID NO: 1065447 - RNA, 22 nt, Human
ugaggccugacagaccaagccu

SEQ ID NO: 1065448 - RNA, 22 nt, Human
uuaaaauccaguguugguggau

SEQ ID NO: 1065449 - RNA, 22 nt, Human
uccuuugacuucuugcagucca

SEQ ID NO: 1065450 - RNA, 22 nt, Human
caccaggaccccacgguggguu

SEQ ID NO: 1065451 - RNA, 22 nt, Human
ucacucagguucaugucuuugu

SEQ ID NO: 1065452 - RNA, 22 nt, Human
auucacagaauaguuuuaccag

SEQ ID NO: 1065453 - RNA, 22 nt, Human
gaacauuuggcaugagaauuug

SEQ ID NO: 1065454 - RNA, 22 nt, Human
aauuaugauuggucuaaaccag

SEQ ID NO: 1065455 - RNA, 22 nt, Human
cugcagcuccugagcucagaga

SEQ ID NO: 1065456 - RNA, 22 nt, Human
acuggggauuagggacucagug

SEQ ID NO: 1065457 - RNA, 22 nt, Human
uugaaaguagcagcugcauaug

SEQ ID NO: 1065458 - RNA, 22 nt, Human
gauuaaguggaaugaguauuug

SEQ ID NO: 1065459 - RNA, 22 nt, Human
uccccaccccagaacuacuagg

SEQ ID NO: 1065460 - RNA, 23 nt, Human
cccagaccuugugcugcccuugg

SEQ ID NO: 1065461 - RNA, 22 nt, Human
gauuguaaaacagaucauuauc

SEQ ID NO: 1065462 - RNA, 22 nt, Human
gggcagugacaaaggggaugaa

SEQ ID NO: 1065463 - RNA, 22 nt, Human
agcagcugguaggaguggccac

SEQ ID NO: 1065464 - RNA, 22 nt, Human
cucuggagguggagguugcagu

SEQ ID NO: 1065465 - RNA, 22 nt, Human
ucuguuuucucuguauuuugac

SEQ ID NO: 1065466 - RNA, 22 nt, Human
uuccaaaacaauauucugugaa

SEQ ID NO: 1065467 - RNA, 22 nt, Human
cucagcagagaccagggaggaa

SEQ ID NO: 1065468 - RNA, 22 nt, Human
ugugcugguacaugugaggaug

SEQ ID NO: 1065469 - RNA, 22 nt, Human
gguggcagaggugcaucagccc

SEQ ID NO: 1065470 - RNA, 22 nt, Human
uccauuaaaccuggauggaguu

SEQ ID NO: 1065471 - RNA, 21 nt, Human
aggacagauguaggaauaaag

SEQ ID NO: 1065472 - RNA, 23 nt, Human
gggcagguuuuuauaggcuucag

SEQ ID NO: 1065473 - RNA, 22 nt, Human
uuccauauuagacuaugugggg

SEQ ID NO: 1065474 - RNA, 22 nt, Human
cugacucuccucaagcauaaau

SEQ ID NO: 1065475 - RNA, 22 nt, Human
ccucaggauacaggagccacag

SEQ ID NO: 1065476 - RNA, 16 nt, Human
ugguggggaggacagc

SEQ ID NO: 1065477 - RNA, 20 nt, Human
cccugagacgacugagcucc

SEQ ID NO: 1065478 - RNA, 22 nt, Human
cccacuguugccucaaauauca

SEQ ID NO: 1065479 - RNA, 22 nt, Human
ccugcagguugcagaggcggaa

SEQ ID NO: 1065480 - RNA, 22 nt, Human
cuaagauaaaugcuuugaugaa

SEQ ID NO: 1065481 - RNA, 22 nt, Human
cagaugaggcaaccucauugcu

SEQ ID NO: 1065482 - RNA, 22 nt, Human
aauaaaauggucaguuuucuca

SEQ ID NO: 1065483 - RNA, 22 nt, Human
gcucugagaggugcagcaguaa

SEQ ID NO: 1065484 - RNA, 22 nt, Human
gucaagucaugacucaaaggaa

SEQ ID NO: 1065485 - RNA, 22 nt, Human
ucccagccacagguguagcccu

SEQ ID NO: 1065486 - RNA, 22 nt, Human
ucuagcauuucuuuccugagga

SEQ ID NO: 1065487 - RNA, 22 nt, Human
gggcucuggugccuucacagaa

SEQ ID NO: 1065488 - RNA, 22 nt, Human
caaaggagguaaugggugugag

SEQ ID NO: 1065489 - RNA, 22 nt, Human
auaauuuggcuuccuagaugua

SEQ ID NO: 1065490 - RNA, 22 nt, Human
gcugcauggagggugcccagga

SEQ ID NO: 1065491 - RNA, 18 nt, Human
uaaaggaagugggagagg

SEQ ID NO: 1065492 - RNA, 22 nt, Human
acaggcucaguucacuggauuu

SEQ ID NO: 1065493 - RNA, 22 nt, Human
uuucacaaguaaaguccuaagu

SEQ ID NO: 1065494 - RNA, 22 nt, Human
aggcccugaagucggccccuca

SEQ ID NO: 1065495 - RNA, 22 nt, Human
ccccugccauagucaaaucuaa

SEQ ID NO: 1065496 - RNA, 22 nt, Human
ccaguggaaauguggucaggau

SEQ ID NO: 1065497 - RNA, 22 nt, Human
cucugaauggacacuccagugu

SEQ ID NO: 1065498 - RNA, 22 nt, Human
ugacugaagaagccacauugga

SEQ ID NO: 1065499 - RNA, 22 nt, Human
aacagcauaccaauguacauau

SEQ ID NO: 1065500 - RNA, 22 nt, Human
uugaagcagcucaggaggcuua

SEQ ID NO: 1065501 - RNA, 22 nt, Human
ggcaccugcucaucuggacuca

SEQ ID NO: 1065502 - RNA, 22 nt, Human
ucaauuucauucuauuaguuaa

SEQ ID NO: 1065503 - RNA, 22 nt, Human
uauuugaaggcauacauuuuga

SEQ ID NO: 1065504 - RNA, 21 nt, Human
ucagaguguguuacagcaagc

SEQ ID NO: 1065505 - RNA, 22 nt, Human
agcagcucaaagccugcaagga

SEQ ID NO: 1065506 - RNA, 20 nt, Human
gagauggacagaugaagggg

SEQ ID NO: 1065507 - RNA, 22 nt, Human
aaaggaagauugagcuuuucca

SEQ ID NO: 1065508 - RNA, 22 nt, Human
ccacacugucuaacaaggcaua

SEQ ID NO: 1065509 - RNA, 22 nt, Human
gccagagaaugaaaaucagauu

SEQ ID NO: 1065510 - RNA, 22 nt, Human
uauuucagcaagaagaaugugg

SEQ ID NO: 1065511 - RNA, 22 nt, Human
gccagagagacugauacaugcu

SEQ ID NO: 1065512 - RNA, 22 nt, Human
agggaguuccgaucugugcacc

SEQ ID NO: 1065513 - RNA, 22 nt, Human
cuuucuuaauuuuuaaggacac

SEQ ID NO: 1065514 - RNA, 22 nt, Human
gagcuuccauggacgccaucug

SEQ ID NO: 1065515 - RNA, 22 nt, Human
gggaagugaaguguagcugucu

SEQ ID NO: 1065516 - RNA, 22 nt, Human
uacauaguuccauuuacaggaa

SEQ ID NO: 1065517 - RNA, 22 nt, Human
gcagggucuugagaggcagcca

SEQ ID NO: 1065518 - RNA, 22 nt, Human
gacacagaauuuacucccgaua

SEQ ID NO: 1065519 - RNA, 22 nt, Human
acauucuggaugucugaugaga

SEQ ID NO: 1065520 - RNA, 22 nt, Human
ggccgggcaggucucagccagc

SEQ ID NO: 1065521 - RNA, 22 nt, Human
aggucauuacaauuaucauuuu

SEQ ID NO: 1065522 - RNA, 22 nt, Human
aggcuuaagccugaggccccag

SEQ ID NO: 1065523 - RNA, 22 nt, Human
uucagcuacccuuggcuuaaua

SEQ ID NO: 1065524 - RNA, 22 nt, Human
uccuagccuggugagaaacugu

SEQ ID NO: 1065525 - RNA, 20 nt, Human
agucuucccccagaagaggg

SEQ ID NO: 1065526 - RNA, 22 nt, Human
cagcuacacaccagaacuauua

SEQ ID NO: 1065527 - RNA, 22 nt, Human
gaagccaagugcaaaugccuua

SEQ ID NO: 1065528 - RNA, 22 nt, Human
agcaaggugacaucaugcugag

SEQ ID NO: 1065529 - RNA, 22 nt, Human
gcauggcauuaacaagauggaa

SEQ ID NO: 1065530 - RNA, 22 nt, Human
cauggcaggaggcugcuggcag

SEQ ID NO: 1065531 - RNA, 21 nt, Human
ugcuucucuagaucaacuacu

SEQ ID NO: 1065532 - RNA, 22 nt, Human
ucaggcugcccguucagggcuc

SEQ ID NO: 1065533 - RNA, 22 nt, Human
auagcaaaaaugaacaaagcuu

SEQ ID NO: 1065534 - RNA, 22 nt, Human
gucucuuuuauggugaguugau

SEQ ID NO: 1065535 - RNA, 22 nt, Human
gcuuccaagcgguagauagcau

SEQ ID NO: 1065536 - RNA, 22 nt, Human
uagcauuagagauagaaauagu

SEQ ID NO: 1065537 - RNA, 22 nt, Human
cuugcugugugguguucucaga

SEQ ID NO: 1065538 - RNA, 22 nt, Human
aacugaacugauaacauacacg

SEQ ID NO: 1065539 - RNA, 20 nt, Human
ucaaagcaaagggagaugau

SEQ ID NO: 1065540 - RNA, 22 nt, Human
ggccucagaccggagcuggcca

SEQ ID NO: 1065541 - RNA, 23 nt, Human
ccuggcagcaaacgaggagguua

SEQ ID NO: 1065542 - RNA, 22 nt, Human
cuggggaauagagcuggagacc

SEQ ID NO: 1065543 - RNA, 22 nt, Human
uggcccuggguggaauguccca

SEQ ID NO: 1065544 - RNA, 22 nt, Human
gcagagccgugaauggauuuca

SEQ ID NO: 1065545 - RNA, 22 nt, Human
ccauggccaggaaagccaaggu

SEQ ID NO: 1065546 - RNA, 22 nt, Human
uggaggccagagguacugggac

SEQ ID NO: 1065547 - RNA, 22 nt, Human
ccugcugugaaacuggcauaug

SEQ ID NO: 1065548 - RNA, 22 nt, Human
uggcauuuccucagugcucaga

SEQ ID NO: 1065549 - RNA, 23 nt, Human
agcauaaaccucuguggcuuuag

SEQ ID NO: 1065550 - RNA, 22 nt, Human
cuggaagcgucggaggaagggc

SEQ ID NO: 1065551 - RNA, 22 nt, Human
agcacagaguugcagagagcgu

SEQ ID NO: 1065552 - RNA, 22 nt, Human
cauggacucugguuuggggagc

SEQ ID NO: 1065553 - RNA, 22 nt, Human
gcagagcuucuguccuucagga

SEQ ID NO: 1065554 - RNA, 22 nt, Human
caguuaauguccuauacaauag

SEQ ID NO: 1065555 - RNA, 22 nt, Human
caggauggagggagggcuguua

SEQ ID NO: 1065556 - RNA, 22 nt, Human
ugaguccaucgcagggaagugg

SEQ ID NO: 1065557 - RNA, 22 nt, Human
aaauaagaaauucuucuuugca

SEQ ID NO: 1065558 - RNA, 22 nt, Human
cagagggcacaugguuuccuca

SEQ ID NO: 1065559 - RNA, 22 nt, Human
gccuucaguagugucagcugua

SEQ ID NO: 1065560 - RNA, 22 nt, Human
gggcugcuuccuggggaaugcu

SEQ ID NO: 1065561 - RNA, 22 nt, Human
ucuacaaauaaauuacuaugua

SEQ ID NO: 1065562 - RNA, 22 nt, Human
cagagcuggagggaacccuggc

SEQ ID NO: 1065563 - RNA, 22 nt, Human
caaguauucuguaaaaagucaa

SEQ ID NO: 1065564 - RNA, 22 nt, Human
ccugucuggggacucccugggu

SEQ ID NO: 1065565 - RNA, 22 nt, Human
uuuaaauggcauuuucccagau

SEQ ID NO: 1065566 - RNA, 22 nt, Human
agugaggcuaauaggcaauggu

SEQ ID NO: 1065567 - RNA, 22 nt, Human
agggcagagcugucuaaauggc

SEQ ID NO: 1065568 - RNA, 22 nt, Human
cugcuuccauggucuggagacu

SEQ ID NO: 1065569 - RNA, 22 nt, Human
cuagcaucagaugagaagcugu

SEQ ID NO: 1065570 - RNA, 22 nt, Human
agcuguggcaaccuugucagac

SEQ ID NO: 1065571 - RNA, 22 nt, Human
ucaucuuuccucaaaagaucca

SEQ ID NO: 1065572 - RNA, 22 nt, Human
aucaaaucauugcauuaauguu

SEQ ID NO: 1065573 - RNA, 22 nt, Human
uggagguguggagucaaaggga

SEQ ID NO: 1065574 - RNA, 21 nt, Human
uucuucaugaugauuaauggc

SEQ ID NO: 1065575 - RNA, 22 nt, Human
uuagccauuaauguccugugca

SEQ ID NO: 1065576 - RNA, 22 nt, Human
ugucacaaggccaugaaaagaa

SEQ ID NO: 1065577 - RNA, 22 nt, Human
uauuucuuuucgugacuuauug

SEQ ID NO: 1065578 - RNA, 22 nt, Human
gcagguggauuaucagaagugc

SEQ ID NO: 1065579 - RNA, 22 nt, Human
uaugaaacauucauacaaauaa

SEQ ID NO: 1065580 - RNA, 22 nt, Human
uccagggaugguaaugagcagu

SEQ ID NO: 1065581 - RNA, 22 nt, Human
cagggcuggguuaaaagcaggg

SEQ ID NO: 1065582 - RNA, 22 nt, Human
uuugacagcuuguuacaaaguu

SEQ ID NO: 1065583 - RNA, 22 nt, Human
guuugcauguguacuuaauugg

SEQ ID NO: 1065584 - RNA, 22 nt, Human
cugggcagccucacacaauguu

SEQ ID NO: 1065585 - RNA, 22 nt, Human
gcuuacaaacaacagaaauuaa

SEQ ID NO: 1065586 - RNA, 22 nt, Human
aacuggaauagcacaggaaaag

SEQ ID NO: 1065587 - RNA, 22 nt, Human
ggccccacgggggaguccuagu

SEQ ID NO: 1065588 - RNA, 22 nt, Human
aaguccuuuccaguccugugau

SEQ ID NO: 1065589 - RNA, 22 nt, Human
auucagugugagguuuucaagu

SEQ ID NO: 1065590 - RNA, 22 nt, Human
aauuuacaguugcugaugguac

SEQ ID NO: 1065591 - RNA, 22 nt, Human
caguucuggaggauagaagucu

SEQ ID NO: 1065592 - RNA, 22 nt, Human
cugggcuuugaagccaggcugc

SEQ ID NO: 1065593 - RNA, 22 nt, Human
aggcuggcccuacuggcugccu

SEQ ID NO: 1065594 - RNA, 22 nt, Human
gcccugcuucuggcaugcagaa

SEQ ID NO: 1065595 - RNA, 22 nt, Human
uguucccauggauaucugcaua

SEQ ID NO: 1065596 - RNA, 21 nt, Human
auacuuugaauuacagccuug

SEQ ID NO: 1065597 - RNA, 22 nt, Human
ucugaagggcugaguggaggag

SEQ ID NO: 1065598 - RNA, 22 nt, Human
uaagacagggucuauucuuagu

SEQ ID NO: 1065599 - RNA, 22 nt, Human
agccacuuuacuuucauauuuu

SEQ ID NO: 1065600 - RNA, 22 nt, Human
augcacuguaggugccaucugc

SEQ ID NO: 1065601 - RNA, 17 nt, Human
cugauuuauuagcagac

SEQ ID NO: 1065602 - RNA, 22 nt, Human
acaagagacaagagguucuucu

SEQ ID NO: 1065603 - RNA, 21 nt, Human
gcaggcuggucaaaccucagu

SEQ ID NO: 1065604 - RNA, 22 nt, Human
uuuuucaagacaaccugcaugu

SEQ ID NO: 1065605 - RNA, 22 nt, Human
gcugggagcccuggucugcucc

SEQ ID NO: 1065606 - RNA, 19 nt, Human
ucaggaguuaguugugcuc

SEQ ID NO: 1065607 - RNA, 22 nt, Human
cacacaugaaucccuaguaccu

SEQ ID NO: 1065608 - RNA, 22 nt, Human
gcccagggcuucaaagagagaa

SEQ ID NO: 1065609 - RNA, 22 nt, Human
aucuacaagagguucuccucuc

SEQ ID NO: 1065610 - RNA, 23 nt, Human
gggcuccagucucugcucaguug

SEQ ID NO: 1065611 - RNA, 20 nt, Human
ccugucucacguuccgcccc

SEQ ID NO: 1065612 - RNA, 22 nt, Human
gcuguggcugaagaugcaggga

SEQ ID NO: 1065613 - RNA, 21 nt, Human
uaccaauugccuucuaguugu

SEQ ID NO: 1065614 - RNA, 22 nt, Human
cgaggcucagagagggugacuu

SEQ ID NO: 1065615 - RNA, 22 nt, Human
ccaaagagcuagaauuauaggc

SEQ ID NO: 1065616 - RNA, 22 nt, Human
aaagauuucacaucccaagccu

SEQ ID NO: 1065617 - RNA, 20 nt, Human
auguacuccccacaagcaac

SEQ ID NO: 1065618 - RNA, 22 nt, Human
gugccugguuuggggaauguuc

SEQ ID NO: 1065619 - RNA, 22 nt, Human
gaagaagcaggaguguguagca

SEQ ID NO: 1065620 - RNA, 22 nt, Human
gggucuggcaugcugagaugga

SEQ ID NO: 1065621 - RNA, 22 nt, Human
aaugucugaaaaucagacugca

SEQ ID NO: 1065622 - RNA, 22 nt, Human
uccaggcaugucugaguccuuc

SEQ ID NO: 1065623 - RNA, 20 nt, Human
aagaggugauaacaggugag

SEQ ID NO: 1065624 - RNA, 22 nt, Human
ugcagcuguaacagaggccuca

SEQ ID NO: 1065625 - RNA, 22 nt, Human
gcugucaguuuuacccacagac

SEQ ID NO: 1065626 - RNA, 22 nt, Human
gaaaugucucuggauuugcuuu

SEQ ID NO: 1065627 - RNA, 22 nt, Human
agggcugaaguuauggcugagc

SEQ ID NO: 1065628 - RNA, 23 nt, Human
cucaacccuaguaagggaguagg

SEQ ID NO: 1065629 - RNA, 22 nt, Human
ccugucaggguuugccucagaa

SEQ ID NO: 1065630 - RNA, 22 nt, Human
aucuugcauuugcuaaaaugca

SEQ ID NO: 1065631 - RNA, 22 nt, Human
agagccaaucuucagagcagag

SEQ ID NO: 1065632 - RNA, 22 nt, Human
auuaauauacacuguuagcaug

SEQ ID NO: 1065633 - RNA, 22 nt, Human
cucaacaugccuacucagucug

SEQ ID NO: 1065634 - RNA, 22 nt, Human
gagggagcuugauggauguuug

SEQ ID NO: 1065635 - RNA, 22 nt, Human
ucugcaugaugaacaaaugagc

SEQ ID NO: 1065636 - RNA, 22 nt, Human
ggagcagagcucuucaucugca

SEQ ID NO: 1065637 - RNA, 22 nt, Human
cugggaaggggaagguccucuc

SEQ ID NO: 1065638 - RNA, 22 nt, Human
cuucuccucugaguccugggag

SEQ ID NO: 1065639 - RNA, 22 nt, Human
ccagcccugucaccaacuggag

SEQ ID NO: 1065640 - RNA, 22 nt, Human
cugcccugagggccuguguguu

SEQ ID NO: 1065641 - RNA, 22 nt, Human
agagaugucgccuugcccaggg

SEQ ID NO: 1065642 - RNA, 22 nt, Human
aggcacuggucuaccccuuagu

SEQ ID NO: 1065643 - RNA, 22 nt, Human
ucugucacucccugaugaugaa

SEQ ID NO: 1065644 - RNA, 22 nt, Human
uaacacauaagcugagaccaug

SEQ ID NO: 1065645 - RNA, 22 nt, Human
ggaacacaaaugggagagcugg

SEQ ID NO: 1065646 - RNA, 22 nt, Human
ugcagccuugccuccucccagc

SEQ ID NO: 1065647 - RNA, 22 nt, Human
uauuuguauguguguacauaua

SEQ ID NO: 1065648 - RNA, 22 nt, Human
gcaaggaagcagaguugcuauc

SEQ ID NO: 1065649 - RNA, 22 nt, Human
acucucucacagcuuggcugau

SEQ ID NO: 1065650 - RNA, 22 nt, Human
agcaaaagauagauuaacaaga

SEQ ID NO: 1065651 - RNA, 22 nt, Human
acacccagagcgccagugccga

SEQ ID NO: 1065652 - RNA, 22 nt, Human
agccaucuaagaaauacaaaau

SEQ ID NO: 1065653 - RNA, 22 nt, Human
gaggcuuuucuucagguaucaa

SEQ ID NO: 1065654 - RNA, 21 nt, Human
aggcacuguuugugguuuggg

SEQ ID NO: 1065655 - RNA, 22 nt, Human
aaagaauagccuuuguccaaau

SEQ ID NO: 1065656 - RNA, 22 nt, Human
caaaauuagggagugagcugga

SEQ ID NO: 1065657 - RNA, 22 nt, Human
uggauaaacucacuguaaguug

SEQ ID NO: 1065658 - RNA, 22 nt, Human
caggcccucaggcaagggcucu

SEQ ID NO: 1065659 - RNA, 22 nt, Human
gacuucaaaggucaaacaucgc

SEQ ID NO: 1065660 - RNA, 22 nt, Human
aggaacacaagcuaugauccac

SEQ ID NO: 1065661 - RNA, 22 nt, Human
aguuccagcugugaccagaaaa

SEQ ID NO: 1065662 - RNA, 22 nt, Human
agguccuggugaccauggaguu

SEQ ID NO: 1065663 - RNA, 22 nt, Human
aucuccagaggagucauggucu

SEQ ID NO: 1065664 - RNA, 22 nt, Human
ugguagggacacuaugcagaaa

SEQ ID NO: 1065665 - RNA, 22 nt, Human
cacauacauucauguuacucua

SEQ ID NO: 1065666 - RNA, 21 nt, Human
acaugucucuaaucucaguga

SEQ ID NO: 1065667 - RNA, 21 nt, Human
uaauuuauucagcacaguguu

SEQ ID NO: 1065668 - RNA, 22 nt, Human
gaaacauugagcagaaggagaa

SEQ ID NO: 1065669 - RNA, 22 nt, Human
uggggaggacgggcgccuuccu

SEQ ID NO: 1065670 - RNA, 22 nt, Human
ugagccuggguggucgaggcug

SEQ ID NO: 1065671 - RNA, 22 nt, Human
ugaguuuugucuugcuagaagu

SEQ ID NO: 1065672 - RNA, 22 nt, Human
gcaaauaauauacuuugaucuc

SEQ ID NO: 1065673 - RNA, 22 nt, Human
uccuuccugcaggccaaguccu

SEQ ID NO: 1065674 - RNA, 22 nt, Human
ccuuuucuguuuccugucacug

SEQ ID NO: 1065675 - RNA, 22 nt, Human
acaguggaguugggguagcccu

SEQ ID NO: 1065676 - RNA, 22 nt, Human
aagagcuggauggaaucuggga

SEQ ID NO: 1065677 - RNA, 22 nt, Human
cugccuggcuaaacucaagucg

SEQ ID NO: 1065678 - RNA, 22 nt, Human
cacugucuuuugugaagacaau

SEQ ID NO: 1065679 - RNA, 22 nt, Human
aacaaacauuaccuggugcugg

SEQ ID NO: 1065680 - RNA, 22 nt, Human
ucuaagaucuacuauacaugug

SEQ ID NO: 1065681 - RNA, 22 nt, Human
auuacugagcaacggucauuuc

SEQ ID NO: 1065682 - RNA, 22 nt, Human
cagaaaauagaguuucucugag

SEQ ID NO: 1065683 - RNA, 23 nt, Human
uggugccucagaagcagugggcu

SEQ ID NO: 1065684 - RNA, 22 nt, Human
gcagcaguggucuguagaagga

SEQ ID NO: 1065685 - RNA, 22 nt, Human
agaggaggcuggguccagauaa

SEQ ID NO: 1065686 - RNA, 22 nt, Human
ccugucucccuggcauggcuca

SEQ ID NO: 1065687 - RNA, 22 nt, Human
ugaaaacagaauccuuguuuuc

SEQ ID NO: 1065688 - RNA, 22 nt, Human
cugcucuguuucuuagcugggu

SEQ ID NO: 1065689 - RNA, 22 nt, Human
cugcucuccccaggccagucug

SEQ ID NO: 1065690 - RNA, 22 nt, Human
acaacaaaaucacuagucuucc

SEQ ID NO: 1065691 - RNA, 22 nt, Human
agggcacaucugcugggaaugg

SEQ ID NO: 1065692 - RNA, 22 nt, Human
guuccuauauagccuuaaggau

SEQ ID NO: 1065693 - RNA, 22 nt, Human
uucugcaggagcccuaguguau

SEQ ID NO: 1065694 - RNA, 22 nt, Human
uuuguuuucuguaggccuuucc

SEQ ID NO: 1065695 - RNA, 22 nt, Human
aaaacauucugugaacucucaa

SEQ ID NO: 1065696 - RNA, 23 nt, Human
ugcagcugccucuggcgggccgg

SEQ ID NO: 1065697 - RNA, 23 nt, Human
aggugcagcccuggaccugcccc

SEQ ID NO: 1065698 - RNA, 22 nt, Human
ugcagguggcagcggggcacca

SEQ ID NO: 1065699 - RNA, 22 nt, Human
uggcagagcccagaacugagca

SEQ ID NO: 1065700 - RNA, 22 nt, Human
guacagcuaagaauuucaucuu

SEQ ID NO: 1065701 - RNA, 22 nt, Human
auuuuguugagguaauugucaa

SEQ ID NO: 1065702 - RNA, 20 nt, Human
uuucaaguuguaagguauca

SEQ ID NO: 1065703 - RNA, 22 nt, Human
ugggccagcacugggugcucau

SEQ ID NO: 1065704 - RNA, 22 nt, Human
uugcucugacuggagugcagug

SEQ ID NO: 1065705 - RNA, 22 nt, Human
gggcaaaggcagaaagcggugu

SEQ ID NO: 1065706 - RNA, 22 nt, Human
uucuacauucauguauuaccuc

SEQ ID NO: 1065707 - RNA, 22 nt, Human
gagcugcagacauagauaagcg

SEQ ID NO: 1065708 - RNA, 22 nt, Human
uaaguuaguccuuuuuaaaagu

SEQ ID NO: 1065709 - RNA, 22 nt, Human
ugugauuuauugaaaagagcuu

SEQ ID NO: 1065710 - RNA, 22 nt, Human
ccugggcuuacgaccucugacu

SEQ ID NO: 1065711 - RNA, 22 nt, Human
uucacauuagugguucuauaua

SEQ ID NO: 1065712 - RNA, 22 nt, Human
ucccagagugugggcaucaagg

SEQ ID NO: 1065713 - RNA, 22 nt, Human
guggcagggcuuugcuguucuu

SEQ ID NO: 1065714 - RNA, 22 nt, Human
aaaugucaggugguggauggcu

SEQ ID NO: 1065715 - RNA, 22 nt, Human
aagauacacggucaacucucaa

SEQ ID NO: 1065716 - RNA, 22 nt, Human
agcugcugugugcucaggcagg

SEQ ID NO: 1065717 - RNA, 22 nt, Human
augcuguguccuagugaaagaa

SEQ ID NO: 1065718 - RNA, 22 nt, Human
uacugaaaguggucaacagugg

SEQ ID NO: 1065719 - RNA, 22 nt, Human
uccccacaucucugcaucaggc

SEQ ID NO: 1065720 - RNA, 22 nt, Human
caggaggcaucauggagcggac

SEQ ID NO: 1065721 - RNA, 22 nt, Human
uauuuggauagacagggagaug

SEQ ID NO: 1065722 - RNA, 22 nt, Human
ucucagagggaaaggccaauuu

SEQ ID NO: 1065723 - RNA, 22 nt, Human
aggaccaacauagcagcagugg

SEQ ID NO: 1065724 - RNA, 22 nt, Human
acagagcucccagccaucuccu

SEQ ID NO: 1065725 - RNA, 22 nt, Human
cuugcuuuguccagaaauucag

SEQ ID NO: 1065726 - RNA, 23 nt, Human
uucaagauacgguuuccaggcug

SEQ ID NO: 1065727 - RNA, 22 nt, Human
cagggccuccccggcagucuuu

SEQ ID NO: 1065728 - RNA, 22 nt, Human
gacauuuaauaguauuguggga

SEQ ID NO: 1065729 - RNA, 22 nt, Human
augucaaaucaguuuuaucaga

SEQ ID NO: 1065730 - RNA, 22 nt, Human
aaagaacuaaugugcaagguuu

SEQ ID NO: 1065731 - RNA, 22 nt, Human
ugccugggccucugaggaaggc

SEQ ID NO: 1065732 - RNA, 22 nt, Human
agaggaggcagcuuaacucagu

SEQ ID NO: 1065733 - RNA, 22 nt, Human
aagcauuuuaguaaugaacuug

SEQ ID NO: 1065734 - RNA, 22 nt, Human
ugcucagcugcucuguauucuu

SEQ ID NO: 1065735 - RNA, 22 nt, Human
agucagcagccuggccaggaga

SEQ ID NO: 1065736 - RNA, 22 nt, Human
agccuucauaaucuugggcuuu

SEQ ID NO: 1065737 - RNA, 22 nt, Human
guugggcugggagcugcccuga

SEQ ID NO: 1065738 - RNA, 22 nt, Human
gaacuuaacggcaacuauuuaa

SEQ ID NO: 1065739 - RNA, 22 nt, Human
agggagguccaucccugcagag

SEQ ID NO: 1065740 - RNA, 22 nt, Human
ugcugggcagugugcccucgag

SEQ ID NO: 1065741 - RNA, 22 nt, Human
uaaugcuuaacagcuggcuuuu

SEQ ID NO: 1065742 - RNA, 22 nt, Human
uuugugcagauguauauuugug

SEQ ID NO: 1065743 - RNA, 21 nt, Human
agcugccuccacuucugaggc

SEQ ID NO: 1065744 - RNA, 22 nt, Human
uccagccaacugccuagggagc

SEQ ID NO: 1065745 - RNA, 22 nt, Human
aauuucacagcuggucuauggg

SEQ ID NO: 1065746 - RNA, 22 nt, Human
gccauuaaugagaucaagaauc

SEQ ID NO: 1065747 - RNA, 19 nt, Human
ggaacucacuuagagaaac

SEQ ID NO: 1065748 - RNA, 20 nt, Human
cugccuggaggccucuaccu

SEQ ID NO: 1065749 - RNA, 22 nt, Human
gaaaccagcuagaggcagaggg

SEQ ID NO: 1065750 - RNA, 22 nt, Human
cugaagaagcugcagccuggag

SEQ ID NO: 1065751 - RNA, 22 nt, Human
gcuuucucuucacugauguuca

SEQ ID NO: 1065752 - RNA, 22 nt, Human
cacaguaacuggcguguaguaa

SEQ ID NO: 1065753 - RNA, 22 nt, Human
accaucaagaccuuaucuaguu

SEQ ID NO: 1065754 - RNA, 21 nt, Human
aaaaugugagcgugaugcuua

SEQ ID NO: 1065755 - RNA, 22 nt, Human
augaacuagccagguugugcug

SEQ ID NO: 1065756 - RNA, 22 nt, Human
uacauuccuguuagcaucuaag

SEQ ID NO: 1065757 - RNA, 19 nt, Human
gcccugcaggagguggggc

SEQ ID NO: 1065758 - RNA, 22 nt, Human
aggccugagguuccugugcuca

SEQ ID NO: 1065759 - RNA, 22 nt, Human
uauuuccagaggaguauagaag

SEQ ID NO: 1065760 - RNA, 22 nt, Human
uggcagggucuugcuguguugc

SEQ ID NO: 1065761 - RNA, 22 nt, Human
aguaacaaagaaagccuuugga

SEQ ID NO: 1065762 - RNA, 22 nt, Human
agcuguauucucuuuguauuaa

SEQ ID NO: 1065763 - RNA, 22 nt, Human
augucacagucugacucaguga

SEQ ID NO: 1065764 - RNA, 17 nt, Human
ucauuuguugugacuag

SEQ ID NO: 1065765 - RNA, 22 nt, Human
uucaauuuagugauguuguugg

SEQ ID NO: 1065766 - RNA, 23 nt, Human
ucauuucauccagccuugagagu

SEQ ID NO: 1065767 - RNA, 22 nt, Human
auaauuuaaauuaguaugugau

SEQ ID NO: 1065768 - RNA, 19 nt, Human
agaaguuagacauugcaau

SEQ ID NO: 1065769 - RNA, 22 nt, Human
uuccuuguuuguagcucuggga

SEQ ID NO: 1065770 - RNA, 22 nt, Human
uggcauuugcucccuuguguuc

SEQ ID NO: 1065771 - RNA, 22 nt, Human
uaaaggauaacuuucaagaauu

SEQ ID NO: 1065772 - RNA, 22 nt, Human
aaagauuugaguucugcuuaua

SEQ ID NO: 1065773 - RNA, 22 nt, Human
uuaauaaacaggugcagcugaa

SEQ ID NO: 1065774 - RNA, 22 nt, Human
gaggaagggcugccugccgggc

SEQ ID NO: 1065775 - RNA, 22 nt, Human
aggagcuggaaugguccuuuug

SEQ ID NO: 1065776 - RNA, 22 nt, Human
uauacagauaaugaagaccaag

SEQ ID NO: 1065777 - RNA, 22 nt, Human
uggcuucuuagaccaguggccu

SEQ ID NO: 1065778 - RNA, 22 nt, Human
uucacagggcagcagcugagcc

SEQ ID NO: 1065779 - RNA, 22 nt, Human
uguacagacuguauuuacaagu

SEQ ID NO: 1065780 - RNA, 22 nt, Human
uggagcaggaagucuauggcug

SEQ ID NO: 1065781 - RNA, 22 nt, Human
aaauuugucaacuucauauguu

SEQ ID NO: 1065782 - RNA, 22 nt, Human
gggguaggaagagaaaauagug

SEQ ID NO: 1065783 - RNA, 22 nt, Human
uugugccaugaacuguaugaag

SEQ ID NO: 1065784 - RNA, 22 nt, Human
aagccaguccucuacugggcac

SEQ ID NO: 1065785 - RNA, 22 nt, Human
ucucagaguuccucuggagucc

SEQ ID NO: 1065786 - RNA, 22 nt, Human
aaacacugauggauauuuuucc

SEQ ID NO: 1065787 - RNA, 22 nt, Human
aggaaaaugaaacagcaacugu

SEQ ID NO: 1065788 - RNA, 22 nt, Human
uguaugaaucucauuuguuuaa

SEQ ID NO: 1065789 - RNA, 22 nt, Human
aagcagaacugggaaguagugg

SEQ ID NO: 1065790 - RNA, 22 nt, Human
ugcaaauuugagcagacuguuc

SEQ ID NO: 1065791 - RNA, 22 nt, Human
ugcuaccuuuuuuauuaaauga

SEQ ID NO: 1065792 - RNA, 19 nt, Human
ggucucagugcagcugcag

SEQ ID NO: 1065793 - RNA, 22 nt, Human
gaacauuugaugaugacauugg

SEQ ID NO: 1065794 - RNA, 22 nt, Human
cuggacaggaagaauugggagc

SEQ ID NO: 1065795 - RNA, 23 nt, Human
ggccauggagacuuagaaugggc

SEQ ID NO: 1065796 - RNA, 22 nt, Human
guaaacauuuucaucugugccc

SEQ ID NO: 1065797 - RNA, 22 nt, Human
gaaacauuguguucuacagauu

SEQ ID NO: 1065798 - RNA, 23 nt, Human
agcccagcagagaaccuaggucc

SEQ ID NO: 1065799 - RNA, 22 nt, Human
acagauggagguuauuaugaac

SEQ ID NO: 1065800 - RNA, 22 nt, Human
cuuauuauaaaauccuguuuga

SEQ ID NO: 1065801 - RNA, 22 nt, Human
ggcuuucuagaucuagcucugu

SEQ ID NO: 1065802 - RNA, 22 nt, Human
agggccagggaaacgaucagca

SEQ ID NO: 1065803 - RNA, 22 nt, Human
ccagaugguccagagucuagcc

SEQ ID NO: 1065804 - RNA, 22 nt, Human
ugagcagagcaauaggacucuc

SEQ ID NO: 1065805 - RNA, 22 nt, Human
gauuaguaagaguuuaccuauu

SEQ ID NO: 1065806 - RNA, 22 nt, Human
cuuuggcagccucugcuauuga

SEQ ID NO: 1065807 - RNA, 22 nt, Human
ucuggcucaggagcuguguuca

SEQ ID NO: 1065808 - RNA, 22 nt, Human
agggggugcuacuuccagaguu

SEQ ID NO: 1065809 - RNA, 22 nt, Human
agagaauacaaagaagauaugu

SEQ ID NO: 1065810 - RNA, 22 nt, Human
gugggaugcaguggugaguggc

SEQ ID NO: 1065811 - RNA, 22 nt, Human
caaugaaaaugaggacuccugu

SEQ ID NO: 1065812 - RNA, 22 nt, Human
uccaaauaguucuggaagacug

SEQ ID NO: 1065813 - RNA, 22 nt, Human
ucacacaggguucuggucucau

SEQ ID NO: 1065814 - RNA, 22 nt, Human
ugaaguuauauauguugaaaau

SEQ ID NO: 1065815 - RNA, 22 nt, Human
gggagcucucccugaggccugg

SEQ ID NO: 1065816 - RNA, 22 nt, Human
aggggcuggaguucgagguuac

SEQ ID NO: 1065817 - RNA, 22 nt, Human
gcaggcuccaggccggccccuu

SEQ ID NO: 1065818 - RNA, 22 nt, Human
aggcuuuggggcauucuguguu

SEQ ID NO: 1065819 - RNA, 22 nt, Human
ggcagaggaggggugaauuugc

SEQ ID NO: 1065820 - RNA, 22 nt, Human
ugcugaaucaaaacaaagguuu

SEQ ID NO: 1065821 - RNA, 23 nt, Human
cugcuguuuucuguaccugaagc

SEQ ID NO: 1065822 - RNA, 20 nt, Human
gaauguuucacuugcuccau

SEQ ID NO: 1065823 - RNA, 22 nt, Human
aaagaagggacagacugccucu

SEQ ID NO: 1065824 - RNA, 22 nt, Human
gcacagaaguaaaauacaaguc

SEQ ID NO: 1065825 - RNA, 22 nt, Human
cucuggccagagccugcgggaa

SEQ ID NO: 1065826 - RNA, 22 nt, Human
cuucuuccaguuauaagagcuu

SEQ ID NO: 1065827 - RNA, 22 nt, Human
auugucuuuccacugagaaguu

SEQ ID NO: 1065828 - RNA, 22 nt, Human
ggaggccaucuggcuggaggcu

SEQ ID NO: 1065829 - RNA, 22 nt, Human
gccaggaaggcucccuggucac

SEQ ID NO: 1065830 - RNA, 22 nt, Human
ucugcagaaguggcugggccac

SEQ ID NO: 1065831 - RNA, 22 nt, Human
agugggggcuggcucugucugu

SEQ ID NO: 1065832 - RNA, 20 nt, Human
ucacacaugguaagcuauga

SEQ ID NO: 1065833 - RNA, 22 nt, Human
ggacccugggcuugcuccuggg

SEQ ID NO: 1065834 - RNA, 22 nt, Human
ccugggcucaccaugccuugga

SEQ ID NO: 1065835 - RNA, 22 nt, Human
acugaaggaaacuuuuguguuu

SEQ ID NO: 1065836 - RNA, 22 nt, Human
ucagacaggcuggacagcuugc

SEQ ID NO: 1065837 - RNA, 22 nt, Human
cacagauaccuagugaaacaua

SEQ ID NO: 1065838 - RNA, 22 nt, Human
cagugcugggcagaggagagcg

SEQ ID NO: 1065839 - RNA, 22 nt, Human
gcagugauaacuuuacucuuuu

SEQ ID NO: 1065840 - RNA, 22 nt, Human
cuuuggaaaagcauaccaagga

SEQ ID NO: 1065841 - RNA, 22 nt, Human
gagcagaacaggccggguggga

SEQ ID NO: 1065842 - RNA, 22 nt, Human
uuacauaacgguaugaaaaaug

SEQ ID NO: 1065843 - RNA, 21 nt, Human
gccucugcugucuuauuguga

SEQ ID NO: 1065844 - RNA, 22 nt, Human
caguggaaaucagagugagagu

SEQ ID NO: 1065845 - RNA, 22 nt, Human
ccuugcguuuuacagcuucuag

SEQ ID NO: 1065846 - RNA, 22 nt, Human
ucccugugagaaaugaagcagg

SEQ ID NO: 1065847 - RNA, 22 nt, Human
aaggaaccugagggaccccaaa

SEQ ID NO: 1065848 - RNA, 22 nt, Human
cuacaaaguaccacagacuggg

SEQ ID NO: 1065849 - RNA, 22 nt, Human
ugagaaauuacuucagugaugg

SEQ ID NO: 1065850 - RNA, 22 nt, Human
uggcagccacaucucguggauu

SEQ ID NO: 1065851 - RNA, 22 nt, Human
acaaaggcagccaaucaucugc

SEQ ID NO: 1065852 - RNA, 22 nt, Human
aaguccagugcuuuagauucca

SEQ ID NO: 1065853 - RNA, 22 nt, Human
uggcucuggggacaguaagucc

SEQ ID NO: 1065854 - RNA, 22 nt, Human
ugcaggugacaccacucuuccu

SEQ ID NO: 1065855 - RNA, 22 nt, Human
gccagcugguaggcaccuagcc

SEQ ID NO: 1065856 - RNA, 22 nt, Human
agaagugagugugacucagcag

SEQ ID NO: 1065857 - RNA, 22 nt, Human
aguggugucgugggaguggaag

SEQ ID NO: 1065858 - RNA, 23 nt, Human
aguacauucgaaaaauucuguga

SEQ ID NO: 1065859 - RNA, 22 nt, Human
uuaucacuuaugagcuuuuugc

SEQ ID NO: 1065860 - RNA, 22 nt, Human
uugcuuuugggaaaacaugccu

SEQ ID NO: 1065861 - RNA, 22 nt, Human
ugcugaguacucuccuguguag

SEQ ID NO: 1065862 - RNA, 22 nt, Human
cugaagccaugugcucacuggu

SEQ ID NO: 1065863 - RNA, 23 nt, Human
uuucucaaagaguggcagcuuca

SEQ ID NO: 1065864 - RNA, 22 nt, Human
acuuucaagcaagaacacuuug

SEQ ID NO: 1065865 - RNA, 22 nt, Human
agaaacaucauuguuugguauu

SEQ ID NO: 1065866 - RNA, 22 nt, Human
ccuggaugauccaugucaugga

SEQ ID NO: 1065867 - RNA, 22 nt, Human
gcucucagguacaaagcugugu

SEQ ID NO: 1065868 - RNA, 19 nt, Human
ugaaacaaacuuaaaagga

SEQ ID NO: 1065869 - RNA, 22 nt, Human
uggcucaggguccccaaauggu

SEQ ID NO: 1065870 - RNA, 22 nt, Human
caagcugggugcgggcaguaua

SEQ ID NO: 1065871 - RNA, 18 nt, Human
caaauucagugcuggaag

SEQ ID NO: 1065872 - RNA, 22 nt, Human
aacaugaugugaagcaugaacu

SEQ ID NO: 1065873 - RNA, 22 nt, Human
acauuugaaauaaacucaagug

SEQ ID NO: 1065874 - RNA, 22 nt, Human
cugccucuauaggaguccacca

SEQ ID NO: 1065875 - RNA, 22 nt, Human
aaaauuauggaguaucccaaag

SEQ ID NO: 1065876 - RNA, 22 nt, Human
gccuccugaagugcugggauua

SEQ ID NO: 1065877 - RNA, 22 nt, Human
uuuauucacuucagugccaaag

SEQ ID NO: 1065878 - RNA, 22 nt, Human
aauauuaauagaagggguucua

SEQ ID NO: 1065879 - RNA, 19 nt, Human
acauguuuugcagaacagc

SEQ ID NO: 1065880 - RNA, 22 nt, Human
cccaggagguggagcuugcagu

SEQ ID NO: 1065881 - RNA, 22 nt, Human
uugcagggaccugcagaaagcu

SEQ ID NO: 1065882 - RNA, 22 nt, Human
cccuuuccugaagaauauuuuu

SEQ ID NO: 1065883 - RNA, 22 nt, Human
cuggcccuguggaggcaggaac

SEQ ID NO: 1065884 - RNA, 22 nt, Human
cugagcgcaugguugcugggga

SEQ ID NO: 1065885 - RNA, 22 nt, Human
uccaagaagcuuacaaucuaau

SEQ ID NO: 1065886 - RNA, 22 nt, Human
uguaggacauguacuuguaaca

SEQ ID NO: 1065887 - RNA, 22 nt, Human
ggcaggugugagcuguaaagga

SEQ ID NO: 1065888 - RNA, 22 nt, Human
ucaaagcacacuuagugguaga

SEQ ID NO: 1065889 - RNA, 22 nt, Human
caaagacugcauaacacaugaa

SEQ ID NO: 1065890 - RNA, 22 nt, Human
ugggagcacucuuugggaagca

SEQ ID NO: 1065891 - RNA, 22 nt, Human
gaggcaggcccugaaugaguca

SEQ ID NO: 1065892 - RNA, 22 nt, Human
gaggggcucuugggcaugaagg

SEQ ID NO: 1065893 - RNA, 22 nt, Human
gguggccucucaugcaagguag

SEQ ID NO: 1065894 - RNA, 22 nt, Human
caaagucuucaguugauucuga

SEQ ID NO: 1065895 - RNA, 22 nt, Human
gccugccuuuguaugacccuga

SEQ ID NO: 1065896 - RNA, 22 nt, Human
gccuggcaggccucaugagggg

SEQ ID NO: 1065897 - RNA, 22 nt, Human
caggaaccugcuccaagaggca

SEQ ID NO: 1065898 - RNA, 22 nt, Human
gccuggaggaauguagcugagg

SEQ ID NO: 1065899 - RNA, 22 nt, Human
aaguuaggcuuaguugagauuu

SEQ ID NO: 1065900 - RNA, 22 nt, Human
acauuucagauucaugaaguga

SEQ ID NO: 1065901 - RNA, 19 nt, Human
ccagagcccgccagauggg

SEQ ID NO: 1065902 - RNA, 22 nt, Human
acugagaggaaauugagacuau

SEQ ID NO: 1065903 - RNA, 22 nt, Human
uuaauaaguaguaguuauuguu

SEQ ID NO: 1065904 - RNA, 22 nt, Human
agccuggaggccaggagacagu

SEQ ID NO: 1065905 - RNA, 22 nt, Human
ccugucaguugcugucagggau

SEQ ID NO: 1065906 - RNA, 22 nt, Human
agggcagagggugccucaccug

SEQ ID NO: 1065907 - RNA, 22 nt, Human
ucuggccacccgaggccccugc

SEQ ID NO: 1065908 - RNA, 22 nt, Human
uaaaauguagcuucuaggcugg

SEQ ID NO: 1065909 - RNA, 22 nt, Human
cagucucuugcuucauuaguug

SEQ ID NO: 1065910 - RNA, 22 nt, Human
ccagcagagucuaggaaggagg

SEQ ID NO: 1065911 - RNA, 22 nt, Human
aauauaacacagauggccuguu

SEQ ID NO: 1065912 - RNA, 22 nt, Human
auuuuuaggcucuacccucaga

SEQ ID NO: 1065913 - RNA, 21 nt, Human
cacuuuaaaaauaucuuuaua

SEQ ID NO: 1065914 - RNA, 22 nt, Human
uuggaaaaacacgauagugguu

SEQ ID NO: 1065915 - RNA, 22 nt, Human
ucucccaguggugcagaaagca

SEQ ID NO: 1065916 - RNA, 22 nt, Human
cccaggucugccagccuguggg

SEQ ID NO: 1065917 - RNA, 20 nt, Human
ugucauuguuucuaggaccu

SEQ ID NO: 1065918 - RNA, 22 nt, Human
gugggagcugcggaggccuggg

SEQ ID NO: 1065919 - RNA, 22 nt, Human
uugaaugauccuaucuagcaca

SEQ ID NO: 1065920 - RNA, 22 nt, Human
agggcuggaggguacuaguuua

SEQ ID NO: 1065921 - RNA, 22 nt, Human
agucuucagagaaauuaacucu

SEQ ID NO: 1065922 - RNA, 22 nt, Human
acaguguacuccuuuaccggag

SEQ ID NO: 1065923 - RNA, 22 nt, Human
acuuguguaacacagaaagaac

SEQ ID NO: 1065924 - RNA, 22 nt, Human
agcuguggaagacugucagggu

SEQ ID NO: 1065925 - RNA, 22 nt, Human
ggcugcuuuaucggcugcugaa

SEQ ID NO: 1065926 - RNA, 22 nt, Human
uccucugcucagcauuccucac

SEQ ID NO: 1065927 - RNA, 22 nt, Human
cccuggaguccuggcaguugau

SEQ ID NO: 1065928 - RNA, 22 nt, Human
ggcucaggacacagugguuuag

SEQ ID NO: 1065929 - RNA, 22 nt, Human
gugaggacugguaaggacugca

SEQ ID NO: 1065930 - RNA, 23 nt, Human
ccuggcugaccugaagguguagu

SEQ ID NO: 1065931 - RNA, 22 nt, Human
gucagagagggcacgugcacac

SEQ ID NO: 1065932 - RNA, 22 nt, Human
aacaguuugagcuuugaauuuc

SEQ ID NO: 1065933 - RNA, 22 nt, Human
ucugaaauaggcuucuuuuggu

SEQ ID NO: 1065934 - RNA, 22 nt, Human
cacugcauggaugauggcugua

SEQ ID NO: 1065935 - RNA, 22 nt, Human
uauuuggaaucugccuuaggac

SEQ ID NO: 1065936 - RNA, 22 nt, Human
ucucugagcgcauuccuccggc

SEQ ID NO: 1065937 - RNA, 22 nt, Human
cacucuccagcacaccccauuu

SEQ ID NO: 1065938 - RNA, 22 nt, Human
guucauucaucaaauauuuacu

SEQ ID NO: 1065939 - RNA, 22 nt, Human
ucucaguggcuuccucacuuuu

SEQ ID NO: 1065940 - RNA, 22 nt, Human
gugaagcauaugcuucucugcc

SEQ ID NO: 1065941 - RNA, 22 nt, Human
uaugaaaagguggccaauguag

SEQ ID NO: 1065942 - RNA, 22 nt, Human
aguuacaugacugccggcggug

SEQ ID NO: 1065943 - RNA, 23 nt, Human
gaggaaagaauauagaugcaauc

SEQ ID NO: 1065944 - RNA, 22 nt, Human
auaaguuugucuuuguaaagau

SEQ ID NO: 1065945 - RNA, 22 nt, Human
auggggagagaagggcugagcu

SEQ ID NO: 1065946 - RNA, 22 nt, Human
aggcagggaccaguuguuuucu

SEQ ID NO: 1065947 - RNA, 22 nt, Human
uugugcauuucucugagugugu

SEQ ID NO: 1065948 - RNA, 22 nt, Human
ugcagcuuaucucuuuggcagu

SEQ ID NO: 1065949 - RNA, 22 nt, Human
uauauucaacaggcuaauguca

SEQ ID NO: 1065950 - RNA, 22 nt, Human
cagcagaagugcauuugugauu

SEQ ID NO: 1065951 - RNA, 22 nt, Human
ucaguuaagaggccacggcagu

SEQ ID NO: 1065952 - RNA, 22 nt, Human
uagcaaaagccacgauuacuuu

SEQ ID NO: 1065953 - RNA, 18 nt, Human
cagaaaguuauuuacucu

SEQ ID NO: 1065954 - RNA, 22 nt, Human
augugagggaaaucagucagaa

SEQ ID NO: 1065955 - RNA, 22 nt, Human
auagaaacagaugcacuucucu

SEQ ID NO: 1065956 - RNA, 22 nt, Human
ccuccuuuccuguuuuccugag

SEQ ID NO: 1065957 - RNA, 17 nt, Human
ugcaggcuccugucccu

SEQ ID NO: 1065958 - RNA, 22 nt, Human
ugauuacacagcaguaauuuca

SEQ ID NO: 1065959 - RNA, 22 nt, Human
uuucacaaaugucuuuaacuug

SEQ ID NO: 1065960 - RNA, 22 nt, Human
acacaggggcucggcugggugc

SEQ ID NO: 1065961 - RNA, 22 nt, Human
uccagccuaauguucuucccac

SEQ ID NO: 1065962 - RNA, 22 nt, Human
uugcagagccaugaggcuggcu

SEQ ID NO: 1065963 - RNA, 22 nt, Human
cccaggucugugccagcucuga

SEQ ID NO: 1065964 - RNA, 20 nt, Human
aagcagaagcugcucucagc

SEQ ID NO: 1065965 - RNA, 22 nt, Human
gugucuggaacgggugguacuc

SEQ ID NO: 1065966 - RNA, 22 nt, Human
gcccauggaaaaccuguccucu

SEQ ID NO: 1065967 - RNA, 22 nt, Human
agcucuccacacauaggacuag

SEQ ID NO: 1065968 - RNA, 22 nt, Human
aaugaguucugguucauuuuau

SEQ ID NO: 1065969 - RNA, 22 nt, Human
uagcagaguagugccuccagau

SEQ ID NO: 1065970 - RNA, 22 nt, Human
ugggccaggucugcggucauuu

SEQ ID NO: 1065971 - RNA, 22 nt, Human
uucauucccaagaguaaacaua

SEQ ID NO: 1065972 - RNA, 22 nt, Human
uccuccucuaucagacagugcc

SEQ ID NO: 1065973 - RNA, 22 nt, Human
cucuguccacagguuugucccu

SEQ ID NO: 1065974 - RNA, 22 nt, Human
ucgugucagaucagagguuccu

SEQ ID NO: 1065975 - RNA, 22 nt, Human
auauuugcaggaaacuaguuuu

SEQ ID NO: 1065976 - RNA, 22 nt, Human
uuuuaaagagaugcugugcaua

SEQ ID NO: 1065977 - RNA, 22 nt, Human
uuucuagaggcuccaggggagu

SEQ ID NO: 1065978 - RNA, 19 nt, Human
agucccaggcccgaaagag

SEQ ID NO: 1065979 - RNA, 22 nt, Human
aacacuuuccugccuuucugau

SEQ ID NO: 1065980 - RNA, 22 nt, Human
auucuuuaauucaauugaagga

SEQ ID NO: 1065981 - RNA, 22 nt, Human
ggcagcugagcauggcuaccuu

SEQ ID NO: 1065982 - RNA, 22 nt, Human
ucucuguacaguacaugccgug

SEQ ID NO: 1065983 - RNA, 22 nt, Human
uugaggcugcacaguacaggcu

SEQ ID NO: 1065984 - RNA, 22 nt, Human
cacaaaugguuguagacauuaa

SEQ ID NO: 1065985 - RNA, 22 nt, Human
cugggagcugucaggagcgugu

SEQ ID NO: 1065986 - RNA, 22 nt, Human
gaauguuuuuaggaauguuaug

SEQ ID NO: 1065987 - RNA, 22 nt, Human
ucuggguuauuaugauggcuac

SEQ ID NO: 1065988 - RNA, 22 nt, Human
ugaaguuuucugguugauuaag

SEQ ID NO: 1065989 - RNA, 22 nt, Human
uucccaggcugugcuaccagag

SEQ ID NO: 1065990 - RNA, 22 nt, Human
gaaucucaaggcuugugaggau

SEQ ID NO: 1065991 - RNA, 22 nt, Human
ucuuaaaugacugauaagagga

SEQ ID NO: 1065992 - RNA, 22 nt, Human
ucugugaaaggaaagaacugac

SEQ ID NO: 1065993 - RNA, 22 nt, Human
auuuccaaucucugcauauggg

SEQ ID NO: 1065994 - RNA, 22 nt, Human
uuuccucugacugcuccccugc

SEQ ID NO: 1065995 - RNA, 22 nt, Human
aggagccaguuccaccccagga

SEQ ID NO: 1065996 - RNA, 22 nt, Human
ccagcauggcaccugagaugag

SEQ ID NO: 1065997 - RNA, 22 nt, Human
gggcagcagaggaucccuuaau

SEQ ID NO: 1065998 - RNA, 22 nt, Human
acacucuguaaugucacacucc

SEQ ID NO: 1065999 - RNA, 22 nt, Human
acuuccagauggccccaucuaa

SEQ ID NO: 1066000 - RNA, 22 nt, Human
uuucugaauuuacucaagguca

SEQ ID NO: 1066001 - RNA, 22 nt, Human
ucauacauucagcagauauuug

SEQ ID NO: 1066002 - RNA, 22 nt, Human
agcuggugcucaggggcaugga

SEQ ID NO: 1066003 - RNA, 22 nt, Human
aauauaugacuccacugcauga

SEQ ID NO: 1066004 - RNA, 22 nt, Human
acucagaguuugcguuccauac

SEQ ID NO: 1066005 - RNA, 22 nt, Human
aucaacauuccaaugugguaga

SEQ ID NO: 1066006 - RNA, 22 nt, Human
caauuucauggauaaaagaugu

SEQ ID NO: 1066007 - RNA, 18 nt, Human
ggguccugugggagacag

SEQ ID NO: 1066008 - RNA, 22 nt, Human
agggacuggcucucugagcagg

SEQ ID NO: 1066009 - RNA, 22 nt, Human
agcccagcagaaaguccagccu

SEQ ID NO: 1066010 - RNA, 22 nt, Human
ucugugacuugcgggaggagaa

SEQ ID NO: 1066011 - RNA, 22 nt, Human
ugagcccuaagggucaagcagg

SEQ ID NO: 1066012 - RNA, 22 nt, Human
uccuucagggggccgccugcac

SEQ ID NO: 1066013 - RNA, 22 nt, Human
guuugcauuuauuagucuucug

SEQ ID NO: 1066014 - RNA, 22 nt, Human
cuucucagaucucagcuuugag

SEQ ID NO: 1066015 - RNA, 19 nt, Human
ccugugagaggacaggugu

SEQ ID NO: 1066016 - RNA, 21 nt, Human
ucuuguccuugcucucccacu

SEQ ID NO: 1066017 - RNA, 22 nt, Human
ggcaggcuccguguuccauucc

SEQ ID NO: 1066018 - RNA, 22 nt, Human
cuguccuguagcuccaucaguc

SEQ ID NO: 1066019 - RNA, 21 nt, Human
acagcauguuuguguguuugc

SEQ ID NO: 1066020 - RNA, 22 nt, Human
gggaagccaugcucagagguac

SEQ ID NO: 1066021 - RNA, 22 nt, Human
acugagagcguguacaaacuua

SEQ ID NO: 1066022 - RNA, 22 nt, Human
aucuggcucaccuggguaaaua

SEQ ID NO: 1066023 - RNA, 22 nt, Human
augaaauguaaguagagaguuu

SEQ ID NO: 1066024 - RNA, 22 nt, Human
gacacagagggcaccagauaug

SEQ ID NO: 1066025 - RNA, 22 nt, Human
aguggcagagguugacugcagu

SEQ ID NO: 1066026 - RNA, 22 nt, Human
agcuuugggcagaagaggauuc

SEQ ID NO: 1066027 - RNA, 22 nt, Human
acugccaaugguaguuugaugg

SEQ ID NO: 1066028 - RNA, 21 nt, Human
ucccagagugcuugggacugc

SEQ ID NO: 1066029 - RNA, 22 nt, Human
gcucugcuggaaguucucugga

SEQ ID NO: 1066030 - RNA, 22 nt, Human
acacagaagcuuuuucuauucc

SEQ ID NO: 1066031 - RNA, 22 nt, Human
gcugcagcccugcggaucacuu

SEQ ID NO: 1066032 - RNA, 22 nt, Human
ggagaaagcuguaguggaaugu

SEQ ID NO: 1066033 - RNA, 22 nt, Human
gcuggccauggggagugaggag

SEQ ID NO: 1066034 - RNA, 19 nt, Human
ugcaagcuuuuucuuguua

SEQ ID NO: 1066035 - RNA, 22 nt, Human
aaaacaguuauaaacagaguca

SEQ ID NO: 1066036 - RNA, 22 nt, Human
caauuucagucucagagaguuc

SEQ ID NO: 1066037 - RNA, 22 nt, Human
ccagggcugguggcugcagagg

SEQ ID NO: 1066038 - RNA, 22 nt, Human
ugaaguuguuaagguugccauu

SEQ ID NO: 1066039 - RNA, 22 nt, Human
cugagccauccauaccagcuua

SEQ ID NO: 1066040 - RNA, 22 nt, Human
guucaaggaagggaggaaagcc

SEQ ID NO: 1066041 - RNA, 22 nt, Human
uggagcagccuuuucuaagcaa

SEQ ID NO: 1066042 - RNA, 22 nt, Human
ccucagggaaugggaggcuggg

SEQ ID NO: 1066043 - RNA, 20 nt, Human
cagccuccacucacucagcu

SEQ ID NO: 1066044 - RNA, 22 nt, Human
aggcucagaggugagcaucugc

SEQ ID NO: 1066045 - RNA, 22 nt, Human
ugcauuguuuagaacucuuugg

SEQ ID NO: 1066046 - RNA, 22 nt, Human
gcugccugucuguuucuuuuau

SEQ ID NO: 1066047 - RNA, 22 nt, Human
ucuggcucuguguccucaccca

SEQ ID NO: 1066048 - RNA, 22 nt, Human
aguguuucucagaagggccuau

SEQ ID NO: 1066049 - RNA, 22 nt, Human
gcaggagcagucaggggcagcu

SEQ ID NO: 1066050 - RNA, 22 nt, Human
gagcagcucgagaaggaagcag

SEQ ID NO: 1066051 - RNA, 21 nt, Human
uuugaaagcccuauguuuuca

SEQ ID NO: 1066052 - RNA, 19 nt, Human
gggaugggcccucacccuc

SEQ ID NO: 1066053 - RNA, 20 nt, Human
uacagaaugcaauaaaaugg

SEQ ID NO: 1066054 - RNA, 22 nt, Human
uaggcagagguaugguaaggac

SEQ ID NO: 1066055 - RNA, 22 nt, Human
aucuggcuugacuuugcgacuu

SEQ ID NO: 1066056 - RNA, 22 nt, Human
gccagugggacccgcugugggc

SEQ ID NO: 1066057 - RNA, 19 nt, Human
ggagaggcuggagggaugc

SEQ ID NO: 1066058 - RNA, 22 nt, Human
gagauauaaccuaaaggucacu

SEQ ID NO: 1066059 - RNA, 22 nt, Human
uguuucccuaaggucuggcucu

SEQ ID NO: 1066060 - RNA, 22 nt, Human
gcugugcuauaucucugagugu

SEQ ID NO: 1066061 - RNA, 22 nt, Human
gcagcagaggcccuacucuuug

SEQ ID NO: 1066062 - RNA, 22 nt, Human
guuuuguugcugcagagcucaa

SEQ ID NO: 1066063 - RNA, 22 nt, Human
uguauuaacauuaauaaaaugg

SEQ ID NO: 1066064 - RNA, 22 nt, Human
gcuggccucuacaggccggcca

SEQ ID NO: 1066065 - RNA, 22 nt, Human
acagucaggccgagaugggccu

SEQ ID NO: 1066066 - RNA, 22 nt, Human
agccugugacucugugaaacca

SEQ ID NO: 1066067 - RNA, 20 nt, Human
cuggcaggagcgagucuacc

SEQ ID NO: 1066068 - RNA, 21 nt, Human
gggcuggaggaugggaagccc

SEQ ID NO: 1066069 - RNA, 22 nt, Human
uggaaggagcuaaggaccuggg

SEQ ID NO: 1066070 - RNA, 23 nt, Human
gugcaugugucuuuacaguagca

SEQ ID NO: 1066071 - RNA, 22 nt, Human
caacacuucuuauacuuacuga

SEQ ID NO: 1066072 - RNA, 22 nt, Human
uugaauaggacucagcagugau

SEQ ID NO: 1066073 - RNA, 22 nt, Human
cacauguacagaagcaggcugg

SEQ ID NO: 1066074 - RNA, 22 nt, Human
ucuguauauauuaaugaaauuc

SEQ ID NO: 1066075 - RNA, 22 nt, Human
uauuccaacuucacuauugucu

SEQ ID NO: 1066076 - RNA, 22 nt, Human
aguuucauuucuuaguaccagu

SEQ ID NO: 1066077 - RNA, 22 nt, Human
acaaaaauuagcugggcauggu

SEQ ID NO: 1066078 - RNA, 22 nt, Human
caggaggcaguuucagaaguca

SEQ ID NO: 1066079 - RNA, 22 nt, Human
ugaacacaucugcgugugucuc

SEQ ID NO: 1066080 - RNA, 22 nt, Human
cacugaaaauuagcuuuccuga

SEQ ID NO: 1066081 - RNA, 22 nt, Human
aagcaacagaaacauucuaaua

SEQ ID NO: 1066082 - RNA, 20 nt, Human
gggcuagaccagggcagagg

SEQ ID NO: 1066083 - RNA, 22 nt, Human
aauaagaaagagucagcuucag

SEQ ID NO: 1066084 - RNA, 22 nt, Human
gggcugagauuggugcccuguc

SEQ ID NO: 1066085 - RNA, 22 nt, Human
ucucugucccuaggagccuugc

SEQ ID NO: 1066086 - RNA, 22 nt, Human
ggagaagauuggaauuaagcac

SEQ ID NO: 1066087 - RNA, 22 nt, Human
gccaagcuggaugaagagguug

SEQ ID NO: 1066088 - RNA, 22 nt, Human
uuuuucuugugcuggaucuaau

SEQ ID NO: 1066089 - RNA, 22 nt, Human
ucagucuucccuccagugcaac

SEQ ID NO: 1066090 - RNA, 22 nt, Human
agcugcugcgccucacccuggc

SEQ ID NO: 1066091 - RNA, 22 nt, Human
auuuacauuuauuugagaaggu

SEQ ID NO: 1066092 - RNA, 22 nt, Human
uucuguuuacucagaaauacaa

SEQ ID NO: 1066093 - RNA, 22 nt, Human
ucccagaacccugccagguccu

SEQ ID NO: 1066094 - RNA, 22 nt, Human
acaaagucaaauugcagccgcc

SEQ ID NO: 1066095 - RNA, 22 nt, Human
uuuguuuucaaugugucauuca

SEQ ID NO: 1066096 - RNA, 22 nt, Human
gagggcugauaacaggaauaca

SEQ ID NO: 1066097 - RNA, 22 nt, Human
cauuuucaugaguuucuguuca

SEQ ID NO: 1066098 - RNA, 22 nt, Human
cagggagaucuuggcuccuggu

SEQ ID NO: 1066099 - RNA, 22 nt, Human
agugcaaagggaucagauuggg

SEQ ID NO: 1066100 - RNA, 22 nt, Human
acuuccagcugcccugugugcu

SEQ ID NO: 1066101 - RNA, 22 nt, Human
aagucagacagcugagcugccu

SEQ ID NO: 1066102 - RNA, 20 nt, Human
acagauggcaguuauuacau

SEQ ID NO: 1066103 - RNA, 22 nt, Human
ugaggcaggaguucaggcugcg

SEQ ID NO: 1066104 - RNA, 22 nt, Human
aaugacuguagucauauuaagg

SEQ ID NO: 1066105 - RNA, 22 nt, Human
ucaggggcugugcauuucccag

SEQ ID NO: 1066106 - RNA, 22 nt, Human
aagcccagaugugagaacugag

SEQ ID NO: 1066107 - RNA, 22 nt, Human
uuacagaaaauguguuuuaacu

SEQ ID NO: 1066108 - RNA, 22 nt, Human
aauuucaccuaucacuuaagcc

SEQ ID NO: 1066109 - RNA, 22 nt, Human
uuuagaaugugacuguauuuga

SEQ ID NO: 1066110 - RNA, 22 nt, Human
accccagaggcggaggcugcag

SEQ ID NO: 1066111 - RNA, 22 nt, Human
uggugcucccuggaguugugca

SEQ ID NO: 1066112 - RNA, 22 nt, Human
caagcugcuauagguugcuggg

SEQ ID NO: 1066113 - RNA, 22 nt, Human
gcugccugggcuggcauuccca

SEQ ID NO: 1066114 - RNA, 22 nt, Human
aggacuucaucaccuguauaaa

SEQ ID NO: 1066115 - RNA, 22 nt, Human
uuucccuugaauaaagauaucu

SEQ ID NO: 1066116 - RNA, 22 nt, Human
ggccuguguccuccuugcccug

SEQ ID NO: 1066117 - RNA, 22 nt, Human
cagcauggcuugaguguuuccu

SEQ ID NO: 1066118 - RNA, 21 nt, Human
cugugcuuuuuaagugugaug

SEQ ID NO: 1066119 - RNA, 22 nt, Human
ugggagugauacaguauggaau

SEQ ID NO: 1066120 - RNA, 22 nt, Human
accaggacuuuguauucagcuu

SEQ ID NO: 1066121 - RNA, 22 nt, Human
ucagaauuuucuggaauggagc

SEQ ID NO: 1066122 - RNA, 22 nt, Human
gcagugaacauaacacagaagg

SEQ ID NO: 1066123 - RNA, 22 nt, Human
gcugccugccugcauuuaaucc

SEQ ID NO: 1066124 - RNA, 22 nt, Human
aucuuccuucacuuucucccac

SEQ ID NO: 1066125 - RNA, 22 nt, Human
aagaacugugcuccaggcucca

SEQ ID NO: 1066126 - RNA, 20 nt, Human
ccacauuuuacuguuugcca

SEQ ID NO: 1066127 - RNA, 22 nt, Human
ccagaaaagcaucugguucuuu

SEQ ID NO: 1066128 - RNA, 22 nt, Human
agccagcaggugcagaauucca

SEQ ID NO: 1066129 - RNA, 22 nt, Human
cugcagcuuucgcuccaucagc

SEQ ID NO: 1066130 - RNA, 22 nt, Human
cugccugaagaauuguguugca

SEQ ID NO: 1066131 - RNA, 22 nt, Human
ucugacuucuucauccuugcca

SEQ ID NO: 1066132 - RNA, 23 nt, Human
acacugucucauggauagacugc

SEQ ID NO: 1066133 - RNA, 22 nt, Human
guggguggaucaccugagguca

SEQ ID NO: 1066134 - RNA, 19 nt, Human
ugaggggcucacagucuca

SEQ ID NO: 1066135 - RNA, 22 nt, Human
uuuccucuuugugacacagcug

SEQ ID NO: 1066136 - RNA, 22 nt, Human
uuagaaguaaggucagauuucu

SEQ ID NO: 1066137 - RNA, 22 nt, Human
caggaacagaguggcauugucu

SEQ ID NO: 1066138 - RNA, 17 nt, Human
uuccuccucaccauguu

SEQ ID NO: 1066139 - RNA, 22 nt, Human
gaacccaguccaggugcagccu

SEQ ID NO: 1066140 - RNA, 22 nt, Human
caggcugggcuccggagauaaa

SEQ ID NO: 1066141 - RNA, 22 nt, Human
cucugcaugccuugcucagaca

SEQ ID NO: 1066142 - RNA, 22 nt, Human
agggcugcaucugccuggugaa

SEQ ID NO: 1066143 - RNA, 22 nt, Human
auucacacacauuuagagcaga

SEQ ID NO: 1066144 - RNA, 22 nt, Human
cuggcaggaaggcauuuagaca

SEQ ID NO: 1066145 - RNA, 22 nt, Human
ccugggaacagcagaguccugg

SEQ ID NO: 1066146 - RNA, 22 nt, Human
cugaagaggacgcagcagcaag

SEQ ID NO: 1066147 - RNA, 22 nt, Human
cagagaacuuagcuaguuuucc

SEQ ID NO: 1066148 - RNA, 22 nt, Human
ugagccaggaguuugaggcugu

SEQ ID NO: 1066149 - RNA, 22 nt, Human
uugcaacucuugaaaagcauug

SEQ ID NO: 1066150 - RNA, 23 nt, Human
aaauagagauaggccagcuuugc

SEQ ID NO: 1066151 - RNA, 22 nt, Human
gcagguguggaguggggugagc

SEQ ID NO: 1066152 - RNA, 22 nt, Human
ccaggcugccgaggaaagaaag

SEQ ID NO: 1066153 - RNA, 22 nt, Human
cugagacuuucaugugcuuuua

SEQ ID NO: 1066154 - RNA, 22 nt, Human
aaggaaccuggaguagagggag

SEQ ID NO: 1066155 - RNA, 22 nt, Human
acugagagucuuagaaacacau

SEQ ID NO: 1066156 - RNA, 22 nt, Human
cauguaaagcacuucauaacag

SEQ ID NO: 1066157 - RNA, 22 nt, Human
ugaagcaguucucagaaguggg

SEQ ID NO: 1066158 - RNA, 22 nt, Human
caggccagugugcuucccaggc

SEQ ID NO: 1066159 - RNA, 22 nt, Human
cugguucaugguggaaugacau

SEQ ID NO: 1066160 - RNA, 22 nt, Human
cuguaaaaugaaccuagucauc

SEQ ID NO: 1066161 - RNA, 22 nt, Human
uuucaaguguccugauuaaugg

SEQ ID NO: 1066162 - RNA, 22 nt, Human
uuuacugaacugcuaguacagg

SEQ ID NO: 1066163 - RNA, 22 nt, Human
cuggcucauagagcagcuccaa

SEQ ID NO: 1066164 - RNA, 22 nt, Human
gcucugcugaagccccuugcau

SEQ ID NO: 1066165 - RNA, 22 nt, Human
caaagggcucuagacucagcag

SEQ ID NO: 1066166 - RNA, 22 nt, Human
augaggcaaggcuggccguguu

SEQ ID NO: 1066167 - RNA, 22 nt, Human
gugguuuucuccaacccagaac

SEQ ID NO: 1066168 - RNA, 22 nt, Human
aaguguuuggggaucauuuuaa

SEQ ID NO: 1066169 - RNA, 21 nt, Human
gucaggcccauagcagugccu

SEQ ID NO: 1066170 - RNA, 20 nt, Human
caaaagcaaugaaguuauga

SEQ ID NO: 1066171 - RNA, 22 nt, Human
ccaggcuccgcauagaccccac

SEQ ID NO: 1066172 - RNA, 22 nt, Human
gcuccucuccucggagucgggg

SEQ ID NO: 1066173 - RNA, 22 nt, Human
cagugaaguuuaaaguguagau

SEQ ID NO: 1066174 - RNA, 22 nt, Human
acagaaauaacuuuuuauguuu

SEQ ID NO: 1066175 - RNA, 21 nt, Human
ggcaggugggucucuguugcu

SEQ ID NO: 1066176 - RNA, 22 nt, Human
auacaaaauauauacuggagac

SEQ ID NO: 1066177 - RNA, 22 nt, Human
gggcccugaucugugagcgcag

SEQ ID NO: 1066178 - RNA, 22 nt, Human
auacacaucuauuuaagagaca

SEQ ID NO: 1066179 - RNA, 22 nt, Human
aacuguugcuuguaauaugugc

SEQ ID NO: 1066180 - RNA, 22 nt, Human
ugccagucagugguuuaaaagu

SEQ ID NO: 1066181 - RNA, 22 nt, Human
gcccuggccuggcgcguuguca

SEQ ID NO: 1066182 - RNA, 22 nt, Human
aaguccaugaucaagauguggc

SEQ ID NO: 1066183 - RNA, 22 nt, Human
ucccagagucuucuccuguaau

SEQ ID NO: 1066184 - RNA, 22 nt, Human
cuuccaguaguaucauucucau

SEQ ID NO: 1066185 - RNA, 22 nt, Human
ucacagaagguggccauagcug

SEQ ID NO: 1066186 - RNA, 22 nt, Human
uuccaaugacuaguggcauccu

SEQ ID NO: 1066187 - RNA, 21 nt, Human
ccacauucucauucugacugc

SEQ ID NO: 1066188 - RNA, 22 nt, Human
uacacuauuuuacugauacaaa

SEQ ID NO: 1066189 - RNA, 22 nt, Human
aaguaaaacacacaguccaccg

SEQ ID NO: 1066190 - RNA, 22 nt, Human
cagagcagaaaccugggugauu

SEQ ID NO: 1066191 - RNA, 22 nt, Human
uggagcccagggugagaaggag

SEQ ID NO: 1066192 - RNA, 22 nt, Human
cugggccuagaggaagcugaca

SEQ ID NO: 1066193 - RNA, 22 nt, Human
aggaauucaagaccagcugggc

SEQ ID NO: 1066194 - RNA, 22 nt, Human
ccagaagggcuauugcagugac

SEQ ID NO: 1066195 - RNA, 22 nt, Human
cucaggccaauaagcuccagcc

SEQ ID NO: 1066196 - RNA, 19 nt, Human
uucagaauugggaggugau

SEQ ID NO: 1066197 - RNA, 22 nt, Human
ggagggguggucaccuggcagg

SEQ ID NO: 1066198 - RNA, 22 nt, Human
cacacauuucagaugcuacaau

SEQ ID NO: 1066199 - RNA, 20 nt, Human
ccuccuggucaggugugcag

SEQ ID NO: 1066200 - RNA, 22 nt, Human
acacuucaaaugguuggaaaau

SEQ ID NO: 1066201 - RNA, 22 nt, Human
ccacagggcucuaggcgcuucc

SEQ ID NO: 1066202 - RNA, 21 nt, Human
ucuggcaggcacgggcccagc

SEQ ID NO: 1066203 - RNA, 22 nt, Human
ccagucccgcaugguccagaau

SEQ ID NO: 1066204 - RNA, 19 nt, Human
gcaggcaguggcauucgga

SEQ ID NO: 1066205 - RNA, 22 nt, Human
cugcucugcagcuuggacuccc

SEQ ID NO: 1066206 - RNA, 22 nt, Human
guggcagggugcucaucaugca

SEQ ID NO: 1066207 - RNA, 22 nt, Human
ucugaaauaggaaagcaaaugg

SEQ ID NO: 1066208 - RNA, 22 nt, Human
caguccuugcucugggaugaug

SEQ ID NO: 1066209 - RNA, 22 nt, Human
uaagaaucgauguuuauuuaga

SEQ ID NO: 1066210 - RNA, 22 nt, Human
aaauguacugauacuuauuuua

SEQ ID NO: 1066211 - RNA, 22 nt, Human
ggcaggcuugguggcaccgguu

SEQ ID NO: 1066212 - RNA, 22 nt, Human
ggcugcucugcacaggggcugg

SEQ ID NO: 1066213 - RNA, 20 nt, Human
ggggcaguggcucaugccug

SEQ ID NO: 1066214 - RNA, 22 nt, Human
ugcucagggacaauggagaggg

SEQ ID NO: 1066215 - RNA, 22 nt, Human
auuuuagagcuccaaguacagc

SEQ ID NO: 1066216 - RNA, 22 nt, Human
gcagggccuuagcagcggcugc

SEQ ID NO: 1066217 - RNA, 22 nt, Human
cuggagccacugggucuuguau

SEQ ID NO: 1066218 - RNA, 22 nt, Human
gguggccaggccagcucuggcc

SEQ ID NO: 1066219 - RNA, 19 nt, Human
cagcugccuuuucuuugca

SEQ ID NO: 1066220 - RNA, 22 nt, Human
agcugcuacugcucugccagag

SEQ ID NO: 1066221 - RNA, 22 nt, Human
guggcugcuacagagcuggagg

SEQ ID NO: 1066222 - RNA, 22 nt, Human
ucucacagggcuaggcccugcc

SEQ ID NO: 1066223 - RNA, 22 nt, Human
caugaagcuugaagcaguccac

SEQ ID NO: 1066224 - RNA, 18 nt, Human
caauguuuuagaucucua

SEQ ID NO: 1066225 - RNA, 22 nt, Human
uauuugaagauucuucugaugu

SEQ ID NO: 1066226 - RNA, 20 nt, Human
acaguggaaauugaugucug

SEQ ID NO: 1066227 - RNA, 22 nt, Human
ggagacaguauggcuuguagcu

SEQ ID NO: 1066228 - RNA, 22 nt, Human
acagauggugagccgcugaugu

SEQ ID NO: 1066229 - RNA, 22 nt, Human
ucacagaaggcaucacagaaga

SEQ ID NO: 1066230 - RNA, 22 nt, Human
cauuugaaauucuuagaacaaa

SEQ ID NO: 1066231 - RNA, 22 nt, Human
acauucuauagcaagcugaucu

SEQ ID NO: 1066232 - RNA, 22 nt, Human
agggauguaaauucuucuucuu

SEQ ID NO: 1066233 - RNA, 22 nt, Human
ccaccagcuucagcagccgcgg

SEQ ID NO: 1066234 - RNA, 22 nt, Human
agcugcaggccucuccugggga

SEQ ID NO: 1066235 - RNA, 22 nt, Human
cucugaggaagucaaguagcca

SEQ ID NO: 1066236 - RNA, 22 nt, Human
gugggcuuguuuugaugagauc

SEQ ID NO: 1066237 - RNA, 22 nt, Human
ccagcccugccagagagagcug

SEQ ID NO: 1066238 - RNA, 22 nt, Human
cugucuccagggcaggugcagg

SEQ ID NO: 1066239 - RNA, 22 nt, Human
cuacagacccaccuuggaagaa

SEQ ID NO: 1066240 - RNA, 22 nt, Human
gcagacaggggcuuaggaaagg

SEQ ID NO: 1066241 - RNA, 22 nt, Human
uucaggauggaguaccuuuuau

SEQ ID NO: 1066242 - RNA, 22 nt, Human
aaacaugcuggauuuagaauau

SEQ ID NO: 1066243 - RNA, 22 nt, Human
gaugcugagagguggagggaac

SEQ ID NO: 1066244 - RNA, 22 nt, Human
gccugcagaacugugaggcaau

SEQ ID NO: 1066245 - RNA, 22 nt, Human
ugcugucaguuggcaggaugag

SEQ ID NO: 1066246 - RNA, 22 nt, Human
cgaaaucagcaucuugaggcaa

SEQ ID NO: 1066247 - RNA, 22 nt, Human
ucagaggagaaguugggaaaau

SEQ ID NO: 1066248 - RNA, 22 nt, Human
ugacagaaauaguucuuaauuu

SEQ ID NO: 1066249 - RNA, 22 nt, Human
cgcagggccgcgagcgggacca

SEQ ID NO: 1066250 - RNA, 22 nt, Human
ugugaaauugagaaacuuucac

SEQ ID NO: 1066251 - RNA, 22 nt, Human
gccagcuggaaaucugcuugaa

SEQ ID NO: 1066252 - RNA, 22 nt, Human
caugugacaggagcagcucuaa

SEQ ID NO: 1066253 - RNA, 22 nt, Human
uuccuaaaagaauacacuggau

SEQ ID NO: 1066254 - RNA, 18 nt, Human
gcagugaagaaagagcuu

SEQ ID NO: 1066255 - RNA, 22 nt, Human
acccaggguagagugcaguggc

SEQ ID NO: 1066256 - RNA, 22 nt, Human
ugaggccucuugguauggugug

SEQ ID NO: 1066257 - RNA, 22 nt, Human
caggagacaguguuauuuuauu

SEQ ID NO: 1066258 - RNA, 22 nt, Human
gagcaggaacagaucccuugga

SEQ ID NO: 1066259 - RNA, 22 nt, Human
ucuucauguauuugacaaccau

SEQ ID NO: 1066260 - RNA, 22 nt, Human
ccugcugguuuuuacaaagaug

SEQ ID NO: 1066261 - RNA, 22 nt, Human
auguuaagaaugcagacaaaug

SEQ ID NO: 1066262 - RNA, 22 nt, Human
cgaaaauagaucuguuucccag

SEQ ID NO: 1066263 - RNA, 22 nt, Human
gcaaagucugcaucuggaucag

SEQ ID NO: 1066264 - RNA, 22 nt, Human
ugcccugcagacccugcagugu

SEQ ID NO: 1066265 - RNA, 22 nt, Human
aggcugagauagguggaucauu

SEQ ID NO: 1066266 - RNA, 17 nt, Human
ggugagaccucccacuc

SEQ ID NO: 1066267 - RNA, 22 nt, Human
cauuucaaacaguuacagcugc

SEQ ID NO: 1066268 - RNA, 22 nt, Human
cagugcaguggcugagcuggag

SEQ ID NO: 1066269 - RNA, 22 nt, Human
ggugcucaagagggcauccucu

SEQ ID NO: 1066270 - RNA, 22 nt, Human
uccugggaagcgccggccugcg

SEQ ID NO: 1066271 - RNA, 22 nt, Human
cacaaaauaucaagcacuuuua

SEQ ID NO: 1066272 - RNA, 22 nt, Human
auucuaaaucagagagcucugu

SEQ ID NO: 1066273 - RNA, 22 nt, Human
ggcaccuggauguagcagugaa

SEQ ID NO: 1066274 - RNA, 22 nt, Human
acuacuuugggccauuuguuua

SEQ ID NO: 1066275 - RNA, 22 nt, Human
ucugccuguaccucuuuuuugc

SEQ ID NO: 1066276 - RNA, 22 nt, Human
gagccagccuucuucugagguc

SEQ ID NO: 1066277 - RNA, 22 nt, Human
ccagcugucacucagaaaggcc

SEQ ID NO: 1066278 - RNA, 17 nt, Human
ucagcaaagacaaagga

SEQ ID NO: 1066279 - RNA, 22 nt, Human
gcugagagaaaagugagguucu

SEQ ID NO: 1066280 - RNA, 22 nt, Human
cagucacauggaugauggauag

SEQ ID NO: 1066281 - RNA, 22 nt, Human
acauucuugaagugaaguuuau

SEQ ID NO: 1066282 - RNA, 22 nt, Human
caaagucauaaaacuuguaagu

SEQ ID NO: 1066283 - RNA, 22 nt, Human
caggccugcuucuuacccuuca

SEQ ID NO: 1066284 - RNA, 22 nt, Human
uaacacaugguuaguacacaau

SEQ ID NO: 1066285 - RNA, 22 nt, Human
augaaaauguacauguguauaa

SEQ ID NO: 1066286 - RNA, 22 nt, Human
gaggcugugugucccucuggac

SEQ ID NO: 1066287 - RNA, 22 nt, Human
auccuucaaggggcugacagcu

SEQ ID NO: 1066288 - RNA, 22 nt, Human
ucuuuccacauucucuguuuag

SEQ ID NO: 1066289 - RNA, 22 nt, Human
uucaaagugcuguucaaaguag

SEQ ID NO: 1066290 - RNA, 18 nt, Human
uggcagagugucuguucu

SEQ ID NO: 1066291 - RNA, 22 nt, Human
cuuuacuucucaaaauaaagca

SEQ ID NO: 1066292 - RNA, 22 nt, Human
cuguauaucaugguuuugcagu

SEQ ID NO: 1066293 - RNA, 22 nt, Human
ucaggggacuuaggagagaagu

SEQ ID NO: 1066294 - RNA, 22 nt, Human
agaguuggagaaauuaaaauuu

SEQ ID NO: 1066295 - RNA, 22 nt, Human
aaauacaguguguguucuuuga

SEQ ID NO: 1066296 - RNA, 22 nt, Human
uuuguauaagaacauucuagca

SEQ ID NO: 1066297 - RNA, 19 nt, Human
uugaggggccaggggagau

SEQ ID NO: 1066298 - RNA, 22 nt, Human
cuccuggaagcccgcccugcug

SEQ ID NO: 1066299 - RNA, 22 nt, Human
accuuucacgguaucagacauc

SEQ ID NO: 1066300 - RNA, 22 nt, Human
aacaucuuguacugcacauuuu

SEQ ID NO: 1066301 - RNA, 22 nt, Human
gcaggccaggcuaggggcuguc

SEQ ID NO: 1066302 - RNA, 22 nt, Human
ccucaggggcuuuucguuguug

SEQ ID NO: 1066303 - RNA, 18 nt, Human
uaacaauccugagugucu

SEQ ID NO: 1066304 - RNA, 22 nt, Human
ugucacauaauuuaucuguagg

SEQ ID NO: 1066305 - RNA, 22 nt, Human
caguggcugugaccagggaccu

SEQ ID NO: 1066306 - RNA, 22 nt, Human
caggaggaggguacaccaucag

SEQ ID NO: 1066307 - RNA, 22 nt, Human
gccagcugaauuuccaacuguu

SEQ ID NO: 1066308 - RNA, 20 nt, Human
uguuccaagcuaaugaauga

SEQ ID NO: 1066309 - RNA, 22 nt, Human
ccugcucugguuuagucagucu

SEQ ID NO: 1066310 - RNA, 22 nt, Human
gccagcuggagacuggcagggg

SEQ ID NO: 1066311 - RNA, 22 nt, Human
caaaguaauauggucccaguga

SEQ ID NO: 1066312 - RNA, 22 nt, Human
ugacauuuaucaaagaaauggu

SEQ ID NO: 1066313 - RNA, 22 nt, Human
gcugggcuguaguuugcugacc

SEQ ID NO: 1066314 - RNA, 22 nt, Human
ggcagcugugaagugccucaca

SEQ ID NO: 1066315 - RNA, 23 nt, Human
ccacagagcugccaauuccugug

SEQ ID NO: 1066316 - RNA, 22 nt, Human
aggccugggacgggagccguga

SEQ ID NO: 1066317 - RNA, 21 nt, Human
ggcagccucuguggaagggga

SEQ ID NO: 1066318 - RNA, 22 nt, Human
agcaccugccugcauuggcuau

SEQ ID NO: 1066319 - RNA, 23 nt, Human
ugcucccaggugacgcugcuguu

SEQ ID NO: 1066320 - RNA, 22 nt, Human
auacaugugugugcauacaugu

SEQ ID NO: 1066321 - RNA, 22 nt, Human
guccuggcuuaguucgcuguaa

SEQ ID NO: 1066322 - RNA, 22 nt, Human
ugucucuugagcugccugaugc

SEQ ID NO: 1066323 - RNA, 22 nt, Human
gggaccugaggcccugcuccac

SEQ ID NO: 1066324 - RNA, 22 nt, Human
ucuaaagccuuccauauaacgc

SEQ ID NO: 1066325 - RNA, 22 nt, Human
agccuggagaggcgccauacac

SEQ ID NO: 1066326 - RNA, 22 nt, Human
aaacuguaaauacuaguaagug

SEQ ID NO: 1066327 - RNA, 22 nt, Human
cugguucauuagguauuagugg

SEQ ID NO: 1066328 - RNA, 22 nt, Human
ccagggcagaaaaagagggaau

SEQ ID NO: 1066329 - RNA, 22 nt, Human
aaauuccagcaacaccuuuuua

SEQ ID NO: 1066330 - RNA, 22 nt, Human
ccagccagccuugaucugagua

SEQ ID NO: 1066331 - RNA, 22 nt, Human
uacauucaacaugucacuaugu

SEQ ID NO: 1066332 - RNA, 22 nt, Human
ucagggcaaaagggaaaccauu

SEQ ID NO: 1066333 - RNA, 22 nt, Human
acuuuaaagcagaauggcuaug

SEQ ID NO: 1066334 - RNA, 22 nt, Human
gucagcagugucagcucugggg

SEQ ID NO: 1066335 - RNA, 19 nt, Human
uguuucuuccuccaucuga

SEQ ID NO: 1066336 - RNA, 18 nt, Human
cacaauuuacagaugaca

SEQ ID NO: 1066337 - RNA, 22 nt, Human
caggccucccggugcacacuga

SEQ ID NO: 1066338 - RNA, 22 nt, Human
uucuaagugauucuagcuggac

SEQ ID NO: 1066339 - RNA, 22 nt, Human
ggaggccaucagggagggcauu

SEQ ID NO: 1066340 - RNA, 22 nt, Human
aaauucuuuggccuacuuugaa

SEQ ID NO: 1066341 - RNA, 22 nt, Human
uuguaugaucaaaagaaaugua

SEQ ID NO: 1066342 - RNA, 22 nt, Human
agcaauaugacauugcuacauc

SEQ ID NO: 1066343 - RNA, 22 nt, Human
ugaaaucaucugccaauaaguu

SEQ ID NO: 1066344 - RNA, 22 nt, Human
gucucuggguuaagcagugcau

SEQ ID NO: 1066345 - RNA, 22 nt, Human
gccugcagggugaugggcugcc

SEQ ID NO: 1066346 - RNA, 22 nt, Human
uuccuguccgcaauggccuggg

SEQ ID NO: 1066347 - RNA, 22 nt, Human
cucagaagaacccaggguccca

SEQ ID NO: 1066348 - RNA, 22 nt, Human
ccccaggacacauggaccaagu

SEQ ID NO: 1066349 - RNA, 22 nt, Human
uuucugcucgcucucaaucagg

SEQ ID NO: 1066350 - RNA, 22 nt, Human
cugccagccaggccagguaggc

SEQ ID NO: 1066351 - RNA, 22 nt, Human
auaaaguagccacuggaaagcu

SEQ ID NO: 1066352 - RNA, 22 nt, Human
ugggcugccagcucuccagaug

SEQ ID NO: 1066353 - RNA, 22 nt, Human
agcccugcaggaggugggagag

SEQ ID NO: 1066354 - RNA, 22 nt, Human
ugaacuucagugcauaauuauc

SEQ ID NO: 1066355 - RNA, 22 nt, Human
ucuagaaacaugacauugaucu

SEQ ID NO: 1066356 - RNA, 22 nt, Human
cugugccaucuuuuugcuaccu

SEQ ID NO: 1066357 - RNA, 22 nt, Human
gcuggccacacugcugauggag

SEQ ID NO: 1066358 - RNA, 17 nt, Human
aucuggcugcuucuaga

SEQ ID NO: 1066359 - RNA, 21 nt, Human
ugggggugaggccuaggaauc

SEQ ID NO: 1066360 - RNA, 23 nt, Human
gcagagcugcccuauugccuugg

SEQ ID NO: 1066361 - RNA, 22 nt, Human
ugaccuauuagauuuccuugcc

SEQ ID NO: 1066362 - RNA, 22 nt, Human
augcuguggaaguuccugaagc

SEQ ID NO: 1066363 - RNA, 22 nt, Human
ucagaggacagcagcuaaauaa

SEQ ID NO: 1066364 - RNA, 22 nt, Human
ggggcacacuuuugguagauau

SEQ ID NO: 1066365 - RNA, 19 nt, Human
ugcaaucagcuacccaggu

SEQ ID NO: 1066366 - RNA, 20 nt, Human
cuucuucaguaguuuguucu

SEQ ID NO: 1066367 - RNA, 22 nt, Human
uguguccuucugggagucccag

SEQ ID NO: 1066368 - RNA, 22 nt, Human
ugcacacaguggacaagucuug

SEQ ID NO: 1066369 - RNA, 22 nt, Human
uggcagaggagaauuaagauua

SEQ ID NO: 1066370 - RNA, 22 nt, Human
agccacagcauguguguaugua

SEQ ID NO: 1066371 - RNA, 22 nt, Human
uucaacaucaagaaugcaugga

SEQ ID NO: 1066372 - RNA, 22 nt, Human
guauacaugugguaaaaugcac

SEQ ID NO: 1066373 - RNA, 22 nt, Human
gaagcagaacccacuccccaac

SEQ ID NO: 1066374 - RNA, 22 nt, Human
acuuggagagcauugcugggga

SEQ ID NO: 1066375 - RNA, 22 nt, Human
aaggcugaauucaaggguaggc

SEQ ID NO: 1066376 - RNA, 22 nt, Human
gggcugggaauggcuaaguaug

SEQ ID NO: 1066377 - RNA, 22 nt, Human
aagagcuggaugaagaaaucaa

SEQ ID NO: 1066378 - RNA, 22 nt, Human
ccagcuaggcuugcacucuugu

SEQ ID NO: 1066379 - RNA, 22 nt, Human
uuuuccucugagcuuugaauaa

SEQ ID NO: 1066380 - RNA, 22 nt, Human
cauaagaauauuuaguggcagc

SEQ ID NO: 1066381 - RNA, 22 nt, Human
uccagugguacauggagacacu

SEQ ID NO: 1066382 - RNA, 23 nt, Human
ugcugggcagagcuggugcugag

SEQ ID NO: 1066383 - RNA, 22 nt, Human
ugccugucuuuccucccucgua

SEQ ID NO: 1066384 - RNA, 22 nt, Human
ugcccugccaagacucaguggu

SEQ ID NO: 1066385 - RNA, 22 nt, Human
uaggaagagcuauaggucccca

SEQ ID NO: 1066386 - RNA, 19 nt, Human
agcagcuggagguggagug

SEQ ID NO: 1066387 - RNA, 22 nt, Human
uacuuugagaugaugcugaucg

SEQ ID NO: 1066388 - RNA, 22 nt, Human
ccacauacaaauggggugcugu

SEQ ID NO: 1066389 - RNA, 22 nt, Human
aaggugggguccugucaucuga

SEQ ID NO: 1066390 - RNA, 19 nt, Human
uuacaugacauaugaagga

SEQ ID NO: 1066391 - RNA, 22 nt, Human
uccagggacacagaguccuucu

SEQ ID NO: 1066392 - RNA, 22 nt, Human
aggcucaggucucaggucuggc

SEQ ID NO: 1066393 - RNA, 22 nt, Human
uggcucuggugcgggcuccugc

SEQ ID NO: 1066394 - RNA, 22 nt, Human
gcugcugggaaugaacaguguu

SEQ ID NO: 1066395 - RNA, 22 nt, Human
ucccagagauuuccucuccuuc

SEQ ID NO: 1066396 - RNA, 22 nt, Human
guccucugaaagaugaaccaug

SEQ ID NO: 1066397 - RNA, 22 nt, Human
ugcaaagaagccuuugccuucu

SEQ ID NO: 1066398 - RNA, 22 nt, Human
gcccuggugugcccagcauggg

SEQ ID NO: 1066399 - RNA, 22 nt, Human
ugcuucugauucaugguuauug

SEQ ID NO: 1066400 - RNA, 23 nt, Human
gcagacagagcagacuaagacaa

SEQ ID NO: 1066401 - RNA, 22 nt, Human
uuuuguguccuucacaucaugu

SEQ ID NO: 1066402 - RNA, 22 nt, Human
ucaguguagcagacuuguagcc

SEQ ID NO: 1066403 - RNA, 22 nt, Human
ggccucucagggcagagacccu

SEQ ID NO: 1066404 - RNA, 22 nt, Human
ugagccuguggggugacaacca

SEQ ID NO: 1066405 - RNA, 22 nt, Human
uccccacagcagaagaucugag

SEQ ID NO: 1066406 - RNA, 22 nt, Human
ggaggaagagguuguucucuca

SEQ ID NO: 1066407 - RNA, 22 nt, Human
gaggccugggagccuguccucc

SEQ ID NO: 1066408 - RNA, 22 nt, Human
ccagcucucaaggcucccuggg

SEQ ID NO: 1066409 - RNA, 21 nt, Human
aaguggagaagaaaagcugga

SEQ ID NO: 1066410 - RNA, 18 nt, Human
ucuggcucaggacugaac

SEQ ID NO: 1066411 - RNA, 22 nt, Human
uuuguuauaacaauaaaaaguc

SEQ ID NO: 1066412 - RNA, 18 nt, Human
caaagcucacguuccauc

SEQ ID NO: 1066413 - RNA, 22 nt, Human
caggcagcagccacucugguau

SEQ ID NO: 1066414 - RNA, 22 nt, Human
agaaauacuaggaauauucaua

SEQ ID NO: 1066415 - RNA, 22 nt, Human
acauuuaacccucagguuucug

SEQ ID NO: 1066416 - RNA, 22 nt, Human
aaacacaccuuuggaacuguga

SEQ ID NO: 1066417 - RNA, 22 nt, Human
ggugugguuugaagggagaugg

SEQ ID NO: 1066418 - RNA, 22 nt, Human
cagggccuggagcugggccugc

SEQ ID NO: 1066419 - RNA, 22 nt, Human
ugaaccacaugcaaagugaaua

SEQ ID NO: 1066420 - RNA, 22 nt, Human
cugcuguggugucaagcaucuc

SEQ ID NO: 1066421 - RNA, 21 nt, Human
uuaauuuauucaugauagcua

SEQ ID NO: 1066422 - RNA, 22 nt, Human
acugggcuagaguggaagcugg

SEQ ID NO: 1066423 - RNA, 22 nt, Human
uuucaagaacaacauucauuca

SEQ ID NO: 1066424 - RNA, 22 nt, Human
ugagaaugaggggguagaaggu

SEQ ID NO: 1066425 - RNA, 22 nt, Human
ccagaaagguaaacacuggauu

SEQ ID NO: 1066426 - RNA, 22 nt, Human
uggcugggggugcuauagcugc

SEQ ID NO: 1066427 - RNA, 22 nt, Human
gcagcacacgguggugcccugg

SEQ ID NO: 1066428 - RNA, 22 nt, Human
gcagggcaaacccagguguuca

SEQ ID NO: 1066429 - RNA, 19 nt, Human
uuucuuaggccuuuggccu

SEQ ID NO: 1066430 - RNA, 22 nt, Human
cccagggguucugagcagcagc

SEQ ID NO: 1066431 - RNA, 22 nt, Human
aauaugucucuggcuagacauu

SEQ ID NO: 1066432 - RNA, 22 nt, Human
caggaacauuuaaccacagggu

SEQ ID NO: 1066433 - RNA, 22 nt, Human
caggcacugugcugagcucugc

SEQ ID NO: 1066434 - RNA, 22 nt, Human
ucucaggaguagugggauccau

SEQ ID NO: 1066435 - RNA, 21 nt, Human
ccugcagcaccagaaggagau

SEQ ID NO: 1066436 - RNA, 22 nt, Human
gcagggagguuugcugaccugg

SEQ ID NO: 1066437 - RNA, 22 nt, Human
cauucugagcuaauaugcuuau

SEQ ID NO: 1066438 - RNA, 22 nt, Human
cagcugcagaucauguuuacag

SEQ ID NO: 1066439 - RNA, 22 nt, Human
cugcagaguggagccucggcug

SEQ ID NO: 1066440 - RNA, 19 nt, Human
cuuuucaagccaucaguuu

SEQ ID NO: 1066441 - RNA, 22 nt, Human
ugcauugcauuugucaugaaga

SEQ ID NO: 1066442 - RNA, 22 nt, Human
cagcucaugaccuuuguuaucu

SEQ ID NO: 1066443 - RNA, 22 nt, Human
agcugcugccucacuggucugu

SEQ ID NO: 1066444 - RNA, 21 nt, Human
gacacaaaggguaguaauggu

SEQ ID NO: 1066445 - RNA, 20 nt, Human
uggcuccucuuggcuguggc

SEQ ID NO: 1066446 - RNA, 22 nt, Human
ucuuccagagccuccaucccua

SEQ ID NO: 1066447 - RNA, 22 nt, Human
auauuauucuagcucuugugug

SEQ ID NO: 1066448 - RNA, 21 nt, Human
ugggagagggcucagcuaccc

SEQ ID NO: 1066449 - RNA, 22 nt, Human
cugccuggaaugccagcuucuc

SEQ ID NO: 1066450 - RNA, 22 nt, Human
cugggcuggcgcauccgacacg

SEQ ID NO: 1066451 - RNA, 22 nt, Human
cccugggcagucugcacuucag

SEQ ID NO: 1066452 - RNA, 22 nt, Human
acacuuaacuucugagaauaaa

SEQ ID NO: 1066453 - RNA, 22 nt, Human
caucagcucuucauucuugauu

SEQ ID NO: 1066454 - RNA, 22 nt, Human
ugccuguguccccuucuuggca

SEQ ID NO: 1066455 - RNA, 22 nt, Human
gggaagugagcuggaaucaagg

SEQ ID NO: 1066456 - RNA, 22 nt, Human
cugugcaguaggucagggcugg

SEQ ID NO: 1066457 - RNA, 17 nt, Human
cccagagaugcugccuu

SEQ ID NO: 1066458 - RNA, 22 nt, Human
cucuucagauauacaguacucu

SEQ ID NO: 1066459 - RNA, 22 nt, Human
uugauuuuuuucuacuaugcgc

SEQ ID NO: 1066460 - RNA, 22 nt, Human
caaacauagugaagcaaugaca

SEQ ID NO: 1066461 - RNA, 22 nt, Human
aacuucuggauguuucaaaugu

SEQ ID NO: 1066462 - RNA, 21 nt, Human
uaaauaauaaguugcugagau

SEQ ID NO: 1066463 - RNA, 22 nt, Human
agauguuuuggagacacuaacc

SEQ ID NO: 1066464 - RNA, 22 nt, Human
cagcucagucuugaagcacugg

SEQ ID NO: 1066465 - RNA, 22 nt, Human
aguauauuuguuaagauuauuc

SEQ ID NO: 1066466 - RNA, 22 nt, Human
ugcccacauggugccauggcca

SEQ ID NO: 1066467 - RNA, 22 nt, Human
ccacagggucagccacucugca

SEQ ID NO: 1066468 - RNA, 22 nt, Human
ucccucagagggcaagcgcaga

SEQ ID NO: 1066469 - RNA, 22 nt, Human
uaggccagcccuuaguccuguc

SEQ ID NO: 1066470 - RNA, 22 nt, Human
cuugagagccacuccuggggcc

SEQ ID NO: 1066471 - RNA, 18 nt, Human
ccuggagcuccacagcaa

SEQ ID NO: 1066472 - RNA, 22 nt, Human
ccagcucugcagggccuggggu

SEQ ID NO: 1066473 - RNA, 22 nt, Human
gagccuccuccuggugugccga

SEQ ID NO: 1066474 - RNA, 22 nt, Human
cuagggcacuaggacucaugug

SEQ ID NO: 1066475 - RNA, 22 nt, Human
gagaagggauauggcuucuuga

SEQ ID NO: 1066476 - RNA, 22 nt, Human
gccugcugccacccuggcuccg

SEQ ID NO: 1066477 - RNA, 22 nt, Human
guuccuaagcacugugcauucu

SEQ ID NO: 1066478 - RNA, 19 nt, Human
gcagccaccgcggcggccg

SEQ ID NO: 1066479 - RNA, 20 nt, Human
gcuuccagaggaggccccgu

SEQ ID NO: 1066480 - RNA, 22 nt, Human
agacaggcagaggcugcagagg

SEQ ID NO: 1066481 - RNA, 22 nt, Human
gccagguggcugagcagcugca

SEQ ID NO: 1066482 - RNA, 22 nt, Human
ugggccuggacaaggccacuag

SEQ ID NO: 1066483 - RNA, 22 nt, Human
guugggaagcagauggaugagc

SEQ ID NO: 1066484 - RNA, 22 nt, Human
cacauuuuuacugccaacuuaa

SEQ ID NO: 1066485 - RNA, 22 nt, Human
uccuggagggaggcggugcuac

SEQ ID NO: 1066486 - RNA, 23 nt, Human
uuucacauuaauguuuagcagga

SEQ ID NO: 1066487 - RNA, 22 nt, Human
uaggaagauaaacauuuguaug

SEQ ID NO: 1066488 - RNA, 22 nt, Human
gccugaggaaugcuccugacuu

SEQ ID NO: 1066489 - RNA, 22 nt, Human
cacugggcgccagcugcugagc

SEQ ID NO: 1066490 - RNA, 22 nt, Human
uauuccaaugucaguuauauca

SEQ ID NO: 1066491 - RNA, 22 nt, Human
acugcucucugcaaguagaugg

SEQ ID NO: 1066492 - RNA, 22 nt, Human
caccaggcugaaccagagggga

SEQ ID NO: 1066493 - RNA, 22 nt, Human
cuggcugcuggccugaggaugc

SEQ ID NO: 1066494 - RNA, 22 nt, Human
gcugggcucuuuaccccuguac

SEQ ID NO: 1066495 - RNA, 22 nt, Human
ugguggacaccgcagccaugaa

SEQ ID NO: 1066496 - RNA, 22 nt, Human
ugcaggcugcucaagacuuagu

SEQ ID NO: 1066497 - RNA, 22 nt, Human
uuguaacagcuguuuauauagu

SEQ ID NO: 1066498 - RNA, 22 nt, Human
gcucccacgcaauucuuuucag

SEQ ID NO: 1066499 - RNA, 22 nt, Human
ccugauggagcccugcugcaug

SEQ ID NO: 1066500 - RNA, 22 nt, Human
uccuuggcaugccgucuucucc

SEQ ID NO: 1066501 - RNA, 23 nt, Human
agguuacaguuguuaaguugcaa

SEQ ID NO: 1066502 - RNA, 22 nt, Human
uuuccuuaaaucuguuucuagu

SEQ ID NO: 1066503 - RNA, 21 nt, Human
ucugacuugaucuauucuccc

SEQ ID NO: 1066504 - RNA, 22 nt, Human
auuacagauagacuuugaagcu

SEQ ID NO: 1066505 - RNA, 22 nt, Human
ugcuucugcaacuugaauguac

SEQ ID NO: 1066506 - RNA, 22 nt, Human
gccugccugcugugugcaaguu

SEQ ID NO: 1066507 - RNA, 22 nt, Human
ugauuacauugguaauguuuau

SEQ ID NO: 1066508 - RNA, 22 nt, Human
ggcugcuggcauugagguaggu

SEQ ID NO: 1066509 - RNA, 22 nt, Human
uuggugaacacauacacauuuu

SEQ ID NO: 1066510 - RNA, 17 nt, Human
cucugcagugcauggcu

SEQ ID NO: 1066511 - RNA, 22 nt, Human
uuggaaagcaagcuggacauac

SEQ ID NO: 1066512 - RNA, 22 nt, Human
gcucaaggcaggcagacaugag

SEQ ID NO: 1066513 - RNA, 22 nt, Human
acuuucuaggucucaguccuuu

SEQ ID NO: 1066514 - RNA, 22 nt, Human
ggccucagaggaggugugaguc

SEQ ID NO: 1066515 - RNA, 22 nt, Human
caaggagauaaaauguugagcu

SEQ ID NO: 1066516 - RNA, 18 nt, Human
caaauucucauugauuuc

SEQ ID NO: 1066517 - RNA, 22 nt, Human
uggcuggagcauuccuugucuu

SEQ ID NO: 1066518 - RNA, 22 nt, Human
cugcugagcauuugcagggaca

SEQ ID NO: 1066519 - RNA, 22 nt, Human
aaaugucauauuuaaguaggaa

SEQ ID NO: 1066520 - RNA, 19 nt, Human
aaaucagaaucugcauuuu

SEQ ID NO: 1066521 - RNA, 22 nt, Human
auaggcuuuccugauucucagg

SEQ ID NO: 1066522 - RNA, 22 nt, Human
cuccucccucuuugccacacau

SEQ ID NO: 1066523 - RNA, 22 nt, Human
ucccagauuccugcucuuauau

SEQ ID NO: 1066524 - RNA, 22 nt, Human
agugcuguaacaacuuauuugg

SEQ ID NO: 1066525 - RNA, 22 nt, Human
uuugauuuucagcaauaguggc

SEQ ID NO: 1066526 - RNA, 22 nt, Human
cuuuucuuacucccgcaaggca

SEQ ID NO: 1066527 - RNA, 22 nt, Human
uccagggagauacuggcugcca

SEQ ID NO: 1066528 - RNA, 22 nt, Human
gucaggggccaugggccaagga

SEQ ID NO: 1066529 - RNA, 22 nt, Human
cuuauacacccucuucccaggc

SEQ ID NO: 1066530 - RNA, 17 nt, Human
gagaugcuaaucugauc

SEQ ID NO: 1066531 - RNA, 19 nt, Human
gagcugagaguagcacugg

SEQ ID NO: 1066532 - RNA, 20 nt, Human
cguaaggcaagugcugcauc

SEQ ID NO: 1066533 - RNA, 22 nt, Human
gacagggaggagcagagcuucu

SEQ ID NO: 1066534 - RNA, 22 nt, Human
acugccaggauggcacuagagg

SEQ ID NO: 1066535 - RNA, 22 nt, Human
agucaguuuuaccaaucucagu

SEQ ID NO: 1066536 - RNA, 22 nt, Human
caagcuggaguuccucagagug

SEQ ID NO: 1066537 - RNA, 22 nt, Human
gagugucugaauuagagcacaa

SEQ ID NO: 1066538 - RNA, 22 nt, Human
uuaauaaaguaugaauuggaaa

SEQ ID NO: 1066539 - RNA, 23 nt, Human
ucagucuucccugucaguaauag

SEQ ID NO: 1066540 - RNA, 22 nt, Human
aaggcagcaacuaauggaucuc

SEQ ID NO: 1066541 - RNA, 22 nt, Human
cagguggcaugacugccuacaa

SEQ ID NO: 1066542 - RNA, 22 nt, Human
uuugaaaggugucgagaugugu

SEQ ID NO: 1066543 - RNA, 22 nt, Human
ugggcuagauuuggugacccag

SEQ ID NO: 1066544 - RNA, 22 nt, Human
gcugccugugcgggucgcuagg

SEQ ID NO: 1066545 - RNA, 22 nt, Human
ggagaagaggagcuggaagccu

SEQ ID NO: 1066546 - RNA, 22 nt, Human
cagcccaggucucucuuccagu

SEQ ID NO: 1066547 - RNA, 22 nt, Human
ccuggcagguggagguugcagu

SEQ ID NO: 1066548 - RNA, 22 nt, Human
uggaauggaaacaaacugagga

SEQ ID NO: 1066549 - RNA, 22 nt, Human
ucauuuucacacauaaauagca

SEQ ID NO: 1066550 - RNA, 22 nt, Human
auaacuucagggcugugacaga

SEQ ID NO: 1066551 - RNA, 22 nt, Human
ucuuugauuuuguuacuaagac

SEQ ID NO: 1066552 - RNA, 22 nt, Human
aaggucauuuuuuccucuguug

SEQ ID NO: 1066553 - RNA, 22 nt, Human
uuucauuacguguuugacuugu

SEQ ID NO: 1066554 - RNA, 22 nt, Human
gugcuuaauacaugucaauaac

SEQ ID NO: 1066555 - RNA, 22 nt, Human
gaauaugaacuauuccuagccc

SEQ ID NO: 1066556 - RNA, 22 nt, Human
uuuacuuucucaaguauauagg

SEQ ID NO: 1066557 - RNA, 22 nt, Human
aacuagcuggauuaguguuuuc

SEQ ID NO: 1066558 - RNA, 22 nt, Human
agggcuagaguugagaugggga

SEQ ID NO: 1066559 - RNA, 22 nt, Human
uaagcauaacuaaaaaugauuu

SEQ ID NO: 1066560 - RNA, 22 nt, Human
ccccaugaaguagggucucuga

SEQ ID NO: 1066561 - RNA, 22 nt, Human
uacacaucacuguaucuuucag

SEQ ID NO: 1066562 - RNA, 22 nt, Human
ugaggccugaagccugaaguga

SEQ ID NO: 1066563 - RNA, 22 nt, Human
cuauucaauuuugcuauuguag

SEQ ID NO: 1066564 - RNA, 22 nt, Human
uagagcaguuggcagcuguauu

SEQ ID NO: 1066565 - RNA, 22 nt, Human
gaggccacgguuuuccuugggg

SEQ ID NO: 1066566 - RNA, 22 nt, Human
ccagagucugugugugucaucc

SEQ ID NO: 1066567 - RNA, 22 nt, Human
uuugacaaaauuaugcuaauau

SEQ ID NO: 1066568 - RNA, 22 nt, Human
uuaaagcaguuuguauacaugg

SEQ ID NO: 1066569 - RNA, 22 nt, Human
cccaggaaugagcaggcagggg

SEQ ID NO: 1066570 - RNA, 22 nt, Human
gacacagaccaccaggcccugg

SEQ ID NO: 1066571 - RNA, 22 nt, Human
ggcugccugggagcccuccucu

SEQ ID NO: 1066572 - RNA, 22 nt, Human
agcaccuucacaggcucucagg

SEQ ID NO: 1066573 - RNA, 22 nt, Human
acaguguauauuguuuaucugg

SEQ ID NO: 1066574 - RNA, 22 nt, Human
aggaggaggugggacacaguga

SEQ ID NO: 1066575 - RNA, 22 nt, Human
ucugaggcuaagagacagaggc

SEQ ID NO: 1066576 - RNA, 22 nt, Human
aaugcuuugacuauaucuauaa

SEQ ID NO: 1066577 - RNA, 22 nt, Human
cacugcuuuuuuggcuauguac

SEQ ID NO: 1066578 - RNA, 22 nt, Human
auuccugacugcuagucauuca

SEQ ID NO: 1066579 - RNA, 22 nt, Human
agguaggguuaauggagauaua

SEQ ID NO: 1066580 - RNA, 22 nt, Human
cuauuuggccagaagaggguca

SEQ ID NO: 1066581 - RNA, 22 nt, Human
acagagccaaaaggacauagua

SEQ ID NO: 1066582 - RNA, 22 nt, Human
ucagaagguggagguugcagug

SEQ ID NO: 1066583 - RNA, 22 nt, Human
cagaaacuguuuguuaauauuu

SEQ ID NO: 1066584 - RNA, 22 nt, Human
aauguuuuauagcucaagcaau

SEQ ID NO: 1066585 - RNA, 22 nt, Human
aguggcagcugucaugcccuag

SEQ ID NO: 1066586 - RNA, 22 nt, Human
aagcacaucucaaacuucaucu

SEQ ID NO: 1066587 - RNA, 22 nt, Human
ccaccccaaaugaagaccucuc

SEQ ID NO: 1066588 - RNA, 22 nt, Human
caauuuuuguacuuauaguacu

SEQ ID NO: 1066589 - RNA, 22 nt, Human
agcuuuaccugaaauuugaucc

SEQ ID NO: 1066590 - RNA, 22 nt, Human
cuggucagagcaacugcucaca

SEQ ID NO: 1066591 - RNA, 22 nt, Human
gaacucaacacaguauuuggua

SEQ ID NO: 1066592 - RNA, 22 nt, Human
uccugagauaaaucucauguga

SEQ ID NO: 1066593 - RNA, 22 nt, Human
gcuccugucaucaaacaauccu

SEQ ID NO: 1066594 - RNA, 22 nt, Human
cuguagaacgauccaggcauuu

SEQ ID NO: 1066595 - RNA, 22 nt, Human
gucucccacuuucuggccucuu

SEQ ID NO: 1066596 - RNA, 22 nt, Human
cagcagaagcaacauucaggcu

SEQ ID NO: 1066597 - RNA, 22 nt, Human
ccuuuucuaaucuuaagaaugu

SEQ ID NO: 1066598 - RNA, 22 nt, Human
agaccacagucaggcuccuggu

SEQ ID NO: 1066599 - RNA, 22 nt, Human
ugcuccaggcugcugaagaucu

SEQ ID NO: 1066600 - RNA, 22 nt, Human
guggcaguucugugucucuugu

SEQ ID NO: 1066601 - RNA, 19 nt, Human
uccccagcaccucugaguc

SEQ ID NO: 1066602 - RNA, 22 nt, Human
gugauucauccuggcauucauu

SEQ ID NO: 1066603 - RNA, 22 nt, Human
aaaaacacugggcugggaguca

SEQ ID NO: 1066604 - RNA, 22 nt, Human
aggcagccugguuugaauggaa

SEQ ID NO: 1066605 - RNA, 22 nt, Human
uaugaagaagacaaaugacacu

SEQ ID NO: 1066606 - RNA, 17 nt, Human
ugcauuguaggcuagcc

SEQ ID NO: 1066607 - RNA, 22 nt, Human
gaaggccacggaauggagcugg

SEQ ID NO: 1066608 - RNA, 22 nt, Human
aaagucugagcagaauuucuca

SEQ ID NO: 1066609 - RNA, 22 nt, Human
acaggugguaaaauggacuguc

SEQ ID NO: 1066610 - RNA, 22 nt, Human
ccugggugaaaucucuccugca

SEQ ID NO: 1066611 - RNA, 22 nt, Human
cccacaggcuagggguagggca

SEQ ID NO: 1066612 - RNA, 22 nt, Human
caauaauauccugugcuguuug

SEQ ID NO: 1066613 - RNA, 22 nt, Human
gugcuuucugcaugguuccuac

SEQ ID NO: 1066614 - RNA, 22 nt, Human
cucagggggaaucaggucacag

SEQ ID NO: 1066615 - RNA, 22 nt, Human
uccuggcuuuucuuggcucauc

SEQ ID NO: 1066616 - RNA, 22 nt, Human
ugacacauuaaaugcucacaaa

SEQ ID NO: 1066617 - RNA, 22 nt, Human
aaaugugucaguuucauucucu

SEQ ID NO: 1066618 - RNA, 22 nt, Human
agcuccugauacaugcaggaau

SEQ ID NO: 1066619 - RNA, 22 nt, Human
uguaugaaccuuuaauauagug

SEQ ID NO: 1066620 - RNA, 22 nt, Human
augauguaacauaaagaugucu

SEQ ID NO: 1066621 - RNA, 22 nt, Human
uccagaaacuuuuccagucuca

SEQ ID NO: 1066622 - RNA, 22 nt, Human
uccucuucuguggauucccuga

SEQ ID NO: 1066623 - RNA, 22 nt, Human
acaguuacucauagaagcacuu

SEQ ID NO: 1066624 - RNA, 22 nt, Human
uagaggugacacugagaccaua

SEQ ID NO: 1066625 - RNA, 22 nt, Human
gcucuguccagcgugcacagaa

SEQ ID NO: 1066626 - RNA, 22 nt, Human
agauaaaaugguucaaaggcua

SEQ ID NO: 1066627 - RNA, 22 nt, Human
gggccaguucuccgccucuuuu

SEQ ID NO: 1066628 - RNA, 22 nt, Human
gcucugagagugggugauucug

SEQ ID NO: 1066629 - RNA, 22 nt, Human
aaauacagauucugacucagag

SEQ ID NO: 1066630 - RNA, 22 nt, Human
ucucaguguuaucuaucugccu

SEQ ID NO: 1066631 - RNA, 22 nt, Human
ccaggguggcguagaugcuggg

SEQ ID NO: 1066632 - RNA, 22 nt, Human
ugaggcagcauucuucaagaca

SEQ ID NO: 1066633 - RNA, 22 nt, Human
uaugaauauaccacaauuuagg

SEQ ID NO: 1066634 - RNA, 22 nt, Human
ugggcagauuaaugcaguggcu

SEQ ID NO: 1066635 - RNA, 22 nt, Human
uggggugugagaaguagaggga

SEQ ID NO: 1066636 - RNA, 22 nt, Human
aggccucacucucagagcuucu

SEQ ID NO: 1066637 - RNA, 22 nt, Human
cagggcuggcucaugaaaaguu

SEQ ID NO: 1066638 - RNA, 22 nt, Human
cuucacagccaacaugggcaca

SEQ ID NO: 1066639 - RNA, 22 nt, Human
agggccuggugaccuggguccu

SEQ ID NO: 1066640 - RNA, 22 nt, Human
gguggccuuuuaugagcagggu

SEQ ID NO: 1066641 - RNA, 22 nt, Human
caguagacacauuuguuuuucc

SEQ ID NO: 1066642 - RNA, 22 nt, Human
acugagaguugaaaagggagga

SEQ ID NO: 1066643 - RNA, 22 nt, Human
agaaaucuaagaugcucaagga

SEQ ID NO: 1066644 - RNA, 22 nt, Human
cauugcacucuggcuggaacgg

SEQ ID NO: 1066645 - RNA, 22 nt, Human
gcccucuggcagccuuggcugg

SEQ ID NO: 1066646 - RNA, 22 nt, Human
gaggggaaaacaggaauuaaca

SEQ ID NO: 1066647 - RNA, 22 nt, Human
aagcagcauaauugcuauuuua

SEQ ID NO: 1066648 - RNA, 22 nt, Human
auuccaaagguuaaugcccauu

SEQ ID NO: 1066649 - RNA, 22 nt, Human
auaagagcuagucuuuuccuug

SEQ ID NO: 1066650 - RNA, 22 nt, Human
ggaagagaauuucucucuuuuu

SEQ ID NO: 1066651 - RNA, 22 nt, Human
cacagauuucuggucuucaccc

SEQ ID NO: 1066652 - RNA, 22 nt, Human
agugggguccucaguaugguuc

SEQ ID NO: 1066653 - RNA, 22 nt, Human
aagacagcucaggacagauuca

SEQ ID NO: 1066654 - RNA, 22 nt, Human
aguauuacccucagaacuugau

SEQ ID NO: 1066655 - RNA, 20 nt, Human
auucugcuuugaaaauaagg

SEQ ID NO: 1066656 - RNA, 23 nt, Human
cauguacacacagcuguacagug

SEQ ID NO: 1066657 - RNA, 22 nt, Human
uacagaaacagcgugguuagaa

SEQ ID NO: 1066658 - RNA, 22 nt, Human
ucccuccccacuucugagcuuu

SEQ ID NO: 1066659 - RNA, 22 nt, Human
uggcucagcaagacauugaccu

SEQ ID NO: 1066660 - RNA, 22 nt, Human
agcccuccucacaucagcgucc

SEQ ID NO: 1066661 - RNA, 18 nt, Human
uccagagcuacuguggug

SEQ ID NO: 1066662 - RNA, 22 nt, Human
uuucagugugagugucuuauuu

SEQ ID NO: 1066663 - RNA, 22 nt, Human
uguggggccaaagcccagccac

SEQ ID NO: 1066664 - RNA, 22 nt, Human
aucaguuuauacuuauaaaucu

SEQ ID NO: 1066665 - RNA, 18 nt, Human
agcugcagaccaggaggu

SEQ ID NO: 1066666 - RNA, 22 nt, Human
augcagaaucuugagaaaaauu

SEQ ID NO: 1066667 - RNA, 22 nt, Human
aaucaguauugguauagaauga

SEQ ID NO: 1066668 - RNA, 22 nt, Human
gcaggggcaggagaucucaggc

SEQ ID NO: 1066669 - RNA, 22 nt, Human
gaaaaguacacagcccaaacau

SEQ ID NO: 1066670 - RNA, 22 nt, Human
gaggaacagagacgggaucgcu

SEQ ID NO: 1066671 - RNA, 19 nt, Human
ggcugcugguuacagaggc

SEQ ID NO: 1066672 - RNA, 22 nt, Human
guccugggaaggaagccaggga

SEQ ID NO: 1066673 - RNA, 22 nt, Human
uaaaguaauccuucauaaggag

SEQ ID NO: 1066674 - RNA, 22 nt, Human
uugauacaggccuucuagauga

SEQ ID NO: 1066675 - RNA, 22 nt, Human
aucagcuagauaagucaagcaa

SEQ ID NO: 1066676 - RNA, 22 nt, Human
ugggcucugugccagguuggug

SEQ ID NO: 1066677 - RNA, 22 nt, Human
uuccauauuguacucuuuggag

SEQ ID NO: 1066678 - RNA, 19 nt, Human
cacauacagaaaagaguaa

SEQ ID NO: 1066679 - RNA, 22 nt, Human
cagucauuccuaaccaagaaca

SEQ ID NO: 1066680 - RNA, 22 nt, Human
agugggaccggugcuauuccag

SEQ ID NO: 1066681 - RNA, 22 nt, Human
aggaaauaagggcacuucagau

SEQ ID NO: 1066682 - RNA, 22 nt, Human
uguguuuuacaaauucucuuaa

SEQ ID NO: 1066683 - RNA, 22 nt, Human
aguacauuuauuaaugguaaaa

SEQ ID NO: 1066684 - RNA, 22 nt, Human
auucagcucugaaucagcagac

SEQ ID NO: 1066685 - RNA, 22 nt, Human
ucugcagcuucuugccagagag

SEQ ID NO: 1066686 - RNA, 22 nt, Human
caggaagcaguagaacuuuucc

SEQ ID NO: 1066687 - RNA, 22 nt, Human
ggagauggcucugcaaggucua

SEQ ID NO: 1066688 - RNA, 22 nt, Human
aggccagcaccagagucaagaa

SEQ ID NO: 1066689 - RNA, 22 nt, Human
cagcagagcugggaauaaaauu

SEQ ID NO: 1066690 - RNA, 22 nt, Human
auucaaguacaguuuucuucuu

SEQ ID NO: 1066691 - RNA, 22 nt, Human
uaauuuuacuuccugagcaccu

SEQ ID NO: 1066692 - RNA, 22 nt, Human
uuuuaucugugacaucuggcag

SEQ ID NO: 1066693 - RNA, 23 nt, Human
gcagcuugugguuuaguagaggg

SEQ ID NO: 1066694 - RNA, 22 nt, Human
ccuggagcucacugggagccgg

SEQ ID NO: 1066695 - RNA, 23 nt, Human
uggcccugaaucuguccuggagg

SEQ ID NO: 1066696 - RNA, 22 nt, Human
gcacaggaaucuucauuuuuua

SEQ ID NO: 1066697 - RNA, 22 nt, Human
ccagcuggcccagcugugcucc

SEQ ID NO: 1066698 - RNA, 22 nt, Human
cugagauggccacugggucuca

SEQ ID NO: 1066699 - RNA, 22 nt, Human
cucuccagaucugcugagccag

SEQ ID NO: 1066700 - RNA, 22 nt, Human
aggcccuggcacugccugggag

SEQ ID NO: 1066701 - RNA, 22 nt, Human
gggcagcauuugaaaaacagau

SEQ ID NO: 1066702 - RNA, 22 nt, Human
gcugugcagccaagugccucug

SEQ ID NO: 1066703 - RNA, 22 nt, Human
agaacaauguuaaauuauuaag

SEQ ID NO: 1066704 - RNA, 19 nt, Human
ucugaggguccagaugcau

SEQ ID NO: 1066705 - RNA, 22 nt, Human
uuuguugacaucccuguacuuu

SEQ ID NO: 1066706 - RNA, 22 nt, Human
auuuuugagcugugaacauagc

SEQ ID NO: 1066707 - RNA, 22 nt, Human
cacauuccuggugcucagcagc

SEQ ID NO: 1066708 - RNA, 22 nt, Human
cccaguggcuuuugcccagguu

SEQ ID NO: 1066709 - RNA, 22 nt, Human
gaagagcuauguccagggagca

SEQ ID NO: 1066710 - RNA, 22 nt, Human
uacagaaggaaguuuagcuaaa

SEQ ID NO: 1066711 - RNA, 22 nt, Human
auguuauuaaaguacagauucu

SEQ ID NO: 1066712 - RNA, 22 nt, Human
ugucccagucaaggcugucauc

SEQ ID NO: 1066713 - RNA, 22 nt, Human
ucauccuuuugcaugggaaggc

SEQ ID NO: 1066714 - RNA, 22 nt, Human
ggagccugggcauuaguaauuu

SEQ ID NO: 1066715 - RNA, 22 nt, Human
cuaauaauagagguggcauuug

SEQ ID NO: 1066716 - RNA, 22 nt, Human
ggcucuggcggcucuuucaaua

SEQ ID NO: 1066717 - RNA, 18 nt, Human
uggacaggguggagaaaa

SEQ ID NO: 1066718 - RNA, 20 nt, Human
cauuaugguugggcacagug

SEQ ID NO: 1066719 - RNA, 22 nt, Human
ccuggcuguggcggugcucuca

SEQ ID NO: 1066720 - RNA, 22 nt, Human
augcaaaugcuagagaauguug

SEQ ID NO: 1066721 - RNA, 22 nt, Human
ucagcacuuuuacucucuuugc

SEQ ID NO: 1066722 - RNA, 22 nt, Human
cuggccucaccucagacuuacu

SEQ ID NO: 1066723 - RNA, 22 nt, Human
uuaaaggcgauaaggcaguguu

SEQ ID NO: 1066724 - RNA, 22 nt, Human
aggaauggugcucagcagaaau

SEQ ID NO: 1066725 - RNA, 22 nt, Human
caucuucacauauuuccaauga

SEQ ID NO: 1066726 - RNA, 22 nt, Human
uguagaaauuaguaagaucaac

SEQ ID NO: 1066727 - RNA, 22 nt, Human
guuuccagcucuuagcaaaggc

SEQ ID NO: 1066728 - RNA, 22 nt, Human
cugcugagaaaagacugaggga

SEQ ID NO: 1066729 - RNA, 22 nt, Human
cccagccugugacagccguccu

SEQ ID NO: 1066730 - RNA, 23 nt, Human
gccugcuggucaccuaaucugcc

SEQ ID NO: 1066731 - RNA, 22 nt, Human
aagaauauuuccugcacuuggg

SEQ ID NO: 1066732 - RNA, 22 nt, Human
cugggccagggaggugucugua

SEQ ID NO: 1066733 - RNA, 22 nt, Human
gccugggaagacuaagugggag

SEQ ID NO: 1066734 - RNA, 22 nt, Human
ugccuuaauuucccuguuuugu

SEQ ID NO: 1066735 - RNA, 22 nt, Human
cagggacagcacuaaacucuug

SEQ ID NO: 1066736 - RNA, 22 nt, Human
caggcagcugcuggguucagcc

SEQ ID NO: 1066737 - RNA, 22 nt, Human
ugcaggccucacaccuggcacc

SEQ ID NO: 1066738 - RNA, 22 nt, Human
cacaucccuggaguuacccagu

SEQ ID NO: 1066739 - RNA, 22 nt, Human
ggaaacaugccugcuggacagu

SEQ ID NO: 1066740 - RNA, 22 nt, Human
gccugggugaauuugauccuaa

SEQ ID NO: 1066741 - RNA, 22 nt, Human
ucuggggauggucuacuuucug

SEQ ID NO: 1066742 - RNA, 21 nt, Human
ucaucuggucuggggccugcu

SEQ ID NO: 1066743 - RNA, 22 nt, Human
ucaggaagcauccugagguguc

SEQ ID NO: 1066744 - RNA, 22 nt, Human
gagcagagaauccagcuaagug

SEQ ID NO: 1066745 - RNA, 22 nt, Human
aagcugcagaugugccugugga

SEQ ID NO: 1066746 - RNA, 22 nt, Human
aguaaacacugucuuuauauau

SEQ ID NO: 1066747 - RNA, 22 nt, Human
uugggggcauauugaguagugg

SEQ ID NO: 1066748 - RNA, 22 nt, Human
uuuuccacuuuagugcaauaac

SEQ ID NO: 1066749 - RNA, 22 nt, Human
auuuaagggauuuggagaccaa

SEQ ID NO: 1066750 - RNA, 22 nt, Human
cuaacuuuagcuuagauuauca

SEQ ID NO: 1066751 - RNA, 22 nt, Human
aaguccaguuuuuccagguggu

SEQ ID NO: 1066752 - RNA, 22 nt, Human
gccuucugauaucucuuggcau

SEQ ID NO: 1066753 - RNA, 22 nt, Human
cuccaaauacagucaucuuggg

SEQ ID NO: 1066754 - RNA, 22 nt, Human
ucucccagaaguccucaguaca

SEQ ID NO: 1066755 - RNA, 22 nt, Human
ucuucauuuuauagcaucugug

SEQ ID NO: 1066756 - RNA, 22 nt, Human
gaggccugguuuccagcauccu

SEQ ID NO: 1066757 - RNA, 22 nt, Human
ucauuuacacuucacaaaugga

SEQ ID NO: 1066758 - RNA, 22 nt, Human
aaauucuuucauggcuaauaag

SEQ ID NO: 1066759 - RNA, 23 nt, Human
aggagccaggaaccagcuucccc

SEQ ID NO: 1066760 - RNA, 22 nt, Human
agaaauguuguggguuuuguua

SEQ ID NO: 1066761 - RNA, 22 nt, Human
uccuucaguuaucacaguacug

SEQ ID NO: 1066762 - RNA, 22 nt, Human
gugguggucaccaaauugaggg

SEQ ID NO: 1066763 - RNA, 22 nt, Human
acacuaaaugagucuacaguac

SEQ ID NO: 1066764 - RNA, 22 nt, Human
gccagcucccaagugagccccu

SEQ ID NO: 1066765 - RNA, 22 nt, Human
gcuggucccaauguguuuccuu

SEQ ID NO: 1066766 - RNA, 22 nt, Human
ucuggcagcaagauaacaaugg

SEQ ID NO: 1066767 - RNA, 22 nt, Human
ugggagcaggugugcuagggaa

SEQ ID NO: 1066768 - RNA, 21 nt, Human
uccuugcuauuuuccucagcu

SEQ ID NO: 1066769 - RNA, 22 nt, Human
gcagauggugccaugucuugug

SEQ ID NO: 1066770 - RNA, 22 nt, Human
gcaggcucuucuuucugcccag

SEQ ID NO: 1066771 - RNA, 22 nt, Human
accaggaggccuggagcacaaa

SEQ ID NO: 1066772 - RNA, 22 nt, Human
aguguacaagaccuuauuguug

SEQ ID NO: 1066773 - RNA, 19 nt, Human
uaacaaagucugaagucag

SEQ ID NO: 1066774 - RNA, 23 nt, Human
uggaagcagaaguuucaauaucc

SEQ ID NO: 1066775 - RNA, 22 nt, Human
agccagcaggugagugcagccu

SEQ ID NO: 1066776 - RNA, 22 nt, Human
acucuucaucccuuuaucagga

SEQ ID NO: 1066777 - RNA, 18 nt, Human
aaacagugccuaaguguc

SEQ ID NO: 1066778 - RNA, 22 nt, Human
cacacaggagagugcuggaggu

SEQ ID NO: 1066779 - RNA, 22 nt, Human
aauauaugaccaggaaguucug

SEQ ID NO: 1066780 - RNA, 22 nt, Human
auuuacuggaaaaacuaugagc

SEQ ID NO: 1066781 - RNA, 22 nt, Human
gucuucuguucugugaggcuuc

SEQ ID NO: 1066782 - RNA, 19 nt, Human
guaagggcuaauggacuau

SEQ ID NO: 1066783 - RNA, 22 nt, Human
aggaaacaguugguaaugcaua

SEQ ID NO: 1066784 - RNA, 22 nt, Human
ucaguguuggcauucagaaaug

SEQ ID NO: 1066785 - RNA, 22 nt, Human
uuggaacauccaggacagauau

SEQ ID NO: 1066786 - RNA, 22 nt, Human
ucuucaugccaaaugaguuuug

SEQ ID NO: 1066787 - RNA, 22 nt, Human
ucaugcccagagcaguaaauua

SEQ ID NO: 1066788 - RNA, 22 nt, Human
cagagcugauuggauccagaga

SEQ ID NO: 1066789 - RNA, 19 nt, Human
uguguguuuauauauguau

SEQ ID NO: 1066790 - RNA, 22 nt, Human
aguggcugagugacugugacuc

SEQ ID NO: 1066791 - RNA, 22 nt, Human
uuuucuauuaacucauuuugca

SEQ ID NO: 1066792 - RNA, 21 nt, Human
aagccagcccacagugguuug

SEQ ID NO: 1066793 - RNA, 22 nt, Human
ugagaaagacagacauuccuaa

SEQ ID NO: 1066794 - RNA, 22 nt, Human
cagggucuuauaaggccaauuu

SEQ ID NO: 1066795 - RNA, 22 nt, Human
cugccucugguuuuggucccug

SEQ ID NO: 1066796 - RNA, 22 nt, Human
auuugucuuugagugcccugcu

SEQ ID NO: 1066797 - RNA, 22 nt, Human
acaagaauuauuucuaguuaac

SEQ ID NO: 1066798 - RNA, 22 nt, Human
agacacagaaguugcuguuggg

SEQ ID NO: 1066799 - RNA, 23 nt, Human
cuuauucauucauguagcccauu

SEQ ID NO: 1066800 - RNA, 19 nt, Human
ucaggacugacuugaaguc

SEQ ID NO: 1066801 - RNA, 22 nt, Human
gaacagcagucacucauguuau

SEQ ID NO: 1066802 - RNA, 22 nt, Human
uuucuggaaagcaagauacauu

SEQ ID NO: 1066803 - RNA, 22 nt, Human
gggaagagugucgguugaagug

SEQ ID NO: 1066804 - RNA, 22 nt, Human
gauauuuuugcagacaccuggg

SEQ ID NO: 1066805 - RNA, 22 nt, Human
auacauaauuacuuccgauguu

SEQ ID NO: 1066806 - RNA, 22 nt, Human
uuggaccaauuccugauauuuu

SEQ ID NO: 1066807 - RNA, 22 nt, Human
aguccauaggcaguucauaaca

SEQ ID NO: 1066808 - RNA, 22 nt, Human
acccagagccagggucaggagc

SEQ ID NO: 1066809 - RNA, 22 nt, Human
augggaguuuucucugaugcuc

SEQ ID NO: 1066810 - RNA, 17 nt, Human
gccuggcccagccuggc

SEQ ID NO: 1066811 - RNA, 22 nt, Human
aggcaaaauuacaaaguuauua

SEQ ID NO: 1066812 - RNA, 22 nt, Human
acaugaaaaauguuugcaguuu

SEQ ID NO: 1066813 - RNA, 20 nt, Human
aguuuauuccaggagaacug

SEQ ID NO: 1066814 - RNA, 22 nt, Human
caggaaaugaacaggaaugaac

SEQ ID NO: 1066815 - RNA, 22 nt, Human
auacuaaaguauagaacuuagu

SEQ ID NO: 1066816 - RNA, 22 nt, Human
uucaugugaucacagauuguaa

SEQ ID NO: 1066817 - RNA, 22 nt, Human
aagcaauaagccagauuuggau

SEQ ID NO: 1066818 - RNA, 22 nt, Human
caacagcucagacacgggaccu

SEQ ID NO: 1066819 - RNA, 22 nt, Human
guuuacauguuuuucucuuaca

SEQ ID NO: 1066820 - RNA, 22 nt, Human
ccagguggugaaagugggcccu

SEQ ID NO: 1066821 - RNA, 22 nt, Human
uaagaacagugucugucucaca

SEQ ID NO: 1066822 - RNA, 22 nt, Human
cacugaagcuuucauucucuug

SEQ ID NO: 1066823 - RNA, 22 nt, Human
cacaugaugguggaagccauag

SEQ ID NO: 1066824 - RNA, 21 nt, Human
gcugugcacauaguagaagug

SEQ ID NO: 1066825 - RNA, 22 nt, Human
uugcuuccucgaggccagcgug

SEQ ID NO: 1066826 - RNA, 22 nt, Human
agaucauauuguaacuuuauug

SEQ ID NO: 1066827 - RNA, 22 nt, Human
uacauauuguccauaguugcuu

SEQ ID NO: 1066828 - RNA, 20 nt, Human
ugaugguucuuuccggguug

SEQ ID NO: 1066829 - RNA, 22 nt, Human
cauguguaugcauucauacaua

SEQ ID NO: 1066830 - RNA, 22 nt, Human
gggcuggaguugggaagacaaa

SEQ ID NO: 1066831 - RNA, 22 nt, Human
auaugaagaaucuaggauaggc

SEQ ID NO: 1066832 - RNA, 22 nt, Human
acuuuacaaacuccucacuguu

SEQ ID NO: 1066833 - RNA, 22 nt, Human
uuucacaucccgcgcgcccuua

SEQ ID NO: 1066834 - RNA, 22 nt, Human
gaaguggaagccaucggcaguc

SEQ ID NO: 1066835 - RNA, 22 nt, Human
ccauuucacccacugcuuuagg

SEQ ID NO: 1066836 - RNA, 22 nt, Human
gaacaucaaggucugugucuag

SEQ ID NO: 1066837 - RNA, 22 nt, Human
cuucugcaggagucaacucugg

SEQ ID NO: 1066838 - RNA, 22 nt, Human
ccuauugacaauucucuucucc

SEQ ID NO: 1066839 - RNA, 22 nt, Human
gccuggguuccaugaucuccag

SEQ ID NO: 1066840 - RNA, 22 nt, Human
uccuuggaguaguuguucuuua

SEQ ID NO: 1066841 - RNA, 22 nt, Human
agggcuguuuuuggcaccuggg

SEQ ID NO: 1066842 - RNA, 22 nt, Human
gauuucuucauuuguggugaau

SEQ ID NO: 1066843 - RNA, 22 nt, Human
ggcagggcagcgcugauuaggg

SEQ ID NO: 1066844 - RNA, 22 nt, Human
uuuuguguagagauggggucuu

SEQ ID NO: 1066845 - RNA, 19 nt, Human
ugagacagggauucaggug

SEQ ID NO: 1066846 - RNA, 22 nt, Human
acagccugagaguggagcuggc

SEQ ID NO: 1066847 - RNA, 22 nt, Human
uaagcagaugcugucugcacaa

SEQ ID NO: 1066848 - RNA, 22 nt, Human
cagcagagacgguaagcagaac

SEQ ID NO: 1066849 - RNA, 22 nt, Human
gcucuugauguucauugacuug

SEQ ID NO: 1066850 - RNA, 22 nt, Human
uuacaaacugucauauaguauu

SEQ ID NO: 1066851 - RNA, 22 nt, Human
ucauucccuccagcuguggcua

SEQ ID NO: 1066852 - RNA, 22 nt, Human
aggcugagcggggucccagagc

SEQ ID NO: 1066853 - RNA, 22 nt, Human
gcagcugcagguggucccaugc

SEQ ID NO: 1066854 - RNA, 22 nt, Human
ugcguugcgcuccugcagcagg

SEQ ID NO: 1066855 - RNA, 22 nt, Human
augggcugacuaaugguaaacu

SEQ ID NO: 1066856 - RNA, 22 nt, Human
cugugaggcccugggugcugga

SEQ ID NO: 1066857 - RNA, 22 nt, Human
agugaaauacugucguuuuuag

SEQ ID NO: 1066858 - RNA, 22 nt, Human
acuugccuguuacauuucuagu

SEQ ID NO: 1066859 - RNA, 20 nt, Human
ugggagcuggugaggucuca

SEQ ID NO: 1066860 - RNA, 22 nt, Human
guucuucucuuguaauggaauc

SEQ ID NO: 1066861 - RNA, 22 nt, Human
uuaauagauuugauuuuaaagg

SEQ ID NO: 1066862 - RNA, 22 nt, Human
gccauuaaugugaaggaaggaa

SEQ ID NO: 1066863 - RNA, 22 nt, Human
ugguccugccccgugcacagag

SEQ ID NO: 1066864 - RNA, 22 nt, Human
gcuuuucuauaagaacuuucaa

SEQ ID NO: 1066865 - RNA, 22 nt, Human
ccaggccucuggcugcuuaguc

SEQ ID NO: 1066866 - RNA, 22 nt, Human
uggccacagccucugccaguuc

SEQ ID NO: 1066867 - RNA, 22 nt, Human
uggcucugagacacaggcucuc

SEQ ID NO: 1066868 - RNA, 22 nt, Human
uugcucugaaccacaccaucac

SEQ ID NO: 1066869 - RNA, 22 nt, Human
ggcagugagcuggagggaagga

SEQ ID NO: 1066870 - RNA, 22 nt, Human
uaucuugagagacaacacagca

SEQ ID NO: 1066871 - RNA, 22 nt, Human
uucuuuucggccugugagaagg

SEQ ID NO: 1066872 - RNA, 22 nt, Human
ugaggaggucagagucuggcug

SEQ ID NO: 1066873 - RNA, 22 nt, Human
cagagcuguuacuauucaugaa

SEQ ID NO: 1066874 - RNA, 22 nt, Human
aagggcuguaagccaaguaaag

SEQ ID NO: 1066875 - RNA, 22 nt, Human
cugugacaguuucucagaauuu

SEQ ID NO: 1066876 - RNA, 22 nt, Human
cugaaggagaaggccacuguuc

SEQ ID NO: 1066877 - RNA, 22 nt, Human
ccuggagcacauggcaggaggc

SEQ ID NO: 1066878 - RNA, 22 nt, Human
ucuaggagcaugaagggaaggc

SEQ ID NO: 1066879 - RNA, 22 nt, Human
uuaaagcacuaaaugaugaggg

SEQ ID NO: 1066880 - RNA, 22 nt, Human
ugcuggcuguauaugugagagu

SEQ ID NO: 1066881 - RNA, 22 nt, Human
gccagccuucuguggccugcaa

SEQ ID NO: 1066882 - RNA, 22 nt, Human
ucacacacauaaucuaagauua

SEQ ID NO: 1066883 - RNA, 22 nt, Human
uuuacaaguuuacagaaugaug

SEQ ID NO: 1066884 - RNA, 22 nt, Human
uguaugaagacuucuucugugu

SEQ ID NO: 1066885 - RNA, 22 nt, Human
ugaacacagggccaaacuugag

SEQ ID NO: 1066886 - RNA, 22 nt, Human
auauuuggaaagaaaaucauug

SEQ ID NO: 1066887 - RNA, 22 nt, Human
gaaggcacugaacuccuucugg

SEQ ID NO: 1066888 - RNA, 22 nt, Human
uuuccaugaucguuauagaacu

SEQ ID NO: 1066889 - RNA, 23 nt, Human
augcaguauaugucaguaguuua

SEQ ID NO: 1066890 - RNA, 22 nt, Human
uucugagaggcagagcuuguga

SEQ ID NO: 1066891 - RNA, 22 nt, Human
ucacaggagggagagacaccca

SEQ ID NO: 1066892 - RNA, 22 nt, Human
cccugcagccggccagcucauu

SEQ ID NO: 1066893 - RNA, 22 nt, Human
agcccugggaggccagcuugua

SEQ ID NO: 1066894 - RNA, 22 nt, Human
uuuacagucaccaaacuuugcu

SEQ ID NO: 1066895 - RNA, 22 nt, Human
ucagagcagacuuugaaggagg

SEQ ID NO: 1066896 - RNA, 22 nt, Human
ugggagcaccuugagggcagaa

SEQ ID NO: 1066897 - RNA, 22 nt, Human
caggaccccauauucacugaac

SEQ ID NO: 1066898 - RNA, 21 nt, Human
ugaaagaaggugcagucugaa

SEQ ID NO: 1066899 - RNA, 22 nt, Human
uuucaagucaguagcuaaucau

SEQ ID NO: 1066900 - RNA, 22 nt, Human
gauuuucugagccuucaaauuu

SEQ ID NO: 1066901 - RNA, 21 nt, Human
ugggccugucccucuuggagg

SEQ ID NO: 1066902 - RNA, 22 nt, Human
aaacaucauaggcaugcaugau

SEQ ID NO: 1066903 - RNA, 18 nt, Human
ggcugccuguuccugaag

SEQ ID NO: 1066904 - RNA, 22 nt, Human
aaggccaacuaggaugagcuag

SEQ ID NO: 1066905 - RNA, 22 nt, Human
cccaggaaagaaaguauauggu

SEQ ID NO: 1066906 - RNA, 22 nt, Human
aaggcucuuggagugaaugcag

SEQ ID NO: 1066907 - RNA, 22 nt, Human
ggaggccaaggcagguggauca

SEQ ID NO: 1066908 - RNA, 22 nt, Human
acagaaggcggggacaaggcgg

SEQ ID NO: 1066909 - RNA, 22 nt, Human
uugugcucuguguuauuuaagg

SEQ ID NO: 1066910 - RNA, 22 nt, Human
agaagccaacagggcaggagag

SEQ ID NO: 1066911 - RNA, 21 nt, Human
acuguucauuugaugaacugg

SEQ ID NO: 1066912 - RNA, 22 nt, Human
guuucuaauuggaacuuugagg

SEQ ID NO: 1066913 - RNA, 22 nt, Human
ugcucagcacagaccaggccag

SEQ ID NO: 1066914 - RNA, 22 nt, Human
aguugcacuuucuagauacugu

SEQ ID NO: 1066915 - RNA, 22 nt, Human
uacagugacccuauuuccaaau

SEQ ID NO: 1066916 - RNA, 22 nt, Human
ggcccacuugaaauggagcuca

SEQ ID NO: 1066917 - RNA, 22 nt, Human
gaggggaaaguucugcacaagg

SEQ ID NO: 1066918 - RNA, 22 nt, Human
aagcccagcugaaagcauuuuu

SEQ ID NO: 1066919 - RNA, 22 nt, Human
uaauuauaacaguuacaucuua

SEQ ID NO: 1066920 - RNA, 22 nt, Human
gugugagggacagagaaagggg

SEQ ID NO: 1066921 - RNA, 22 nt, Human
uuuggaauauuaaaaugucuca

SEQ ID NO: 1066922 - RNA, 22 nt, Human
cagcuggacuuuugauagaagu

SEQ ID NO: 1066923 - RNA, 22 nt, Human
ccagaggaggggggucuuucug

SEQ ID NO: 1066924 - RNA, 22 nt, Human
agacagcaugauacaugaugcu

SEQ ID NO: 1066925 - RNA, 22 nt, Human
ugcacacacacguagagaaaag

SEQ ID NO: 1066926 - RNA, 22 nt, Human
guguucaaaauguagguagauu

SEQ ID NO: 1066927 - RNA, 22 nt, Human
aauguucugauguaggguuuag

SEQ ID NO: 1066928 - RNA, 22 nt, Human
gccacucaugggaggugugcaa

SEQ ID NO: 1066929 - RNA, 22 nt, Human
cauuuaauccucacaagccuau

SEQ ID NO: 1066930 - RNA, 22 nt, Human
gcagggcaguaagagcuagagu

SEQ ID NO: 1066931 - RNA, 22 nt, Human
guuugcaaauuguguuaaagcu

SEQ ID NO: 1066932 - RNA, 22 nt, Human
gaggucaucuguuuugguuacu

SEQ ID NO: 1066933 - RNA, 22 nt, Human
auuuucucacaaugcagaagga

SEQ ID NO: 1066934 - RNA, 22 nt, Human
uggccaggaggcugcuucugac

SEQ ID NO: 1066935 - RNA, 22 nt, Human
aaugaaugugauuaacuucaag

SEQ ID NO: 1066936 - RNA, 22 nt, Human
gaggggcuugaggcccugaugg

SEQ ID NO: 1066937 - RNA, 22 nt, Human
gaauuuaagaggaugaaucugu

SEQ ID NO: 1066938 - RNA, 22 nt, Human
aagugagauuauauguacggga

SEQ ID NO: 1066939 - RNA, 22 nt, Human
cacauuuaugggcugggaggca

SEQ ID NO: 1066940 - RNA, 22 nt, Human
agcugucuuucugccuccugau

SEQ ID NO: 1066941 - RNA, 22 nt, Human
gcucccagaaccaaggcugggg

SEQ ID NO: 1066942 - RNA, 21 nt, Human
uggcugagccaggugugugga

SEQ ID NO: 1066943 - RNA, 22 nt, Human
aagguggugaucaucuugaagg

SEQ ID NO: 1066944 - RNA, 22 nt, Human
ucucagagcaucauuuucuuag

SEQ ID NO: 1066945 - RNA, 22 nt, Human
aguccagguggaccuuggccag

SEQ ID NO: 1066946 - RNA, 22 nt, Human
cacagcagagggagccauugaa

SEQ ID NO: 1066947 - RNA, 22 nt, Human
uucucuuuucaccaguugcuaa

SEQ ID NO: 1066948 - RNA, 22 nt, Human
auacuguuucucuucuacauga

SEQ ID NO: 1066949 - RNA, 22 nt, Human
ggccaugguuggggaagacaug

SEQ ID NO: 1066950 - RNA, 22 nt, Human
uggcucagucauggaugaguaa

SEQ ID NO: 1066951 - RNA, 22 nt, Human
uguuuuaugagccauauaaccu

SEQ ID NO: 1066952 - RNA, 22 nt, Human
gggagccaaggagagaggccuu

SEQ ID NO: 1066953 - RNA, 22 nt, Human
uggcagcaauagaaauauaauc

SEQ ID NO: 1066954 - RNA, 22 nt, Human
gagauauuuauucauacuguca

SEQ ID NO: 1066955 - RNA, 22 nt, Human
acucaggagggaucagcuauca

SEQ ID NO: 1066956 - RNA, 22 nt, Human
cuccucuggguccugguggcca

SEQ ID NO: 1066957 - RNA, 22 nt, Human
ugaaaucuuagccauucugccu

SEQ ID NO: 1066958 - RNA, 22 nt, Human
uucagaaaugaauauugguauu

SEQ ID NO: 1066959 - RNA, 22 nt, Human
gaaggaagucauuagugcagac

SEQ ID NO: 1066960 - RNA, 23 nt, Human
aaaaucauuaauuuacccugaaa

SEQ ID NO: 1066961 - RNA, 22 nt, Human
aaugccuuauaggcugaaaauu

SEQ ID NO: 1066962 - RNA, 20 nt, Human
cuucaaguuaugguuggcaa

SEQ ID NO: 1066963 - RNA, 22 nt, Human
cugggccaguuaugucucaucu

SEQ ID NO: 1066964 - RNA, 22 nt, Human
caggagagauaugaguccccac

SEQ ID NO: 1066965 - RNA, 22 nt, Human
uccugagagcagcugcuuugga

SEQ ID NO: 1066966 - RNA, 22 nt, Human
caaaugaugcauggcuagugag

SEQ ID NO: 1066967 - RNA, 23 nt, Human
cagggccaggcagcagcugucac

SEQ ID NO: 1066968 - RNA, 22 nt, Human
cggggcuguagcacagcugagc

SEQ ID NO: 1066969 - RNA, 22 nt, Human
ugacauuuaucuucuacaauga

SEQ ID NO: 1066970 - RNA, 22 nt, Human
cgucccaguuccagccgcgcug

SEQ ID NO: 1066971 - RNA, 20 nt, Human
uuggucagugguucaguuug

SEQ ID NO: 1066972 - RNA, 22 nt, Human
ccucauucucgcguguguuucu

SEQ ID NO: 1066973 - RNA, 22 nt, Human
aaagaaucacauccuucagcaa

SEQ ID NO: 1066974 - RNA, 22 nt, Human
uacauucugguggagaaaguaa

SEQ ID NO: 1066975 - RNA, 19 nt, Human
gggaaauucacuugcuucc

SEQ ID NO: 1066976 - RNA, 22 nt, Human
gaugagggccugguggcugugc

SEQ ID NO: 1066977 - RNA, 23 nt, Human
ggccuccuggucuaggcuagacu

SEQ ID NO: 1066978 - RNA, 22 nt, Human
aggcuucccagcugagcucagc

SEQ ID NO: 1066979 - RNA, 22 nt, Human
uccuucagcuacucaguuucca

SEQ ID NO: 1066980 - RNA, 22 nt, Human
cugguggaggugccaggauuug

SEQ ID NO: 1066981 - RNA, 22 nt, Human
aggguaggguaaaugaugcauc

SEQ ID NO: 1066982 - RNA, 22 nt, Human
uucugccuuacgauauuuucaa

SEQ ID NO: 1066983 - RNA, 23 nt, Human
uaaauuaccuuuccagugcaggg

SEQ ID NO: 1066984 - RNA, 22 nt, Human
augucccagcugagagacaacu

SEQ ID NO: 1066985 - RNA, 22 nt, Human
cuggcucaguucuugguuuuca

SEQ ID NO: 1066986 - RNA, 22 nt, Human
ccugagcuggaagagcuugugc

SEQ ID NO: 1066987 - RNA, 22 nt, Human
aucuuuagucaggcguggguau

SEQ ID NO: 1066988 - RNA, 22 nt, Human
gagggugggcuccuaucugggu

SEQ ID NO: 1066989 - RNA, 22 nt, Human
gauuucaaggaguuuucacagu

SEQ ID NO: 1066990 - RNA, 22 nt, Human
ccaggccuggccaggggaugcc

SEQ ID NO: 1066991 - RNA, 21 nt, Human
aguuuucugaguuauaaaaua

SEQ ID NO: 1066992 - RNA, 22 nt, Human
cuggucugagggcucuugaggc

SEQ ID NO: 1066993 - RNA, 22 nt, Human
aggaaagcaauggcugagaaca

SEQ ID NO: 1066994 - RNA, 20 nt, Human
uucauucauuccacaacuuc

SEQ ID NO: 1066995 - RNA, 20 nt, Human
uguaaacaauaguguucuug

SEQ ID NO: 1066996 - RNA, 22 nt, Human
ugucaguagauuauuacaauaa

SEQ ID NO: 1066997 - RNA, 22 nt, Human
caggcuuuuucugcuguccucu

SEQ ID NO: 1066998 - RNA, 22 nt, Human
gagcuguccuaccaggaguccu

SEQ ID NO: 1066999 - RNA, 22 nt, Human
ucugccuggccuggagggcaca

SEQ ID NO: 1067000 - RNA, 22 nt, Human
ucagaaaagguagcugugacaa

SEQ ID NO: 1067001 - RNA, 22 nt, Human
cuuggccucuucucaggguggg

SEQ ID NO: 1067002 - RNA, 22 nt, Human
uguuaccauaggucagaacguu

SEQ ID NO: 1067003 - RNA, 19 nt, Human
ccuggcccugcugcgcggg

SEQ ID NO: 1067004 - RNA, 22 nt, Human
guuucaaaagucaggcuauucu

SEQ ID NO: 1067005 - RNA, 22 nt, Human
auuuacugcuugacacauuggu

SEQ ID NO: 1067006 - RNA, 22 nt, Human
ucaccaggauugggcuguaggc

SEQ ID NO: 1067007 - RNA, 22 nt, Human
uccaggcccacucgguggggcu

SEQ ID NO: 1067008 - RNA, 22 nt, Human
ggaacacagaagggcugaaaaa

SEQ ID NO: 1067009 - RNA, 17 nt, Human
aggagucucagaugagc

SEQ ID NO: 1067010 - RNA, 22 nt, Human
ugcccugugccagacuuccugg

SEQ ID NO: 1067011 - RNA, 22 nt, Human
gguggggucacgacagagggaa

SEQ ID NO: 1067012 - RNA, 22 nt, Human
ggagaccagaaggaagcuucga

SEQ ID NO: 1067013 - RNA, 22 nt, Human
gaaagacucuugaugucuuugg

SEQ ID NO: 1067014 - RNA, 19 nt, Human
aucuacaauuauucucagu

SEQ ID NO: 1067015 - RNA, 22 nt, Human
aacagcagggggaccugcuggu

SEQ ID NO: 1067016 - RNA, 20 nt, Human
aggcucagauacccagggaa

SEQ ID NO: 1067017 - RNA, 22 nt, Human
auacaguaaccacauucuauag

SEQ ID NO: 1067018 - RNA, 19 nt, Human
cuucaguguucaccuggcc

SEQ ID NO: 1067019 - RNA, 22 nt, Human
gguacacauugugacuguauua

SEQ ID NO: 1067020 - RNA, 20 nt, Human
acugccuugguucaguaggu

SEQ ID NO: 1067021 - RNA, 22 nt, Human
gggaggaaagagaaguggucca

SEQ ID NO: 1067022 - RNA, 22 nt, Human
aggauuugcacugguguuugag

SEQ ID NO: 1067023 - RNA, 22 nt, Human
cugagcaggauauucacagcag

SEQ ID NO: 1067024 - RNA, 22 nt, Human
caguugcuggaugugcagcucu

SEQ ID NO: 1067025 - RNA, 22 nt, Human
uguuuuguuuaugagagcacag

SEQ ID NO: 1067026 - RNA, 22 nt, Human
ccuggccuggcacucccucugc

SEQ ID NO: 1067027 - RNA, 20 nt, Human
ugggcugaggaucaggugcc

SEQ ID NO: 1067028 - RNA, 22 nt, Human
ugagggcugcuuccagagcuag

SEQ ID NO: 1067029 - RNA, 22 nt, Human
gaaggagagggucaaggauaau

SEQ ID NO: 1067030 - RNA, 22 nt, Human
gcccugccugucugcugggagg

SEQ ID NO: 1067031 - RNA, 22 nt, Human
ccaggacucaguggggaaaggg

SEQ ID NO: 1067032 - RNA, 22 nt, Human
uuugggaacucuaucauggaaa

SEQ ID NO: 1067033 - RNA, 22 nt, Human
uggcucucaggccugcugcguu

SEQ ID NO: 1067034 - RNA, 22 nt, Human
aggcugaugcuggcugaggcug

SEQ ID NO: 1067035 - RNA, 21 nt, Human
uuuugcuguuuuagaaugaga

SEQ ID NO: 1067036 - RNA, 22 nt, Human
uuggaagaccagaggccuuguc

SEQ ID NO: 1067037 - RNA, 22 nt, Human
gccuggugaaaggcagagagcg

SEQ ID NO: 1067038 - RNA, 22 nt, Human
uugaaauauuugggaguguuug

SEQ ID NO: 1067039 - RNA, 22 nt, Human
gcagccagccccucugaccucu

SEQ ID NO: 1067040 - RNA, 22 nt, Human
ggggaccugggcuucaaggguu

SEQ ID NO: 1067041 - RNA, 22 nt, Human
cauagagugauguaagguaugu

SEQ ID NO: 1067042 - RNA, 22 nt, Human
aaaugucaaggugauagaugca

SEQ ID NO: 1067043 - RNA, 22 nt, Human
ggcugcucuucuuggcgaccuc

SEQ ID NO: 1067044 - RNA, 22 nt, Human
uaguauuuuagaaaaccaugaa

SEQ ID NO: 1067045 - RNA, 22 nt, Human
ccagggaaggcugcuggcugug

SEQ ID NO: 1067046 - RNA, 21 nt, Human
uuuuuucuugcgugaggccug

SEQ ID NO: 1067047 - RNA, 22 nt, Human
auucuacauuuggagugauguc

SEQ ID NO: 1067048 - RNA, 22 nt, Human
gcagagcucaagguguucagcu

SEQ ID NO: 1067049 - RNA, 22 nt, Human
cuuacauugugugcaugagggg

SEQ ID NO: 1067050 - RNA, 22 nt, Human
acaaaauuguguuaaacuuuau

SEQ ID NO: 1067051 - RNA, 22 nt, Human
acauagaaauuuauuucuuaca

SEQ ID NO: 1067052 - RNA, 19 nt, Human
ccagaggacuguuaaugaa

SEQ ID NO: 1067053 - RNA, 22 nt, Human
acaggugugagaacaugccuug

SEQ ID NO: 1067054 - RNA, 22 nt, Human
uggcugagggggcucugcucag

SEQ ID NO: 1067055 - RNA, 22 nt, Human
gaauguuuuucauuggugacuc

SEQ ID NO: 1067056 - RNA, 22 nt, Human
agcuucuuguagaacucaaaag

SEQ ID NO: 1067057 - RNA, 22 nt, Human
gccagggcaggggagcaucugc

SEQ ID NO: 1067058 - RNA, 17 nt, Human
gugaagagucauugaau

SEQ ID NO: 1067059 - RNA, 21 nt, Human
uuacuuuugcaccaaccuaau

SEQ ID NO: 1067060 - RNA, 22 nt, Human
cagagacauccauguuaguugg

SEQ ID NO: 1067061 - RNA, 23 nt, Human
aagcuuccuucacgucuccuggg

SEQ ID NO: 1067062 - RNA, 22 nt, Human
cuuaagauuugcgauaccuaau

SEQ ID NO: 1067063 - RNA, 22 nt, Human
uacauaguauucacauuguuuu

SEQ ID NO: 1067064 - RNA, 22 nt, Human
agggccuggaacugugggcagg

SEQ ID NO: 1067065 - RNA, 22 nt, Human
ugacuuuaaaauaacaaguuua

SEQ ID NO: 1067066 - RNA, 22 nt, Human
uccaggggagacuagacccaca

SEQ ID NO: 1067067 - RNA, 22 nt, Human
aaagcaaacagaaccccaagcu

SEQ ID NO: 1067068 - RNA, 22 nt, Human
caaacauuuugagugguuucug

SEQ ID NO: 1067069 - RNA, 22 nt, Human
ucacagcuaagcuuggucacug

SEQ ID NO: 1067070 - RNA, 22 nt, Human
caugaaaugauauuuggguggg

SEQ ID NO: 1067071 - RNA, 22 nt, Human
uugcauuugacaaauuauuuaa

SEQ ID NO: 1067072 - RNA, 22 nt, Human
cugagaucuuuauacgaggcac

SEQ ID NO: 1067073 - RNA, 21 nt, Human
auacacauacacauaaaugug

SEQ ID NO: 1067074 - RNA, 22 nt, Human
aucaggaagccagucuaaugga

SEQ ID NO: 1067075 - RNA, 22 nt, Human
ucagaggaaaggucagauggcu

SEQ ID NO: 1067076 - RNA, 22 nt, Human
aggagccaugagugacaucaca

SEQ ID NO: 1067077 - RNA, 19 nt, Human
agaguugggcacuguuuca

SEQ ID NO: 1067078 - RNA, 22 nt, Human
cuggcagucugccucuucacug

SEQ ID NO: 1067079 - RNA, 21 nt, Human
ccauaccuaccucaccugguu

SEQ ID NO: 1067080 - RNA, 22 nt, Human
aaagaugucacaagaugugaug

SEQ ID NO: 1067081 - RNA, 23 nt, Human
agccuucaggcaaugucaguaga

SEQ ID NO: 1067082 - RNA, 22 nt, Human
agccagggcucuccuucgcgug

SEQ ID NO: 1067083 - RNA, 22 nt, Human
augaaggcuguguagauggaug

SEQ ID NO: 1067084 - RNA, 22 nt, Human
acagcugugagggucacuugua

SEQ ID NO: 1067085 - RNA, 22 nt, Human
uugagucaguaauuccauuucu

SEQ ID NO: 1067086 - RNA, 22 nt, Human
agagaggcugggcguagggcuu

SEQ ID NO: 1067087 - RNA, 22 nt, Human
ugggccuucucaaugcacugga

SEQ ID NO: 1067088 - RNA, 22 nt, Human
gaagcacauggcugugagcaac

SEQ ID NO: 1067089 - RNA, 22 nt, Human
ucuuuucugccacagccugagc

SEQ ID NO: 1067090 - RNA, 22 nt, Human
cugccuggguucaaguccuguu

SEQ ID NO: 1067091 - RNA, 22 nt, Human
aucaaagauguuucagggugua

SEQ ID NO: 1067092 - RNA, 22 nt, Human
gggaaccagccgcuuccgccuc

SEQ ID NO: 1067093 - RNA, 17 nt, Human
uucauuaauaaaagcaa

SEQ ID NO: 1067094 - RNA, 19 nt, Human
ugaaggagggggauggcca

SEQ ID NO: 1067095 - RNA, 22 nt, Human
ccugccuggggacaaaggaggg

SEQ ID NO: 1067096 - RNA, 22 nt, Human
cagccugcuagggcaaugccuu

SEQ ID NO: 1067097 - RNA, 22 nt, Human
ggcuucucucuucacauggcuu

SEQ ID NO: 1067098 - RNA, 22 nt, Human
ggugaggcuaagugacacaggg

SEQ ID NO: 1067099 - RNA, 22 nt, Human
aucuuuucuguuugcuaugucu

SEQ ID NO: 1067100 - RNA, 22 nt, Human
cacaucuauagggacagcaaca

SEQ ID NO: 1067101 - RNA, 22 nt, Human
acaacuguuggaggaacacagg

SEQ ID NO: 1067102 - RNA, 22 nt, Human
ggcuccucucuggccgcucccg

SEQ ID NO: 1067103 - RNA, 22 nt, Human
gggcuggcgggaaaggcaauuc

SEQ ID NO: 1067104 - RNA, 19 nt, Human
acccucucagugccugagg

SEQ ID NO: 1067105 - RNA, 22 nt, Human
gcaguuacuagcaauuugugaa

SEQ ID NO: 1067106 - RNA, 22 nt, Human
gggcauggugaugugcaccugu

SEQ ID NO: 1067107 - RNA, 22 nt, Human
uagaauaugugguaggaucugg

SEQ ID NO: 1067108 - RNA, 22 nt, Human
gcugucugcugggucgcucagg

SEQ ID NO: 1067109 - RNA, 22 nt, Human
caagggugguauugggagcaua

SEQ ID NO: 1067110 - RNA, 22 nt, Human
aacuacagaaaagguaagcucu

SEQ ID NO: 1067111 - RNA, 22 nt, Human
cagcugggcuaagaguagaggc

SEQ ID NO: 1067112 - RNA, 22 nt, Human
ugcuugggaauguggagucaga

SEQ ID NO: 1067113 - RNA, 22 nt, Human
aagccaacaugauuacuauaau

SEQ ID NO: 1067114 - RNA, 22 nt, Human
uuugcagucuggccugcuuugg

SEQ ID NO: 1067115 - RNA, 22 nt, Human
cuugaaagaagggucuuuuaau

SEQ ID NO: 1067116 - RNA, 22 nt, Human
ggaggcuccacugcucuuccug

SEQ ID NO: 1067117 - RNA, 22 nt, Human
cagcugaggucaaagaagcagg

SEQ ID NO: 1067118 - RNA, 22 nt, Human
gugauucaaauguaacuaauua

SEQ ID NO: 1067119 - RNA, 22 nt, Human
cugugggaauacugcgagugua

SEQ ID NO: 1067120 - RNA, 18 nt, Human
acauuuaggagagucaau

SEQ ID NO: 1067121 - RNA, 22 nt, Human
ugcccagggauaagccuagaga

SEQ ID NO: 1067122 - RNA, 22 nt, Human
aggaccagccuccaggucucuu

SEQ ID NO: 1067123 - RNA, 19 nt, Human
caguuacagcagcuaagac

SEQ ID NO: 1067124 - RNA, 22 nt, Human
ggaggccuugaggccaggagcu

SEQ ID NO: 1067125 - RNA, 22 nt, Human
acauucaagaugcauucacuua

SEQ ID NO: 1067126 - RNA, 22 nt, Human
ucccagagcucuggagguugga

SEQ ID NO: 1067127 - RNA, 23 nt, Human
gagcagagcgggcggggguccug

SEQ ID NO: 1067128 - RNA, 22 nt, Human
auuuuuucccaguuagccagga

SEQ ID NO: 1067129 - RNA, 22 nt, Human
gcugcuggccgcccagcuucuc

SEQ ID NO: 1067130 - RNA, 22 nt, Human
ggaaccaguggaaugauaugcu

SEQ ID NO: 1067131 - RNA, 22 nt, Human
cuggccccaggcagccugcugg

SEQ ID NO: 1067132 - RNA, 21 nt, Human
acagacagggccagugucccc

SEQ ID NO: 1067133 - RNA, 22 nt, Human
auuagguugagguacucagagc

SEQ ID NO: 1067134 - RNA, 22 nt, Human
aagauuucagaguuugggggaa

SEQ ID NO: 1067135 - RNA, 22 nt, Human
ccaggagccugggccaggcugg

SEQ ID NO: 1067136 - RNA, 22 nt, Human
uguagauauuaauuauuccuuu

SEQ ID NO: 1067137 - RNA, 22 nt, Human
cagggcaguaccgcccucuggc

SEQ ID NO: 1067138 - RNA, 22 nt, Human
aaaugucagagcuggaaggggc

SEQ ID NO: 1067139 - RNA, 20 nt, Human
uuauuucucauucuccuacu

SEQ ID NO: 1067140 - RNA, 22 nt, Human
cucaccacagagccuguccagc

SEQ ID NO: 1067141 - RNA, 22 nt, Human
aggaaggguucuuugugaaaga

SEQ ID NO: 1067142 - RNA, 22 nt, Human
acugggcuccaaggaccuggag

SEQ ID NO: 1067143 - RNA, 22 nt, Human
uuauuaaucuuaucuuuggaaa

SEQ ID NO: 1067144 - RNA, 22 nt, Human
ugaaaauuuccaucaguuauau

SEQ ID NO: 1067145 - RNA, 22 nt, Human
aggcaguuucugggacagcaua

SEQ ID NO: 1067146 - RNA, 22 nt, Human
ugcagagcagcaacugcgugcg

SEQ ID NO: 1067147 - RNA, 22 nt, Human
cagaggcugggaccucaggcau

SEQ ID NO: 1067148 - RNA, 20 nt, Human
uugcauuggaugugcaggug

SEQ ID NO: 1067149 - RNA, 22 nt, Human
uuccaguuugcaguugacacua

SEQ ID NO: 1067150 - RNA, 22 nt, Human
aguauuuccuggcuuaucugcu

SEQ ID NO: 1067151 - RNA, 22 nt, Human
ccuuuucuguguggguaauuua

SEQ ID NO: 1067152 - RNA, 22 nt, Human
aaagucacuuccuucugucagc

SEQ ID NO: 1067153 - RNA, 22 nt, Human
aaauacugguuuuggagaugcu

SEQ ID NO: 1067154 - RNA, 22 nt, Human
uuucccaagaaaaauaauugga

SEQ ID NO: 1067155 - RNA, 22 nt, Human
ugcccugcuaaauauagguagc

SEQ ID NO: 1067156 - RNA, 22 nt, Human
uaugcacaauaugaucuauuug

SEQ ID NO: 1067157 - RNA, 22 nt, Human
uccauuuucucuuccggaggug

SEQ ID NO: 1067158 - RNA, 22 nt, Human
aggccagaaaugucagggagug

SEQ ID NO: 1067159 - RNA, 22 nt, Human
ggcugcugugaccucaggugau

SEQ ID NO: 1067160 - RNA, 17 nt, Human
uccagagcacagagcuc

SEQ ID NO: 1067161 - RNA, 22 nt, Human
ugggugagugggaaaagcccag

SEQ ID NO: 1067162 - RNA, 22 nt, Human
ccagugcaggugagcaccaggu

SEQ ID NO: 1067163 - RNA, 22 nt, Human
agaaaauuuauucauguuaguu

SEQ ID NO: 1067164 - RNA, 22 nt, Human
agcugauuccacuuuuucccca

SEQ ID NO: 1067165 - RNA, 22 nt, Human
ggccucugguucguggugaccu

SEQ ID NO: 1067166 - RNA, 22 nt, Human
ggcagccuccagggcacuggug

SEQ ID NO: 1067167 - RNA, 22 nt, Human
ugcacuuugcaggcauggaaac

SEQ ID NO: 1067168 - RNA, 22 nt, Human
caggggcaagaaugcugucagc

SEQ ID NO: 1067169 - RNA, 22 nt, Human
auuucuuuucaagagggugcuu

SEQ ID NO: 1067170 - RNA, 22 nt, Human
aaagguuuugguaaggcuuuaa

SEQ ID NO: 1067171 - RNA, 22 nt, Human
uucaaacaggggucagggagau

SEQ ID NO: 1067172 - RNA, 22 nt, Human
ucugccugcaguguggcagggc

SEQ ID NO: 1067173 - RNA, 20 nt, Human
accauuaauguaagcuuugu

SEQ ID NO: 1067174 - RNA, 22 nt, Human
caucuacacugauuaggugaac

SEQ ID NO: 1067175 - RNA, 22 nt, Human
ucugaaaugcaggcaauuugcu

SEQ ID NO: 1067176 - RNA, 22 nt, Human
uccacagaauguaagauccaca

SEQ ID NO: 1067177 - RNA, 22 nt, Human
cugagcccucuguuuucccucu

SEQ ID NO: 1067178 - RNA, 22 nt, Human
guauuuucaagagcaguaguau

SEQ ID NO: 1067179 - RNA, 22 nt, Human
uggaggcaacugaagauguagu

SEQ ID NO: 1067180 - RNA, 22 nt, Human
acauucuucuugugaauuuacu

SEQ ID NO: 1067181 - RNA, 22 nt, Human
agcuuccuuggcgcugaggccu

SEQ ID NO: 1067182 - RNA, 22 nt, Human
aggaagcuccuggagagccagu

SEQ ID NO: 1067183 - RNA, 22 nt, Human
uauuugcaaagaacuacacuag

SEQ ID NO: 1067184 - RNA, 22 nt, Human
ggcucagguuaccagucccucc

SEQ ID NO: 1067185 - RNA, 22 nt, Human
uggcagagaaccugggcuuugu

SEQ ID NO: 1067186 - RNA, 22 nt, Human
ugccaggggaccuagggauguc

SEQ ID NO: 1067187 - RNA, 22 nt, Human
gaggcacaugacucaccaaugg

SEQ ID NO: 1067188 - RNA, 22 nt, Human
cccaggagguagagguugcagu

SEQ ID NO: 1067189 - RNA, 22 nt, Human
gguggguuuggaagagcaggcu

SEQ ID NO: 1067190 - RNA, 22 nt, Human
uggcuucugcuuucaguggagg

SEQ ID NO: 1067191 - RNA, 23 nt, Human
cugcagagaacugagggacagcc

SEQ ID NO: 1067192 - RNA, 22 nt, Human
ggggaagggaguccaaguguua

SEQ ID NO: 1067193 - RNA, 22 nt, Human
aggagcugucagagugccagag

SEQ ID NO: 1067194 - RNA, 22 nt, Human
auuuuacuacuccaauuaauga

SEQ ID NO: 1067195 - RNA, 22 nt, Human
augggcugaggaagcuccugag

SEQ ID NO: 1067196 - RNA, 22 nt, Human
aaagcauuguuucaagauuaac

SEQ ID NO: 1067197 - RNA, 22 nt, Human
ccaguguucaucaagaaaaugu

SEQ ID NO: 1067198 - RNA, 22 nt, Human
gcugcugugaauuuuuuaaaug

SEQ ID NO: 1067199 - RNA, 22 nt, Human
gauuuuauuagcccaaacuuug

SEQ ID NO: 1067200 - RNA, 22 nt, Human
auggacaaugugaaacuacaag

SEQ ID NO: 1067201 - RNA, 22 nt, Human
uugagaaaagcuguguaaggau

SEQ ID NO: 1067202 - RNA, 22 nt, Human
gccuccucuugagggucaggga

SEQ ID NO: 1067203 - RNA, 22 nt, Human
gcugucagaaggugaaggguaa

SEQ ID NO: 1067204 - RNA, 22 nt, Human
uccagcagguccgagacaaguu

SEQ ID NO: 1067205 - RNA, 21 nt, Human
uugaaggaucacuucuguacc

SEQ ID NO: 1067206 - RNA, 18 nt, Human
ucaagacaucaugaaaua

SEQ ID NO: 1067207 - RNA, 22 nt, Human
auaauaaugaaagccacugugu

SEQ ID NO: 1067208 - RNA, 22 nt, Human
uagcaggguccaaugugaggca

SEQ ID NO: 1067209 - RNA, 22 nt, Human
gggagguguucugccaacgcgg

SEQ ID NO: 1067210 - RNA, 22 nt, Human
agucucagaaaauaugcuuuuu

SEQ ID NO: 1067211 - RNA, 22 nt, Human
ugggccuggguuccuccugggc

SEQ ID NO: 1067212 - RNA, 22 nt, Human
gggagcaggagccugccugcca

SEQ ID NO: 1067213 - RNA, 22 nt, Human
agcugggcugggcugagcugag

SEQ ID NO: 1067214 - RNA, 22 nt, Human
agcaggugacagggcuguggug

SEQ ID NO: 1067215 - RNA, 22 nt, Human
ggugaggcccagugaucugugu

SEQ ID NO: 1067216 - RNA, 22 nt, Human
agagcuguucaacguagcaaug

SEQ ID NO: 1067217 - RNA, 22 nt, Human
agcccugcacaguucgggagga

SEQ ID NO: 1067218 - RNA, 22 nt, Human
uccaagaugguugguguggugg

SEQ ID NO: 1067219 - RNA, 22 nt, Human
uaucuacauucuuguaucuucu

SEQ ID NO: 1067220 - RNA, 22 nt, Human
auucacagggggagaaggguau

SEQ ID NO: 1067221 - RNA, 23 nt, Human
acagggcauugcuggccucgagg

SEQ ID NO: 1067222 - RNA, 22 nt, Human
aacuggaaccuuuuauucaguc

SEQ ID NO: 1067223 - RNA, 22 nt, Human
agaacauaucuguuuucuaacu

SEQ ID NO: 1067224 - RNA, 22 nt, Human
agaguaugcuacaaagccagcc

SEQ ID NO: 1067225 - RNA, 22 nt, Human
aggcaggugggucacuugaguc

SEQ ID NO: 1067226 - RNA, 22 nt, Human
aagaguuuuagacaaacugauu

SEQ ID NO: 1067227 - RNA, 22 nt, Human
agcaggcugcuggcguugaagu

SEQ ID NO: 1067228 - RNA, 22 nt, Human
aaauucuaaggucacaauguug

SEQ ID NO: 1067229 - RNA, 22 nt, Human
uacuguuucuacuacuuaggga

SEQ ID NO: 1067230 - RNA, 22 nt, Human
ucugagaguccaucuccaagcc

SEQ ID NO: 1067231 - RNA, 22 nt, Human
auguaauuuagaaaugaacaca

SEQ ID NO: 1067232 - RNA, 22 nt, Human
gggcuggaggagauccagaggc

SEQ ID NO: 1067233 - RNA, 22 nt, Human
ucagcugcuucauguucugaau

SEQ ID NO: 1067234 - RNA, 22 nt, Human
ugcagggccuucuagaccaugg

SEQ ID NO: 1067235 - RNA, 22 nt, Human
ucacugaauacuugucucaucc

SEQ ID NO: 1067236 - RNA, 22 nt, Human
uuaauacauuucagacuguuau

SEQ ID NO: 1067237 - RNA, 22 nt, Human
gggcaggagagaacagucaugg

SEQ ID NO: 1067238 - RNA, 22 nt, Human
agugcagcugggacuguagggu

SEQ ID NO: 1067239 - RNA, 22 nt, Human
accuggagaaagccucucccug

SEQ ID NO: 1067240 - RNA, 22 nt, Human
aucuuaccucuuccucugcauu

SEQ ID NO: 1067241 - RNA, 22 nt, Human
ucaaagucauggcaggcucaga

SEQ ID NO: 1067242 - RNA, 22 nt, Human
gaaauauucuugucuuguuuuc

SEQ ID NO: 1067243 - RNA, 22 nt, Human
gaaggaagggcuggcugucuug

SEQ ID NO: 1067244 - RNA, 22 nt, Human
aagaaaugugaauauugaauag

SEQ ID NO: 1067245 - RNA, 21 nt, Human
acacacucugagucuucuauu

SEQ ID NO: 1067246 - RNA, 22 nt, Human
gcagagcagugcuugcccagcg

SEQ ID NO: 1067247 - RNA, 22 nt, Human
guggcuugaccaucccugcuac

SEQ ID NO: 1067248 - RNA, 19 nt, Human
ugcuucuggaaugcaaggc

SEQ ID NO: 1067249 - RNA, 22 nt, Human
gcaaaauuaaacuuagcaucau

SEQ ID NO: 1067250 - RNA, 20 nt, Human
aggcucaggguguuuaggaa

SEQ ID NO: 1067251 - RNA, 22 nt, Human
uccugguggcuuucccugccuu

SEQ ID NO: 1067252 - RNA, 22 nt, Human
gccuucaggaaaucaguccuug

SEQ ID NO: 1067253 - RNA, 22 nt, Human
aagcagaugggacuccaaggca

SEQ ID NO: 1067254 - RNA, 22 nt, Human
aggguggccaugagggagagau

SEQ ID NO: 1067255 - RNA, 20 nt, Human
agggaggugcugggccugag

SEQ ID NO: 1067256 - RNA, 22 nt, Human
accaggcugugaagugagacua

SEQ ID NO: 1067257 - RNA, 22 nt, Human
uuuacaauucucuaccaguguu

SEQ ID NO: 1067258 - RNA, 22 nt, Human
uauugaaaugaaugacagugau

SEQ ID NO: 1067259 - RNA, 22 nt, Human
auguuuccgugagcauccuuga

SEQ ID NO: 1067260 - RNA, 22 nt, Human
uagaggcacccuggaggagacu

SEQ ID NO: 1067261 - RNA, 22 nt, Human
aggccucuggagguggcagugu

SEQ ID NO: 1067262 - RNA, 22 nt, Human
uuucacagcuuccacuuaagga

SEQ ID NO: 1067263 - RNA, 22 nt, Human
ucacaguagccauuucaugagu

SEQ ID NO: 1067264 - RNA, 22 nt, Human
gugcagcuuccuggucucagcc

SEQ ID NO: 1067265 - RNA, 22 nt, Human
aucacagagauugcuuuuaaaa

SEQ ID NO: 1067266 - RNA, 22 nt, Human
uuccaaguccagccaggccaaa

SEQ ID NO: 1067267 - RNA, 21 nt, Human
uucuccccagcgaauccucgg

SEQ ID NO: 1067268 - RNA, 22 nt, Human
uuuuucuagaccuuaaaggcca

SEQ ID NO: 1067269 - RNA, 21 nt, Human
guauaucagcagugaauucaa

SEQ ID NO: 1067270 - RNA, 22 nt, Human
ccucuucaccucgggcacacug

SEQ ID NO: 1067271 - RNA, 22 nt, Human
ucucuuccaguggcuuugauuu

SEQ ID NO: 1067272 - RNA, 22 nt, Human
cauuuaagagaaauauuuaguu

SEQ ID NO: 1067273 - RNA, 22 nt, Human
uauucacaggcuggagugaugu

SEQ ID NO: 1067274 - RNA, 21 nt, Human
ucugucugguuuuagaguggc

SEQ ID NO: 1067275 - RNA, 22 nt, Human
uuugagaagauguaauguuaag

SEQ ID NO: 1067276 - RNA, 22 nt, Human
ucagagagugcaaaauauagcu

SEQ ID NO: 1067277 - RNA, 22 nt, Human
ucugccuguugagccuaaggcc

SEQ ID NO: 1067278 - RNA, 22 nt, Human
ucaugcuaguuaagaacacaau

SEQ ID NO: 1067279 - RNA, 22 nt, Human
cugcugucuuuauuucacugcu

SEQ ID NO: 1067280 - RNA, 22 nt, Human
auucaaguucuucugucuuugc

SEQ ID NO: 1067281 - RNA, 22 nt, Human
cacaucagggcugcuugggggu

SEQ ID NO: 1067282 - RNA, 22 nt, Human
ugauucuuucuccaccaauuca

SEQ ID NO: 1067283 - RNA, 22 nt, Human
acucuaaaaugcuaugagaucu

SEQ ID NO: 1067284 - RNA, 22 nt, Human
auguaugauauuuccaguauca

SEQ ID NO: 1067285 - RNA, 22 nt, Human
cacaguggcagguguggguugu

SEQ ID NO: 1067286 - RNA, 22 nt, Human
caaaguacagugcuuccuggga

SEQ ID NO: 1067287 - RNA, 22 nt, Human
caguugaugggacucauguggg

SEQ ID NO: 1067288 - RNA, 22 nt, Human
cacaggagugcugcuauuguug

SEQ ID NO: 1067289 - RNA, 17 nt, Human
ucaggcugugccuggua

SEQ ID NO: 1067290 - RNA, 22 nt, Human
agaagccacaggccucgucugg

SEQ ID NO: 1067291 - RNA, 22 nt, Human
cuuauuagaguuguguucuguu

SEQ ID NO: 1067292 - RNA, 19 nt, Human
uccuccuuacuuccucuug

SEQ ID NO: 1067293 - RNA, 22 nt, Human
gagcuuggacaccuuggcaggu

SEQ ID NO: 1067294 - RNA, 22 nt, Human
acauuucagauguaaugugaug

SEQ ID NO: 1067295 - RNA, 22 nt, Human
gcugaggccucagaaggcugag

SEQ ID NO: 1067296 - RNA, 22 nt, Human
gcagauaggguauuaggaguaa

SEQ ID NO: 1067297 - RNA, 22 nt, Human
cauggccugccuccuccuggug

SEQ ID NO: 1067298 - RNA, 22 nt, Human
agccuggauucgugcauccaca

SEQ ID NO: 1067299 - RNA, 20 nt, Human
cuccugggacugcugguuau

SEQ ID NO: 1067300 - RNA, 22 nt, Human
cacaacuuagcagcuugaaaca

SEQ ID NO: 1067301 - RNA, 22 nt, Human
uauuaaagagagaaucaucauc

SEQ ID NO: 1067302 - RNA, 22 nt, Human
ugccuacauuccuugcuuaugg

SEQ ID NO: 1067303 - RNA, 22 nt, Human
augucagagcuuccacaauagu

SEQ ID NO: 1067304 - RNA, 22 nt, Human
cggagccugcuuguugcagcug

SEQ ID NO: 1067305 - RNA, 23 nt, Human
cagguggcuccacgagggguggg

SEQ ID NO: 1067306 - RNA, 22 nt, Human
cgaggcagggaagcugcaaaag

SEQ ID NO: 1067307 - RNA, 22 nt, Human
ucagacaucucauaauguauua

SEQ ID NO: 1067308 - RNA, 22 nt, Human
aagauucuguauuucuaacaau

SEQ ID NO: 1067309 - RNA, 22 nt, Human
aagauuuccuggauguaauucc

SEQ ID NO: 1067310 - RNA, 23 nt, Human
gaggccacauuccccugcuugag

SEQ ID NO: 1067311 - RNA, 22 nt, Human
auacaaguuaaugagaaugaca

SEQ ID NO: 1067312 - RNA, 22 nt, Human
caggacaguauaggcuuuagga

SEQ ID NO: 1067313 - RNA, 22 nt, Human
uucuccagagguggcuagaguu

SEQ ID NO: 1067314 - RNA, 22 nt, Human
uuacugaagguggauagugagu

SEQ ID NO: 1067315 - RNA, 22 nt, Human
uaccugaaguaacaaugaauau

SEQ ID NO: 1067316 - RNA, 22 nt, Human
cuagccaugggcauuaaaggua

SEQ ID NO: 1067317 - RNA, 22 nt, Human
uauugacaauuugugaaacuau

SEQ ID NO: 1067318 - RNA, 22 nt, Human
ucucuggaauuggcugaggcaa

SEQ ID NO: 1067319 - RNA, 22 nt, Human
cccaggucccgccccagcucua

SEQ ID NO: 1067320 - RNA, 22 nt, Human
uccagcuugccuggucuuuugg

SEQ ID NO: 1067321 - RNA, 22 nt, Human
augaaauugaucuugaacuuuu

SEQ ID NO: 1067322 - RNA, 22 nt, Human
gaggaccacagaugagccugca

SEQ ID NO: 1067323 - RNA, 22 nt, Human
aggcagagaaaaaccagauaug

SEQ ID NO: 1067324 - RNA, 21 nt, Human
aaucaaaugucauauccccag

SEQ ID NO: 1067325 - RNA, 22 nt, Human
uauuucuuucagguauguguug

SEQ ID NO: 1067326 - RNA, 22 nt, Human
ggggcugauggaacucaggccu

SEQ ID NO: 1067327 - RNA, 23 nt, Human
acucacaaagcaggaucauguug

SEQ ID NO: 1067328 - RNA, 22 nt, Human
aaaguauuugugauuuuuacca

SEQ ID NO: 1067329 - RNA, 22 nt, Human
ucuccaggccuuucccaucuua

SEQ ID NO: 1067330 - RNA, 22 nt, Human
uuuacagcuagacauaccugag

SEQ ID NO: 1067331 - RNA, 22 nt, Human
guggggacgggauggcucacug

SEQ ID NO: 1067332 - RNA, 22 nt, Human
cuucugaagagguuaucauaga

SEQ ID NO: 1067333 - RNA, 22 nt, Human
ccaguguucccucggguucaug

SEQ ID NO: 1067334 - RNA, 22 nt, Human
gcugaaaugcagaucccucacu

SEQ ID NO: 1067335 - RNA, 22 nt, Human
ucuuugcacugugcaagcagaa

SEQ ID NO: 1067336 - RNA, 20 nt, Human
gagagcuggggaugaggcug

SEQ ID NO: 1067337 - RNA, 20 nt, Human
augugaaagaucaguugucu

SEQ ID NO: 1067338 - RNA, 22 nt, Human
ucacauuuuguucaaggcuagu

SEQ ID NO: 1067339 - RNA, 22 nt, Human
gcagacaggauuggguuaauag

SEQ ID NO: 1067340 - RNA, 22 nt, Human
uuauguacucugcaauguuuga

SEQ ID NO: 1067341 - RNA, 22 nt, Human
agaagccagcuucagcugcccg

SEQ ID NO: 1067342 - RNA, 22 nt, Human
gucugcccuuggcucagccaua

SEQ ID NO: 1067343 - RNA, 22 nt, Human
ugucccaguuuugcagguuaga

SEQ ID NO: 1067344 - RNA, 20 nt, Human
ucaauuuucuacaacauuug

SEQ ID NO: 1067345 - RNA, 22 nt, Human
cucagacuggagccccaaggac

SEQ ID NO: 1067346 - RNA, 22 nt, Human
cagucucugccacuucuaagcu

SEQ ID NO: 1067347 - RNA, 22 nt, Human
cuggggaacaauuugccacacu

SEQ ID NO: 1067348 - RNA, 22 nt, Human
aggaagaugugcaaaguuggaa

SEQ ID NO: 1067349 - RNA, 20 nt, Human
cuuccuuuuccuucgucaaa

SEQ ID NO: 1067350 - RNA, 22 nt, Human
cagaguguuagcgcugguuggg

SEQ ID NO: 1067351 - RNA, 22 nt, Human
aacagacauauuuuuaauaugc

SEQ ID NO: 1067352 - RNA, 22 nt, Human
acagaccaaaaaaggauauugg

SEQ ID NO: 1067353 - RNA, 22 nt, Human
cuggcucugggccucagacacu

SEQ ID NO: 1067354 - RNA, 22 nt, Human
gacuucugagcuauccagcugu

SEQ ID NO: 1067355 - RNA, 22 nt, Human
ugguccuucguggugcaguucu

SEQ ID NO: 1067356 - RNA, 22 nt, Human
auaaauggcuuucauuccuagg

SEQ ID NO: 1067357 - RNA, 22 nt, Human
cagaccucaguccucaguagga

SEQ ID NO: 1067358 - RNA, 22 nt, Human
ccagaagaaaaagcugguauua

SEQ ID NO: 1067359 - RNA, 22 nt, Human
ugcaggagcugugcggugaggg

SEQ ID NO: 1067360 - RNA, 22 nt, Human
agugggcugagcuugcugggug

SEQ ID NO: 1067361 - RNA, 22 nt, Human
cgggcagcggcguggccauggu

SEQ ID NO: 1067362 - RNA, 22 nt, Human
gaggagggagcuggaagcucuu

SEQ ID NO: 1067363 - RNA, 22 nt, Human
cugggguccuugccauguguca

SEQ ID NO: 1067364 - RNA, 22 nt, Human
guccuuaaccacuuguguuuau

SEQ ID NO: 1067365 - RNA, 22 nt, Human
aacccaggguggagguugcagu

SEQ ID NO: 1067366 - RNA, 22 nt, Human
uuugaaaggagcuuuauccaga

SEQ ID NO: 1067367 - RNA, 22 nt, Human
agcaggaggguuuuguagaguc

SEQ ID NO: 1067368 - RNA, 22 nt, Human
aguggauggucacugauccagu

SEQ ID NO: 1067369 - RNA, 22 nt, Human
acccugggcuuggccugcucag

SEQ ID NO: 1067370 - RNA, 22 nt, Human
uguccccaagguucagcccaca

SEQ ID NO: 1067371 - RNA, 22 nt, Human
ucuggcucuguguccccaccca

SEQ ID NO: 1067372 - RNA, 22 nt, Human
gcagugcuaaguagcuggccca

SEQ ID NO: 1067373 - RNA, 21 nt, Human
ucuggagcccuaagcugagaa

SEQ ID NO: 1067374 - RNA, 22 nt, Human
gauaugaaguggcauugugaag

SEQ ID NO: 1067375 - RNA, 22 nt, Human
caggcuccuucccagggauggu

SEQ ID NO: 1067376 - RNA, 22 nt, Human
ccauuucacucuuccugaagga

SEQ ID NO: 1067377 - RNA, 22 nt, Human
gcuaucucuuuaguacuagauu

SEQ ID NO: 1067378 - RNA, 22 nt, Human
cagauggcauuuccuuucuggc

SEQ ID NO: 1067379 - RNA, 22 nt, Human
guggguggaggcgucgagggca

SEQ ID NO: 1067380 - RNA, 22 nt, Human
gccagagcaugcacugccugca

SEQ ID NO: 1067381 - RNA, 22 nt, Human
gaaggaaaacagaucugccuga

SEQ ID NO: 1067382 - RNA, 22 nt, Human
uccaaauacauuuacuguauuu

SEQ ID NO: 1067383 - RNA, 22 nt, Human
ugcacacauguuuacaagcauc

SEQ ID NO: 1067384 - RNA, 22 nt, Human
ugaggcagcccacuuuccuuag

SEQ ID NO: 1067385 - RNA, 22 nt, Human
ugcuccuuccucauccugugca

SEQ ID NO: 1067386 - RNA, 22 nt, Human
uuaauuuauacauaaucacagg

SEQ ID NO: 1067387 - RNA, 22 nt, Human
ggcucuggugggaagguuagau

SEQ ID NO: 1067388 - RNA, 20 nt, Human
cuguagggugcagcaggcuc

SEQ ID NO: 1067389 - RNA, 22 nt, Human
augggcuguccuaguccagccc

SEQ ID NO: 1067390 - RNA, 22 nt, Human
ucgcauuuguuaaagcauguug

SEQ ID NO: 1067391 - RNA, 22 nt, Human
gcaagcugaugugauagugaaa

SEQ ID NO: 1067392 - RNA, 22 nt, Human
auuuacagguagaauuuuaagu

SEQ ID NO: 1067393 - RNA, 23 nt, Human
aaucaccagcagccaaugugcag

SEQ ID NO: 1067394 - RNA, 22 nt, Human
ugugugugggcggaacggcccc

SEQ ID NO: 1067395 - RNA, 22 nt, Human
uuccugugaagccgguggucuc

SEQ ID NO: 1067396 - RNA, 22 nt, Human
uuccauuguuucugucuucacu

SEQ ID NO: 1067397 - RNA, 19 nt, Human
agaaaaacugguacugcug

SEQ ID NO: 1067398 - RNA, 22 nt, Human
auauacugaggagacuuuauau

SEQ ID NO: 1067399 - RNA, 22 nt, Human
cugaagaugucugagaugcuca

SEQ ID NO: 1067400 - RNA, 22 nt, Human
uauuaauaagugacuacuagcu

SEQ ID NO: 1067401 - RNA, 22 nt, Human
uuuauuauguacaggcacuaua

SEQ ID NO: 1067402 - RNA, 22 nt, Human
uaagucaggaggucuccugaca

SEQ ID NO: 1067403 - RNA, 22 nt, Human
ucucaagaucucaagauggccc

SEQ ID NO: 1067404 - RNA, 20 nt, Human
gcucugaccauaucaagaca

SEQ ID NO: 1067405 - RNA, 22 nt, Human
agugugugcuguuccccggagg

SEQ ID NO: 1067406 - RNA, 22 nt, Human
uucuuuggggaauauucugguu

SEQ ID NO: 1067407 - RNA, 22 nt, Human
ggcuuaagaugguagcuuugag

SEQ ID NO: 1067408 - RNA, 22 nt, Human
uucauugugaacacauucugcc

SEQ ID NO: 1067409 - RNA, 22 nt, Human
gccacaugcaauugcagcacgu

SEQ ID NO: 1067410 - RNA, 22 nt, Human
cuguacaggucaaugauaagau

SEQ ID NO: 1067411 - RNA, 22 nt, Human
cugcagagcauaaaucugaaua

SEQ ID NO: 1067412 - RNA, 22 nt, Human
aauuucaccugcacuacaucgc

SEQ ID NO: 1067413 - RNA, 22 nt, Human
gugccugggcaugagcuuguug

SEQ ID NO: 1067414 - RNA, 22 nt, Human
auguuuuauuaccaacuuguac

SEQ ID NO: 1067415 - RNA, 22 nt, Human
ugcacagagagaugagacacgu

SEQ ID NO: 1067416 - RNA, 22 nt, Human
auucaacuagugauuguguuau

SEQ ID NO: 1067417 - RNA, 22 nt, Human
accaaaaagauauguugaagcc

SEQ ID NO: 1067418 - RNA, 22 nt, Human
cugccugugugugccugcagaa

SEQ ID NO: 1067419 - RNA, 22 nt, Human
aggugcuuggcucgugcacaca

SEQ ID NO: 1067420 - RNA, 22 nt, Human
agcacagguacggagaugcuac

SEQ ID NO: 1067421 - RNA, 22 nt, Human
gcacacagggauuuuugaaugg

SEQ ID NO: 1067422 - RNA, 22 nt, Human
ucucccaggcugcccuguggac

SEQ ID NO: 1067423 - RNA, 22 nt, Human
agagccuggggauuggcaaggg

SEQ ID NO: 1067424 - RNA, 22 nt, Human
guggagcccugccuugcucaug

SEQ ID NO: 1067425 - RNA, 22 nt, Human
agaaagcuccccaugagaugau

SEQ ID NO: 1067426 - RNA, 22 nt, Human
gagaaagggauaauuugaagag

SEQ ID NO: 1067427 - RNA, 22 nt, Human
uccagcucuaacaugcugggcc

SEQ ID NO: 1067428 - RNA, 21 nt, Human
gccaccucgucucggagcagc

SEQ ID NO: 1067429 - RNA, 20 nt, Human
guggcagugguggcagcagu

SEQ ID NO: 1067430 - RNA, 22 nt, Human
gcagccucagggcacucagaug

SEQ ID NO: 1067431 - RNA, 21 nt, Human
ugcagcugacacugguaugcc

SEQ ID NO: 1067432 - RNA, 22 nt, Human
uugaaagaagaagcugcgaugu

SEQ ID NO: 1067433 - RNA, 22 nt, Human
cagacacugcagcagucuccca

SEQ ID NO: 1067434 - RNA, 22 nt, Human
cugccacuuucacccagugcuc

SEQ ID NO: 1067435 - RNA, 22 nt, Human
cccucgagguuuucugagguac

SEQ ID NO: 1067436 - RNA, 23 nt, Human
augugugggaggucagagagcca

SEQ ID NO: 1067437 - RNA, 22 nt, Human
acggaaugagucuugaaaagug

SEQ ID NO: 1067438 - RNA, 22 nt, Human
ugcugaguauuuguuugaauaa

SEQ ID NO: 1067439 - RNA, 21 nt, Human
auggaaauuggcaaaugcuac

SEQ ID NO: 1067440 - RNA, 22 nt, Human
auugaaagagaauguagcucuu

SEQ ID NO: 1067441 - RNA, 21 nt, Human
gccugcagaccccaccaggcu

SEQ ID NO: 1067442 - RNA, 22 nt, Human
cagggcccauggcucagguagg

SEQ ID NO: 1067443 - RNA, 22 nt, Human
ggagcugaaggggugggcucag

SEQ ID NO: 1067444 - RNA, 22 nt, Human
agcacaaauauaaaaaugucug

SEQ ID NO: 1067445 - RNA, 22 nt, Human
caaagcaguuuuaaucaaguag

SEQ ID NO: 1067446 - RNA, 22 nt, Human
gaauacaagccugccaccugga

SEQ ID NO: 1067447 - RNA, 20 nt, Human
gcaauuaauuuuugguuaca

SEQ ID NO: 1067448 - RNA, 22 nt, Human
ggcucugguugaccaugauggc

SEQ ID NO: 1067449 - RNA, 22 nt, Human
gugucccaaucuacuuuucccu

SEQ ID NO: 1067450 - RNA, 22 nt, Human
acaggcagcacuaaucucuggu

SEQ ID NO: 1067451 - RNA, 22 nt, Human
ccuggcuggacuggaccguggc

SEQ ID NO: 1067452 - RNA, 22 nt, Human
ccugggugacccgugagcgucc

SEQ ID NO: 1067453 - RNA, 22 nt, Human
uucuacauauauuuuucucacu

SEQ ID NO: 1067454 - RNA, 22 nt, Human
uucaggauggcggauguugggg

SEQ ID NO: 1067455 - RNA, 22 nt, Human
cucagcagcagggaagagguca

SEQ ID NO: 1067456 - RNA, 22 nt, Human
uucuuuaaaauagugagaaaga

SEQ ID NO: 1067457 - RNA, 22 nt, Human
gcugagcacaccuaggguagag

SEQ ID NO: 1067458 - RNA, 22 nt, Human
cugaagcaugcguuuguaaacu

SEQ ID NO: 1067459 - RNA, 22 nt, Human
gugcaugugucuuuauaguaga

SEQ ID NO: 1067460 - RNA, 19 nt, Human
caugaugagcauccugcag

SEQ ID NO: 1067461 - RNA, 22 nt, Human
ugaaaugauguacaagaaggca

SEQ ID NO: 1067462 - RNA, 22 nt, Human
ugaaggagaaauggaaaguggg

SEQ ID NO: 1067463 - RNA, 22 nt, Human
uuuaaaaguuaucaucugucca

SEQ ID NO: 1067464 - RNA, 19 nt, Human
ugcucaggccaaggagccc

SEQ ID NO: 1067465 - RNA, 22 nt, Human
aauaaaggcaccauaaggcaaa

SEQ ID NO: 1067466 - RNA, 22 nt, Human
gcagcugauggaaguccuauug

SEQ ID NO: 1067467 - RNA, 22 nt, Human
cuuauacauaaaauggguguag

SEQ ID NO: 1067468 - RNA, 22 nt, Human
aucagcaaaaaugccuucagaa

SEQ ID NO: 1067469 - RNA, 22 nt, Human
cugccuugaggagguuguggga

SEQ ID NO: 1067470 - RNA, 22 nt, Human
agaaaauuagauuuuacugugu

SEQ ID NO: 1067471 - RNA, 22 nt, Human
aucuucaaagcacaucguuugu

SEQ ID NO: 1067472 - RNA, 22 nt, Human
uguaggccuauguccagcaauu

SEQ ID NO: 1067473 - RNA, 22 nt, Human
guguuuuaucagacaaaguaua

SEQ ID NO: 1067474 - RNA, 22 nt, Human
gcuggccugucuagagccuuac

SEQ ID NO: 1067475 - RNA, 22 nt, Human
gaggguggccuuuagagcccau

SEQ ID NO: 1067476 - RNA, 22 nt, Human
ugugccugucccgcauucuggu

SEQ ID NO: 1067477 - RNA, 22 nt, Human
cucagggucugguccuuagauu

SEQ ID NO: 1067478 - RNA, 20 nt, Human
gcugggcuaccacuggcccu

SEQ ID NO: 1067479 - RNA, 22 nt, Human
uuuguagacuaccaguaauugu

SEQ ID NO: 1067480 - RNA, 22 nt, Human
acaaauguuggauuugucuucc

SEQ ID NO: 1067481 - RNA, 22 nt, Human
gcagcugagcgugaggaagagu

SEQ ID NO: 1067482 - RNA, 22 nt, Human
acugccuugaaagauuguugag

SEQ ID NO: 1067483 - RNA, 22 nt, Human
cucuccagccaggggcuuccug

SEQ ID NO: 1067484 - RNA, 22 nt, Human
cagcucugaggaacacuccuuu

SEQ ID NO: 1067485 - RNA, 22 nt, Human
aauuucacagugaacuuugagg

SEQ ID NO: 1067486 - RNA, 22 nt, Human
uucaaaagcgguccaggaagau

SEQ ID NO: 1067487 - RNA, 22 nt, Human
agcuggccuucggugucacugg

SEQ ID NO: 1067488 - RNA, 22 nt, Human
ugugccugauggucacguggcc

SEQ ID NO: 1067489 - RNA, 22 nt, Human
gccuucucccuaaccaaauccu

SEQ ID NO: 1067490 - RNA, 22 nt, Human
cuuugaaauucuucagcugaag

SEQ ID NO: 1067491 - RNA, 22 nt, Human
ugugccuggaucucugugacaa

SEQ ID NO: 1067492 - RNA, 22 nt, Human
aucagaggaaauuaacucucuc

SEQ ID NO: 1067493 - RNA, 22 nt, Human
uuuuaaacugcagaauuuagaa

SEQ ID NO: 1067494 - RNA, 22 nt, Human
agccuggcccugcugaacucug

SEQ ID NO: 1067495 - RNA, 22 nt, Human
acagaacauggauuuuugaagu

SEQ ID NO: 1067496 - RNA, 22 nt, Human
ucacaucuguugauacagcauc

SEQ ID NO: 1067497 - RNA, 22 nt, Human
cuuuucucuuacauuccacugg

SEQ ID NO: 1067498 - RNA, 22 nt, Human
ccaggagcagggcuggcugcac

SEQ ID NO: 1067499 - RNA, 22 nt, Human
cugggagaugacucagagcagg

SEQ ID NO: 1067500 - RNA, 22 nt, Human
uuggaccaaauuaaaaguuggc

SEQ ID NO: 1067501 - RNA, 22 nt, Human
aguucuuuucuagauucuggau

SEQ ID NO: 1067502 - RNA, 22 nt, Human
gcugccagcuuuccuuggcuga

SEQ ID NO: 1067503 - RNA, 22 nt, Human
gcucucagaugcuccagcagcc

SEQ ID NO: 1067504 - RNA, 22 nt, Human
uuugagaaaugggcucugugcu

SEQ ID NO: 1067505 - RNA, 22 nt, Human
ggcucugucaccuaugagcuga

SEQ ID NO: 1067506 - RNA, 22 nt, Human
ucgcagaggcacgagugcagaa

SEQ ID NO: 1067507 - RNA, 22 nt, Human
gccagguguaguggccacaccu

SEQ ID NO: 1067508 - RNA, 22 nt, Human
aaagagaaaaugaucuguacau

SEQ ID NO: 1067509 - RNA, 22 nt, Human
uaaaagaagcuucaaggccggc

SEQ ID NO: 1067510 - RNA, 17 nt, Human
uggcaagaauggaaaug

SEQ ID NO: 1067511 - RNA, 22 nt, Human
agcccucaggcuuugcugggcc

SEQ ID NO: 1067512 - RNA, 22 nt, Human
caggcugcagaggccuuucaug

SEQ ID NO: 1067513 - RNA, 22 nt, Human
aggacuuagaacauuauguacu

SEQ ID NO: 1067514 - RNA, 22 nt, Human
uuucuguagggauuucacaguu

SEQ ID NO: 1067515 - RNA, 22 nt, Human
cuugggagacacaagaagacau

SEQ ID NO: 1067516 - RNA, 22 nt, Human
gcagagccccauugcuggcggg

SEQ ID NO: 1067517 - RNA, 22 nt, Human
agucagucaccauuuaagaaca

SEQ ID NO: 1067518 - RNA, 18 nt, Human
ucauucauuaaacuuggc

SEQ ID NO: 1067519 - RNA, 22 nt, Human
gaggcugguucugaaguacugu

SEQ ID NO: 1067520 - RNA, 21 nt, Human
ccugagccuguuuauccagaa

SEQ ID NO: 1067521 - RNA, 22 nt, Human
cccuggaggaccccaauguggc

SEQ ID NO: 1067522 - RNA, 22 nt, Human
cagagcugugauaaauagauau

SEQ ID NO: 1067523 - RNA, 22 nt, Human
ggaaaucaucugauuggcuuuc

SEQ ID NO: 1067524 - RNA, 23 nt, Human
agcaggaaaccgagggugauguu

SEQ ID NO: 1067525 - RNA, 20 nt, Human
gcccuggagccuuguccugg

SEQ ID NO: 1067526 - RNA, 22 nt, Human
cugaaaugggcaaaaguagauu

SEQ ID NO: 1067527 - RNA, 22 nt, Human
aagcacagacacaaaaggcuuu

SEQ ID NO: 1067528 - RNA, 22 nt, Human
uggagcugguucuggggaagcu

SEQ ID NO: 1067529 - RNA, 22 nt, Human
agcagacagguaggaggauaaa

SEQ ID NO: 1067530 - RNA, 22 nt, Human
uguccuuuucuuuagugcagcu

SEQ ID NO: 1067531 - RNA, 22 nt, Human
aaaguuuuauucaagcauuagu

SEQ ID NO: 1067532 - RNA, 22 nt, Human
cugcugaugaccucaaacucuu

SEQ ID NO: 1067533 - RNA, 22 nt, Human
ccugccugacagagaagguuca

SEQ ID NO: 1067534 - RNA, 23 nt, Human
agcagggccagaauacuugcugu

SEQ ID NO: 1067535 - RNA, 22 nt, Human
augcuguauacauaugaaauua

SEQ ID NO: 1067536 - RNA, 22 nt, Human
uggcaagaauauuggaccagaa

SEQ ID NO: 1067537 - RNA, 22 nt, Human
agagccagcaagugaauaguga

SEQ ID NO: 1067538 - RNA, 22 nt, Human
cacagcugugagaagggagccu

SEQ ID NO: 1067539 - RNA, 22 nt, Human
gaggcucagagacuuuaaguuu

SEQ ID NO: 1067540 - RNA, 22 nt, Human
auucacaguauggacgaaauga

SEQ ID NO: 1067541 - RNA, 22 nt, Human
ugaagagaagaaaauuaucuuu

SEQ ID NO: 1067542 - RNA, 22 nt, Human
gcuuuuuugcuauugaaguggu

SEQ ID NO: 1067543 - RNA, 22 nt, Human
gcagagcuccccaagacaccaa

SEQ ID NO: 1067544 - RNA, 22 nt, Human
auuucuuacauaacaaauuguu

SEQ ID NO: 1067545 - RNA, 22 nt, Human
ucugcuggucaaggcugggucc

SEQ ID NO: 1067546 - RNA, 22 nt, Human
caacugcuuggaggaauacugc

SEQ ID NO: 1067547 - RNA, 22 nt, Human
guuuuucugugagcgguaaagg

SEQ ID NO: 1067548 - RNA, 22 nt, Human
cucccaagggguaagggagcug

SEQ ID NO: 1067549 - RNA, 22 nt, Human
uugaaagugccaaguccuagug

SEQ ID NO: 1067550 - RNA, 20 nt, Human
uucaggauucuagaccacac

SEQ ID NO: 1067551 - RNA, 22 nt, Human
aggcacacagaccccagcaagu

SEQ ID NO: 1067552 - RNA, 22 nt, Human
acaaauuucauaggcaaauuuu

SEQ ID NO: 1067553 - RNA, 22 nt, Human
gcccugcucauuucacguguuu

SEQ ID NO: 1067554 - RNA, 22 nt, Human
ggcucagcuuggugcgcagaaa

SEQ ID NO: 1067555 - RNA, 22 nt, Human
ccugcuggcgcuugucugggag

SEQ ID NO: 1067556 - RNA, 22 nt, Human
gggaccugggccagaggacagu

SEQ ID NO: 1067557 - RNA, 22 nt, Human
cagugcccuuccaggacugcag

SEQ ID NO: 1067558 - RNA, 22 nt, Human
acagagucauucauuguccagu

SEQ ID NO: 1067559 - RNA, 22 nt, Human
cuucucaguugcaagugucaga

SEQ ID NO: 1067560 - RNA, 22 nt, Human
guugaaagcuuuucauuuaguu

SEQ ID NO: 1067561 - RNA, 21 nt, Human
cacagaauauacauuuuaguu

SEQ ID NO: 1067562 - RNA, 22 nt, Human
gcauuucaugccguggaagucc

SEQ ID NO: 1067563 - RNA, 22 nt, Human
uucaaguagucacacaugauau

SEQ ID NO: 1067564 - RNA, 21 nt, Human
uccugggaagcacuggggugg

SEQ ID NO: 1067565 - RNA, 22 nt, Human
acucucagaggguggcagcaau

SEQ ID NO: 1067566 - RNA, 22 nt, Human
acuuuuaucaaggaagugaucu

SEQ ID NO: 1067567 - RNA, 19 nt, Human
cuguccugguuuggucccu

SEQ ID NO: 1067568 - RNA, 22 nt, Human
agacccugcaccucucgugggc

SEQ ID NO: 1067569 - RNA, 22 nt, Human
agaugugguaguugaagggaag

SEQ ID NO: 1067570 - RNA, 20 nt, Human
aggcagacaaggagucuguu

SEQ ID NO: 1067571 - RNA, 22 nt, Human
aggcugugcucagccaauggga

SEQ ID NO: 1067572 - RNA, 22 nt, Human
guggccaggccgacugccaggc

SEQ ID NO: 1067573 - RNA, 22 nt, Human
ugcuaaguucugcaaaagauaa

SEQ ID NO: 1067574 - RNA, 22 nt, Human
uccaggcuaauuuugcauuguu

SEQ ID NO: 1067575 - RNA, 22 nt, Human
uaucuacuccucuuucagaugc

SEQ ID NO: 1067576 - RNA, 22 nt, Human
uacauucuacuuuuucacuccc

SEQ ID NO: 1067577 - RNA, 22 nt, Human
gcacugggaaugugagcagcug

SEQ ID NO: 1067578 - RNA, 22 nt, Human
agcgcaggaacacgucugccuu

SEQ ID NO: 1067579 - RNA, 22 nt, Human
agaacacacgucagaguuuccu

SEQ ID NO: 1067580 - RNA, 22 nt, Human
uauauagaaaagcagauguugg

SEQ ID NO: 1067581 - RNA, 22 nt, Human
ccaggguggaggcuggauggag

SEQ ID NO: 1067582 - RNA, 22 nt, Human
gcuuuuuugggaugccugccuu

SEQ ID NO: 1067583 - RNA, 22 nt, Human
ugcaauaacccaguaucuguga

SEQ ID NO: 1067584 - RNA, 22 nt, Human
ucaaugaugcugaagguagcgu

SEQ ID NO: 1067585 - RNA, 22 nt, Human
agcccagcuuugaaccauauca

SEQ ID NO: 1067586 - RNA, 22 nt, Human
aguacagauuuagacacgauag

SEQ ID NO: 1067587 - RNA, 22 nt, Human
cccagggcuuuucucacuagac

SEQ ID NO: 1067588 - RNA, 22 nt, Human
ugaaggcacuugccuaggggca

SEQ ID NO: 1067589 - RNA, 22 nt, Human
agcagccagagucugaacauua

SEQ ID NO: 1067590 - RNA, 22 nt, Human
gaggacagugugaucugccagc

SEQ ID NO: 1067591 - RNA, 22 nt, Human
gccaggccugcaagugcuggug

SEQ ID NO: 1067592 - RNA, 22 nt, Human
agcagccacccagcugcucauu

SEQ ID NO: 1067593 - RNA, 22 nt, Human
uguggggccucgugcuagcugg

SEQ ID NO: 1067594 - RNA, 22 nt, Human
agaaggcacucacacuggcacg

SEQ ID NO: 1067595 - RNA, 21 nt, Human
auucagaaagggaauaaacuc

SEQ ID NO: 1067596 - RNA, 22 nt, Human
cagguggggagaguguggagca

SEQ ID NO: 1067597 - RNA, 22 nt, Human
ggugggcaacauuuggccugag

SEQ ID NO: 1067598 - RNA, 23 nt, Human
uuaaaaguggagagagaagcugg

SEQ ID NO: 1067599 - RNA, 22 nt, Human
uagaaaauguuccacugccauu

SEQ ID NO: 1067600 - RNA, 20 nt, Human
aggagccauugacugcagca

SEQ ID NO: 1067601 - RNA, 22 nt, Human
ugcagcuagcgugccuagugaa

SEQ ID NO: 1067602 - RNA, 17 nt, Human
gcagaaaagucaaggga

SEQ ID NO: 1067603 - RNA, 22 nt, Human
cuuggggcugucacucuggcau

SEQ ID NO: 1067604 - RNA, 22 nt, Human
cacugcaaccuccagcucucag

SEQ ID NO: 1067605 - RNA, 22 nt, Human
aaaucuuucccuuuacuaucca

SEQ ID NO: 1067606 - RNA, 22 nt, Human
acugucuccucaucaugccugg

SEQ ID NO: 1067607 - RNA, 22 nt, Human
gcagguggagcaguagucuggu

SEQ ID NO: 1067608 - RNA, 22 nt, Human
ugugaugguucacugggcauga

SEQ ID NO: 1067609 - RNA, 21 nt, Human
guuauacauucuauggauuug

SEQ ID NO: 1067610 - RNA, 22 nt, Human
uucaaagaccuuacuuggcaaa

SEQ ID NO: 1067611 - RNA, 22 nt, Human
cacucucagcauaaugaaugug

SEQ ID NO: 1067612 - RNA, 22 nt, Human
gagccaggguuugaaacuagac

SEQ ID NO: 1067613 - RNA, 22 nt, Human
aaagaauacuccuuuugccuug

SEQ ID NO: 1067614 - RNA, 22 nt, Human
ugaaaugagauagauaaucagg

SEQ ID NO: 1067615 - RNA, 22 nt, Human
aaagacauggaacuagagaugg

SEQ ID NO: 1067616 - RNA, 22 nt, Human
gcuggagccuucugcucuguug

SEQ ID NO: 1067617 - RNA, 22 nt, Human
gcugccuggauuugcaauccuc

SEQ ID NO: 1067618 - RNA, 22 nt, Human
gucacaggaagcagcaggcacu

SEQ ID NO: 1067619 - RNA, 22 nt, Human
gcaggaggccagguaugcuuua

SEQ ID NO: 1067620 - RNA, 22 nt, Human
caggcagacauuuuugacauag

SEQ ID NO: 1067621 - RNA, 22 nt, Human
gaauauuuucaguacagauggu

SEQ ID NO: 1067622 - RNA, 22 nt, Human
cuucagugauauaggcuucucc

SEQ ID NO: 1067623 - RNA, 22 nt, Human
aaacagcaggaacaucuugcca

SEQ ID NO: 1067624 - RNA, 22 nt, Human
auccugggcagugugucacucu

SEQ ID NO: 1067625 - RNA, 22 nt, Human
uuccauaacugaccgaaugcau

SEQ ID NO: 1067626 - RNA, 22 nt, Human
gagaagggcuugggagucaaca

SEQ ID NO: 1067627 - RNA, 22 nt, Human
cucccuggaggugagcuggcac

SEQ ID NO: 1067628 - RNA, 22 nt, Human
cagacuuucaaggagugaaggc

SEQ ID NO: 1067629 - RNA, 22 nt, Human
aaaaguuuaagacucauucuag

SEQ ID NO: 1067630 - RNA, 22 nt, Human
uggccucugcaauggauucacc

SEQ ID NO: 1067631 - RNA, 22 nt, Human
caagcuacucaggcaagaugug

SEQ ID NO: 1067632 - RNA, 23 nt, Human
agacccagagacuggcucugcuc

SEQ ID NO: 1067633 - RNA, 22 nt, Human
acuauacaagauuagggauuug

SEQ ID NO: 1067634 - RNA, 22 nt, Human
aguucuuugugauggaaauuua

SEQ ID NO: 1067635 - RNA, 22 nt, Human
agcaugaagacuucagagcuag

SEQ ID NO: 1067636 - RNA, 22 nt, Human
acugcuggggcucauucaucuc

SEQ ID NO: 1067637 - RNA, 22 nt, Human
guguuuuauggagucauaacgu

SEQ ID NO: 1067638 - RNA, 22 nt, Human
uugugugugagccuucaccaca

SEQ ID NO: 1067639 - RNA, 22 nt, Human
ggcugagaacaggcccagccuc

SEQ ID NO: 1067640 - RNA, 22 nt, Human
agcuuaaaguauuuaaauuuca

SEQ ID NO: 1067641 - RNA, 22 nt, Human
caggaaauuuauguucuacuua

SEQ ID NO: 1067642 - RNA, 22 nt, Human
cauuuguaguuaaaaaugucuc

SEQ ID NO: 1067643 - RNA, 22 nt, Human
uucauguguauggaacauuuuu

SEQ ID NO: 1067644 - RNA, 22 nt, Human
ggcagugagaggucuccugguc

SEQ ID NO: 1067645 - RNA, 22 nt, Human
uaacaguugguguaauuucuug

SEQ ID NO: 1067646 - RNA, 22 nt, Human
augauuuuucagcagaggaucu

SEQ ID NO: 1067647 - RNA, 22 nt, Human
aaggcugagagucacaguccua

SEQ ID NO: 1067648 - RNA, 22 nt, Human
caugaacauucagaaauacagc

SEQ ID NO: 1067649 - RNA, 22 nt, Human
ggcucagaccucccagcuccag

SEQ ID NO: 1067650 - RNA, 22 nt, Human
acuagcagggauguuauuacuu

SEQ ID NO: 1067651 - RNA, 22 nt, Human
uuucuucugagaucagggagaa

SEQ ID NO: 1067652 - RNA, 22 nt, Human
ugacuuuaagcuaucugauucu

SEQ ID NO: 1067653 - RNA, 22 nt, Human
gccugcagugagugcagaaggu

SEQ ID NO: 1067654 - RNA, 22 nt, Human
auggcagagaaagcgagccaca

SEQ ID NO: 1067655 - RNA, 22 nt, Human
aaguguuuaaugguuuugauga

SEQ ID NO: 1067656 - RNA, 22 nt, Human
cuggcagguccagcuggacuca

SEQ ID NO: 1067657 - RNA, 22 nt, Human
gaagggugugugugagggacac

SEQ ID NO: 1067658 - RNA, 22 nt, Human
aggaaucagaauucuuagaauu

SEQ ID NO: 1067659 - RNA, 22 nt, Human
ugggaagcugcauuuuaacaag

SEQ ID NO: 1067660 - RNA, 22 nt, Human
gcuggggaccagcugucucuga

SEQ ID NO: 1067661 - RNA, 22 nt, Human
gucccacugggcaacuagaaaa

SEQ ID NO: 1067662 - RNA, 22 nt, Human
ucagaauuuugguuugguuggu

SEQ ID NO: 1067663 - RNA, 22 nt, Human
auauuuguauuucgugugugua

SEQ ID NO: 1067664 - RNA, 22 nt, Human
aagcagagccugagacagggau

SEQ ID NO: 1067665 - RNA, 23 nt, Human
cagcuucuuugggauucuuuaua

SEQ ID NO: 1067666 - RNA, 22 nt, Human
ugcauuccuccaccuccugcac

SEQ ID NO: 1067667 - RNA, 23 nt, Human
cagugugacgaggugaggcaggc

SEQ ID NO: 1067668 - RNA, 22 nt, Human
gagcacagaacuaaaugcuggu

SEQ ID NO: 1067669 - RNA, 22 nt, Human
guggugcauccuugaguaagcu

SEQ ID NO: 1067670 - RNA, 22 nt, Human
aaucagaaagaucuugaugaga

SEQ ID NO: 1067671 - RNA, 22 nt, Human
ggggcccuuguggcugcaggcc

SEQ ID NO: 1067672 - RNA, 22 nt, Human
uucacaggaauguaggggucuu

SEQ ID NO: 1067673 - RNA, 22 nt, Human
uccaaagggaagcgcuuucugu

SEQ ID NO: 1067674 - RNA, 22 nt, Human
cugagauggucucuuuguuacu

SEQ ID NO: 1067675 - RNA, 22 nt, Human
gaggaacaugaggugaccuggg

SEQ ID NO: 1067676 - RNA, 22 nt, Human
cuggcucccguuguccuugaag

SEQ ID NO: 1067677 - RNA, 22 nt, Human
cuggaagaggaagccagcugga

SEQ ID NO: 1067678 - RNA, 22 nt, Human
agcagggcuccauuucacugcc

SEQ ID NO: 1067679 - RNA, 22 nt, Human
ggccugcucuguuuagaggggg

SEQ ID NO: 1067680 - RNA, 22 nt, Human
ugcaaaugggcaucuccaagug

SEQ ID NO: 1067681 - RNA, 23 nt, Human
ucugucacuuucugcuguggagu

SEQ ID NO: 1067682 - RNA, 22 nt, Human
gcccugagacugagcauggguu

SEQ ID NO: 1067683 - RNA, 22 nt, Human
agagugaucagauaucaggugu

SEQ ID NO: 1067684 - RNA, 22 nt, Human
uucugagaagggugggucuggc

SEQ ID NO: 1067685 - RNA, 22 nt, Human
agggcacaagacucugagcccc

SEQ ID NO: 1067686 - RNA, 22 nt, Human
gcaggagccaggccgagcuggu

SEQ ID NO: 1067687 - RNA, 22 nt, Human
cucccagggccaucgagucacu

SEQ ID NO: 1067688 - RNA, 22 nt, Human
ucucagagauuuauggaaaacu

SEQ ID NO: 1067689 - RNA, 22 nt, Human
uaacagaaacagauaaguguaa

SEQ ID NO: 1067690 - RNA, 22 nt, Human
aggagguggcaacugucgacag

SEQ ID NO: 1067691 - RNA, 22 nt, Human
cccaaggccucuccuuggcuug

SEQ ID NO: 1067692 - RNA, 22 nt, Human
guuugcauauuugcacaggaau

SEQ ID NO: 1067693 - RNA, 22 nt, Human
cugcccaggaaccagaggggca

SEQ ID NO: 1067694 - RNA, 22 nt, Human
gcagaugggagccccaggggag

SEQ ID NO: 1067695 - RNA, 22 nt, Human
agaaaugcucaggucaacuuaa

SEQ ID NO: 1067696 - RNA, 22 nt, Human
uucuacaucacuuaacaugcua

SEQ ID NO: 1067697 - RNA, 22 nt, Human
agugcugggauugcaggcauga

SEQ ID NO: 1067698 - RNA, 22 nt, Human
agugcugggauuacaggcauaa

SEQ ID NO: 1067699 - RNA, 22 nt, Human
ggcuuccuuucacuacccucag

SEQ ID NO: 1067700 - RNA, 22 nt, Human
guggcagcugguaugcagacag

SEQ ID NO: 1067701 - RNA, 22 nt, Human
gucugagaggaggcagccucgg

SEQ ID NO: 1067702 - RNA, 22 nt, Human
gaccuucaagcaccauauuuau

SEQ ID NO: 1067703 - RNA, 21 nt, Human
gcuuccaagauggcaccuuga

SEQ ID NO: 1067704 - RNA, 22 nt, Human
cuggagcauccaugcccagggu

SEQ ID NO: 1067705 - RNA, 21 nt, Human
gccuggcucucacuggccugg

SEQ ID NO: 1067706 - RNA, 22 nt, Human
uccuguggaagacaguguuggg

SEQ ID NO: 1067707 - RNA, 22 nt, Human
uugauauucccgauuuaaggua

SEQ ID NO: 1067708 - RNA, 22 nt, Human
aagcagccaccucaucuccacu

SEQ ID NO: 1067709 - RNA, 22 nt, Human
ugagcuuccucccugcauccau

SEQ ID NO: 1067710 - RNA, 22 nt, Human
aucaaauuaugugcuacaagaa

SEQ ID NO: 1067711 - RNA, 22 nt, Human
ucugccuggcggacucccggaa

SEQ ID NO: 1067712 - RNA, 22 nt, Human
agugauucuuuaaagugguauu

SEQ ID NO: 1067713 - RNA, 22 nt, Human
caagcagacaguaggccuagaa

SEQ ID NO: 1067714 - RNA, 22 nt, Human
cagaaugggaaggacugcaguu

SEQ ID NO: 1067715 - RNA, 22 nt, Human
augaggcaucugcagucacuag

SEQ ID NO: 1067716 - RNA, 22 nt, Human
acaaaugucuacauugagaaua

SEQ ID NO: 1067717 - RNA, 22 nt, Human
uuggucuuuucuauuaaauaua

SEQ ID NO: 1067718 - RNA, 22 nt, Human
uuuccauauucugcgucugcca

SEQ ID NO: 1067719 - RNA, 22 nt, Human
ccugagagagaagcgaccuggu

SEQ ID NO: 1067720 - RNA, 22 nt, Human
acagggcaccugagguaggaag

SEQ ID NO: 1067721 - RNA, 22 nt, Human
caugaaaucugaguauguuucc

SEQ ID NO: 1067722 - RNA, 22 nt, Human
uccuccuccucacagucaccug

SEQ ID NO: 1067723 - RNA, 22 nt, Human
aaaaucugguaauuugaaugug

SEQ ID NO: 1067724 - RNA, 22 nt, Human
auccaaagauggaaagaacuuu

SEQ ID NO: 1067725 - RNA, 23 nt, Human
acugagccagggccugggucagc

SEQ ID NO: 1067726 - RNA, 22 nt, Human
guauuacaaauaaauguuacug

SEQ ID NO: 1067727 - RNA, 22 nt, Human
cugcuggaaguuugcuguggau

SEQ ID NO: 1067728 - RNA, 22 nt, Human
cauuauggcagccaggauauug

SEQ ID NO: 1067729 - RNA, 22 nt, Human
gcaggggaguggaugauggauu

SEQ ID NO: 1067730 - RNA, 22 nt, Human
uuuaucugaccucacuucuuaa

SEQ ID NO: 1067731 - RNA, 22 nt, Human
ucaccaggcuggaaugcagugg

SEQ ID NO: 1067732 - RNA, 22 nt, Human
ccuacagacaaaccagugacua

SEQ ID NO: 1067733 - RNA, 22 nt, Human
ugcuuucuuuagcuccugaguc

SEQ ID NO: 1067734 - RNA, 22 nt, Human
uuggcaggaauauugcagaggu

SEQ ID NO: 1067735 - RNA, 22 nt, Human
ugcagcuucuccaucuccuugu

SEQ ID NO: 1067736 - RNA, 22 nt, Human
gcaauacaguugaagagauuga

SEQ ID NO: 1067737 - RNA, 22 nt, Human
ucacaauuguuuuuaggaucaa

SEQ ID NO: 1067738 - RNA, 22 nt, Human
ucugggagguaaccaugcugau

SEQ ID NO: 1067739 - RNA, 22 nt, Human
cacauuuagguuccuauagcca

SEQ ID NO: 1067740 - RNA, 17 nt, Human
aaauaugaccucaaagu

SEQ ID NO: 1067741 - RNA, 22 nt, Human
cagaagacugcagggaagggac

SEQ ID NO: 1067742 - RNA, 22 nt, Human
auuaaggaagccuauucucucc

SEQ ID NO: 1067743 - RNA, 22 nt, Human
auggcagggcagccucucagag

SEQ ID NO: 1067744 - RNA, 22 nt, Human
gggacaggccccucgcuagcuu

SEQ ID NO: 1067745 - RNA, 22 nt, Human
uuccaaguugagcgauuuuccu

SEQ ID NO: 1067746 - RNA, 22 nt, Human
aucuuuuugacauggugauggu

SEQ ID NO: 1067747 - RNA, 22 nt, Human
cccucugccucugaguaggaca

SEQ ID NO: 1067748 - RNA, 22 nt, Human
gagagcuggauucuggauaggu

SEQ ID NO: 1067749 - RNA, 22 nt, Human
cuuccagcuuguggcgcuuucc

SEQ ID NO: 1067750 - RNA, 22 nt, Human
auuagaaugacagaaaugaggc

SEQ ID NO: 1067751 - RNA, 22 nt, Human
ccagucagggcaggagccuggu

SEQ ID NO: 1067752 - RNA, 22 nt, Human
cagggugacugcccuggccacu

SEQ ID NO: 1067753 - RNA, 22 nt, Human
auucuuuuuuaaggaauagaac

SEQ ID NO: 1067754 - RNA, 22 nt, Human
uauuucuugagacucgucuucc

SEQ ID NO: 1067755 - RNA, 22 nt, Human
aggcuuccuggaggaagaggua

SEQ ID NO: 1067756 - RNA, 22 nt, Human
agggccugcaucaggagcuugg

SEQ ID NO: 1067757 - RNA, 22 nt, Human
ucagggcacugucaccugauau

SEQ ID NO: 1067758 - RNA, 22 nt, Human
aggaaccagagguugagcaacu

SEQ ID NO: 1067759 - RNA, 22 nt, Human
ucauuugugcugucagcaugca

SEQ ID NO: 1067760 - RNA, 22 nt, Human
acauguauugacauuauauucu

SEQ ID NO: 1067761 - RNA, 20 nt, Human
uccacaucuuuugagaugug

SEQ ID NO: 1067762 - RNA, 18 nt, Human
auauauugacaagaggga

SEQ ID NO: 1067763 - RNA, 22 nt, Human
ugcuggcuacauuauugcuguc

SEQ ID NO: 1067764 - RNA, 22 nt, Human
ccaguuaguuaaaggcgcagua

SEQ ID NO: 1067765 - RNA, 22 nt, Human
aauaguuugaauuuaucagaug

SEQ ID NO: 1067766 - RNA, 22 nt, Human
cucuucaguaaaugacacuguu

SEQ ID NO: 1067767 - RNA, 22 nt, Human
acaaugaauacuaagcaccagg

SEQ ID NO: 1067768 - RNA, 22 nt, Human
acacauuaaccuuugaaauucu

SEQ ID NO: 1067769 - RNA, 22 nt, Human
ucugcaggccucgacaaggcca

SEQ ID NO: 1067770 - RNA, 22 nt, Human
ccaggacagugaacauguaaga

SEQ ID NO: 1067771 - RNA, 23 nt, Human
agcacagacuagaaaggucuuuc

SEQ ID NO: 1067772 - RNA, 22 nt, Human
aacuugaaaaccucaugaauug

SEQ ID NO: 1067773 - RNA, 22 nt, Human
aaaugaguuugccucuagauag

SEQ ID NO: 1067774 - RNA, 22 nt, Human
auaaaaaggacagauguggucu

SEQ ID NO: 1067775 - RNA, 22 nt, Human
augaaguucucaauaaucaugu

SEQ ID NO: 1067776 - RNA, 22 nt, Human
ugggccuggagcccuggagagu

SEQ ID NO: 1067777 - RNA, 22 nt, Human
cauauucuguuggucacauaga

SEQ ID NO: 1067778 - RNA, 22 nt, Human
ucagauauucaauuaaguuaaa

SEQ ID NO: 1067779 - RNA, 22 nt, Human
uauuuguagaauggauuaaggg

SEQ ID NO: 1067780 - RNA, 22 nt, Human
ccaucagcuccaguaucuucug

SEQ ID NO: 1067781 - RNA, 18 nt, Human
cagauccaggcagcuauu

SEQ ID NO: 1067782 - RNA, 22 nt, Human
gccagaggaacgcugcgcgccc

SEQ ID NO: 1067783 - RNA, 22 nt, Human
gggcucugggauucagagcaag

SEQ ID NO: 1067784 - RNA, 21 nt, Human
cccaggucguggucuucccag

SEQ ID NO: 1067785 - RNA, 22 nt, Human
cagguaagagacggauuggccc

SEQ ID NO: 1067786 - RNA, 22 nt, Human
gagggcugccacguugggcgag

SEQ ID NO: 1067787 - RNA, 22 nt, Human
aagguaggcucaggguuguucu

SEQ ID NO: 1067788 - RNA, 22 nt, Human
aggugagaaaacgaggguugca

SEQ ID NO: 1067789 - RNA, 22 nt, Human
ggagggugcauuuuacccugug

SEQ ID NO: 1067790 - RNA, 22 nt, Human
caggaagaggacaggcuucccc

SEQ ID NO: 1067791 - RNA, 22 nt, Human
ugcaaaugcccauuuauuuucu

SEQ ID NO: 1067792 - RNA, 22 nt, Human
ucaggcucuggguacaccugac

SEQ ID NO: 1067793 - RNA, 22 nt, Human
cagccucuuuccacaucaggca

SEQ ID NO: 1067794 - RNA, 22 nt, Human
aacuauucuguggacucuuaua

SEQ ID NO: 1067795 - RNA, 22 nt, Human
aguauuuagagacacaagacgg

SEQ ID NO: 1067796 - RNA, 22 nt, Human
agcugaggaggaaugaugggua

SEQ ID NO: 1067797 - RNA, 22 nt, Human
ucuggcaggucaaucauucuuu

SEQ ID NO: 1067798 - RNA, 22 nt, Human
ggccugcuggcuccagcgcccg

SEQ ID NO: 1067799 - RNA, 22 nt, Human
guccucugcuucaugcccugau

SEQ ID NO: 1067800 - RNA, 22 nt, Human
aaggcagccucugccagccggg

SEQ ID NO: 1067801 - RNA, 22 nt, Human
cuccuugguguaguacugagca

SEQ ID NO: 1067802 - RNA, 22 nt, Human
ugcacacaggucuaggacaugg

SEQ ID NO: 1067803 - RNA, 22 nt, Human
gcagcacauauaaacaaagaga

SEQ ID NO: 1067804 - RNA, 22 nt, Human
ggcccugagcugaaguacugug

SEQ ID NO: 1067805 - RNA, 23 nt, Human
gcucaucaggcuuagagucaagg

SEQ ID NO: 1067806 - RNA, 22 nt, Human
ggaagcccagcugucuccuguc

SEQ ID NO: 1067807 - RNA, 22 nt, Human
accuggcuuccaaucuaggagc

SEQ ID NO: 1067808 - RNA, 22 nt, Human
acuauaaccuguuagaauagau

SEQ ID NO: 1067809 - RNA, 22 nt, Human
ucaggaggccaccaggaccugu

SEQ ID NO: 1067810 - RNA, 22 nt, Human
uacauuuucuaggggaccaaga

SEQ ID NO: 1067811 - RNA, 22 nt, Human
uggccugcagcucucagggaag

SEQ ID NO: 1067812 - RNA, 22 nt, Human
agagcagcacguuguccccaca

SEQ ID NO: 1067813 - RNA, 22 nt, Human
aggcucugcagaccccagcugu

SEQ ID NO: 1067814 - RNA, 22 nt, Human
ugggcugcuuccucagcugaga

SEQ ID NO: 1067815 - RNA, 22 nt, Human
aggacagcagccauuggcaguc

SEQ ID NO: 1067816 - RNA, 20 nt, Human
cagauaaacgggaaagaagc

SEQ ID NO: 1067817 - RNA, 22 nt, Human
accaggaauauuuugcucauuu

SEQ ID NO: 1067818 - RNA, 22 nt, Human
cauacaaucaaguucuuuauua

SEQ ID NO: 1067819 - RNA, 22 nt, Human
ggagccuguggccgucacgacu

SEQ ID NO: 1067820 - RNA, 22 nt, Human
acacucacccucccacugccug

SEQ ID NO: 1067821 - RNA, 19 nt, Human
uuuuguguagcugcugguu

SEQ ID NO: 1067822 - RNA, 22 nt, Human
gugcccugaggucuucacuuug

SEQ ID NO: 1067823 - RNA, 22 nt, Human
gucaauauagguuucaaacaug

SEQ ID NO: 1067824 - RNA, 22 nt, Human
cccugcacagccuggcucucuu

SEQ ID NO: 1067825 - RNA, 18 nt, Human
ccugugcuccagcaucug

SEQ ID NO: 1067826 - RNA, 22 nt, Human
ucuaaacugcuagcugacugag

SEQ ID NO: 1067827 - RNA, 20 nt, Human
auauuucuuaagaacuuuca

SEQ ID NO: 1067828 - RNA, 22 nt, Human
cagagcagguaucuuuggugaa

SEQ ID NO: 1067829 - RNA, 22 nt, Human
uugcaucaguccucaauaaaau

SEQ ID NO: 1067830 - RNA, 22 nt, Human
acacugaagagcacuuucaaag

SEQ ID NO: 1067831 - RNA, 20 nt, Human
agugucuggugcagggccuc

SEQ ID NO: 1067832 - RNA, 22 nt, Human
uggcucagcugacucggcuucu

SEQ ID NO: 1067833 - RNA, 22 nt, Human
uuauacauguguuuugagauga

SEQ ID NO: 1067834 - RNA, 22 nt, Human
aguguuuauggaaucuuaguua

SEQ ID NO: 1067835 - RNA, 22 nt, Human
agcuguccuggcucaggcugug

SEQ ID NO: 1067836 - RNA, 21 nt, Human
acagauauuucauugaacauu

SEQ ID NO: 1067837 - RNA, 22 nt, Human
ccuugcugaccaucaccuuuga

SEQ ID NO: 1067838 - RNA, 22 nt, Human
gccuuccuuuuaccaccagcca

SEQ ID NO: 1067839 - RNA, 19 nt, Human
gggcuuggggcugaagccu

SEQ ID NO: 1067840 - RNA, 22 nt, Human
acacagggggcauucuaggagu

SEQ ID NO: 1067841 - RNA, 22 nt, Human
gccucaggccuauagcugcugu

SEQ ID NO: 1067842 - RNA, 22 nt, Human
auucuuuuaagccccagggauu

SEQ ID NO: 1067843 - RNA, 22 nt, Human
gggcccugccuaaggaacacac

SEQ ID NO: 1067844 - RNA, 18 nt, Human
cacauuuaccuggcuccc

SEQ ID NO: 1067845 - RNA, 22 nt, Human
cuucagagcaucacuucagcug

SEQ ID NO: 1067846 - RNA, 22 nt, Human
ucucuuccaguaagagucuuua

SEQ ID NO: 1067847 - RNA, 22 nt, Human
gugcugucguggaacugggcug

SEQ ID NO: 1067848 - RNA, 22 nt, Human
uugaagcaggaaaauuucuauu

SEQ ID NO: 1067849 - RNA, 22 nt, Human
uacauugugauguuucaauaca

SEQ ID NO: 1067850 - RNA, 22 nt, Human
uucaugaagggugaauauaguc

SEQ ID NO: 1067851 - RNA, 22 nt, Human
uuugcauuuauaaguuggugga

SEQ ID NO: 1067852 - RNA, 22 nt, Human
ucaaauguaauuuauuguuuua

SEQ ID NO: 1067853 - RNA, 23 nt, Human
agggcaugaagcagaggacgugg

SEQ ID NO: 1067854 - RNA, 22 nt, Human
ggcuucugaaccaggcccugga

SEQ ID NO: 1067855 - RNA, 20 nt, Human
acacaagcacuucugguauu

SEQ ID NO: 1067856 - RNA, 22 nt, Human
cacucugacuggcccugcagga

SEQ ID NO: 1067857 - RNA, 22 nt, Human
ucugggcuugguuagggcuguu

SEQ ID NO: 1067858 - RNA, 22 nt, Human
uacagagagagggguuaccagg

SEQ ID NO: 1067859 - RNA, 20 nt, Human
ccugccuggccauuccuugg

SEQ ID NO: 1067860 - RNA, 22 nt, Human
agccagcuggugggucagcugg

SEQ ID NO: 1067861 - RNA, 22 nt, Human
gagggaagauuccccauauggg

SEQ ID NO: 1067862 - RNA, 22 nt, Human
uccucauucuuggugcaucaaa

SEQ ID NO: 1067863 - RNA, 22 nt, Human
ccugagccugaguggugcaggg

SEQ ID NO: 1067864 - RNA, 22 nt, Human
ugaagcaaacgcuucuguuccu

SEQ ID NO: 1067865 - RNA, 22 nt, Human
uguggcccagaugagugugcua

SEQ ID NO: 1067866 - RNA, 22 nt, Human
ggagucagaggaaggcuugcuc

SEQ ID NO: 1067867 - RNA, 22 nt, Human
auuucacaucuaucucagauuu

SEQ ID NO: 1067868 - RNA, 22 nt, Human
uucuucaaggguaaaggcaacg

SEQ ID NO: 1067869 - RNA, 22 nt, Human
uggugcugacaguucugagugc

SEQ ID NO: 1067870 - RNA, 22 nt, Human
uuuagaguuucuaaauggaauu

SEQ ID NO: 1067871 - RNA, 22 nt, Human
aaagcagacugauuugcaucac

SEQ ID NO: 1067872 - RNA, 19 nt, Human
aggcagaggcuuggcuagc

SEQ ID NO: 1067873 - RNA, 22 nt, Human
aagcauuuauagauaagaauuu

SEQ ID NO: 1067874 - RNA, 22 nt, Human
ccaggccuagccccugagggua

SEQ ID NO: 1067875 - RNA, 22 nt, Human
uuuagaggcugccuaucacaac

SEQ ID NO: 1067876 - RNA, 22 nt, Human
cuguauuuguccucuauuuauu

SEQ ID NO: 1067877 - RNA, 22 nt, Human
uucuuaaucccacaaaucuuca

SEQ ID NO: 1067878 - RNA, 22 nt, Human
aaagucauuguaauauaugcua

SEQ ID NO: 1067879 - RNA, 20 nt, Human
uguuaaaggacacuugcuuu

SEQ ID NO: 1067880 - RNA, 22 nt, Human
uugaaacugaguguguuugggg

SEQ ID NO: 1067881 - RNA, 22 nt, Human
aacaaauggaacacaaaucuuu

SEQ ID NO: 1067882 - RNA, 22 nt, Human
aaguaccuagaaauauuuuuga

SEQ ID NO: 1067883 - RNA, 22 nt, Human
ucacaaauagcuauauuaagga

SEQ ID NO: 1067884 - RNA, 22 nt, Human
cugagggccuuggcuccugccc

SEQ ID NO: 1067885 - RNA, 23 nt, Human
ugcagggcaaguuagagacccca

SEQ ID NO: 1067886 - RNA, 22 nt, Human
agggaggagaauggacuccuuc

SEQ ID NO: 1067887 - RNA, 22 nt, Human
uuuacacaaaauguuaguagau

SEQ ID NO: 1067888 - RNA, 22 nt, Human
cuggcugccacuucagggucuu

SEQ ID NO: 1067889 - RNA, 22 nt, Human
gggcaguguggucgugccuuug

SEQ ID NO: 1067890 - RNA, 20 nt, Human
ccuggaagagcuccccaggc

SEQ ID NO: 1067891 - RNA, 22 nt, Human
aggaagcccaagucucaucuuc

SEQ ID NO: 1067892 - RNA, 20 nt, Human
acauuuguaucucccagugg

SEQ ID NO: 1067893 - RNA, 22 nt, Human
aagggcugaaugaaggguugaa

SEQ ID NO: 1067894 - RNA, 22 nt, Human
cucaggauuuaaaggggcacuc

SEQ ID NO: 1067895 - RNA, 19 nt, Human
gcccucaugauauucagau

SEQ ID NO: 1067896 - RNA, 22 nt, Human
cuuguaaaagguacauuaugcu

SEQ ID NO: 1067897 - RNA, 22 nt, Human
cccaggaaagaauuuagagcca

SEQ ID NO: 1067898 - RNA, 22 nt, Human
agggcgaggagacggaggcaca

SEQ ID NO: 1067899 - RNA, 22 nt, Human
uaggaaaauaucucuuauuggg

SEQ ID NO: 1067900 - RNA, 22 nt, Human
cuauugaauuaacuauuaaagu

SEQ ID NO: 1067901 - RNA, 22 nt, Human
aaaugguaaugucuuucuguuu

SEQ ID NO: 1067902 - RNA, 22 nt, Human
cagaggcauuacugaaaaggug

SEQ ID NO: 1067903 - RNA, 17 nt, Human
cugucugcgcaugaggu

SEQ ID NO: 1067904 - RNA, 22 nt, Human
aucuggcucccuuggaauccgu

SEQ ID NO: 1067905 - RNA, 22 nt, Human
ugcuuccacuaaugagcugugu

SEQ ID NO: 1067906 - RNA, 19 nt, Human
aggcaggugcagagguccc

SEQ ID NO: 1067907 - RNA, 22 nt, Human
gcacagggaggcuggccuggcc

SEQ ID NO: 1067908 - RNA, 22 nt, Human
ugucaucagcauauaagacagu

SEQ ID NO: 1067909 - RNA, 22 nt, Human
guuaccauugucuaggucauug

SEQ ID NO: 1067910 - RNA, 22 nt, Human
uucuaaagccuguccuaucaga

SEQ ID NO: 1067911 - RNA, 22 nt, Human
augggcugugagguccggcagg

SEQ ID NO: 1067912 - RNA, 21 nt, Human
gcucucugcaugguggcucag

SEQ ID NO: 1067913 - RNA, 22 nt, Human
ucaguguuuccuagagcauaua

SEQ ID NO: 1067914 - RNA, 22 nt, Human
acacucuuucacuaccuuaauu

SEQ ID NO: 1067915 - RNA, 23 nt, Human
ucccagggaaggugagcgaggcu

SEQ ID NO: 1067916 - RNA, 22 nt, Human
gaugcccaggcccaaccaugga

SEQ ID NO: 1067917 - RNA, 22 nt, Human
agcagguguuggcugggccauc

SEQ ID NO: 1067918 - RNA, 22 nt, Human
augugaaaaauuucuuauuaca

SEQ ID NO: 1067919 - RNA, 22 nt, Human
acuuuguauaagacaauaaaga

SEQ ID NO: 1067920 - RNA, 22 nt, Human
cugggagauugcuagagaugca

SEQ ID NO: 1067921 - RNA, 22 nt, Human
ggccugugcugagaaccuggcu

SEQ ID NO: 1067922 - RNA, 22 nt, Human
guaaacaucgacccaacagggg

SEQ ID NO: 1067923 - RNA, 22 nt, Human
uaacagaaauauuuccagguga

SEQ ID NO: 1067924 - RNA, 22 nt, Human
ugcuggcugggcugcuggagac

SEQ ID NO: 1067925 - RNA, 22 nt, Human
agcugggcuggagcuccaagcg

SEQ ID NO: 1067926 - RNA, 22 nt, Human
cacagcagaacuuaauuucaaa

SEQ ID NO: 1067927 - RNA, 21 nt, Human
ugcaggcugugcgcuccugcc

SEQ ID NO: 1067928 - RNA, 22 nt, Human
agugaccaaucaugguuagauu

SEQ ID NO: 1067929 - RNA, 22 nt, Human
uuagaaagaacuuuagauauca

SEQ ID NO: 1067930 - RNA, 22 nt, Human
ucagagugguagccuauuuucu

SEQ ID NO: 1067931 - RNA, 22 nt, Human
uggagcuggaauuucugggccu

SEQ ID NO: 1067932 - RNA, 21 nt, Human
auauuucagauuuccguaauc

SEQ ID NO: 1067933 - RNA, 22 nt, Human
gggcuccagcccgggaccaggu

SEQ ID NO: 1067934 - RNA, 22 nt, Human
uauuucaccucacccaggagaa

SEQ ID NO: 1067935 - RNA, 22 nt, Human
agggcucugagugggaaagagg

SEQ ID NO: 1067936 - RNA, 22 nt, Human
aauguuuggacuggaagguccc

SEQ ID NO: 1067937 - RNA, 22 nt, Human
uugcaucagcaggcauaauugg

SEQ ID NO: 1067938 - RNA, 22 nt, Human
uccuugaaaaucuugguuuaga

SEQ ID NO: 1067939 - RNA, 22 nt, Human
aaacagcuuucagaaucucuca

SEQ ID NO: 1067940 - RNA, 22 nt, Human
uuucuccuugugucuccuuuga

SEQ ID NO: 1067941 - RNA, 22 nt, Human
uucuuuucugcagcugguauuu

SEQ ID NO: 1067942 - RNA, 22 nt, Human
gcuguggcugaccaccaggggg

SEQ ID NO: 1067943 - RNA, 22 nt, Human
acagggcagagaggcaggcuug

SEQ ID NO: 1067944 - RNA, 19 nt, Human
ucucaauguucagaaagcu

SEQ ID NO: 1067945 - RNA, 22 nt, Human
uuugaauguuuuagguacuuaa

SEQ ID NO: 1067946 - RNA, 23 nt, Human
caugccaguuugugcaggcagau

SEQ ID NO: 1067947 - RNA, 22 nt, Human
ucugccugugguggaggaaguu

SEQ ID NO: 1067948 - RNA, 22 nt, Human
ucugagccguauggcuuggcua

SEQ ID NO: 1067949 - RNA, 21 nt, Human
auucacagguauccucucccu

SEQ ID NO: 1067950 - RNA, 22 nt, Human
ugcugagaugaauagggcuguc

SEQ ID NO: 1067951 - RNA, 22 nt, Human
ggcacagcucaggucccagcuc

SEQ ID NO: 1067952 - RNA, 22 nt, Human
aaaaguauuggccaccauuucu

SEQ ID NO: 1067953 - RNA, 22 nt, Human
auggaagguccuacagagcgca

SEQ ID NO: 1067954 - RNA, 22 nt, Human
uugcauaaaugcuuaaaauuug

SEQ ID NO: 1067955 - RNA, 22 nt, Human
aucagaauaauuagauuucaga

SEQ ID NO: 1067956 - RNA, 22 nt, Human
cuauaauuaugcucaaaaugua

SEQ ID NO: 1067957 - RNA, 22 nt, Human
ggaggaguguggggcacucugc

SEQ ID NO: 1067958 - RNA, 22 nt, Human
agaggcaguauacaauccgagc

SEQ ID NO: 1067959 - RNA, 22 nt, Human
ucacaguuauagucuguagaau

SEQ ID NO: 1067960 - RNA, 22 nt, Human
aguaaugaagauuuguugcaca

SEQ ID NO: 1067961 - RNA, 22 nt, Human
auacaaguugcccaaaugauua

SEQ ID NO: 1067962 - RNA, 22 nt, Human
ccaucccuucaccacagcagua

SEQ ID NO: 1067963 - RNA, 22 nt, Human
ugugggcucccccucacucugu

SEQ ID NO: 1067964 - RNA, 20 nt, Human
uccagccacuuccgcugguc

SEQ ID NO: 1067965 - RNA, 22 nt, Human
gccaggagggaaaggacaauuu

SEQ ID NO: 1067966 - RNA, 22 nt, Human
uaugcuacuagaaauaaaaugg

SEQ ID NO: 1067967 - RNA, 22 nt, Human
ucugagugggaacucucaugac

SEQ ID NO: 1067968 - RNA, 22 nt, Human
gcagguggggcugcuaccagaa

SEQ ID NO: 1067969 - RNA, 22 nt, Human
gacagcagacagaacuaccugc

SEQ ID NO: 1067970 - RNA, 22 nt, Human
aggagcagaauuuaaugugcag

SEQ ID NO: 1067971 - RNA, 21 nt, Human
agagacugucacugcaguacc

SEQ ID NO: 1067972 - RNA, 22 nt, Human
caggcuggacauuagauacaua

SEQ ID NO: 1067973 - RNA, 22 nt, Human
caguaacaggcucugugguaua

SEQ ID NO: 1067974 - RNA, 22 nt, Human
gagacacagcagauauucaauc

SEQ ID NO: 1067975 - RNA, 22 nt, Human
ugccagugggugugcagagacu

SEQ ID NO: 1067976 - RNA, 22 nt, Human
ugcuuugacagggaugacauga

SEQ ID NO: 1067977 - RNA, 22 nt, Human
uuugcauuuccagaguagcaga

SEQ ID NO: 1067978 - RNA, 20 nt, Human
aggguggggacguucugacu

SEQ ID NO: 1067979 - RNA, 22 nt, Human
auauagaucaaaugaugcuaau

SEQ ID NO: 1067980 - RNA, 22 nt, Human
cccagagucucugcucuugccu

SEQ ID NO: 1067981 - RNA, 22 nt, Human
cugucuuuaguacaaaaaaugu

SEQ ID NO: 1067982 - RNA, 19 nt, Human
cucugccucccuccugggu

SEQ ID NO: 1067983 - RNA, 22 nt, Human
gggcugagugucccaggccgaa

SEQ ID NO: 1067984 - RNA, 22 nt, Human
agagaagggggaaagaucucac

SEQ ID NO: 1067985 - RNA, 22 nt, Human
gccuggucucuuucaugucagu

SEQ ID NO: 1067986 - RNA, 23 nt, Human
cccauuuucauguuaacuccugg

SEQ ID NO: 1067987 - RNA, 22 nt, Human
ggucaugcugugaaucagugcu

SEQ ID NO: 1067988 - RNA, 22 nt, Human
cccuuagcucaauuucuugccc

SEQ ID NO: 1067989 - RNA, 22 nt, Human
agcaaaucagcugcucaggaaa

SEQ ID NO: 1067990 - RNA, 22 nt, Human
uccaagaauacagauuugugaa

SEQ ID NO: 1067991 - RNA, 22 nt, Human
acaagauagguugagucuagcc

SEQ ID NO: 1067992 - RNA, 22 nt, Human
aggcagcaaaugucuggaacag

SEQ ID NO: 1067993 - RNA, 22 nt, Human
aaaggccacacugcucuuucuc

SEQ ID NO: 1067994 - RNA, 22 nt, Human
ugcagggcuacaggacuacaac

SEQ ID NO: 1067995 - RNA, 22 nt, Human
gaggaaccaccuuggguaggcu

SEQ ID NO: 1067996 - RNA, 22 nt, Human
uugcuuccaguccaagucuguu

SEQ ID NO: 1067997 - RNA, 22 nt, Human
gaguuauagauggacuauuauu

SEQ ID NO: 1067998 - RNA, 22 nt, Human
aaggggaauagaguggguugug

SEQ ID NO: 1067999 - RNA, 22 nt, Human
uagggcaggggaggaaucugaa

SEQ ID NO: 1068000 - RNA, 22 nt, Human
cuucacaguauaggucccugag

SEQ ID NO: 1068001 - RNA, 22 nt, Human
cccaggcuggauuucgguggca

SEQ ID NO: 1068002 - RNA, 22 nt, Human
caucaaauacuacauggguugg

SEQ ID NO: 1068003 - RNA, 21 nt, Human
ucauggccagcaaguggcaga

SEQ ID NO: 1068004 - RNA, 22 nt, Human
agagggcuggacgcagguugga

SEQ ID NO: 1068005 - RNA, 22 nt, Human
acuuuaaaacugaucaucagag

SEQ ID NO: 1068006 - RNA, 22 nt, Human
caucaguguuggcuucucagag

SEQ ID NO: 1068007 - RNA, 22 nt, Human
ucaggcuaagggagaggcgcuc

SEQ ID NO: 1068008 - RNA, 23 nt, Human
aaagcaaggaauuggcaacagag

SEQ ID NO: 1068009 - RNA, 22 nt, Human
agauacacagagcaucuucaga

SEQ ID NO: 1068010 - RNA, 22 nt, Human
aagacccuaccccuggagagga

SEQ ID NO: 1068011 - RNA, 23 nt, Human
acagccaguucaccucuccuugg

SEQ ID NO: 1068012 - RNA, 22 nt, Human
ggugacuggagggacccaggcc

SEQ ID NO: 1068013 - RNA, 22 nt, Human
aucuggcuuaccuagggugccu

SEQ ID NO: 1068014 - RNA, 23 nt, Human
cccagcagauuguaaagugucca

SEQ ID NO: 1068015 - RNA, 22 nt, Human
agauuuccaucuuuuucaugug

SEQ ID NO: 1068016 - RNA, 22 nt, Human
gcugcugggauccugggucuca

SEQ ID NO: 1068017 - RNA, 22 nt, Human
ggaaagcauccaggugccccca

SEQ ID NO: 1068018 - RNA, 22 nt, Human
gagaaacaggaauugagucgcu

SEQ ID NO: 1068019 - RNA, 22 nt, Human
uucuuucucaacaugaauguuu

SEQ ID NO: 1068020 - RNA, 22 nt, Human
agccacagcaacaagugcaauu

SEQ ID NO: 1068021 - RNA, 22 nt, Human
cuggccuggcagggagggcaug

SEQ ID NO: 1068022 - RNA, 22 nt, Human
acuuuuaugauaaucaauguuc

SEQ ID NO: 1068023 - RNA, 22 nt, Human
auuacagaaagcaauauugagu

SEQ ID NO: 1068024 - RNA, 22 nt, Human
guagaaaugguguguuucuucu

SEQ ID NO: 1068025 - RNA, 22 nt, Human
uccaggaagcaguguuuggagc

SEQ ID NO: 1068026 - RNA, 22 nt, Human
agccaggguuagaagauaguca

SEQ ID NO: 1068027 - RNA, 22 nt, Human
acugaaagauaaaucaguuagc

SEQ ID NO: 1068028 - RNA, 22 nt, Human
caaagauuuuagaauuugcaau

SEQ ID NO: 1068029 - RNA, 22 nt, Human
cugggcuguaauguggcacuga

SEQ ID NO: 1068030 - RNA, 22 nt, Human
uuuaccagaauugccaccagaa

SEQ ID NO: 1068031 - RNA, 17 nt, Human
uaacacaggcucagaga

SEQ ID NO: 1068032 - RNA, 22 nt, Human
ucuaaacuaggguuaaaggaaa

SEQ ID NO: 1068033 - RNA, 22 nt, Human
cauucucaauaguagaugagua

SEQ ID NO: 1068034 - RNA, 22 nt, Human
cagucccaaggaggaagcaguc

SEQ ID NO: 1068035 - RNA, 22 nt, Human
acagauggagcuacuagguaaa

SEQ ID NO: 1068036 - RNA, 22 nt, Human
ugcagggccuugggucuuucuu

SEQ ID NO: 1068037 - RNA, 22 nt, Human
gaggcucaacccacagggguug

SEQ ID NO: 1068038 - RNA, 22 nt, Human
ggcucugccugcccagcagcac

SEQ ID NO: 1068039 - RNA, 22 nt, Human
guggcagagggugagcuggacu

SEQ ID NO: 1068040 - RNA, 23 nt, Human
guccuauuuuuugaaauacugag

SEQ ID NO: 1068041 - RNA, 22 nt, Human
aggcugcagugcagguaggauu

SEQ ID NO: 1068042 - RNA, 22 nt, Human
agacagcacuuuuguauggggg

SEQ ID NO: 1068043 - RNA, 22 nt, Human
uggcagagaugaagaguuguuu

SEQ ID NO: 1068044 - RNA, 22 nt, Human
cugccuugcaccggcucucugg

SEQ ID NO: 1068045 - RNA, 19 nt, Human
ucauuguugguuugucggg

SEQ ID NO: 1068046 - RNA, 22 nt, Human
cugccucaugcugccugcagcc

SEQ ID NO: 1068047 - RNA, 21 nt, Human
ggccaguggccuugacuuucc

SEQ ID NO: 1068048 - RNA, 18 nt, Human
caguuacaccuucauuca

SEQ ID NO: 1068049 - RNA, 22 nt, Human
uguauuucgcuagguacucccu

SEQ ID NO: 1068050 - RNA, 22 nt, Human
uccagaauauuugggaaagaug

SEQ ID NO: 1068051 - RNA, 22 nt, Human
ugcucagcaaaaagcuugugag

SEQ ID NO: 1068052 - RNA, 22 nt, Human
uuuuaauccucuugguaucuua

SEQ ID NO: 1068053 - RNA, 22 nt, Human
uggaggugggagggacuguccu

SEQ ID NO: 1068054 - RNA, 22 nt, Human
aaagauuauggaacacacauga

SEQ ID NO: 1068055 - RNA, 22 nt, Human
ugucacauugaauaugauuuau

SEQ ID NO: 1068056 - RNA, 22 nt, Human
auaaggaaaugaaacucuaaua

SEQ ID NO: 1068057 - RNA, 22 nt, Human
augccaguaagucucagcuagg

SEQ ID NO: 1068058 - RNA, 21 nt, Human
aacauuucaggauccaaauug

SEQ ID NO: 1068059 - RNA, 21 nt, Human
gggcagcacgucauuccugug

SEQ ID NO: 1068060 - RNA, 22 nt, Human
uugaaaauaucacaggagcagc

SEQ ID NO: 1068061 - RNA, 22 nt, Human
uuugaacaggaguaucuauagu

SEQ ID NO: 1068062 - RNA, 18 nt, Human
uauaaacacacuuagguu

SEQ ID NO: 1068063 - RNA, 22 nt, Human
gacauuuacugaauacugauua

SEQ ID NO: 1068064 - RNA, 22 nt, Human
caacauguguuagacaauagac

SEQ ID NO: 1068065 - RNA, 23 nt, Human
ccaggcucuuucaccugcuauuc

SEQ ID NO: 1068066 - RNA, 22 nt, Human
ggcagaggaaggaugaauucac

SEQ ID NO: 1068067 - RNA, 22 nt, Human
uacaaguuucaaagagaucaug

SEQ ID NO: 1068068 - RNA, 22 nt, Human
ccagcugacgaugccuggucuc

SEQ ID NO: 1068069 - RNA, 22 nt, Human
accaaggaagagauucucaguu

SEQ ID NO: 1068070 - RNA, 22 nt, Human
gaagccaggggccugacaggca

SEQ ID NO: 1068071 - RNA, 22 nt, Human
aauguuuuagauuacugcuggg

SEQ ID NO: 1068072 - RNA, 22 nt, Human
gaaugaguuaauauuugcuugg

SEQ ID NO: 1068073 - RNA, 22 nt, Human
cagggugggcacccagccucca

SEQ ID NO: 1068074 - RNA, 22 nt, Human
acugaaaugaaaucuaucaucu

SEQ ID NO: 1068075 - RNA, 22 nt, Human
ccugcugugaccggggagcagg

SEQ ID NO: 1068076 - RNA, 17 nt, Human
uuuguacaacauuuuaa

SEQ ID NO: 1068077 - RNA, 22 nt, Human
ugcaggcucaccugccagggcc

SEQ ID NO: 1068078 - RNA, 22 nt, Human
ugggcucagccuucauguggcc

SEQ ID NO: 1068079 - RNA, 22 nt, Human
uggcuuccugcacagugucugc

SEQ ID NO: 1068080 - RNA, 22 nt, Human
aaugauauagcagacauagccu

SEQ ID NO: 1068081 - RNA, 22 nt, Human
caugucuugcccugauuaguag

SEQ ID NO: 1068082 - RNA, 22 nt, Human
aggcuucagaaagaguaauugg

SEQ ID NO: 1068083 - RNA, 22 nt, Human
auugcaaagaaauacaugcuua

SEQ ID NO: 1068084 - RNA, 19 nt, Human
ccagagucaugucuccccc

SEQ ID NO: 1068085 - RNA, 21 nt, Human
ugccagggauuuacagagccu

SEQ ID NO: 1068086 - RNA, 22 nt, Human
aggacuccauguguccuggaga

SEQ ID NO: 1068087 - RNA, 22 nt, Human
ucugaacagcauggaaucauuu

SEQ ID NO: 1068088 - RNA, 22 nt, Human
caggaaccuacaucuguuuggg

SEQ ID NO: 1068089 - RNA, 22 nt, Human
aaaagcaguuuauagucaguug

SEQ ID NO: 1068090 - RNA, 21 nt, Human
ucagggaagugugcagaaggg

SEQ ID NO: 1068091 - RNA, 22 nt, Human
ucuaacauuguuuuucacagau

SEQ ID NO: 1068092 - RNA, 22 nt, Human
ccagagaaagcucacaggcagu

SEQ ID NO: 1068093 - RNA, 22 nt, Human
caucaaaugccauauaugguug

SEQ ID NO: 1068094 - RNA, 22 nt, Human
cugcuguguuucacaccucugg

SEQ ID NO: 1068095 - RNA, 22 nt, Human
uugagagucauuuaagguguug

SEQ ID NO: 1068096 - RNA, 22 nt, Human
augcccuggggcuaccucugag

SEQ ID NO: 1068097 - RNA, 22 nt, Human
aggcagcauccagaggagaaug

SEQ ID NO: 1068098 - RNA, 22 nt, Human
uucuucaacaaggacacuguua

SEQ ID NO: 1068099 - RNA, 22 nt, Human
caaaucuaggaugcauguagug

SEQ ID NO: 1068100 - RNA, 22 nt, Human
aaaaacugcaauuacuuuuguc

SEQ ID NO: 1068101 - RNA, 22 nt, Human
gcugcucugaaaaugacuguug

SEQ ID NO: 1068102 - RNA, 22 nt, Human
aggggcugacuggaaagugcca

SEQ ID NO: 1068103 - RNA, 22 nt, Human
ucccacacuacacgguuguugg

SEQ ID NO: 1068104 - RNA, 22 nt, Human
aagugguagagagagcauaagc

SEQ ID NO: 1068105 - RNA, 22 nt, Human
uucaucaucuacaaccaggacc

SEQ ID NO: 1068106 - RNA, 22 nt, Human
gcaggggcugagcaccagcggg

SEQ ID NO: 1068107 - RNA, 22 nt, Human
uggcugaauaaaauaugguguu

SEQ ID NO: 1068108 - RNA, 22 nt, Human
aggcacuguggaagacaugguu

SEQ ID NO: 1068109 - RNA, 22 nt, Human
cuuucuuucgaagacgugauua

SEQ ID NO: 1068110 - RNA, 22 nt, Human
ucaaaauuaaaccaacguccag

SEQ ID NO: 1068111 - RNA, 22 nt, Human
uuucaaaguugggaauuguaau

SEQ ID NO: 1068112 - RNA, 22 nt, Human
gcaggaacccagacaaccaggg

SEQ ID NO: 1068113 - RNA, 22 nt, Human
cucagcucugacaggaggcauc

SEQ ID NO: 1068114 - RNA, 22 nt, Human
gcugcuggggccuucccucggg

SEQ ID NO: 1068115 - RNA, 22 nt, Human
ucuucaguagguccucagaauc

SEQ ID NO: 1068116 - RNA, 22 nt, Human
gcucagaaaagugaggcucagu

SEQ ID NO: 1068117 - RNA, 22 nt, Human
aucagcaaucaaauugcagagu

SEQ ID NO: 1068118 - RNA, 22 nt, Human
cagcaucucugccugccugcaa

SEQ ID NO: 1068119 - RNA, 17 nt, Human
ugcauuguuggaaauuu

SEQ ID NO: 1068120 - RNA, 21 nt, Human
uccuucucuaugauugucuga

SEQ ID NO: 1068121 - RNA, 22 nt, Human
acacagauauuuugaauacaua

SEQ ID NO: 1068122 - RNA, 22 nt, Human
ucccaagacgaugugcuuggcc

SEQ ID NO: 1068123 - RNA, 17 nt, Human
aagucccagcuaacaca

SEQ ID NO: 1068124 - RNA, 22 nt, Human
agacagcuccaagugucucugu

SEQ ID NO: 1068125 - RNA, 22 nt, Human
gagcucagcccaaagagcagug

SEQ ID NO: 1068126 - RNA, 22 nt, Human
aggugccagcucucaggcagga

SEQ ID NO: 1068127 - RNA, 22 nt, Human
uaggcagcugcaaacuucgguc

SEQ ID NO: 1068128 - RNA, 22 nt, Human
cuuccuuugcuguucggagguu

SEQ ID NO: 1068129 - RNA, 22 nt, Human
uaauuauugucugaagaguuau

SEQ ID NO: 1068130 - RNA, 22 nt, Human
ugcagcugcuggcccaggugcu

SEQ ID NO: 1068131 - RNA, 22 nt, Human
aaugucaaguagccaaugcuuc

SEQ ID NO: 1068132 - RNA, 22 nt, Human
ggccuuuuguguccuugcccgu

SEQ ID NO: 1068133 - RNA, 17 nt, Human
gcagcagagagacccuc

SEQ ID NO: 1068134 - RNA, 19 nt, Human
ucucagagcccuagaggcc

SEQ ID NO: 1068135 - RNA, 22 nt, Human
caaaggcuuccacugcauccuu

SEQ ID NO: 1068136 - RNA, 22 nt, Human
cuuuauuagauguagacuuucu

SEQ ID NO: 1068137 - RNA, 22 nt, Human
ugcaggugguccauuugggaac

SEQ ID NO: 1068138 - RNA, 22 nt, Human
ccaggaggucugaguguggaca

SEQ ID NO: 1068139 - RNA, 20 nt, Human
cucuccuugccgacuuggca

SEQ ID NO: 1068140 - RNA, 22 nt, Human
uccucaaauuagcagaucauag

SEQ ID NO: 1068141 - RNA, 22 nt, Human
gaggcagcaaaauauaucauaa

SEQ ID NO: 1068142 - RNA, 22 nt, Human
uaaggcacccgugagcugccag

SEQ ID NO: 1068143 - RNA, 22 nt, Human
ccugagaggcccucucacuguc

SEQ ID NO: 1068144 - RNA, 22 nt, Human
ugaaaguuacaggaaaacagau

SEQ ID NO: 1068145 - RNA, 22 nt, Human
ugccaggccaauucuauuugac

SEQ ID NO: 1068146 - RNA, 23 nt, Human
uggauaaagcugugcugcauagg

SEQ ID NO: 1068147 - RNA, 22 nt, Human
uugauucaaccacuuaauaauc

SEQ ID NO: 1068148 - RNA, 22 nt, Human
uguugaagauaaaguucucauu

SEQ ID NO: 1068149 - RNA, 22 nt, Human
gauuucuguugagaaacauggg

SEQ ID NO: 1068150 - RNA, 22 nt, Human
acauguuugauaaauauuuggg

SEQ ID NO: 1068151 - RNA, 22 nt, Human
ggccuugggaggagggucagaa

SEQ ID NO: 1068152 - RNA, 22 nt, Human
gcaggaagaugagcucagguaa

SEQ ID NO: 1068153 - RNA, 22 nt, Human
cuccaaauucagucacagucug

SEQ ID NO: 1068154 - RNA, 22 nt, Human
cccccaggcucugacacaggag

SEQ ID NO: 1068155 - RNA, 22 nt, Human
auuccauuguguaaggauaucg

SEQ ID NO: 1068156 - RNA, 18 nt, Human
uggcucuggacuugcucc

SEQ ID NO: 1068157 - RNA, 22 nt, Human
uaguggagaaguggagucugug

SEQ ID NO: 1068158 - RNA, 22 nt, Human
caggucagagucccccuguccu

SEQ ID NO: 1068159 - RNA, 22 nt, Human
uuaauuuuaaccuguuuguguc

SEQ ID NO: 1068160 - RNA, 22 nt, Human
cauugcacaucugagaagagau

SEQ ID NO: 1068161 - RNA, 19 nt, Human
accucugcagagauguuua

SEQ ID NO: 1068162 - RNA, 21 nt, Human
gccaagaacaagacagacaug

SEQ ID NO: 1068163 - RNA, 20 nt, Human
agcaggcugcagggugaaau

SEQ ID NO: 1068164 - RNA, 22 nt, Human
ggcugcagcggauuggggauug

SEQ ID NO: 1068165 - RNA, 23 nt, Human
uugaaggagaaagcuuucuuggu

SEQ ID NO: 1068166 - RNA, 19 nt, Human
acacugaauguagaauugg

SEQ ID NO: 1068167 - RNA, 19 nt, Human
agguaggcaguggcaugga

SEQ ID NO: 1068168 - RNA, 22 nt, Human
acuuccagaauuagaauuuaag

SEQ ID NO: 1068169 - RNA, 22 nt, Human
uccucaugccgggucucacgcu

SEQ ID NO: 1068170 - RNA, 22 nt, Human
caucuguaaaguaggaauauug

SEQ ID NO: 1068171 - RNA, 22 nt, Human
cauccauucagugcaaaucaca

SEQ ID NO: 1068172 - RNA, 22 nt, Human
uuucugacuccagagaggaaua

SEQ ID NO: 1068173 - RNA, 22 nt, Human
aacauaaauuugaaguggcaaa

SEQ ID NO: 1068174 - RNA, 22 nt, Human
agacaaaugaacaaauauguga

SEQ ID NO: 1068175 - RNA, 22 nt, Human
ccacagggugucaucagcuuga

SEQ ID NO: 1068176 - RNA, 22 nt, Human
aaauugucagaauucagaaagu

SEQ ID NO: 1068177 - RNA, 22 nt, Human
gagggguggcccuggcguguac

SEQ ID NO: 1068178 - RNA, 22 nt, Human
gagugaaaaaggaagggccaua

SEQ ID NO: 1068179 - RNA, 22 nt, Human
cagcagcugauggggaagugau

SEQ ID NO: 1068180 - RNA, 22 nt, Human
gugggaguggggaagcagagug

SEQ ID NO: 1068181 - RNA, 23 nt, Human
cacaucaguuuaggucagauuuu

SEQ ID NO: 1068182 - RNA, 22 nt, Human
acuuuuuuauaaggaagaagau

SEQ ID NO: 1068183 - RNA, 22 nt, Human
caggagcccagaguccucagcu

SEQ ID NO: 1068184 - RNA, 22 nt, Human
ggcagaagacaggcaaaucaug

SEQ ID NO: 1068185 - RNA, 22 nt, Human
ucagacagaggagcucgugcag

SEQ ID NO: 1068186 - RNA, 22 nt, Human
cuguuacacggaccuucaaauc

SEQ ID NO: 1068187 - RNA, 22 nt, Human
ucucauguauugcccuggugug

SEQ ID NO: 1068188 - RNA, 22 nt, Human
ccaggaaggccuggaugccccc

SEQ ID NO: 1068189 - RNA, 22 nt, Human
uacagucuuuggaaagagauag

SEQ ID NO: 1068190 - RNA, 22 nt, Human
aaauucaauuaacuuucaugcu

SEQ ID NO: 1068191 - RNA, 22 nt, Human
ucaaaucucacucugcauuucu

SEQ ID NO: 1068192 - RNA, 22 nt, Human
gagcuggcaagucuguccuugg

SEQ ID NO: 1068193 - RNA, 22 nt, Human
gaguuauucuagguccuuugua

SEQ ID NO: 1068194 - RNA, 22 nt, Human
aucaggauagucuguaaauugu

SEQ ID NO: 1068195 - RNA, 22 nt, Human
uccaaagaagucacaaacgaag

SEQ ID NO: 1068196 - RNA, 22 nt, Human
uccuucagaggacggcagccag

SEQ ID NO: 1068197 - RNA, 21 nt, Human
cucaggaucuuauauauuagu

SEQ ID NO: 1068198 - RNA, 22 nt, Human
ugauugaacugagcuucaagau

SEQ ID NO: 1068199 - RNA, 22 nt, Human
aguggcagccgagcaggagaug

SEQ ID NO: 1068200 - RNA, 22 nt, Human
ggauccuucuuugaccucacag

SEQ ID NO: 1068201 - RNA, 22 nt, Human
uccucaggugacuagguaucuu

SEQ ID NO: 1068202 - RNA, 22 nt, Human
uuaaauauuauguugucugcaa

SEQ ID NO: 1068203 - RNA, 22 nt, Human
ccagauggaaaugauguucuca

SEQ ID NO: 1068204 - RNA, 19 nt, Human
uuucuuuuccccucagcac

SEQ ID NO: 1068205 - RNA, 22 nt, Human
aagggcaggagaagacggauau

SEQ ID NO: 1068206 - RNA, 22 nt, Human
aaggaggaauuucagggugaau

SEQ ID NO: 1068207 - RNA, 22 nt, Human
aagucacaagcauauaugcauu

SEQ ID NO: 1068208 - RNA, 22 nt, Human
ugugccaggcacuugcccaggc

SEQ ID NO: 1068209 - RNA, 22 nt, Human
aucaacauagccacuccuuaga

SEQ ID NO: 1068210 - RNA, 21 nt, Human
ucaggcagugcaaauacaugg

SEQ ID NO: 1068211 - RNA, 22 nt, Human
gcagggaaguuugaucuuuuuc

SEQ ID NO: 1068212 - RNA, 22 nt, Human
uguucauuuggcccuuuuguau

SEQ ID NO: 1068213 - RNA, 22 nt, Human
aaagccagugguaugagagaaa

SEQ ID NO: 1068214 - RNA, 22 nt, Human
uggggugccgacagggagggca

SEQ ID NO: 1068215 - RNA, 22 nt, Human
uuaagucauuucugauuauaga

SEQ ID NO: 1068216 - RNA, 22 nt, Human
caggcuugggagcagagccacu

SEQ ID NO: 1068217 - RNA, 22 nt, Human
gggggcaguaaccucaaagugu

SEQ ID NO: 1068218 - RNA, 22 nt, Human
gggcugaguuccugccucacuc

SEQ ID NO: 1068219 - RNA, 22 nt, Human
ccaggaccuggagcucuaugaa

SEQ ID NO: 1068220 - RNA, 22 nt, Human
gaaaggagggaaacagagcggu

SEQ ID NO: 1068221 - RNA, 22 nt, Human
ggcagaguggagugcggccucc

SEQ ID NO: 1068222 - RNA, 22 nt, Human
cggggcuggcacaggugaccac

SEQ ID NO: 1068223 - RNA, 22 nt, Human
uccccagccgugaaggagagga

SEQ ID NO: 1068224 - RNA, 21 nt, Human
agggcagauuagcuguaagag

SEQ ID NO: 1068225 - RNA, 22 nt, Human
gcagaugguggggcaggaaaau

SEQ ID NO: 1068226 - RNA, 21 nt, Human
aaggaaaagcuuggucucuga

SEQ ID NO: 1068227 - RNA, 22 nt, Human
augaugguggguaauguguaaa

SEQ ID NO: 1068228 - RNA, 22 nt, Human
gagggauggugugagaggcuca

SEQ ID NO: 1068229 - RNA, 22 nt, Human
uauuucaggcuauauuucuugu

SEQ ID NO: 1068230 - RNA, 21 nt, Human
gagcauggcuuacaucagcag

SEQ ID NO: 1068231 - RNA, 22 nt, Human
cagagccuuccuagcagacucu

SEQ ID NO: 1068232 - RNA, 18 nt, Human
cagggccccagaauuauc

SEQ ID NO: 1068233 - RNA, 22 nt, Human
aaauauugguaggaugcuuguu

SEQ ID NO: 1068234 - RNA, 22 nt, Human
gcugccuuugugagccaagggg

SEQ ID NO: 1068235 - RNA, 22 nt, Human
ccaggagcaaagaucacuggga

SEQ ID NO: 1068236 - RNA, 22 nt, Human
ucaagaauagcugcaaacaggg

SEQ ID NO: 1068237 - RNA, 22 nt, Human
auuucacagcugucaguguuac

SEQ ID NO: 1068238 - RNA, 22 nt, Human
aaagcucuuaaauugaccugcu

SEQ ID NO: 1068239 - RNA, 19 nt, Human
gccaggagggcucuggcug

SEQ ID NO: 1068240 - RNA, 22 nt, Human
uagcuguguagacacucagagc

SEQ ID NO: 1068241 - RNA, 22 nt, Human
aauucaaauuacaauaguuguu

SEQ ID NO: 1068242 - RNA, 22 nt, Human
cugagguguugaugaccuaugc

SEQ ID NO: 1068243 - RNA, 22 nt, Human
uugaaaaugguaagcaugauau

SEQ ID NO: 1068244 - RNA, 22 nt, Human
ucugcugguuccgaauuaggcc

SEQ ID NO: 1068245 - RNA, 22 nt, Human
cugcagcugugagugcuggaug

SEQ ID NO: 1068246 - RNA, 22 nt, Human
gaugcauuacaaaagugauuau

SEQ ID NO: 1068247 - RNA, 22 nt, Human
gcagagcagagccugcauuggc

SEQ ID NO: 1068248 - RNA, 22 nt, Human
agggcccuagggaaugagacau

SEQ ID NO: 1068249 - RNA, 22 nt, Human
ggcagcuggccuccucgcccac

SEQ ID NO: 1068250 - RNA, 22 nt, Human
cagcugccugucuggaggcaau

SEQ ID NO: 1068251 - RNA, 22 nt, Human
cccacacacuggcugcugccaa

SEQ ID NO: 1068252 - RNA, 22 nt, Human
uaugagcuuccaguguugcaug

SEQ ID NO: 1068253 - RNA, 22 nt, Human
gugaaggcuacaagagaucaag

SEQ ID NO: 1068254 - RNA, 23 nt, Human
uccuccugagugagagugccagc

SEQ ID NO: 1068255 - RNA, 22 nt, Human
guauuccuaagucaugacaaau

SEQ ID NO: 1068256 - RNA, 22 nt, Human
uguaacaguaagccugugagcu

SEQ ID NO: 1068257 - RNA, 22 nt, Human
ggauggcaggacaaggacccag

SEQ ID NO: 1068258 - RNA, 22 nt, Human
cagggcagccaggccccguggg

SEQ ID NO: 1068259 - RNA, 22 nt, Human
aaacaaagcaucuugcuaugca

SEQ ID NO: 1068260 - RNA, 22 nt, Human
ucucccacgguacaggauaaac

SEQ ID NO: 1068261 - RNA, 22 nt, Human
uugcauuuccuguacuguuuga

SEQ ID NO: 1068262 - RNA, 19 nt, Human
cccucauucacuuauucuc

SEQ ID NO: 1068263 - RNA, 22 nt, Human
cagcagugaugugugaggguuc

SEQ ID NO: 1068264 - RNA, 22 nt, Human
uggugagauaacuuucggcaag

SEQ ID NO: 1068265 - RNA, 21 nt, Human
ucuggagucaucuuuaccaua

SEQ ID NO: 1068266 - RNA, 22 nt, Human
aucacaaaggucucagagcaca

SEQ ID NO: 1068267 - RNA, 22 nt, Human
ggaagagagguucagcccuaag

SEQ ID NO: 1068268 - RNA, 22 nt, Human
ucagagguaguagcagaguuga

SEQ ID NO: 1068269 - RNA, 22 nt, Human
aauuucaguugcuaauaaguuc

SEQ ID NO: 1068270 - RNA, 22 nt, Human
ugggaagauggagugacaggca

SEQ ID NO: 1068271 - RNA, 22 nt, Human
agcagggcugugcuccuuccga

SEQ ID NO: 1068272 - RNA, 22 nt, Human
aucaggauagugguuaccuggg

SEQ ID NO: 1068273 - RNA, 22 nt, Human
ugguaauuaauuugauagguuc

SEQ ID NO: 1068274 - RNA, 22 nt, Human
uacacauaggucugaauaaaaa

SEQ ID NO: 1068275 - RNA, 20 nt, Human
cugagcccagaucccagguc

SEQ ID NO: 1068276 - RNA, 21 nt, Human
ugcagagauaucugaagcaga

SEQ ID NO: 1068277 - RNA, 18 nt, Human
ugaggccucugcugggcc

SEQ ID NO: 1068278 - RNA, 22 nt, Human
gcuuuaaauggcuugcccaagu

SEQ ID NO: 1068279 - RNA, 19 nt, Human
ccuuugaaucaggacacuu

SEQ ID NO: 1068280 - RNA, 22 nt, Human
ugucuacuugggcucuacagca

SEQ ID NO: 1068281 - RNA, 22 nt, Human
guauuauuggguaguaugguaa

SEQ ID NO: 1068282 - RNA, 22 nt, Human
auuaagacugcccauguuuuua

SEQ ID NO: 1068283 - RNA, 19 nt, Human
ccauuucauauguauugug

SEQ ID NO: 1068284 - RNA, 23 nt, Human
ugccaaaguuuaccuaacacugg

SEQ ID NO: 1068285 - RNA, 22 nt, Human
aaaugucagaggaacauauuga

SEQ ID NO: 1068286 - RNA, 22 nt, Human
acaaagucacaauaauuaaccu

SEQ ID NO: 1068287 - RNA, 22 nt, Human
aagaauuuuccagcaugucagu

SEQ ID NO: 1068288 - RNA, 22 nt, Human
ggaagaaaaugggcaacaggug

SEQ ID NO: 1068289 - RNA, 20 nt, Human
ugguaucaauuacuagauug

SEQ ID NO: 1068290 - RNA, 22 nt, Human
uuagaauuauuguuuccuucua

SEQ ID NO: 1068291 - RNA, 22 nt, Human
cacagaaauuauuaggaugcuu

SEQ ID NO: 1068292 - RNA, 22 nt, Human
uugauguacagaauuguucaca

SEQ ID NO: 1068293 - RNA, 22 nt, Human
auuuucaaaacaucugcugugu

SEQ ID NO: 1068294 - RNA, 21 nt, Human
aucacauuggcuguuauuauu

SEQ ID NO: 1068295 - RNA, 22 nt, Human
gcagcagaguuugggagauggu

SEQ ID NO: 1068296 - RNA, 22 nt, Human
uuucuucagccuucacaaccug

SEQ ID NO: 1068297 - RNA, 22 nt, Human
aucuauacccaucaugauuuaa

SEQ ID NO: 1068298 - RNA, 22 nt, Human
cugggaggcccacguugggaag

SEQ ID NO: 1068299 - RNA, 21 nt, Human
gcagugcagcuuggaggguag

SEQ ID NO: 1068300 - RNA, 22 nt, Human
uaggaagccugcugugcacagc

SEQ ID NO: 1068301 - RNA, 22 nt, Human
aaguaacagaggggguguugcu

SEQ ID NO: 1068302 - RNA, 22 nt, Human
acugaugaaaacuaauaaauua

SEQ ID NO: 1068303 - RNA, 22 nt, Human
uucuuugcccuuaaugaaauaa

SEQ ID NO: 1068304 - RNA, 22 nt, Human
ucuuuacaaucuaagcauaguu

SEQ ID NO: 1068305 - RNA, 22 nt, Human
caggaaaugggguuuaguuauu

SEQ ID NO: 1068306 - RNA, 22 nt, Human
agagugaaaagcuagagcagua

SEQ ID NO: 1068307 - RNA, 22 nt, Human
cuggcaggaucuaaccagggaa

SEQ ID NO: 1068308 - RNA, 22 nt, Human
uuuguucacuauaucccucagu

SEQ ID NO: 1068309 - RNA, 22 nt, Human
uggcugagguaacuaugaauaa

SEQ ID NO: 1068310 - RNA, 22 nt, Human
uacagggguaacaguggggaau

SEQ ID NO: 1068311 - RNA, 22 nt, Human
uauuugauagagauaaaugaua

SEQ ID NO: 1068312 - RNA, 22 nt, Human
auaauaacuccuguugaagaac

SEQ ID NO: 1068313 - RNA, 22 nt, Human
cccuccagccauggacccaggu

SEQ ID NO: 1068314 - RNA, 22 nt, Human
guaggaaagggagugaagggaa

SEQ ID NO: 1068315 - RNA, 22 nt, Human
ccagagagucgaugggggacac

SEQ ID NO: 1068316 - RNA, 22 nt, Human
auauagauuccaugguuccuuu

SEQ ID NO: 1068317 - RNA, 22 nt, Human
aacuuucucuacggcauuuguu

SEQ ID NO: 1068318 - RNA, 22 nt, Human
ccaggacuucgaggcuacagug

SEQ ID NO: 1068319 - RNA, 22 nt, Human
aucaagaauguucauucuucua

SEQ ID NO: 1068320 - RNA, 22 nt, Human
cuggacuuuggcccaucugcca

SEQ ID NO: 1068321 - RNA, 22 nt, Human
ucugcagcgugcaggcuggugc

SEQ ID NO: 1068322 - RNA, 19 nt, Human
ugcauaaauuauauacuuu

SEQ ID NO: 1068323 - RNA, 22 nt, Human
uuaacuugucagaaaauacagu

SEQ ID NO: 1068324 - RNA, 22 nt, Human
guaaugaugucugagaaguaug

SEQ ID NO: 1068325 - RNA, 22 nt, Human
uaacaauaguguuugcuaguca

SEQ ID NO: 1068326 - RNA, 22 nt, Human
gaaggcaggcuucugauuaggu

SEQ ID NO: 1068327 - RNA, 22 nt, Human
aaucaguucuacaucuuaucca

SEQ ID NO: 1068328 - RNA, 22 nt, Human
cucacugugccuuuucccaaac

SEQ ID NO: 1068329 - RNA, 22 nt, Human
uaguggaguagaaaccaaagaa

SEQ ID NO: 1068330 - RNA, 22 nt, Human
ggucaggguuccagguaucuuc

SEQ ID NO: 1068331 - RNA, 22 nt, Human
uggcucuguugugcugagccag

SEQ ID NO: 1068332 - RNA, 22 nt, Human
ggaugcugcugcacauccugca

SEQ ID NO: 1068333 - RNA, 22 nt, Human
ugcuuuauucgacaucugguag

SEQ ID NO: 1068334 - RNA, 22 nt, Human
ugugugugacucauacuagaac

SEQ ID NO: 1068335 - RNA, 22 nt, Human
gagccugaaauacaggucacug

SEQ ID NO: 1068336 - RNA, 22 nt, Human
uauacagaaagaauucaagucu

SEQ ID NO: 1068337 - RNA, 22 nt, Human
aucucccagccacagcauucuu

SEQ ID NO: 1068338 - RNA, 22 nt, Human
uuuuaguuguacugucaacagu

SEQ ID NO: 1068339 - RNA, 22 nt, Human
ccacugcuagagaugcaucccc

SEQ ID NO: 1068340 - RNA, 22 nt, Human
aucuacaaaaacugucucagga

SEQ ID NO: 1068341 - RNA, 22 nt, Human
gacauuuagcuguuuugcauuu

SEQ ID NO: 1068342 - RNA, 22 nt, Human
ugugaaauuacuuaaaggaaau

SEQ ID NO: 1068343 - RNA, 17 nt, Human
cagacagauauccuggg

SEQ ID NO: 1068344 - RNA, 18 nt, Human
uuuccaagaagagagcuc

SEQ ID NO: 1068345 - RNA, 22 nt, Human
ucuuuucacagacaaauggaga

SEQ ID NO: 1068346 - RNA, 22 nt, Human
uaauuuuuccacguacacuggg

SEQ ID NO: 1068347 - RNA, 20 nt, Human
gcuuccuucccagcccccac

SEQ ID NO: 1068348 - RNA, 22 nt, Human
uaugcauacaaugagauauucc

SEQ ID NO: 1068349 - RNA, 22 nt, Human
ccuggccaggcauggagucaca

SEQ ID NO: 1068350 - RNA, 22 nt, Human
cagaguggcacucugcuggaug

SEQ ID NO: 1068351 - RNA, 20 nt, Human
ccagcauguacacaugugga

SEQ ID NO: 1068352 - RNA, 22 nt, Human
ugccacagaggugaagcccacu

SEQ ID NO: 1068353 - RNA, 22 nt, Human
acacacaauuaguuuuaugcuu

SEQ ID NO: 1068354 - RNA, 22 nt, Human
ugcacacacucugcauauacuu

SEQ ID NO: 1068355 - RNA, 22 nt, Human
cagcucccuauggugaggcgac

SEQ ID NO: 1068356 - RNA, 22 nt, Human
agguguguauaaacauacauau

SEQ ID NO: 1068357 - RNA, 19 nt, Human
caaguuaaaaugaggucau

SEQ ID NO: 1068358 - RNA, 22 nt, Human
ccucuucugcuucaggagcacu

SEQ ID NO: 1068359 - RNA, 23 nt, Human
acagcuuccuacuuugcugcugc

SEQ ID NO: 1068360 - RNA, 22 nt, Human
gucuucuuuucagucugcuugu

SEQ ID NO: 1068361 - RNA, 23 nt, Human
ugcauggggcuauacugcuguuc

SEQ ID NO: 1068362 - RNA, 22 nt, Human
auuuuuccugggugcuuuaguu

SEQ ID NO: 1068363 - RNA, 22 nt, Human
gcuuugaagucugugucuuuug

SEQ ID NO: 1068364 - RNA, 22 nt, Human
uaguuucauaugcaaaauagua

SEQ ID NO: 1068365 - RNA, 22 nt, Human
acagcagcuaaccccugggcca

SEQ ID NO: 1068366 - RNA, 22 nt, Human
agaguggagagaaacaacucug

SEQ ID NO: 1068367 - RNA, 23 nt, Human
caauuucauaugauucuaccuaa

SEQ ID NO: 1068368 - RNA, 22 nt, Human
aagccaucuuguuuauauguua

SEQ ID NO: 1068369 - RNA, 22 nt, Human
uucacauucucacaagaggaaa

SEQ ID NO: 1068370 - RNA, 22 nt, Human
aacaaaacauuugucuuguuuc

SEQ ID NO: 1068371 - RNA, 22 nt, Human
uguuucaaguuugcucaaagga

SEQ ID NO: 1068372 - RNA, 22 nt, Human
ggagacucucauugucaagcuu

SEQ ID NO: 1068373 - RNA, 19 nt, Human
ucugcauggcaggaagaga

SEQ ID NO: 1068374 - RNA, 17 nt, Human
ggcuggagcagcucccc

SEQ ID NO: 1068375 - RNA, 22 nt, Human
gaaagggcaugggcaugacaac

SEQ ID NO: 1068376 - RNA, 22 nt, Human
caaagcaggcuugucaaauugc

SEQ ID NO: 1068377 - RNA, 22 nt, Human
gccucccuguucuuccacaaua

SEQ ID NO: 1068378 - RNA, 22 nt, Human
uuuguucaacaucacuuccacc

SEQ ID NO: 1068379 - RNA, 22 nt, Human
cauggcagugauucagccuuug

SEQ ID NO: 1068380 - RNA, 22 nt, Human
uuucauguuacauuuaaaaugu

SEQ ID NO: 1068381 - RNA, 22 nt, Human
agugcuggagggaggcagguuc

SEQ ID NO: 1068382 - RNA, 22 nt, Human
cagcucugagacugaggcuaug

SEQ ID NO: 1068383 - RNA, 22 nt, Human
uguucuguuuuaugguagggaa

SEQ ID NO: 1068384 - RNA, 22 nt, Human
agaugaugauaauugaaaggca

SEQ ID NO: 1068385 - RNA, 22 nt, Human
uuauuugcccauguuuagcaga

SEQ ID NO: 1068386 - RNA, 22 nt, Human
caaaugauaccuauuacuaggc

SEQ ID NO: 1068387 - RNA, 18 nt, Human
ugagaauguaagaaaugg

SEQ ID NO: 1068388 - RNA, 21 nt, Human
ccaggcagagcugugaguucu

SEQ ID NO: 1068389 - RNA, 20 nt, Human
agaguaacuggcacauaggg

SEQ ID NO: 1068390 - RNA, 22 nt, Human
ccaucagcaugggagcaugggc

SEQ ID NO: 1068391 - RNA, 22 nt, Human
uggugaagucagcggagcccgg

SEQ ID NO: 1068392 - RNA, 22 nt, Human
aucagaagcaggaggaaugaag

SEQ ID NO: 1068393 - RNA, 22 nt, Human
agaaauguuacaguuguuauuu

SEQ ID NO: 1068394 - RNA, 22 nt, Human
ugccaggcauauggccucuuug

SEQ ID NO: 1068395 - RNA, 22 nt, Human
caaaugcauaguuuauaagaag

SEQ ID NO: 1068396 - RNA, 22 nt, Human
ucacaggguguacaucaccuau

SEQ ID NO: 1068397 - RNA, 22 nt, Human
ggccugcuccgggggcugagcu

SEQ ID NO: 1068398 - RNA, 22 nt, Human
cugagcagccccaccagccauu

SEQ ID NO: 1068399 - RNA, 22 nt, Human
uauacacaccuccaaagcagga

SEQ ID NO: 1068400 - RNA, 22 nt, Human
aaaauucucuugaucuugacag

SEQ ID NO: 1068401 - RNA, 22 nt, Human
agaagccaccagcugaggaaga

SEQ ID NO: 1068402 - RNA, 22 nt, Human
gucugaauucuguguaacucua

SEQ ID NO: 1068403 - RNA, 22 nt, Human
aggccugaggaccagauaaaug

SEQ ID NO: 1068404 - RNA, 22 nt, Human
acucagaaccauuuacucugag

SEQ ID NO: 1068405 - RNA, 22 nt, Human
agcugcucauucccagcacaug

SEQ ID NO: 1068406 - RNA, 22 nt, Human
gagaaagacguaggcugggagg

SEQ ID NO: 1068407 - RNA, 22 nt, Human
aggcccagagcaggaaaggguu

SEQ ID NO: 1068408 - RNA, 22 nt, Human
uaacaaaguaccauagacugga

SEQ ID NO: 1068409 - RNA, 22 nt, Human
augcagaagcagaacuuacaca

SEQ ID NO: 1068410 - RNA, 22 nt, Human
uggccucuggcugaggacuaac

SEQ ID NO: 1068411 - RNA, 22 nt, Human
cugggcacacucugcuccagcu

SEQ ID NO: 1068412 - RNA, 22 nt, Human
cccugccugugggcaucaacau

SEQ ID NO: 1068413 - RNA, 22 nt, Human
gguggcagucuuaagagaucuu

SEQ ID NO: 1068414 - RNA, 22 nt, Human
cuucuucagcacaauauugaug

SEQ ID NO: 1068415 - RNA, 22 nt, Human
ucaguggauauuucuguggcug

SEQ ID NO: 1068416 - RNA, 22 nt, Human
ccaggccccagggcuggcuuuc

SEQ ID NO: 1068417 - RNA, 22 nt, Human
aauguucagcuuucuuacuuaa

SEQ ID NO: 1068418 - RNA, 22 nt, Human
uggcuggacagugggcagugga

SEQ ID NO: 1068419 - RNA, 22 nt, Human
gcugaaaugccuuguaaauauu

SEQ ID NO: 1068420 - RNA, 22 nt, Human
ucucccacagccgugcuucaag

SEQ ID NO: 1068421 - RNA, 22 nt, Human
cagaaauaugugccaugccuua

SEQ ID NO: 1068422 - RNA, 20 nt, Human
agauggugggcuggaacacc

SEQ ID NO: 1068423 - RNA, 22 nt, Human
uugggcuggcagagguggucuu

SEQ ID NO: 1068424 - RNA, 20 nt, Human
ugccaggcugcacgccugcc

SEQ ID NO: 1068425 - RNA, 22 nt, Human
ugcugggcuucaacugccugag

SEQ ID NO: 1068426 - RNA, 22 nt, Human
accaaaaccugcuacuaaagga

SEQ ID NO: 1068427 - RNA, 22 nt, Human
uugcagaggcaaaaaugaacuc

SEQ ID NO: 1068428 - RNA, 22 nt, Human
gacacagagacuugcaguugua

SEQ ID NO: 1068429 - RNA, 22 nt, Human
aauaagaauuuacuugucaaga

SEQ ID NO: 1068430 - RNA, 22 nt, Human
guccucugauuucuagguauau

SEQ ID NO: 1068431 - RNA, 22 nt, Human
ucauuauaaacauaugcuaaag

SEQ ID NO: 1068432 - RNA, 22 nt, Human
uuuauuugucuugccauuuagu

SEQ ID NO: 1068433 - RNA, 22 nt, Human
uuuuaccacugggugacaugga

SEQ ID NO: 1068434 - RNA, 22 nt, Human
gucucugccuggggggaucaga

SEQ ID NO: 1068435 - RNA, 22 nt, Human
aauucacugaacuucucugaga

SEQ ID NO: 1068436 - RNA, 22 nt, Human
uccuucaggccucauucucaua

SEQ ID NO: 1068437 - RNA, 22 nt, Human
uuuccuaugauauucuaugugu

SEQ ID NO: 1068438 - RNA, 22 nt, Human
ucugucacccaggcuggagugc

SEQ ID NO: 1068439 - RNA, 21 nt, Human
aacuuuagaaagacugggaag

SEQ ID NO: 1068440 - RNA, 22 nt, Human
gaaaauuuaauucucuucugug

SEQ ID NO: 1068441 - RNA, 22 nt, Human
guguucauggaugucaauuuga

SEQ ID NO: 1068442 - RNA, 22 nt, Human
ucgcugugguuucuguacaugg

SEQ ID NO: 1068443 - RNA, 22 nt, Human
cucugagaaagcugugagcuaa

SEQ ID NO: 1068444 - RNA, 22 nt, Human
uauuucucagcauuuuacaucc

SEQ ID NO: 1068445 - RNA, 21 nt, Human
ucugagagcaacugcccuuua

SEQ ID NO: 1068446 - RNA, 22 nt, Human
cugcagagcaaguaacauccuc

SEQ ID NO: 1068447 - RNA, 20 nt, Human
ucugagagucugagugauga

SEQ ID NO: 1068448 - RNA, 22 nt, Human
gcaagaaaaaggcuucaugaac

SEQ ID NO: 1068449 - RNA, 22 nt, Human
caucuccuuuggucuacuucca

SEQ ID NO: 1068450 - RNA, 22 nt, Human
ggcaggcacugugcuaggcgcu

SEQ ID NO: 1068451 - RNA, 22 nt, Human
gagauggcucucagaucuuuga

SEQ ID NO: 1068452 - RNA, 22 nt, Human
caccugccccagucuuggagcu

SEQ ID NO: 1068453 - RNA, 22 nt, Human
ugaaggccagcucuuuaucagc

SEQ ID NO: 1068454 - RNA, 22 nt, Human
cacaggagagcugggaggugcc

SEQ ID NO: 1068455 - RNA, 22 nt, Human
ggccuagggaguggccaugccu

SEQ ID NO: 1068456 - RNA, 19 nt, Human
agccagugagccucugggu

SEQ ID NO: 1068457 - RNA, 22 nt, Human
gucugcccuuggccugggacuu

SEQ ID NO: 1068458 - RNA, 22 nt, Human
uuuaccuuuugcuaugguggaa

SEQ ID NO: 1068459 - RNA, 22 nt, Human
ugcccuggaaccaucuacaguc

SEQ ID NO: 1068460 - RNA, 22 nt, Human
aagcugccagcugagcugaggc

SEQ ID NO: 1068461 - RNA, 22 nt, Human
gcugugugaaaacugggccugg

SEQ ID NO: 1068462 - RNA, 22 nt, Human
aaccaggauuuaagauucuaga

SEQ ID NO: 1068463 - RNA, 22 nt, Human
ucugccuggguguggagcagag

SEQ ID NO: 1068464 - RNA, 22 nt, Human
ucagugcacagagauuuuuguu

SEQ ID NO: 1068465 - RNA, 22 nt, Human
ccccuguguuguucaaggguca

SEQ ID NO: 1068466 - RNA, 22 nt, Human
cccagccuggugcacugugggg

SEQ ID NO: 1068467 - RNA, 22 nt, Human
uggcugaguuucaugcaucaug

SEQ ID NO: 1068468 - RNA, 22 nt, Human
ccagcagcccucuuccaagacu

SEQ ID NO: 1068469 - RNA, 22 nt, Human
ggcuucccuuuccgagaggaga

SEQ ID NO: 1068470 - RNA, 19 nt, Human
cuucuaagucauuuggaau

SEQ ID NO: 1068471 - RNA, 20 nt, Human
ucuuggagaggguggacuua

SEQ ID NO: 1068472 - RNA, 22 nt, Human
caacauuucaaggucuuuagga

SEQ ID NO: 1068473 - RNA, 22 nt, Human
gcugcaggcggccgugguggcg

SEQ ID NO: 1068474 - RNA, 22 nt, Human
gggcucauucaucugggcuugg

SEQ ID NO: 1068475 - RNA, 22 nt, Human
acaugucaauuuaguacucuua

SEQ ID NO: 1068476 - RNA, 22 nt, Human
cacauuuagagguuagcauggu

SEQ ID NO: 1068477 - RNA, 22 nt, Human
ugggcucugcaucagugcccau

SEQ ID NO: 1068478 - RNA, 22 nt, Human
ggcuucaggggcccagucagca

SEQ ID NO: 1068479 - RNA, 22 nt, Human
agggagaaaauuggaugcacaa

SEQ ID NO: 1068480 - RNA, 22 nt, Human
gauacaaaauauaaauggagag

SEQ ID NO: 1068481 - RNA, 22 nt, Human
gagcuuccugaugccgaccagu

SEQ ID NO: 1068482 - RNA, 23 nt, Human
cuggucagaggcugcuggaaggg

SEQ ID NO: 1068483 - RNA, 22 nt, Human
guggcauucucggcaccaucug

SEQ ID NO: 1068484 - RNA, 22 nt, Human
aucagcaagauugugucuugua

SEQ ID NO: 1068485 - RNA, 22 nt, Human
cagaggaaaguauuucuggaag

SEQ ID NO: 1068486 - RNA, 22 nt, Human
ggugaagggccuuaggagacag

SEQ ID NO: 1068487 - RNA, 22 nt, Human
gacauauuugaaaccaagagaa

SEQ ID NO: 1068488 - RNA, 22 nt, Human
cuggcuggagcuguuguaggcu

SEQ ID NO: 1068489 - RNA, 22 nt, Human
agcaguggcuggauggugugcu

SEQ ID NO: 1068490 - RNA, 22 nt, Human
gccucugcgccucagccgaccu

SEQ ID NO: 1068491 - RNA, 22 nt, Human
uucuaaagugcaaucugacaga

SEQ ID NO: 1068492 - RNA, 20 nt, Human
auaauuuacccugcaccacu

SEQ ID NO: 1068493 - RNA, 22 nt, Human
uuaaaauuuccccaccauguau

SEQ ID NO: 1068494 - RNA, 22 nt, Human
cagcugccccauaaaucacagu

SEQ ID NO: 1068495 - RNA, 22 nt, Human
agguggcucugacagcucuggu

SEQ ID NO: 1068496 - RNA, 22 nt, Human
ccugucuggaacauggccuguu

SEQ ID NO: 1068497 - RNA, 22 nt, Human
aagaaucauuguaaaguucugu

SEQ ID NO: 1068498 - RNA, 22 nt, Human
cacuguaaccuccaccuccugg

SEQ ID NO: 1068499 - RNA, 17 nt, Human
gagaguguauuggaugc

SEQ ID NO: 1068500 - RNA, 22 nt, Human
cuuccucuagccuaguaaugcc

SEQ ID NO: 1068501 - RNA, 18 nt, Human
gagguccugcucuagccc

SEQ ID NO: 1068502 - RNA, 22 nt, Human
cugcuguguggauucaauggcu

SEQ ID NO: 1068503 - RNA, 22 nt, Human
agcuggggcugcagagaacagg

SEQ ID NO: 1068504 - RNA, 22 nt, Human
gacacagagcucacagucuccu

SEQ ID NO: 1068505 - RNA, 22 nt, Human
ucauuacagagauauaaucuac

SEQ ID NO: 1068506 - RNA, 22 nt, Human
cagacaugauguaagcagaggc

SEQ ID NO: 1068507 - RNA, 22 nt, Human
uacauauguaaacauguauaaa

SEQ ID NO: 1068508 - RNA, 22 nt, Human
ggggcagagcauagcuccaauu

SEQ ID NO: 1068509 - RNA, 22 nt, Human
gguggggcugcaagcaguucgg

SEQ ID NO: 1068510 - RNA, 22 nt, Human
cuggggcuggugaggcaggcuc

SEQ ID NO: 1068511 - RNA, 19 nt, Human
gggaugcacucugaccacu

SEQ ID NO: 1068512 - RNA, 22 nt, Human
ucagguggcuuggagggggacg

SEQ ID NO: 1068513 - RNA, 22 nt, Human
cuucugggccauggccuuccuc

SEQ ID NO: 1068514 - RNA, 22 nt, Human
uggcagucggacuucuaucuca

SEQ ID NO: 1068515 - RNA, 22 nt, Human
aaucagaaccuugggucauaac

SEQ ID NO: 1068516 - RNA, 22 nt, Human
cuaucuuuuguucauuuugagu

SEQ ID NO: 1068517 - RNA, 22 nt, Human
agcaggcuuuccacagaaggag

SEQ ID NO: 1068518 - RNA, 22 nt, Human
uaacacauagauauuuuaacuu

SEQ ID NO: 1068519 - RNA, 22 nt, Human
gacaggaggcagagcucaggug

SEQ ID NO: 1068520 - RNA, 22 nt, Human
uaugaacuuuugaugugacaug

SEQ ID NO: 1068521 - RNA, 21 nt, Human
aggaagaaagguuggagguug

SEQ ID NO: 1068522 - RNA, 22 nt, Human
aagcagccacuggccaguuaua

SEQ ID NO: 1068523 - RNA, 22 nt, Human
gagaagccgagucagcugagcc

SEQ ID NO: 1068524 - RNA, 22 nt, Human
uuucagugaaagcuacuguuag

SEQ ID NO: 1068525 - RNA, 22 nt, Human
uguggcaguaaaauugggcaac

SEQ ID NO: 1068526 - RNA, 22 nt, Human
ucugggcuuuguaaugggaggu

SEQ ID NO: 1068527 - RNA, 22 nt, Human
ugcacuguugcuuuauaugauu

SEQ ID NO: 1068528 - RNA, 20 nt, Human
gccugcagguuggaugggau

SEQ ID NO: 1068529 - RNA, 22 nt, Human
uacuuuuuagcacagugugugc

SEQ ID NO: 1068530 - RNA, 22 nt, Human
acacccaggcuggcgugcagug

SEQ ID NO: 1068531 - RNA, 22 nt, Human
aauuucaguaugaaguuucaca

SEQ ID NO: 1068532 - RNA, 22 nt, Human
ccuggagcgcgggucaagcugg

SEQ ID NO: 1068533 - RNA, 23 nt, Human
aacacauugcuaauuacauucaa

SEQ ID NO: 1068534 - RNA, 19 nt, Human
ucccuggcgccucucgggc

SEQ ID NO: 1068535 - RNA, 22 nt, Human
cuauuucauguuccuauggccg

SEQ ID NO: 1068536 - RNA, 22 nt, Human
uagaaauccccagucucauagu

SEQ ID NO: 1068537 - RNA, 22 nt, Human
augauucagggaguuuucagga

SEQ ID NO: 1068538 - RNA, 19 nt, Human
aggugaugugacucuagaa

SEQ ID NO: 1068539 - RNA, 17 nt, Human
agugaaauuuacauugc

SEQ ID NO: 1068540 - RNA, 17 nt, Human
cccugcacccuacucuc

SEQ ID NO: 1068541 - RNA, 22 nt, Human
uacuacauuaauaaaacauuca

SEQ ID NO: 1068542 - RNA, 22 nt, Human
aauguuugagcaucuacaugcu

SEQ ID NO: 1068543 - RNA, 22 nt, Human
acagaugaaucugugauugcug

SEQ ID NO: 1068544 - RNA, 22 nt, Human
aggcagguguuaacccucugag

SEQ ID NO: 1068545 - RNA, 23 nt, Human
uacuauaacgcugugucagcucc

SEQ ID NO: 1068546 - RNA, 22 nt, Human
ucaggggagguugaaucgucuc

SEQ ID NO: 1068547 - RNA, 22 nt, Human
gggcuggcugauuuuccucucu

SEQ ID NO: 1068548 - RNA, 22 nt, Human
cauguguagguauacaaaauuc

SEQ ID NO: 1068549 - RNA, 22 nt, Human
ugcaugcaaugugaagaaagcu

SEQ ID NO: 1068550 - RNA, 22 nt, Human
ccagcagcccacaggcgucccu

SEQ ID NO: 1068551 - RNA, 22 nt, Human
aggggagcaaggccguggugua

SEQ ID NO: 1068552 - RNA, 22 nt, Human
aaauacagaguugcuuaaaagc

SEQ ID NO: 1068553 - RNA, 22 nt, Human
uucagcuagcaucucacuuggu

SEQ ID NO: 1068554 - RNA, 22 nt, Human
uccaggcucagcacuugcuacu

SEQ ID NO: 1068555 - RNA, 22 nt, Human
ucccacugcuuugcucugcuca

SEQ ID NO: 1068556 - RNA, 22 nt, Human
gcugucugucuucacaucucgc

SEQ ID NO: 1068557 - RNA, 22 nt, Human
aaacugucauuggaugcauuug

SEQ ID NO: 1068558 - RNA, 22 nt, Human
agcaggaacucagggaguucuc

SEQ ID NO: 1068559 - RNA, 22 nt, Human
uuccagaagauggcagcaaagg

SEQ ID NO: 1068560 - RNA, 22 nt, Human
agaagaauacuugauguucaug

SEQ ID NO: 1068561 - RNA, 22 nt, Human
gcagaggcuccauuuuacagau

SEQ ID NO: 1068562 - RNA, 22 nt, Human
aaauaaguuaaacuagaaugau

SEQ ID NO: 1068563 - RNA, 22 nt, Human
aacuuucuuugcaucuaaguuu

SEQ ID NO: 1068564 - RNA, 22 nt, Human
ugaaaaacuuuaauccauaaag

SEQ ID NO: 1068565 - RNA, 22 nt, Human
auggcugugaaggucacacccu

SEQ ID NO: 1068566 - RNA, 18 nt, Human
gccugccuagagcuugcc

SEQ ID NO: 1068567 - RNA, 22 nt, Human
acuuccaaauaccaucacauug

SEQ ID NO: 1068568 - RNA, 22 nt, Human
gggggcuguccugugcauugua

SEQ ID NO: 1068569 - RNA, 22 nt, Human
uagcucuagcacuggauaaucc

SEQ ID NO: 1068570 - RNA, 22 nt, Human
gucuggagagcugagcagaguu

SEQ ID NO: 1068571 - RNA, 22 nt, Human
cagugcaggaagugagaugccu

SEQ ID NO: 1068572 - RNA, 22 nt, Human
guuugcauuccaauuuagggga

SEQ ID NO: 1068573 - RNA, 19 nt, Human
ugcaggaggacugagcaga

SEQ ID NO: 1068574 - RNA, 22 nt, Human
gaucaacaaauguccuuuguga

SEQ ID NO: 1068575 - RNA, 22 nt, Human
gcccugcugucuucagaguaua

SEQ ID NO: 1068576 - RNA, 22 nt, Human
gcagggcucaacaggacacccc

SEQ ID NO: 1068577 - RNA, 22 nt, Human
ggagcuguugcgcaugcgcucg

SEQ ID NO: 1068578 - RNA, 21 nt, Human
uucugcuaagaaaacauuauu

SEQ ID NO: 1068579 - RNA, 22 nt, Human
aaguucagccugguuuuaaugc

SEQ ID NO: 1068580 - RNA, 22 nt, Human
agcuuguaacagacauaaaaau

SEQ ID NO: 1068581 - RNA, 22 nt, Human
gcuacugauugaccuuggagag

SEQ ID NO: 1068582 - RNA, 22 nt, Human
auaugagagaggaaagauuuua

SEQ ID NO: 1068583 - RNA, 22 nt, Human
aagaaagagaucacuccuccau

SEQ ID NO: 1068584 - RNA, 22 nt, Human
gggcugagugaccucaggccaa

SEQ ID NO: 1068585 - RNA, 22 nt, Human
gggaagagaccguacccuggcc

SEQ ID NO: 1068586 - RNA, 19 nt, Human
ugucucagugucccuuccu

SEQ ID NO: 1068587 - RNA, 22 nt, Human
guauaucaccccaagcagcuga

SEQ ID NO: 1068588 - RNA, 22 nt, Human
aacauuucuucugaaacugagu

SEQ ID NO: 1068589 - RNA, 22 nt, Human
acucugugugaguagagccugu

SEQ ID NO: 1068590 - RNA, 22 nt, Human
gccugagccgccugagcggcgg

SEQ ID NO: 1068591 - RNA, 22 nt, Human
cagggagaagucuggucagucc

SEQ ID NO: 1068592 - RNA, 22 nt, Human
caugagacugccuuuucaaacc

SEQ ID NO: 1068593 - RNA, 22 nt, Human
cuggaaggcucugcugccuguc

SEQ ID NO: 1068594 - RNA, 22 nt, Human
aaaggaguuacucauaaagcuu

SEQ ID NO: 1068595 - RNA, 23 nt, Human
uggcucucucagugcugcagagg

SEQ ID NO: 1068596 - RNA, 22 nt, Human
gagaugcugccugauuuauuca

SEQ ID NO: 1068597 - RNA, 22 nt, Human
agaggcaccaucuggaacagcc

SEQ ID NO: 1068598 - RNA, 22 nt, Human
aguggcugauguaggcaguggg

SEQ ID NO: 1068599 - RNA, 22 nt, Human
uggaggaugccuggggaggccu

SEQ ID NO: 1068600 - RNA, 22 nt, Human
acagcuguggggacucuugccc

SEQ ID NO: 1068601 - RNA, 22 nt, Human
cacaggaauaagucaaacuuca

SEQ ID NO: 1068602 - RNA, 22 nt, Human
cuggcagggugggcuuugcuuu

SEQ ID NO: 1068603 - RNA, 22 nt, Human
uacuugugugucaugugcagag

SEQ ID NO: 1068604 - RNA, 22 nt, Human
cggcuggugucgggcacagcaa

SEQ ID NO: 1068605 - RNA, 22 nt, Human
caucuuuucagaagccauucug

SEQ ID NO: 1068606 - RNA, 22 nt, Human
cucuucagcaaugcuuuagucc

SEQ ID NO: 1068607 - RNA, 22 nt, Human
uagcagcaauuacacaguccgu

SEQ ID NO: 1068608 - RNA, 20 nt, Human
ucaggcuccgcauuaacuua

SEQ ID NO: 1068609 - RNA, 22 nt, Human
gcagggcuauuggaaggagaug

SEQ ID NO: 1068610 - RNA, 22 nt, Human
ugcugagguuucugacuaugga

SEQ ID NO: 1068611 - RNA, 22 nt, Human
uuuuuguucugauuauacuggu

SEQ ID NO: 1068612 - RNA, 22 nt, Human
caggcugccuggaagaggacug

SEQ ID NO: 1068613 - RNA, 22 nt, Human
cuguguccugucuccuaaggug

SEQ ID NO: 1068614 - RNA, 22 nt, Human
ucucaagagggaggcaaucaug

SEQ ID NO: 1068615 - RNA, 22 nt, Human
uuccaaguguugagauuagagg

SEQ ID NO: 1068616 - RNA, 22 nt, Human
agaaaugaagagagucaagguu

SEQ ID NO: 1068617 - RNA, 22 nt, Human
cccucccugugugccucauuug

SEQ ID NO: 1068618 - RNA, 22 nt, Human
ccagaggaugcuggucagccuc

SEQ ID NO: 1068619 - RNA, 22 nt, Human
gggcugucaugugucagugacc

SEQ ID NO: 1068620 - RNA, 20 nt, Human
cugagcugagcuccaugggu

SEQ ID NO: 1068621 - RNA, 22 nt, Human
auaauauugaagagccuuggcc

SEQ ID NO: 1068622 - RNA, 22 nt, Human
gcagggcaaugaucccgagagg

SEQ ID NO: 1068623 - RNA, 22 nt, Human
gguggggcucagcaaucugugu

SEQ ID NO: 1068624 - RNA, 20 nt, Human
gcaugaggaaucauugcagc

SEQ ID NO: 1068625 - RNA, 22 nt, Human
ugcacagcuggcucuccuuuuc

SEQ ID NO: 1068626 - RNA, 22 nt, Human
cagggccacacggaagggaaca

SEQ ID NO: 1068627 - RNA, 22 nt, Human
cccagaguucaaacccugcguc

SEQ ID NO: 1068628 - RNA, 23 nt, Human
ugaaaguucugaagagaucaugc

SEQ ID NO: 1068629 - RNA, 22 nt, Human
aucauuuaaaacaagucucuau

SEQ ID NO: 1068630 - RNA, 22 nt, Human
cccaggugcugcgugaagccuc

SEQ ID NO: 1068631 - RNA, 22 nt, Human
ugguggcaauguccuggagaag

SEQ ID NO: 1068632 - RNA, 22 nt, Human
aaguauuucguucugaaaaagu

SEQ ID NO: 1068633 - RNA, 22 nt, Human
gcugggcucugucaugccuucc

SEQ ID NO: 1068634 - RNA, 22 nt, Human
uuuggaaagacacacaguuuua

SEQ ID NO: 1068635 - RNA, 22 nt, Human
uccagggagauggcagaggcug

SEQ ID NO: 1068636 - RNA, 20 nt, Human
agggcagcuugaggagccgg

SEQ ID NO: 1068637 - RNA, 23 nt, Human
ugagcugggccugcaggggucuc

SEQ ID NO: 1068638 - RNA, 22 nt, Human
uuaagcucucauuauuauuauu

SEQ ID NO: 1068639 - RNA, 22 nt, Human
uggaaagaaaguaaaggcguau

SEQ ID NO: 1068640 - RNA, 22 nt, Human
gggcucuuuucugagcuucacu

SEQ ID NO: 1068641 - RNA, 22 nt, Human
cgaacacacuugggaguucuga

SEQ ID NO: 1068642 - RNA, 22 nt, Human
aaggcagucugguuucaaagca

SEQ ID NO: 1068643 - RNA, 22 nt, Human
uaaauuuuuguuaacagccucu

SEQ ID NO: 1068644 - RNA, 22 nt, Human
gacacagaaggucacauguuca

SEQ ID NO: 1068645 - RNA, 22 nt, Human
aagauuucucuccuggaaagca

SEQ ID NO: 1068646 - RNA, 22 nt, Human
acaguacagcugaaacuuuagu

SEQ ID NO: 1068647 - RNA, 22 nt, Human
ccagccagcugguuggacgccu

SEQ ID NO: 1068648 - RNA, 22 nt, Human
uaaagcaaaaaugaacugccau

SEQ ID NO: 1068649 - RNA, 23 nt, Human
acacucuucccagaagguucuga

SEQ ID NO: 1068650 - RNA, 22 nt, Human
cagcuguugacugguacaugaa

SEQ ID NO: 1068651 - RNA, 22 nt, Human
aggaagcaccggaaugaugacu

SEQ ID NO: 1068652 - RNA, 22 nt, Human
acugcccuggagacagcagagu

SEQ ID NO: 1068653 - RNA, 22 nt, Human
ugaauucaggggcuauuauauu

SEQ ID NO: 1068654 - RNA, 22 nt, Human
auaugaaaguaagcaugugugu

SEQ ID NO: 1068655 - RNA, 22 nt, Human
uucuugaaaauagccauguaca

SEQ ID NO: 1068656 - RNA, 21 nt, Human
gggcucuccugaggccaugaa

SEQ ID NO: 1068657 - RNA, 22 nt, Human
cagggccuucguaaguguccgg

SEQ ID NO: 1068658 - RNA, 22 nt, Human
aaaaucuaaguagcgaguaagg

SEQ ID NO: 1068659 - RNA, 22 nt, Human
gcuggagauaguaggauccaua

SEQ ID NO: 1068660 - RNA, 22 nt, Human
acagacagggcaccugccuccu

SEQ ID NO: 1068661 - RNA, 22 nt, Human
agccauugaauuuagugccuuu

SEQ ID NO: 1068662 - RNA, 22 nt, Human
cugcugugucagaguccagggg

SEQ ID NO: 1068663 - RNA, 22 nt, Human
aggcuuaaccugaucacaugag

SEQ ID NO: 1068664 - RNA, 22 nt, Human
uggggcaguuaauaaacauucu

SEQ ID NO: 1068665 - RNA, 22 nt, Human
ugggaggaaugucacugagcca

SEQ ID NO: 1068666 - RNA, 22 nt, Human
agaaaauaauuucuuggcuggu

SEQ ID NO: 1068667 - RNA, 22 nt, Human
cagcuacaaauacuuuuguaug

SEQ ID NO: 1068668 - RNA, 22 nt, Human
acagaagaaguucaaggugaag

SEQ ID NO: 1068669 - RNA, 22 nt, Human
ucugccuggacccuggugagcu

SEQ ID NO: 1068670 - RNA, 22 nt, Human
ccccugccagcuaucccugaac

SEQ ID NO: 1068671 - RNA, 22 nt, Human
acaucaguaauuaagucucaag

SEQ ID NO: 1068672 - RNA, 22 nt, Human
ggcaggugccuucugugcuagc

SEQ ID NO: 1068673 - RNA, 22 nt, Human
uugcagagaucagcagguuuga

SEQ ID NO: 1068674 - RNA, 22 nt, Human
cacauacugagaaucacaccca

SEQ ID NO: 1068675 - RNA, 22 nt, Human
ccaggagcuauguacacacuau

SEQ ID NO: 1068676 - RNA, 23 nt, Human
ccagcccuccaccagcucuaggc

SEQ ID NO: 1068677 - RNA, 22 nt, Human
ccagggccaagagaccucgagg

SEQ ID NO: 1068678 - RNA, 22 nt, Human
gggaaggaaaucuugcuuguga

SEQ ID NO: 1068679 - RNA, 22 nt, Human
acauuugaaauucugaacagau

SEQ ID NO: 1068680 - RNA, 22 nt, Human
gagauggggucagcugggacau

SEQ ID NO: 1068681 - RNA, 22 nt, Human
cagcuccccucuguggggcagu

SEQ ID NO: 1068682 - RNA, 22 nt, Human
cuuuuugcaagaguuucucauc

SEQ ID NO: 1068683 - RNA, 22 nt, Human
aggagucacucagggcuucauc

SEQ ID NO: 1068684 - RNA, 22 nt, Human
auaggcaagcacaaagucagga

SEQ ID NO: 1068685 - RNA, 22 nt, Human
acuguguguuugucuagcacag

SEQ ID NO: 1068686 - RNA, 22 nt, Human
cagaaguaaugaugucauuccu

SEQ ID NO: 1068687 - RNA, 22 nt, Human
uaagaaacugucacaguacuau

SEQ ID NO: 1068688 - RNA, 18 nt, Human
agggcucucugcuggguu

SEQ ID NO: 1068689 - RNA, 22 nt, Human
gcugggcagccuggccgcugcc

SEQ ID NO: 1068690 - RNA, 22 nt, Human
ucuaaacacgucucuuugaaua

SEQ ID NO: 1068691 - RNA, 22 nt, Human
aggauguggcugagacuucugg

SEQ ID NO: 1068692 - RNA, 22 nt, Human
uggggcugugagacuacaggau

SEQ ID NO: 1068693 - RNA, 22 nt, Human
agcugaggcauggacaggcugc

SEQ ID NO: 1068694 - RNA, 22 nt, Human
caugaaauggccaaccuucggc

SEQ ID NO: 1068695 - RNA, 22 nt, Human
uuccuuccgggcaccaggcacu

SEQ ID NO: 1068696 - RNA, 22 nt, Human
uguuacaguggcuuuuuaaaca

SEQ ID NO: 1068697 - RNA, 22 nt, Human
uuacaucauugagacauacaua

SEQ ID NO: 1068698 - RNA, 22 nt, Human
ggcagguguggaguguuauuuu

SEQ ID NO: 1068699 - RNA, 22 nt, Human
ccacacagggggaugaguuauu

SEQ ID NO: 1068700 - RNA, 22 nt, Human
agucagggccuggccugcugaa

SEQ ID NO: 1068701 - RNA, 22 nt, Human
ccucugaggugagcccagcugg

SEQ ID NO: 1068702 - RNA, 22 nt, Human
uuaauaacauuguguaucaccc

SEQ ID NO: 1068703 - RNA, 22 nt, Human
gcacacagacuaaccauauuuc

SEQ ID NO: 1068704 - RNA, 19 nt, Human
aucuuacagagcagaguac

SEQ ID NO: 1068705 - RNA, 19 nt, Human
ucucagaggaaaaauugcu

SEQ ID NO: 1068706 - RNA, 22 nt, Human
acaggcuggugguccuggccau

SEQ ID NO: 1068707 - RNA, 22 nt, Human
agugccaggagcaaggagcucc

SEQ ID NO: 1068708 - RNA, 22 nt, Human
aggaagcuuggggcagggcuac

SEQ ID NO: 1068709 - RNA, 22 nt, Human
ucccagaggcaguugguaacuu

SEQ ID NO: 1068710 - RNA, 22 nt, Human
gacacagagauaggccuguguu

SEQ ID NO: 1068711 - RNA, 22 nt, Human
cacaggaaucagcauuaauggc

SEQ ID NO: 1068712 - RNA, 22 nt, Human
gcgcaggugcugcuggagcagc

SEQ ID NO: 1068713 - RNA, 22 nt, Human
cccuuccucccaggcuucugug

SEQ ID NO: 1068714 - RNA, 22 nt, Human
cuucugggcagaaguuuugaga

SEQ ID NO: 1068715 - RNA, 22 nt, Human
gcuggagcuugagaggacaggg

SEQ ID NO: 1068716 - RNA, 22 nt, Human
augcacaauguuuugauuugag

SEQ ID NO: 1068717 - RNA, 17 nt, Human
ugacuuuauuugcuugg

SEQ ID NO: 1068718 - RNA, 22 nt, Human
cccaggaaaagcagugccagca

SEQ ID NO: 1068719 - RNA, 22 nt, Human
ucuugauuugaauugcaguugu

SEQ ID NO: 1068720 - RNA, 22 nt, Human
uaguaacagcagcuucccugug

SEQ ID NO: 1068721 - RNA, 22 nt, Human
cugcccugcuaaugaguuccaa

SEQ ID NO: 1068722 - RNA, 22 nt, Human
agggccagcagcuuggccaacc

SEQ ID NO: 1068723 - RNA, 22 nt, Human
gcaccacaucaaugaggggagc

SEQ ID NO: 1068724 - RNA, 22 nt, Human
gcaggugguccccguggagugg

SEQ ID NO: 1068725 - RNA, 18 nt, Human
gaacagcaauuucauguu

SEQ ID NO: 1068726 - RNA, 22 nt, Human
ucugagagcucuggggccccuu

SEQ ID NO: 1068727 - RNA, 22 nt, Human
aggaacccggucugucacugug

SEQ ID NO: 1068728 - RNA, 22 nt, Human
cugugggaugggaccucagcug

SEQ ID NO: 1068729 - RNA, 22 nt, Human
ggcuuugguagacacagauuga

SEQ ID NO: 1068730 - RNA, 22 nt, Human
uauuuuacagacuacuuuagau

SEQ ID NO: 1068731 - RNA, 23 nt, Human
ugcugguguuuuugggaccaggg

SEQ ID NO: 1068732 - RNA, 22 nt, Human
aagucauuccugcuuguugccc

SEQ ID NO: 1068733 - RNA, 22 nt, Human
aggcucuguuauucuagagggc

SEQ ID NO: 1068734 - RNA, 22 nt, Human
ccacuguauuuuggaagcagau

SEQ ID NO: 1068735 - RNA, 22 nt, Human
aaacugaaacaucaucauguug

SEQ ID NO: 1068736 - RNA, 22 nt, Human
ugggagagugcucaaugugcaa

SEQ ID NO: 1068737 - RNA, 22 nt, Human
uuucacaggaguccuuucuaua

SEQ ID NO: 1068738 - RNA, 22 nt, Human
uuuuugucaucuauuucuggug

SEQ ID NO: 1068739 - RNA, 22 nt, Human
acagaaaaaugagggagcugga

SEQ ID NO: 1068740 - RNA, 22 nt, Human
aagaugcaugcugaagcuggcu

SEQ ID NO: 1068741 - RNA, 20 nt, Human
aaacacagccucucuuuaca

SEQ ID NO: 1068742 - RNA, 22 nt, Human
aacugaaaguuucaccugaggu

SEQ ID NO: 1068743 - RNA, 22 nt, Human
cagcagagaaauuaaacuucug

SEQ ID NO: 1068744 - RNA, 21 nt, Human
cagggcacacagaggauggua

SEQ ID NO: 1068745 - RNA, 22 nt, Human
cuuauaaaguccaucugaacaa

SEQ ID NO: 1068746 - RNA, 22 nt, Human
gaguggggucugggcaucaguc

SEQ ID NO: 1068747 - RNA, 22 nt, Human
agcuagagcugagaagcacuug

SEQ ID NO: 1068748 - RNA, 22 nt, Human
gugcccuggaugacuuuggucu

SEQ ID NO: 1068749 - RNA, 22 nt, Human
ucaucgccucgugcaucuuggc

SEQ ID NO: 1068750 - RNA, 22 nt, Human
ucuacauuccuuuuauaauauc

SEQ ID NO: 1068751 - RNA, 22 nt, Human
uucauagaagcagaaaguaaac

SEQ ID NO: 1068752 - RNA, 22 nt, Human
uauuuggaaacaauucacaugc

SEQ ID NO: 1068753 - RNA, 22 nt, Human
ccuggccagggucugggcugcu

SEQ ID NO: 1068754 - RNA, 22 nt, Human
agaagcaggccucacagaucug

SEQ ID NO: 1068755 - RNA, 22 nt, Human
gugcaggagguaacauagcaaa

SEQ ID NO: 1068756 - RNA, 22 nt, Human
ugggagcugggguuggacgucu

SEQ ID NO: 1068757 - RNA, 22 nt, Human
cagcugccccuccagggcuggg

SEQ ID NO: 1068758 - RNA, 22 nt, Human
uugaaauuuuaggccuugcaau

SEQ ID NO: 1068759 - RNA, 22 nt, Human
uuaaacaguauaucugagcaag

SEQ ID NO: 1068760 - RNA, 22 nt, Human
acucugaggcaggucagggcag

SEQ ID NO: 1068761 - RNA, 22 nt, Human
cgcaggcucgguucacagagca

SEQ ID NO: 1068762 - RNA, 22 nt, Human
ggcccagccggcgagucucgcg

SEQ ID NO: 1068763 - RNA, 22 nt, Human
uuacucagucucccauacauug

SEQ ID NO: 1068764 - RNA, 22 nt, Human
ugccaggccacguagcuucaag

SEQ ID NO: 1068765 - RNA, 22 nt, Human
gcaauaaaauguaaugauuggg

SEQ ID NO: 1068766 - RNA, 22 nt, Human
acauuacauaagauuguaaccu

SEQ ID NO: 1068767 - RNA, 22 nt, Human
auggaagacuaacagaaacaug

SEQ ID NO: 1068768 - RNA, 22 nt, Human
ugcucugcaagcaggagcaaga

SEQ ID NO: 1068769 - RNA, 22 nt, Human
gaggggucacaugggcuggcuu

SEQ ID NO: 1068770 - RNA, 22 nt, Human
ucaauuuaagguacuacuuugg

SEQ ID NO: 1068771 - RNA, 21 nt, Human
cagcccagcuucuuccccagu

SEQ ID NO: 1068772 - RNA, 20 nt, Human
augcuuucuugugugcugcu

SEQ ID NO: 1068773 - RNA, 22 nt, Human
cuucuuucccaggcauguuuua

SEQ ID NO: 1068774 - RNA, 22 nt, Human
gugggggcuggcucguccugug

SEQ ID NO: 1068775 - RNA, 22 nt, Human
cacagaaucauauugucaguuu

SEQ ID NO: 1068776 - RNA, 21 nt, Human
uauugauucaauuucuugagu

SEQ ID NO: 1068777 - RNA, 22 nt, Human
ugcagcauugcaaagcagucuu

SEQ ID NO: 1068778 - RNA, 22 nt, Human
uagaaagaacuucauguaaaac

SEQ ID NO: 1068779 - RNA, 22 nt, Human
ugggccuggaguuuguccagag

SEQ ID NO: 1068780 - RNA, 22 nt, Human
agaaauuauuagugaauagucu

SEQ ID NO: 1068781 - RNA, 22 nt, Human
gggagggaggugcugguucacg

SEQ ID NO: 1068782 - RNA, 22 nt, Human
ccagaaaacucuacaugcuugu

SEQ ID NO: 1068783 - RNA, 22 nt, Human
gccagucugcucccacaaguuc

SEQ ID NO: 1068784 - RNA, 22 nt, Human
ggguggcaggauuggcaggagu

SEQ ID NO: 1068785 - RNA, 22 nt, Human
uguucccauuuucugcauaauc

SEQ ID NO: 1068786 - RNA, 22 nt, Human
cuacauuuuaauaagcugcuua

SEQ ID NO: 1068787 - RNA, 22 nt, Human
aggugcuagguguguaguggag

SEQ ID NO: 1068788 - RNA, 22 nt, Human
cccuagggcuaagcaggacugc

SEQ ID NO: 1068789 - RNA, 22 nt, Human
cugcaggcaucuaacugugggc

SEQ ID NO: 1068790 - RNA, 22 nt, Human
agggcucaauggugggcaugua

SEQ ID NO: 1068791 - RNA, 22 nt, Human
aaaagcaagaggcuggauuaaa

SEQ ID NO: 1068792 - RNA, 22 nt, Human
gaaagacuuccuuugagaguac

SEQ ID NO: 1068793 - RNA, 22 nt, Human
cugugugcugaaaugcagugag

SEQ ID NO: 1068794 - RNA, 22 nt, Human
gaagaaggguaaggaguguuga

SEQ ID NO: 1068795 - RNA, 22 nt, Human
cccugugagcggcuggaugccu

SEQ ID NO: 1068796 - RNA, 22 nt, Human
gagcugcagaguaaccuuugca

SEQ ID NO: 1068797 - RNA, 22 nt, Human
aacagccacugauacugaauag

SEQ ID NO: 1068798 - RNA, 22 nt, Human
ccagaagaccggggagucaggg

SEQ ID NO: 1068799 - RNA, 22 nt, Human
ggcccagcugugcuuccagccc

SEQ ID NO: 1068800 - RNA, 22 nt, Human
auuaauauugguucauuagcug

SEQ ID NO: 1068801 - RNA, 22 nt, Human
cugggaggcacuauucaggagg

SEQ ID NO: 1068802 - RNA, 22 nt, Human
uucacaguaaguaggauaguug

SEQ ID NO: 1068803 - RNA, 22 nt, Human
auauguguaaaugcauuuguuu

SEQ ID NO: 1068804 - RNA, 22 nt, Human
ggcagcacgacaggaguggaag

SEQ ID NO: 1068805 - RNA, 22 nt, Human
ucaguuuuuacggucacaggga

SEQ ID NO: 1068806 - RNA, 22 nt, Human
cucugggcuccuucagcccuuu

SEQ ID NO: 1068807 - RNA, 22 nt, Human
aucacagauugugaauaacuau

SEQ ID NO: 1068808 - RNA, 22 nt, Human
auguuuaauuaucuggguuuug

SEQ ID NO: 1068809 - RNA, 18 nt, Human
aggagccuuugcacugga

SEQ ID NO: 1068810 - RNA, 22 nt, Human
aaaugcaucagcucauaagaga

SEQ ID NO: 1068811 - RNA, 23 nt, Human
agugcuggagaagcuucuggcuu

SEQ ID NO: 1068812 - RNA, 22 nt, Human
gaggccaggagugcuguaaguu

SEQ ID NO: 1068813 - RNA, 22 nt, Human
auagacaaacacgaagaugaca

SEQ ID NO: 1068814 - RNA, 21 nt, Human
agaugcugugcuccaggagca

SEQ ID NO: 1068815 - RNA, 22 nt, Human
cugguggagagugggcucugga

SEQ ID NO: 1068816 - RNA, 22 nt, Human
gaacagcugcuagagaucugug

SEQ ID NO: 1068817 - RNA, 22 nt, Human
aucagaaaaacauaauguuauu

SEQ ID NO: 1068818 - RNA, 22 nt, Human
aaggggaaguagcaccagaggu

SEQ ID NO: 1068819 - RNA, 22 nt, Human
uuacacagaaacacuguucaga

SEQ ID NO: 1068820 - RNA, 22 nt, Human
uuuaacaugugaauuuuggaag

SEQ ID NO: 1068821 - RNA, 22 nt, Human
gagaagggauaugccacucucg

SEQ ID NO: 1068822 - RNA, 22 nt, Human
ucugaggccccugggcaggaug

SEQ ID NO: 1068823 - RNA, 22 nt, Human
ugaggcagcuuuuucugugugu

SEQ ID NO: 1068824 - RNA, 22 nt, Human
cacagcugcccuacuccaugug

SEQ ID NO: 1068825 - RNA, 22 nt, Human
ccagaaaauauggcuaagguga

SEQ ID NO: 1068826 - RNA, 22 nt, Human
cuauaucaucauuaccugcacc

SEQ ID NO: 1068827 - RNA, 22 nt, Human
ucaguuuuucuauacuuuguag

SEQ ID NO: 1068828 - RNA, 22 nt, Human
ggcaguggcuccucucuacucc

SEQ ID NO: 1068829 - RNA, 22 nt, Human
ugaagaaacgcagagagguagg

SEQ ID NO: 1068830 - RNA, 22 nt, Human
ggcagagcuuguuccuucuguu

SEQ ID NO: 1068831 - RNA, 22 nt, Human
gugcccugaguggguaggagag

SEQ ID NO: 1068832 - RNA, 22 nt, Human
uugguucaggacauauuugagu

SEQ ID NO: 1068833 - RNA, 19 nt, Human
uaucuguuuccugcuuguc

SEQ ID NO: 1068834 - RNA, 22 nt, Human
ggcugcucuccaucccaggccu

SEQ ID NO: 1068835 - RNA, 23 nt, Human
guccucuggagagaaaggcagua

SEQ ID NO: 1068836 - RNA, 22 nt, Human
ugauuuccucuacuagcaauua

SEQ ID NO: 1068837 - RNA, 22 nt, Human
ugccauccaucaguauuugugg

SEQ ID NO: 1068838 - RNA, 23 nt, Human
uggcugagauccuacuguuugcu

SEQ ID NO: 1068839 - RNA, 22 nt, Human
uauacacaggaaucugugaaaa

SEQ ID NO: 1068840 - RNA, 22 nt, Human
cagccaugagucuaagcaguuu

SEQ ID NO: 1068841 - RNA, 22 nt, Human
gcagcccaauggacugagacag

SEQ ID NO: 1068842 - RNA, 20 nt, Human
caggcacacucauuccugcu

SEQ ID NO: 1068843 - RNA, 22 nt, Human
cuggggacuugcagacacaauu

SEQ ID NO: 1068844 - RNA, 22 nt, Human
gugggccuucaacccugucugg

SEQ ID NO: 1068845 - RNA, 19 nt, Human
acacagggaucagaggguu

SEQ ID NO: 1068846 - RNA, 22 nt, Human
ccuccaggaacuugagagacac

SEQ ID NO: 1068847 - RNA, 18 nt, Human
cagaagcaggcagugcag

SEQ ID NO: 1068848 - RNA, 22 nt, Human
cuggcccuucucuugcuuccug

SEQ ID NO: 1068849 - RNA, 22 nt, Human
ggcaaagccuuccagcuguuac

SEQ ID NO: 1068850 - RNA, 22 nt, Human
auaaaauuugcuacuguuaaau

SEQ ID NO: 1068851 - RNA, 22 nt, Human
aggcucaggaggagcugccgga

SEQ ID NO: 1068852 - RNA, 22 nt, Human
uuuaagaaguuauguuauaaau

SEQ ID NO: 1068853 - RNA, 22 nt, Human
ugggcugagcacugaggaagga

SEQ ID NO: 1068854 - RNA, 16 nt, Human
ugggcagaugagaaga

SEQ ID NO: 1068855 - RNA, 22 nt, Human
ccuuagagaguacugggcugcc

SEQ ID NO: 1068856 - RNA, 22 nt, Human
cugccugcucaccagggcucug

SEQ ID NO: 1068857 - RNA, 22 nt, Human
gggagagaauuauugccagacc

SEQ ID NO: 1068858 - RNA, 22 nt, Human
uggcucaggaucuaagcagaau

SEQ ID NO: 1068859 - RNA, 22 nt, Human
accagggcuuacagcaguagcu

SEQ ID NO: 1068860 - RNA, 22 nt, Human
uuccauaauaaccugagagaaa

SEQ ID NO: 1068861 - RNA, 22 nt, Human
ccucccucuuucagucccacag

SEQ ID NO: 1068862 - RNA, 22 nt, Human
gaaagcaaguugacugcagaau

SEQ ID NO: 1068863 - RNA, 22 nt, Human
auucauaucauagaguuauuga

SEQ ID NO: 1068864 - RNA, 22 nt, Human
ggaugcaggggcagcagagccu

SEQ ID NO: 1068865 - RNA, 22 nt, Human
ucauugcaguagggagagaccc

SEQ ID NO: 1068866 - RNA, 22 nt, Human
uggugggggaggcugucuagca

SEQ ID NO: 1068867 - RNA, 22 nt, Human
ccuugcugcgugcuagcacaga

SEQ ID NO: 1068868 - RNA, 21 nt, Human
agauguuucccccuuggcuuc

SEQ ID NO: 1068869 - RNA, 22 nt, Human
cuugcaggcagggccuccugga

SEQ ID NO: 1068870 - RNA, 22 nt, Human
cugugucccuugucccagagcc

SEQ ID NO: 1068871 - RNA, 22 nt, Human
ggucucagcccucgccagcagc

SEQ ID NO: 1068872 - RNA, 22 nt, Human
gccuuggccaacaccuugcaaa

SEQ ID NO: 1068873 - RNA, 22 nt, Human
cccagcuugcccaggacugagg

SEQ ID NO: 1068874 - RNA, 22 nt, Human
uaauuucuaauucauuuucagu

SEQ ID NO: 1068875 - RNA, 22 nt, Human
acagccagggucucaggaggcg

SEQ ID NO: 1068876 - RNA, 22 nt, Human
aggcacacagcuugcauaaauc

SEQ ID NO: 1068877 - RNA, 22 nt, Human
guggagcaaucagagggucagu

SEQ ID NO: 1068878 - RNA, 23 nt, Human
ccugggcauuggcugcagcuucu

SEQ ID NO: 1068879 - RNA, 22 nt, Human
uguucuuaugaugaagcacuga

SEQ ID NO: 1068880 - RNA, 22 nt, Human
gacccucauugucaccgugagc

SEQ ID NO: 1068881 - RNA, 22 nt, Human
agugcuuuagagaaauggugcu

SEQ ID NO: 1068882 - RNA, 22 nt, Human
caggaucccuggccuccgccca

SEQ ID NO: 1068883 - RNA, 22 nt, Human
auaaagucauuucaaaaguuga

SEQ ID NO: 1068884 - RNA, 22 nt, Human
guguuuuagugcugcugagcug

SEQ ID NO: 1068885 - RNA, 22 nt, Human
gaauaacauuuuuuccuuuaca

SEQ ID NO: 1068886 - RNA, 22 nt, Human
auauucacacuguuuaguuaca

SEQ ID NO: 1068887 - RNA, 22 nt, Human
caggggccggcuguccgugccc

SEQ ID NO: 1068888 - RNA, 19 nt, Human
cagcucaguuugauucucu

SEQ ID NO: 1068889 - RNA, 22 nt, Human
ugcccuguuaucuuggaagagu

SEQ ID NO: 1068890 - RNA, 23 nt, Human
ucagaggaucaucaaacguuuuc

SEQ ID NO: 1068891 - RNA, 22 nt, Human
uggcugagccacuuguucagau

SEQ ID NO: 1068892 - RNA, 22 nt, Human
acaguuauucuuuaugcaacca

SEQ ID NO: 1068893 - RNA, 22 nt, Human
ggcaugggagugagcaaccuua

SEQ ID NO: 1068894 - RNA, 22 nt, Human
uuaaagcaggcaucauuccuca

SEQ ID NO: 1068895 - RNA, 15 nt, Human
aggcacugugggacc

SEQ ID NO: 1068896 - RNA, 22 nt, Human
cugaggucaauuaaucaacaac

SEQ ID NO: 1068897 - RNA, 22 nt, Human
acuauucauguuuccuaacuau

SEQ ID NO: 1068898 - RNA, 22 nt, Human
ucugucaccauucagcuugaau

SEQ ID NO: 1068899 - RNA, 22 nt, Human
gaauacaugauuaaaguuugau

SEQ ID NO: 1068900 - RNA, 22 nt, Human
auuuuucucucacacuuaccag

SEQ ID NO: 1068901 - RNA, 22 nt, Human
ugcugccaugcagagcaacaga

SEQ ID NO: 1068902 - RNA, 19 nt, Human
uucuggagguuacccugag

SEQ ID NO: 1068903 - RNA, 22 nt, Human
ggcugugccucaaggcuacuca

SEQ ID NO: 1068904 - RNA, 22 nt, Human
caggguggaauggaaugcuggc

SEQ ID NO: 1068905 - RNA, 22 nt, Human
aaauuaacuaucacuuuuguga

SEQ ID NO: 1068906 - RNA, 22 nt, Human
ugaugcugcugggaguggugcu

SEQ ID NO: 1068907 - RNA, 22 nt, Human
ggcaggugaguucauuaucugc

SEQ ID NO: 1068908 - RNA, 22 nt, Human
aaaauaguuaacguucagagua

SEQ ID NO: 1068909 - RNA, 22 nt, Human
gguggggcuaggaccucaggau

SEQ ID NO: 1068910 - RNA, 22 nt, Human
uuucacaugugcuguugucaau

SEQ ID NO: 1068911 - RNA, 22 nt, Human
aaauaguuguuuggaucaauaa

SEQ ID NO: 1068912 - RNA, 23 nt, Human
agggguggucaguacccgcagug

SEQ ID NO: 1068913 - RNA, 23 nt, Human
acacauauauucagauacagaug

SEQ ID NO: 1068914 - RNA, 22 nt, Human
uugcucugaacccagggcacca

SEQ ID NO: 1068915 - RNA, 22 nt, Human
ugccugugaucagcugaguuca

SEQ ID NO: 1068916 - RNA, 22 nt, Human
uucuggggccccaguguccucg

SEQ ID NO: 1068917 - RNA, 23 nt, Human
uuccaagugcuuuacuuaauccu

SEQ ID NO: 1068918 - RNA, 22 nt, Human
ugaacagauggcccagcagagg

SEQ ID NO: 1068919 - RNA, 22 nt, Human
auacaaugaaguauagaugaaa

SEQ ID NO: 1068920 - RNA, 22 nt, Human
cucacugugaccucagcagaca

SEQ ID NO: 1068921 - RNA, 22 nt, Human
cuuuauggaaucaaagacugga

SEQ ID NO: 1068922 - RNA, 20 nt, Human
ucacagaaacaaauagagaa

SEQ ID NO: 1068923 - RNA, 22 nt, Human
ccagaagauggcucaaaccaug

SEQ ID NO: 1068924 - RNA, 22 nt, Human
ugcaggcuuuagccccauggcu

SEQ ID NO: 1068925 - RNA, 22 nt, Human
guuucacagggccauggaggaa

SEQ ID NO: 1068926 - RNA, 22 nt, Human
uuggcauuuauucuaaggucaa

SEQ ID NO: 1068927 - RNA, 22 nt, Human
uucuuaacuggaaaaugucaga

SEQ ID NO: 1068928 - RNA, 22 nt, Human
ucacagaauagcacuguaagcg

SEQ ID NO: 1068929 - RNA, 22 nt, Human
uucuugauuucaugcaguuaag

SEQ ID NO: 1068930 - RNA, 18 nt, Human
cuuuagcugucaucuuug

SEQ ID NO: 1068931 - RNA, 22 nt, Human
gcagggaaggggacggaaccag

SEQ ID NO: 1068932 - RNA, 21 nt, Human
gccaaggggguagcuauuccu

SEQ ID NO: 1068933 - RNA, 22 nt, Human
uggccugggccugccggugcaa

SEQ ID NO: 1068934 - RNA, 22 nt, Human
cuguagccaguuuggccucacc

SEQ ID NO: 1068935 - RNA, 22 nt, Human
aaguacuucuagauggauaauc

SEQ ID NO: 1068936 - RNA, 22 nt, Human
gcucucugguuccagucaggaa

SEQ ID NO: 1068937 - RNA, 22 nt, Human
uagagugguuaacaguuuagaa

SEQ ID NO: 1068938 - RNA, 22 nt, Human
gccuguguggaugggccccugg

SEQ ID NO: 1068939 - RNA, 22 nt, Human
aucagcaaguccuguuaauucu

SEQ ID NO: 1068940 - RNA, 22 nt, Human
ccuggcugugugaccuuggcaa

SEQ ID NO: 1068941 - RNA, 22 nt, Human
aaaaaguauuggccaugguuga

SEQ ID NO: 1068942 - RNA, 22 nt, Human
uuucacauguauauaggcauua

SEQ ID NO: 1068943 - RNA, 22 nt, Human
gcugcagggcucucacaggggg

SEQ ID NO: 1068944 - RNA, 22 nt, Human
agcccaagcauaggagggaggc

SEQ ID NO: 1068945 - RNA, 22 nt, Human
ucaucacucauuggacaacaga

SEQ ID NO: 1068946 - RNA, 22 nt, Human
ucauuuccucaaauucaagguu

SEQ ID NO: 1068947 - RNA, 22 nt, Human
caagaaucagaccugucagggu

SEQ ID NO: 1068948 - RNA, 22 nt, Human
uacccaggagaaacagcagggc

SEQ ID NO: 1068949 - RNA, 22 nt, Human
cacagugauugauuuuuacuuu

SEQ ID NO: 1068950 - RNA, 22 nt, Human
ccuggcugucguuuugugaaau

SEQ ID NO: 1068951 - RNA, 20 nt, Human
ugcagggccuaaaaagggaa

SEQ ID NO: 1068952 - RNA, 22 nt, Human
auaauuaauuucaguaaucucc

SEQ ID NO: 1068953 - RNA, 22 nt, Human
ugccaggcuuagagcaggggcu

SEQ ID NO: 1068954 - RNA, 22 nt, Human
gauguguauuuggaagacaaaa

SEQ ID NO: 1068955 - RNA, 22 nt, Human
acauucuauucugcaggacaag

SEQ ID NO: 1068956 - RNA, 22 nt, Human
auggcagacgaggcagcagggg

SEQ ID NO: 1068957 - RNA, 22 nt, Human
gacuucucccaaccaucagagg

SEQ ID NO: 1068958 - RNA, 22 nt, Human
auggaaagggaagcaaggaaca

SEQ ID NO: 1068959 - RNA, 22 nt, Human
uucagagaugacaccugguguu

SEQ ID NO: 1068960 - RNA, 22 nt, Human
cagagccacuuggagaugagaa

SEQ ID NO: 1068961 - RNA, 22 nt, Human
gucaggaucaaauugaaguuau

SEQ ID NO: 1068962 - RNA, 17 nt, Human
caauuucauagguuuug

SEQ ID NO: 1068963 - RNA, 22 nt, Human
aggagcugaaacuucucauaug

SEQ ID NO: 1068964 - RNA, 22 nt, Human
ucuuuauuuaagucuguuguaa

SEQ ID NO: 1068965 - RNA, 22 nt, Human
gccaggaaucacugcugaguaa

SEQ ID NO: 1068966 - RNA, 22 nt, Human
acaacacagcuuuccucaaguu

SEQ ID NO: 1068967 - RNA, 22 nt, Human
ggcaggcuagcacugauguccu

SEQ ID NO: 1068968 - RNA, 22 nt, Human
aucaguuuggugcuuucaguga

SEQ ID NO: 1068969 - RNA, 22 nt, Human
ucaggaacccuggucuccugcu

SEQ ID NO: 1068970 - RNA, 22 nt, Human
cugaaaaacgggauuuggcugg

SEQ ID NO: 1068971 - RNA, 22 nt, Human
aggccugcuguguagccuguug

SEQ ID NO: 1068972 - RNA, 17 nt, Human
ucugggcuucagugguc

SEQ ID NO: 1068973 - RNA, 22 nt, Human
agguaccaaaagccuuuuucug

SEQ ID NO: 1068974 - RNA, 22 nt, Human
ggucucagcaguugcuuugacu

SEQ ID NO: 1068975 - RNA, 22 nt, Human
acacaucaugccaaguuucacc

SEQ ID NO: 1068976 - RNA, 22 nt, Human
agugcccuuuacaacuucuuga

SEQ ID NO: 1068977 - RNA, 22 nt, Human
uuuuaaaggcagauuauggcuu

SEQ ID NO: 1068978 - RNA, 22 nt, Human
gagcuggcagugguagacaugg

SEQ ID NO: 1068979 - RNA, 22 nt, Human
ugcugugauggagaauucugga

SEQ ID NO: 1068980 - RNA, 22 nt, Human
acacagugguguuuacaaaauu

SEQ ID NO: 1068981 - RNA, 22 nt, Human
cugcuuuaucugagacaaguca

SEQ ID NO: 1068982 - RNA, 22 nt, Human
cugggaguguucuaggucacau

SEQ ID NO: 1068983 - RNA, 22 nt, Human
guguguuuagcauuagcagggg

SEQ ID NO: 1068984 - RNA, 22 nt, Human
ggcagcacugcagcuuguuggg

SEQ ID NO: 1068985 - RNA, 22 nt, Human
aaacaucuuucuauugcaaguu

SEQ ID NO: 1068986 - RNA, 22 nt, Human
ucccacaggaaaguagacauug

SEQ ID NO: 1068987 - RNA, 22 nt, Human
ggcagcuuuuaucccugacaga

SEQ ID NO: 1068988 - RNA, 22 nt, Human
uggcagcagcaaauggcauauc

SEQ ID NO: 1068989 - RNA, 22 nt, Human
aguucucagcuuaguaugcugu

SEQ ID NO: 1068990 - RNA, 22 nt, Human
cuuagaaauuguuacucauuca

SEQ ID NO: 1068991 - RNA, 21 nt, Human
ugccagcauguaggcuaguug

SEQ ID NO: 1068992 - RNA, 22 nt, Human
ugagccccaggaaauugaggag

SEQ ID NO: 1068993 - RNA, 22 nt, Human
cuggccugaucucaugcugucc

SEQ ID NO: 1068994 - RNA, 22 nt, Human
cugggcaguuuauucaguucug

SEQ ID NO: 1068995 - RNA, 22 nt, Human
aguguccuccucugggagccag

SEQ ID NO: 1068996 - RNA, 22 nt, Human
ugguggcagcugagugucaggu

SEQ ID NO: 1068997 - RNA, 22 nt, Human
aaucaugugggauagucugcuc

SEQ ID NO: 1068998 - RNA, 22 nt, Human
ugcuggaaccaggaauuugaag

SEQ ID NO: 1068999 - RNA, 22 nt, Human
acagagcacauagauuggaguu

SEQ ID NO: 1069000 - RNA, 22 nt, Human
cucuucagguuucugcucugga

SEQ ID NO: 1069001 - RNA, 22 nt, Human
gcuucucucucagacugcaagc

SEQ ID NO: 1069002 - RNA, 22 nt, Human
cauauugcugucauugucccuc

SEQ ID NO: 1069003 - RNA, 23 nt, Human
uaugugcauauguguaagaauac

SEQ ID NO: 1069004 - RNA, 22 nt, Human
gucuaaaccucaaaucaguguc

SEQ ID NO: 1069005 - RNA, 22 nt, Human
aaaaggauguuuucaugaaaca

SEQ ID NO: 1069006 - RNA, 22 nt, Human
uucaaacauucaaauaaaccgg

SEQ ID NO: 1069007 - RNA, 22 nt, Human
ucuggcaggacaugcugaccau

SEQ ID NO: 1069008 - RNA, 23 nt, Human
auucuucauuaucuucuagaaaa

SEQ ID NO: 1069009 - RNA, 22 nt, Human
aggcacuugauuaaugugaauu

SEQ ID NO: 1069010 - RNA, 22 nt, Human
cucagaaaggugccauuuaugu

SEQ ID NO: 1069011 - RNA, 22 nt, Human
ucucucagucagaugcuaaaga

SEQ ID NO: 1069012 - RNA, 22 nt, Human
gcagcugcuguggcaucaagcu

SEQ ID NO: 1069013 - RNA, 19 nt, Human
cccuggcaggcaagccugg

SEQ ID NO: 1069014 - RNA, 22 nt, Human
acagugaugggggugcaggaag

SEQ ID NO: 1069015 - RNA, 22 nt, Human
uguuccaagcugcuggauaagc

SEQ ID NO: 1069016 - RNA, 22 nt, Human
aaaacugagguuuccugaagaa

SEQ ID NO: 1069017 - RNA, 20 nt, Human
agagacccuguagcuugcag

SEQ ID NO: 1069018 - RNA, 22 nt, Human
uaggcagauguuaacaggaaaa

SEQ ID NO: 1069019 - RNA, 22 nt, Human
gcugcuccgucugagcucuggu

SEQ ID NO: 1069020 - RNA, 22 nt, Human
ucuuuguuuguacuguuagaau

SEQ ID NO: 1069021 - RNA, 22 nt, Human
agcagcuuacauguggccuauc

SEQ ID NO: 1069022 - RNA, 22 nt, Human
ccugcagcuccggauuucuggg

SEQ ID NO: 1069023 - RNA, 22 nt, Human
ccugccugcaaaaugggacaag

SEQ ID NO: 1069024 - RNA, 22 nt, Human
ucacaaauauagugagaaccag

SEQ ID NO: 1069025 - RNA, 22 nt, Human
uguuuucuuccuaauugcucau

SEQ ID NO: 1069026 - RNA, 22 nt, Human
aagugaaacauguaucucuuua

SEQ ID NO: 1069027 - RNA, 22 nt, Human
aggucauugaaguuauuuucuu

SEQ ID NO: 1069028 - RNA, 19 nt, Human
agggucaggacaaggacuu

SEQ ID NO: 1069029 - RNA, 22 nt, Human
ugaugcugucaaggaggugaac

SEQ ID NO: 1069030 - RNA, 22 nt, Human
uuucagaaagcugaacauauga

SEQ ID NO: 1069031 - RNA, 22 nt, Human
acaggugaccugcucauaugaa

SEQ ID NO: 1069032 - RNA, 22 nt, Human
gccaguaagugguagagacuua

SEQ ID NO: 1069033 - RNA, 22 nt, Human
ugggccagcaauugcugcucag

SEQ ID NO: 1069034 - RNA, 22 nt, Human
ugcucuggggagcuccucugcg

SEQ ID NO: 1069035 - RNA, 22 nt, Human
ucuuugcuccacacucuagaga

SEQ ID NO: 1069036 - RNA, 22 nt, Human
gugucccaauguucaggacggc

SEQ ID NO: 1069037 - RNA, 22 nt, Human
gcaggaagcauagaagaaugcc

SEQ ID NO: 1069038 - RNA, 23 nt, Human
aggcaggcaguucagcuguuguu

SEQ ID NO: 1069039 - RNA, 22 nt, Human
ucugggcugcuaugaggcagag

SEQ ID NO: 1069040 - RNA, 22 nt, Human
gcagagucugggcuaccucuug

SEQ ID NO: 1069041 - RNA, 22 nt, Human
aggagaaggaggccccucacac

SEQ ID NO: 1069042 - RNA, 22 nt, Human
gccaggcuggccagcaccuucu

SEQ ID NO: 1069043 - RNA, 22 nt, Human
agcugggccugagcuggaagcu

SEQ ID NO: 1069044 - RNA, 22 nt, Human
uacauuaacuuacguccacaug

SEQ ID NO: 1069045 - RNA, 22 nt, Human
gucaggauuuacaaacuucagu

SEQ ID NO: 1069046 - RNA, 23 nt, Human
gccuggagaaaagcugcaguuca

SEQ ID NO: 1069047 - RNA, 22 nt, Human
aaguccagguccucauuccauc

SEQ ID NO: 1069048 - RNA, 23 nt, Human
ucacauaauccuucauccacagg

SEQ ID NO: 1069049 - RNA, 22 nt, Human
uagaaacagagcagguggccca

SEQ ID NO: 1069050 - RNA, 22 nt, Human
accucugccaagaugugcuccc

SEQ ID NO: 1069051 - RNA, 22 nt, Human
cucugaacucuugggcagcaug

SEQ ID NO: 1069052 - RNA, 22 nt, Human
cagcuacuccucccaugacuuc

SEQ ID NO: 1069053 - RNA, 22 nt, Human
cauuuccacuucugaaaacugg

SEQ ID NO: 1069054 - RNA, 22 nt, Human
aauuucagaacccaaauuagcg

SEQ ID NO: 1069055 - RNA, 23 nt, Human
ugccagaggcagucacaguggug

SEQ ID NO: 1069056 - RNA, 22 nt, Human
uguauuagguugaugcgaaagu

SEQ ID NO: 1069057 - RNA, 23 nt, Human
guuaauaaugaacacuuucuccc

SEQ ID NO: 1069058 - RNA, 22 nt, Human
uugugucugggggagugacauc

SEQ ID NO: 1069059 - RNA, 22 nt, Human
uuuagcagaucuauguauguga

SEQ ID NO: 1069060 - RNA, 22 nt, Human
ggguacaaagauuucauaagau

SEQ ID NO: 1069061 - RNA, 22 nt, Human
ggugggcaggucacucugccuc

SEQ ID NO: 1069062 - RNA, 22 nt, Human
aagugguguguuggaagaaauc

SEQ ID NO: 1069063 - RNA, 22 nt, Human
gcuggagcugaguucccugggc

SEQ ID NO: 1069064 - RNA, 22 nt, Human
aggcacugaauauccaguaaaa

SEQ ID NO: 1069065 - RNA, 22 nt, Human
gcagcuggugcaaaugucacuc

SEQ ID NO: 1069066 - RNA, 22 nt, Human
gccugucucuuggaacuuggua

SEQ ID NO: 1069067 - RNA, 22 nt, Human
aagaauuauugcaauacuagau

SEQ ID NO: 1069068 - RNA, 18 nt, Human
agcagcugucagaaugcc

SEQ ID NO: 1069069 - RNA, 22 nt, Human
uacuuucuuucccaagaggugg

SEQ ID NO: 1069070 - RNA, 22 nt, Human
guuugcauguauuaagucaaua

SEQ ID NO: 1069071 - RNA, 22 nt, Human
gauuucaagcccccagagauuc

SEQ ID NO: 1069072 - RNA, 22 nt, Human
ucagcucuguuuugaguggaac

SEQ ID NO: 1069073 - RNA, 23 nt, Human
gggagccauggguggucauggag

SEQ ID NO: 1069074 - RNA, 22 nt, Human
aacugggcccagucugaguugg

SEQ ID NO: 1069075 - RNA, 22 nt, Human
gagagugauucccucccauaga

SEQ ID NO: 1069076 - RNA, 22 nt, Human
ugugaagcuggauccuggagcu

SEQ ID NO: 1069077 - RNA, 22 nt, Human
cagaaacagagaaauauuggcu

SEQ ID NO: 1069078 - RNA, 22 nt, Human
ugaccaaagaguugcuuguauu

SEQ ID NO: 1069079 - RNA, 22 nt, Human
aaacacuguacaaucugcaggg

SEQ ID NO: 1069080 - RNA, 22 nt, Human
gaucauuugcaggaaacauuaa

SEQ ID NO: 1069081 - RNA, 22 nt, Human
uguggggugugguccaggcauc

SEQ ID NO: 1069082 - RNA, 22 nt, Human
agcagaggaggauuuaguuagg

SEQ ID NO: 1069083 - RNA, 22 nt, Human
cagucucucagcuuucagcugu

SEQ ID NO: 1069084 - RNA, 22 nt, Human
ugcuucucccaaccagggccug

SEQ ID NO: 1069085 - RNA, 22 nt, Human
gcuuuuaauuaguugcuuccau

SEQ ID NO: 1069086 - RNA, 22 nt, Human
cagcaauaagguaagcuucucc

SEQ ID NO: 1069087 - RNA, 22 nt, Human
aaggccugggaguacugggaca

SEQ ID NO: 1069088 - RNA, 22 nt, Human
uacacaaaggcacucuguuguu

SEQ ID NO: 1069089 - RNA, 18 nt, Human
ccugcagcccaggaggcc

SEQ ID NO: 1069090 - RNA, 22 nt, Human
caucagaagaaagacaaaugau

SEQ ID NO: 1069091 - RNA, 22 nt, Human
guuuuccugagcccagagaugc

SEQ ID NO: 1069092 - RNA, 22 nt, Human
aaaauucugucauuaaauugug

SEQ ID NO: 1069093 - RNA, 22 nt, Human
accuuuuuguucuguucucagc

SEQ ID NO: 1069094 - RNA, 18 nt, Human
gccugcaggcacgggggu

SEQ ID NO: 1069095 - RNA, 22 nt, Human
gauauauuuggaccagagcauu

SEQ ID NO: 1069096 - RNA, 22 nt, Human
uggcucaguaaucgagucuccu

SEQ ID NO: 1069097 - RNA, 22 nt, Human
aucaggauccaccuugagccug

SEQ ID NO: 1069098 - RNA, 22 nt, Human
aauuauacaauugucaaguucu

SEQ ID NO: 1069099 - RNA, 16 nt, Human
ucagggcagaauggca

SEQ ID NO: 1069100 - RNA, 22 nt, Human
cgcugccaggucaccaggggua

SEQ ID NO: 1069101 - RNA, 22 nt, Human
gggguugguuuaaaugcuugag

SEQ ID NO: 1069102 - RNA, 23 nt, Human
ggccuguguuuugucugaaguac

SEQ ID NO: 1069103 - RNA, 22 nt, Human
cacagggccacuuucccaguaa

SEQ ID NO: 1069104 - RNA, 22 nt, Human
ccacagcuucgcagucugcugc

SEQ ID NO: 1069105 - RNA, 22 nt, Human
ugaugggaggugcugcaggacc

SEQ ID NO: 1069106 - RNA, 22 nt, Human
cugccuuggaaaaugugguaau

SEQ ID NO: 1069107 - RNA, 22 nt, Human
gguuuuggaaguauaaagaugu

SEQ ID NO: 1069108 - RNA, 22 nt, Human
acauuguagacuuuucauaugu

SEQ ID NO: 1069109 - RNA, 22 nt, Human
ugcaagaggcaucuuuuaaaaa

SEQ ID NO: 1069110 - RNA, 22 nt, Human
gagugugcuuagagagcugcau

SEQ ID NO: 1069111 - RNA, 22 nt, Human
aacauuuauucuaauucuggga

SEQ ID NO: 1069112 - RNA, 21 nt, Human
ucuacauaucaauauguaauu

SEQ ID NO: 1069113 - RNA, 22 nt, Human
cugucuggugucccugucuaca

SEQ ID NO: 1069114 - RNA, 22 nt, Human
cagagcuggagcuugaauggag

SEQ ID NO: 1069115 - RNA, 21 nt, Human
uuucuuucuggcucucacagu

SEQ ID NO: 1069116 - RNA, 22 nt, Human
ccucccaccguaucucaguggc

SEQ ID NO: 1069117 - RNA, 22 nt, Human
agucucugcugguugugccuau

SEQ ID NO: 1069118 - RNA, 22 nt, Human
aaucaccaucucucuugucccc

SEQ ID NO: 1069119 - RNA, 22 nt, Human
uuugaacaagagcuucacauua

SEQ ID NO: 1069120 - RNA, 19 nt, Human
uuugaaaggauuguuauuu

SEQ ID NO: 1069121 - RNA, 22 nt, Human
uuauggcauauuccucauugua

SEQ ID NO: 1069122 - RNA, 22 nt, Human
auuagcugaccucuaaggagcc

SEQ ID NO: 1069123 - RNA, 21 nt, Human
ugcucugguguuuuauuuaac

SEQ ID NO: 1069124 - RNA, 22 nt, Human
aguaacaaagugggagaaugau

SEQ ID NO: 1069125 - RNA, 21 nt, Human
ucaggcaggcgcagagggaag

SEQ ID NO: 1069126 - RNA, 22 nt, Human
augggaggguggaaaggcucug

SEQ ID NO: 1069127 - RNA, 22 nt, Human
ccuuguccucugguuuccuguu

SEQ ID NO: 1069128 - RNA, 22 nt, Human
caacugggauaaagagcuaaag

SEQ ID NO: 1069129 - RNA, 22 nt, Human
guacaaggcauuuaucuguuca

SEQ ID NO: 1069130 - RNA, 22 nt, Human
ugucucagaauggcucauaaua

SEQ ID NO: 1069131 - RNA, 22 nt, Human
cugugagggucacagccaugcc

SEQ ID NO: 1069132 - RNA, 22 nt, Human
uuccugcaagaucuuuaaggag

SEQ ID NO: 1069133 - RNA, 22 nt, Human
augaaacugaaggacaaccaga

SEQ ID NO: 1069134 - RNA, 22 nt, Human
aauuucacuguggagcacauuu

SEQ ID NO: 1069135 - RNA, 22 nt, Human
agagugaagguugacacuucac

SEQ ID NO: 1069136 - RNA, 17 nt, Human
cuaaauacuugcguuuc

SEQ ID NO: 1069137 - RNA, 22 nt, Human
gaaagaggaaggagauguauua

SEQ ID NO: 1069138 - RNA, 22 nt, Human
cagcuggcccuuugguagccuu

SEQ ID NO: 1069139 - RNA, 22 nt, Human
aggagcugggcugcugcuggga

SEQ ID NO: 1069140 - RNA, 19 nt, Human
caugcugaccugcuguggu

SEQ ID NO: 1069141 - RNA, 22 nt, Human
gcuggcagaagagcugguucaa

SEQ ID NO: 1069142 - RNA, 22 nt, Human
uccucaggagagcuccuaugcc

SEQ ID NO: 1069143 - RNA, 22 nt, Human
agacagaauuugucagauaaau

SEQ ID NO: 1069144 - RNA, 22 nt, Human
ccaugggcacuggguggaggua

SEQ ID NO: 1069145 - RNA, 22 nt, Human
uccagugguaguaaagaggucu

SEQ ID NO: 1069146 - RNA, 21 nt, Human
auguuauucuguuccuccagc

SEQ ID NO: 1069147 - RNA, 22 nt, Human
ucaucuucuauuaauagggaga

SEQ ID NO: 1069148 - RNA, 22 nt, Human
auugaaaaauucacaauucugg

SEQ ID NO: 1069149 - RNA, 17 nt, Human
cucagagcaggacagaa

SEQ ID NO: 1069150 - RNA, 22 nt, Human
uugcugaaguuaaugcuugcaa

SEQ ID NO: 1069151 - RNA, 22 nt, Human
cuuguacaggaauccaugguau

SEQ ID NO: 1069152 - RNA, 22 nt, Human
uaaauagggaauagaagaggaa

SEQ ID NO: 1069153 - RNA, 22 nt, Human
aguaugaauacagauuuucucu

SEQ ID NO: 1069154 - RNA, 23 nt, Human
uccugcugaaagcuccagcuggc

SEQ ID NO: 1069155 - RNA, 22 nt, Human
gaaauuuauuaucuacaucauu

SEQ ID NO: 1069156 - RNA, 22 nt, Human
cccuggcucuucaccaccugcc

SEQ ID NO: 1069157 - RNA, 22 nt, Human
gaaggagcuaaagggagcccug

SEQ ID NO: 1069158 - RNA, 22 nt, Human
agcagcugccacuggaauagga

SEQ ID NO: 1069159 - RNA, 22 nt, Human
aaucuacauagagaucaaauga

SEQ ID NO: 1069160 - RNA, 22 nt, Human
gaacacaagcguaugucuuugu

SEQ ID NO: 1069161 - RNA, 22 nt, Human
ggucagggggaucugugaggua

SEQ ID NO: 1069162 - RNA, 22 nt, Human
agggcagugggaaagccugcuc

SEQ ID NO: 1069163 - RNA, 22 nt, Human
cacugguguauuagagcuagaa

SEQ ID NO: 1069164 - RNA, 22 nt, Human
caguccagagcccaccagagga

SEQ ID NO: 1069165 - RNA, 22 nt, Human
agcuggcucagccggguggucu

SEQ ID NO: 1069166 - RNA, 19 nt, Human
ccugugugggguagagauc

SEQ ID NO: 1069167 - RNA, 22 nt, Human
gucacaaauccccucagcaacu

SEQ ID NO: 1069168 - RNA, 22 nt, Human
ugccucugugugcaggugagca

SEQ ID NO: 1069169 - RNA, 22 nt, Human
uuuaaucaggcaaagcauaaua

SEQ ID NO: 1069170 - RNA, 22 nt, Human
ugcugcuccugccuggcuccca

SEQ ID NO: 1069171 - RNA, 22 nt, Human
gagagcuguguucauucuacca

SEQ ID NO: 1069172 - RNA, 22 nt, Human
cccaggaaagagacugcugggu

SEQ ID NO: 1069173 - RNA, 22 nt, Human
acagaguuaauggauaggcagg

SEQ ID NO: 1069174 - RNA, 22 nt, Human
aaggcaggaugggaaaagauuu

SEQ ID NO: 1069175 - RNA, 22 nt, Human
aaggggucaagcggcagcuaca

SEQ ID NO: 1069176 - RNA, 22 nt, Human
cuggggugugcucagagcaggg

SEQ ID NO: 1069177 - RNA, 22 nt, Human
cuggugcaggaaggagcuggca

SEQ ID NO: 1069178 - RNA, 22 nt, Human
aguggggccggugaggccgagg

SEQ ID NO: 1069179 - RNA, 22 nt, Human
uaucaaggcauggaaaaugcua

SEQ ID NO: 1069180 - RNA, 22 nt, Human
guaacagaaagucaugcucauu

SEQ ID NO: 1069181 - RNA, 19 nt, Human
gagugauggaucuccuugc

SEQ ID NO: 1069182 - RNA, 22 nt, Human
gaaggccaguuuugagauaggu

SEQ ID NO: 1069183 - RNA, 22 nt, Human
ucauucuccucuggaaaaggca

SEQ ID NO: 1069184 - RNA, 22 nt, Human
aagucagaauaauguuucuuuu

SEQ ID NO: 1069185 - RNA, 23 nt, Human
cugaggccugcugcguucagguu

SEQ ID NO: 1069186 - RNA, 22 nt, Human
uggggacaggagacuuacagcu

SEQ ID NO: 1069187 - RNA, 22 nt, Human
ugcagggcuuccucuuggaguu

SEQ ID NO: 1069188 - RNA, 22 nt, Human
cagcuauggugacaaggucagg

SEQ ID NO: 1069189 - RNA, 22 nt, Human
aaguuuuugguagagaaaagua

SEQ ID NO: 1069190 - RNA, 22 nt, Human
uagcacaucuggcgcuuauagg

SEQ ID NO: 1069191 - RNA, 22 nt, Human
acguuuucagccuuaauguaga

SEQ ID NO: 1069192 - RNA, 22 nt, Human
auguucugccuccauuuugagu

SEQ ID NO: 1069193 - RNA, 22 nt, Human
ccaggcuggauuuugcaguuca

SEQ ID NO: 1069194 - RNA, 22 nt, Human
accaggaagugugggccaacgu

SEQ ID NO: 1069195 - RNA, 22 nt, Human
acagagucgccuuguagcuggc

SEQ ID NO: 1069196 - RNA, 22 nt, Human
uucuggaguauuccuggcaccu

SEQ ID NO: 1069197 - RNA, 22 nt, Human
ucuuuguuauugcuuuaucuau

SEQ ID NO: 1069198 - RNA, 22 nt, Human
uugucuuaaauggauggacaau

SEQ ID NO: 1069199 - RNA, 22 nt, Human
uuucuuaugagcaagacucuau

SEQ ID NO: 1069200 - RNA, 22 nt, Human
uuccauaaucaccuuauucuuu

SEQ ID NO: 1069201 - RNA, 22 nt, Human
gcagguggcagaggugggaucu

SEQ ID NO: 1069202 - RNA, 22 nt, Human
uuuccuaagguagugauaauuu

SEQ ID NO: 1069203 - RNA, 22 nt, Human
uugaacauuaacuucagucuau

SEQ ID NO: 1069204 - RNA, 22 nt, Human
aaaucagacuugaauuuucauc

SEQ ID NO: 1069205 - RNA, 22 nt, Human
cagaggcuguguaggcagacug

SEQ ID NO: 1069206 - RNA, 22 nt, Human
aggucauuaaaguuaaaugagg

SEQ ID NO: 1069207 - RNA, 22 nt, Human
caggauagaaaggccauggagu

SEQ ID NO: 1069208 - RNA, 20 nt, Human
uaugaagauaugugaacagc

SEQ ID NO: 1069209 - RNA, 22 nt, Human
uauuuccaggccccacucuaga

SEQ ID NO: 1069210 - RNA, 22 nt, Human
acuugaaagaaguuuccuuaaa

SEQ ID NO: 1069211 - RNA, 22 nt, Human
uuucacauuuuauacuuaagcc

SEQ ID NO: 1069212 - RNA, 22 nt, Human
augaggcagaaaaaagucggag

SEQ ID NO: 1069213 - RNA, 22 nt, Human
acucaguacaucuggaguuggc

SEQ ID NO: 1069214 - RNA, 22 nt, Human
uuucacaaugcaauccuacuuc

SEQ ID NO: 1069215 - RNA, 22 nt, Human
gcacagggcccugugcguaggu

SEQ ID NO: 1069216 - RNA, 23 nt, Human
aaagacugcugagaauuuuagga

SEQ ID NO: 1069217 - RNA, 17 nt, Human
aggcauggucuggggug

SEQ ID NO: 1069218 - RNA, 22 nt, Human
aggcccugcuuuccagagcuca

SEQ ID NO: 1069219 - RNA, 22 nt, Human
cacagcagcaucauuuaucugg

SEQ ID NO: 1069220 - RNA, 22 nt, Human
ugaggcagguggauuacaaggu

SEQ ID NO: 1069221 - RNA, 21 nt, Human
gaaaagcaagggaguagaaca

SEQ ID NO: 1069222 - RNA, 22 nt, Human
agagccaggugcugcuguuuga

SEQ ID NO: 1069223 - RNA, 22 nt, Human
acaguggagaagcaaaugcagu

SEQ ID NO: 1069224 - RNA, 22 nt, Human
uccccauggguggggacacaua

SEQ ID NO: 1069225 - RNA, 20 nt, Human
ccucucugaagaggucaucu

SEQ ID NO: 1069226 - RNA, 22 nt, Human
uguguacaaauuuagccagcag

SEQ ID NO: 1069227 - RNA, 22 nt, Human
uacaaagccugguagauaucug

SEQ ID NO: 1069228 - RNA, 22 nt, Human
ucucaacaccacuugcugaaga

SEQ ID NO: 1069229 - RNA, 22 nt, Human
uggggccuggucagagcugcac

SEQ ID NO: 1069230 - RNA, 22 nt, Human
gagccaggaggcagagacugca

SEQ ID NO: 1069231 - RNA, 22 nt, Human
cuguccugcccacccugcaggg

SEQ ID NO: 1069232 - RNA, 22 nt, Human
uaagucauggagcugggauuga

SEQ ID NO: 1069233 - RNA, 22 nt, Human
uaagcuauuccugaagaagguu

SEQ ID NO: 1069234 - RNA, 22 nt, Human
guggagcaggacuagcugagaa

SEQ ID NO: 1069235 - RNA, 22 nt, Human
ugugaggaacaggacuagagca

SEQ ID NO: 1069236 - RNA, 22 nt, Human
uuguugguggaauugaugcuag

SEQ ID NO: 1069237 - RNA, 22 nt, Human
caguuacacaccauugugaaca

SEQ ID NO: 1069238 - RNA, 22 nt, Human
aggcacugugcagucccaagca

SEQ ID NO: 1069239 - RNA, 22 nt, Human
ccaggacccugcaaacccuguu

SEQ ID NO: 1069240 - RNA, 20 nt, Human
aaaaucucccagaaacuuau

SEQ ID NO: 1069241 - RNA, 22 nt, Human
auucuacaaaagaacuggaucu

SEQ ID NO: 1069242 - RNA, 22 nt, Human
gagagaaaggauaacagcucaa

SEQ ID NO: 1069243 - RNA, 19 nt, Human
ccuccugcuagauaugcaa

SEQ ID NO: 1069244 - RNA, 22 nt, Human
accugugcacagucagcccugg

SEQ ID NO: 1069245 - RNA, 22 nt, Human
uguaaagaaagacgcagaguua

SEQ ID NO: 1069246 - RNA, 19 nt, Human
caggucuucuuggaggacu

SEQ ID NO: 1069247 - RNA, 22 nt, Human
gcagaagcuguucgaaggccgc

SEQ ID NO: 1069248 - RNA, 22 nt, Human
uuguauuucuccacuuucuguu

SEQ ID NO: 1069249 - RNA, 22 nt, Human
cuuucugaaguuuaaguucuaa

SEQ ID NO: 1069250 - RNA, 22 nt, Human
ccucgaccuccccaggcucagg

SEQ ID NO: 1069251 - RNA, 22 nt, Human
acaggcucucuauugagugcag

SEQ ID NO: 1069252 - RNA, 18 nt, Human
gccauguucuaugcuuac

SEQ ID NO: 1069253 - RNA, 22 nt, Human
cugcagcugucucuacugggca

SEQ ID NO: 1069254 - RNA, 22 nt, Human
agcugccaucugaagaacugca

SEQ ID NO: 1069255 - RNA, 22 nt, Human
uauuaauucuugccaauucucc

SEQ ID NO: 1069256 - RNA, 22 nt, Human
uccagucauuuccauuguuccc

SEQ ID NO: 1069257 - RNA, 22 nt, Human
cugcagugaaaucaggaagcaa

SEQ ID NO: 1069258 - RNA, 22 nt, Human
ccuggugcuuaccagagcuuuu

SEQ ID NO: 1069259 - RNA, 22 nt, Human
uauuucuuguucccuccaaguu

SEQ ID NO: 1069260 - RNA, 22 nt, Human
uccagccaugacucggacagug

SEQ ID NO: 1069261 - RNA, 22 nt, Human
uauaguaaaauuuucauuuaug

SEQ ID NO: 1069262 - RNA, 22 nt, Human
aaagucacauagcaucacuucu

SEQ ID NO: 1069263 - RNA, 23 nt, Human
aggcugagcucucccagcuucag

SEQ ID NO: 1069264 - RNA, 22 nt, Human
ccugagagugagggccuccuua

SEQ ID NO: 1069265 - RNA, 20 nt, Human
ggggcccaagcccucuugcc

SEQ ID NO: 1069266 - RNA, 22 nt, Human
cuucuggguauuccagauaccu

SEQ ID NO: 1069267 - RNA, 22 nt, Human
gugcagaaguaacaauuaaaga

SEQ ID NO: 1069268 - RNA, 22 nt, Human
uagguuccauuuaaacaaagaa

SEQ ID NO: 1069269 - RNA, 22 nt, Human
ugaaaacacuuuaguuuagguc

SEQ ID NO: 1069270 - RNA, 22 nt, Human
gcugccugcucacccggccugg

SEQ ID NO: 1069271 - RNA, 22 nt, Human
ucuucuuugaaucauagugacc

SEQ ID NO: 1069272 - RNA, 16 nt, Human
cuuuuucuccccucuu

SEQ ID NO: 1069273 - RNA, 18 nt, Human
ucagcuggggcugcagcc

SEQ ID NO: 1069274 - RNA, 22 nt, Human
ggugugccuggggcuuagcugc

SEQ ID NO: 1069275 - RNA, 22 nt, Human
cuuaaaaguugcuucccuaacu

SEQ ID NO: 1069276 - RNA, 22 nt, Human
ucaaaaauaagauauucuggac

SEQ ID NO: 1069277 - RNA, 22 nt, Human
caaaagcagcaaguuuauaugu

SEQ ID NO: 1069278 - RNA, 22 nt, Human
uuaauuaaauucaugagcauug

SEQ ID NO: 1069279 - RNA, 22 nt, Human
gcuggcagcuggaaguugggcu

SEQ ID NO: 1069280 - RNA, 22 nt, Human
ugggaaggugauuuuccaaaag

SEQ ID NO: 1069281 - RNA, 21 nt, Human
acaggcucuggggaugcuggg

SEQ ID NO: 1069282 - RNA, 22 nt, Human
acugccugcucauaacauugcu

SEQ ID NO: 1069283 - RNA, 22 nt, Human
uggaggaaucagggcuuaggcu

SEQ ID NO: 1069284 - RNA, 22 nt, Human
acacugugacaaaggcuguucu

SEQ ID NO: 1069285 - RNA, 22 nt, Human
auucuccacacauccagaccuu

SEQ ID NO: 1069286 - RNA, 22 nt, Human
cagaggaagagauacaagcccu

SEQ ID NO: 1069287 - RNA, 22 nt, Human
agaaucugaaggcaccucuggu

SEQ ID NO: 1069288 - RNA, 22 nt, Human
gcaggaacccggccgcccuggc

SEQ ID NO: 1069289 - RNA, 20 nt, Human
acagccagaggaggcagaca

SEQ ID NO: 1069290 - RNA, 22 nt, Human
gcccagcuggcuuccagcacau

SEQ ID NO: 1069291 - RNA, 22 nt, Human
uccucugcuccaucuuuacugu

SEQ ID NO: 1069292 - RNA, 22 nt, Human
agccaccaccacugaaagguua

SEQ ID NO: 1069293 - RNA, 22 nt, Human
ugaacacagcauauuuuguuac

SEQ ID NO: 1069294 - RNA, 18 nt, Human
aagccagagaccacugcc

SEQ ID NO: 1069295 - RNA, 22 nt, Human
gagcaccucaauuugcuauuug

SEQ ID NO: 1069296 - RNA, 22 nt, Human
acugugauguucucuaucuugg

SEQ ID NO: 1069297 - RNA, 22 nt, Human
cuucacuguuugguucacagca

SEQ ID NO: 1069298 - RNA, 22 nt, Human
cauuacaaaguuauaaacaguu

SEQ ID NO: 1069299 - RNA, 21 nt, Human
aauuucagacccauuuugccu

SEQ ID NO: 1069300 - RNA, 19 nt, Human
ggcucucuuaaagcuguuu

SEQ ID NO: 1069301 - RNA, 22 nt, Human
uucagcuaaaaaugcccacuug

SEQ ID NO: 1069302 - RNA, 22 nt, Human
cacagggcagguacucucagag

SEQ ID NO: 1069303 - RNA, 22 nt, Human
cauaugaaguucaacagagaug

SEQ ID NO: 1069304 - RNA, 22 nt, Human
gggauggggggaagcguccaug

SEQ ID NO: 1069305 - RNA, 22 nt, Human
gcaggcugaugacuggaguugg

SEQ ID NO: 1069306 - RNA, 22 nt, Human
gagcagcuugcgcugucuucac

SEQ ID NO: 1069307 - RNA, 17 nt, Human
uccagcccugcccgacg

SEQ ID NO: 1069308 - RNA, 22 nt, Human
ucagagugcagcgggaggcugg

SEQ ID NO: 1069309 - RNA, 22 nt, Human
agagcccucucauuggcuuauu

SEQ ID NO: 1069310 - RNA, 22 nt, Human
caagagcuggagaggcagucua

SEQ ID NO: 1069311 - RNA, 22 nt, Human
ucagaagaagagacuccacagc

SEQ ID NO: 1069312 - RNA, 22 nt, Human
ugggcugcugagaaugagagag

SEQ ID NO: 1069313 - RNA, 20 nt, Human
ccugggcuccaggagccccg

SEQ ID NO: 1069314 - RNA, 22 nt, Human
cagcagaaacccagcaaagcca

SEQ ID NO: 1069315 - RNA, 22 nt, Human
uagaacagaguuccagugauca

SEQ ID NO: 1069316 - RNA, 22 nt, Human
uggcuggcaguaggcuaguggc

SEQ ID NO: 1069317 - RNA, 22 nt, Human
acacacagaguuuauacaggca

SEQ ID NO: 1069318 - RNA, 22 nt, Human
cacaagucuguggucuccaaca

SEQ ID NO: 1069319 - RNA, 22 nt, Human
cugggacagcugagacaggaga

SEQ ID NO: 1069320 - RNA, 22 nt, Human
aguggggucuccuccagccccc

SEQ ID NO: 1069321 - RNA, 22 nt, Human
ccaccagcuuugccacccugcu

SEQ ID NO: 1069322 - RNA, 22 nt, Human
ggcaggagcucuccaguuugcc

SEQ ID NO: 1069323 - RNA, 22 nt, Human
uggaagcagugauucuugucug

SEQ ID NO: 1069324 - RNA, 22 nt, Human
cuuccugaacaaugccaucaau

SEQ ID NO: 1069325 - RNA, 22 nt, Human
aggagagagaacacuugggucc

SEQ ID NO: 1069326 - RNA, 22 nt, Human
ccaggaagguaugggaagaaaa

SEQ ID NO: 1069327 - RNA, 22 nt, Human
aacaguaaagacagaauuuauc

SEQ ID NO: 1069328 - RNA, 22 nt, Human
cugggaggauacacaagaucag

SEQ ID NO: 1069329 - RNA, 22 nt, Human
cugagaggaugcugcaguggag

SEQ ID NO: 1069330 - RNA, 22 nt, Human
ugagcucauagcucuuauuaug

SEQ ID NO: 1069331 - RNA, 22 nt, Human
agcaaacagugugcuaagaaau

SEQ ID NO: 1069332 - RNA, 22 nt, Human
agaccaugggcucugaagagca

SEQ ID NO: 1069333 - RNA, 22 nt, Human
auccccagaaaauaggugccua

SEQ ID NO: 1069334 - RNA, 22 nt, Human
gcaggaagaggcucgaagcccc

SEQ ID NO: 1069335 - RNA, 22 nt, Human
acugccuugucucuugccuguu

SEQ ID NO: 1069336 - RNA, 21 nt, Human
uuggaccauacaaguuaugca

SEQ ID NO: 1069337 - RNA, 17 nt, Human
gcaucacagauaacacg

SEQ ID NO: 1069338 - RNA, 22 nt, Human
agaaacuaaccugguaggguuc

SEQ ID NO: 1069339 - RNA, 22 nt, Human
gcuccuggagagauugagaaag

SEQ ID NO: 1069340 - RNA, 22 nt, Human
aauguacaucucaguguaguac

SEQ ID NO: 1069341 - RNA, 22 nt, Human
aauuucagaccauuugcaauua

SEQ ID NO: 1069342 - RNA, 22 nt, Human
uuucaacuugaagaauugauac

SEQ ID NO: 1069343 - RNA, 22 nt, Human
aaguguuuaacggugauugagc

SEQ ID NO: 1069344 - RNA, 22 nt, Human
gcuggcagguaaagccccgggg

SEQ ID NO: 1069345 - RNA, 22 nt, Human
gaggccugcagcguggucccug

SEQ ID NO: 1069346 - RNA, 22 nt, Human
aacaaaugaccugauuucuucc

SEQ ID NO: 1069347 - RNA, 22 nt, Human
ccaggcagcucugauuuauguc

SEQ ID NO: 1069348 - RNA, 22 nt, Human
acagauaaggcaguuaagaguu

SEQ ID NO: 1069349 - RNA, 22 nt, Human
uggcugagccuuuggggcuuuc

SEQ ID NO: 1069350 - RNA, 22 nt, Human
gcugccucuguagcuuuggacc

SEQ ID NO: 1069351 - RNA, 22 nt, Human
uucaggaucacuaaacccucca

SEQ ID NO: 1069352 - RNA, 22 nt, Human
ugcaguggaaagacucagacuu

SEQ ID NO: 1069353 - RNA, 22 nt, Human
agggcugccugacuccagagcc

SEQ ID NO: 1069354 - RNA, 22 nt, Human
ucacugcucuccaauguggagu

SEQ ID NO: 1069355 - RNA, 22 nt, Human
cugucagcacucuacuacagau

SEQ ID NO: 1069356 - RNA, 22 nt, Human
aaaggucauugaaaaggaggaa

SEQ ID NO: 1069357 - RNA, 22 nt, Human
gccaagcucuuuaaaggccaaa

SEQ ID NO: 1069358 - RNA, 22 nt, Human
ccuggcagaauauuaaagugca

SEQ ID NO: 1069359 - RNA, 22 nt, Human
acagguggaggcuuuaggaggu

SEQ ID NO: 1069360 - RNA, 22 nt, Human
uguaugugcuugagaagguggg

SEQ ID NO: 1069361 - RNA, 19 nt, Human
agugaacacaaagagaagg

SEQ ID NO: 1069362 - RNA, 22 nt, Human
ucugaggcuucagacuguacug

SEQ ID NO: 1069363 - RNA, 22 nt, Human
ggcuucagaagacuggacaggu

SEQ ID NO: 1069364 - RNA, 22 nt, Human
aggcacugaaggaagcuugcgc

SEQ ID NO: 1069365 - RNA, 22 nt, Human
ucaagaaacugugcuacagagu

SEQ ID NO: 1069366 - RNA, 22 nt, Human
uggcucaguuaggucagaaaca

SEQ ID NO: 1069367 - RNA, 22 nt, Human
ugcaggugguacuucuuuuucu

SEQ ID NO: 1069368 - RNA, 22 nt, Human
uuccagggcuaauuccugugga

SEQ ID NO: 1069369 - RNA, 22 nt, Human
uuagccauggacugaauugacu

SEQ ID NO: 1069370 - RNA, 22 nt, Human
aaugauggauuuagacaagcug

SEQ ID NO: 1069371 - RNA, 22 nt, Human
caugggcuacagaagcaugcug

SEQ ID NO: 1069372 - RNA, 22 nt, Human
ggcgggaaguucuugcccacuu

SEQ ID NO: 1069373 - RNA, 22 nt, Human
uaaguuagagguuaggcacuua

SEQ ID NO: 1069374 - RNA, 22 nt, Human
ugggcugaggggccuugaugac

SEQ ID NO: 1069375 - RNA, 20 nt, Human
caggcaguuugugguuaggg

SEQ ID NO: 1069376 - RNA, 22 nt, Human
ugaacagaucaauagaacugac

SEQ ID NO: 1069377 - RNA, 22 nt, Human
ucuccccaaaggacucacucuc

SEQ ID NO: 1069378 - RNA, 22 nt, Human
aauaugcagcaugaugaaguaa

SEQ ID NO: 1069379 - RNA, 21 nt, Human
aagagcugucaggaaggcugc

SEQ ID NO: 1069380 - RNA, 22 nt, Human
ucagggcaaugucccucagaag

SEQ ID NO: 1069381 - RNA, 22 nt, Human
uuucauuauucaugcuaguuau

SEQ ID NO: 1069382 - RNA, 22 nt, Human
uagugcaacagggaaagagugu

SEQ ID NO: 1069383 - RNA, 22 nt, Human
cugccuggucucaggcaugggg

SEQ ID NO: 1069384 - RNA, 22 nt, Human
agaaaugggccuugggacacaa

SEQ ID NO: 1069385 - RNA, 22 nt, Human
uagcuuaucccacagugcccag

SEQ ID NO: 1069386 - RNA, 22 nt, Human
uggaacacauuaaccacaggga

SEQ ID NO: 1069387 - RNA, 22 nt, Human
cagagcucuauguucauggagg

SEQ ID NO: 1069388 - RNA, 21 nt, Human
auccuugaucagaagagugcu

SEQ ID NO: 1069389 - RNA, 22 nt, Human
aaucaagaauaaguuguaaagc

SEQ ID NO: 1069390 - RNA, 22 nt, Human
auauuugugguaaagguaagaa

SEQ ID NO: 1069391 - RNA, 22 nt, Human
cuagggaaugagagacuggauc

SEQ ID NO: 1069392 - RNA, 22 nt, Human
aagagcuggcucuugcagcagc

SEQ ID NO: 1069393 - RNA, 22 nt, Human
auuuucaucauggguuuaacau

SEQ ID NO: 1069394 - RNA, 22 nt, Human
ugccaggcaacugcccagccau

SEQ ID NO: 1069395 - RNA, 22 nt, Human
uucaggaucauuuguuuuaucu

SEQ ID NO: 1069396 - RNA, 22 nt, Human
uagccgcuuaauuauuugguga

SEQ ID NO: 1069397 - RNA, 22 nt, Human
gggcugcaaugcuucaguuguu

SEQ ID NO: 1069398 - RNA, 22 nt, Human
agcuggugaaccugaggcacag

SEQ ID NO: 1069399 - RNA, 22 nt, Human
gcaaagaaaguuuuaaugaggu

SEQ ID NO: 1069400 - RNA, 22 nt, Human
gggccagugaacaaugagggaa

SEQ ID NO: 1069401 - RNA, 22 nt, Human
gaauuuaucuacguuaaguaug

SEQ ID NO: 1069402 - RNA, 18 nt, Human
gggaucaggcugccuagg

SEQ ID NO: 1069403 - RNA, 22 nt, Human
ucuucaugaaugaaucuuugac

SEQ ID NO: 1069404 - RNA, 21 nt, Human
cgcagagcgaacuugcggcgc

SEQ ID NO: 1069405 - RNA, 22 nt, Human
uauuuuguuaauaauccagucc

SEQ ID NO: 1069406 - RNA, 22 nt, Human
gaggcaguggucugaugcaagg

SEQ ID NO: 1069407 - RNA, 22 nt, Human
aacuauacauauuuacauagac

SEQ ID NO: 1069408 - RNA, 22 nt, Human
uucacagagaguaugcagagaa

SEQ ID NO: 1069409 - RNA, 22 nt, Human
ggccucacccaucggugccuuu

SEQ ID NO: 1069410 - RNA, 22 nt, Human
agugggcuuuuuuccguuccau

SEQ ID NO: 1069411 - RNA, 22 nt, Human
uguucuaaguguuuuguucaug

SEQ ID NO: 1069412 - RNA, 22 nt, Human
uugccaggagcucaucugaggg

SEQ ID NO: 1069413 - RNA, 18 nt, Human
uaaauauauuucccccuu

SEQ ID NO: 1069414 - RNA, 22 nt, Human
gaaucucaguggaagcaggaag

SEQ ID NO: 1069415 - RNA, 22 nt, Human
gcuccagguauuugcccuuuua

SEQ ID NO: 1069416 - RNA, 22 nt, Human
uaauuucagugggcucugggcu

SEQ ID NO: 1069417 - RNA, 22 nt, Human
acccugcccucuccagcucagg

SEQ ID NO: 1069418 - RNA, 22 nt, Human
cuucaagagaaugcagggaugu

SEQ ID NO: 1069419 - RNA, 21 nt, Human
ggagucagggucuggcugggg

SEQ ID NO: 1069420 - RNA, 22 nt, Human
ucaaauacauggucaaucaacu

SEQ ID NO: 1069421 - RNA, 22 nt, Human
gcccaggaguugaaugcagcag

SEQ ID NO: 1069422 - RNA, 17 nt, Human
gagauggcauuggcagc

SEQ ID NO: 1069423 - RNA, 22 nt, Human
aauauuguuucaagaucacaga

SEQ ID NO: 1069424 - RNA, 22 nt, Human
aagcaaacaggagaagagcugu

SEQ ID NO: 1069425 - RNA, 22 nt, Human
aagcugccugccacgcuagaua

SEQ ID NO: 1069426 - RNA, 22 nt, Human
ucucacugggucacagcagagg

SEQ ID NO: 1069427 - RNA, 22 nt, Human
uccucagaugcucuuggacgcc

SEQ ID NO: 1069428 - RNA, 22 nt, Human
uuuuuccuagcgauuugucagc

SEQ ID NO: 1069429 - RNA, 22 nt, Human
aauuauauugaaguugaauguc

SEQ ID NO: 1069430 - RNA, 22 nt, Human
ucagggaaugggcccagucccu

SEQ ID NO: 1069431 - RNA, 22 nt, Human
aaguccagcagugcuuguugau

SEQ ID NO: 1069432 - RNA, 22 nt, Human
ucuggcucauaggaaggccauu

SEQ ID NO: 1069433 - RNA, 22 nt, Human
gaggcacaccagggagucuugu

SEQ ID NO: 1069434 - RNA, 20 nt, Human
agaagcugauacugauggaa

SEQ ID NO: 1069435 - RNA, 22 nt, Human
agcagcauagaagcugggagga

SEQ ID NO: 1069436 - RNA, 22 nt, Human
ucagaaagcuuagugucuugca

SEQ ID NO: 1069437 - RNA, 22 nt, Human
aggcugugagcaagaacaccua

SEQ ID NO: 1069438 - RNA, 22 nt, Human
ucaaaggcuugugguucuggga

SEQ ID NO: 1069439 - RNA, 23 nt, Human
uccuuugucuuugcauagauggu

SEQ ID NO: 1069440 - RNA, 22 nt, Human
gcuggcuguguuccuucugcca

SEQ ID NO: 1069441 - RNA, 22 nt, Human
uucaggauaugugauaucugaa

SEQ ID NO: 1069442 - RNA, 22 nt, Human
gguggggagucaggcauucuug

SEQ ID NO: 1069443 - RNA, 22 nt, Human
gccuccccugcaauuguccuug

SEQ ID NO: 1069444 - RNA, 22 nt, Human
cagaaauggaauuuuccaucac

SEQ ID NO: 1069445 - RNA, 23 nt, Human
cagcucagcacauaggagguacu

SEQ ID NO: 1069446 - RNA, 22 nt, Human
cagcacugcuucgcagccaggg

SEQ ID NO: 1069447 - RNA, 22 nt, Human
aggggagaggugagcaacuucu

SEQ ID NO: 1069448 - RNA, 22 nt, Human
cuggaaguauaggggagaugau

SEQ ID NO: 1069449 - RNA, 21 nt, Human
agaaaaguagaguuuucagag

SEQ ID NO: 1069450 - RNA, 22 nt, Human
gcaaacaaggacauacauccug

SEQ ID NO: 1069451 - RNA, 22 nt, Human
cucugagaagaguucaaguaaa

SEQ ID NO: 1069452 - RNA, 22 nt, Human
uacuuugaccaccaucugauua

SEQ ID NO: 1069453 - RNA, 22 nt, Human
ucagaacagaagcuggcuauaa

SEQ ID NO: 1069454 - RNA, 22 nt, Human
ccagggacuuugcauuguuuau

SEQ ID NO: 1069455 - RNA, 22 nt, Human
cuuguaauuauaauguacuguu

SEQ ID NO: 1069456 - RNA, 22 nt, Human
agaaggccuaacuugggggcaa

SEQ ID NO: 1069457 - RNA, 22 nt, Human
gggcagcagccacucauuuagc

SEQ ID NO: 1069458 - RNA, 22 nt, Human
gacagccaucagcacacgcugc

SEQ ID NO: 1069459 - RNA, 22 nt, Human
ggccugggcccacugucaagag

SEQ ID NO: 1069460 - RNA, 20 nt, Human
ggagcuggcauccagccucu

SEQ ID NO: 1069461 - RNA, 22 nt, Human
ccccuuccacagugcuuccuaa

SEQ ID NO: 1069462 - RNA, 22 nt, Human
ucauggcacuuagcacaguccu

SEQ ID NO: 1069463 - RNA, 22 nt, Human
uuucacauuagauaugucauuu

SEQ ID NO: 1069464 - RNA, 22 nt, Human
ucugccugagggagcugaggaa

SEQ ID NO: 1069465 - RNA, 22 nt, Human
aucaggauguuuggcugucaua

SEQ ID NO: 1069466 - RNA, 22 nt, Human
uuaagucacuuaucuaaagaca

SEQ ID NO: 1069467 - RNA, 22 nt, Human
caggcagaaggaaguaccaggc

SEQ ID NO: 1069468 - RNA, 22 nt, Human
gcucaagggaugggagugggug

SEQ ID NO: 1069469 - RNA, 22 nt, Human
uaaauaaguucuucauuguuug

SEQ ID NO: 1069470 - RNA, 22 nt, Human
aagccagauagaagaacucauu

SEQ ID NO: 1069471 - RNA, 22 nt, Human
agccaucauuucugucacuggc

SEQ ID NO: 1069472 - RNA, 23 nt, Human
ugcaggggaggcuuaaagcaggu

SEQ ID NO: 1069473 - RNA, 22 nt, Human
aacaguuuaugagauaugcuau

SEQ ID NO: 1069474 - RNA, 22 nt, Human
ccuuucaaaacagaacacuagc

SEQ ID NO: 1069475 - RNA, 22 nt, Human
uacuauuuggaauuuuaaauug

SEQ ID NO: 1069476 - RNA, 20 nt, Human
uuauuuguuuacuuuggucc

SEQ ID NO: 1069477 - RNA, 22 nt, Human
uuuucaagagaguguucuaugu

SEQ ID NO: 1069478 - RNA, 22 nt, Human
ucccuguggaagacugccagag

SEQ ID NO: 1069479 - RNA, 22 nt, Human
gggagccacaguuuauagugau

SEQ ID NO: 1069480 - RNA, 22 nt, Human
ucaggaagugccuaggcuggcc

SEQ ID NO: 1069481 - RNA, 22 nt, Human
cugagcccuccugcuugcugag

SEQ ID NO: 1069482 - RNA, 22 nt, Human
ugcagggaccccgaggcucucu

SEQ ID NO: 1069483 - RNA, 22 nt, Human
cuugaaagcacuccuuugacug

SEQ ID NO: 1069484 - RNA, 22 nt, Human
uucauuuucuuucacgcugcug

SEQ ID NO: 1069485 - RNA, 22 nt, Human
uucaccuugaauaugucuuaaa

SEQ ID NO: 1069486 - RNA, 22 nt, Human
gcagaggcucuuuaaugcuuag

SEQ ID NO: 1069487 - RNA, 22 nt, Human
agccaaggacacggagccuccu

SEQ ID NO: 1069488 - RNA, 17 nt, Human
uggacccuugggccucc

SEQ ID NO: 1069489 - RNA, 22 nt, Human
aaggcacugagccagccgucuc

SEQ ID NO: 1069490 - RNA, 22 nt, Human
cagggcugugcccaucuucccc

SEQ ID NO: 1069491 - RNA, 22 nt, Human
gucauuuugcugcauauuuaga

SEQ ID NO: 1069492 - RNA, 22 nt, Human
agggcagcagcuccuccuagcu

SEQ ID NO: 1069493 - RNA, 22 nt, Human
aucaugcuuggauuauguuugg

SEQ ID NO: 1069494 - RNA, 22 nt, Human
aggaaggggagaaguuaaagcu

SEQ ID NO: 1069495 - RNA, 22 nt, Human
gcagaaguuaaucgaaggccau

SEQ ID NO: 1069496 - RNA, 22 nt, Human
gaagccaacauuccaaguagaa

SEQ ID NO: 1069497 - RNA, 22 nt, Human
uggguagaggaauugggcuacc

SEQ ID NO: 1069498 - RNA, 22 nt, Human
gggguagggugauugugaagua

SEQ ID NO: 1069499 - RNA, 22 nt, Human
gcugcccucccagggcaagcuu

SEQ ID NO: 1069500 - RNA, 22 nt, Human
agaaaugacacacaugagacau

SEQ ID NO: 1069501 - RNA, 22 nt, Human
ccacagaaucgcuaguggagca

SEQ ID NO: 1069502 - RNA, 22 nt, Human
aaccagcugagaaugcuucugc

SEQ ID NO: 1069503 - RNA, 22 nt, Human
agcagacaccaggaguaaagaa

SEQ ID NO: 1069504 - RNA, 22 nt, Human
uguugacucaacacugugggca

SEQ ID NO: 1069505 - RNA, 22 nt, Human
cagguugggcugcgaggaggag

SEQ ID NO: 1069506 - RNA, 22 nt, Human
uaccuguggcuuguuggaugga

SEQ ID NO: 1069507 - RNA, 22 nt, Human
cagcaggguagguuguaucagu

SEQ ID NO: 1069508 - RNA, 22 nt, Human
cccugcagaccaaugccauaga

SEQ ID NO: 1069509 - RNA, 22 nt, Human
uucacaaagcugguuccuucug

SEQ ID NO: 1069510 - RNA, 22 nt, Human
ggaaaucaugggagaguuggaa

SEQ ID NO: 1069511 - RNA, 17 nt, Human
ucuguccagggagugug

SEQ ID NO: 1069512 - RNA, 22 nt, Human
ggccacugaccuacaucugggg

SEQ ID NO: 1069513 - RNA, 22 nt, Human
acagguggggcacuuggagccu

SEQ ID NO: 1069514 - RNA, 22 nt, Human
uugggggaagaggauagacagu

SEQ ID NO: 1069515 - RNA, 22 nt, Human
aaacaccagucccaguauacac

SEQ ID NO: 1069516 - RNA, 22 nt, Human
auauaucaugaguaaaacuuga

SEQ ID NO: 1069517 - RNA, 22 nt, Human
uauuuaaaaagaggccagcugg

SEQ ID NO: 1069518 - RNA, 22 nt, Human
guguaaggugaaaucaacaaau

SEQ ID NO: 1069519 - RNA, 22 nt, Human
aucaaaguccaucagaagguag

SEQ ID NO: 1069520 - RNA, 22 nt, Human
guauccuuugcggaaauuucua

SEQ ID NO: 1069521 - RNA, 22 nt, Human
auaucuuucaaagccaaaagua

SEQ ID NO: 1069522 - RNA, 22 nt, Human
auacacauguguaugugcaugc

SEQ ID NO: 1069523 - RNA, 22 nt, Human
cagaaggcuggcagauugagau

SEQ ID NO: 1069524 - RNA, 22 nt, Human
cacaggcuugucagcaugaggc

SEQ ID NO: 1069525 - RNA, 22 nt, Human
gugucccaggagaggagacaau

SEQ ID NO: 1069526 - RNA, 22 nt, Human
agcuguggcagcacuuuggagu

SEQ ID NO: 1069527 - RNA, 17 nt, Human
ugagaaguaggcaucau

SEQ ID NO: 1069528 - RNA, 22 nt, Human
gccagagugccaucagugccau

SEQ ID NO: 1069529 - RNA, 22 nt, Human
uaacacauauuugcaguaagca

SEQ ID NO: 1069530 - RNA, 22 nt, Human
auauuuugaaguuaauaaugug

SEQ ID NO: 1069531 - RNA, 22 nt, Human
ccuggggauucugacacggagu

SEQ ID NO: 1069532 - RNA, 22 nt, Human
agacaaauaacuuuuuaugucc

SEQ ID NO: 1069533 - RNA, 22 nt, Human
ugggugcaugugagcacgugca

SEQ ID NO: 1069534 - RNA, 22 nt, Human
agccucugauggcucccaagga

SEQ ID NO: 1069535 - RNA, 22 nt, Human
gaggcugcuuugaugacaggag

SEQ ID NO: 1069536 - RNA, 21 nt, Human
gcaggguccuuuccauuccua

SEQ ID NO: 1069537 - RNA, 22 nt, Human
gugggcuuuugacagugccugg

SEQ ID NO: 1069538 - RNA, 22 nt, Human
aguuacauaaucugugaauuuu

SEQ ID NO: 1069539 - RNA, 22 nt, Human
agaaauaugcugauuagaugaa

SEQ ID NO: 1069540 - RNA, 22 nt, Human
caccagcagaagacugagggug

SEQ ID NO: 1069541 - RNA, 22 nt, Human
gaggcagcaugguaccuuggag

SEQ ID NO: 1069542 - RNA, 22 nt, Human
aagugacaccucuucccuuucc

SEQ ID NO: 1069543 - RNA, 22 nt, Human
agucccagaucuacaggaggga

SEQ ID NO: 1069544 - RNA, 22 nt, Human
auucacauuuuauuucacugga

SEQ ID NO: 1069545 - RNA, 22 nt, Human
aacaguaauuugcgguuuuugc

SEQ ID NO: 1069546 - RNA, 22 nt, Human
uuaacuauuauuagcaucuuug

SEQ ID NO: 1069547 - RNA, 22 nt, Human
agcugaauguucucagaccaga

SEQ ID NO: 1069548 - RNA, 22 nt, Human
uagcagcagugguguauuuaga

SEQ ID NO: 1069549 - RNA, 22 nt, Human
ucugucauguuuccauuacaug

SEQ ID NO: 1069550 - RNA, 22 nt, Human
gcagcuuuuuggaugucaguua

SEQ ID NO: 1069551 - RNA, 22 nt, Human
aggaagcccuugucauuucugu

SEQ ID NO: 1069552 - RNA, 22 nt, Human
gccuggguccacugaucaugcu

SEQ ID NO: 1069553 - RNA, 22 nt, Human
uccaggaaaucagaagugguaa

SEQ ID NO: 1069554 - RNA, 22 nt, Human
ucugccugcuucuucauagucu

SEQ ID NO: 1069555 - RNA, 22 nt, Human
acaguuaagcaguaugaucaca

SEQ ID NO: 1069556 - RNA, 20 nt, Human
uuccacaucuuugcacaugc

SEQ ID NO: 1069557 - RNA, 23 nt, Human
ucagcugcuuccuccugccugcc

SEQ ID NO: 1069558 - RNA, 22 nt, Human
ucuuuuguugccuacuuauuaa

SEQ ID NO: 1069559 - RNA, 22 nt, Human
cugguguuguccgggugagagu

SEQ ID NO: 1069560 - RNA, 22 nt, Human
ccugacucuggccaggccagcu

SEQ ID NO: 1069561 - RNA, 22 nt, Human
ccugcccuagagaugacacaau

SEQ ID NO: 1069562 - RNA, 22 nt, Human
aaggccagcuuguagggcuggu

SEQ ID NO: 1069563 - RNA, 22 nt, Human
auauuuuccgaacuugagguag

SEQ ID NO: 1069564 - RNA, 23 nt, Human
uccucaguauauaaaggcagaug

SEQ ID NO: 1069565 - RNA, 22 nt, Human
aaacauuagacaccauaugcuc

SEQ ID NO: 1069566 - RNA, 22 nt, Human
cucagcccagcccaggaccagg

SEQ ID NO: 1069567 - RNA, 22 nt, Human
aagagaaggugaggaagccggu

SEQ ID NO: 1069568 - RNA, 22 nt, Human
ggcuuaaaguuuucuagaauaa

SEQ ID NO: 1069569 - RNA, 22 nt, Human
uuucaaacuuuacucuugaauc

SEQ ID NO: 1069570 - RNA, 22 nt, Human
uggacagcgaaagugccuggga

SEQ ID NO: 1069571 - RNA, 22 nt, Human
cccucccagaugggcuugaggu

SEQ ID NO: 1069572 - RNA, 22 nt, Human
acaguggagaaggcaugaggcu

SEQ ID NO: 1069573 - RNA, 22 nt, Human
augauacaagcaaaacuaauca

SEQ ID NO: 1069574 - RNA, 22 nt, Human
gccaggcuggugcaaggauauu

SEQ ID NO: 1069575 - RNA, 22 nt, Human
gccuguuggguaacagaguuca

SEQ ID NO: 1069576 - RNA, 23 nt, Human
ucccucaggccuuaucuccaucu

SEQ ID NO: 1069577 - RNA, 20 nt, Human
aacacagauaccaaagguug

SEQ ID NO: 1069578 - RNA, 22 nt, Human
cuucuucauguauugauagucu

SEQ ID NO: 1069579 - RNA, 22 nt, Human
cuguggcucaaaaucccaugau

SEQ ID NO: 1069580 - RNA, 22 nt, Human
caggaggcccggccacagccca

SEQ ID NO: 1069581 - RNA, 18 nt, Human
ggcugagguugacuagaa

SEQ ID NO: 1069582 - RNA, 22 nt, Human
ucuggggaugagguccagugau

SEQ ID NO: 1069583 - RNA, 22 nt, Human
uguacagagguguacauaugau

SEQ ID NO: 1069584 - RNA, 22 nt, Human
ugagcccuggcucuuucacuua

SEQ ID NO: 1069585 - RNA, 23 nt, Human
uuacaugugugcacacauucugg

SEQ ID NO: 1069586 - RNA, 22 nt, Human
gaaggcuggcuuucugagagca

SEQ ID NO: 1069587 - RNA, 22 nt, Human
uugaaacuuuucuuggagaaac

SEQ ID NO: 1069588 - RNA, 22 nt, Human
ugcaggcaggggaugagcagcc

SEQ ID NO: 1069589 - RNA, 21 nt, Human
ucaaagcacauauuugcacau

SEQ ID NO: 1069590 - RNA, 17 nt, Human
agcagggagucaaggga

SEQ ID NO: 1069591 - RNA, 22 nt, Human
acacaguauuacaauaggugcu

SEQ ID NO: 1069592 - RNA, 22 nt, Human
cuggagcccaggccuggugucu

SEQ ID NO: 1069593 - RNA, 22 nt, Human
gugcugugugauccaugcuggc

SEQ ID NO: 1069594 - RNA, 22 nt, Human
gucuccugagacugcagucacc

SEQ ID NO: 1069595 - RNA, 22 nt, Human
ucagcugcucuguugagcugaa

SEQ ID NO: 1069596 - RNA, 22 nt, Human
cagcagguccugggcguggccu

SEQ ID NO: 1069597 - RNA, 22 nt, Human
gugguuuugccauuacaaguaa

SEQ ID NO: 1069598 - RNA, 22 nt, Human
cacagcuaauggaaguggaauc

SEQ ID NO: 1069599 - RNA, 22 nt, Human
ucagagugaccuuacauggucu

SEQ ID NO: 1069600 - RNA, 22 nt, Human
gcugcuggaacaaaucacccca

SEQ ID NO: 1069601 - RNA, 20 nt, Human
uggagcuccagcguccaugu

SEQ ID NO: 1069602 - RNA, 22 nt, Human
uuuaccaguguuaaacaccagc

SEQ ID NO: 1069603 - RNA, 22 nt, Human
aaagccaguuucuggaaguacc

SEQ ID NO: 1069604 - RNA, 22 nt, Human
uguuuucaugguuaugugucua

SEQ ID NO: 1069605 - RNA, 22 nt, Human
ugacaauacagagagagcaaaa

SEQ ID NO: 1069606 - RNA, 22 nt, Human
aguuggugggugugagcuggac

SEQ ID NO: 1069607 - RNA, 23 nt, Human
ucaauuaucaauggaaagaaguu

SEQ ID NO: 1069608 - RNA, 22 nt, Human
aaggaaagacauauaaaugacu

SEQ ID NO: 1069609 - RNA, 22 nt, Human
acacaucucaggggacacucuc

SEQ ID NO: 1069610 - RNA, 19 nt, Human
ggagacucagcccaugccu

SEQ ID NO: 1069611 - RNA, 22 nt, Human
cauuuguuaauuacuauuaucu

SEQ ID NO: 1069612 - RNA, 22 nt, Human
uuccugugugcucucauuuagu

SEQ ID NO: 1069613 - RNA, 22 nt, Human
ucaggcucccugcugggcucug

SEQ ID NO: 1069614 - RNA, 22 nt, Human
ucccagccauuccuuuaggugu

SEQ ID NO: 1069615 - RNA, 22 nt, Human
gaagagcuuaguuguccuagaa

SEQ ID NO: 1069616 - RNA, 22 nt, Human
cccuccccagggucauauugaa

SEQ ID NO: 1069617 - RNA, 22 nt, Human
aacuagucagugauucucagaa

SEQ ID NO: 1069618 - RNA, 22 nt, Human
aucuucuggucaaauuuuugca

SEQ ID NO: 1069619 - RNA, 22 nt, Human
agaagagaaauagugccacugu

SEQ ID NO: 1069620 - RNA, 22 nt, Human
agaaauuaggaaaguaacacuu

SEQ ID NO: 1069621 - RNA, 21 nt, Human
caguguggugaccagggucuc

SEQ ID NO: 1069622 - RNA, 22 nt, Human
acaguguuccuuuguugugacu

SEQ ID NO: 1069623 - RNA, 22 nt, Human
uuuuccuauaugcaaagaaugc

SEQ ID NO: 1069624 - RNA, 19 nt, Human
agacagcucuauuauuuug

SEQ ID NO: 1069625 - RNA, 22 nt, Human
acaggggaauuuacugucauua

SEQ ID NO: 1069626 - RNA, 22 nt, Human
acacaucagccucagcuuuggg

SEQ ID NO: 1069627 - RNA, 22 nt, Human
acaagaauuuacauguagugga

SEQ ID NO: 1069628 - RNA, 22 nt, Human
ugggcugcuucuauuggugguc

SEQ ID NO: 1069629 - RNA, 22 nt, Human
uaagaauaccucucagcucuuu

SEQ ID NO: 1069630 - RNA, 22 nt, Human
ggcacugacugugcagcgcacc

SEQ ID NO: 1069631 - RNA, 22 nt, Human
ugggcuuccuggagccugugcu

SEQ ID NO: 1069632 - RNA, 22 nt, Human
augaaacaugagaaauggagag

SEQ ID NO: 1069633 - RNA, 22 nt, Human
gucaggaugcuauuguuauuaa

SEQ ID NO: 1069634 - RNA, 22 nt, Human
gggcacugcuuugcucugucac

SEQ ID NO: 1069635 - RNA, 22 nt, Human
uuucacauaucaacucuauccu

SEQ ID NO: 1069636 - RNA, 22 nt, Human
gaggcaguuugccaugccagga

SEQ ID NO: 1069637 - RNA, 22 nt, Human
guggccuuuaucuuagguaucc

SEQ ID NO: 1069638 - RNA, 20 nt, Human
aacaaacuacaaaauuaugu

SEQ ID NO: 1069639 - RNA, 22 nt, Human
acaguucaagucuuagacaaca

SEQ ID NO: 1069640 - RNA, 22 nt, Human
cuguaugauauccaaauugaua

SEQ ID NO: 1069641 - RNA, 22 nt, Human
ucaaagauugaaacuaaggaga

SEQ ID NO: 1069642 - RNA, 22 nt, Human
aaauuuaagaagugugugcgug

SEQ ID NO: 1069643 - RNA, 22 nt, Human
cccugucuguaccgugaugagc

SEQ ID NO: 1069644 - RNA, 22 nt, Human
aacugcauucagaaagcucacu

SEQ ID NO: 1069645 - RNA, 22 nt, Human
gucucagaccacccucuuuggc

SEQ ID NO: 1069646 - RNA, 22 nt, Human
guggcugcagcccagcggcacg

SEQ ID NO: 1069647 - RNA, 22 nt, Human
gggaugcaguauguauauuuuc

SEQ ID NO: 1069648 - RNA, 22 nt, Human
ccuccugggccuugcucuguga

SEQ ID NO: 1069649 - RNA, 22 nt, Human
gcuguucccauguggggcucag

SEQ ID NO: 1069650 - RNA, 22 nt, Human
cuaugaccccagcaugaauaag

SEQ ID NO: 1069651 - RNA, 22 nt, Human
agggcccuuacgcaggcccuuc

SEQ ID NO: 1069652 - RNA, 22 nt, Human
gagcccuccauggagccaggca

SEQ ID NO: 1069653 - RNA, 22 nt, Human
uaaguagacuguugaacuuggu

SEQ ID NO: 1069654 - RNA, 22 nt, Human
ugcuggcccaguauggacugca

SEQ ID NO: 1069655 - RNA, 22 nt, Human
cagagcuguugcggggcuuggc

SEQ ID NO: 1069656 - RNA, 22 nt, Human
ugauuuuacuuagcaugauguu

SEQ ID NO: 1069657 - RNA, 20 nt, Human
ucccaagggcugagaggauc

SEQ ID NO: 1069658 - RNA, 22 nt, Human
ggagaggcuuggcccagccugg

SEQ ID NO: 1069659 - RNA, 17 nt, Human
gguggccugcaguggcu

SEQ ID NO: 1069660 - RNA, 22 nt, Human
aagcugcccuguguuagaguuc

SEQ ID NO: 1069661 - RNA, 19 nt, Human
gcugugugaccuugggcaa

SEQ ID NO: 1069662 - RNA, 22 nt, Human
agaaggccuagaguaagacauu

SEQ ID NO: 1069663 - RNA, 19 nt, Human
ccugcagggaugagagguu

SEQ ID NO: 1069664 - RNA, 22 nt, Human
cugggccuagcaacagaggagu

SEQ ID NO: 1069665 - RNA, 22 nt, Human
ucucucagaggaagaggcagug

SEQ ID NO: 1069666 - RNA, 22 nt, Human
gagcagggagacaacucuggug

SEQ ID NO: 1069667 - RNA, 19 nt, Human
gccaggccuggaccugcag

SEQ ID NO: 1069668 - RNA, 22 nt, Human
ucccacacuugaaacaaggcug

SEQ ID NO: 1069669 - RNA, 20 nt, Human
cucaggauacugcaaaguug

SEQ ID NO: 1069670 - RNA, 22 nt, Human
ucaaaguagccggauggaauuu

SEQ ID NO: 1069671 - RNA, 22 nt, Human
cuggccaggcuugggacagaca

SEQ ID NO: 1069672 - RNA, 21 nt, Human
ggauggauagggaagagauuu

SEQ ID NO: 1069673 - RNA, 22 nt, Human
ccucuccaguuuuaacgugacc

SEQ ID NO: 1069674 - RNA, 20 nt, Human
cuucuucauuaacccuacug

SEQ ID NO: 1069675 - RNA, 22 nt, Human
ugucccagaucacaggagggga

SEQ ID NO: 1069676 - RNA, 22 nt, Human
aucaaaguucguaacugauaac

SEQ ID NO: 1069677 - RNA, 22 nt, Human
cagacagcugcuuucuugcugu

SEQ ID NO: 1069678 - RNA, 22 nt, Human
acccucccauuuccauguagca

SEQ ID NO: 1069679 - RNA, 22 nt, Human
uggaagaauagaagaugguuga

SEQ ID NO: 1069680 - RNA, 22 nt, Human
cacaggaagaucucccagaggu

SEQ ID NO: 1069681 - RNA, 22 nt, Human
aacacaaucuuccaguuugcug

SEQ ID NO: 1069682 - RNA, 22 nt, Human
gcagaagcugggcagcgaggug

SEQ ID NO: 1069683 - RNA, 22 nt, Human
gggcccuggacguggcggcaga

SEQ ID NO: 1069684 - RNA, 17 nt, Human
gauuuccugaaguucuu

SEQ ID NO: 1069685 - RNA, 22 nt, Human
cagcuggcuccaccucugggcu

SEQ ID NO: 1069686 - RNA, 22 nt, Human
gcacagcaugaagagaggaagc

SEQ ID NO: 1069687 - RNA, 22 nt, Human
ggagaugcuauguaguuugguu

SEQ ID NO: 1069688 - RNA, 22 nt, Human
auuucagcccaguaugagcccc

SEQ ID NO: 1069689 - RNA, 22 nt, Human
agcaggaguuugaugcuuuuau

SEQ ID NO: 1069690 - RNA, 22 nt, Human
aaagucacaguuuaggggauau

SEQ ID NO: 1069691 - RNA, 22 nt, Human
agaugauggccauguccucucc

SEQ ID NO: 1069692 - RNA, 22 nt, Human
aggggcucaguuacuuuggcag

SEQ ID NO: 1069693 - RNA, 22 nt, Human
uucagauguggcuuugucaggc

SEQ ID NO: 1069694 - RNA, 22 nt, Human
aaauccaguuugucauuuccca

SEQ ID NO: 1069695 - RNA, 22 nt, Human
cugcugagaugccaggagcucu

SEQ ID NO: 1069696 - RNA, 22 nt, Human
ucuccaggaagcccucccugac

SEQ ID NO: 1069697 - RNA, 22 nt, Human
uggcucagcgguggcagcagac

SEQ ID NO: 1069698 - RNA, 23 nt, Human
uggaccugaaccagugccucugu

SEQ ID NO: 1069699 - RNA, 22 nt, Human
aguucaggcauaaggcaugaac

SEQ ID NO: 1069700 - RNA, 21 nt, Human
uccaagcucaacucccuuccu

SEQ ID NO: 1069701 - RNA, 22 nt, Human
aauauuuuaggcuuuccaggcu

SEQ ID NO: 1069702 - RNA, 22 nt, Human
auuuguaaagugcuuaaaagua

SEQ ID NO: 1069703 - RNA, 20 nt, Human
aagcacauuucuacaauaau

SEQ ID NO: 1069704 - RNA, 22 nt, Human
aaugaagcaagcugcuguguuu

SEQ ID NO: 1069705 - RNA, 23 nt, Human
cauggaaaacugaaagcugaccu

SEQ ID NO: 1069706 - RNA, 22 nt, Human
agcucugguuuagaaggggaaa

SEQ ID NO: 1069707 - RNA, 21 nt, Human
agaauuaaauuggauuugugu

SEQ ID NO: 1069708 - RNA, 22 nt, Human
ugucuguuauugguguauaaga

SEQ ID NO: 1069709 - RNA, 22 nt, Human
ugggcagaaggaagagccaccu

SEQ ID NO: 1069710 - RNA, 22 nt, Human
gaggggcuggcacgauggcugc

SEQ ID NO: 1069711 - RNA, 22 nt, Human
uaccuuuugcuuauuaugacac

SEQ ID NO: 1069712 - RNA, 22 nt, Human
ggaaagaaucaagugauccugu

SEQ ID NO: 1069713 - RNA, 22 nt, Human
aucaagcuggcauauguaguuc

SEQ ID NO: 1069714 - RNA, 22 nt, Human
aggcacugcuucuaaguaggaa

SEQ ID NO: 1069715 - RNA, 22 nt, Human
aagcuccccgaaacccaccucu

SEQ ID NO: 1069716 - RNA, 22 nt, Human
cuucaguggucauuugugauaa

SEQ ID NO: 1069717 - RNA, 22 nt, Human
acauuuaaauaccuauguuucu

SEQ ID NO: 1069718 - RNA, 22 nt, Human
cugggccaggaccaggguugaa

SEQ ID NO: 1069719 - RNA, 22 nt, Human
ugucucuggcccaugagcagag

SEQ ID NO: 1069720 - RNA, 22 nt, Human
agcaccaagccuagagugaugu

SEQ ID NO: 1069721 - RNA, 22 nt, Human
ugcagggccgcuggaggucaug

SEQ ID NO: 1069722 - RNA, 22 nt, Human
accugagagcuauaagguuuua

SEQ ID NO: 1069723 - RNA, 22 nt, Human
ggcacugggagaggugagacgg

SEQ ID NO: 1069724 - RNA, 22 nt, Human
ugcauuugucuugucucaugaa

SEQ ID NO: 1069725 - RNA, 22 nt, Human
acagccuguuugaucuggugcu

SEQ ID NO: 1069726 - RNA, 22 nt, Human
acaaaugaaccugaaaucucag

SEQ ID NO: 1069727 - RNA, 22 nt, Human
ugacagaaagaauaugucaauc

SEQ ID NO: 1069728 - RNA, 19 nt, Human
cucucacucgccacauccu

SEQ ID NO: 1069729 - RNA, 22 nt, Human
ccaagaugaucuuuacaguguu

SEQ ID NO: 1069730 - RNA, 22 nt, Human
augcuuaacucuguacauaguu

SEQ ID NO: 1069731 - RNA, 18 nt, Human
gacaaaugcaauuuaaag

SEQ ID NO: 1069732 - RNA, 22 nt, Human
ucuccucuauuucuguauguau

SEQ ID NO: 1069733 - RNA, 22 nt, Human
uagguggugugcgaagagcgug

SEQ ID NO: 1069734 - RNA, 22 nt, Human
acuugaaaggaagcucuaaaac

SEQ ID NO: 1069735 - RNA, 22 nt, Human
gcucagggccauggaccagcag

SEQ ID NO: 1069736 - RNA, 22 nt, Human
ugaaaucauguaguuauugcaa

SEQ ID NO: 1069737 - RNA, 22 nt, Human
ugaacacagggaauggggguuu

SEQ ID NO: 1069738 - RNA, 22 nt, Human
gugggcuuuggccucuuucucc

SEQ ID NO: 1069739 - RNA, 22 nt, Human
uuauuauagauuaugcaagauu

SEQ ID NO: 1069740 - RNA, 22 nt, Human
ccagcuugaagaugugcugguu

SEQ ID NO: 1069741 - RNA, 22 nt, Human
ugcuucugacugggucaguuga

SEQ ID NO: 1069742 - RNA, 22 nt, Human
gaguagguugucagacuccaaa

SEQ ID NO: 1069743 - RNA, 22 nt, Human
ggcaaaaaccgcaauaacuucu

SEQ ID NO: 1069744 - RNA, 22 nt, Human
uuauaggcuuaguucugugugu

SEQ ID NO: 1069745 - RNA, 22 nt, Human
uaucuaagagagucaauauuua

SEQ ID NO: 1069746 - RNA, 22 nt, Human
agggccagcacuccuggcagga

SEQ ID NO: 1069747 - RNA, 22 nt, Human
ucugucaccgagggcauccaaa

SEQ ID NO: 1069748 - RNA, 22 nt, Human
gcagaagggaauaaggagcuuu

SEQ ID NO: 1069749 - RNA, 22 nt, Human
agcucugggccaggaacccuaa

SEQ ID NO: 1069750 - RNA, 21 nt, Human
auaucuucuucaaaccacuca

SEQ ID NO: 1069751 - RNA, 22 nt, Human
auauuuacugcuguggugaagg

SEQ ID NO: 1069752 - RNA, 22 nt, Human
cuaaauacuagccuucagauuu

SEQ ID NO: 1069753 - RNA, 22 nt, Human
gugcccugagcuuaugcauucu

SEQ ID NO: 1069754 - RNA, 22 nt, Human
uuuccuuucugguuuggucaua

SEQ ID NO: 1069755 - RNA, 22 nt, Human
acacauuuucaacacugucaag

SEQ ID NO: 1069756 - RNA, 22 nt, Human
uaauuuaugaugcaaagaaaag

SEQ ID NO: 1069757 - RNA, 22 nt, Human
agcugcagugaacuguuuuguc

SEQ ID NO: 1069758 - RNA, 17 nt, Human
uucagaagcauuuuggc

SEQ ID NO: 1069759 - RNA, 22 nt, Human
guauuacauuuaguaauuaggc

SEQ ID NO: 1069760 - RNA, 22 nt, Human
agcuggcauacuuugcuaggaa

SEQ ID NO: 1069761 - RNA, 22 nt, Human
gccuggagggauagaaugcaag

SEQ ID NO: 1069762 - RNA, 22 nt, Human
caaaguccauaguuuacaauag

SEQ ID NO: 1069763 - RNA, 22 nt, Human
gugccaggcccagggagcgggg

SEQ ID NO: 1069764 - RNA, 22 nt, Human
gcagccacucucauuccacgug

SEQ ID NO: 1069765 - RNA, 22 nt, Human
aaaguuuguugcuuacaaagaa

SEQ ID NO: 1069766 - RNA, 22 nt, Human
agaaacucuaggucaauugagg

SEQ ID NO: 1069767 - RNA, 22 nt, Human
acuggggagagucaugccagca

SEQ ID NO: 1069768 - RNA, 22 nt, Human
auuacaauaauacaugcucauu

SEQ ID NO: 1069769 - RNA, 22 nt, Human
ggcuucugccacgagagggaag

SEQ ID NO: 1069770 - RNA, 22 nt, Human
gcugaggaaaggcuggaaggga

SEQ ID NO: 1069771 - RNA, 22 nt, Human
aggagcucugggcagggccucc

SEQ ID NO: 1069772 - RNA, 22 nt, Human
uuucacauggacuuuuuguucu

SEQ ID NO: 1069773 - RNA, 19 nt, Human
ucgagucaagacacuaggc

SEQ ID NO: 1069774 - RNA, 22 nt, Human
agacaauauguauauuaagaau

SEQ ID NO: 1069775 - RNA, 16 nt, Human
agcagggcgggaagga

SEQ ID NO: 1069776 - RNA, 22 nt, Human
cuucagcugacgucaaaacacc

SEQ ID NO: 1069777 - RNA, 22 nt, Human
cugcaggggccucgagcacagg

SEQ ID NO: 1069778 - RNA, 22 nt, Human
ccaguguuauuuuagaguguga

SEQ ID NO: 1069779 - RNA, 22 nt, Human
ugggaagggucaacagcuggaa

SEQ ID NO: 1069780 - RNA, 22 nt, Human
gcaggagccacuucagggaugc

SEQ ID NO: 1069781 - RNA, 22 nt, Human
caggugucaaaauacuaagugg

SEQ ID NO: 1069782 - RNA, 22 nt, Human
ucuuugcaggccaaauuguuaa

SEQ ID NO: 1069783 - RNA, 22 nt, Human
cuggaggcugaguugggucucc

SEQ ID NO: 1069784 - RNA, 22 nt, Human
uagauacaggcucucugagccu

SEQ ID NO: 1069785 - RNA, 22 nt, Human
accucccagcucugagcuuggg

SEQ ID NO: 1069786 - RNA, 22 nt, Human
caggagccccaggcugacaaua

SEQ ID NO: 1069787 - RNA, 22 nt, Human
gagucccaugaugauagccaca

SEQ ID NO: 1069788 - RNA, 23 nt, Human
ggacacauuuauuucagaauuca

SEQ ID NO: 1069789 - RNA, 22 nt, Human
auagaaaacagauguccuuaaa

SEQ ID NO: 1069790 - RNA, 22 nt, Human
gcagugauuggaucagagaugg

SEQ ID NO: 1069791 - RNA, 22 nt, Human
uggagcccagacacuggcauug

SEQ ID NO: 1069792 - RNA, 22 nt, Human
cugaggucuagacaccccaggg

SEQ ID NO: 1069793 - RNA, 22 nt, Human
ggccacugcugcucugguggag

SEQ ID NO: 1069794 - RNA, 22 nt, Human
ucaggauaaaauguaauggcaa

SEQ ID NO: 1069795 - RNA, 20 nt, Human
uuggcucaugcaacaccuac

SEQ ID NO: 1069796 - RNA, 22 nt, Human
guggcuucuggcugggccucag

SEQ ID NO: 1069797 - RNA, 22 nt, Human
ucagagccccuccgcuguccca

SEQ ID NO: 1069798 - RNA, 22 nt, Human
agucucugcaugaugcagcaca

SEQ ID NO: 1069799 - RNA, 22 nt, Human
ggguccuggaaucugcauuuua

SEQ ID NO: 1069800 - RNA, 22 nt, Human
uaacagcacuggcaggcacugu

SEQ ID NO: 1069801 - RNA, 22 nt, Human
cacacugucagguaaauaacac

SEQ ID NO: 1069802 - RNA, 22 nt, Human
ccucuggcaacuucacagccca

SEQ ID NO: 1069803 - RNA, 22 nt, Human
ugccuggaugugcuggccucac

SEQ ID NO: 1069804 - RNA, 22 nt, Human
uagagaaauaagcuuugccuug

SEQ ID NO: 1069805 - RNA, 22 nt, Human
auauucaagugaggauggcuaa

SEQ ID NO: 1069806 - RNA, 22 nt, Human
aauguacaaaccuucuuuguag

SEQ ID NO: 1069807 - RNA, 22 nt, Human
uagauuucaggcuggcuugcgg

SEQ ID NO: 1069808 - RNA, 15 nt, Human
uggcagcuuguuaag

SEQ ID NO: 1069809 - RNA, 22 nt, Human
cagcucuuugaguauuccauuu

SEQ ID NO: 1069810 - RNA, 22 nt, Human
uggaggcaucagagugcuuggc

SEQ ID NO: 1069811 - RNA, 22 nt, Human
gccucugcaggugcgguuaucc

SEQ ID NO: 1069812 - RNA, 22 nt, Human
acaaugaacgcuuuuuaacugu

SEQ ID NO: 1069813 - RNA, 22 nt, Human
ugcaaaugaguugcagaucagg

SEQ ID NO: 1069814 - RNA, 23 nt, Human
guguguggaaagugcaugggccu

SEQ ID NO: 1069815 - RNA, 22 nt, Human
gagcugcaugcaacuguuuaaa

SEQ ID NO: 1069816 - RNA, 22 nt, Human
uggcuucugggacuugugagca

SEQ ID NO: 1069817 - RNA, 22 nt, Human
guuucacagaugguguucauau

SEQ ID NO: 1069818 - RNA, 22 nt, Human
aggcacuguggguguggccgga

SEQ ID NO: 1069819 - RNA, 22 nt, Human
cugagcagucuagccagguguu

SEQ ID NO: 1069820 - RNA, 22 nt, Human
cagagcugggcauggugaaagg

SEQ ID NO: 1069821 - RNA, 22 nt, Human
gggaaggagguggcuugaagug

SEQ ID NO: 1069822 - RNA, 22 nt, Human
uuuaucaucuuguuuuuaaagc

SEQ ID NO: 1069823 - RNA, 22 nt, Human
gccuuuugaucuauaacugugu

SEQ ID NO: 1069824 - RNA, 22 nt, Human
ggcugcuguuucagagacuguu

SEQ ID NO: 1069825 - RNA, 22 nt, Human
gggucagcugcugggggcugac

SEQ ID NO: 1069826 - RNA, 20 nt, Human
guuaaaagaguaauuugagg

SEQ ID NO: 1069827 - RNA, 22 nt, Human
gcuaggagauugagcucugaag

SEQ ID NO: 1069828 - RNA, 22 nt, Human
ggcuucugguaaagaccacacc

SEQ ID NO: 1069829 - RNA, 22 nt, Human
gcugggaaguggcagagcugga

SEQ ID NO: 1069830 - RNA, 22 nt, Human
uaggaaagaaaugaguagugau

SEQ ID NO: 1069831 - RNA, 22 nt, Human
gcgggccaccuuggagagcgcu

SEQ ID NO: 1069832 - RNA, 22 nt, Human
ccuggcugggguagaagugagg

SEQ ID NO: 1069833 - RNA, 22 nt, Human
acuggcaggcugcuggccggcg

SEQ ID NO: 1069834 - RNA, 22 nt, Human
agaguguuucagucuuccuaga

SEQ ID NO: 1069835 - RNA, 22 nt, Human
uuucugaauaacucuaugauau

SEQ ID NO: 1069836 - RNA, 22 nt, Human
auacacacauaugugaguuuug

SEQ ID NO: 1069837 - RNA, 22 nt, Human
cacaguacccagcacuacugag

SEQ ID NO: 1069838 - RNA, 22 nt, Human
aguuuuauuaaauccacagaag

SEQ ID NO: 1069839 - RNA, 16 nt, Human
uggcugagagaggguu

SEQ ID NO: 1069840 - RNA, 22 nt, Human
uaagucaguagaacugugguca

SEQ ID NO: 1069841 - RNA, 18 nt, Human
cagcugccagcucaugga

SEQ ID NO: 1069842 - RNA, 22 nt, Human
gaaacuuuuaaaccucaugagu

SEQ ID NO: 1069843 - RNA, 22 nt, Human
uggagcaggugggaugucguga

SEQ ID NO: 1069844 - RNA, 22 nt, Human
aggaagccuggcauuaaaaagc

SEQ ID NO: 1069845 - RNA, 22 nt, Human
acaaguuagguuuuaauccaaa

SEQ ID NO: 1069846 - RNA, 21 nt, Human
aaucaagaguacugguguggc

SEQ ID NO: 1069847 - RNA, 22 nt, Human
cuguaugaacccauauacuuau

SEQ ID NO: 1069848 - RNA, 22 nt, Human
agcuuuaaagcauauuucuaag

SEQ ID NO: 1069849 - RNA, 22 nt, Human
ugcacgugggcucucugcucuu

SEQ ID NO: 1069850 - RNA, 22 nt, Human
aaucuuagaguguuuuugaagc

SEQ ID NO: 1069851 - RNA, 22 nt, Human
ugcuucuggcacuugagggggu

SEQ ID NO: 1069852 - RNA, 19 nt, Human
cucuuacagaauagacaca

SEQ ID NO: 1069853 - RNA, 22 nt, Human
uuggcaguaaaagaaaaugcuu

SEQ ID NO: 1069854 - RNA, 22 nt, Human
cuuugauauaaguauacauagu

SEQ ID NO: 1069855 - RNA, 22 nt, Human
gaaaucaucugaguaauaaucu

SEQ ID NO: 1069856 - RNA, 22 nt, Human
aauuuucugaugaugaagcacg

SEQ ID NO: 1069857 - RNA, 22 nt, Human
uuuuccucuguauuugaaaugc

SEQ ID NO: 1069858 - RNA, 22 nt, Human
aucaguuuugggggacauacug

SEQ ID NO: 1069859 - RNA, 22 nt, Human
cacagggccuugugugacugca

SEQ ID NO: 1069860 - RNA, 22 nt, Human
auugguggugaggacaugccag

SEQ ID NO: 1069861 - RNA, 22 nt, Human
acaucacaguaguuaagccaga

SEQ ID NO: 1069862 - RNA, 19 nt, Human
gcucugagaggggcauggg

SEQ ID NO: 1069863 - RNA, 22 nt, Human
gcugacuuugccugucuuuagc

SEQ ID NO: 1069864 - RNA, 22 nt, Human
acaggugguagaguggaaagag

SEQ ID NO: 1069865 - RNA, 22 nt, Human
aggaccugacuggcuccugcuu

SEQ ID NO: 1069866 - RNA, 22 nt, Human
ugggcacauaguuuuaugguca

SEQ ID NO: 1069867 - RNA, 17 nt, Human
acacagacaggcagaca

SEQ ID NO: 1069868 - RNA, 22 nt, Human
ccaggagagcagaagcccaggc

SEQ ID NO: 1069869 - RNA, 22 nt, Human
ugccaaggguaugggcaagaua

SEQ ID NO: 1069870 - RNA, 22 nt, Human
uagugcuuuaggccugaguguc

SEQ ID NO: 1069871 - RNA, 22 nt, Human
cugcuuccugcugggauacuga

SEQ ID NO: 1069872 - RNA, 22 nt, Human
cagaagcagauucuaaagcaag

SEQ ID NO: 1069873 - RNA, 22 nt, Human
aagauauagauggugguauaaa

SEQ ID NO: 1069874 - RNA, 22 nt, Human
uuuugccgaagguaucugagau

SEQ ID NO: 1069875 - RNA, 22 nt, Human
uuuauccauaucauuaaaaucu

SEQ ID NO: 1069876 - RNA, 18 nt, Human
uggagccauugccaccau

SEQ ID NO: 1069877 - RNA, 22 nt, Human
cuucaggauuuaggaagaugaa

SEQ ID NO: 1069878 - RNA, 22 nt, Human
uuugucuuggccucaguuuucu

SEQ ID NO: 1069879 - RNA, 22 nt, Human
uacauacaagauguguuuaaaa

SEQ ID NO: 1069880 - RNA, 22 nt, Human
uggccugccuucgcugagcuga

SEQ ID NO: 1069881 - RNA, 22 nt, Human
uccugcagccacugcaggcaga

SEQ ID NO: 1069882 - RNA, 22 nt, Human
caggugggauuuugcugcuuga

SEQ ID NO: 1069883 - RNA, 22 nt, Human
caagagcucaccggagagcauu

SEQ ID NO: 1069884 - RNA, 22 nt, Human
cuccuucaaaagucauaguaaa

SEQ ID NO: 1069885 - RNA, 22 nt, Human
cuggguggcgucuggggccagu

SEQ ID NO: 1069886 - RNA, 22 nt, Human
cagaaacuguggauucauuaaa

SEQ ID NO: 1069887 - RNA, 22 nt, Human
cuauuugggguagaagauggau

SEQ ID NO: 1069888 - RNA, 22 nt, Human
uacugauagcacaaaugacauu

SEQ ID NO: 1069889 - RNA, 22 nt, Human
uccauucuaugcuuacauuuau

SEQ ID NO: 1069890 - RNA, 23 nt, Human
agaugagccaacaccuccaugcc

SEQ ID NO: 1069891 - RNA, 22 nt, Human
gugggcaggcccuaggcgauuu

SEQ ID NO: 1069892 - RNA, 22 nt, Human
ucugaaauggcagcgggaauga

SEQ ID NO: 1069893 - RNA, 20 nt, Human
auacacauucauagaaaaau

SEQ ID NO: 1069894 - RNA, 22 nt, Human
acaggggauugauuggaagucu

SEQ ID NO: 1069895 - RNA, 22 nt, Human
uagugcuuaacacaaagugauu

SEQ ID NO: 1069896 - RNA, 22 nt, Human
auuucauugaaguuaauucuuc

SEQ ID NO: 1069897 - RNA, 22 nt, Human
gcauuuccugugcuuggcauau

SEQ ID NO: 1069898 - RNA, 22 nt, Human
uuuuugcaccaaccuaauagaa

SEQ ID NO: 1069899 - RNA, 22 nt, Human
ucaggagacaaagggugcggag

SEQ ID NO: 1069900 - RNA, 22 nt, Human
gugcauuggugcgccacuucac

SEQ ID NO: 1069901 - RNA, 19 nt, Human
aacuguaaagaucuguagc

SEQ ID NO: 1069902 - RNA, 22 nt, Human
ccacaucucgguccccucuuug

SEQ ID NO: 1069903 - RNA, 22 nt, Human
aaagcacucguuaguauuucug

SEQ ID NO: 1069904 - RNA, 22 nt, Human
uguaaaccagggucauccuuag

SEQ ID NO: 1069905 - RNA, 19 nt, Human
auauagcauuauucaauuu

SEQ ID NO: 1069906 - RNA, 19 nt, Human
acuggcaguuucugcaugg

SEQ ID NO: 1069907 - RNA, 22 nt, Human
gauugaaacauaggcagucgag

SEQ ID NO: 1069908 - RNA, 20 nt, Human
uccugcaguuccuaggaggg

SEQ ID NO: 1069909 - RNA, 22 nt, Human
ccaggaccacacgacaggagag

SEQ ID NO: 1069910 - RNA, 19 nt, Human
aucugaaguaggugcagcu

SEQ ID NO: 1069911 - RNA, 22 nt, Human
aagagcuggauugugcugcaga

SEQ ID NO: 1069912 - RNA, 22 nt, Human
uagcugugagcacccaggcugu

SEQ ID NO: 1069913 - RNA, 22 nt, Human
gugugcagggcugccugugccg

SEQ ID NO: 1069914 - RNA, 22 nt, Human
auucucuguuuccaagaugaaa

SEQ ID NO: 1069915 - RNA, 22 nt, Human
cuucagagugcagaagauuggg

SEQ ID NO: 1069916 - RNA, 22 nt, Human
ucugaggccuucagcaugaauc

SEQ ID NO: 1069917 - RNA, 22 nt, Human
aaucaagaguuguguaauauuu

SEQ ID NO: 1069918 - RNA, 22 nt, Human
cuggcaggagcauucacagagg

SEQ ID NO: 1069919 - RNA, 22 nt, Human
ccuguggcucucuuuggagguc

SEQ ID NO: 1069920 - RNA, 22 nt, Human
ggccuggccuccagaugugggc

SEQ ID NO: 1069921 - RNA, 21 nt, Human
aguuacauguauagauaaagu

SEQ ID NO: 1069922 - RNA, 22 nt, Human
augaggcagcugcuggagaacg

SEQ ID NO: 1069923 - RNA, 22 nt, Human
ugaacaguuucaagaaaacuuu

SEQ ID NO: 1069924 - RNA, 22 nt, Human
guguccuuauaagaagagaugc

SEQ ID NO: 1069925 - RNA, 22 nt, Human
ugccugcuaggcccugcugggu

SEQ ID NO: 1069926 - RNA, 22 nt, Human
uguggcagcugcugcaggagcu

SEQ ID NO: 1069927 - RNA, 22 nt, Human
uccaggaaagugggaugugugu

SEQ ID NO: 1069928 - RNA, 22 nt, Human
ucccugggccuccugcuaugca

SEQ ID NO: 1069929 - RNA, 22 nt, Human
ucagaaggcccguugcuaagag

SEQ ID NO: 1069930 - RNA, 22 nt, Human
caucagugguaacugaaugguu

SEQ ID NO: 1069931 - RNA, 22 nt, Human
ggccucuguucugcauuccucc

SEQ ID NO: 1069932 - RNA, 22 nt, Human
cucagaaguucagccuagagua

SEQ ID NO: 1069933 - RNA, 22 nt, Human
acccuggacuggggcugaggcu

SEQ ID NO: 1069934 - RNA, 22 nt, Human
cacagaaauauugugucccuug

SEQ ID NO: 1069935 - RNA, 22 nt, Human
uggagcagcacaagaaagggga

SEQ ID NO: 1069936 - RNA, 22 nt, Human
gagguuggugaggggacacggu

SEQ ID NO: 1069937 - RNA, 22 nt, Human
cagcaggcguugggagaaagac

SEQ ID NO: 1069938 - RNA, 22 nt, Human
gaggcacagucccgaggcaagg

SEQ ID NO: 1069939 - RNA, 22 nt, Human
cagaauuuuucacucaaucuuc

SEQ ID NO: 1069940 - RNA, 22 nt, Human
ugcacagauagugauagauagc

SEQ ID NO: 1069941 - RNA, 22 nt, Human
acagggcagaaauguugcaucu

SEQ ID NO: 1069942 - RNA, 22 nt, Human
guccagggccccgagcaccagg

SEQ ID NO: 1069943 - RNA, 22 nt, Human
ccaucaguggcaaauaaacacc

SEQ ID NO: 1069944 - RNA, 22 nt, Human
uauagacuagcagcagaauuua

SEQ ID NO: 1069945 - RNA, 22 nt, Human
acucagaggaaacccuccuagg

SEQ ID NO: 1069946 - RNA, 22 nt, Human
ggugucccaggccagcugugug

SEQ ID NO: 1069947 - RNA, 19 nt, Human
cugugcaggccgggcugag

SEQ ID NO: 1069948 - RNA, 22 nt, Human
uggcagcagggaggccaguguu

SEQ ID NO: 1069949 - RNA, 20 nt, Human
acaggggcagcacaauaaug

SEQ ID NO: 1069950 - RNA, 22 nt, Human
auacacuggacaucauugcauu

SEQ ID NO: 1069951 - RNA, 22 nt, Human
cguuggagacacuugaggacuu

SEQ ID NO: 1069952 - RNA, 22 nt, Human
gaugaagcuaaaucuaagguuu

SEQ ID NO: 1069953 - RNA, 22 nt, Human
gcagaggaucaggcucuggaaa

SEQ ID NO: 1069954 - RNA, 22 nt, Human
aguggugcugcgcgcggagcuc

SEQ ID NO: 1069955 - RNA, 22 nt, Human
auauuucagcuuuacuuaggaa

SEQ ID NO: 1069956 - RNA, 22 nt, Human
ucuggagaacuugcaagaggau

SEQ ID NO: 1069957 - RNA, 22 nt, Human
caggggcucugagauugucuaa

SEQ ID NO: 1069958 - RNA, 22 nt, Human
uguuaccaggcaguauugcuua

SEQ ID NO: 1069959 - RNA, 23 nt, Human
ucuuuccucagcacacaccaaga

SEQ ID NO: 1069960 - RNA, 22 nt, Human
ggcuuaagauauuucugauucc

SEQ ID NO: 1069961 - RNA, 22 nt, Human
caaauaguaugagcaaugauuc

SEQ ID NO: 1069962 - RNA, 22 nt, Human
gagugugguaugcucugaggcu

SEQ ID NO: 1069963 - RNA, 22 nt, Human
ccaucuccacugucccugucaa

SEQ ID NO: 1069964 - RNA, 22 nt, Human
ccucaggaaaugaauaaauggc

SEQ ID NO: 1069965 - RNA, 22 nt, Human
caagaauaaaauacauguugau

SEQ ID NO: 1069966 - RNA, 22 nt, Human
aguggaguugaguugauggauu

SEQ ID NO: 1069967 - RNA, 20 nt, Human
ggggcagguuuuuauggcua

SEQ ID NO: 1069968 - RNA, 22 nt, Human
agcaccaucacagcuguauguc

SEQ ID NO: 1069969 - RNA, 22 nt, Human
gcugccuggaauaacggcuggc

SEQ ID NO: 1069970 - RNA, 22 nt, Human
cuaaauaaucccucuggucuua

SEQ ID NO: 1069971 - RNA, 20 nt, Human
ugcuccaucuaaagugauua

SEQ ID NO: 1069972 - RNA, 22 nt, Human
ucugccugcugccugggggcuc

SEQ ID NO: 1069973 - RNA, 22 nt, Human
ucacaucacccugcucuuaauu

SEQ ID NO: 1069974 - RNA, 22 nt, Human
aacagcuguucgcagauguagg

SEQ ID NO: 1069975 - RNA, 22 nt, Human
uuaugaaggaucagguacuugg

SEQ ID NO: 1069976 - RNA, 22 nt, Human
cccccagccagcagugcucagc

SEQ ID NO: 1069977 - RNA, 22 nt, Human
caaggcagcuauugucuccaua

SEQ ID NO: 1069978 - RNA, 22 nt, Human
ugaggcucugcuucuguggcuc

SEQ ID NO: 1069979 - RNA, 22 nt, Human
cuuuuuccagcuucaggguggg

SEQ ID NO: 1069980 - RNA, 22 nt, Human
caaauuagagguuuguuuugau

SEQ ID NO: 1069981 - RNA, 22 nt, Human
ccagugccuuuuguggguuugu

SEQ ID NO: 1069982 - RNA, 22 nt, Human
cagugcagaggccagggaggau

SEQ ID NO: 1069983 - RNA, 22 nt, Human
guuuuauaggugaaauauuacu

SEQ ID NO: 1069984 - RNA, 22 nt, Human
uuccaaauggagaagaugaguu

SEQ ID NO: 1069985 - RNA, 22 nt, Human
gugcuguaacaacagagugucu

SEQ ID NO: 1069986 - RNA, 22 nt, Human
uaggaauuuuuguaaugguacu

SEQ ID NO: 1069987 - RNA, 22 nt, Human
caaagcuuggagaagcagcugg

SEQ ID NO: 1069988 - RNA, 22 nt, Human
aaagccuuuucuguuuaacaca

SEQ ID NO: 1069989 - RNA, 22 nt, Human
uuccucaucugugcaccucacu

SEQ ID NO: 1069990 - RNA, 22 nt, Human
uacaugcaugucacagaaugaa

SEQ ID NO: 1069991 - RNA, 22 nt, Human
cccaucacagacacuggguuau

SEQ ID NO: 1069992 - RNA, 22 nt, Human
cuucaaagauuugauaaagcca

SEQ ID NO: 1069993 - RNA, 22 nt, Human
cugaaggaagcagguggccugu

SEQ ID NO: 1069994 - RNA, 22 nt, Human
cugccuguuuccucuugcuccc

SEQ ID NO: 1069995 - RNA, 22 nt, Human
guggccuggauagacuccaucu

SEQ ID NO: 1069996 - RNA, 22 nt, Human
ccucagccuuggccccaggcag

SEQ ID NO: 1069997 - RNA, 22 nt, Human
gcagacagacugcagugauuuu

SEQ ID NO: 1069998 - RNA, 22 nt, Human
gaagacaccuacugucauuucu

SEQ ID NO: 1069999 - RNA, 22 nt, Human
uagggcugccuauggcuagaua

SEQ ID NO: 1070000 - RNA, 22 nt, Human
guguaugaggggagaauguuuu

SEQ ID NO: 1070001 - RNA, 22 nt, Human
ugcaggugccucuugagcuugu

SEQ ID NO: 1070002 - RNA, 22 nt, Human
ccuggggaaaagcaggcauuua

SEQ ID NO: 1070003 - RNA, 22 nt, Human
ugaguuuuuucaacauaugaag

SEQ ID NO: 1070004 - RNA, 22 nt, Human
gcugagagugggugcagugcuu

SEQ ID NO: 1070005 - RNA, 22 nt, Human
uauacaauggcugaaucaucca

SEQ ID NO: 1070006 - RNA, 18 nt, Human
uggaagcuggcagauuuu

SEQ ID NO: 1070007 - RNA, 22 nt, Human
ugacauaauaauccaaacauac

SEQ ID NO: 1070008 - RNA, 22 nt, Human
aacccuggggcagcugcuaggg

SEQ ID NO: 1070009 - RNA, 22 nt, Human
ugcuucauuuccuuauauugua

SEQ ID NO: 1070010 - RNA, 22 nt, Human
uuccaacucugaaaugugaaau

SEQ ID NO: 1070011 - RNA, 22 nt, Human
aaacugcugguugcuggccagc

SEQ ID NO: 1070012 - RNA, 22 nt, Human
uuccucaguuagugccugaggc

SEQ ID NO: 1070013 - RNA, 22 nt, Human
ugagauuuggguuguuuaacau

SEQ ID NO: 1070014 - RNA, 20 nt, Human
ucucacaggggcuuuucucu

SEQ ID NO: 1070015 - RNA, 22 nt, Human
ucccugguuacguauaaagaug

SEQ ID NO: 1070016 - RNA, 22 nt, Human
acuguuuugugccuuaguuucc

SEQ ID NO: 1070017 - RNA, 22 nt, Human
uacaugcuccacuuucuccugu

SEQ ID NO: 1070018 - RNA, 22 nt, Human
agucuuuacuaaacagaccacc

SEQ ID NO: 1070019 - RNA, 22 nt, Human
gaugcacuuucuuuucaacagu

SEQ ID NO: 1070020 - RNA, 22 nt, Human
gaaagguucuugggaguucaca

SEQ ID NO: 1070021 - RNA, 22 nt, Human
uuucaaacauagaucugaauau

SEQ ID NO: 1070022 - RNA, 22 nt, Human
augagcccagaaaucucccuuu

SEQ ID NO: 1070023 - RNA, 22 nt, Human
ccaaucuuaucuuuauuuucua

SEQ ID NO: 1070024 - RNA, 22 nt, Human
uggaagcacugaagagacaacc

SEQ ID NO: 1070025 - RNA, 22 nt, Human
acacacucaauugcauaagcac

SEQ ID NO: 1070026 - RNA, 22 nt, Human
aaagguaaaguaucugcccaag

SEQ ID NO: 1070027 - RNA, 22 nt, Human
gagggcugugaaggagcggguu

SEQ ID NO: 1070028 - RNA, 19 nt, Human
agauggggaagagugugag

SEQ ID NO: 1070029 - RNA, 22 nt, Human
uaucuguugucuuuuacaugua

SEQ ID NO: 1070030 - RNA, 22 nt, Human
uaggaaaaauacagaauuauau

SEQ ID NO: 1070031 - RNA, 22 nt, Human
aagcagaggccacagagugggc

SEQ ID NO: 1070032 - RNA, 21 nt, Human
cagugcucaaucugacagugg

SEQ ID NO: 1070033 - RNA, 22 nt, Human
uggccccccagagcuggaggac

SEQ ID NO: 1070034 - RNA, 22 nt, Human
cagccagcuggugcggcagagc

SEQ ID NO: 1070035 - RNA, 22 nt, Human
aggcuuuggaaucagaguucug

SEQ ID NO: 1070036 - RNA, 22 nt, Human
ucugaggcccugcaggcagugu

SEQ ID NO: 1070037 - RNA, 22 nt, Human
uauguuaagugggauaaucaaa

SEQ ID NO: 1070038 - RNA, 22 nt, Human
cagagaaacucagauagcugau

SEQ ID NO: 1070039 - RNA, 22 nt, Human
cauauacacuuccaccucugug

SEQ ID NO: 1070040 - RNA, 22 nt, Human
cagcaagacaaggaacaaacug

SEQ ID NO: 1070041 - RNA, 21 nt, Human
gacaggcaaggagucacuuag

SEQ ID NO: 1070042 - RNA, 22 nt, Human
ccuggcagcuguuuggcuuggc

SEQ ID NO: 1070043 - RNA, 22 nt, Human
ucccugcucagcucaccuggca

SEQ ID NO: 1070044 - RNA, 22 nt, Human
ugcugucugauucagggugauu

SEQ ID NO: 1070045 - RNA, 22 nt, Human
ggagccaguuuagaccucaguu

SEQ ID NO: 1070046 - RNA, 19 nt, Human
auggaaaauuguacucaau

SEQ ID NO: 1070047 - RNA, 22 nt, Human
caugcacauguggcuauguaau

SEQ ID NO: 1070048 - RNA, 20 nt, Human
uucaaaguguaugauaugca

SEQ ID NO: 1070049 - RNA, 22 nt, Human
uggaagagguggaaguggcuuc

SEQ ID NO: 1070050 - RNA, 22 nt, Human
agucacuguucugucaugucaa

SEQ ID NO: 1070051 - RNA, 22 nt, Human
ugcugagauagcugacuaggca

SEQ ID NO: 1070052 - RNA, 22 nt, Human
ggcugggcuccgggagcaugcg

SEQ ID NO: 1070053 - RNA, 22 nt, Human
uggcaucucaaacaggcagauu

SEQ ID NO: 1070054 - RNA, 22 nt, Human
uugucugucccagcuugugcau

SEQ ID NO: 1070055 - RNA, 22 nt, Human
uagcuguguaagcuugguaaga

SEQ ID NO: 1070056 - RNA, 22 nt, Human
ggccaggcgaugaccccuccac

SEQ ID NO: 1070057 - RNA, 23 nt, Human
aggcagcagguuguccaggguga

SEQ ID NO: 1070058 - RNA, 22 nt, Human
gcugcaggagcuggagcugugg

SEQ ID NO: 1070059 - RNA, 22 nt, Human
cagagccaaaccucagggcccg

SEQ ID NO: 1070060 - RNA, 22 nt, Human
augaggcaggauuaagcuauca

SEQ ID NO: 1070061 - RNA, 17 nt, Human
agaaagaggauccacag

SEQ ID NO: 1070062 - RNA, 22 nt, Human
uggccuugggcagguggccugc

SEQ ID NO: 1070063 - RNA, 22 nt, Human
aagaauaucuguuuuauuuagg

SEQ ID NO: 1070064 - RNA, 22 nt, Human
gagggcagaaaauuaugcggug

SEQ ID NO: 1070065 - RNA, 22 nt, Human
ccuggagcacucucccuggcug

SEQ ID NO: 1070066 - RNA, 20 nt, Human
caugguggaggagcagggcc

SEQ ID NO: 1070067 - RNA, 23 nt, Human
gugcugugagccccuuggccucc

SEQ ID NO: 1070068 - RNA, 22 nt, Human
gccagcagggcccaaaugcugg

SEQ ID NO: 1070069 - RNA, 22 nt, Human
ugcugaguggcggccucacuuu

SEQ ID NO: 1070070 - RNA, 22 nt, Human
gacuucagauauuuuuuaaguu

SEQ ID NO: 1070071 - RNA, 22 nt, Human
ugaaaugagcauuuauucuuua

SEQ ID NO: 1070072 - RNA, 22 nt, Human
ucacagacgccuccccucgccu

SEQ ID NO: 1070073 - RNA, 22 nt, Human
auaaaacuuggguaugaucccu

SEQ ID NO: 1070074 - RNA, 22 nt, Human
gagcaagacuacaggcagauga

SEQ ID NO: 1070075 - RNA, 22 nt, Human
gggcagguguuuccaaggugag

SEQ ID NO: 1070076 - RNA, 22 nt, Human
caagcagagguuuauguauuag

SEQ ID NO: 1070077 - RNA, 21 nt, Human
cagaggccucaugcucugugc

SEQ ID NO: 1070078 - RNA, 22 nt, Human
cauaccuuucucaagcacaugu

SEQ ID NO: 1070079 - RNA, 22 nt, Human
aaauaacagucagggacaacau

SEQ ID NO: 1070080 - RNA, 21 nt, Human
gagcucucaggcaagaagcag

SEQ ID NO: 1070081 - RNA, 19 nt, Human
uggcagggagugauauuag

SEQ ID NO: 1070082 - RNA, 22 nt, Human
uggcauuuucuccuuugaguuu

SEQ ID NO: 1070083 - RNA, 22 nt, Human
cuucuuaacuguauauacuaug

SEQ ID NO: 1070084 - RNA, 18 nt, Human
ucagacaaguuagacagg

SEQ ID NO: 1070085 - RNA, 22 nt, Human
cugcugugggcaggguagcugg

SEQ ID NO: 1070086 - RNA, 22 nt, Human
agaugcugcuccacaggccagg

SEQ ID NO: 1070087 - RNA, 22 nt, Human
auuuguaagcuagagccaugau

SEQ ID NO: 1070088 - RNA, 22 nt, Human
aauguuugaacuuugcauauuu

SEQ ID NO: 1070089 - RNA, 23 nt, Human
uuguuuuuagagguggcaugaga

SEQ ID NO: 1070090 - RNA, 22 nt, Human
ugcagcugauuaaagggcagac

SEQ ID NO: 1070091 - RNA, 22 nt, Human
ucccagcagucagagcuaugug

SEQ ID NO: 1070092 - RNA, 22 nt, Human
gccugccugaaggcuguaccag

SEQ ID NO: 1070093 - RNA, 22 nt, Human
uggcucagcuuuccccaucugg

SEQ ID NO: 1070094 - RNA, 17 nt, Human
ucacaucacacaagcaa

SEQ ID NO: 1070095 - RNA, 22 nt, Human
gucccagaggcuuuggccacag

SEQ ID NO: 1070096 - RNA, 22 nt, Human
aaccaggagauuaaagaaaggu

SEQ ID NO: 1070097 - RNA, 22 nt, Human
aaacuuuuuuagguucauaggc

SEQ ID NO: 1070098 - RNA, 22 nt, Human
ggccagagaagucagacccuug

SEQ ID NO: 1070099 - RNA, 22 nt, Human
ccagagcugauuccugggacuu

SEQ ID NO: 1070100 - RNA, 22 nt, Human
ccucagagaaagguauggcuga

SEQ ID NO: 1070101 - RNA, 22 nt, Human
aggaagugaaagggaaggaguu

SEQ ID NO: 1070102 - RNA, 22 nt, Human
acucugccuuucagcagaugaa

SEQ ID NO: 1070103 - RNA, 19 nt, Human
ucucuucucccugguuuua

SEQ ID NO: 1070104 - RNA, 22 nt, Human
aaacaucugacuugcuuuuuca

SEQ ID NO: 1070105 - RNA, 22 nt, Human
auauuuaaacaggguaccaaua

SEQ ID NO: 1070106 - RNA, 22 nt, Human
gcugaggccccagggugauggg

SEQ ID NO: 1070107 - RNA, 22 nt, Human
agcaggaaggucugugugaguc

SEQ ID NO: 1070108 - RNA, 22 nt, Human
gaagaacaccugcugcccagug

SEQ ID NO: 1070109 - RNA, 22 nt, Human
accuuuuuucagaacucuaaag

SEQ ID NO: 1070110 - RNA, 18 nt, Human
uggcucugcagccagaug

SEQ ID NO: 1070111 - RNA, 22 nt, Human
gccagcagguugucaaggagcu

SEQ ID NO: 1070112 - RNA, 22 nt, Human
gucaggaugagggaugaggagu

SEQ ID NO: 1070113 - RNA, 22 nt, Human
caggcacagaguuauucauuua

SEQ ID NO: 1070114 - RNA, 22 nt, Human
aucagaauguuuuggugugcuc

SEQ ID NO: 1070115 - RNA, 22 nt, Human
gccugagcccaggugugcagag

SEQ ID NO: 1070116 - RNA, 22 nt, Human
ugguccugaggcuuguuuccac

SEQ ID NO: 1070117 - RNA, 22 nt, Human
cccuccugugccugaggccagc

SEQ ID NO: 1070118 - RNA, 22 nt, Human
aaggugaacugguaaugacaga

SEQ ID NO: 1070119 - RNA, 22 nt, Human
caggagacuauggcccaaggcc

SEQ ID NO: 1070120 - RNA, 22 nt, Human
guuuuccuacuguaucaucaaa

SEQ ID NO: 1070121 - RNA, 22 nt, Human
agagcaggcauaaagcuuugaa

SEQ ID NO: 1070122 - RNA, 22 nt, Human
ucuucauguugcuuauucuggg

SEQ ID NO: 1070123 - RNA, 22 nt, Human
uaucaaaguuguccugugaagu

SEQ ID NO: 1070124 - RNA, 22 nt, Human
aaguuacauuuuggucuaauug

SEQ ID NO: 1070125 - RNA, 22 nt, Human
cagcagagcuuauguuggguca

SEQ ID NO: 1070126 - RNA, 22 nt, Human
uucugggccuccuaggacaggc

SEQ ID NO: 1070127 - RNA, 22 nt, Human
aguguggguuuuauggagcccu

SEQ ID NO: 1070128 - RNA, 22 nt, Human
gcugcuuuagguugagcucagc

SEQ ID NO: 1070129 - RNA, 22 nt, Human
cucagaaaaccucuuucuugau

SEQ ID NO: 1070130 - RNA, 22 nt, Human
agucuugcauuuucugaagaug

SEQ ID NO: 1070131 - RNA, 22 nt, Human
uuuuucuagcucaaagauucua

SEQ ID NO: 1070132 - RNA, 22 nt, Human
auaaggacuugaauuagacauu

SEQ ID NO: 1070133 - RNA, 22 nt, Human
aaguggagucccuacaaccagc

SEQ ID NO: 1070134 - RNA, 22 nt, Human
aauuuggcagugucuugaagua

SEQ ID NO: 1070135 - RNA, 22 nt, Human
uacacagaggcagcugucugcu

SEQ ID NO: 1070136 - RNA, 22 nt, Human
gcuggcaguaaaggguuuggca

SEQ ID NO: 1070137 - RNA, 22 nt, Human
gagaaucuacaggaaaccgaag

SEQ ID NO: 1070138 - RNA, 22 nt, Human
gagauggcuugcucucacgugg

SEQ ID NO: 1070139 - RNA, 23 nt, Human
agguucaggagauggaggaacaa

SEQ ID NO: 1070140 - RNA, 22 nt, Human
ggaguauaucguguaucauaug

SEQ ID NO: 1070141 - RNA, 22 nt, Human
cacugcuuucacaguuuguucc

SEQ ID NO: 1070142 - RNA, 22 nt, Human
uuugaaacucaugaucaucacu

SEQ ID NO: 1070143 - RNA, 22 nt, Human
gaucaacaacuuuugaauagcu

SEQ ID NO: 1070144 - RNA, 22 nt, Human
ucuucauguauacucaugguac

SEQ ID NO: 1070145 - RNA, 22 nt, Human
acaagauuuggcugaaacucca

SEQ ID NO: 1070146 - RNA, 22 nt, Human
ugagcccagagcccuuguaggg

SEQ ID NO: 1070147 - RNA, 22 nt, Human
ccuucaaauuuagaacaaguga

SEQ ID NO: 1070148 - RNA, 22 nt, Human
gcugucugcaagccaggaaaug

SEQ ID NO: 1070149 - RNA, 22 nt, Human
gcugcugggggaacaguuaaaa

SEQ ID NO: 1070150 - RNA, 22 nt, Human
gugccugcagcaauccauggca

SEQ ID NO: 1070151 - RNA, 22 nt, Human
uucaaugagcccggggccauag

SEQ ID NO: 1070152 - RNA, 22 nt, Human
gagcaggcucugccuguguguc

SEQ ID NO: 1070153 - RNA, 22 nt, Human
aaacauuuuucuucaucauccu

SEQ ID NO: 1070154 - RNA, 22 nt, Human
aggaccuguagggccugcaucc

SEQ ID NO: 1070155 - RNA, 22 nt, Human
uggcagggugggcuucagcccc

SEQ ID NO: 1070156 - RNA, 22 nt, Human
agggagaagguccaugccuguc

SEQ ID NO: 1070157 - RNA, 22 nt, Human
ugacauuuuuauaagagucaaa

SEQ ID NO: 1070158 - RNA, 22 nt, Human
ucccugugaaucagaagcaggu

SEQ ID NO: 1070159 - RNA, 22 nt, Human
uaaauaagucacugaccauuua

SEQ ID NO: 1070160 - RNA, 20 nt, Human
uguuccaugacuauuuggau

SEQ ID NO: 1070161 - RNA, 21 nt, Human
auggagccuaagaguggaggu

SEQ ID NO: 1070162 - RNA, 22 nt, Human
uguguucauuagcauugccuug

SEQ ID NO: 1070163 - RNA, 22 nt, Human
acaggugauucaggcucuggga

SEQ ID NO: 1070164 - RNA, 22 nt, Human
uuuuagauugggaaauguaaag

SEQ ID NO: 1070165 - RNA, 22 nt, Human
ugucagaacucuauugaugucc

SEQ ID NO: 1070166 - RNA, 22 nt, Human
uccacaagaugauaaagagagg

SEQ ID NO: 1070167 - RNA, 22 nt, Human
ucacauuuguucuugaaucuaa

SEQ ID NO: 1070168 - RNA, 22 nt, Human
aauacuuuccuauauaaggugc

SEQ ID NO: 1070169 - RNA, 22 nt, Human
uuucacaggccuuuuguagccc

SEQ ID NO: 1070170 - RNA, 22 nt, Human
ugggcucaaucugcuucuguuu

SEQ ID NO: 1070171 - RNA, 23 nt, Human
ucauuucagguugcaugguacca

SEQ ID NO: 1070172 - RNA, 22 nt, Human
uguauacaggcauaagagauac

SEQ ID NO: 1070173 - RNA, 22 nt, Human
aggcugagucaaguuaggguga

SEQ ID NO: 1070174 - RNA, 22 nt, Human
agcacucuucugugauaguugu

SEQ ID NO: 1070175 - RNA, 22 nt, Human
gcugggcccugggugcccuagc

SEQ ID NO: 1070176 - RNA, 20 nt, Human
agaaauauugaguucagagg

SEQ ID NO: 1070177 - RNA, 22 nt, Human
caaaggcaugugaguauaugug

SEQ ID NO: 1070178 - RNA, 22 nt, Human
augaaggcuguguggagccccc

SEQ ID NO: 1070179 - RNA, 22 nt, Human
uacacauacaccaaugugguca

SEQ ID NO: 1070180 - RNA, 22 nt, Human
ggcucuguuuacuuucagaggc

SEQ ID NO: 1070181 - RNA, 22 nt, Human
uggggccagagauggggcgcag

SEQ ID NO: 1070182 - RNA, 22 nt, Human
ucagggaacuacuucucccuau

SEQ ID NO: 1070183 - RNA, 19 nt, Human
aagagcagggaaagaauug

SEQ ID NO: 1070184 - RNA, 22 nt, Human
guggccuggaaaggcuggucug

SEQ ID NO: 1070185 - RNA, 22 nt, Human
aggcacugacucaagggagcca

SEQ ID NO: 1070186 - RNA, 22 nt, Human
uuucaguguaagguuuccagga

SEQ ID NO: 1070187 - RNA, 20 nt, Human
gcaaauggaucccacaagcc

SEQ ID NO: 1070188 - RNA, 22 nt, Human
cagauggcacagauuuagagug

SEQ ID NO: 1070189 - RNA, 22 nt, Human
caugcuguacucugugucagaa

SEQ ID NO: 1070190 - RNA, 22 nt, Human
ccucacagggccaggccccuca

SEQ ID NO: 1070191 - RNA, 22 nt, Human
auugacaagugagcugggcugc

SEQ ID NO: 1070192 - RNA, 21 nt, Human
agccugggaggcggagguugc

SEQ ID NO: 1070193 - RNA, 22 nt, Human
cuucucagcauuuugucagucu

SEQ ID NO: 1070194 - RNA, 22 nt, Human
agcucagcccuccugugcagcu

SEQ ID NO: 1070195 - RNA, 22 nt, Human
gggcugagagugacuguucugu

SEQ ID NO: 1070196 - RNA, 22 nt, Human
cacagguguaugaauaugucca

SEQ ID NO: 1070197 - RNA, 22 nt, Human
gcaggcugauagaggauuccau

SEQ ID NO: 1070198 - RNA, 22 nt, Human
auucauuuagguauucacuuac

SEQ ID NO: 1070199 - RNA, 22 nt, Human
ugcugucuucucugaggucccu

SEQ ID NO: 1070200 - RNA, 22 nt, Human
ggcagguggauuuucuacucua

SEQ ID NO: 1070201 - RNA, 22 nt, Human
ucuugcacuucaugaauauguu

SEQ ID NO: 1070202 - RNA, 22 nt, Human
cauugacaucaggcuuggccaa

SEQ ID NO: 1070203 - RNA, 22 nt, Human
ggcaggguggcccuccagugag

SEQ ID NO: 1070204 - RNA, 22 nt, Human
agagcagguggcaacucuggga

SEQ ID NO: 1070205 - RNA, 22 nt, Human
acuugcugguggcauuuacagu

SEQ ID NO: 1070206 - RNA, 22 nt, Human
gcaggcagguggcaucuuguga

SEQ ID NO: 1070207 - RNA, 22 nt, Human
caaagucagggaagaguggcug

SEQ ID NO: 1070208 - RNA, 22 nt, Human
acaaggcuguggggagaacuga

SEQ ID NO: 1070209 - RNA, 22 nt, Human
gccugccuguuggcugaggugc

SEQ ID NO: 1070210 - RNA, 21 nt, Human
uggagacucugguucuuugug

SEQ ID NO: 1070211 - RNA, 22 nt, Human
uuuaaugauagucuuacgaaaa

SEQ ID NO: 1070212 - RNA, 22 nt, Human
aucuuuuuugucuuggucacug

SEQ ID NO: 1070213 - RNA, 22 nt, Human
gaguccuucuggcuggcaggau

SEQ ID NO: 1070214 - RNA, 22 nt, Human
cucucuggaagggggagcugau

SEQ ID NO: 1070215 - RNA, 22 nt, Human
gcuuucuucauacucaagcauc

SEQ ID NO: 1070216 - RNA, 19 nt, Human
uagaaagaugauggguggg

SEQ ID NO: 1070217 - RNA, 22 nt, Human
uggagcuggaagaauguagacg

SEQ ID NO: 1070218 - RNA, 22 nt, Human
gggcuagaaauucugcagugga

SEQ ID NO: 1070219 - RNA, 22 nt, Human
uagcagagugauuggccaugag

SEQ ID NO: 1070220 - RNA, 22 nt, Human
ccugugcucccauagcuucugu

SEQ ID NO: 1070221 - RNA, 22 nt, Human
uccguauuugacuauugcaccg

SEQ ID NO: 1070222 - RNA, 22 nt, Human
guggggugggcugaguuaggcc

SEQ ID NO: 1070223 - RNA, 22 nt, Human
ugucagugguaagguugggagu

SEQ ID NO: 1070224 - RNA, 23 nt, Human
ugaauuuuggcauauucugaaau

SEQ ID NO: 1070225 - RNA, 23 nt, Human
cugagcaaagggggaagcugcuu

SEQ ID NO: 1070226 - RNA, 22 nt, Human
cuggaaggucuguccccacugc

SEQ ID NO: 1070227 - RNA, 21 nt, Human
ccccagcaccuugccagccug

SEQ ID NO: 1070228 - RNA, 22 nt, Human
uguggccuccuguuccugggua

SEQ ID NO: 1070229 - RNA, 22 nt, Human
ucaguauuucuaaacauuggcu

SEQ ID NO: 1070230 - RNA, 21 nt, Human
ucagagucucaggagcaaggg

SEQ ID NO: 1070231 - RNA, 20 nt, Human
cagagcuguuauggaugaug

SEQ ID NO: 1070232 - RNA, 22 nt, Human
uucaacagcuuccaaagugugu

SEQ ID NO: 1070233 - RNA, 22 nt, Human
ugaggggagaagcagcagccug

SEQ ID NO: 1070234 - RNA, 22 nt, Human
ccaggaggcagaaguugcagug

SEQ ID NO: 1070235 - RNA, 22 nt, Human
gugcugcucacaucuggaggua

SEQ ID NO: 1070236 - RNA, 22 nt, Human
gcuucauuacugacagucugug

SEQ ID NO: 1070237 - RNA, 22 nt, Human
ccuuucucuggcagcaggacag

SEQ ID NO: 1070238 - RNA, 22 nt, Human
ggcccugugguuuugcaaaguc

SEQ ID NO: 1070239 - RNA, 22 nt, Human
acucaugauaugccuauaagau

SEQ ID NO: 1070240 - RNA, 22 nt, Human
caagauauauguaugauuccau

SEQ ID NO: 1070241 - RNA, 22 nt, Human
ugggccugaguuugggaacugg

SEQ ID NO: 1070242 - RNA, 22 nt, Human
acugccauuggucaaaugagug

SEQ ID NO: 1070243 - RNA, 23 nt, Human
agggcugaugccauugcagcucu

SEQ ID NO: 1070244 - RNA, 22 nt, Human
agcuaggaaauugaggcugaga

SEQ ID NO: 1070245 - RNA, 22 nt, Human
ggugagaggcagugcuguggaa

SEQ ID NO: 1070246 - RNA, 22 nt, Human
acaaucuuauuaguaguauaga

SEQ ID NO: 1070247 - RNA, 22 nt, Human
cauucacucagcgaugccagua

SEQ ID NO: 1070248 - RNA, 22 nt, Human
uuccuuaauaucccuuuuggaa

SEQ ID NO: 1070249 - RNA, 22 nt, Human
ucagaacaauugggaaccauua

SEQ ID NO: 1070250 - RNA, 22 nt, Human
uacauguucaaauuugucuuuc

SEQ ID NO: 1070251 - RNA, 22 nt, Human
agagugggugaucucuguuguc

SEQ ID NO: 1070252 - RNA, 22 nt, Human
ucccagaggucucugcugguuc

SEQ ID NO: 1070253 - RNA, 22 nt, Human
uacagaaaaacuggcauugaag

SEQ ID NO: 1070254 - RNA, 22 nt, Human
uauuuguugcgggaauugcuau

SEQ ID NO: 1070255 - RNA, 22 nt, Human
gagcugggacauggguccucuc

SEQ ID NO: 1070256 - RNA, 22 nt, Human
cauguguagugaaauaagcagu

SEQ ID NO: 1070257 - RNA, 22 nt, Human
uuacugaucccccaggugaccc

SEQ ID NO: 1070258 - RNA, 22 nt, Human
ucacaguauagaguuauuuugg

SEQ ID NO: 1070259 - RNA, 22 nt, Human
aagaaaagaaaccugaggcuuu

SEQ ID NO: 1070260 - RNA, 22 nt, Human
ugaggggcggccugcagaggcc

SEQ ID NO: 1070261 - RNA, 22 nt, Human
uggaaagggacuuaugaguucc

SEQ ID NO: 1070262 - RNA, 22 nt, Human
ggguggggcccaggaaaucuau

SEQ ID NO: 1070263 - RNA, 22 nt, Human
auguuacagaaagcaaagauga

SEQ ID NO: 1070264 - RNA, 22 nt, Human
gaggccacccuaugggucccag

SEQ ID NO: 1070265 - RNA, 22 nt, Human
uucuuagaagaaacaucuaaaa

SEQ ID NO: 1070266 - RNA, 22 nt, Human
uguucuuaacuuuuguguauau

SEQ ID NO: 1070267 - RNA, 22 nt, Human
gcauuuuaaugagguuuaugag

SEQ ID NO: 1070268 - RNA, 22 nt, Human
agcaauauuuaaagguuugcaa

SEQ ID NO: 1070269 - RNA, 22 nt, Human
cgcuggccauagccuccugugu

SEQ ID NO: 1070270 - RNA, 22 nt, Human
uugguuccuucugaaaguauug

SEQ ID NO: 1070271 - RNA, 22 nt, Human
guggccuggcgagcuggcgcgg

SEQ ID NO: 1070272 - RNA, 22 nt, Human
uuucauuuugguuaugccauaa

SEQ ID NO: 1070273 - RNA, 22 nt, Human
uuggcagugucugcaaaaugga

SEQ ID NO: 1070274 - RNA, 21 nt, Human
ggcccugguuacgccuccucu

SEQ ID NO: 1070275 - RNA, 22 nt, Human
gggcaggugcccagggccagag

SEQ ID NO: 1070276 - RNA, 22 nt, Human
uuuguacacaggucauucaggg

SEQ ID NO: 1070277 - RNA, 22 nt, Human
uccaggcuggaaaugucaaacu

SEQ ID NO: 1070278 - RNA, 22 nt, Human
uggcucugugcuucuaguaucu

SEQ ID NO: 1070279 - RNA, 22 nt, Human
augagcugugggauuccagagg

SEQ ID NO: 1070280 - RNA, 17 nt, Human
aggugcagaggcagagc

SEQ ID NO: 1070281 - RNA, 22 nt, Human
aggccucuucagggagcaugga

SEQ ID NO: 1070282 - RNA, 22 nt, Human
ugugaaauucuugaaaugcaca

SEQ ID NO: 1070283 - RNA, 21 nt, Human
gguugguguguccaguggcca

SEQ ID NO: 1070284 - RNA, 22 nt, Human
uagauuuuacuucugucauuac

SEQ ID NO: 1070285 - RNA, 22 nt, Human
uucuugcucaaugucuguuuaa

SEQ ID NO: 1070286 - RNA, 22 nt, Human
cagggccugcuuccuucuuguu

SEQ ID NO: 1070287 - RNA, 22 nt, Human
ugguaccagcuguguguucacu

SEQ ID NO: 1070288 - RNA, 22 nt, Human
gucccagaggacagggucacau

SEQ ID NO: 1070289 - RNA, 22 nt, Human
uaagcacuuuauaugcuuuauc

SEQ ID NO: 1070290 - RNA, 22 nt, Human
guucuuaagaccacaauaaaaa

SEQ ID NO: 1070291 - RNA, 22 nt, Human
cuucccuuucuggugacuucuc

SEQ ID NO: 1070292 - RNA, 21 nt, Human
ggcagcacuaccugaagcaua

SEQ ID NO: 1070293 - RNA, 22 nt, Human
agucucuuauucccuauugcug

SEQ ID NO: 1070294 - RNA, 20 nt, Human
gagggugggacuuccuaggc

SEQ ID NO: 1070295 - RNA, 22 nt, Human
ccuuuucuacaagcaaaugugc

SEQ ID NO: 1070296 - RNA, 22 nt, Human
uggcuucauuauuguuuuuccu

SEQ ID NO: 1070297 - RNA, 22 nt, Human
aacaaccaaaaagaugaaugua

SEQ ID NO: 1070298 - RNA, 22 nt, Human
uaucauaaguuaauuaaacagu

SEQ ID NO: 1070299 - RNA, 22 nt, Human
ucaggcagagggagaagccaag

SEQ ID NO: 1070300 - RNA, 20 nt, Human
uuuauucacagagaagaguu

SEQ ID NO: 1070301 - RNA, 18 nt, Human
uaggcugggggcuguagu

SEQ ID NO: 1070302 - RNA, 22 nt, Human
caaaguuuaaaguagauuucag

SEQ ID NO: 1070303 - RNA, 22 nt, Human
agcaaggaguagaacaagagug

SEQ ID NO: 1070304 - RNA, 18 nt, Human
cccucuccugcuaguggg

SEQ ID NO: 1070305 - RNA, 22 nt, Human
uguaaaaccaaaucaaucuagu

SEQ ID NO: 1070306 - RNA, 22 nt, Human
agcaaaauaagguaauuuauug

SEQ ID NO: 1070307 - RNA, 22 nt, Human
cagaaacugcuuguggucaucu

SEQ ID NO: 1070308 - RNA, 22 nt, Human
ugcugagaggaaagaaugcaca

SEQ ID NO: 1070309 - RNA, 22 nt, Human
agcagcucaacagugucucuau

SEQ ID NO: 1070310 - RNA, 22 nt, Human
agcagcucugagaggccagcac

SEQ ID NO: 1070311 - RNA, 22 nt, Human
agcaagaaaucuucaguguucu

SEQ ID NO: 1070312 - RNA, 22 nt, Human
aagcaaggccggaaggaaacuc

SEQ ID NO: 1070313 - RNA, 22 nt, Human
ccagagcagggcagcagggcuc

SEQ ID NO: 1070314 - RNA, 22 nt, Human
ucaaaacaaucauuggaugugc

SEQ ID NO: 1070315 - RNA, 22 nt, Human
gugcucugaguuugcaugucag

SEQ ID NO: 1070316 - RNA, 22 nt, Human
caguccuggggaccaggcugag

SEQ ID NO: 1070317 - RNA, 22 nt, Human
ugagcaggcucccacuucagug

SEQ ID NO: 1070318 - RNA, 22 nt, Human
uuacacagugaauuuacucaag

SEQ ID NO: 1070319 - RNA, 22 nt, Human
auccaggagucguggcgcucag

SEQ ID NO: 1070320 - RNA, 21 nt, Human
uuuauuuauauaggacacaug

SEQ ID NO: 1070321 - RNA, 22 nt, Human
ccuugcucaagcuagugacggg

SEQ ID NO: 1070322 - RNA, 22 nt, Human
agcuggguguguaucagauaaa

SEQ ID NO: 1070323 - RNA, 22 nt, Human
uacaaagugacaagcucugcug

SEQ ID NO: 1070324 - RNA, 22 nt, Human
ucucaggggcagugauccuaag

SEQ ID NO: 1070325 - RNA, 18 nt, Human
ccagauggccagucugcu

SEQ ID NO: 1070326 - RNA, 22 nt, Human
agugaaaucagguuuugacugc

SEQ ID NO: 1070327 - RNA, 22 nt, Human
auugugcaauguuuuacaauuu

SEQ ID NO: 1070328 - RNA, 20 nt, Human
aggcucagcugagcucuugg

SEQ ID NO: 1070329 - RNA, 22 nt, Human
gcuucucccuacagaugucagu

SEQ ID NO: 1070330 - RNA, 22 nt, Human
ucuacuguagugaugcugcagu

SEQ ID NO: 1070331 - RNA, 22 nt, Human
ggggugggguuacucauugugc

SEQ ID NO: 1070332 - RNA, 22 nt, Human
uccaggccaggguaagaggaga

SEQ ID NO: 1070333 - RNA, 22 nt, Human
uugauacacaauggaacaaugu

SEQ ID NO: 1070334 - RNA, 22 nt, Human
gccaauggcucaugagcaggac

SEQ ID NO: 1070335 - RNA, 22 nt, Human
uguguccucauguggcagagag

SEQ ID NO: 1070336 - RNA, 22 nt, Human
aggaggcugguucaggccauau

SEQ ID NO: 1070337 - RNA, 22 nt, Human
auugaaagcacaaagaacaagu

SEQ ID NO: 1070338 - RNA, 22 nt, Human
caguguguggauugcccuugca

SEQ ID NO: 1070339 - RNA, 22 nt, Human
ggaggccaggguggguggaucg

SEQ ID NO: 1070340 - RNA, 22 nt, Human
cacacacugacaccuuaucuug

SEQ ID NO: 1070341 - RNA, 22 nt, Human
uguuccuaaauaugaauggaga

SEQ ID NO: 1070342 - RNA, 22 nt, Human
uaggaagaugaguaucaacuug

SEQ ID NO: 1070343 - RNA, 22 nt, Human
ggccuggaagaggacagagaaa

SEQ ID NO: 1070344 - RNA, 22 nt, Human
agcagcuggggccugugacgau

SEQ ID NO: 1070345 - RNA, 23 nt, Human
cugcagucgccggccugggugcc

SEQ ID NO: 1070346 - RNA, 22 nt, Human
cuauuuucugucucuauagagu

SEQ ID NO: 1070347 - RNA, 22 nt, Human
aggcagcagagguugaggaaag

SEQ ID NO: 1070348 - RNA, 22 nt, Human
augggcugcuucuccagcaccu

SEQ ID NO: 1070349 - RNA, 22 nt, Human
cuguccuaugaguacucacuag

SEQ ID NO: 1070350 - RNA, 22 nt, Human
uggcugagggcacuaugaagcc

SEQ ID NO: 1070351 - RNA, 22 nt, Human
cugggagcccgcguccuggugg

SEQ ID NO: 1070352 - RNA, 22 nt, Human
ggcugccuacuuucccagaguu

SEQ ID NO: 1070353 - RNA, 22 nt, Human
gacauuuaaggcagucacuuaa

SEQ ID NO: 1070354 - RNA, 22 nt, Human
gaggaacagagggcaaggccag

SEQ ID NO: 1070355 - RNA, 22 nt, Human
ucaggaagaagacggggcagga

SEQ ID NO: 1070356 - RNA, 22 nt, Human
caggguggggaaauagcgcccu

SEQ ID NO: 1070357 - RNA, 23 nt, Human
agcagcugugguuuaccuuagua

SEQ ID NO: 1070358 - RNA, 22 nt, Human
ggaagaggcucucauugagggc

SEQ ID NO: 1070359 - RNA, 22 nt, Human
auugaaauugaugaaauucuug

SEQ ID NO: 1070360 - RNA, 22 nt, Human
aggcaggcugcuauggaguaga

SEQ ID NO: 1070361 - RNA, 22 nt, Human
acagcagagccugguacuuacu

SEQ ID NO: 1070362 - RNA, 22 nt, Human
gugccugccccacuccucagca

SEQ ID NO: 1070363 - RNA, 21 nt, Human
uuguaaagguuuagaagaaug

SEQ ID NO: 1070364 - RNA, 22 nt, Human
gaugcaggauagcuucacccag

SEQ ID NO: 1070365 - RNA, 23 nt, Human
aaacaugcagcacaugaaugcua

SEQ ID NO: 1070366 - RNA, 22 nt, Human
cgggcagauugggaagguucau

SEQ ID NO: 1070367 - RNA, 22 nt, Human
ggcucagguugggucacaugac

SEQ ID NO: 1070368 - RNA, 23 nt, Human
gcugacugugaaauucuggagcu

SEQ ID NO: 1070369 - RNA, 22 nt, Human
gugggcuguuguucccuguucu

SEQ ID NO: 1070370 - RNA, 22 nt, Human
auuauucagucuuguaaggagu

SEQ ID NO: 1070371 - RNA, 22 nt, Human
ccuuucucauuuuaagcauuag

SEQ ID NO: 1070372 - RNA, 22 nt, Human
ugcuucugaaguggaugggugc

SEQ ID NO: 1070373 - RNA, 22 nt, Human
uuuuucaucugauugauaacuc

SEQ ID NO: 1070374 - RNA, 22 nt, Human
ucauuucuccgaccugcugucc

SEQ ID NO: 1070375 - RNA, 21 nt, Human
acagcagagaucaagacuaag

SEQ ID NO: 1070376 - RNA, 22 nt, Human
gccaggaaauucaugccagauc

SEQ ID NO: 1070377 - RNA, 22 nt, Human
caggccucuccuuagucuggca

SEQ ID NO: 1070378 - RNA, 22 nt, Human
ucuaaacacuaagucuugaugc

SEQ ID NO: 1070379 - RNA, 22 nt, Human
aggcagagagcaguggccgucu

SEQ ID NO: 1070380 - RNA, 22 nt, Human
caggcucccacaagcucccagc

SEQ ID NO: 1070381 - RNA, 22 nt, Human
uccugccucacaguugaaguuu

SEQ ID NO: 1070382 - RNA, 22 nt, Human
agcagccaagguaaccugugcu

SEQ ID NO: 1070383 - RNA, 20 nt, Human
aauuuuaucuccauccuuug

SEQ ID NO: 1070384 - RNA, 22 nt, Human
cagaguucaaagccugcuggga

SEQ ID NO: 1070385 - RNA, 22 nt, Human
ccagggcugcugugggacucca

SEQ ID NO: 1070386 - RNA, 22 nt, Human
guuuuuccugcugacuuggguc

SEQ ID NO: 1070387 - RNA, 22 nt, Human
cucaggauguacuacagaaggc

SEQ ID NO: 1070388 - RNA, 22 nt, Human
uggggucugaguaucugcauuu

SEQ ID NO: 1070389 - RNA, 22 nt, Human
cauggccuugagugacugcacu

SEQ ID NO: 1070390 - RNA, 21 nt, Human
ggguccugggaugggauccag

SEQ ID NO: 1070391 - RNA, 21 nt, Human
gugucaugguugacuuuggca

SEQ ID NO: 1070392 - RNA, 22 nt, Human
uauuguaucuuaccacauguau

SEQ ID NO: 1070393 - RNA, 21 nt, Human
aggaggaacccguggcugggc

SEQ ID NO: 1070394 - RNA, 22 nt, Human
gcccaggaagugacucagaugu

SEQ ID NO: 1070395 - RNA, 22 nt, Human
uaauugaaaucauuucaauuca

SEQ ID NO: 1070396 - RNA, 22 nt, Human
uccaauauucauuaaaaugcag

SEQ ID NO: 1070397 - RNA, 22 nt, Human
aaucuuaagcugaauucucucc

SEQ ID NO: 1070398 - RNA, 22 nt, Human
ucagaacauugacauucuuauu

SEQ ID NO: 1070399 - RNA, 22 nt, Human
ccuuuucugaaccacuuaaaua

SEQ ID NO: 1070400 - RNA, 22 nt, Human
caggcugccgugaagcaggccu

SEQ ID NO: 1070401 - RNA, 22 nt, Human
acacagggaggaggugcugugc

SEQ ID NO: 1070402 - RNA, 22 nt, Human
cagcuuuuaggacugugagaaa

SEQ ID NO: 1070403 - RNA, 22 nt, Human
ggcccagccucagacaugcccu

SEQ ID NO: 1070404 - RNA, 21 nt, Human
cucuuuguggcaauguauuuu

SEQ ID NO: 1070405 - RNA, 20 nt, Human
cagcagagacccauggggag

SEQ ID NO: 1070406 - RNA, 20 nt, Human
aaaauauguauaacucuucu

SEQ ID NO: 1070407 - RNA, 22 nt, Human
cagggccagagagggcuggcug

SEQ ID NO: 1070408 - RNA, 22 nt, Human
agccaguguuaagugacugguu

SEQ ID NO: 1070409 - RNA, 22 nt, Human
uaacagcaguccucuucucaug

SEQ ID NO: 1070410 - RNA, 22 nt, Human
gagcuggugugugcccgagcac

SEQ ID NO: 1070411 - RNA, 22 nt, Human
ggguccagaguugaagagguua

SEQ ID NO: 1070412 - RNA, 22 nt, Human
ggaggaagcacacggcuuguau

SEQ ID NO: 1070413 - RNA, 22 nt, Human
cucccuccucaaauaucuuugu

SEQ ID NO: 1070414 - RNA, 22 nt, Human
auaugggggggcgugcagagga

SEQ ID NO: 1070415 - RNA, 22 nt, Human
ccaggagcaggagcuggacaga

SEQ ID NO: 1070416 - RNA, 18 nt, Human
caagagcugcuccuggcc

SEQ ID NO: 1070417 - RNA, 22 nt, Human
cagaacagacuuaacagggcug

SEQ ID NO: 1070418 - RNA, 22 nt, Human
ccagagcuccagggcuacagaa

SEQ ID NO: 1070419 - RNA, 22 nt, Human
cccaggaagguggucuguggcu

SEQ ID NO: 1070420 - RNA, 22 nt, Human
gcucugagucucagcuaccaca

SEQ ID NO: 1070421 - RNA, 22 nt, Human
uauucaugucggcugaaaaagc

SEQ ID NO: 1070422 - RNA, 22 nt, Human
uccugccuguuuaccuguacuu

SEQ ID NO: 1070423 - RNA, 19 nt, Human
ggcuggaguggccaucugu

SEQ ID NO: 1070424 - RNA, 22 nt, Human
ugaugaaauguugaggcaguga

SEQ ID NO: 1070425 - RNA, 22 nt, Human
ccauaagguuuggggccaugca

SEQ ID NO: 1070426 - RNA, 22 nt, Human
cugaggaggggccugagugaga

SEQ ID NO: 1070427 - RNA, 18 nt, Human
aggcaggcuggagugacu

SEQ ID NO: 1070428 - RNA, 22 nt, Human
cccagaguauuugugauguuag

SEQ ID NO: 1070429 - RNA, 22 nt, Human
ugcccagcacugugccagucac

SEQ ID NO: 1070430 - RNA, 22 nt, Human
uuuaaauguguucuuaguagcu

SEQ ID NO: 1070431 - RNA, 22 nt, Human
auuuauuaagcaucugcuaugu

SEQ ID NO: 1070432 - RNA, 22 nt, Human
ugagaaagccuuuagucccagg

SEQ ID NO: 1070433 - RNA, 22 nt, Human
aguaugaauugcuuugccugua

SEQ ID NO: 1070434 - RNA, 22 nt, Human
agucaccaucuguggcagccug

SEQ ID NO: 1070435 - RNA, 22 nt, Human
ucagagcucaugagcagagcca

SEQ ID NO: 1070436 - RNA, 22 nt, Human
acaagagauuaucuacagauga

SEQ ID NO: 1070437 - RNA, 22 nt, Human
agagggcauuaacucugucuug

SEQ ID NO: 1070438 - RNA, 22 nt, Human
acugucugcaaaacucauacuc

SEQ ID NO: 1070439 - RNA, 22 nt, Human
ucagcugcucaaauuuauguca

SEQ ID NO: 1070440 - RNA, 22 nt, Human
aagugccugaccuagccuggag

SEQ ID NO: 1070441 - RNA, 22 nt, Human
uugcaggacaaugauggucccu

SEQ ID NO: 1070442 - RNA, 22 nt, Human
acagagcaauucuuggguguuu

SEQ ID NO: 1070443 - RNA, 22 nt, Human
uaguacuuaucucugucauugu

SEQ ID NO: 1070444 - RNA, 22 nt, Human
aguacauuuaguuuaugaacau

SEQ ID NO: 1070445 - RNA, 22 nt, Human
ugaaagcacaaguucuaacagg

SEQ ID NO: 1070446 - RNA, 22 nt, Human
acagugauugggguaucugcag

SEQ ID NO: 1070447 - RNA, 17 nt, Human
ugcauguccuuuguucc

SEQ ID NO: 1070448 - RNA, 22 nt, Human
ccaggcugaauauguuccaggg

SEQ ID NO: 1070449 - RNA, 22 nt, Human
cagaguggagauguguguggaa

SEQ ID NO: 1070450 - RNA, 22 nt, Human
uguaaaaggaaaucaaagcacu

SEQ ID NO: 1070451 - RNA, 22 nt, Human
auugugaauaaugcugcaauaa

SEQ ID NO: 1070452 - RNA, 22 nt, Human
agggugcagaaggagccuagga

SEQ ID NO: 1070453 - RNA, 22 nt, Human
uagccuucucaagacaaaguug

SEQ ID NO: 1070454 - RNA, 22 nt, Human
uuggaauuugcuucagcuaaua

SEQ ID NO: 1070455 - RNA, 22 nt, Human
uucaaacagaugacucugcucu

SEQ ID NO: 1070456 - RNA, 22 nt, Human
gccugugcuguucccucugcca

SEQ ID NO: 1070457 - RNA, 21 nt, Human
aucccagcacccaggagugca

SEQ ID NO: 1070458 - RNA, 23 nt, Human
ggcacugaagcuacaauggugag

SEQ ID NO: 1070459 - RNA, 21 nt, Human
guacacacagguggaugggcu

SEQ ID NO: 1070460 - RNA, 22 nt, Human
ugcaaacuauugguagagaugg

SEQ ID NO: 1070461 - RNA, 22 nt, Human
gcuaucuuucugcaccauaauu

SEQ ID NO: 1070462 - RNA, 22 nt, Human
cacccagccuucacacaggagu

SEQ ID NO: 1070463 - RNA, 19 nt, Human
gaaggcugaaaugaagcac

SEQ ID NO: 1070464 - RNA, 22 nt, Human
cagcugccaugacauguccugc

SEQ ID NO: 1070465 - RNA, 19 nt, Human
cagaacagaggucauggcc

SEQ ID NO: 1070466 - RNA, 22 nt, Human
auaauauugagucaggaccuga

SEQ ID NO: 1070467 - RNA, 22 nt, Human
cccagaguuggucaggggaccc

SEQ ID NO: 1070468 - RNA, 20 nt, Human
gucuuuauguuuuaugaccu

SEQ ID NO: 1070469 - RNA, 22 nt, Human
uucuagaugauaaaccagcagc

SEQ ID NO: 1070470 - RNA, 22 nt, Human
cuuccaauagcaacaaagauua

SEQ ID NO: 1070471 - RNA, 22 nt, Human
ggugggaaggggccagugugcg

SEQ ID NO: 1070472 - RNA, 22 nt, Human
uucacacacagcuuccuauugu

SEQ ID NO: 1070473 - RNA, 16 nt, Human
gggcugggggauucug

SEQ ID NO: 1070474 - RNA, 22 nt, Human
cacaggggcaaacuguagggga

SEQ ID NO: 1070475 - RNA, 22 nt, Human
ggugaggggagagugaaagaaa

SEQ ID NO: 1070476 - RNA, 22 nt, Human
cugucauuuaagacauucugga

SEQ ID NO: 1070477 - RNA, 22 nt, Human
cucucugaggcaggccuguggg

SEQ ID NO: 1070478 - RNA, 22 nt, Human
auauuauucuaguaacagugau

SEQ ID NO: 1070479 - RNA, 22 nt, Human
ccagcagaagcucccgcugggu

SEQ ID NO: 1070480 - RNA, 22 nt, Human
aggggugauuugggacaggaca

SEQ ID NO: 1070481 - RNA, 22 nt, Human
ggcucaagcagucugccugccu

SEQ ID NO: 1070482 - RNA, 22 nt, Human
ugcagaaguauuccaggcccca

SEQ ID NO: 1070483 - RNA, 22 nt, Human
aauggcagaggcaaagauggua

SEQ ID NO: 1070484 - RNA, 22 nt, Human
uaacaauuugcuucauuuguuu

SEQ ID NO: 1070485 - RNA, 22 nt, Human
uauuauuaaauggcagaauuuu

SEQ ID NO: 1070486 - RNA, 22 nt, Human
uuaguuuucccaucuuuauggu

SEQ ID NO: 1070487 - RNA, 22 nt, Human
uaagaacaagauguuccuguuu

SEQ ID NO: 1070488 - RNA, 19 nt, Human
augauggucccauucaccu

SEQ ID NO: 1070489 - RNA, 22 nt, Human
ucauauuuaggccuuuaauuca

SEQ ID NO: 1070490 - RNA, 22 nt, Human
cagcccaggccgacaguuccuc

SEQ ID NO: 1070491 - RNA, 22 nt, Human
gcagaggagaugaagauacuuu

SEQ ID NO: 1070492 - RNA, 23 nt, Human
cccuggaguaaauucuuggaagg

SEQ ID NO: 1070493 - RNA, 22 nt, Human
cauggcagagccugcagguggg

SEQ ID NO: 1070494 - RNA, 22 nt, Human
cucaggaggccauucucaaggu

SEQ ID NO: 1070495 - RNA, 21 nt, Human
guggcucugccaggacugaaa

SEQ ID NO: 1070496 - RNA, 22 nt, Human
aagagccuggcugcuaggcuca

SEQ ID NO: 1070497 - RNA, 21 nt, Human
ucucuggaguuagcagagaga

SEQ ID NO: 1070498 - RNA, 22 nt, Human
cagggcucaucugugugaccag

SEQ ID NO: 1070499 - RNA, 22 nt, Human
agccccuuccaguucucagauc

SEQ ID NO: 1070500 - RNA, 16 nt, Human
gaaggagauucagaaa

SEQ ID NO: 1070501 - RNA, 21 nt, Human
agggagcuauuuauaguaagc

SEQ ID NO: 1070502 - RNA, 22 nt, Human
uuucacauaaauggaguaaaga

SEQ ID NO: 1070503 - RNA, 22 nt, Human
caaggccacuccagagacuggu

SEQ ID NO: 1070504 - RNA, 22 nt, Human
augaccagccgagauaaacaga

SEQ ID NO: 1070505 - RNA, 22 nt, Human
ugggcagacgcuguuggaaggc

SEQ ID NO: 1070506 - RNA, 22 nt, Human
gggagcuggagcuggaagacuc

SEQ ID NO: 1070507 - RNA, 22 nt, Human
caggucuuuucuacugguggag

SEQ ID NO: 1070508 - RNA, 22 nt, Human
gugcuuaaccuaguuucuagua

SEQ ID NO: 1070509 - RNA, 22 nt, Human
ggcuccuguggcaagacagcuu

SEQ ID NO: 1070510 - RNA, 22 nt, Human
augcugagacuggagcagcugg

SEQ ID NO: 1070511 - RNA, 22 nt, Human
uuagcucagaaaauuuaaacuu

SEQ ID NO: 1070512 - RNA, 22 nt, Human
aaauagaaaccaacaaggucag

SEQ ID NO: 1070513 - RNA, 22 nt, Human
acagauauaugauuguguaaau

SEQ ID NO: 1070514 - RNA, 22 nt, Human
gccccuggcuggccagcuccuc

SEQ ID NO: 1070515 - RNA, 22 nt, Human
cuucuuuaauguauacaaaaga

SEQ ID NO: 1070516 - RNA, 22 nt, Human
ucaggcucugccaccuagauua

SEQ ID NO: 1070517 - RNA, 22 nt, Human
ccugcuucagggaugauggcac

SEQ ID NO: 1070518 - RNA, 22 nt, Human
gcaggcugcugagauccuuagg

SEQ ID NO: 1070519 - RNA, 22 nt, Human
uagaaaauagggccuguggagc

SEQ ID NO: 1070520 - RNA, 22 nt, Human
aggagagaauguuccaggcuug

SEQ ID NO: 1070521 - RNA, 21 nt, Human
acucaggagacuaacuauguc

SEQ ID NO: 1070522 - RNA, 22 nt, Human
ugcucugggcaacagccucccu

SEQ ID NO: 1070523 - RNA, 22 nt, Human
uucucagagcacugcugacaaa

SEQ ID NO: 1070524 - RNA, 22 nt, Human
uuauuacuguauuaauccagag

SEQ ID NO: 1070525 - RNA, 22 nt, Human
caaacaucugcaccuugaccgg

SEQ ID NO: 1070526 - RNA, 22 nt, Human
ccaucaguuuuaucugacaaaa

SEQ ID NO: 1070527 - RNA, 22 nt, Human
uggcagcaaguucuugggaggu

SEQ ID NO: 1070528 - RNA, 22 nt, Human
auauacuuggagacuaucauug

SEQ ID NO: 1070529 - RNA, 22 nt, Human
agcacuuuagaauuuagaguug

SEQ ID NO: 1070530 - RNA, 22 nt, Human
uacacagaggcugaugucuuag

SEQ ID NO: 1070531 - RNA, 22 nt, Human
cugagccagggccacacaugga

SEQ ID NO: 1070532 - RNA, 22 nt, Human
ucccugcacagccgagccaugc

SEQ ID NO: 1070533 - RNA, 22 nt, Human
uuucaguguuaugacuuucauu

SEQ ID NO: 1070534 - RNA, 22 nt, Human
uuagaaaggaaucuucauuuca

SEQ ID NO: 1070535 - RNA, 22 nt, Human
aggcaggcacuccggaaguguc

SEQ ID NO: 1070536 - RNA, 19 nt, Human
ugcagaagacacaguggug

SEQ ID NO: 1070537 - RNA, 22 nt, Human
uuaacaugucuugacuucaucu

SEQ ID NO: 1070538 - RNA, 22 nt, Human
caagaauagcuaccucccauau

SEQ ID NO: 1070539 - RNA, 22 nt, Human
gagaggcugguaaagucugaac

SEQ ID NO: 1070540 - RNA, 22 nt, Human
uuacagauggaucuagcaaaau

SEQ ID NO: 1070541 - RNA, 21 nt, Human
aggcucagcagguguauaaag

SEQ ID NO: 1070542 - RNA, 22 nt, Human
cagcagcucccauccgcugagc

SEQ ID NO: 1070543 - RNA, 20 nt, Human
ugggccucuggugccucugg

SEQ ID NO: 1070544 - RNA, 22 nt, Human
gaagaauauauaaugauuuugu

SEQ ID NO: 1070545 - RNA, 22 nt, Human
gcagacagcauguugggcuauu

SEQ ID NO: 1070546 - RNA, 22 nt, Human
agcaggugguaggcagucagca

SEQ ID NO: 1070547 - RNA, 22 nt, Human
uaaaaguauacuuucaaaggag

SEQ ID NO: 1070548 - RNA, 22 nt, Human
ggagugaaguggcgcgaucucg

SEQ ID NO: 1070549 - RNA, 22 nt, Human
ccugucuguccucucaugagcc

SEQ ID NO: 1070550 - RNA, 22 nt, Human
uuauuuguaaggcagggccagu

SEQ ID NO: 1070551 - RNA, 22 nt, Human
ggcuucaccaggugcaugcaug

SEQ ID NO: 1070552 - RNA, 22 nt, Human
gccagccauaggccagcacugg

SEQ ID NO: 1070553 - RNA, 22 nt, Human
aagauauucaaagauuuauuag

SEQ ID NO: 1070554 - RNA, 16 nt, Human
agcagguguauagugu

SEQ ID NO: 1070555 - RNA, 22 nt, Human
cuggcucagacagcugugcagu

SEQ ID NO: 1070556 - RNA, 22 nt, Human
ucuuugcaaaauacaacaaugg

SEQ ID NO: 1070557 - RNA, 22 nt, Human
uacuguuuucuuuauaguacag

SEQ ID NO: 1070558 - RNA, 22 nt, Human
ugauucaucagaauaggaguuu

SEQ ID NO: 1070559 - RNA, 22 nt, Human
ggagcugggguuggcaucuucc

SEQ ID NO: 1070560 - RNA, 22 nt, Human
agccaggcugcaguuggcuggc

SEQ ID NO: 1070561 - RNA, 22 nt, Human
ggaccacauugagagucauuaa

SEQ ID NO: 1070562 - RNA, 22 nt, Human
auucuacuuuguguaauuaucu

SEQ ID NO: 1070563 - RNA, 22 nt, Human
agaaagggaacuggcaaagcca

SEQ ID NO: 1070564 - RNA, 22 nt, Human
cagcugguagguagcagauuug

SEQ ID NO: 1070565 - RNA, 22 nt, Human
uacagagagauaaguguaaaag

SEQ ID NO: 1070566 - RNA, 22 nt, Human
ucaggagggugacaggcccugg

SEQ ID NO: 1070567 - RNA, 22 nt, Human
uuaaagggccgauuuccaggcc

SEQ ID NO: 1070568 - RNA, 22 nt, Human
uauuuguuucuaguggcagcaa

SEQ ID NO: 1070569 - RNA, 22 nt, Human
ugaaaaugcccucuaugucuca

SEQ ID NO: 1070570 - RNA, 22 nt, Human
ugugacagaucuuuaaauaaug

SEQ ID NO: 1070571 - RNA, 22 nt, Human
caugaacagcuaacauuuuggg

SEQ ID NO: 1070572 - RNA, 22 nt, Human
aucuaaacuauaguaccuaguc

SEQ ID NO: 1070573 - RNA, 22 nt, Human
cugagcccgggugcucuacccc

SEQ ID NO: 1070574 - RNA, 22 nt, Human
acaaacagcuaacauauguuaa

SEQ ID NO: 1070575 - RNA, 22 nt, Human
cugggccuggagcccacgagcc

SEQ ID NO: 1070576 - RNA, 22 nt, Human
ugcuagugugugagauguucaa

SEQ ID NO: 1070577 - RNA, 22 nt, Human
uauugaaauccauuacguucuu

SEQ ID NO: 1070578 - RNA, 22 nt, Human
aauccuagaaauuuauuugaag

SEQ ID NO: 1070579 - RNA, 22 nt, Human
gcaaaggcuagagacacaggga

SEQ ID NO: 1070580 - RNA, 17 nt, Human
cugagccccgggcagcu

SEQ ID NO: 1070581 - RNA, 22 nt, Human
cagccaggagcucccccugcuc

SEQ ID NO: 1070582 - RNA, 22 nt, Human
agauuacagaagaauaaguaga

SEQ ID NO: 1070583 - RNA, 22 nt, Human
ugauccuauuucaguguauguu

SEQ ID NO: 1070584 - RNA, 22 nt, Human
cagagauuauuauaacuaauua

SEQ ID NO: 1070585 - RNA, 22 nt, Human
cugccuguuagucuagcaguua

SEQ ID NO: 1070586 - RNA, 22 nt, Human
gcucugucaacagcuagcugug

SEQ ID NO: 1070587 - RNA, 22 nt, Human
aucuacaacggguggaguaggg

SEQ ID NO: 1070588 - RNA, 22 nt, Human
uggaaagaugaagauguuuaag

SEQ ID NO: 1070589 - RNA, 22 nt, Human
gagcugcacaucugaggcuaau

SEQ ID NO: 1070590 - RNA, 22 nt, Human
ucgccagggaugcuguaaggaa

SEQ ID NO: 1070591 - RNA, 22 nt, Human
auggcccaggccuccuguggcu

SEQ ID NO: 1070592 - RNA, 22 nt, Human
ggccucuggcaggcaggcccuc

SEQ ID NO: 1070593 - RNA, 22 nt, Human
ugaaaucuuauacuuugguagu

SEQ ID NO: 1070594 - RNA, 22 nt, Human
cagaccugggucccuggccugu

SEQ ID NO: 1070595 - RNA, 22 nt, Human
ggagaagcaggugcuuuggguc

SEQ ID NO: 1070596 - RNA, 22 nt, Human
ccaaaauguuugaaugcaugug

SEQ ID NO: 1070597 - RNA, 22 nt, Human
agccugagugcuuaggacuguu

SEQ ID NO: 1070598 - RNA, 22 nt, Human
acaugaggaacucaggagucac

SEQ ID NO: 1070599 - RNA, 22 nt, Human
acauuucagugagcuauugaag

SEQ ID NO: 1070600 - RNA, 22 nt, Human
uugagaagaggcuuuguaggaa

SEQ ID NO: 1070601 - RNA, 22 nt, Human
gaaaucuccaaucuuuucuuua

SEQ ID NO: 1070602 - RNA, 18 nt, Human
cugccuguugcugagagg

SEQ ID NO: 1070603 - RNA, 22 nt, Human
guguuacaaaucaccugugcug

SEQ ID NO: 1070604 - RNA, 20 nt, Human
uucuacaaaacugauucuga

SEQ ID NO: 1070605 - RNA, 22 nt, Human
ucucagagauguuagggaagag

SEQ ID NO: 1070606 - RNA, 20 nt, Human
gcugcucuccacggucugca

SEQ ID NO: 1070607 - RNA, 22 nt, Human
ccugggcagggagaccaggcuc

SEQ ID NO: 1070608 - RNA, 22 nt, Human
caucugccuaaguggcccuguu

SEQ ID NO: 1070609 - RNA, 21 nt, Human
acagcagacaggcuuaggacc

SEQ ID NO: 1070610 - RNA, 22 nt, Human
aagcagcuuaaauuagagccug

SEQ ID NO: 1070611 - RNA, 22 nt, Human
acauuugauugaugaaucaaau

SEQ ID NO: 1070612 - RNA, 22 nt, Human
ugcucacagcccagaacauaau

SEQ ID NO: 1070613 - RNA, 22 nt, Human
aguuucuuuagauagaaaguuc

SEQ ID NO: 1070614 - RNA, 22 nt, Human
uuucucuguucucuaacuguaa

SEQ ID NO: 1070615 - RNA, 22 nt, Human
aggguaggaacugaguggaagg

SEQ ID NO: 1070616 - RNA, 22 nt, Human
uggauggggcagcuuaggugug

SEQ ID NO: 1070617 - RNA, 22 nt, Human
gaggcuggacgugcauuucuac

SEQ ID NO: 1070618 - RNA, 22 nt, Human
caguagccacuagacacaugua

SEQ ID NO: 1070619 - RNA, 19 nt, Human
uggaaaauggauugaauca

SEQ ID NO: 1070620 - RNA, 22 nt, Human
ucauuucaugucucaggcacug

SEQ ID NO: 1070621 - RNA, 22 nt, Human
aggugucugugaugggagcgau

SEQ ID NO: 1070622 - RNA, 22 nt, Human
uuacaauaccacaucaccucau

SEQ ID NO: 1070623 - RNA, 22 nt, Human
cgagcaugaugacggcuguggc

SEQ ID NO: 1070624 - RNA, 22 nt, Human
uggcagcaguagccaccccagc

SEQ ID NO: 1070625 - RNA, 22 nt, Human
cuuguaaaugcagauucugauu

SEQ ID NO: 1070626 - RNA, 22 nt, Human
ggcccaaggcccaggucgagcu

SEQ ID NO: 1070627 - RNA, 22 nt, Human
uucuucaaaauccagcaugauu

SEQ ID NO: 1070628 - RNA, 22 nt, Human
ucuucaguauuuggauaacauu

SEQ ID NO: 1070629 - RNA, 20 nt, Human
aauaaacuacugagagaugu

SEQ ID NO: 1070630 - RNA, 22 nt, Human
uuugcagucaaauuugcuaaau

SEQ ID NO: 1070631 - RNA, 22 nt, Human
acagugucaugucguguucccc

SEQ ID NO: 1070632 - RNA, 21 nt, Human
ggaugccacgaagcaccagga

SEQ ID NO: 1070633 - RNA, 22 nt, Human
uaaacaagcugucugauauucu

SEQ ID NO: 1070634 - RNA, 22 nt, Human
acacggaaucccuuuugugaca

SEQ ID NO: 1070635 - RNA, 22 nt, Human
gcacagagucacuagcuaagca

SEQ ID NO: 1070636 - RNA, 22 nt, Human
caagagcugugaccucauucac

SEQ ID NO: 1070637 - RNA, 22 nt, Human
uggcugccuagucccucagccu

SEQ ID NO: 1070638 - RNA, 23 nt, Human
ccaggaagaggccauccacaguc

SEQ ID NO: 1070639 - RNA, 22 nt, Human
caggcuggagugcaauggugcu

SEQ ID NO: 1070640 - RNA, 22 nt, Human
agcagggcaaagucaggcuaac

SEQ ID NO: 1070641 - RNA, 22 nt, Human
gcaggaagccuuaccaagccca

SEQ ID NO: 1070642 - RNA, 22 nt, Human
aaggaagaaaugaauaggugga

SEQ ID NO: 1070643 - RNA, 22 nt, Human
uauuucuuguuauucucguuga

SEQ ID NO: 1070644 - RNA, 22 nt, Human
ugggcugcagggguugagagcu

SEQ ID NO: 1070645 - RNA, 22 nt, Human
ucucuggaguauaaccagggau

SEQ ID NO: 1070646 - RNA, 22 nt, Human
cagccagccucucaaccaugca

SEQ ID NO: 1070647 - RNA, 21 nt, Human
uuucucauaaaauacucauua

SEQ ID NO: 1070648 - RNA, 22 nt, Human
acacugugcagauucccuguga

SEQ ID NO: 1070649 - RNA, 22 nt, Human
agucaggauaugccuugugggc

SEQ ID NO: 1070650 - RNA, 22 nt, Human
uaaugccuuaugucaaauguaa

SEQ ID NO: 1070651 - RNA, 22 nt, Human
gagcccucucuguaggcaagua

SEQ ID NO: 1070652 - RNA, 22 nt, Human
gaauucugguuuugaaaugaau

SEQ ID NO: 1070653 - RNA, 22 nt, Human
aggccucugggccugcggguuu

SEQ ID NO: 1070654 - RNA, 19 nt, Human
ugaauuaaagauuaaaguc

SEQ ID NO: 1070655 - RNA, 22 nt, Human
gacauacaagcugguaccuccu

SEQ ID NO: 1070656 - RNA, 22 nt, Human
uccaggaggguuuucugccuuc

SEQ ID NO: 1070657 - RNA, 22 nt, Human
agaacacacugggggaaacaag

SEQ ID NO: 1070658 - RNA, 22 nt, Human
ggagcugagguaacagugagug

SEQ ID NO: 1070659 - RNA, 22 nt, Human
ugcccugugugugcaagcacug

SEQ ID NO: 1070660 - RNA, 22 nt, Human
acuggcaguuugagaaugcauu

SEQ ID NO: 1070661 - RNA, 20 nt, Human
cauuccugaggaauucaugu

SEQ ID NO: 1070662 - RNA, 22 nt, Human
cccuccccacaaagcuucacac

SEQ ID NO: 1070663 - RNA, 22 nt, Human
agacaauauauaauuuuaguug

SEQ ID NO: 1070664 - RNA, 22 nt, Human
acugagcucuugacugggaguu

SEQ ID NO: 1070665 - RNA, 22 nt, Human
uacauacacaaaugcugaaugg

SEQ ID NO: 1070666 - RNA, 22 nt, Human
uccuucagugucccgcucaggu

SEQ ID NO: 1070667 - RNA, 22 nt, Human
uccaggaauuuccccuuuccug

SEQ ID NO: 1070668 - RNA, 22 nt, Human
gagaccaggaaguacagcagcc

SEQ ID NO: 1070669 - RNA, 22 nt, Human
ucaguuuauagauauugcugau

SEQ ID NO: 1070670 - RNA, 22 nt, Human
agucuucagcauagcauauggc

SEQ ID NO: 1070671 - RNA, 22 nt, Human
gaagagaugacaaaggagcaug

SEQ ID NO: 1070672 - RNA, 22 nt, Human
guuugcaaauuauguuaaaagu

SEQ ID NO: 1070673 - RNA, 22 nt, Human
ucuggagccuuggaugggaaag

SEQ ID NO: 1070674 - RNA, 19 nt, Human
ggccaggcugacugugguc

SEQ ID NO: 1070675 - RNA, 22 nt, Human
uagucuuaaguaauucauggaa

SEQ ID NO: 1070676 - RNA, 22 nt, Human
ugaggccucauuuagggagagg

SEQ ID NO: 1070677 - RNA, 23 nt, Human
agaggccaacuucuugccccucc

SEQ ID NO: 1070678 - RNA, 22 nt, Human
uaugauaugcacuuuaucagaa

SEQ ID NO: 1070679 - RNA, 22 nt, Human
caagagcuuuagaaaugcucau

SEQ ID NO: 1070680 - RNA, 22 nt, Human
ucuucucaguuucucuaggaug

SEQ ID NO: 1070681 - RNA, 22 nt, Human
caggagugaguuggggucuaca

SEQ ID NO: 1070682 - RNA, 22 nt, Human
uagcuagaagguugaaagcagg

SEQ ID NO: 1070683 - RNA, 22 nt, Human
gagcugcuucugugugccgggu

SEQ ID NO: 1070684 - RNA, 22 nt, Human
cuggagggggaaauguucauug

SEQ ID NO: 1070685 - RNA, 22 nt, Human
agggucagguuaagggagucau

SEQ ID NO: 1070686 - RNA, 23 nt, Human
ugguucaagugagaaguaauguu

SEQ ID NO: 1070687 - RNA, 22 nt, Human
caggagacaauggcuguggggc

SEQ ID NO: 1070688 - RNA, 22 nt, Human
cgcagguguguuuucaggacua

SEQ ID NO: 1070689 - RNA, 21 nt, Human
agcagaacagucgagcacugc

SEQ ID NO: 1070690 - RNA, 22 nt, Human
aauacugucuuucacagauauu

SEQ ID NO: 1070691 - RNA, 22 nt, Human
uacauauuugucuuuguacugu

SEQ ID NO: 1070692 - RNA, 22 nt, Human
ggagucagccugucagagugua

SEQ ID NO: 1070693 - RNA, 22 nt, Human
gcugucugucucugucccacca

SEQ ID NO: 1070694 - RNA, 22 nt, Human
gaguuaaugaggccaagggcag

SEQ ID NO: 1070695 - RNA, 22 nt, Human
uuacaaguuucuggcuucaucc

SEQ ID NO: 1070696 - RNA, 15 nt, Human
cagucccagggaccc

SEQ ID NO: 1070697 - RNA, 22 nt, Human
ucuuugaaaagggagauagaaa

SEQ ID NO: 1070698 - RNA, 22 nt, Human
gccuccccaggggugucaugag

SEQ ID NO: 1070699 - RNA, 22 nt, Human
ggagccuugggcgcucucccau

SEQ ID NO: 1070700 - RNA, 22 nt, Human
aaugggcuuucuuggacaggag

SEQ ID NO: 1070701 - RNA, 22 nt, Human
uggugccauuagcccugcuguu

SEQ ID NO: 1070702 - RNA, 22 nt, Human
agcugccagggacugggcaugg

SEQ ID NO: 1070703 - RNA, 22 nt, Human
augaaugaugccaguugaaaug

SEQ ID NO: 1070704 - RNA, 22 nt, Human
aagccucaccuuuuagaagcua

SEQ ID NO: 1070705 - RNA, 18 nt, Human
caaauacuguugucuuau

SEQ ID NO: 1070706 - RNA, 22 nt, Human
agugggccuuagaagguucccu

SEQ ID NO: 1070707 - RNA, 22 nt, Human
aaaugucuuucaauagagaaau

SEQ ID NO: 1070708 - RNA, 22 nt, Human
caaauacugaguuuauuuucaa

SEQ ID NO: 1070709 - RNA, 22 nt, Human
uucuaaacugaaguauuuuaaa

SEQ ID NO: 1070710 - RNA, 22 nt, Human
ugcagagaagaggacaguucua

SEQ ID NO: 1070711 - RNA, 22 nt, Human
accuggcaugaagcaugccuua

SEQ ID NO: 1070712 - RNA, 23 nt, Human
gggauauggaccuuggaggaguc

SEQ ID NO: 1070713 - RNA, 22 nt, Human
guuucuuagguaaauucuuuga

SEQ ID NO: 1070714 - RNA, 22 nt, Human
cucugagacuuagcaucuacau

SEQ ID NO: 1070715 - RNA, 22 nt, Human
aggcacaguggcucacaccugu

SEQ ID NO: 1070716 - RNA, 22 nt, Human
augcuguguauuuuacucuuuc

SEQ ID NO: 1070717 - RNA, 22 nt, Human
uuauuuaauuuucucacucaga

SEQ ID NO: 1070718 - RNA, 22 nt, Human
ugaggcuuagagaagaugggau

SEQ ID NO: 1070719 - RNA, 22 nt, Human
uuucccaauugagagguucugu

SEQ ID NO: 1070720 - RNA, 22 nt, Human
ccugagccgagcgcucuuucuc

SEQ ID NO: 1070721 - RNA, 22 nt, Human
gggcagugguccaggcuacagc

SEQ ID NO: 1070722 - RNA, 18 nt, Human
ucacagaauauugagugg

SEQ ID NO: 1070723 - RNA, 22 nt, Human
ugaagcagcaaaugaugggaga

SEQ ID NO: 1070724 - RNA, 20 nt, Human
uggugagagcaccugauggg

SEQ ID NO: 1070725 - RNA, 17 nt, Human
aggcuggccuucacagu

SEQ ID NO: 1070726 - RNA, 22 nt, Human
ccugggcucaagugaugguccc

SEQ ID NO: 1070727 - RNA, 22 nt, Human
ccugucucuguuaccacauuug

SEQ ID NO: 1070728 - RNA, 22 nt, Human
cugugcuggagaugggccagag

SEQ ID NO: 1070729 - RNA, 22 nt, Human
aaugagauggcaaugacuuaaa

SEQ ID NO: 1070730 - RNA, 22 nt, Human
uugcaccaaaugaguuaaaauu

SEQ ID NO: 1070731 - RNA, 22 nt, Human
gaggggcuggcuguggucccau

SEQ ID NO: 1070732 - RNA, 22 nt, Human
ugaaauauuuagagaguaaguu

SEQ ID NO: 1070733 - RNA, 22 nt, Human
cauuucacuauucacuaaaagg

SEQ ID NO: 1070734 - RNA, 21 nt, Human
gcucccuggcugugugaccug

SEQ ID NO: 1070735 - RNA, 22 nt, Human
uuaacagacuugggauuuucua

SEQ ID NO: 1070736 - RNA, 22 nt, Human
uuaaauuauugagggauuguca

SEQ ID NO: 1070737 - RNA, 22 nt, Human
agggacugagcuaggaucuagu

SEQ ID NO: 1070738 - RNA, 22 nt, Human
acaucuuuauacuaguccuuga

SEQ ID NO: 1070739 - RNA, 22 nt, Human
augaaaauugacagcggaagua

SEQ ID NO: 1070740 - RNA, 22 nt, Human
ucacaucaacauuauagcauga

SEQ ID NO: 1070741 - RNA, 22 nt, Human
auuuccuaggguagaugucaca

SEQ ID NO: 1070742 - RNA, 22 nt, Human
gccuggcugccggccuuggcaa

SEQ ID NO: 1070743 - RNA, 20 nt, Human
uccugguggauacugcuuaa

SEQ ID NO: 1070744 - RNA, 22 nt, Human
gcaggagcuggaaagugauguu

SEQ ID NO: 1070745 - RNA, 22 nt, Human
augaggcuaugaauggggagau

SEQ ID NO: 1070746 - RNA, 22 nt, Human
auguguaaaaagugcuuaauau

SEQ ID NO: 1070747 - RNA, 22 nt, Human
aaaggauucucuugauuucagu

SEQ ID NO: 1070748 - RNA, 22 nt, Human
agcauggggcuccgcaaugaac

SEQ ID NO: 1070749 - RNA, 22 nt, Human
gagagucacugucugcauuucc

SEQ ID NO: 1070750 - RNA, 22 nt, Human
gcuucugcagccaaagaagccg

SEQ ID NO: 1070751 - RNA, 22 nt, Human
acacaucuccagccagcaggag

SEQ ID NO: 1070752 - RNA, 22 nt, Human
agcagccagaaagggcagucga

SEQ ID NO: 1070753 - RNA, 22 nt, Human
ucauuuguucucauucucuacu

SEQ ID NO: 1070754 - RNA, 22 nt, Human
cccacacacauuuaugauagga

SEQ ID NO: 1070755 - RNA, 22 nt, Human
uccugccuagcaggugaccuau

SEQ ID NO: 1070756 - RNA, 22 nt, Human
gcacggcuaauuuuuguauuuu

SEQ ID NO: 1070757 - RNA, 22 nt, Human
cagcuguuguuaugucugcagg

SEQ ID NO: 1070758 - RNA, 22 nt, Human
cucaagucuauugauaagugca

SEQ ID NO: 1070759 - RNA, 22 nt, Human
aggucauuccagccauuccccu

SEQ ID NO: 1070760 - RNA, 22 nt, Human
cugcggcuggggacagcuguug

SEQ ID NO: 1070761 - RNA, 22 nt, Human
gccugugugugaggacuggcug

SEQ ID NO: 1070762 - RNA, 22 nt, Human
guaaauauucccucgguuccua

SEQ ID NO: 1070763 - RNA, 22 nt, Human
uaugugcaguuugcucuuaaca

SEQ ID NO: 1070764 - RNA, 22 nt, Human
ggcugcuucucacucauuugca

SEQ ID NO: 1070765 - RNA, 22 nt, Human
agaaaucucaguaucucaggga

SEQ ID NO: 1070766 - RNA, 22 nt, Human
aagcagaguuagcuugucaccu

SEQ ID NO: 1070767 - RNA, 22 nt, Human
ggccuggaaugcuuuccuacca

SEQ ID NO: 1070768 - RNA, 22 nt, Human
caaagugcuaggauuacaggcc

SEQ ID NO: 1070769 - RNA, 22 nt, Human
ggcagcuccucucagcaaaaga

SEQ ID NO: 1070770 - RNA, 20 nt, Human
cccuccagcaaccaggacuu

SEQ ID NO: 1070771 - RNA, 22 nt, Human
ucagggcaagauugguuaauaa

SEQ ID NO: 1070772 - RNA, 18 nt, Human
ucugggcaaucucaguau

SEQ ID NO: 1070773 - RNA, 19 nt, Human
aggacccuuauccuggcuu

SEQ ID NO: 1070774 - RNA, 22 nt, Human
aagggccauaacuugcaguguu

SEQ ID NO: 1070775 - RNA, 22 nt, Human
caggcccucgcccgcagcgacc

SEQ ID NO: 1070776 - RNA, 18 nt, Human
gagaggcccggcugugcc

SEQ ID NO: 1070777 - RNA, 22 nt, Human
agccaggccagcugucuugagu

SEQ ID NO: 1070778 - RNA, 22 nt, Human
aaagagaaaaagaucccggcuc

SEQ ID NO: 1070779 - RNA, 22 nt, Human
ccagagaaagugaagcaaaugu

SEQ ID NO: 1070780 - RNA, 22 nt, Human
ucagccuggcaggauggccugg

SEQ ID NO: 1070781 - RNA, 22 nt, Human
augaaggauggcuggcugcccu

SEQ ID NO: 1070782 - RNA, 22 nt, Human
uacagaaauacugggggguucu

SEQ ID NO: 1070783 - RNA, 22 nt, Human
caaugauggcuaggcagcugcu

SEQ ID NO: 1070784 - RNA, 22 nt, Human
uuguauuuauauugaauagcuu

SEQ ID NO: 1070785 - RNA, 21 nt, Human
cauaugaaagaaguaucugac

SEQ ID NO: 1070786 - RNA, 22 nt, Human
ccugaagggacuccagagagca

SEQ ID NO: 1070787 - RNA, 22 nt, Human
agcagagcugcaguggccugcu

SEQ ID NO: 1070788 - RNA, 22 nt, Human
ucuuugauacagauguaagcug

SEQ ID NO: 1070789 - RNA, 22 nt, Human
ccauaagguugaaaacuguaca

SEQ ID NO: 1070790 - RNA, 21 nt, Human
ucaguaaaccuaaagauugua

SEQ ID NO: 1070791 - RNA, 19 nt, Human
auaaggcagugacuuuuuu

SEQ ID NO: 1070792 - RNA, 22 nt, Human
gccucugcggggcccgagcccg

SEQ ID NO: 1070793 - RNA, 22 nt, Human
aaggaagauauaucaagcuuaa

SEQ ID NO: 1070794 - RNA, 22 nt, Human
gccaaggccucugcaggaugag

SEQ ID NO: 1070795 - RNA, 22 nt, Human
auuuuguuauaggagcugaaau

SEQ ID NO: 1070796 - RNA, 22 nt, Human
agcucuggaagcccugguaguu

SEQ ID NO: 1070797 - RNA, 22 nt, Human
ucuucaucucagauuaacagga

SEQ ID NO: 1070798 - RNA, 22 nt, Human
aguauuuguugauugauaugaa

SEQ ID NO: 1070799 - RNA, 22 nt, Human
ggaggggauuuaguagaugcua

SEQ ID NO: 1070800 - RNA, 22 nt, Human
cagcugagucugagguucuuug

SEQ ID NO: 1070801 - RNA, 22 nt, Human
cagggugccucccgcucgccgg

SEQ ID NO: 1070802 - RNA, 21 nt, Human
gaugaugccauccuccaucuc

SEQ ID NO: 1070803 - RNA, 22 nt, Human
ccugcuggcguggcuggcgccc

SEQ ID NO: 1070804 - RNA, 17 nt, Human
ugaagaugcauggcagc

SEQ ID NO: 1070805 - RNA, 22 nt, Human
cagacuuucuggaagcuaaaaa

SEQ ID NO: 1070806 - RNA, 22 nt, Human
caaagcagagaacugucucauu

SEQ ID NO: 1070807 - RNA, 22 nt, Human
gagaauauauugaaguaguucc

SEQ ID NO: 1070808 - RNA, 22 nt, Human
aauagcuuuggucaccaucugg

SEQ ID NO: 1070809 - RNA, 22 nt, Human
caguacuuaacuuauaggagag

SEQ ID NO: 1070810 - RNA, 22 nt, Human
aggccugggcaagaaggggcgu

SEQ ID NO: 1070811 - RNA, 21 nt, Human
gagaugcuuuuuauucaaccc

SEQ ID NO: 1070812 - RNA, 22 nt, Human
ugucucagggcagcagcagggg

SEQ ID NO: 1070813 - RNA, 22 nt, Human
uuagggcaggcaugagagaacu

SEQ ID NO: 1070814 - RNA, 22 nt, Human
ggagugaguggccuugucacug

SEQ ID NO: 1070815 - RNA, 22 nt, Human
agagcuguagcuuccuagagcc

SEQ ID NO: 1070816 - RNA, 22 nt, Human
uccucugcuccaggcuggacuu

SEQ ID NO: 1070817 - RNA, 22 nt, Human
gcuccucugucaaaugagagug

SEQ ID NO: 1070818 - RNA, 18 nt, Human
cauuguacaaugcuuuau

SEQ ID NO: 1070819 - RNA, 18 nt, Human
agcaggugcuguuucuuu

SEQ ID NO: 1070820 - RNA, 22 nt, Human
caggagugcagguggugaggca

SEQ ID NO: 1070821 - RNA, 22 nt, Human
ugagcccagagaucugagcuau

SEQ ID NO: 1070822 - RNA, 22 nt, Human
auuuacacauucauaagauuuc

SEQ ID NO: 1070823 - RNA, 22 nt, Human
cugggccaucagaggggcugga

SEQ ID NO: 1070824 - RNA, 22 nt, Human
aggucauuuccuuagaggcaga

SEQ ID NO: 1070825 - RNA, 22 nt, Human
uggguaggggacguggaagaaa

SEQ ID NO: 1070826 - RNA, 22 nt, Human
ugcagugccucggcagugcagc

SEQ ID NO: 1070827 - RNA, 22 nt, Human
cuuucacagcuugaaaaguauu

SEQ ID NO: 1070828 - RNA, 22 nt, Human
cagaaacuagauuuagacacaa

SEQ ID NO: 1070829 - RNA, 22 nt, Human
agcugccugggcuuguacaccu

SEQ ID NO: 1070830 - RNA, 22 nt, Human
uuauagguccacugcaauuugc

SEQ ID NO: 1070831 - RNA, 22 nt, Human
ccauuguaaauucuguggaagu

SEQ ID NO: 1070832 - RNA, 22 nt, Human
caagauggagaagcagcaaggg

SEQ ID NO: 1070833 - RNA, 22 nt, Human
gggcuggugaggcugcccugca

SEQ ID NO: 1070834 - RNA, 22 nt, Human
ucaggccugcaggcuuccugga

SEQ ID NO: 1070835 - RNA, 22 nt, Human
aggcucagccccugggaggaga

SEQ ID NO: 1070836 - RNA, 22 nt, Human
auggaguucugccagcgcugcu

SEQ ID NO: 1070837 - RNA, 22 nt, Human
ggaagcugcauaacuagcgugg

SEQ ID NO: 1070838 - RNA, 23 nt, Human
gcccugcuacucacaagcugugu

SEQ ID NO: 1070839 - RNA, 22 nt, Human
aggucccugcagcagacugcca

SEQ ID NO: 1070840 - RNA, 22 nt, Human
uagagaaaagcagggaucagga

SEQ ID NO: 1070841 - RNA, 22 nt, Human
agcaggugacccaagcaggcug

SEQ ID NO: 1070842 - RNA, 22 nt, Human
uugcagagugguugugaggauu

SEQ ID NO: 1070843 - RNA, 22 nt, Human
ucccagccuuucuuucuccagc

SEQ ID NO: 1070844 - RNA, 22 nt, Human
aaauacugggcucaaaaggguu

SEQ ID NO: 1070845 - RNA, 22 nt, Human
cagggcugaggacacaaguaaa

SEQ ID NO: 1070846 - RNA, 17 nt, Human
uaucagaauguguuuac

SEQ ID NO: 1070847 - RNA, 22 nt, Human
ucugaaauagaagugucuuucu

SEQ ID NO: 1070848 - RNA, 22 nt, Human
ggccucugccucaucugggcac

SEQ ID NO: 1070849 - RNA, 22 nt, Human
ugugggccugggaaggugacac

SEQ ID NO: 1070850 - RNA, 22 nt, Human
uagauggcuuucugagguauuu

SEQ ID NO: 1070851 - RNA, 22 nt, Human
ggcugcagaggcgaucugaggu

SEQ ID NO: 1070852 - RNA, 22 nt, Human
acuuucaauuugcacuaaccua

SEQ ID NO: 1070853 - RNA, 22 nt, Human
ucagguggaauuaauuaagaga

SEQ ID NO: 1070854 - RNA, 22 nt, Human
guucacagguucucuuucuaag

SEQ ID NO: 1070855 - RNA, 22 nt, Human
gaaauacuguaaaguuauuauu

SEQ ID NO: 1070856 - RNA, 22 nt, Human
agauguggauccuaggguagaa

SEQ ID NO: 1070857 - RNA, 19 nt, Human
ggcagaagguguaggggga

SEQ ID NO: 1070858 - RNA, 22 nt, Human
accugccuucucaaggacauga

SEQ ID NO: 1070859 - RNA, 22 nt, Human
uggcgugcccuccagacuuggc

SEQ ID NO: 1070860 - RNA, 22 nt, Human
aggcugagucgggaggaucacu

SEQ ID NO: 1070861 - RNA, 22 nt, Human
aagaguuuucuauaaucuuggc

SEQ ID NO: 1070862 - RNA, 22 nt, Human
acugggccaggggcuuuggagc

SEQ ID NO: 1070863 - RNA, 22 nt, Human
acaguguucuugauauuacagu

SEQ ID NO: 1070864 - RNA, 22 nt, Human
uuacaacaaaggcacgugcaug

SEQ ID NO: 1070865 - RNA, 22 nt, Human
caggguccaucuuucaucacug

SEQ ID NO: 1070866 - RNA, 22 nt, Human
gccugugcuuaacugacgugag

SEQ ID NO: 1070867 - RNA, 22 nt, Human
uuagugaugacuagacuuuugu

SEQ ID NO: 1070868 - RNA, 19 nt, Human
acaaagcugugagcagcuu

SEQ ID NO: 1070869 - RNA, 20 nt, Human
auugucagccuucagaggag

SEQ ID NO: 1070870 - RNA, 22 nt, Human
gggaaguuugugggaggaauau

SEQ ID NO: 1070871 - RNA, 22 nt, Human
cuuuuauuuugaauuaagggcu

SEQ ID NO: 1070872 - RNA, 21 nt, Human
caucaacucuugugcucacac

SEQ ID NO: 1070873 - RNA, 22 nt, Human
acucaucagccucuaggaaaga

SEQ ID NO: 1070874 - RNA, 22 nt, Human
uagaaaacuaauacaugcuuga

SEQ ID NO: 1070875 - RNA, 22 nt, Human
aaauguaagucuuuguuucuua

SEQ ID NO: 1070876 - RNA, 22 nt, Human
augaguugaagcuacaagaggc

SEQ ID NO: 1070877 - RNA, 22 nt, Human
aggaacuagugcaacaggagcg

SEQ ID NO: 1070878 - RNA, 22 nt, Human
accagagcuggcagaguaucaa

SEQ ID NO: 1070879 - RNA, 20 nt, Human
aaguuacauuguauuguacc

SEQ ID NO: 1070880 - RNA, 22 nt, Human
uggaccugcuggaugggcaggu

SEQ ID NO: 1070881 - RNA, 22 nt, Human
caugagcugcugggagccuguc

SEQ ID NO: 1070882 - RNA, 22 nt, Human
aaggcagggaaaguggauuagg

SEQ ID NO: 1070883 - RNA, 22 nt, Human
ucaguguuaaucagugguaccu

SEQ ID NO: 1070884 - RNA, 22 nt, Human
acuuccagguuccacccaagac

SEQ ID NO: 1070885 - RNA, 22 nt, Human
ucauuuaauaauuuuugaguag

SEQ ID NO: 1070886 - RNA, 22 nt, Human
cggucaggugcagcguuggcac

SEQ ID NO: 1070887 - RNA, 22 nt, Human
aggcacugggggaugagcaagg

SEQ ID NO: 1070888 - RNA, 22 nt, Human
caaagucagcugccagucccaa

SEQ ID NO: 1070889 - RNA, 19 nt, Human
cuucagggaggggccaggc

SEQ ID NO: 1070890 - RNA, 22 nt, Human
uuucacauaaauauuaugccua

SEQ ID NO: 1070891 - RNA, 22 nt, Human
uuucuuauauucugucauuguu

SEQ ID NO: 1070892 - RNA, 22 nt, Human
gcugagccacccuugcuucccu

SEQ ID NO: 1070893 - RNA, 22 nt, Human
acaggcauugggauggagguug

SEQ ID NO: 1070894 - RNA, 22 nt, Human
ugggaagggucaguuucuucau

SEQ ID NO: 1070895 - RNA, 21 nt, Human
ucucuggaauuagaccauguu

SEQ ID NO: 1070896 - RNA, 22 nt, Human
gaugaaauucagaauugagggg

SEQ ID NO: 1070897 - RNA, 22 nt, Human
cccagccaaggugcugguguug

SEQ ID NO: 1070898 - RNA, 22 nt, Human
cucugagaggcugcccugccau

SEQ ID NO: 1070899 - RNA, 22 nt, Human
guguccucuuauugcucuuggc

SEQ ID NO: 1070900 - RNA, 22 nt, Human
ccuggcugcccauggacccucu

SEQ ID NO: 1070901 - RNA, 22 nt, Human
acagugaugagccggcugaggc

SEQ ID NO: 1070902 - RNA, 22 nt, Human
caggcacagagagaauaccuuu

SEQ ID NO: 1070903 - RNA, 22 nt, Human
aauuagaagcuguuagcaaaau

SEQ ID NO: 1070904 - RNA, 22 nt, Human
ucccuguccugggcaaucccag

SEQ ID NO: 1070905 - RNA, 22 nt, Human
uucaaacaguguagaauauaug

SEQ ID NO: 1070906 - RNA, 22 nt, Human
augcacaucacucugaagaaaa

SEQ ID NO: 1070907 - RNA, 22 nt, Human
acuuccuguuaugugugccucu

SEQ ID NO: 1070908 - RNA, 22 nt, Human
gcuuccaggucauucucacccu

SEQ ID NO: 1070909 - RNA, 22 nt, Human
gggcucagacaucccuccugga

SEQ ID NO: 1070910 - RNA, 23 nt, Human
ucauuucacagugagcuuccuag

SEQ ID NO: 1070911 - RNA, 22 nt, Human
ugcacacauuaaggauacacag

SEQ ID NO: 1070912 - RNA, 22 nt, Human
acaaaugugucuaauugugccu

SEQ ID NO: 1070913 - RNA, 22 nt, Human
uguuguuuucucauggagaaua

SEQ ID NO: 1070914 - RNA, 22 nt, Human
ccucuucugagugagacucccu

SEQ ID NO: 1070915 - RNA, 22 nt, Human
ccagguggcccugcccuacucu

SEQ ID NO: 1070916 - RNA, 22 nt, Human
ugcaggcucaucucaagaguag

SEQ ID NO: 1070917 - RNA, 23 nt, Human
aaacaaugucaucaggacuuggu

SEQ ID NO: 1070918 - RNA, 21 nt, Human
agagagaaggccauauggucc

SEQ ID NO: 1070919 - RNA, 22 nt, Human
auuagcuuuauuugaaauagga

SEQ ID NO: 1070920 - RNA, 22 nt, Human
aucaacaugaauuucucugaag

SEQ ID NO: 1070921 - RNA, 22 nt, Human
gcagugaagccagaucugaaau

SEQ ID NO: 1070922 - RNA, 22 nt, Human
caggaggcuuugggauccaagu

SEQ ID NO: 1070923 - RNA, 22 nt, Human
ccacagaggacaacugccuggc

SEQ ID NO: 1070924 - RNA, 20 nt, Human
gacauucauaguuauuacca

SEQ ID NO: 1070925 - RNA, 19 nt, Human
agggccugcagcucaagcu

SEQ ID NO: 1070926 - RNA, 22 nt, Human
uguuuuuacugugauccagaaa

SEQ ID NO: 1070927 - RNA, 22 nt, Human
acccaugggccaguuggggugg

SEQ ID NO: 1070928 - RNA, 22 nt, Human
gccucagcuguugcaggggccc

SEQ ID NO: 1070929 - RNA, 22 nt, Human
aauuuuauuagaaggcaagggg

SEQ ID NO: 1070930 - RNA, 22 nt, Human
ugggcaggaugcguugauucuu

SEQ ID NO: 1070931 - RNA, 22 nt, Human
cauugcccaguaggaucaccag

SEQ ID NO: 1070932 - RNA, 23 nt, Human
cuagggcaguauuucacagacac

SEQ ID NO: 1070933 - RNA, 22 nt, Human
uuugugugcaacgcauggaguc

SEQ ID NO: 1070934 - RNA, 22 nt, Human
agugcauauaugaagaguauga

SEQ ID NO: 1070935 - RNA, 22 nt, Human
gcccacacagcagauccuuugg

SEQ ID NO: 1070936 - RNA, 23 nt, Human
uaaagcaaagucaagugcacucc

SEQ ID NO: 1070937 - RNA, 22 nt, Human
cagccacguagcccuuggccgu

SEQ ID NO: 1070938 - RNA, 22 nt, Human
acagaaguuggaauuagauacu

SEQ ID NO: 1070939 - RNA, 22 nt, Human
ucuggagcuggcagggcccugg

SEQ ID NO: 1070940 - RNA, 22 nt, Human
ugagaaaacaguuuguaauaau

SEQ ID NO: 1070941 - RNA, 18 nt, Human
ucuuggaguaaugaucaa

SEQ ID NO: 1070942 - RNA, 22 nt, Human
aauguuuucauuauccuaacug

SEQ ID NO: 1070943 - RNA, 22 nt, Human
ggucagccuuggauuugguagc

SEQ ID NO: 1070944 - RNA, 21 nt, Human
uuucuaaggaggaagaaaaga

SEQ ID NO: 1070945 - RNA, 22 nt, Human
agcugggcuuggccaggucgcu

SEQ ID NO: 1070946 - RNA, 22 nt, Human
gugaagcacaugggcguugggu

SEQ ID NO: 1070947 - RNA, 22 nt, Human
ucugucacccagagugcagugg

SEQ ID NO: 1070948 - RNA, 22 nt, Human
ccuagagucucucugcaggagu

SEQ ID NO: 1070949 - RNA, 22 nt, Human
cucugguucagggcucccuggc

SEQ ID NO: 1070950 - RNA, 22 nt, Human
ugcaugcauguuuuuacccaca

SEQ ID NO: 1070951 - RNA, 22 nt, Human
gccuugccucagccauggaaac

SEQ ID NO: 1070952 - RNA, 22 nt, Human
uugugaaaucguguuuggaagc

SEQ ID NO: 1070953 - RNA, 22 nt, Human
gaggaagaagcaaaccagcuaa

SEQ ID NO: 1070954 - RNA, 22 nt, Human
gucaguaggaaccuagggucaa

SEQ ID NO: 1070955 - RNA, 23 nt, Human
uggcagcuguguaagagaaagca

SEQ ID NO: 1070956 - RNA, 22 nt, Human
uacaguaauaaaaugagcuaca

SEQ ID NO: 1070957 - RNA, 22 nt, Human
aagcugccaaugguaagcugcu

SEQ ID NO: 1070958 - RNA, 22 nt, Human
gaaggccaagaggcuccaagau

SEQ ID NO: 1070959 - RNA, 22 nt, Human
cagucccagacauaguaaggga

SEQ ID NO: 1070960 - RNA, 22 nt, Human
cuggauuuacugaguuuuauca

SEQ ID NO: 1070961 - RNA, 21 nt, Human
ugauuuccaucuuaaaauaaa

SEQ ID NO: 1070962 - RNA, 22 nt, Human
agcaggugucacuuucacucca

SEQ ID NO: 1070963 - RNA, 22 nt, Human
uggcagcugaggggaggcuuug

SEQ ID NO: 1070964 - RNA, 22 nt, Human
auucuuaauugccaugcuguau

SEQ ID NO: 1070965 - RNA, 22 nt, Human
cugggcucccucaugugucugc

SEQ ID NO: 1070966 - RNA, 22 nt, Human
cuggcagguggagguugcagug

SEQ ID NO: 1070967 - RNA, 22 nt, Human
ucugggagagcacguggcugac

SEQ ID NO: 1070968 - RNA, 22 nt, Human
gagcugucuggggacucugggu

SEQ ID NO: 1070969 - RNA, 22 nt, Human
auucagcauaaucaguagcuug

SEQ ID NO: 1070970 - RNA, 22 nt, Human
aacugagacacgaacuaugauu

SEQ ID NO: 1070971 - RNA, 22 nt, Human
uuugaaagcaggugugggaggg

SEQ ID NO: 1070972 - RNA, 22 nt, Human
gcugucugacuccaaguuggag

SEQ ID NO: 1070973 - RNA, 22 nt, Human
ugcccaggaucuggcgaugcuc

SEQ ID NO: 1070974 - RNA, 22 nt, Human
aaggcccuggccccagcuucuu

SEQ ID NO: 1070975 - RNA, 22 nt, Human
ucugagagucuuucuucaagug

SEQ ID NO: 1070976 - RNA, 22 nt, Human
gagaggaaagaaccaaugaccc

SEQ ID NO: 1070977 - RNA, 22 nt, Human
ucgugaggcucugcaucgcaca

SEQ ID NO: 1070978 - RNA, 22 nt, Human
aaaguuagcauucucucuugcu

SEQ ID NO: 1070979 - RNA, 23 nt, Human
ucaauaacucggguuaaaauaga

SEQ ID NO: 1070980 - RNA, 19 nt, Human
agauuauugcacauucaug

SEQ ID NO: 1070981 - RNA, 22 nt, Human
ugcugaaggcaggggagguggc

SEQ ID NO: 1070982 - RNA, 22 nt, Human
guggccugccgugugguauggg

SEQ ID NO: 1070983 - RNA, 22 nt, Human
uacaguauauacuguguguaga

SEQ ID NO: 1070984 - RNA, 22 nt, Human
ugaggcuguucuaccagggcca

SEQ ID NO: 1070985 - RNA, 22 nt, Human
gaucaccaguuguagguauuuu

SEQ ID NO: 1070986 - RNA, 19 nt, Human
agguggucuaggcuggaga

SEQ ID NO: 1070987 - RNA, 22 nt, Human
ugcaggcugcagucucaggugg

SEQ ID NO: 1070988 - RNA, 22 nt, Human
gcauuacaggaauuuguuacug

SEQ ID NO: 1070989 - RNA, 22 nt, Human
ggucauuguucuuuucugugau

SEQ ID NO: 1070990 - RNA, 22 nt, Human
gcugccaugguccaggcuccag

SEQ ID NO: 1070991 - RNA, 22 nt, Human
uugcauuugagaaaguucuccu

SEQ ID NO: 1070992 - RNA, 22 nt, Human
aacacauugccagagaucagca

SEQ ID NO: 1070993 - RNA, 22 nt, Human
ugagaaauccagaugugcaguu

SEQ ID NO: 1070994 - RNA, 22 nt, Human
aagacugugucuauggcuacuc

SEQ ID NO: 1070995 - RNA, 22 nt, Human
ugaggcucagagcaccugcucc

SEQ ID NO: 1070996 - RNA, 22 nt, Human
aaucuucauguccucucuaauu

SEQ ID NO: 1070997 - RNA, 22 nt, Human
gugaggcagagaugccaaaacu

SEQ ID NO: 1070998 - RNA, 20 nt, Human
agaggcuuccuugggaggag

SEQ ID NO: 1070999 - RNA, 22 nt, Human
cggcagagugugugcgugcaug

SEQ ID NO: 1071000 - RNA, 22 nt, Human
agcugauuuuuaggagacagga

SEQ ID NO: 1071001 - RNA, 22 nt, Human
uauuuauaaucugccaaagaga

SEQ ID NO: 1071002 - RNA, 22 nt, Human
acuggaaaguugauuaugucca

SEQ ID NO: 1071003 - RNA, 22 nt, Human
aggaaagggguagguguggacg

SEQ ID NO: 1071004 - RNA, 22 nt, Human
aagucuguuugagugucacacu

SEQ ID NO: 1071005 - RNA, 22 nt, Human
aauauacuauacuacuuucugg

SEQ ID NO: 1071006 - RNA, 22 nt, Human
guaaauuauuucaagaucaucu

SEQ ID NO: 1071007 - RNA, 22 nt, Human
ccugccugucaucgccugcgcc

SEQ ID NO: 1071008 - RNA, 22 nt, Human
guucacaggguuaggaaucacu

SEQ ID NO: 1071009 - RNA, 22 nt, Human
ggcuucuccagguacugagcau

SEQ ID NO: 1071010 - RNA, 22 nt, Human
uuugaucucccagacuaaggag

SEQ ID NO: 1071011 - RNA, 22 nt, Human
ugugaggaccucagcagagucu

SEQ ID NO: 1071012 - RNA, 22 nt, Human
augcuguguggccaccuccaug

SEQ ID NO: 1071013 - RNA, 22 nt, Human
uacaaagucaccagcuucuugc

SEQ ID NO: 1071014 - RNA, 22 nt, Human
cagucucagaggugggaguggg

SEQ ID NO: 1071015 - RNA, 22 nt, Human
ucugaaauaacugaugccagau

SEQ ID NO: 1071016 - RNA, 21 nt, Human
aguguuaauggaaauuauauu

SEQ ID NO: 1071017 - RNA, 21 nt, Human
aggcccagcuuuccucuugcu

SEQ ID NO: 1071018 - RNA, 22 nt, Human
uggcagagagacucuccuugau

SEQ ID NO: 1071019 - RNA, 22 nt, Human
ugggggagccuucacaguagcu

SEQ ID NO: 1071020 - RNA, 22 nt, Human
aaaugcaauucaggaagacaag

SEQ ID NO: 1071021 - RNA, 22 nt, Human
uucuacaugguugcucagaggg

SEQ ID NO: 1071022 - RNA, 22 nt, Human
uguggugagaaacugguagauu

SEQ ID NO: 1071023 - RNA, 22 nt, Human
aaucagaauuuguccccugagu

SEQ ID NO: 1071024 - RNA, 22 nt, Human
acaucugaggagaccagccucu

SEQ ID NO: 1071025 - RNA, 22 nt, Human
ggggagugguugccugugaucc

SEQ ID NO: 1071026 - RNA, 22 nt, Human
ccacagaaugaugacacuucag

SEQ ID NO: 1071027 - RNA, 22 nt, Human
gaggccugaggcugccuggagc

SEQ ID NO: 1071028 - RNA, 22 nt, Human
cccagagucaagcuuaccauua

SEQ ID NO: 1071029 - RNA, 22 nt, Human
ggcuuccuggggccuccugcaa

SEQ ID NO: 1071030 - RNA, 22 nt, Human
gaacacuuuaacauuccuuuuc

SEQ ID NO: 1071031 - RNA, 22 nt, Human
ggggccugcgagguucaacuuc

SEQ ID NO: 1071032 - RNA, 22 nt, Human
uaaagcaauuacucaguggcuu

SEQ ID NO: 1071033 - RNA, 22 nt, Human
cuuagaaaugcagauucucagg

SEQ ID NO: 1071034 - RNA, 22 nt, Human
uacacaucucugucaguaguga

SEQ ID NO: 1071035 - RNA, 20 nt, Human
ucucuucuggggagauaaaa

SEQ ID NO: 1071036 - RNA, 19 nt, Human
gcuuuucuccuucaagcca

SEQ ID NO: 1071037 - RNA, 22 nt, Human
aaagacaguggauucaaaaucc

SEQ ID NO: 1071038 - RNA, 22 nt, Human
uggucuuuaagguagcugucau

SEQ ID NO: 1071039 - RNA, 22 nt, Human
cuccagaagacccauccucaug

SEQ ID NO: 1071040 - RNA, 22 nt, Human
ucccuuaagcaccugaguaguc

SEQ ID NO: 1071041 - RNA, 22 nt, Human
auggcagccuguggacagucaa

SEQ ID NO: 1071042 - RNA, 22 nt, Human
cagcaguggcugcaggcagcug

SEQ ID NO: 1071043 - RNA, 22 nt, Human
gaggagagagggacugucugca

SEQ ID NO: 1071044 - RNA, 22 nt, Human
ucuuugaaguugaaguaguugg

SEQ ID NO: 1071045 - RNA, 22 nt, Human
agaaacauuuagauuauauguc

SEQ ID NO: 1071046 - RNA, 22 nt, Human
uguauuuaagcuuuaccuaaaa

SEQ ID NO: 1071047 - RNA, 22 nt, Human
auauaacauacauacagaaaag

SEQ ID NO: 1071048 - RNA, 22 nt, Human
agcugacaggauggcauuauua

SEQ ID NO: 1071049 - RNA, 22 nt, Human
cagccugacaccagcuuugggc

SEQ ID NO: 1071050 - RNA, 22 nt, Human
aaugaaacucgaaauaaucaca

SEQ ID NO: 1071051 - RNA, 22 nt, Human
gauaauuuuagucugaaaauug

SEQ ID NO: 1071052 - RNA, 22 nt, Human
agagcuggcugguagcccugau

SEQ ID NO: 1071053 - RNA, 22 nt, Human
cagacuugacggcagcugcuuu

SEQ ID NO: 1071054 - RNA, 22 nt, Human
acuuuaaaaagagccuucuaac

SEQ ID NO: 1071055 - RNA, 22 nt, Human
uugggccaagugauucucugcc

SEQ ID NO: 1071056 - RNA, 22 nt, Human
ggaagaaagcacacaaacuuga

SEQ ID NO: 1071057 - RNA, 22 nt, Human
uaacacacugaaggugagaugg

SEQ ID NO: 1071058 - RNA, 22 nt, Human
gaaaguauuuacauuaacaucu

SEQ ID NO: 1071059 - RNA, 22 nt, Human
uuguccuuaccucaaucuggaa

SEQ ID NO: 1071060 - RNA, 22 nt, Human
gcagagugagauaugaacccag

SEQ ID NO: 1071061 - RNA, 19 nt, Human
aaagcagaggagcaucuga

SEQ ID NO: 1071062 - RNA, 17 nt, Human
acagagcacaucaagau

SEQ ID NO: 1071063 - RNA, 22 nt, Human
gggaagaguaacuagcccaugu

SEQ ID NO: 1071064 - RNA, 20 nt, Human
gaggcucugggcauggcgcc

SEQ ID NO: 1071065 - RNA, 22 nt, Human
uuggaaggagucaaccagcuga

SEQ ID NO: 1071066 - RNA, 22 nt, Human
gaggcucagagagguccacaua

SEQ ID NO: 1071067 - RNA, 22 nt, Human
ggagugugggauggagcucagg

SEQ ID NO: 1071068 - RNA, 19 nt, Human
aguagcagaaagugcagug

SEQ ID NO: 1071069 - RNA, 22 nt, Human
cuuggcagauccaaaaaugaca

SEQ ID NO: 1071070 - RNA, 22 nt, Human
ugugauuauuugauuaacaugu

SEQ ID NO: 1071071 - RNA, 22 nt, Human
augcagguugggcaaguguggg

SEQ ID NO: 1071072 - RNA, 22 nt, Human
uuggaccaguggauuauggugg

SEQ ID NO: 1071073 - RNA, 22 nt, Human
cagaggaagcagacacaucuug

SEQ ID NO: 1071074 - RNA, 22 nt, Human
gcccagcugcacccuggugggu

SEQ ID NO: 1071075 - RNA, 22 nt, Human
gaagcccaggcuuccuuggcuu

SEQ ID NO: 1071076 - RNA, 22 nt, Human
cugggguggauggguccaaguu

SEQ ID NO: 1071077 - RNA, 22 nt, Human
aggaagagguagcugucaaggg

SEQ ID NO: 1071078 - RNA, 22 nt, Human
cagcuagagggaugcuguguga

SEQ ID NO: 1071079 - RNA, 22 nt, Human
uuugacagcauaauccuacacc

SEQ ID NO: 1071080 - RNA, 22 nt, Human
ccuggugccacuagagaauguc

SEQ ID NO: 1071081 - RNA, 22 nt, Human
uggacaggaucugagacugaga

SEQ ID NO: 1071082 - RNA, 22 nt, Human
agugucauuccagggacccucg

SEQ ID NO: 1071083 - RNA, 22 nt, Human
cugucccucaucaccucugggu

SEQ ID NO: 1071084 - RNA, 22 nt, Human
cauggcagaaaccugagcugcu

SEQ ID NO: 1071085 - RNA, 22 nt, Human
ccucagagccuccagaaggaau

SEQ ID NO: 1071086 - RNA, 22 nt, Human
ucugacuuccuccacaucuguu

SEQ ID NO: 1071087 - RNA, 22 nt, Human
uuuauaaaauagacugggucua

SEQ ID NO: 1071088 - RNA, 22 nt, Human
uacagaauguuaugaagcauag

SEQ ID NO: 1071089 - RNA, 22 nt, Human
uuggaaaagugaaacuagaugc

SEQ ID NO: 1071090 - RNA, 22 nt, Human
ucauuguuauguuuugcugucu

SEQ ID NO: 1071091 - RNA, 22 nt, Human
cugggcuccacuacuugcuaac

SEQ ID NO: 1071092 - RNA, 22 nt, Human
cuggccuggagccucugggugg

SEQ ID NO: 1071093 - RNA, 22 nt, Human
cagcuguugugcugggcaguua

SEQ ID NO: 1071094 - RNA, 22 nt, Human
uuaauauguugaaauuuauuag

SEQ ID NO: 1071095 - RNA, 22 nt, Human
uucuuuaugcuucuguuuaggc

SEQ ID NO: 1071096 - RNA, 22 nt, Human
cugcaggcucgaagacacggau

SEQ ID NO: 1071097 - RNA, 22 nt, Human
ugaaugaaugaauuaauagagu

SEQ ID NO: 1071098 - RNA, 22 nt, Human
augaagauaagaccaggcugga

SEQ ID NO: 1071099 - RNA, 22 nt, Human
agcugucuaccugcagaguccu

SEQ ID NO: 1071100 - RNA, 22 nt, Human
agcccugcucaucuggaucccg

SEQ ID NO: 1071101 - RNA, 22 nt, Human
caggacagguguucuagaucag

SEQ ID NO: 1071102 - RNA, 22 nt, Human
gugccugggguugagcuaugaa

SEQ ID NO: 1071103 - RNA, 22 nt, Human
cugugccuuuguagcugugccu

SEQ ID NO: 1071104 - RNA, 22 nt, Human
uuucuggacagcaagaucaguu

SEQ ID NO: 1071105 - RNA, 22 nt, Human
cacacaugucucuccaugcucu

SEQ ID NO: 1071106 - RNA, 22 nt, Human
ggaggguggcagcguccugggc

SEQ ID NO: 1071107 - RNA, 22 nt, Human
ccugggcuugcaucugugcugg

SEQ ID NO: 1071108 - RNA, 22 nt, Human
uucuuacuaguauguuucagca

SEQ ID NO: 1071109 - RNA, 22 nt, Human
ugguggccuugauggcaucugc

SEQ ID NO: 1071110 - RNA, 22 nt, Human
cacauuuaucuguucuuucuag

SEQ ID NO: 1071111 - RNA, 17 nt, Human
ucagggaaugagguugu

SEQ ID NO: 1071112 - RNA, 22 nt, Human
aagaauaaauuaagauacuuag

SEQ ID NO: 1071113 - RNA, 22 nt, Human
gaacaacuuugaaacaugaaga

SEQ ID NO: 1071114 - RNA, 22 nt, Human
uuugucuucauccuucgagcug

SEQ ID NO: 1071115 - RNA, 22 nt, Human
auuacugagcuuguagcugcau

SEQ ID NO: 1071116 - RNA, 22 nt, Human
caggaacaacucccagcaucuc

SEQ ID NO: 1071117 - RNA, 22 nt, Human
cuggcagcgguuugcagccugg

SEQ ID NO: 1071118 - RNA, 22 nt, Human
cuguacaggagacgucugugca

SEQ ID NO: 1071119 - RNA, 22 nt, Human
ccucagggacuccaugcugcag

SEQ ID NO: 1071120 - RNA, 23 nt, Human
aauauauguguuuuucugcuuca

SEQ ID NO: 1071121 - RNA, 22 nt, Human
uuauaauugcuuauuagaccca

SEQ ID NO: 1071122 - RNA, 22 nt, Human
ucagcagggaggcucugugccc

SEQ ID NO: 1071123 - RNA, 22 nt, Human
ugggcugagaguaccuuauaaa

SEQ ID NO: 1071124 - RNA, 22 nt, Human
agaggcuccaccuucucugucc

SEQ ID NO: 1071125 - RNA, 22 nt, Human
uuacagauacauuucuuuuguu

SEQ ID NO: 1071126 - RNA, 22 nt, Human
uauuagguuggugcaaaaagua

SEQ ID NO: 1071127 - RNA, 22 nt, Human
ucaguggagcuaagcaugagau

SEQ ID NO: 1071128 - RNA, 22 nt, Human
aacaacaacggagaaaggguug

SEQ ID NO: 1071129 - RNA, 22 nt, Human
agggucagagucaggugcagua

SEQ ID NO: 1071130 - RNA, 22 nt, Human
acuuccagugucugcugcuagc

SEQ ID NO: 1071131 - RNA, 22 nt, Human
ggcugagacuagagugaggcau

SEQ ID NO: 1071132 - RNA, 22 nt, Human
uucuaugccauguucagcuacu

SEQ ID NO: 1071133 - RNA, 22 nt, Human
uucauacucacuccaauaacug

SEQ ID NO: 1071134 - RNA, 21 nt, Human
gccugcuguucacccugccac

SEQ ID NO: 1071135 - RNA, 22 nt, Human
ucauuuaucgcugccuuuuaaa

SEQ ID NO: 1071136 - RNA, 22 nt, Human
ugggcugcccugaugguccuca

SEQ ID NO: 1071137 - RNA, 22 nt, Human
uuuucuuauggugaagcacaaa

SEQ ID NO: 1071138 - RNA, 22 nt, Human
cccaggaguuugaguucagcau

SEQ ID NO: 1071139 - RNA, 22 nt, Human
ugccugugcccuucuuggcauu

SEQ ID NO: 1071140 - RNA, 22 nt, Human
cccaccaguacagaugguagau

SEQ ID NO: 1071141 - RNA, 17 nt, Human
ggcuuuagggacaccac

SEQ ID NO: 1071142 - RNA, 22 nt, Human
aaaagagaguugccagucugua

SEQ ID NO: 1071143 - RNA, 22 nt, Human
gcugcucuccauggccgugagu

SEQ ID NO: 1071144 - RNA, 22 nt, Human
acagguccucaagucagcuggg

SEQ ID NO: 1071145 - RNA, 22 nt, Human
ucuaaacucucuuugaauuaug

SEQ ID NO: 1071146 - RNA, 22 nt, Human
ucccucagcuugucuccaugca

SEQ ID NO: 1071147 - RNA, 22 nt, Human
caggagauguaccuguuuuuga

SEQ ID NO: 1071148 - RNA, 22 nt, Human
auucuagaaggcaaagcaaggg

SEQ ID NO: 1071149 - RNA, 22 nt, Human
ucugacuuauuuguccuuggug

SEQ ID NO: 1071150 - RNA, 22 nt, Human
ucagggaaucagacucugcagc

SEQ ID NO: 1071151 - RNA, 20 nt, Human
aguguuccggaagacuggca

SEQ ID NO: 1071152 - RNA, 22 nt, Human
uccucauugucacuggcccgca

SEQ ID NO: 1071153 - RNA, 22 nt, Human
uuuggcacagcuucccagacuu

SEQ ID NO: 1071154 - RNA, 22 nt, Human
aaggcugagacagcacaggucc

SEQ ID NO: 1071155 - RNA, 22 nt, Human
augcaaauugccauaaaguggg

SEQ ID NO: 1071156 - RNA, 22 nt, Human
gaaagcagaugaaauugcaaca

SEQ ID NO: 1071157 - RNA, 22 nt, Human
uggcagaguuauggguauuuau

SEQ ID NO: 1071158 - RNA, 22 nt, Human
acuuuguugaagaauauguuag

SEQ ID NO: 1071159 - RNA, 22 nt, Human
ugcaccauguaaguggccacgu

SEQ ID NO: 1071160 - RNA, 22 nt, Human
aguuuucacacucaccaaaagg

SEQ ID NO: 1071161 - RNA, 22 nt, Human
auuacacagcgguuacuacuag

SEQ ID NO: 1071162 - RNA, 22 nt, Human
aacaucacaauuucauuuaugc

SEQ ID NO: 1071163 - RNA, 22 nt, Human
acccagaggcggagguugcagu

SEQ ID NO: 1071164 - RNA, 22 nt, Human
uggcucagccagcccuaggaac

SEQ ID NO: 1071165 - RNA, 22 nt, Human
gagggaaagguuaauacaugau

SEQ ID NO: 1071166 - RNA, 22 nt, Human
augugcaaauuauuuugccaga

SEQ ID NO: 1071167 - RNA, 22 nt, Human
uuucuucaguaacacaaaccau

SEQ ID NO: 1071168 - RNA, 22 nt, Human
acagaacugcagacagugccaa

SEQ ID NO: 1071169 - RNA, 22 nt, Human
aaggaagaugaggugcugcuua

SEQ ID NO: 1071170 - RNA, 22 nt, Human
uuuccuaacacaaugcaugaga

SEQ ID NO: 1071171 - RNA, 21 nt, Human
agcucccuguuuccucacucu

SEQ ID NO: 1071172 - RNA, 22 nt, Human
cccuggccagggcacagggagg

SEQ ID NO: 1071173 - RNA, 22 nt, Human
uuauuuucuccucagaaagugg

SEQ ID NO: 1071174 - RNA, 22 nt, Human
guggcugggcuccgagcggcuu

SEQ ID NO: 1071175 - RNA, 22 nt, Human
aguggagaagaggauggucucc

SEQ ID NO: 1071176 - RNA, 22 nt, Human
ugaaaugucauccuuuagccau

SEQ ID NO: 1071177 - RNA, 22 nt, Human
cuuggcaggguggaggaugcag

SEQ ID NO: 1071178 - RNA, 22 nt, Human
caguuuuauugguugaaaucug

SEQ ID NO: 1071179 - RNA, 22 nt, Human
uuucugaaaugcuggcuuugga

SEQ ID NO: 1071180 - RNA, 22 nt, Human
gagcugccuacauugccaagag

SEQ ID NO: 1071181 - RNA, 22 nt, Human
caaagaugucauugguaagaca

SEQ ID NO: 1071182 - RNA, 17 nt, Human
agagagaaaagggccau

SEQ ID NO: 1071183 - RNA, 22 nt, Human
uucugaggcacuggcucuccca

SEQ ID NO: 1071184 - RNA, 22 nt, Human
uccucaggaucuaggagugcuu

SEQ ID NO: 1071185 - RNA, 20 nt, Human
uccugagccuccaccauguc

SEQ ID NO: 1071186 - RNA, 23 nt, Human
cugguucauagucaagagauuga

SEQ ID NO: 1071187 - RNA, 22 nt, Human
aucaaauaaagguaccuagcuu

SEQ ID NO: 1071188 - RNA, 22 nt, Human
auuguacaugcagugagucauc

SEQ ID NO: 1071189 - RNA, 22 nt, Human
ugggccugaaauucccauuuua

SEQ ID NO: 1071190 - RNA, 22 nt, Human
auccucaguguuucugacaucu

SEQ ID NO: 1071191 - RNA, 22 nt, Human
agagaugggaaggcagacuuca

SEQ ID NO: 1071192 - RNA, 22 nt, Human
aaggccaggagacuuggaguca

SEQ ID NO: 1071193 - RNA, 22 nt, Human
caucuuuguaacuuccacauaa

SEQ ID NO: 1071194 - RNA, 20 nt, Human
uuuccuuucauuuuaguacc

SEQ ID NO: 1071195 - RNA, 22 nt, Human
ggagccuggucagguuggcucc

SEQ ID NO: 1071196 - RNA, 22 nt, Human
gcuugcauucuggaucuauggu

SEQ ID NO: 1071197 - RNA, 22 nt, Human
gcaaagcugggugugaaugcac

SEQ ID NO: 1071198 - RNA, 21 nt, Human
ggcugggucaugcagcuggcc

SEQ ID NO: 1071199 - RNA, 22 nt, Human
uuguaacucugaauacauccua

SEQ ID NO: 1071200 - RNA, 22 nt, Human
gaauguuucauguguauguuag

SEQ ID NO: 1071201 - RNA, 21 nt, Human
ugcaggagucugugagucagg

SEQ ID NO: 1071202 - RNA, 22 nt, Human
uggccugggugcugcugacauc

SEQ ID NO: 1071203 - RNA, 22 nt, Human
acuuuucucccuccugccuuca

SEQ ID NO: 1071204 - RNA, 22 nt, Human
uucauacaaugggauauuauga

SEQ ID NO: 1071205 - RNA, 22 nt, Human
ugcugggcaucguaggagguac

SEQ ID NO: 1071206 - RNA, 20 nt, Human
acaguguuagguuuuuccuu

SEQ ID NO: 1071207 - RNA, 22 nt, Human
uccucccugcacucagugaagu

SEQ ID NO: 1071208 - RNA, 22 nt, Human
cugagccacugcuuguucagug

SEQ ID NO: 1071209 - RNA, 22 nt, Human
cccuggagggcagacagaugcc

SEQ ID NO: 1071210 - RNA, 22 nt, Human
aaaucagugcucauuugaaagg

SEQ ID NO: 1071211 - RNA, 22 nt, Human
gucagagcugugcaaggcugag

SEQ ID NO: 1071212 - RNA, 22 nt, Human
gaaagcacuaaaagagaauccu

SEQ ID NO: 1071213 - RNA, 22 nt, Human
caguagcagggauuauuuuagg

SEQ ID NO: 1071214 - RNA, 17 nt, Human
agaacuguaguagcucc

SEQ ID NO: 1071215 - RNA, 22 nt, Human
aucagaagcuuguagucucucu

SEQ ID NO: 1071216 - RNA, 21 nt, Human
acaauagacauaagcagagca

SEQ ID NO: 1071217 - RNA, 22 nt, Human
auguuuaugaccuccauaagga

SEQ ID NO: 1071218 - RNA, 22 nt, Human
caggggccuggcugucuaggaa

SEQ ID NO: 1071219 - RNA, 22 nt, Human
uggcacagggcuuggucgcuca

SEQ ID NO: 1071220 - RNA, 22 nt, Human
aaacauucucagcccugcuugc

SEQ ID NO: 1071221 - RNA, 22 nt, Human
ugaaacuaggccaaucaaauua

SEQ ID NO: 1071222 - RNA, 22 nt, Human
gcucaggaccgaggggugggaa

SEQ ID NO: 1071223 - RNA, 22 nt, Human
auuacaauaagguuuauuugua

SEQ ID NO: 1071224 - RNA, 22 nt, Human
guuucuuaauagcaggggccaa

SEQ ID NO: 1071225 - RNA, 20 nt, Human
ccuggagccuggaaggaguc

SEQ ID NO: 1071226 - RNA, 22 nt, Human
ugugaaggcagagccagugaaa

SEQ ID NO: 1071227 - RNA, 22 nt, Human
ggcccugggcagaggagugggc

SEQ ID NO: 1071228 - RNA, 22 nt, Human
uauguagacuucauuguuuacu

SEQ ID NO: 1071229 - RNA, 22 nt, Human
ugaugguugauuauaaaucagu

SEQ ID NO: 1071230 - RNA, 22 nt, Human
ccucugagucaugcgcauagga

SEQ ID NO: 1071231 - RNA, 21 nt, Human
ucuuuuccuuucugugugcaa

SEQ ID NO: 1071232 - RNA, 22 nt, Human
aaaaagagaaaugcucuagucc

SEQ ID NO: 1071233 - RNA, 22 nt, Human
caaauacuggguaaguuaauuu

SEQ ID NO: 1071234 - RNA, 22 nt, Human
ugucuccuacugccuguggauc

SEQ ID NO: 1071235 - RNA, 22 nt, Human
ggcagcucugugucugggaagc

SEQ ID NO: 1071236 - RNA, 22 nt, Human
gcaggcaguuauuuaguagaau

SEQ ID NO: 1071237 - RNA, 22 nt, Human
aacagugagaagguggacagga

SEQ ID NO: 1071238 - RNA, 22 nt, Human
gcagggcacaaggacgcacagg

SEQ ID NO: 1071239 - RNA, 19 nt, Human
aggagaaguagcagaaauu

SEQ ID NO: 1071240 - RNA, 22 nt, Human
uucaacuuuaugcauauguauu

SEQ ID NO: 1071241 - RNA, 22 nt, Human
acauuugagcauauuucuuguc

SEQ ID NO: 1071242 - RNA, 22 nt, Human
gcaaaguauuaaguauuaaguu

SEQ ID NO: 1071243 - RNA, 22 nt, Human
acugcuuuaucugagaaguccu

SEQ ID NO: 1071244 - RNA, 22 nt, Human
aggccuguuggcgugggcucua

SEQ ID NO: 1071245 - RNA, 22 nt, Human
ucaugcuuuggguuagaaaccu

SEQ ID NO: 1071246 - RNA, 22 nt, Human
ugaaaucuccucuuuauauauc

SEQ ID NO: 1071247 - RNA, 22 nt, Human
agagguagagguugcagugagc

SEQ ID NO: 1071248 - RNA, 22 nt, Human
caggggccaaggguccagaccu

SEQ ID NO: 1071249 - RNA, 22 nt, Human
acacauuucucuuuuuguaagu

SEQ ID NO: 1071250 - RNA, 22 nt, Human
ugcaggcuggggaggcagacuu

SEQ ID NO: 1071251 - RNA, 22 nt, Human
cugcccugcccaggccuugggc

SEQ ID NO: 1071252 - RNA, 21 nt, Human
guuugcaugaacaagucagcc

SEQ ID NO: 1071253 - RNA, 20 nt, Human
ggucccugcccucugucauc

SEQ ID NO: 1071254 - RNA, 22 nt, Human
cagccaggccuggugaccaaag

SEQ ID NO: 1071255 - RNA, 22 nt, Human
gaggaagaugguugaguggucc

SEQ ID NO: 1071256 - RNA, 22 nt, Human
uggcagcaauuugugauguuga

SEQ ID NO: 1071257 - RNA, 22 nt, Human
cugaagcaauugagagauguuu

SEQ ID NO: 1071258 - RNA, 22 nt, Human
cugugucuaaucaggucaguca

SEQ ID NO: 1071259 - RNA, 22 nt, Human
gccugggaacucugaucuccug

SEQ ID NO: 1071260 - RNA, 22 nt, Human
auguggaggaaaugaguguaca

SEQ ID NO: 1071261 - RNA, 22 nt, Human
uaaagcagccagggucuaagcc

SEQ ID NO: 1071262 - RNA, 22 nt, Human
uuugaaagcaccauuugaguag

SEQ ID NO: 1071263 - RNA, 22 nt, Human
aucugcuugcccucuuaggacc

SEQ ID NO: 1071264 - RNA, 22 nt, Human
ccaugccccaauacaggacacc

SEQ ID NO: 1071265 - RNA, 20 nt, Human
cugcugugguccuuuauuuu

SEQ ID NO: 1071266 - RNA, 22 nt, Human
aaauauuagggagaacagggac

SEQ ID NO: 1071267 - RNA, 22 nt, Human
agucccagcucagaaccacuag

SEQ ID NO: 1071268 - RNA, 22 nt, Human
ugaaagguagcuggccucauag

SEQ ID NO: 1071269 - RNA, 22 nt, Human
cucuggagaacgcuauggaucu

SEQ ID NO: 1071270 - RNA, 22 nt, Human
uuuacauggaauauugucuugu

SEQ ID NO: 1071271 - RNA, 22 nt, Human
cagcagcugggaaggaggcuga

SEQ ID NO: 1071272 - RNA, 22 nt, Human
uggcugcucaagggaggaggcu

SEQ ID NO: 1071273 - RNA, 22 nt, Human
caaagaagagauuuacagagcu

SEQ ID NO: 1071274 - RNA, 22 nt, Human
cugccugcacugccuggcucca

SEQ ID NO: 1071275 - RNA, 22 nt, Human
caggcccagugaucagggcucu

SEQ ID NO: 1071276 - RNA, 22 nt, Human
gcacacccucucaccagcacug

SEQ ID NO: 1071277 - RNA, 22 nt, Human
aaugaaaauuggacccuagaac

SEQ ID NO: 1071278 - RNA, 22 nt, Human
uuugaaaagaaccaucgccuua

SEQ ID NO: 1071279 - RNA, 22 nt, Human
ucaggcagaggauggggagcgu

SEQ ID NO: 1071280 - RNA, 22 nt, Human
ggaguucacugugcaggcucug

SEQ ID NO: 1071281 - RNA, 22 nt, Human
ggaagccccagacccagagucu

SEQ ID NO: 1071282 - RNA, 22 nt, Human
gaaauucaaauaagauauguag

SEQ ID NO: 1071283 - RNA, 22 nt, Human
cacagaauuaagggagaaauau

SEQ ID NO: 1071284 - RNA, 22 nt, Human
gugugcagucugcuaggcaggg

SEQ ID NO: 1071285 - RNA, 22 nt, Human
cugggccauggaagucucugcc

SEQ ID NO: 1071286 - RNA, 22 nt, Human
gcagcuuggugaaaggugaugg

SEQ ID NO: 1071287 - RNA, 22 nt, Human
gcagaugaggaagcuaaugcug

SEQ ID NO: 1071288 - RNA, 22 nt, Human
ucagauggcauagguuggaauu

SEQ ID NO: 1071289 - RNA, 22 nt, Human
ccaggagcagccggcccaccug

SEQ ID NO: 1071290 - RNA, 22 nt, Human
cauugcaccacauugcaucccu

SEQ ID NO: 1071291 - RNA, 22 nt, Human
gcuucuggaagcauaugcaaga

SEQ ID NO: 1071292 - RNA, 22 nt, Human
uucaagguaugguagcugguca

SEQ ID NO: 1071293 - RNA, 22 nt, Human
gcagagccaggagcccaggauc

SEQ ID NO: 1071294 - RNA, 22 nt, Human
ugccagggcugcuacuggcuga

SEQ ID NO: 1071295 - RNA, 22 nt, Human
agcagggcuggauuuggcaaga

SEQ ID NO: 1071296 - RNA, 22 nt, Human
ucagaagucccagaauucacau

SEQ ID NO: 1071297 - RNA, 22 nt, Human
cgcaccacugaauuccagccug

SEQ ID NO: 1071298 - RNA, 22 nt, Human
cuggccuuuuguuucuggagaa

SEQ ID NO: 1071299 - RNA, 22 nt, Human
acagcagcacuauugacauuuu

SEQ ID NO: 1071300 - RNA, 22 nt, Human
ccaggccugauugggaaucuug

SEQ ID NO: 1071301 - RNA, 22 nt, Human
ugcagagguguugcugagauaa

SEQ ID NO: 1071302 - RNA, 22 nt, Human
ucauucuuuaccaaguugucac

SEQ ID NO: 1071303 - RNA, 22 nt, Human
ucuuggaagccucaagauacuc

SEQ ID NO: 1071304 - RNA, 22 nt, Human
gcaguaaaaaaggauaugugca

SEQ ID NO: 1071305 - RNA, 22 nt, Human
gccauuaacaagaauauaguag

SEQ ID NO: 1071306 - RNA, 22 nt, Human
gccaggaauggagagguggccu

SEQ ID NO: 1071307 - RNA, 22 nt, Human
gaggagaaagcagugauuugug

SEQ ID NO: 1071308 - RNA, 22 nt, Human
gcucugaggcugugaggugcug

SEQ ID NO: 1071309 - RNA, 22 nt, Human
cagcucccagagugaccagcag

SEQ ID NO: 1071310 - RNA, 22 nt, Human
cugguucaauacuaaacuucuu

SEQ ID NO: 1071311 - RNA, 22 nt, Human
aaugcuuugauugauuaaaaca

SEQ ID NO: 1071312 - RNA, 19 nt, Human
uuucacaaagagagcguga

SEQ ID NO: 1071313 - RNA, 22 nt, Human
uggagaagauuggucaccauuc

SEQ ID NO: 1071314 - RNA, 21 nt, Human
uccaggggccagcacccaagc

SEQ ID NO: 1071315 - RNA, 22 nt, Human
uuacacacaauuagcauaguaa

SEQ ID NO: 1071316 - RNA, 22 nt, Human
uagcagagagguuucagcuaau

SEQ ID NO: 1071317 - RNA, 22 nt, Human
uggucaggcugcucugcggcgu

SEQ ID NO: 1071318 - RNA, 22 nt, Human
cugcuuuguaaaauagacauaa

SEQ ID NO: 1071319 - RNA, 22 nt, Human
ugcuuuggaucuauuugcugag

SEQ ID NO: 1071320 - RNA, 22 nt, Human
uggagggcaucuguggucaggc

SEQ ID NO: 1071321 - RNA, 22 nt, Human
caggcagcugggucaccguccc

SEQ ID NO: 1071322 - RNA, 19 nt, Human
agggaguuuauauuugcac

SEQ ID NO: 1071323 - RNA, 22 nt, Human
gggauuugugggauggccagug

SEQ ID NO: 1071324 - RNA, 21 nt, Human
ugaaacaaucagacagagucu

SEQ ID NO: 1071325 - RNA, 20 nt, Human
gcacugaaauucaauguuug

SEQ ID NO: 1071326 - RNA, 21 nt, Human
uccuucaguucugcacuuucu

SEQ ID NO: 1071327 - RNA, 22 nt, Human
uaaacuacugggcaaggacagg

SEQ ID NO: 1071328 - RNA, 22 nt, Human
ugcuuccaguuccucaccacau

SEQ ID NO: 1071329 - RNA, 22 nt, Human
acacauauauuugcauauacac

SEQ ID NO: 1071330 - RNA, 22 nt, Human
aucuggcugcugugcuuaagcu

SEQ ID NO: 1071331 - RNA, 22 nt, Human
gcccucagaguuccccacagug

SEQ ID NO: 1071332 - RNA, 22 nt, Human
aucccaugagaccacguuggcu

SEQ ID NO: 1071333 - RNA, 22 nt, Human
aguggcaguggggcagggcccu

SEQ ID NO: 1071334 - RNA, 22 nt, Human
gaggugagaagggggucagaug

SEQ ID NO: 1071335 - RNA, 22 nt, Human
aaauaucauucuggugcacaga

SEQ ID NO: 1071336 - RNA, 22 nt, Human
aaggcacucagccuugggacag

SEQ ID NO: 1071337 - RNA, 22 nt, Human
gccagguggucuggcuccagag

SEQ ID NO: 1071338 - RNA, 22 nt, Human
cucucugugguggcugucccau

SEQ ID NO: 1071339 - RNA, 22 nt, Human
agcaggaaagaaaaaucugugu

SEQ ID NO: 1071340 - RNA, 22 nt, Human
ggcaggguggcagaggcucaga

SEQ ID NO: 1071341 - RNA, 22 nt, Human
gccaggcauuuguuaggugcug

SEQ ID NO: 1071342 - RNA, 22 nt, Human
cagaaauagacaauggcagugg

SEQ ID NO: 1071343 - RNA, 22 nt, Human
uucugauugcugaugaggccca

SEQ ID NO: 1071344 - RNA, 22 nt, Human
gcucagacucuggccugaugau

SEQ ID NO: 1071345 - RNA, 22 nt, Human
gggguggauuucaggcgguguc

SEQ ID NO: 1071346 - RNA, 22 nt, Human
uuguacuugccauagaacaaca

SEQ ID NO: 1071347 - RNA, 21 nt, Human
ugacauuuccaauauaaagcc

SEQ ID NO: 1071348 - RNA, 19 nt, Human
acaggcagaauugggugug

SEQ ID NO: 1071349 - RNA, 22 nt, Human
gagcugugagggacacauugcu

SEQ ID NO: 1071350 - RNA, 22 nt, Human
ggccugcugcuaugacuuccug

SEQ ID NO: 1071351 - RNA, 22 nt, Human
ucacaggaaccaucagagaaau

SEQ ID NO: 1071352 - RNA, 22 nt, Human
uuuggaaaaagacagcuuauga

SEQ ID NO: 1071353 - RNA, 22 nt, Human
uauagaaguaagcauugugaug

SEQ ID NO: 1071354 - RNA, 22 nt, Human
aaauuucaagcaaaguagcuau

SEQ ID NO: 1071355 - RNA, 21 nt, Human
aagcaggacauaugaugcccu

SEQ ID NO: 1071356 - RNA, 22 nt, Human
ucugcaggaaaaaagugccugg

SEQ ID NO: 1071357 - RNA, 22 nt, Human
agaaaauauucauugagaggcu

SEQ ID NO: 1071358 - RNA, 22 nt, Human
gucaccagcaccaaugccacau

SEQ ID NO: 1071359 - RNA, 22 nt, Human
acagagcuuaggaugacuccca

SEQ ID NO: 1071360 - RNA, 20 nt, Human
cucaguguggccugaguguu

SEQ ID NO: 1071361 - RNA, 22 nt, Human
aaaggaagugccacucuucuuc

SEQ ID NO: 1071362 - RNA, 22 nt, Human
ucaauucaguccaacaguaauu

SEQ ID NO: 1071363 - RNA, 22 nt, Human
ugucucugugagaucugacgau

SEQ ID NO: 1071364 - RNA, 20 nt, Human
gcuuuuucuaauagcagucc

SEQ ID NO: 1071365 - RNA, 22 nt, Human
cauaacaguggcuucagcaagu

SEQ ID NO: 1071366 - RNA, 22 nt, Human
uuuccacuccuauugcaucuca

SEQ ID NO: 1071367 - RNA, 22 nt, Human
cuuuccaaugcauuuccaaugu

SEQ ID NO: 1071368 - RNA, 22 nt, Human
aaaggaaugagcuucuguuagg

SEQ ID NO: 1071369 - RNA, 22 nt, Human
ugagauaauacuucuuagcugg

SEQ ID NO: 1071370 - RNA, 22 nt, Human
aaacuaagggagaugugggcug

SEQ ID NO: 1071371 - RNA, 19 nt, Human
uagucuuuauucuuaauuu

SEQ ID NO: 1071372 - RNA, 22 nt, Human
agucccagaugacccagcuacu

SEQ ID NO: 1071373 - RNA, 22 nt, Human
uuuacagaugaggauacugagg

SEQ ID NO: 1071374 - RNA, 22 nt, Human
ugggagcagcuuugcgagggag

SEQ ID NO: 1071375 - RNA, 22 nt, Human
cagacacagcaauucuguguug

SEQ ID NO: 1071376 - RNA, 22 nt, Human
cauguacaguuuuucuguccug

SEQ ID NO: 1071377 - RNA, 22 nt, Human
caacuacuggugcucaggaaau

SEQ ID NO: 1071378 - RNA, 19 nt, Human
gacuccaacuuuaagcaug

SEQ ID NO: 1071379 - RNA, 22 nt, Human
uauaucauggagauuaacauuc

SEQ ID NO: 1071380 - RNA, 21 nt, Human
ugauccuuucccccauguugc

SEQ ID NO: 1071381 - RNA, 22 nt, Human
ucucagggaccaugaugaugac

SEQ ID NO: 1071382 - RNA, 22 nt, Human
ucauaaacacacuaguaugauu

SEQ ID NO: 1071383 - RNA, 20 nt, Human
acaggagaucugaggaaagg

SEQ ID NO: 1071384 - RNA, 22 nt, Human
aguuuuauaucuuccauugguu

SEQ ID NO: 1071385 - RNA, 21 nt, Human
cagagguggccugaccucuga

SEQ ID NO: 1071386 - RNA, 22 nt, Human
aaauauaguaaaugcauaguuc

SEQ ID NO: 1071387 - RNA, 22 nt, Human
gaaaucuacuuagugucuggau

SEQ ID NO: 1071388 - RNA, 22 nt, Human
uggaggaaguugcuggaaguca

SEQ ID NO: 1071389 - RNA, 22 nt, Human
cagcugaguuuccaagucugcc

SEQ ID NO: 1071390 - RNA, 22 nt, Human
gaaauuaaccaccuuuggcuuu

SEQ ID NO: 1071391 - RNA, 22 nt, Human
cugaacucaugauaugcuuuug

SEQ ID NO: 1071392 - RNA, 22 nt, Human
uaacacagaguaaguggucaau

SEQ ID NO: 1071393 - RNA, 18 nt, Human
caggaugagugaugggga

SEQ ID NO: 1071394 - RNA, 22 nt, Human
uugcauucuguuaaaauguauu

SEQ ID NO: 1071395 - RNA, 21 nt, Human
ugggaugggucugggaccagc

SEQ ID NO: 1071396 - RNA, 22 nt, Human
guauuuuuaguagagucggggu

SEQ ID NO: 1071397 - RNA, 17 nt, Human
ucuggccuuccugaacu

SEQ ID NO: 1071398 - RNA, 22 nt, Human
uaaaggguagguuuuacuguaa

SEQ ID NO: 1071399 - RNA, 20 nt, Human
auagaaguauuauguaaugu

SEQ ID NO: 1071400 - RNA, 17 nt, Human
acaagcaguggccaugg

SEQ ID NO: 1071401 - RNA, 22 nt, Human
ccaucacaguccccaucgugau

SEQ ID NO: 1071402 - RNA, 22 nt, Human
gggcaggaggcuaauucugcau

SEQ ID NO: 1071403 - RNA, 22 nt, Human
cagaauggcuuuuauggcucag

SEQ ID NO: 1071404 - RNA, 22 nt, Human
ccaggcucugagaggaauguga

SEQ ID NO: 1071405 - RNA, 22 nt, Human
agggaggcaggaaaguugucug

SEQ ID NO: 1071406 - RNA, 22 nt, Human
aggcaggggagcuggaagggua

SEQ ID NO: 1071407 - RNA, 22 nt, Human
ccacuguaguuaugaugaaguu

SEQ ID NO: 1071408 - RNA, 22 nt, Human
ucugagcuuuuauuaucaaccu

SEQ ID NO: 1071409 - RNA, 22 nt, Human
ccaggcucuguuccccgaggag

SEQ ID NO: 1071410 - RNA, 22 nt, Human
aguuucauauuaccaugucacc

SEQ ID NO: 1071411 - RNA, 22 nt, Human
auauuaaugggauuuagucagg

SEQ ID NO: 1071412 - RNA, 22 nt, Human
cccuccagcucaaagcaaccgg

SEQ ID NO: 1071413 - RNA, 22 nt, Human
aacauuuaugguagucauugca

SEQ ID NO: 1071414 - RNA, 22 nt, Human
agugaaauuccuggucuuuguu

SEQ ID NO: 1071415 - RNA, 22 nt, Human
agucaacauuugagaugcaaug

SEQ ID NO: 1071416 - RNA, 22 nt, Human
aaugucacauacaauggcaagu

SEQ ID NO: 1071417 - RNA, 22 nt, Human
aacuuuagaaaggaaggaagug

SEQ ID NO: 1071418 - RNA, 22 nt, Human
cauuuaguccuugacuucucuc

SEQ ID NO: 1071419 - RNA, 20 nt, Human
gcauugaguauagacagaug

SEQ ID NO: 1071420 - RNA, 22 nt, Human
uaagucauuaggcugaguucaa

SEQ ID NO: 1071421 - RNA, 22 nt, Human
gccaggcgggucucaaacuccu

SEQ ID NO: 1071422 - RNA, 22 nt, Human
uucacaaucuggcuuagcauug

SEQ ID NO: 1071423 - RNA, 22 nt, Human
gaggccucugucccaccaggga

SEQ ID NO: 1071424 - RNA, 22 nt, Human
uccuuuuuaagucguuguggua

SEQ ID NO: 1071425 - RNA, 19 nt, Human
acagacauuugcaauuagc

SEQ ID NO: 1071426 - RNA, 22 nt, Human
gugacucacacaggccugggcu

SEQ ID NO: 1071427 - RNA, 22 nt, Human
agggggcccuugcaggugagcg

SEQ ID NO: 1071428 - RNA, 22 nt, Human
auuuuuccaauuaggauaaaga

SEQ ID NO: 1071429 - RNA, 22 nt, Human
caaagugcuggaauuacaggug

SEQ ID NO: 1071430 - RNA, 22 nt, Human
agauuaucuccugauuuuaagg

SEQ ID NO: 1071431 - RNA, 18 nt, Human
aggcaggauccuggccuc

SEQ ID NO: 1071432 - RNA, 22 nt, Human
gcacaacaccaagggagguauc

SEQ ID NO: 1071433 - RNA, 22 nt, Human
gugugcagaagacacaagacau

SEQ ID NO: 1071434 - RNA, 22 nt, Human
gcaugggcaccagucucuaggu

SEQ ID NO: 1071435 - RNA, 22 nt, Human
uucacagccucugccccaggca

SEQ ID NO: 1071436 - RNA, 22 nt, Human
guacaauaacuagucuuauagu

SEQ ID NO: 1071437 - RNA, 22 nt, Human
ccaguccacgucaagaagaggu

SEQ ID NO: 1071438 - RNA, 22 nt, Human
gugaucuuguaauugggcaaug

SEQ ID NO: 1071439 - RNA, 22 nt, Human
ccucccagugccuccagagcag

SEQ ID NO: 1071440 - RNA, 22 nt, Human
agacaauggaccaagcaccuuc

SEQ ID NO: 1071441 - RNA, 22 nt, Human
ugucaugcccaggagcaaggua

SEQ ID NO: 1071442 - RNA, 22 nt, Human
aaaguucuggagaaaauaauga

SEQ ID NO: 1071443 - RNA, 22 nt, Human
auacaaguugugauaauguaaa

SEQ ID NO: 1071444 - RNA, 22 nt, Human
caguauuuaggauuaggagaga

SEQ ID NO: 1071445 - RNA, 22 nt, Human
gggcaguggguggcugcagccu

SEQ ID NO: 1071446 - RNA, 22 nt, Human
ugccagagaagacccagucacu

SEQ ID NO: 1071447 - RNA, 22 nt, Human
acccacaccuccguauaucacu

SEQ ID NO: 1071448 - RNA, 22 nt, Human
cagagaaagacuugcccuuagu

SEQ ID NO: 1071449 - RNA, 22 nt, Human
gaggaaacauuguagaagcagu

SEQ ID NO: 1071450 - RNA, 22 nt, Human
uacaucuuugucuaugaccagc

SEQ ID NO: 1071451 - RNA, 23 nt, Human
uuuuaauuuggacauaagaagau

SEQ ID NO: 1071452 - RNA, 22 nt, Human
cugugccuggggggcagagcug

SEQ ID NO: 1071453 - RNA, 22 nt, Human
ugacagauuuugauggcuaaua

SEQ ID NO: 1071454 - RNA, 22 nt, Human
acaaaggugagcagaagacaca

SEQ ID NO: 1071455 - RNA, 22 nt, Human
acccuucauagaggagaagcug

SEQ ID NO: 1071456 - RNA, 22 nt, Human
uuuucucuuguuaauguacuga

SEQ ID NO: 1071457 - RNA, 22 nt, Human
uguauacauuuggugcauauuu

SEQ ID NO: 1071458 - RNA, 22 nt, Human
ucagggaagaaaugggacuuua

SEQ ID NO: 1071459 - RNA, 22 nt, Human
ggagggcugccagguggagcgg

SEQ ID NO: 1071460 - RNA, 22 nt, Human
uccaaguugauguuucuuaaau

SEQ ID NO: 1071461 - RNA, 22 nt, Human
ccuggcagguggcgcccucggc

SEQ ID NO: 1071462 - RNA, 20 nt, Human
uccagcugucuuucagagac

SEQ ID NO: 1071463 - RNA, 22 nt, Human
ggagugggcagcacugcccugu

SEQ ID NO: 1071464 - RNA, 22 nt, Human
ugcagguggauucaauguggga

SEQ ID NO: 1071465 - RNA, 18 nt, Human
acagaacucaggggcacc

SEQ ID NO: 1071466 - RNA, 19 nt, Human
gcuggcagauguggccgug

SEQ ID NO: 1071467 - RNA, 22 nt, Human
aggcugaggaucccuguguucu

SEQ ID NO: 1071468 - RNA, 22 nt, Human
gagggguccaggaggcacuuac

SEQ ID NO: 1071469 - RNA, 22 nt, Human
agagcuggacgucugagcccua

SEQ ID NO: 1071470 - RNA, 22 nt, Human
augauucagcaauuuuauaucu

SEQ ID NO: 1071471 - RNA, 22 nt, Human
uggcucagaguucaucuuuuag

SEQ ID NO: 1071472 - RNA, 19 nt, Human
ggcucuggcggcuguagcc

SEQ ID NO: 1071473 - RNA, 19 nt, Human
aggacucuggaggcaugag

SEQ ID NO: 1071474 - RNA, 22 nt, Human
agugaguggguuacagauggga

SEQ ID NO: 1071475 - RNA, 22 nt, Human
uacaagagugagauuaucaugu

SEQ ID NO: 1071476 - RNA, 22 nt, Human
gucuucauucaacaaauauuca

SEQ ID NO: 1071477 - RNA, 22 nt, Human
cuuucagagguuacucaggaaa

SEQ ID NO: 1071478 - RNA, 22 nt, Human
uaaggccaaggggccauagucu

SEQ ID NO: 1071479 - RNA, 22 nt, Human
aguggccagugcugcucugggg

SEQ ID NO: 1071480 - RNA, 22 nt, Human
agugcaaaauucagaagcaauu

SEQ ID NO: 1071481 - RNA, 22 nt, Human
aagcagcauagcucccuuaguu

SEQ ID NO: 1071482 - RNA, 22 nt, Human
cagugcagccaaggacaggcac

SEQ ID NO: 1071483 - RNA, 22 nt, Human
auacaaaguauuaauccuggau

SEQ ID NO: 1071484 - RNA, 22 nt, Human
gcagccacccucaaggcugaau

SEQ ID NO: 1071485 - RNA, 22 nt, Human
auugugaauagugcugcaauaa

SEQ ID NO: 1071486 - RNA, 21 nt, Human
cauugucgacauuuuccccuc

SEQ ID NO: 1071487 - RNA, 22 nt, Human
auuuuuccaugauacuuaucug

SEQ ID NO: 1071488 - RNA, 19 nt, Human
acauggcaucccaggaggu

SEQ ID NO: 1071489 - RNA, 22 nt, Human
aggcaggcucaggcccaugcuu

SEQ ID NO: 1071490 - RNA, 22 nt, Human
cauaacacauucaucagcagag

SEQ ID NO: 1071491 - RNA, 22 nt, Human
agaagaaaugaggccguucugc

SEQ ID NO: 1071492 - RNA, 22 nt, Human
acagcagccugcagcccugugu

SEQ ID NO: 1071493 - RNA, 22 nt, Human
ggcccugcgauuagguggcagg

SEQ ID NO: 1071494 - RNA, 22 nt, Human
ugauggugggucugaucucaua

SEQ ID NO: 1071495 - RNA, 22 nt, Human
agaaauacuuuguaaaucucac

SEQ ID NO: 1071496 - RNA, 22 nt, Human
acagcaguuacugaaauaaagu

SEQ ID NO: 1071497 - RNA, 22 nt, Human
gaacauuuauauuagauagcua

SEQ ID NO: 1071498 - RNA, 22 nt, Human
uaaaggcucguauuguugugug

SEQ ID NO: 1071499 - RNA, 21 nt, Human
cccacggaaugaugaggcacu

SEQ ID NO: 1071500 - RNA, 22 nt, Human
aauauaguucugguauuguuaa

SEQ ID NO: 1071501 - RNA, 22 nt, Human
ucuuagaaguucauguuccagc

SEQ ID NO: 1071502 - RNA, 22 nt, Human
gcagacuggucuucagccuugg

SEQ ID NO: 1071503 - RNA, 22 nt, Human
gagugugggcacgggggccuug

SEQ ID NO: 1071504 - RNA, 21 nt, Human
ccacaggggcuccccugucag

SEQ ID NO: 1071505 - RNA, 22 nt, Human
agcauccagcauccuauagaaa

SEQ ID NO: 1071506 - RNA, 22 nt, Human
cacaggaaaauaaaagaucuaa

SEQ ID NO: 1071507 - RNA, 22 nt, Human
ucucccaggcuggagugcagug

SEQ ID NO: 1071508 - RNA, 22 nt, Human
uggcucaggagggaucuuugcu

SEQ ID NO: 1071509 - RNA, 22 nt, Human
agugcaaauaucuacgcgguga

SEQ ID NO: 1071510 - RNA, 22 nt, Human
uggacaacauagugagaccuca

SEQ ID NO: 1071511 - RNA, 16 nt, Human
uggcagagguucagcc

SEQ ID NO: 1071512 - RNA, 22 nt, Human
gccaggcugaggcucuggaaga

SEQ ID NO: 1071513 - RNA, 20 nt, Human
caccaggcgcucugagaaca

SEQ ID NO: 1071514 - RNA, 22 nt, Human
ugcaggugguuuggacacugcu

SEQ ID NO: 1071515 - RNA, 21 nt, Human
gcaggaugcaucuuggugucu

SEQ ID NO: 1071516 - RNA, 22 nt, Human
gugccagggaguggaggagcuu

SEQ ID NO: 1071517 - RNA, 22 nt, Human
cagcugcuguucaguuuuguuu

SEQ ID NO: 1071518 - RNA, 22 nt, Human
guuauacacauuccuggugagg

SEQ ID NO: 1071519 - RNA, 22 nt, Human
aaacaucuugcucugauuggua

SEQ ID NO: 1071520 - RNA, 21 nt, Human
gcagccagacgggauucaguu

SEQ ID NO: 1071521 - RNA, 22 nt, Human
gaaggaaggaaaaauauauuua

SEQ ID NO: 1071522 - RNA, 22 nt, Human
ucucugguggcuccaucaguag

SEQ ID NO: 1071523 - RNA, 22 nt, Human
gcagggcacagacagugccaag

SEQ ID NO: 1071524 - RNA, 18 nt, Human
agcuggcccuggcugccg

SEQ ID NO: 1071525 - RNA, 22 nt, Human
auuauuaaagcuuaggucuuau

SEQ ID NO: 1071526 - RNA, 22 nt, Human
cugccaugcaguuagucccuca

SEQ ID NO: 1071527 - RNA, 22 nt, Human
guagaucaugagaauguuuuug

SEQ ID NO: 1071528 - RNA, 22 nt, Human
uucaacaaauauuuauugagcu

SEQ ID NO: 1071529 - RNA, 22 nt, Human
cugcuucuaagaaccugcagcu

SEQ ID NO: 1071530 - RNA, 22 nt, Human
cccugcugugccugacugccau

SEQ ID NO: 1071531 - RNA, 22 nt, Human
aaacagcuccuuaguuuccauc

SEQ ID NO: 1071532 - RNA, 22 nt, Human
uuucagaugcaauuaauuuuca

SEQ ID NO: 1071533 - RNA, 22 nt, Human
cccacccugggcuacacaucca

SEQ ID NO: 1071534 - RNA, 22 nt, Human
uggagggaacccaggcugcucu

SEQ ID NO: 1071535 - RNA, 22 nt, Human
ucucaugugauucccgugcaug

SEQ ID NO: 1071536 - RNA, 22 nt, Human
ggugaaggcacaagagggcaag

SEQ ID NO: 1071537 - RNA, 22 nt, Human
uucucuuacauuuucucagccu

SEQ ID NO: 1071538 - RNA, 22 nt, Human
aaguuacaguuauuauuuaaaa

SEQ ID NO: 1071539 - RNA, 22 nt, Human
aagcuagaugacguuauuuuuu

SEQ ID NO: 1071540 - RNA, 22 nt, Human
uagaauuuucugcuuugauagu

SEQ ID NO: 1071541 - RNA, 22 nt, Human
ugggcucugguuuccuggcugg

SEQ ID NO: 1071542 - RNA, 22 nt, Human
uccucagggcggccuccgucuu

SEQ ID NO: 1071543 - RNA, 21 nt, Human
cuagagugggaccggagucua

SEQ ID NO: 1071544 - RNA, 22 nt, Human
agagcagauggccagggggccu

SEQ ID NO: 1071545 - RNA, 22 nt, Human
augccaggaacaaacaguggug

SEQ ID NO: 1071546 - RNA, 22 nt, Human
aauuuuguucuuggaaaucagg

SEQ ID NO: 1071547 - RNA, 22 nt, Human
ucugcugucacucauuugcuuc

SEQ ID NO: 1071548 - RNA, 22 nt, Human
gcugaaggaggcucugguacua

SEQ ID NO: 1071549 - RNA, 22 nt, Human
agcagcaggcuagggaacugcu

SEQ ID NO: 1071550 - RNA, 22 nt, Human
ucucugagcugcuucuugcaua

SEQ ID NO: 1071551 - RNA, 22 nt, Human
accaacauguccucacacagcc

SEQ ID NO: 1071552 - RNA, 22 nt, Human
uucuuucuuggggaacacacuc

SEQ ID NO: 1071553 - RNA, 22 nt, Human
agcccagccggauucccaguuc

SEQ ID NO: 1071554 - RNA, 22 nt, Human
auaacagaauaagucauuaccg

SEQ ID NO: 1071555 - RNA, 22 nt, Human
ucuaguucuagaucccugagga

SEQ ID NO: 1071556 - RNA, 22 nt, Human
auaauuuaauuuucacaguggu

SEQ ID NO: 1071557 - RNA, 22 nt, Human
uuuuauguuccugaagcuaucu

SEQ ID NO: 1071558 - RNA, 22 nt, Human
cagcacuggggggauucggagc

SEQ ID NO: 1071559 - RNA, 22 nt, Human
ucuccugucuucucagcacccc

SEQ ID NO: 1071560 - RNA, 22 nt, Human
aaaugucaaagacguguuuuug

SEQ ID NO: 1071561 - RNA, 18 nt, Human
uccuccuuuggccuuuuc

SEQ ID NO: 1071562 - RNA, 22 nt, Human
gguagaaggggaagagguccau

SEQ ID NO: 1071563 - RNA, 22 nt, Human
agccagggucucucgcucuguu

SEQ ID NO: 1071564 - RNA, 22 nt, Human
ucucccagaggaucccagugga

SEQ ID NO: 1071565 - RNA, 22 nt, Human
agucucuuccuucaaggcuggu

SEQ ID NO: 1071566 - RNA, 22 nt, Human
ugcagggccccucugcaugagu

SEQ ID NO: 1071567 - RNA, 22 nt, Human
cugcugugagcacuccagccug

SEQ ID NO: 1071568 - RNA, 22 nt, Human
aaucagaaauucuacaucacaa

SEQ ID NO: 1071569 - RNA, 22 nt, Human
gcacccagcccagggcgugaug

SEQ ID NO: 1071570 - RNA, 22 nt, Human
agcccaagcuaugaggugaccu

SEQ ID NO: 1071571 - RNA, 20 nt, Human
agcagcauuguucuagagca

SEQ ID NO: 1071572 - RNA, 22 nt, Human
agaauccugaugaaaaggagag

SEQ ID NO: 1071573 - RNA, 22 nt, Human
cugacagucucauugauuugcu

SEQ ID NO: 1071574 - RNA, 22 nt, Human
ucauauuuauauguuggcacag

SEQ ID NO: 1071575 - RNA, 22 nt, Human
ucugucacaauuugcuuacucu

SEQ ID NO: 1071576 - RNA, 22 nt, Human
auguguguaaacaaguauaauu

SEQ ID NO: 1071577 - RNA, 22 nt, Human
agggcugagacuaaggccagau

SEQ ID NO: 1071578 - RNA, 22 nt, Human
agggcagcacagcugugcuccu

SEQ ID NO: 1071579 - RNA, 22 nt, Human
acuugaaacaucuuuaaaugua

SEQ ID NO: 1071580 - RNA, 17 nt, Human
ggagaucuggcagaggg

SEQ ID NO: 1071581 - RNA, 22 nt, Human
caggcagcucuaauggaaagug

SEQ ID NO: 1071582 - RNA, 19 nt, Human
aucugccuuagugcugcug

SEQ ID NO: 1071583 - RNA, 22 nt, Human
ucccagaaaaaggaggcuauga

SEQ ID NO: 1071584 - RNA, 22 nt, Human
ggccucaguuucuucaacugua

SEQ ID NO: 1071585 - RNA, 21 nt, Human
ccugugugucugacugggcua

SEQ ID NO: 1071586 - RNA, 22 nt, Human
uccaggcuagguuuacaggaca

SEQ ID NO: 1071587 - RNA, 22 nt, Human
caccuggcuggaagugcuccgg

SEQ ID NO: 1071588 - RNA, 19 nt, Human
ugagagugaggaaggcuuc

SEQ ID NO: 1071589 - RNA, 22 nt, Human
ccuccagggcagacggggagca

SEQ ID NO: 1071590 - RNA, 22 nt, Human
uagaacaaugaauuucuggagg

SEQ ID NO: 1071591 - RNA, 21 nt, Human
acugcaaacagcagagacuga

SEQ ID NO: 1071592 - RNA, 22 nt, Human
auuuccacauaagggaaauaag

SEQ ID NO: 1071593 - RNA, 22 nt, Human
aggauccuccuuagaaaagacc

SEQ ID NO: 1071594 - RNA, 22 nt, Human
cucuggaggucagguguggugg

SEQ ID NO: 1071595 - RNA, 22 nt, Human
ggggugugucugacaaugguau

SEQ ID NO: 1071596 - RNA, 22 nt, Human
ugaagccuuguguggccucucu

SEQ ID NO: 1071597 - RNA, 22 nt, Human
ucacaauucagaaaccaaguag

SEQ ID NO: 1071598 - RNA, 17 nt, Human
ccuguguuugcuccuuc

SEQ ID NO: 1071599 - RNA, 22 nt, Human
cugucacacuaaaacaagaagu

SEQ ID NO: 1071600 - RNA, 22 nt, Human
ugcaggcuccaggugcacauau

SEQ ID NO: 1071601 - RNA, 22 nt, Human
gugcgccagcucaaggggaggc

SEQ ID NO: 1071602 - RNA, 22 nt, Human
acacauacauggggaagaugag

SEQ ID NO: 1071603 - RNA, 20 nt, Human
uccuucaggcagggccuagu

SEQ ID NO: 1071604 - RNA, 18 nt, Human
cuacauucauaggaaagg

SEQ ID NO: 1071605 - RNA, 22 nt, Human
aagccagguguugugguaagag

SEQ ID NO: 1071606 - RNA, 22 nt, Human
ucaggggaaaucucucagcgaa

SEQ ID NO: 1071607 - RNA, 22 nt, Human
aggaagaugggagagcucugga

SEQ ID NO: 1071608 - RNA, 22 nt, Human
accugccucuaagcagcaggug

SEQ ID NO: 1071609 - RNA, 22 nt, Human
ugcccugccaagacugaguggu

SEQ ID NO: 1071610 - RNA, 22 nt, Human
ccaguguuuacaguugaacaaa

SEQ ID NO: 1071611 - RNA, 22 nt, Human
uuugagguuagcuagcagauca

SEQ ID NO: 1071612 - RNA, 22 nt, Human
ccaggccuuucuucuuggucug

SEQ ID NO: 1071613 - RNA, 22 nt, Human
gcucuggacccuggaguggcug

SEQ ID NO: 1071614 - RNA, 22 nt, Human
ccagguaccagucaaaucugua

SEQ ID NO: 1071615 - RNA, 22 nt, Human
gcucccuguucucagccaugau

SEQ ID NO: 1071616 - RNA, 22 nt, Human
uuucaacauauaccauaaugcc

SEQ ID NO: 1071617 - RNA, 22 nt, Human
gggccuccgugugcuggugcuc

SEQ ID NO: 1071618 - RNA, 22 nt, Human
ucaggcugcaucuguaagggug

SEQ ID NO: 1071619 - RNA, 22 nt, Human
uggaggugagugugguacagca

SEQ ID NO: 1071620 - RNA, 22 nt, Human
aucacaggugguaggaaaagaa

SEQ ID NO: 1071621 - RNA, 20 nt, Human
uucuaaacuguuaggcuugc

SEQ ID NO: 1071622 - RNA, 22 nt, Human
agcauauacaaacucauauaca

SEQ ID NO: 1071623 - RNA, 22 nt, Human
agaagcagaaggaagcagggcc

SEQ ID NO: 1071624 - RNA, 22 nt, Human
aagugauucugauguguuucuu

SEQ ID NO: 1071625 - RNA, 22 nt, Human
ugggggagauuagagcuucuua

SEQ ID NO: 1071626 - RNA, 22 nt, Human
gaaaauuauugaaaauggcucu

SEQ ID NO: 1071627 - RNA, 20 nt, Human
gcagcugaaaguaugacacc

SEQ ID NO: 1071628 - RNA, 22 nt, Human
ggaggcacuucccgucucagcc

SEQ ID NO: 1071629 - RNA, 22 nt, Human
ccagugcacagccaggcaggug

SEQ ID NO: 1071630 - RNA, 22 nt, Human
ucugaaggugcuagagaaagcu

SEQ ID NO: 1071631 - RNA, 22 nt, Human
agugaaaugacugaaucagaua

SEQ ID NO: 1071632 - RNA, 22 nt, Human
gcccucagcauccucagggcca

SEQ ID NO: 1071633 - RNA, 20 nt, Human
uaugaagacucaaguagggc

SEQ ID NO: 1071634 - RNA, 22 nt, Human
cauacuuuugcccugacauucu

SEQ ID NO: 1071635 - RNA, 22 nt, Human
agggcagcauugccuuucucca

SEQ ID NO: 1071636 - RNA, 22 nt, Human
agggccugucagcgguguccug

SEQ ID NO: 1071637 - RNA, 22 nt, Human
auugcuguggaaauauaagaug

SEQ ID NO: 1071638 - RNA, 22 nt, Human
agggaugcaguaaaaacuguag

SEQ ID NO: 1071639 - RNA, 20 nt, Human
uggcagaguugucccaccca

SEQ ID NO: 1071640 - RNA, 19 nt, Human
ugcagcucagggcaggggc

SEQ ID NO: 1071641 - RNA, 22 nt, Human
agaagagaacugccaaacacuu

SEQ ID NO: 1071642 - RNA, 22 nt, Human
cuggggacugaaggauguugcu

SEQ ID NO: 1071643 - RNA, 22 nt, Human
aauucuuaaucccauaaaguga

SEQ ID NO: 1071644 - RNA, 22 nt, Human
aaaugucagaagcuuuacuucu

SEQ ID NO: 1071645 - RNA, 22 nt, Human
ugggggugacuaucucgggaau

SEQ ID NO: 1071646 - RNA, 22 nt, Human
ugugagacguguuagaacagug

SEQ ID NO: 1071647 - RNA, 22 nt, Human
cucuguagaaacagggcagaag

SEQ ID NO: 1071648 - RNA, 17 nt, Human
caucuuuaaaauccuga

SEQ ID NO: 1071649 - RNA, 22 nt, Human
gacacagauaauuuaguuaaaa

SEQ ID NO: 1071650 - RNA, 17 nt, Human
guccugggaggagagag

SEQ ID NO: 1071651 - RNA, 22 nt, Human
aaggccacacuugcuggccagc

SEQ ID NO: 1071652 - RNA, 22 nt, Human
cucugaggcuccaugcaggcuu

SEQ ID NO: 1071653 - RNA, 22 nt, Human
uaaggaaagugccaugauuucu

SEQ ID NO: 1071654 - RNA, 22 nt, Human
ccugagacaugaaccaggcucc

SEQ ID NO: 1071655 - RNA, 22 nt, Human
agcacagauucugaagaguccu

SEQ ID NO: 1071656 - RNA, 22 nt, Human
gccaccagggggcuccagugag

SEQ ID NO: 1071657 - RNA, 20 nt, Human
acccugcauacuggaaggcu

SEQ ID NO: 1071658 - RNA, 22 nt, Human
ggcagcucugcuccacaugagu

SEQ ID NO: 1071659 - RNA, 22 nt, Human
uccuggcuucugucuccuuauu

SEQ ID NO: 1071660 - RNA, 22 nt, Human
ccagucacuggaaaaugggaau

SEQ ID NO: 1071661 - RNA, 22 nt, Human
agcagagccugggcuaggggug

SEQ ID NO: 1071662 - RNA, 22 nt, Human
uugcauauccuccaacacaugg

SEQ ID NO: 1071663 - RNA, 22 nt, Human
cagcuguugucucucacauauu

SEQ ID NO: 1071664 - RNA, 22 nt, Human
gagaagcaaucaguggccaccc

SEQ ID NO: 1071665 - RNA, 22 nt, Human
cagcccagcagggucuggcccu

SEQ ID NO: 1071666 - RNA, 22 nt, Human
ugcaaauugcaugauguguauc

SEQ ID NO: 1071667 - RNA, 22 nt, Human
acacaucuauauugcaucugca

SEQ ID NO: 1071668 - RNA, 22 nt, Human
uuucuucucacccaggacagag

SEQ ID NO: 1071669 - RNA, 22 nt, Human
aauauuucuggugcuucucacu

SEQ ID NO: 1071670 - RNA, 22 nt, Human
gaggcagcaucuauggugggaa

SEQ ID NO: 1071671 - RNA, 22 nt, Human
auaacauuuugacaacugguga

SEQ ID NO: 1071672 - RNA, 22 nt, Human
aaaaucaguacacuuuauuuug

SEQ ID NO: 1071673 - RNA, 22 nt, Human
ggcccaucucuugcucuggguu

SEQ ID NO: 1071674 - RNA, 22 nt, Human
ggcucuggcguccaauggagcg

SEQ ID NO: 1071675 - RNA, 22 nt, Human
ugaaggagggaagaaggcucug

SEQ ID NO: 1071676 - RNA, 22 nt, Human
gcuguggaugcuauggaucauc

SEQ ID NO: 1071677 - RNA, 18 nt, Human
acaggccucaguccugca

SEQ ID NO: 1071678 - RNA, 22 nt, Human
cugcuucugggaugauggagua

SEQ ID NO: 1071679 - RNA, 22 nt, Human
ggucucaggagacuggagagca

SEQ ID NO: 1071680 - RNA, 22 nt, Human
uuacaacuuuccugugucaaau

SEQ ID NO: 1071681 - RNA, 22 nt, Human
ggagaggcgaugagucacagcc

SEQ ID NO: 1071682 - RNA, 22 nt, Human
gaaggccuagggaugcucugcg

SEQ ID NO: 1071683 - RNA, 22 nt, Human
agaccagcugccucccagggcc

SEQ ID NO: 1071684 - RNA, 22 nt, Human
cuggccuggcaggggaccucua

SEQ ID NO: 1071685 - RNA, 22 nt, Human
uuccucagcuggccugauuggg

SEQ ID NO: 1071686 - RNA, 19 nt, Human
cucugcccuacagaaagcu

SEQ ID NO: 1071687 - RNA, 22 nt, Human
agcagcagauccaaaaaaugug

SEQ ID NO: 1071688 - RNA, 22 nt, Human
acacauuugcauaauaccucau

SEQ ID NO: 1071689 - RNA, 21 nt, Human
cugugcuucuuccuaagccag

SEQ ID NO: 1071690 - RNA, 22 nt, Human
cugaggcacugucagcugaggc

SEQ ID NO: 1071691 - RNA, 22 nt, Human
ugccucugaggaagauuguguu

SEQ ID NO: 1071692 - RNA, 22 nt, Human
aagcagagaaaagcuuagguuc

SEQ ID NO: 1071693 - RNA, 22 nt, Human
agcugugaccuucaagagcuac

SEQ ID NO: 1071694 - RNA, 22 nt, Human
cugagaaauacccaagucuggu

SEQ ID NO: 1071695 - RNA, 20 nt, Human
uguugauuggugucaucuca

SEQ ID NO: 1071696 - RNA, 22 nt, Human
ucauaaguaauuuaaacauucc

SEQ ID NO: 1071697 - RNA, 22 nt, Human
gggaccuggggacuccuuguuc

SEQ ID NO: 1071698 - RNA, 22 nt, Human
acaccaaaguagaauuaaugua

SEQ ID NO: 1071699 - RNA, 22 nt, Human
uuguuucugaguuuucauguau

SEQ ID NO: 1071700 - RNA, 19 nt, Human
uucugcccucucuucuagc

SEQ ID NO: 1071701 - RNA, 22 nt, Human
uguaugaaagaacaagggcuua

SEQ ID NO: 1071702 - RNA, 22 nt, Human
gcacugaaugcuuuuacuguaa

SEQ ID NO: 1071703 - RNA, 22 nt, Human
uggcucaguuccaucaucugga

SEQ ID NO: 1071704 - RNA, 23 nt, Human
ucugagugauuagccucuggggu

SEQ ID NO: 1071705 - RNA, 22 nt, Human
auacaucuuccuuuuaaaaugc

SEQ ID NO: 1071706 - RNA, 22 nt, Human
aguuuuauggcucaaccuaaua

SEQ ID NO: 1071707 - RNA, 22 nt, Human
cugagcuuggccaggaaugaau

SEQ ID NO: 1071708 - RNA, 22 nt, Human
uccuggaguauuucuguggugu

SEQ ID NO: 1071709 - RNA, 22 nt, Human
ggugacugguuuaucuggcagu

SEQ ID NO: 1071710 - RNA, 22 nt, Human
acugcuauuuuauaacagaaga

SEQ ID NO: 1071711 - RNA, 22 nt, Human
ucaaaggcugcuugucuucugg

SEQ ID NO: 1071712 - RNA, 17 nt, Human
uuuuguucaucuucaaa

SEQ ID NO: 1071713 - RNA, 22 nt, Human
acagcuggaggucugugagcac

SEQ ID NO: 1071714 - RNA, 22 nt, Human
ugguuuuauuuauguugaguca

SEQ ID NO: 1071715 - RNA, 22 nt, Human
gggagggaucugcuaggcaaug

SEQ ID NO: 1071716 - RNA, 23 nt, Human
guggccuccccggaaugccucgc

SEQ ID NO: 1071717 - RNA, 20 nt, Human
ucuucagaugcuuuuggagu

SEQ ID NO: 1071718 - RNA, 22 nt, Human
cugccuugaaaaugaagcuuua

SEQ ID NO: 1071719 - RNA, 22 nt, Human
ggaggaugccaagcugugcaca

SEQ ID NO: 1071720 - RNA, 22 nt, Human
ucccacugugaauccaaggccu

SEQ ID NO: 1071721 - RNA, 22 nt, Human
agcaugaaagcauaggacaguc

SEQ ID NO: 1071722 - RNA, 22 nt, Human
ucugucuccugccagugccucu

SEQ ID NO: 1071723 - RNA, 22 nt, Human
uaaaggcacggaguuguuaugg

SEQ ID NO: 1071724 - RNA, 22 nt, Human
aggcugggcuccgcccaacucc

SEQ ID NO: 1071725 - RNA, 22 nt, Human
agcagggcagugcuucagcucu

SEQ ID NO: 1071726 - RNA, 22 nt, Human
ucccucagacagauguguuccu

SEQ ID NO: 1071727 - RNA, 22 nt, Human
ucuauucauucaauuuagcucu

SEQ ID NO: 1071728 - RNA, 22 nt, Human
auauuuguuagagucuaugugu

SEQ ID NO: 1071729 - RNA, 22 nt, Human
ucuuguccuaagagcuggauuc

SEQ ID NO: 1071730 - RNA, 22 nt, Human
uuuccucuuuguaccuugacua

SEQ ID NO: 1071731 - RNA, 21 nt, Human
ggagucauuagucauuuccuu

SEQ ID NO: 1071732 - RNA, 22 nt, Human
cagucuuuguucccauuacuga

SEQ ID NO: 1071733 - RNA, 22 nt, Human
acuggacagaggaaauauggag

SEQ ID NO: 1071734 - RNA, 22 nt, Human
cagcucuguaaauuccuucauc

SEQ ID NO: 1071735 - RNA, 22 nt, Human
ugagguaggugguaagagauac

SEQ ID NO: 1071736 - RNA, 22 nt, Human
cuggccugggagcugcuagcgu

SEQ ID NO: 1071737 - RNA, 22 nt, Human
gcuaguuucuugaauacucuaa

SEQ ID NO: 1071738 - RNA, 22 nt, Human
ugauacauaaaccaucauuuug

SEQ ID NO: 1071739 - RNA, 22 nt, Human
aaaugcagguaguauuuauuuu

SEQ ID NO: 1071740 - RNA, 18 nt, Human
uccaaaaucauguauuuu

SEQ ID NO: 1071741 - RNA, 22 nt, Human
uccagaguuguaaguguugaca

SEQ ID NO: 1071742 - RNA, 20 nt, Human
uuucaaaggcaccuaugaag

SEQ ID NO: 1071743 - RNA, 22 nt, Human
augggcaguguauuggaaggaa

SEQ ID NO: 1071744 - RNA, 22 nt, Human
ugucugugaccucuuuggagcc

SEQ ID NO: 1071745 - RNA, 22 nt, Human
agagcucaagacgcucacagua

SEQ ID NO: 1071746 - RNA, 22 nt, Human
gacacaggggggcgcuagaaga

SEQ ID NO: 1071747 - RNA, 22 nt, Human
aaucuuuuaggggauccugagg

SEQ ID NO: 1071748 - RNA, 22 nt, Human
gggcaggggucaguggccccaa

SEQ ID NO: 1071749 - RNA, 22 nt, Human
aggagguggcugaacuugaggg

SEQ ID NO: 1071750 - RNA, 22 nt, Human
uggcagaguggaccauacucaa

SEQ ID NO: 1071751 - RNA, 17 nt, Human
ucaggauccaggguucu

SEQ ID NO: 1071752 - RNA, 22 nt, Human
ggcacagggagccgcaguugca

SEQ ID NO: 1071753 - RNA, 22 nt, Human
agaauguagucuuggagauuua

SEQ ID NO: 1071754 - RNA, 22 nt, Human
guccucuguagggcugggccac

SEQ ID NO: 1071755 - RNA, 22 nt, Human
ugacauuugagagagauauaca

SEQ ID NO: 1071756 - RNA, 22 nt, Human
agacauuuauucacacauuuau

SEQ ID NO: 1071757 - RNA, 22 nt, Human
cugcuguguuggcauuggauag

SEQ ID NO: 1071758 - RNA, 22 nt, Human
uuccucuuccaucuucccaggg

SEQ ID NO: 1071759 - RNA, 22 nt, Human
agaaaucauugaauuauuugcu

SEQ ID NO: 1071760 - RNA, 22 nt, Human
caugaagcccucaucagucuga

SEQ ID NO: 1071761 - RNA, 22 nt, Human
gaggguggaagagcugcugaga

SEQ ID NO: 1071762 - RNA, 22 nt, Human
gccuguccacuaaacagccaag

SEQ ID NO: 1071763 - RNA, 18 nt, Human
uggguggcuagggaguuu

SEQ ID NO: 1071764 - RNA, 22 nt, Human
aggagugagcuuuggggucaga

SEQ ID NO: 1071765 - RNA, 22 nt, Human
uucauucagguguauuuauggg

SEQ ID NO: 1071766 - RNA, 22 nt, Human
aggaaacauccuuaucuauucu

SEQ ID NO: 1071767 - RNA, 22 nt, Human
gcuuaaaagccacuuagucuau

SEQ ID NO: 1071768 - RNA, 22 nt, Human
gcagauggcugagccugcagau

SEQ ID NO: 1071769 - RNA, 21 nt, Human
agcuuccugcagugggagguc

SEQ ID NO: 1071770 - RNA, 22 nt, Human
augaaacagaguacuuaauaua

SEQ ID NO: 1071771 - RNA, 22 nt, Human
aaagucaugcaguugaacuuuu

SEQ ID NO: 1071772 - RNA, 22 nt, Human
ugcaggugagugcaggggcuca

SEQ ID NO: 1071773 - RNA, 23 nt, Human
uuugaaaguaucaacucgccuga

SEQ ID NO: 1071774 - RNA, 22 nt, Human
uauguaaaguagauggcaggua

SEQ ID NO: 1071775 - RNA, 22 nt, Human
uuauaacaacaguuuacuuuaa

SEQ ID NO: 1071776 - RNA, 22 nt, Human
gccaggcagcugggagggugcc

SEQ ID NO: 1071777 - RNA, 22 nt, Human
acuucauguuucuauuagcuca

SEQ ID NO: 1071778 - RNA, 22 nt, Human
cagcagagcugggcuuugaauu

SEQ ID NO: 1071779 - RNA, 22 nt, Human
agugggggccaacgagggcagc

SEQ ID NO: 1071780 - RNA, 22 nt, Human
uacauugaauuuuuuagcaugu

SEQ ID NO: 1071781 - RNA, 22 nt, Human
aggcaggcccucuggaaaggua

SEQ ID NO: 1071782 - RNA, 22 nt, Human
uaugccugauaacugugucucu

SEQ ID NO: 1071783 - RNA, 22 nt, Human
acuguggccugcuguaugggcu

SEQ ID NO: 1071784 - RNA, 22 nt, Human
ucccagaggacuguuggugcua

SEQ ID NO: 1071785 - RNA, 22 nt, Human
cccuggggcugagggauggccg

SEQ ID NO: 1071786 - RNA, 22 nt, Human
caggaccuggaaugcuugugaa

SEQ ID NO: 1071787 - RNA, 20 nt, Human
gagcacaguaaugacugcua

SEQ ID NO: 1071788 - RNA, 22 nt, Human
auaaauucaaagcauuuaggac

SEQ ID NO: 1071789 - RNA, 22 nt, Human
ucagggcauggcugcacuuggc

SEQ ID NO: 1071790 - RNA, 22 nt, Human
ucugccuggcucauggcaguga

SEQ ID NO: 1071791 - RNA, 22 nt, Human
ucacaucaggugucuccccaag

SEQ ID NO: 1071792 - RNA, 22 nt, Human
acauucuucagcuuugucaggc

SEQ ID NO: 1071793 - RNA, 22 nt, Human
acagaaaaugccagaagggugg

SEQ ID NO: 1071794 - RNA, 22 nt, Human
acacauguacagauuaguauuu

SEQ ID NO: 1071795 - RNA, 22 nt, Human
uucuuucccagaagauauguuu

SEQ ID NO: 1071796 - RNA, 22 nt, Human
ugcugcugaaaaggugugcuua

SEQ ID NO: 1071797 - RNA, 22 nt, Human
cagggaacaagaugagaaugga

SEQ ID NO: 1071798 - RNA, 18 nt, Human
acccucuggcuucugagc

SEQ ID NO: 1071799 - RNA, 22 nt, Human
gcuccugggcccugggcuaacu

SEQ ID NO: 1071800 - RNA, 22 nt, Human
gugguucagugucauauuaacg

SEQ ID NO: 1071801 - RNA, 22 nt, Human
cagauggcugccuucuugcugu

SEQ ID NO: 1071802 - RNA, 22 nt, Human
guggccagccagggugcugaug

SEQ ID NO: 1071803 - RNA, 22 nt, Human
ucaaaagaaacaccauguuccu

SEQ ID NO: 1071804 - RNA, 22 nt, Human
ugaggaaacugaggcacagaug

SEQ ID NO: 1071805 - RNA, 17 nt, Human
ucgguuugccaggcuuc

SEQ ID NO: 1071806 - RNA, 22 nt, Human
aaauuucuugaggcucucuagc

SEQ ID NO: 1071807 - RNA, 22 nt, Human
cugagaauuacucugaugagua

SEQ ID NO: 1071808 - RNA, 22 nt, Human
aggucauuguuaagucaccaua

SEQ ID NO: 1071809 - RNA, 22 nt, Human
ggggcggggcucugagaagcau

SEQ ID NO: 1071810 - RNA, 22 nt, Human
ucaucccuaaggacagcucugc

SEQ ID NO: 1071811 - RNA, 22 nt, Human
uccaggaagagguguguuggga

SEQ ID NO: 1071812 - RNA, 22 nt, Human
uuacaaagguaguuuugucuau

SEQ ID NO: 1071813 - RNA, 22 nt, Human
aaacaaguuuagaauaaugaau

SEQ ID NO: 1071814 - RNA, 22 nt, Human
aggcacugguccauuuucugca

SEQ ID NO: 1071815 - RNA, 22 nt, Human
agacucuggagucagcuaggau

SEQ ID NO: 1071816 - RNA, 22 nt, Human
uuaaugaccuagagcaguaauu

SEQ ID NO: 1071817 - RNA, 22 nt, Human
uggcucagagagggagugugga

SEQ ID NO: 1071818 - RNA, 22 nt, Human
uucauuccugagcccauauuua

SEQ ID NO: 1071819 - RNA, 22 nt, Human
caguagcaggcaggugcuuuug

SEQ ID NO: 1071820 - RNA, 22 nt, Human
gcagcugcagagaccggguggg

SEQ ID NO: 1071821 - RNA, 22 nt, Human
augccagucaaagaagaugaca

SEQ ID NO: 1071822 - RNA, 22 nt, Human
uaucuuguaauagguccacuug

SEQ ID NO: 1071823 - RNA, 22 nt, Human
ucuucucauagcuaguucuucc

SEQ ID NO: 1071824 - RNA, 22 nt, Human
uccaggcucucaggugucagca

SEQ ID NO: 1071825 - RNA, 22 nt, Human
ugccaggcgauugcuaucagca

SEQ ID NO: 1071826 - RNA, 22 nt, Human
uugcacuauaggaaaauguguc

SEQ ID NO: 1071827 - RNA, 22 nt, Human
cugagggagcugcuggccuugg

SEQ ID NO: 1071828 - RNA, 22 nt, Human
gguuggggcgagcuggaggccc

SEQ ID NO: 1071829 - RNA, 22 nt, Human
gcagagucauuauuuaugcaau

SEQ ID NO: 1071830 - RNA, 22 nt, Human
cuuugaauuccaguacaauaac

SEQ ID NO: 1071831 - RNA, 22 nt, Human
uauuuggauacaaucauuugcu

SEQ ID NO: 1071832 - RNA, 22 nt, Human
uggggccucaggccuuuuccua

SEQ ID NO: 1071833 - RNA, 22 nt, Human
gcugagagugugagaucagauu

SEQ ID NO: 1071834 - RNA, 22 nt, Human
ccuuuuucccuggagggacagc

SEQ ID NO: 1071835 - RNA, 22 nt, Human
aaacuacuggauuaguaacuua

SEQ ID NO: 1071836 - RNA, 21 nt, Human
ucuuccaagggcugcugagac

SEQ ID NO: 1071837 - RNA, 22 nt, Human
aucuggcucgcuaggcucuggg

SEQ ID NO: 1071838 - RNA, 22 nt, Human
acugggcucaagugauuguccu

SEQ ID NO: 1071839 - RNA, 19 nt, Human
aguggcagaucuggaagua

SEQ ID NO: 1071840 - RNA, 22 nt, Human
cagaagggcagcacugggaagg

SEQ ID NO: 1071841 - RNA, 22 nt, Human
agugaaccaggcugcgucccug

SEQ ID NO: 1071842 - RNA, 22 nt, Human
uuucaauuuccaggcuagaauu

SEQ ID NO: 1071843 - RNA, 22 nt, Human
uacacagaaccugguguacagu

SEQ ID NO: 1071844 - RNA, 22 nt, Human
ggaaaacaagagaaugauguuu

SEQ ID NO: 1071845 - RNA, 22 nt, Human
ugaaggucaugguaauauuuuu

SEQ ID NO: 1071846 - RNA, 22 nt, Human
cuucagugaauguugaguaagg

SEQ ID NO: 1071847 - RNA, 22 nt, Human
aaaaaccucaauuacuuuugca

SEQ ID NO: 1071848 - RNA, 22 nt, Human
guguguccucaguaguggcaug

SEQ ID NO: 1071849 - RNA, 22 nt, Human
agccugagagccaagcugugca

SEQ ID NO: 1071850 - RNA, 22 nt, Human
cagguggaucucuaaggacuga

SEQ ID NO: 1071851 - RNA, 21 nt, Human
ccugggccaaauucccuggac

SEQ ID NO: 1071852 - RNA, 22 nt, Human
ugggaagaguuagagacagcug

SEQ ID NO: 1071853 - RNA, 22 nt, Human
ccaguggguaggccauggugag

SEQ ID NO: 1071854 - RNA, 22 nt, Human
gcacugugacccagagcaggug

SEQ ID NO: 1071855 - RNA, 22 nt, Human
ccugucugcggaggaguggaag

SEQ ID NO: 1071856 - RNA, 22 nt, Human
guggcagugugaggauccugcu

SEQ ID NO: 1071857 - RNA, 22 nt, Human
uugguucacauuagauuuccuu

SEQ ID NO: 1071858 - RNA, 22 nt, Human
guggccuggaugagcuucgaca

SEQ ID NO: 1071859 - RNA, 22 nt, Human
agcugggccugauuugcagggg

SEQ ID NO: 1071860 - RNA, 22 nt, Human
cauuuguuuagaagucuuuaua

SEQ ID NO: 1071861 - RNA, 22 nt, Human
uaacauuaaaagagauaauuga

SEQ ID NO: 1071862 - RNA, 22 nt, Human
agcugcugguuuaagggauggg

SEQ ID NO: 1071863 - RNA, 22 nt, Human
uaccuugagccguugcugauga

SEQ ID NO: 1071864 - RNA, 22 nt, Human
caggagugagaugcgaucacuu

SEQ ID NO: 1071865 - RNA, 21 nt, Human
uggcagggguaguaguacagc

SEQ ID NO: 1071866 - RNA, 22 nt, Human
aggggaggagcuuuucuugccu

SEQ ID NO: 1071867 - RNA, 22 nt, Human
agccacagagagggagcugcaa

SEQ ID NO: 1071868 - RNA, 22 nt, Human
uccuucccccucaagagaacuu

SEQ ID NO: 1071869 - RNA, 19 nt, Human
ucaaagucugagucacuuu

SEQ ID NO: 1071870 - RNA, 22 nt, Human
cacauacaaggcacacuggagg

SEQ ID NO: 1071871 - RNA, 20 nt, Human
cccacacccuucccacuugg

SEQ ID NO: 1071872 - RNA, 22 nt, Human
gagcugccuguugcauagcaac

SEQ ID NO: 1071873 - RNA, 22 nt, Human
caguaaaugcagauauagauac

SEQ ID NO: 1071874 - RNA, 22 nt, Human
guauuuuacuuacgcaugacuu

SEQ ID NO: 1071875 - RNA, 22 nt, Human
gucucaguaagaaaggcuccug

SEQ ID NO: 1071876 - RNA, 22 nt, Human
accaugggucagccaccucagc

SEQ ID NO: 1071877 - RNA, 22 nt, Human
agguggaguuaagugugaacug

SEQ ID NO: 1071878 - RNA, 22 nt, Human
uggcagaguuggagguggaaga

SEQ ID NO: 1071879 - RNA, 22 nt, Human
gaucggguggguucugccauca

SEQ ID NO: 1071880 - RNA, 22 nt, Human
aggccuggguguucaccagaag

SEQ ID NO: 1071881 - RNA, 22 nt, Human
gccugagauucccggagccgug

SEQ ID NO: 1071882 - RNA, 21 nt, Human
gggcgaggccugauguggcuc

SEQ ID NO: 1071883 - RNA, 22 nt, Human
aaguggaggccgaguucacgca

SEQ ID NO: 1071884 - RNA, 22 nt, Human
uuuacacagaggacacugggcu

SEQ ID NO: 1071885 - RNA, 20 nt, Human
cuguuaaaagguaugaauuc

SEQ ID NO: 1071886 - RNA, 22 nt, Human
ugcaggugucugggggcaacag

SEQ ID NO: 1071887 - RNA, 22 nt, Human
gggcccagcgugguuccaucug

SEQ ID NO: 1071888 - RNA, 22 nt, Human
guggggcuaaaaacugugcagu

SEQ ID NO: 1071889 - RNA, 22 nt, Human
gggcucuggaaaugggagcucc

SEQ ID NO: 1071890 - RNA, 22 nt, Human
gaggccuggucuaugagauguu

SEQ ID NO: 1071891 - RNA, 22 nt, Human
cgucuuuauugauuccuucaag

SEQ ID NO: 1071892 - RNA, 22 nt, Human
uggcucugaccagguagaggag

SEQ ID NO: 1071893 - RNA, 22 nt, Human
caguauuuccucuucuuaacuu

SEQ ID NO: 1071894 - RNA, 22 nt, Human
uccaguccuagaaacuggagag

SEQ ID NO: 1071895 - RNA, 22 nt, Human
uaaaguuuggcagacaauaaca

SEQ ID NO: 1071896 - RNA, 17 nt, Human
gacaggcucagugacga

SEQ ID NO: 1071897 - RNA, 22 nt, Human
uuuuccucuguuauuaguguga

SEQ ID NO: 1071898 - RNA, 22 nt, Human
gggcacugaacacccucuucgc

SEQ ID NO: 1071899 - RNA, 22 nt, Human
ucugccugagcagagggaggcc

SEQ ID NO: 1071900 - RNA, 18 nt, Human
gagcagaggcucaacugg

SEQ ID NO: 1071901 - RNA, 22 nt, Human
ucugggcccugagauguucuuc

SEQ ID NO: 1071902 - RNA, 22 nt, Human
uccauggguagcccugguugag

SEQ ID NO: 1071903 - RNA, 18 nt, Human
ccucagggagauccagug

SEQ ID NO: 1071904 - RNA, 22 nt, Human
gugauucugccuggaagguccu

SEQ ID NO: 1071905 - RNA, 22 nt, Human
cagucagucaauacucuuugag

SEQ ID NO: 1071906 - RNA, 22 nt, Human
gggcagguguugucaaucuaau

SEQ ID NO: 1071907 - RNA, 19 nt, Human
ccugugacuaucuuuguaa

SEQ ID NO: 1071908 - RNA, 22 nt, Human
gcagagcagaggugcagguugg

SEQ ID NO: 1071909 - RNA, 22 nt, Human
ccuggaagauucaccacuacca

SEQ ID NO: 1071910 - RNA, 20 nt, Human
agacccucuggacugggccc

SEQ ID NO: 1071911 - RNA, 22 nt, Human
uucaggaugaaagugugcaaca

SEQ ID NO: 1071912 - RNA, 22 nt, Human
guaauugacucagcucuguuca

SEQ ID NO: 1071913 - RNA, 22 nt, Human
caugcacuuaccugaaauucaa

SEQ ID NO: 1071914 - RNA, 22 nt, Human
gagaggcugacuggcuguccug

SEQ ID NO: 1071915 - RNA, 20 nt, Human
uguaaaacaaggugaauccu

SEQ ID NO: 1071916 - RNA, 22 nt, Human
gcuaggaaucggacccaggaag

SEQ ID NO: 1071917 - RNA, 22 nt, Human
uaagucaucccauaacagugcu

SEQ ID NO: 1071918 - RNA, 22 nt, Human
guggcaggucccauuggagcag

SEQ ID NO: 1071919 - RNA, 22 nt, Human
uccaauuuguuugaugauggaa

SEQ ID NO: 1071920 - RNA, 22 nt, Human
cuggcccagucucagaguguca

SEQ ID NO: 1071921 - RNA, 20 nt, Human
cuugccaguucccuggcaga

SEQ ID NO: 1071922 - RNA, 22 nt, Human
ucagggaagacuucuuagagga

SEQ ID NO: 1071923 - RNA, 22 nt, Human
uggcugagaaaaugguuuuagg

SEQ ID NO: 1071924 - RNA, 22 nt, Human
aaaugcagacagcuucacacac

SEQ ID NO: 1071925 - RNA, 22 nt, Human
uggcagcauuuuuuccagaaca

SEQ ID NO: 1071926 - RNA, 22 nt, Human
cugcugcucagugucaucaugu

SEQ ID NO: 1071927 - RNA, 21 nt, Human
uuagcuuucuagaaucuuugu

SEQ ID NO: 1071928 - RNA, 22 nt, Human
acacagccgugaaucugcuucu

SEQ ID NO: 1071929 - RNA, 22 nt, Human
cagagcaguggagaguaggucu

SEQ ID NO: 1071930 - RNA, 22 nt, Human
aacagcuuugagcaguucugua

SEQ ID NO: 1071931 - RNA, 22 nt, Human
augcaguacauacaaacacuga

SEQ ID NO: 1071932 - RNA, 22 nt, Human
ucaguuuugauuccugguucuc

SEQ ID NO: 1071933 - RNA, 22 nt, Human
agcagcagaucaaacaggcuug

SEQ ID NO: 1071934 - RNA, 22 nt, Human
gagcugcaugcggaaaccuguu

SEQ ID NO: 1071935 - RNA, 23 nt, Human
uuacaacaguguccauauuugua

SEQ ID NO: 1071936 - RNA, 19 nt, Human
agcuuuuacuaacagcaga

SEQ ID NO: 1071937 - RNA, 22 nt, Human
ccuggccacucagguguggggc

SEQ ID NO: 1071938 - RNA, 22 nt, Human
agaauauugaaaguucuugaca

SEQ ID NO: 1071939 - RNA, 22 nt, Human
agucaguggcuccgagccuggu

SEQ ID NO: 1071940 - RNA, 22 nt, Human
ccucugaguuagagaucuagau

SEQ ID NO: 1071941 - RNA, 22 nt, Human
ccuuuacaguaugguuguauca

SEQ ID NO: 1071942 - RNA, 22 nt, Human
aaugcuuuagcagugauuagug

SEQ ID NO: 1071943 - RNA, 22 nt, Human
aaaggcuaugagauagaagaua

SEQ ID NO: 1071944 - RNA, 22 nt, Human
ggcuggcaagucagugcugaug

SEQ ID NO: 1071945 - RNA, 22 nt, Human
uggaagaugaauaaagauucua

SEQ ID NO: 1071946 - RNA, 22 nt, Human
gugggggaugcugaguuggaaa

SEQ ID NO: 1071947 - RNA, 22 nt, Human
cugggccagucucggccgcucu

SEQ ID NO: 1071948 - RNA, 22 nt, Human
cuguguggacugguugaggccc

SEQ ID NO: 1071949 - RNA, 22 nt, Human
aaggaaaggaugagcaugcauu

SEQ ID NO: 1071950 - RNA, 22 nt, Human
aggugcagcugguggagucugg

SEQ ID NO: 1071951 - RNA, 22 nt, Human
uuuuaucaaucauuaagacauu

SEQ ID NO: 1071952 - RNA, 22 nt, Human
ugcaguggaggccgugagacag

SEQ ID NO: 1071953 - RNA, 22 nt, Human
gcaggagguugagccaggacug

SEQ ID NO: 1071954 - RNA, 22 nt, Human
acacuguaaagugaugcuuaaa

SEQ ID NO: 1071955 - RNA, 22 nt, Human
uaccauuuacuugaaaauaaaa

SEQ ID NO: 1071956 - RNA, 22 nt, Human
cagcagaguaauucucaccucu

SEQ ID NO: 1071957 - RNA, 22 nt, Human
agugaaaacacuaguucuugcc

SEQ ID NO: 1071958 - RNA, 19 nt, Human
gcuccugggccucacucau

SEQ ID NO: 1071959 - RNA, 22 nt, Human
cagaggccauauuucuucacuc

SEQ ID NO: 1071960 - RNA, 22 nt, Human
aggauccuuuggccacuucuua

SEQ ID NO: 1071961 - RNA, 22 nt, Human
uucugggacaucuggacaguuu

SEQ ID NO: 1071962 - RNA, 22 nt, Human
ggcugccucuggaagcuggaga

SEQ ID NO: 1071963 - RNA, 22 nt, Human
ucacagaauugacaugggaauc

SEQ ID NO: 1071964 - RNA, 22 nt, Human
gccucagagggcccuagggaca

SEQ ID NO: 1071965 - RNA, 22 nt, Human
acuucauuguaauauuauagca

SEQ ID NO: 1071966 - RNA, 22 nt, Human
cugagccaugagccugcgccca

SEQ ID NO: 1071967 - RNA, 22 nt, Human
caaaggcuucaucucagagcag

SEQ ID NO: 1071968 - RNA, 19 nt, Human
cugcucccuccuucuggca

SEQ ID NO: 1071969 - RNA, 22 nt, Human
uugugucccccuuugagagcca

SEQ ID NO: 1071970 - RNA, 22 nt, Human
acucugccccgaguucugggaa

SEQ ID NO: 1071971 - RNA, 22 nt, Human
gccaguggcuugccaggcagga

SEQ ID NO: 1071972 - RNA, 22 nt, Human
ggagugugauuguucucuguua

SEQ ID NO: 1071973 - RNA, 22 nt, Human
cccuuuaaggucugauuuucag

SEQ ID NO: 1071974 - RNA, 22 nt, Human
gccaguggaggacccauggaga

SEQ ID NO: 1071975 - RNA, 22 nt, Human
caggagcccguugcuccggcgg

SEQ ID NO: 1071976 - RNA, 22 nt, Human
aaguuuuauuggcuauagcacu

SEQ ID NO: 1071977 - RNA, 22 nt, Human
acauuuuuauucaucaaagcag

SEQ ID NO: 1071978 - RNA, 22 nt, Human
aaaauuaagugucugggaagcc

SEQ ID NO: 1071979 - RNA, 22 nt, Human
aggcugaggcagguggaucacu

SEQ ID NO: 1071980 - RNA, 22 nt, Human
cuguacaucucugaggacagua

SEQ ID NO: 1071981 - RNA, 19 nt, Human
cagaguacaccagauagga

SEQ ID NO: 1071982 - RNA, 22 nt, Human
agcugaugccauguggaacagu

SEQ ID NO: 1071983 - RNA, 17 nt, Human
agcagaagucagaggga

SEQ ID NO: 1071984 - RNA, 22 nt, Human
uuauucacucugaagccauccu

SEQ ID NO: 1071985 - RNA, 22 nt, Human
aggggagcuaacaccagagccc

SEQ ID NO: 1071986 - RNA, 22 nt, Human
gcagauggaucaccugaggucg

SEQ ID NO: 1071987 - RNA, 22 nt, Human
cucccugggccucaguuucucu

SEQ ID NO: 1071988 - RNA, 22 nt, Human
agaagugguguguggccgagcu

SEQ ID NO: 1071989 - RNA, 20 nt, Human
ugaaggccauuuguuccaga

SEQ ID NO: 1071990 - RNA, 22 nt, Human
ggaggagcacuucugagcucag

SEQ ID NO: 1071991 - RNA, 23 nt, Human
uuauugcauccaaaugcauuccu

SEQ ID NO: 1071992 - RNA, 18 nt, Human
uucaucaugacucugugg

SEQ ID NO: 1071993 - RNA, 22 nt, Human
ucuaaacauugguauggagcag

SEQ ID NO: 1071994 - RNA, 22 nt, Human
aguggcugccaagagcaaugcu

SEQ ID NO: 1071995 - RNA, 22 nt, Human
ucugcuguauuagguugaacug

SEQ ID NO: 1071996 - RNA, 22 nt, Human
uaaauaucaccuggaauuguua

SEQ ID NO: 1071997 - RNA, 22 nt, Human
uucauuuguaacucuguuaggg

SEQ ID NO: 1071998 - RNA, 22 nt, Human
caguuuuagggcaaugugaaga

SEQ ID NO: 1071999 - RNA, 20 nt, Human
aggcagagcgcacuuuuaga

SEQ ID NO: 1072000 - RNA, 23 nt, Human
ugucauugugacuacagaaccag

SEQ ID NO: 1072001 - RNA, 22 nt, Human
aaagugaugaacucugugaccu

SEQ ID NO: 1072002 - RNA, 22 nt, Human
gagaaacuguuggaauuuuaau

SEQ ID NO: 1072003 - RNA, 22 nt, Human
caguugcuacaguucaagugug

SEQ ID NO: 1072004 - RNA, 22 nt, Human
ugaaugaguuuggcugcuguuc

SEQ ID NO: 1072005 - RNA, 22 nt, Human
ucaaaguauaauugcuuuuuug

SEQ ID NO: 1072006 - RNA, 22 nt, Human
gaaacuguauguaguuuuuggg

SEQ ID NO: 1072007 - RNA, 22 nt, Human
uuuguagauucauugaacuuuu

SEQ ID NO: 1072008 - RNA, 18 nt, Human
aagcugggaaggagacag

SEQ ID NO: 1072009 - RNA, 22 nt, Human
uacaguagacaauguuaguaug

SEQ ID NO: 1072010 - RNA, 22 nt, Human
uucuuagaugauuaaugauggg

SEQ ID NO: 1072011 - RNA, 22 nt, Human
aaguguuuagguuugcagucga

SEQ ID NO: 1072012 - RNA, 22 nt, Human
ccugcccagcuucaccucaggc

SEQ ID NO: 1072013 - RNA, 22 nt, Human
gccuucaggaggguuccagaca

SEQ ID NO: 1072014 - RNA, 22 nt, Human
ccaggugcucuugccagggcug

SEQ ID NO: 1072015 - RNA, 22 nt, Human
ucugcaauguuuucccauccug

SEQ ID NO: 1072016 - RNA, 22 nt, Human
cugguucaucgcggccacuuau

SEQ ID NO: 1072017 - RNA, 22 nt, Human
gauuucuuuguacccacaaucc

SEQ ID NO: 1072018 - RNA, 22 nt, Human
cccugcuuucaaccuucuagcu

SEQ ID NO: 1072019 - RNA, 22 nt, Human
uuuaugcagccucaguaucaga

SEQ ID NO: 1072020 - RNA, 22 nt, Human
ggggaagauuuuuaauuaguaa

SEQ ID NO: 1072021 - RNA, 22 nt, Human
uuauuucuacuauuuugccuga

SEQ ID NO: 1072022 - RNA, 22 nt, Human
auuaagaugugggaaaauuuaa

SEQ ID NO: 1072023 - RNA, 22 nt, Human
ucaguguuuuccagggucuacu

SEQ ID NO: 1072024 - RNA, 22 nt, Human
cagaagaggacuggguagcuca

SEQ ID NO: 1072025 - RNA, 22 nt, Human
ggcugccuucccugagccccgg

SEQ ID NO: 1072026 - RNA, 22 nt, Human
aggcucagugauguaaaauaua

SEQ ID NO: 1072027 - RNA, 22 nt, Human
gcugucuggguugagggcccug

SEQ ID NO: 1072028 - RNA, 22 nt, Human
ccaggcagagugcuccagaaag

SEQ ID NO: 1072029 - RNA, 22 nt, Human
ucuggaguugaaguucuucccc

SEQ ID NO: 1072030 - RNA, 22 nt, Human
agcugcucugauaaaccuacuu

SEQ ID NO: 1072031 - RNA, 22 nt, Human
cagcagcuacuuggagcagcag

SEQ ID NO: 1072032 - RNA, 19 nt, Human
agcagccaucgaccaugga

SEQ ID NO: 1072033 - RNA, 22 nt, Human
ucccaggcuggcaggcagcagu

SEQ ID NO: 1072034 - RNA, 22 nt, Human
uacaaagugaaauaauucugag

SEQ ID NO: 1072035 - RNA, 22 nt, Human
aaaagguuuugaguacaaauau

SEQ ID NO: 1072036 - RNA, 22 nt, Human
aaauggaauguguuuauaauuc

SEQ ID NO: 1072037 - RNA, 22 nt, Human
aauuacuuaagagaaacuuuga

SEQ ID NO: 1072038 - RNA, 22 nt, Human
ugggccuggacaucuguauuuu

SEQ ID NO: 1072039 - RNA, 22 nt, Human
uuccuauuuccaugaaacacaa

SEQ ID NO: 1072040 - RNA, 22 nt, Human
gcacagaauaacacucugggcu

SEQ ID NO: 1072041 - RNA, 22 nt, Human
uguauuugggucacaagauggg

SEQ ID NO: 1072042 - RNA, 22 nt, Human
cagcucuggguaggaggaaucu

SEQ ID NO: 1072043 - RNA, 22 nt, Human
ugcagaggagcuggaaggcugg

SEQ ID NO: 1072044 - RNA, 22 nt, Human
ucucagagaucuuucugcaugu

SEQ ID NO: 1072045 - RNA, 22 nt, Human
cagcaucuuucucuucuggagu

SEQ ID NO: 1072046 - RNA, 17 nt, Human
aaggccauuuccaccca

SEQ ID NO: 1072047 - RNA, 22 nt, Human
uggagccagagcgcagccuggg

SEQ ID NO: 1072048 - RNA, 22 nt, Human
ucucauucauacccuacaugcu

SEQ ID NO: 1072049 - RNA, 22 nt, Human
ucuggaguguuucuaauuacug

SEQ ID NO: 1072050 - RNA, 22 nt, Human
uucaguauacauuaucuaauug

SEQ ID NO: 1072051 - RNA, 22 nt, Human
cuucugugauuugguuaggaua

SEQ ID NO: 1072052 - RNA, 22 nt, Human
aaucaacuguuuccacagggag

SEQ ID NO: 1072053 - RNA, 22 nt, Human
ucccagagcaguacuccaggag

SEQ ID NO: 1072054 - RNA, 22 nt, Human
aacacuuuuuaguaaagauuga

SEQ ID NO: 1072055 - RNA, 22 nt, Human
acaacauuauacauagaaagcu

SEQ ID NO: 1072056 - RNA, 22 nt, Human
aagggcaggcacccacccucac

SEQ ID NO: 1072057 - RNA, 22 nt, Human
aggcagccuauggggagcucag

SEQ ID NO: 1072058 - RNA, 22 nt, Human
gaggcucacuaggcauccuggg

SEQ ID NO: 1072059 - RNA, 20 nt, Human
gguagcagcugcugucaucc

SEQ ID NO: 1072060 - RNA, 22 nt, Human
uagcuuguuacacagcaauguu

SEQ ID NO: 1072061 - RNA, 22 nt, Human
gccucccuggcccacagcagcg

SEQ ID NO: 1072062 - RNA, 23 nt, Human
uccaaacucaagacauuaauaag

SEQ ID NO: 1072063 - RNA, 22 nt, Human
gagagcuguccggcugagcagc

SEQ ID NO: 1072064 - RNA, 22 nt, Human
gcacagaacccuaucuuucgga

SEQ ID NO: 1072065 - RNA, 18 nt, Human
auccaacuaucgcucauu

SEQ ID NO: 1072066 - RNA, 21 nt, Human
agcaggugcuguuggaggaaa

SEQ ID NO: 1072067 - RNA, 22 nt, Human
uggcagcacuagguacugagcu

SEQ ID NO: 1072068 - RNA, 22 nt, Human
aauacauaauaaguuuugucug

SEQ ID NO: 1072069 - RNA, 22 nt, Human
cagcuguuaccaaucuuagggc

SEQ ID NO: 1072070 - RNA, 22 nt, Human
ucaggcucugagcugaugcuaa

SEQ ID NO: 1072071 - RNA, 22 nt, Human
caugcugaugaacuucuacuug

SEQ ID NO: 1072072 - RNA, 19 nt, Human
gcugggagcagacccuccc

SEQ ID NO: 1072073 - RNA, 22 nt, Human
acagcuguguuuuauaaucagc

SEQ ID NO: 1072074 - RNA, 22 nt, Human
acacacuguugcucauccaggc

SEQ ID NO: 1072075 - RNA, 22 nt, Human
ucagucuuugcuuaugacaaua

SEQ ID NO: 1072076 - RNA, 22 nt, Human
ggaagccaggccaaugagaaca

SEQ ID NO: 1072077 - RNA, 19 nt, Human
agagacugccaccagcugu

SEQ ID NO: 1072078 - RNA, 22 nt, Human
uuugagaagcaucugguccacu

SEQ ID NO: 1072079 - RNA, 22 nt, Human
cuucuucaauagcaagcgcaua

SEQ ID NO: 1072080 - RNA, 22 nt, Human
uguaaagacgcuuauagcuugc

SEQ ID NO: 1072081 - RNA, 22 nt, Human
gaaaugcaggcuuggauucagc

SEQ ID NO: 1072082 - RNA, 22 nt, Human
ccugagggucaaggagcccuag

SEQ ID NO: 1072083 - RNA, 22 nt, Human
ucagaagcaggagugugcacaa

SEQ ID NO: 1072084 - RNA, 22 nt, Human
uccaggcuacuuggauuccugg

SEQ ID NO: 1072085 - RNA, 22 nt, Human
ggcaggcaggucuucauggccc

SEQ ID NO: 1072086 - RNA, 23 nt, Human
ucagugauguugaaccuagcagu

SEQ ID NO: 1072087 - RNA, 22 nt, Human
aucaccaggcaaaaugucagag

SEQ ID NO: 1072088 - RNA, 22 nt, Human
ugugcaaaguguacaaauuaau

SEQ ID NO: 1072089 - RNA, 22 nt, Human
cacagaaaggcucaaaucccaa

SEQ ID NO: 1072090 - RNA, 22 nt, Human
caucuucaggggcuacaucugu

SEQ ID NO: 1072091 - RNA, 22 nt, Human
uccuugaauugugccacuuacc

SEQ ID NO: 1072092 - RNA, 22 nt, Human
ucuucaugucaugguauauuga

SEQ ID NO: 1072093 - RNA, 22 nt, Human
acugucugcccugagaugccag

SEQ ID NO: 1072094 - RNA, 22 nt, Human
ugcagggcagauaugacuguag

SEQ ID NO: 1072095 - RNA, 22 nt, Human
ggcucaggcuggagugcagugg

SEQ ID NO: 1072096 - RNA, 22 nt, Human
augugacuccaggcaguuuugu

SEQ ID NO: 1072097 - RNA, 22 nt, Human
cuuauucagaccuuggauucuu

SEQ ID NO: 1072098 - RNA, 22 nt, Human
cugucauugagccugucagggc

SEQ ID NO: 1072099 - RNA, 22 nt, Human
aguccccucuaacccaacuuua

SEQ ID NO: 1072100 - RNA, 22 nt, Human
gacauuuagaagucuaauggcc

SEQ ID NO: 1072101 - RNA, 22 nt, Human
auucacaauuagaaguagauaa

SEQ ID NO: 1072102 - RNA, 22 nt, Human
cccaggaaaugggcucuugccu

SEQ ID NO: 1072103 - RNA, 22 nt, Human
auugaaagguuuugagcagaua

SEQ ID NO: 1072104 - RNA, 23 nt, Human
ccucaggggaccugugagccuga

SEQ ID NO: 1072105 - RNA, 22 nt, Human
gaggaggcacuaguuagugaca

SEQ ID NO: 1072106 - RNA, 22 nt, Human
cacaucuucuuaacuccaaagu

SEQ ID NO: 1072107 - RNA, 22 nt, Human
agccucaguuucaggccuccuc

SEQ ID NO: 1072108 - RNA, 22 nt, Human
uagcuuccagaauuuaauguca

SEQ ID NO: 1072109 - RNA, 22 nt, Human
aacagcugucugccuaucucug

SEQ ID NO: 1072110 - RNA, 22 nt, Human
ucauaacagcuaagucccuuuc

SEQ ID NO: 1072111 - RNA, 22 nt, Human
ucaucacuguaucauugauaga

SEQ ID NO: 1072112 - RNA, 22 nt, Human
ugcaggcucugugugugccugg

SEQ ID NO: 1072113 - RNA, 20 nt, Human
ucacauccucucccaacaug

SEQ ID NO: 1072114 - RNA, 22 nt, Human
guugugcagaagugccucagua

SEQ ID NO: 1072115 - RNA, 23 nt, Human
cauuucugggagauuuauaaaau

SEQ ID NO: 1072116 - RNA, 22 nt, Human
uccagggcuggguuggcucagc

SEQ ID NO: 1072117 - RNA, 22 nt, Human
cagcucccgccaucgggaggca

SEQ ID NO: 1072118 - RNA, 22 nt, Human
cugugcccauaaucugguauuu

SEQ ID NO: 1072119 - RNA, 22 nt, Human
aggcucagagaugaguaagcac

SEQ ID NO: 1072120 - RNA, 22 nt, Human
ugguuuuaaaaacaugcugcau

SEQ ID NO: 1072121 - RNA, 22 nt, Human
guggggcucccaucuccuggcu

SEQ ID NO: 1072122 - RNA, 22 nt, Human
aaacagaaggguagguaaacau

SEQ ID NO: 1072123 - RNA, 22 nt, Human
uuuccuccuagccuccagccgc

SEQ ID NO: 1072124 - RNA, 22 nt, Human
agaagccagucgcucucccgca

SEQ ID NO: 1072125 - RNA, 17 nt, Human
gcccuggagccaggcua

SEQ ID NO: 1072126 - RNA, 22 nt, Human
cauccaauaccaguuugcaggc

SEQ ID NO: 1072127 - RNA, 22 nt, Human
uacagaauuagauuauuagaga

SEQ ID NO: 1072128 - RNA, 22 nt, Human
aauguacaauaagacaaagagg

SEQ ID NO: 1072129 - RNA, 22 nt, Human
uuaucaguuguguguauacacg

SEQ ID NO: 1072130 - RNA, 23 nt, Human
ccaggccucucagagggugugcc

SEQ ID NO: 1072131 - RNA, 22 nt, Human
gccaccucggcuuucucugcuc

SEQ ID NO: 1072132 - RNA, 22 nt, Human
ucuuuacacaagacaagaauaa

SEQ ID NO: 1072133 - RNA, 22 nt, Human
aguuacaagcuauuuuacuuaa

SEQ ID NO: 1072134 - RNA, 21 nt, Human
gucagcugugugugaggaccc

SEQ ID NO: 1072135 - RNA, 22 nt, Human
auuguucauuguacaccuagua

SEQ ID NO: 1072136 - RNA, 22 nt, Human
auguuacauaguccuuauuugu

SEQ ID NO: 1072137 - RNA, 22 nt, Human
uccauccauguaggaagauggu

SEQ ID NO: 1072138 - RNA, 19 nt, Human
gcuuuggagggagguucua

SEQ ID NO: 1072139 - RNA, 22 nt, Human
uuuaccaagauagcaucugguu

SEQ ID NO: 1072140 - RNA, 22 nt, Human
ccugggcucaagcgaucuuguc

SEQ ID NO: 1072141 - RNA, 22 nt, Human
cucuccauucccuacaguuuuc

SEQ ID NO: 1072142 - RNA, 22 nt, Human
aacauuuuuaagaccaagugcu

SEQ ID NO: 1072143 - RNA, 22 nt, Human
uggagaugcacgagcaggugga

SEQ ID NO: 1072144 - RNA, 22 nt, Human
agugggguccaucccuucccuc

SEQ ID NO: 1072145 - RNA, 22 nt, Human
auggcagagaacaaagcaacaa

SEQ ID NO: 1072146 - RNA, 22 nt, Human
uuugcuaaaagugaugaagaca

SEQ ID NO: 1072147 - RNA, 22 nt, Human
guccuggggauuauagaguguu

SEQ ID NO: 1072148 - RNA, 22 nt, Human
acugucaaauuuauggaaagag

SEQ ID NO: 1072149 - RNA, 22 nt, Human
ugcuuuaucugugagaaccuga

SEQ ID NO: 1072150 - RNA, 22 nt, Human
uggaaggaaagguagcagagaa

SEQ ID NO: 1072151 - RNA, 22 nt, Human
gccucuguaggagugagagcau

SEQ ID NO: 1072152 - RNA, 22 nt, Human
auacaaaguauugauccugagu

SEQ ID NO: 1072153 - RNA, 22 nt, Human
uccagggcuuggcugggacggu

SEQ ID NO: 1072154 - RNA, 22 nt, Human
aggcuccuugcucacaggcuca

SEQ ID NO: 1072155 - RNA, 22 nt, Human
ucucagaggucuucagccucug

SEQ ID NO: 1072156 - RNA, 22 nt, Human
acuuucuucuuaugcauuaagg

SEQ ID NO: 1072157 - RNA, 22 nt, Human
aucugaagggaaguggaaggca

SEQ ID NO: 1072158 - RNA, 22 nt, Human
agggaaaguaagcauuucauua

SEQ ID NO: 1072159 - RNA, 22 nt, Human
uuaaugacuuauauuuaaagca

SEQ ID NO: 1072160 - RNA, 22 nt, Human
ccagcuccuucugucuguggag

SEQ ID NO: 1072161 - RNA, 22 nt, Human
ggcugccuccugcugggcugga

SEQ ID NO: 1072162 - RNA, 22 nt, Human
ggagcugucuguagggcacagg

SEQ ID NO: 1072163 - RNA, 22 nt, Human
gggccuggggacaccaccauga

SEQ ID NO: 1072164 - RNA, 22 nt, Human
caagcagagacuagauagcugu

SEQ ID NO: 1072165 - RNA, 22 nt, Human
gggacaucuuucuagucagggu

SEQ ID NO: 1072166 - RNA, 22 nt, Human
agggaggaccaaugugugguua

SEQ ID NO: 1072167 - RNA, 22 nt, Human
uaaugcuuuguuuugaucuaac

SEQ ID NO: 1072168 - RNA, 22 nt, Human
ccauccugcaggaccuccauau

SEQ ID NO: 1072169 - RNA, 22 nt, Human
uaacaaguucugacagcauugu

SEQ ID NO: 1072170 - RNA, 19 nt, Human
ugccuguggcgagcaucuu

SEQ ID NO: 1072171 - RNA, 19 nt, Human
aaggaauggcuuuaaguag

SEQ ID NO: 1072172 - RNA, 22 nt, Human
guccucuggagguuuuuaggug

SEQ ID NO: 1072173 - RNA, 22 nt, Human
acuggcugcguuccugugagac

SEQ ID NO: 1072174 - RNA, 22 nt, Human
ggcacugggcaccggcugaggg

SEQ ID NO: 1072175 - RNA, 21 nt, Human
aggucagcccagcucuggaag

SEQ ID NO: 1072176 - RNA, 22 nt, Human
ccagagcccagcacacggugcu

SEQ ID NO: 1072177 - RNA, 22 nt, Human
gggcccugccccguggcucuga

SEQ ID NO: 1072178 - RNA, 22 nt, Human
ugggcucaaacuggagguuguu

SEQ ID NO: 1072179 - RNA, 22 nt, Human
ucuccuuugaaaguuaggacug

SEQ ID NO: 1072180 - RNA, 22 nt, Human
ucuggggaugagugaugucgua

SEQ ID NO: 1072181 - RNA, 22 nt, Human
aaaaaagauugaugguggaugc

SEQ ID NO: 1072182 - RNA, 22 nt, Human
cuuccaagaugaacagcaagcg

SEQ ID NO: 1072183 - RNA, 22 nt, Human
ugugcaaucuugagcaauuuau

SEQ ID NO: 1072184 - RNA, 22 nt, Human
cagaacugggcagggagcagag

SEQ ID NO: 1072185 - RNA, 22 nt, Human
uuuccaaaggaguaccacgcau

SEQ ID NO: 1072186 - RNA, 22 nt, Human
cuucccaagcuuuaguuauuuu

SEQ ID NO: 1072187 - RNA, 22 nt, Human
uuggcugagagaggaaaagggc

SEQ ID NO: 1072188 - RNA, 22 nt, Human
uucauucaucucuaaaaugccu

SEQ ID NO: 1072189 - RNA, 22 nt, Human
uucuuguucugguucuguuagc

SEQ ID NO: 1072190 - RNA, 22 nt, Human
uauguacacauacacuuguaau

SEQ ID NO: 1072191 - RNA, 22 nt, Human
cugcucugaagccaggauucug

SEQ ID NO: 1072192 - RNA, 22 nt, Human
gcuuuguguagaaggaggaugg

SEQ ID NO: 1072193 - RNA, 22 nt, Human
cacagcuucugagugaggauuu

SEQ ID NO: 1072194 - RNA, 22 nt, Human
ugcaggugugguuccucagcca

SEQ ID NO: 1072195 - RNA, 22 nt, Human
auguucuucuaucuuuauuaaa

SEQ ID NO: 1072196 - RNA, 22 nt, Human
aaugacuaaaucugaagauagg

SEQ ID NO: 1072197 - RNA, 22 nt, Human
cacuuuaacucacauuucagcu

SEQ ID NO: 1072198 - RNA, 20 nt, Human
cugcugugauucccuccucc

SEQ ID NO: 1072199 - RNA, 22 nt, Human
uggcugaacuaaugugcuguuu

SEQ ID NO: 1072200 - RNA, 22 nt, Human
ugggcucugcugcguaccaguu

SEQ ID NO: 1072201 - RNA, 22 nt, Human
aacaguaauggcauugccauga

SEQ ID NO: 1072202 - RNA, 22 nt, Human
caaggagaaaacggcuucugaa

SEQ ID NO: 1072203 - RNA, 22 nt, Human
gaacacagaagaauuucuaaga

SEQ ID NO: 1072204 - RNA, 22 nt, Human
ggggacccucaggacugcgucu

SEQ ID NO: 1072205 - RNA, 22 nt, Human
ucucagagugguggucccucug

SEQ ID NO: 1072206 - RNA, 22 nt, Human
gauuuuauagucaggaaaaaga

SEQ ID NO: 1072207 - RNA, 22 nt, Human
gaggcugauucggggaacagca

SEQ ID NO: 1072208 - RNA, 18 nt, Human
acaaaugugucacaggaa

SEQ ID NO: 1072209 - RNA, 22 nt, Human
cugggcugucccaaccccaucc

SEQ ID NO: 1072210 - RNA, 22 nt, Human
ugaagcacaggcauacacaacc

SEQ ID NO: 1072211 - RNA, 22 nt, Human
cagcuccugccugggcagcugu

SEQ ID NO: 1072212 - RNA, 22 nt, Human
ggcgcucaguguugccccagag

SEQ ID NO: 1072213 - RNA, 22 nt, Human
cagggcaggaugcugugauuau

SEQ ID NO: 1072214 - RNA, 22 nt, Human
aagucagagcaacugagacauu

SEQ ID NO: 1072215 - RNA, 22 nt, Human
cagguggcuucucugcagccuu

SEQ ID NO: 1072216 - RNA, 22 nt, Human
agcacacaggccaccuccacuu

SEQ ID NO: 1072217 - RNA, 22 nt, Human
uuucacagcuagugagcuucua

SEQ ID NO: 1072218 - RNA, 22 nt, Human
caagaugaaugaugaagugugu

SEQ ID NO: 1072219 - RNA, 22 nt, Human
uuucaaaugcaugucuuuccuc

SEQ ID NO: 1072220 - RNA, 22 nt, Human
ucauuuacuucuaugacaacau

SEQ ID NO: 1072221 - RNA, 22 nt, Human
guaggcagauaggagugcagcc

SEQ ID NO: 1072222 - RNA, 22 nt, Human
aaaauugucgaacaguaguaac

SEQ ID NO: 1072223 - RNA, 18 nt, Human
ccucaggggaccuggcag

SEQ ID NO: 1072224 - RNA, 22 nt, Human
gaguucugugauuauuugggac

SEQ ID NO: 1072225 - RNA, 22 nt, Human
cagcagcuuugccaagucagcc

SEQ ID NO: 1072226 - RNA, 22 nt, Human
aaacagauaagggacaauuuca

SEQ ID NO: 1072227 - RNA, 22 nt, Human
ugcagccaccaccucugcugaa

SEQ ID NO: 1072228 - RNA, 22 nt, Human
gaucaaaagcuggguucuaaaa

SEQ ID NO: 1072229 - RNA, 22 nt, Human
cuguggcaggaagggacuagca

SEQ ID NO: 1072230 - RNA, 22 nt, Human
caguuuuucaaaauuacaugau

SEQ ID NO: 1072231 - RNA, 22 nt, Human
uggcaaagacugcaaggacuuu

SEQ ID NO: 1072232 - RNA, 22 nt, Human
uagaauaugauuaauuuucuua

SEQ ID NO: 1072233 - RNA, 22 nt, Human
ccugggcagggcuggacucuca

SEQ ID NO: 1072234 - RNA, 22 nt, Human
guugaaagaugucuugguuccc

SEQ ID NO: 1072235 - RNA, 22 nt, Human
agggcaugcuggaggagagaca

SEQ ID NO: 1072236 - RNA, 22 nt, Human
cuauuuucauucuuacauuguc

SEQ ID NO: 1072237 - RNA, 22 nt, Human
uccuucaguucaauuaguccgu

SEQ ID NO: 1072238 - RNA, 17 nt, Human
gcugccaccuuuggagc

SEQ ID NO: 1072239 - RNA, 22 nt, Human
uccuugaaaagaaugucuccau

SEQ ID NO: 1072240 - RNA, 22 nt, Human
guggccugccagcagauggcgc

SEQ ID NO: 1072241 - RNA, 22 nt, Human
auuuccaagguaauuuugagua

SEQ ID NO: 1072242 - RNA, 22 nt, Human
ugaaaucaauaauuggugauug

SEQ ID NO: 1072243 - RNA, 22 nt, Human
uggcagaguucgcugugccuuu

SEQ ID NO: 1072244 - RNA, 22 nt, Human
gcccugcuuggucauggccuuc

SEQ ID NO: 1072245 - RNA, 22 nt, Human
cugggcuguucugccccugggu

SEQ ID NO: 1072246 - RNA, 22 nt, Human
uucauguuuugagccauucuga

SEQ ID NO: 1072247 - RNA, 22 nt, Human
gucauugcaguggcaaaucaca

SEQ ID NO: 1072248 - RNA, 22 nt, Human
ugauuuuuagcuauucugaaga

SEQ ID NO: 1072249 - RNA, 22 nt, Human
gccuugcuuugcuucuggacag

SEQ ID NO: 1072250 - RNA, 22 nt, Human
gucauuccuuauguugauucag

SEQ ID NO: 1072251 - RNA, 22 nt, Human
uauuugcaacauaaaacucuga

SEQ ID NO: 1072252 - RNA, 22 nt, Human
aggcugugcgaggucucagagu

SEQ ID NO: 1072253 - RNA, 22 nt, Human
aaagagaaacuuagaagccuga

SEQ ID NO: 1072254 - RNA, 22 nt, Human
cagggccuuguucaggagugaa

SEQ ID NO: 1072255 - RNA, 22 nt, Human
gcaggaugccagggcagcagcg

SEQ ID NO: 1072256 - RNA, 14 nt, Human
caggaagacucagc

SEQ ID NO: 1072257 - RNA, 22 nt, Human
cuucugugaccaccagcagccc

SEQ ID NO: 1072258 - RNA, 22 nt, Human
caugagauuugggaggggccag

SEQ ID NO: 1072259 - RNA, 22 nt, Human
uggcaaagaugaagcauuucgu

SEQ ID NO: 1072260 - RNA, 22 nt, Human
auacauuagaaucugguacuca

SEQ ID NO: 1072261 - RNA, 22 nt, Human
uggcucagaaggcugccuucac

SEQ ID NO: 1072262 - RNA, 22 nt, Human
accagaguuuuauuaguucuaa

SEQ ID NO: 1072263 - RNA, 22 nt, Human
agccagggacgcugcaggcuac

SEQ ID NO: 1072264 - RNA, 22 nt, Human
agcagcaugaugacagagucuc

SEQ ID NO: 1072265 - RNA, 22 nt, Human
aggaggaauugacacagaagcc

SEQ ID NO: 1072266 - RNA, 22 nt, Human
uucuuacaucaguuuauuuugu

SEQ ID NO: 1072267 - RNA, 22 nt, Human
acauuuagcuguacaaucuaug

SEQ ID NO: 1072268 - RNA, 22 nt, Human
caaaugcaggucauaaccugag

SEQ ID NO: 1072269 - RNA, 22 nt, Human
auuauguauuugguauaguuug

SEQ ID NO: 1072270 - RNA, 20 nt, Human
cagagaccugucuucacaga

SEQ ID NO: 1072271 - RNA, 22 nt, Human
cccagcccagcguucgaggggu

SEQ ID NO: 1072272 - RNA, 22 nt, Human
gccugccuucggugcgcagcgg

SEQ ID NO: 1072273 - RNA, 22 nt, Human
guggccaggacauugccaggca

SEQ ID NO: 1072274 - RNA, 22 nt, Human
gggggcuggacuuucccacaca

SEQ ID NO: 1072275 - RNA, 22 nt, Human
uuacugaaaauucuucaggauu

SEQ ID NO: 1072276 - RNA, 22 nt, Human
gaggcugaauggccagaagcca

SEQ ID NO: 1072277 - RNA, 17 nt, Human
aggauguggagaaaauu

SEQ ID NO: 1072278 - RNA, 22 nt, Human
ucccuggacagccuugccuggg

SEQ ID NO: 1072279 - RNA, 22 nt, Human
ugggccuguugccugaguccau

SEQ ID NO: 1072280 - RNA, 22 nt, Human
uccauaaaccagaaaaucaaga

SEQ ID NO: 1072281 - RNA, 19 nt, Human
augucuguugaauuucaua

SEQ ID NO: 1072282 - RNA, 22 nt, Human
ugcaggcuauaucuuauuugac

SEQ ID NO: 1072283 - RNA, 22 nt, Human
aggcugccuguuccaaucuccu

SEQ ID NO: 1072284 - RNA, 23 nt, Human
agaguccacaagauuuuccagug

SEQ ID NO: 1072285 - RNA, 22 nt, Human
ucuaaauggaaagaaaauaccu

SEQ ID NO: 1072286 - RNA, 22 nt, Human
gcugggcuggaaggccaaggca

SEQ ID NO: 1072287 - RNA, 22 nt, Human
acagggucauuuuaugaucugu

SEQ ID NO: 1072288 - RNA, 22 nt, Human
uugaccauaccuccaggcaguu

SEQ ID NO: 1072289 - RNA, 18 nt, Human
cauuccaaguucuaccuc

SEQ ID NO: 1072290 - RNA, 22 nt, Human
auugaauagaugcauuauacua

SEQ ID NO: 1072291 - RNA, 22 nt, Human
ugaagcaggaucguuugcuuca

SEQ ID NO: 1072292 - RNA, 21 nt, Human
aguggggucucuguggaggcc

SEQ ID NO: 1072293 - RNA, 22 nt, Human
cccagccucuggguucugccgg

SEQ ID NO: 1072294 - RNA, 22 nt, Human
ugcaaauggagcauguauaaga

SEQ ID NO: 1072295 - RNA, 22 nt, Human
caguggugaagagcaggggcuc

SEQ ID NO: 1072296 - RNA, 22 nt, Human
aggcacaguuucauccccgggc

SEQ ID NO: 1072297 - RNA, 20 nt, Human
uucugcuugcaaauaucaag

SEQ ID NO: 1072298 - RNA, 22 nt, Human
ggaccaaaugcuuuuuaauuga

SEQ ID NO: 1072299 - RNA, 22 nt, Human
aaacagcuuguaagguguaauu

SEQ ID NO: 1072300 - RNA, 22 nt, Human
cagacaauuaaguaauugaggu

SEQ ID NO: 1072301 - RNA, 22 nt, Human
uuuucaggccagaagauagacc

SEQ ID NO: 1072302 - RNA, 22 nt, Human
cucugcccccagcuggugcuug

SEQ ID NO: 1072303 - RNA, 22 nt, Human
gaggaaccugggcuuccauccu

SEQ ID NO: 1072304 - RNA, 16 nt, Human
gagccaggugccuuga

SEQ ID NO: 1072305 - RNA, 22 nt, Human
uuucaaacauaucuucauuacu

SEQ ID NO: 1072306 - RNA, 22 nt, Human
uaaagcaagacacacccauagc

SEQ ID NO: 1072307 - RNA, 22 nt, Human
ugucagugguagacccagaggu

SEQ ID NO: 1072308 - RNA, 22 nt, Human
agcaggcuaaauaauaauacau

SEQ ID NO: 1072309 - RNA, 22 nt, Human
cugggcugucccagggcggcag

SEQ ID NO: 1072310 - RNA, 22 nt, Human
cucagagaaaaggagcaagggu

SEQ ID NO: 1072311 - RNA, 22 nt, Human
aggucauuggggacuaucuccg

SEQ ID NO: 1072312 - RNA, 22 nt, Human
acauuugugcaacguauccaca

SEQ ID NO: 1072313 - RNA, 22 nt, Human
auuuaccauauguacugaguau

SEQ ID NO: 1072314 - RNA, 23 nt, Human
acauacauaagcaccacauuuug

SEQ ID NO: 1072315 - RNA, 22 nt, Human
ggccuggcauggggacuaaggg

SEQ ID NO: 1072316 - RNA, 22 nt, Human
cagcuccccaugguuccugaag

SEQ ID NO: 1072317 - RNA, 23 nt, Human
uggcuucugccccauucucucca

SEQ ID NO: 1072318 - RNA, 22 nt, Human
uguucccugguaaacugacucc

SEQ ID NO: 1072319 - RNA, 23 nt, Human
agaagcaaugcuuuuuuuccucu

SEQ ID NO: 1072320 - RNA, 22 nt, Human
acuguacacgugucauuuacag

SEQ ID NO: 1072321 - RNA, 22 nt, Human
ccccacaccugccgggcagcag

SEQ ID NO: 1072322 - RNA, 22 nt, Human
ucagcuuauauuuuuaguguaa

SEQ ID NO: 1072323 - RNA, 22 nt, Human
cacaggaaugaacagggaaaga

SEQ ID NO: 1072324 - RNA, 22 nt, Human
ucccagaguauuagcaauugcu

SEQ ID NO: 1072325 - RNA, 22 nt, Human
acaauauuugggggcaguuugu

SEQ ID NO: 1072326 - RNA, 22 nt, Human
accaggaaacucucgucuaguu

SEQ ID NO: 1072327 - RNA, 22 nt, Human
guccucaggaaagcagauaaca

SEQ ID NO: 1072328 - RNA, 22 nt, Human
cuggcccucgucaguuucacug

SEQ ID NO: 1072329 - RNA, 22 nt, Human
gggcugaccaaugccuugcuuu

SEQ ID NO: 1072330 - RNA, 22 nt, Human
uguuaacagaggucauuuuggg

SEQ ID NO: 1072331 - RNA, 22 nt, Human
uggcugagugaacauguccauu

SEQ ID NO: 1072332 - RNA, 22 nt, Human
caggaaaugaaagcuagcuaau

SEQ ID NO: 1072333 - RNA, 22 nt, Human
aggcugagggcuccugagggca

SEQ ID NO: 1072334 - RNA, 22 nt, Human
caggagcuacucagguuggguu

SEQ ID NO: 1072335 - RNA, 22 nt, Human
acuaaaacaguggcuaguagac

SEQ ID NO: 1072336 - RNA, 22 nt, Human
uguauuuugaguccaaucuccu

SEQ ID NO: 1072337 - RNA, 22 nt, Human
gcugccaccguggagaugagug

SEQ ID NO: 1072338 - RNA, 22 nt, Human
ucucaccauggugcuugcuuau

SEQ ID NO: 1072339 - RNA, 22 nt, Human
ucucaaacuacacuguaaauug

SEQ ID NO: 1072340 - RNA, 22 nt, Human
accugcaagcauuacacuucua

SEQ ID NO: 1072341 - RNA, 22 nt, Human
gcuggcaggguucucacugaaa

SEQ ID NO: 1072342 - RNA, 22 nt, Human
ucaguggauuguagaaggcuua

SEQ ID NO: 1072343 - RNA, 22 nt, Human
gcugucccgaaccccugguaau

SEQ ID NO: 1072344 - RNA, 22 nt, Human
guucacaguucagccuguaaca

SEQ ID NO: 1072345 - RNA, 22 nt, Human
auuucuuccucugucaguaacu

SEQ ID NO: 1072346 - RNA, 21 nt, Human
gccacugcacuccagccuggg

SEQ ID NO: 1072347 - RNA, 22 nt, Human
ucuuuagagcacgggaaaaaca

SEQ ID NO: 1072348 - RNA, 23 nt, Human
aggcagugggggccacuuugcuu

SEQ ID NO: 1072349 - RNA, 22 nt, Human
uuuccacaauguuuuugcagga

SEQ ID NO: 1072350 - RNA, 22 nt, Human
agaaagggaugagguagcugcu

SEQ ID NO: 1072351 - RNA, 22 nt, Human
gaggaggaaguucucuguaggc

SEQ ID NO: 1072352 - RNA, 22 nt, Human
ccacauuuggagaagauacuuu

SEQ ID NO: 1072353 - RNA, 22 nt, Human
ugcaguggugguaaagaugcuc

SEQ ID NO: 1072354 - RNA, 22 nt, Human
acauagcuuaaaugagaagaua

SEQ ID NO: 1072355 - RNA, 22 nt, Human
ucuggccaacaaaaacuaaguc

SEQ ID NO: 1072356 - RNA, 22 nt, Human
ugggggucaggaugaggccuug

SEQ ID NO: 1072357 - RNA, 22 nt, Human
ugcagaagcagagccgguggcc

SEQ ID NO: 1072358 - RNA, 22 nt, Human
acacacuucagauguaauuugu

SEQ ID NO: 1072359 - RNA, 22 nt, Human
uuauauuaguuagacuugcugu

SEQ ID NO: 1072360 - RNA, 22 nt, Human
ucccucaggugguucuuguuuc

SEQ ID NO: 1072361 - RNA, 22 nt, Human
aaggaacacuacaaggcuggga

SEQ ID NO: 1072362 - RNA, 22 nt, Human
cugggcuuucaggcccuaaggc

SEQ ID NO: 1072363 - RNA, 22 nt, Human
caggcaggucagugaagaagga

SEQ ID NO: 1072364 - RNA, 22 nt, Human
aggguauguuuuuaucuacugu

SEQ ID NO: 1072365 - RNA, 22 nt, Human
uggcugagaccaucagggugua

SEQ ID NO: 1072366 - RNA, 22 nt, Human
uggcagagucucuccuuuccag

SEQ ID NO: 1072367 - RNA, 22 nt, Human
gggcucuggauggagccugcag

SEQ ID NO: 1072368 - RNA, 22 nt, Human
ugccagccagguucugaggcua

SEQ ID NO: 1072369 - RNA, 22 nt, Human
cagcccuggaacagcugacuca

SEQ ID NO: 1072370 - RNA, 22 nt, Human
accaggaaaaacacuguguugg

SEQ ID NO: 1072371 - RNA, 22 nt, Human
ugaagcaggcauugacugauga

SEQ ID NO: 1072372 - RNA, 22 nt, Human
ucccacuggacgucugugcugg

SEQ ID NO: 1072373 - RNA, 22 nt, Human
uucuagauaucuaguguauaac

SEQ ID NO: 1072374 - RNA, 23 nt, Human
aaucuggcugauguuuuuucucu

SEQ ID NO: 1072375 - RNA, 23 nt, Human
ugccucugccucccuagucugca

SEQ ID NO: 1072376 - RNA, 22 nt, Human
aagugauuuagucuuauaaagg

SEQ ID NO: 1072377 - RNA, 22 nt, Human
uggcaagagggaugcaagguuu

SEQ ID NO: 1072378 - RNA, 22 nt, Human
auaaauuuucuugcuguacuua

SEQ ID NO: 1072379 - RNA, 19 nt, Human
cuggaaaguuggcagugag

SEQ ID NO: 1072380 - RNA, 22 nt, Human
ugccagcaguagcaguaggcca

SEQ ID NO: 1072381 - RNA, 22 nt, Human
aaggcacuagcagaauuaguga

SEQ ID NO: 1072382 - RNA, 22 nt, Human
agucaauuaucucuaggucauc

SEQ ID NO: 1072383 - RNA, 22 nt, Human
uggcaguccccugugccuggaa

SEQ ID NO: 1072384 - RNA, 22 nt, Human
uggaaggaagccaaggaagguu

SEQ ID NO: 1072385 - RNA, 22 nt, Human
cuuacaaaggagaggagauagg

SEQ ID NO: 1072386 - RNA, 22 nt, Human
ugguaaagugcucuaacuucau

SEQ ID NO: 1072387 - RNA, 22 nt, Human
cugugaaaugcuuugcgauggu

SEQ ID NO: 1072388 - RNA, 22 nt, Human
acagacaaguaguucagacaag

SEQ ID NO: 1072389 - RNA, 22 nt, Human
uuacauuagacccacuuucaug

SEQ ID NO: 1072390 - RNA, 18 nt, Human
gcugcugguggagggagc

SEQ ID NO: 1072391 - RNA, 22 nt, Human
caguagauuugguaaacuagga

SEQ ID NO: 1072392 - RNA, 22 nt, Human
ugggaacaguagcugcugagcu

SEQ ID NO: 1072393 - RNA, 22 nt, Human
gccaggcagauaugugagcuua

SEQ ID NO: 1072394 - RNA, 22 nt, Human
ggggacugccuuccacagacac

SEQ ID NO: 1072395 - RNA, 22 nt, Human
uuguuuguaugcugagaagaau

SEQ ID NO: 1072396 - RNA, 22 nt, Human
gcuguggucugugagcuccaaa

SEQ ID NO: 1072397 - RNA, 22 nt, Human
ucugagagcaggaggagcugcu

SEQ ID NO: 1072398 - RNA, 22 nt, Human
aguguacaucagaacauaucaa

SEQ ID NO: 1072399 - RNA, 22 nt, Human
ucaaggaaugacuauaugagga

SEQ ID NO: 1072400 - RNA, 22 nt, Human
cagggcccaagacacaaugagg

SEQ ID NO: 1072401 - RNA, 22 nt, Human
auuuauugagacuuaacaaccc

SEQ ID NO: 1072402 - RNA, 22 nt, Human
aacaugcuugcuuagaaucagc

SEQ ID NO: 1072403 - RNA, 23 nt, Human
uccuucagagccucccuccaagc

SEQ ID NO: 1072404 - RNA, 22 nt, Human
aauaagaacaacuaagguuuau

SEQ ID NO: 1072405 - RNA, 22 nt, Human
aauuauuuaacuccuuuggaga

SEQ ID NO: 1072406 - RNA, 21 nt, Human
aggcucagagaucaaacagua

SEQ ID NO: 1072407 - RNA, 22 nt, Human
cccaggaagggaugccaaggaa

SEQ ID NO: 1072408 - RNA, 22 nt, Human
agaguuaagacguacaugagug

SEQ ID NO: 1072409 - RNA, 22 nt, Human
aggaggccgcugaugggcuccc

SEQ ID NO: 1072410 - RNA, 22 nt, Human
aguggaugguauugggaccagg

SEQ ID NO: 1072411 - RNA, 22 nt, Human
uguguccuuuggaggaucagcg

SEQ ID NO: 1072412 - RNA, 21 nt, Human
ugguggagugugcugagcaug

SEQ ID NO: 1072413 - RNA, 22 nt, Human
cugagccagagggagucggguc

SEQ ID NO: 1072414 - RNA, 22 nt, Human
uagaaagacuguccagauuuca

SEQ ID NO: 1072415 - RNA, 22 nt, Human
caucacuguccucagcauucca

SEQ ID NO: 1072416 - RNA, 22 nt, Human
agaaaacagaaagucauuggug

SEQ ID NO: 1072417 - RNA, 22 nt, Human
caucacaguggcuguuuauuua

SEQ ID NO: 1072418 - RNA, 22 nt, Human
ggcucacgcaauuaucccggcc

SEQ ID NO: 1072419 - RNA, 22 nt, Human
augcagcugucagggagaacau

SEQ ID NO: 1072420 - RNA, 22 nt, Human
uauacacauuuuuaccuauagu

SEQ ID NO: 1072421 - RNA, 22 nt, Human
aaauuccaccagaaucaguaau

SEQ ID NO: 1072422 - RNA, 22 nt, Human
uuuccagauuaagauaccacuu

SEQ ID NO: 1072423 - RNA, 22 nt, Human
ccauggccgccgcugcucagga

SEQ ID NO: 1072424 - RNA, 22 nt, Human
uuucaaauggagucgugaaaug

SEQ ID NO: 1072425 - RNA, 22 nt, Human
aguuuuucugcuggucucacua

SEQ ID NO: 1072426 - RNA, 22 nt, Human
uuuuucuuaaauguggguuggc

SEQ ID NO: 1072427 - RNA, 22 nt, Human
caucagucagucucuucaguau

SEQ ID NO: 1072428 - RNA, 22 nt, Human
cugaggcagagggcagaccaga

SEQ ID NO: 1072429 - RNA, 22 nt, Human
aguccaaggagagacagcauuu

SEQ ID NO: 1072430 - RNA, 23 nt, Human
cugcugugaaacaugguuuuggu

SEQ ID NO: 1072431 - RNA, 22 nt, Human
ggguagcaugugucagaguuug

SEQ ID NO: 1072432 - RNA, 22 nt, Human
cuccagggcagcauggcagugg

SEQ ID NO: 1072433 - RNA, 22 nt, Human
auaaacagaguaguugcuacug

SEQ ID NO: 1072434 - RNA, 22 nt, Human
cugggagucaccaggagcaagg

SEQ ID NO: 1072435 - RNA, 22 nt, Human
guuauucaacuugugucucuua

SEQ ID NO: 1072436 - RNA, 22 nt, Human
ggucaggggcugcucuacagag

SEQ ID NO: 1072437 - RNA, 22 nt, Human
gcccagcuuuuugaggcaggca

SEQ ID NO: 1072438 - RNA, 22 nt, Human
ucugaggcauacccaggccccc

SEQ ID NO: 1072439 - RNA, 22 nt, Human
aaggcacuagcaagcugccugg

SEQ ID NO: 1072440 - RNA, 22 nt, Human
guucuucaaagugacaacuaaa

SEQ ID NO: 1072441 - RNA, 22 nt, Human
gcuucaaacugagcuucaagug

SEQ ID NO: 1072442 - RNA, 22 nt, Human
cucuuuuucagccuuaccaaag

SEQ ID NO: 1072443 - RNA, 22 nt, Human
uugaagaaguaauuuuaagucu

SEQ ID NO: 1072444 - RNA, 22 nt, Human
ugccaggccaaugaaggcaggg

SEQ ID NO: 1072445 - RNA, 22 nt, Human
caggaugcacuaggaaccaggg

SEQ ID NO: 1072446 - RNA, 21 nt, Human
uuagaaagcucacuacaguua

SEQ ID NO: 1072447 - RNA, 22 nt, Human
cuggaaggguacauaggaaacu

SEQ ID NO: 1072448 - RNA, 19 nt, Human
gccacuccugaugcugccc

SEQ ID NO: 1072449 - RNA, 22 nt, Human
ugcacacacucguguauaugag

SEQ ID NO: 1072450 - RNA, 22 nt, Human
auucaguuucauggcacagcua

SEQ ID NO: 1072451 - RNA, 22 nt, Human
ugagcaguaggucugaauagug

SEQ ID NO: 1072452 - RNA, 22 nt, Human
acagggccauuaucuguucuag

SEQ ID NO: 1072453 - RNA, 22 nt, Human
uacaaaacagugcucugguccu

SEQ ID NO: 1072454 - RNA, 22 nt, Human
gccuggagugguccugcugccc

SEQ ID NO: 1072455 - RNA, 22 nt, Human
ggguggaggagaacaggcccca

SEQ ID NO: 1072456 - RNA, 22 nt, Human
gcugucucauacaaggcccugc

SEQ ID NO: 1072457 - RNA, 22 nt, Human
ccaaggagcucauauucuuguu

SEQ ID NO: 1072458 - RNA, 22 nt, Human
ggcagcuguaagaugagugaau

SEQ ID NO: 1072459 - RNA, 22 nt, Human
ugggacagugugccuugcuccu

SEQ ID NO: 1072460 - RNA, 22 nt, Human
cccuguccuuggcugugaggcu

SEQ ID NO: 1072461 - RNA, 22 nt, Human
aggcgcagaaggccaggggccu

SEQ ID NO: 1072462 - RNA, 22 nt, Human
ucaggaacccccgcugggugaa

SEQ ID NO: 1072463 - RNA, 22 nt, Human
ggcaagcauaaccuguacagcc

SEQ ID NO: 1072464 - RNA, 20 nt, Human
ucacaggggaccaggagcag

SEQ ID NO: 1072465 - RNA, 22 nt, Human
gcuggggcugggcugaggaaga

SEQ ID NO: 1072466 - RNA, 22 nt, Human
guauuuuacugcucaaagcucu

SEQ ID NO: 1072467 - RNA, 22 nt, Human
gccaggcuguuuuuauuacugu

SEQ ID NO: 1072468 - RNA, 22 nt, Human
acagugaucuuuuaguuggaac

SEQ ID NO: 1072469 - RNA, 22 nt, Human
ucuucucuacaccagcagcccc

SEQ ID NO: 1072470 - RNA, 22 nt, Human
gccugagaucagccaagccccu

SEQ ID NO: 1072471 - RNA, 22 nt, Human
caacauuugaguaaagaaaugg

SEQ ID NO: 1072472 - RNA, 22 nt, Human
cccagcauuucugggcugcacu

SEQ ID NO: 1072473 - RNA, 22 nt, Human
gugcaggggaucagguugcagc

SEQ ID NO: 1072474 - RNA, 22 nt, Human
aagcagcaaguuuauuucuauc

SEQ ID NO: 1072475 - RNA, 23 nt, Human
aguaugaauucauuguuuuaguu

SEQ ID NO: 1072476 - RNA, 22 nt, Human
aaagccacugcauguguaguau

SEQ ID NO: 1072477 - RNA, 22 nt, Human
aaguuacaggagaaagagauca

SEQ ID NO: 1072478 - RNA, 22 nt, Human
aauacagugaaagugagcaagg

SEQ ID NO: 1072479 - RNA, 22 nt, Human
acaggcuuuuuuagaaugacau

SEQ ID NO: 1072480 - RNA, 22 nt, Human
auggagauuuuuagaauuacag

SEQ ID NO: 1072481 - RNA, 22 nt, Human
uagggcagaguccaggaugggc

SEQ ID NO: 1072482 - RNA, 22 nt, Human
cugcccaggcugaaggaacauc

SEQ ID NO: 1072483 - RNA, 23 nt, Human
agagcuuucuaaaauguaaaucu

SEQ ID NO: 1072484 - RNA, 22 nt, Human
guuacucuuccccggggucugg

SEQ ID NO: 1072485 - RNA, 22 nt, Human
cugaaauugaugacagggaugg

SEQ ID NO: 1072486 - RNA, 22 nt, Human
ggccagggggcuucagacucca

SEQ ID NO: 1072487 - RNA, 22 nt, Human
aagagcaggacagaaucagaac

SEQ ID NO: 1072488 - RNA, 22 nt, Human
auucuaagucuuguucacauuc

SEQ ID NO: 1072489 - RNA, 21 nt, Human
cucaaagaccaaaaguguaga

SEQ ID NO: 1072490 - RNA, 22 nt, Human
cccugcagccuugcaugccuuc

SEQ ID NO: 1072491 - RNA, 22 nt, Human
ucucaggccccugaguuucucu

SEQ ID NO: 1072492 - RNA, 22 nt, Human
uauggcuucuuuugcaacuacu

SEQ ID NO: 1072493 - RNA, 22 nt, Human
cgcuggggcuuuuugcuugaga

SEQ ID NO: 1072494 - RNA, 22 nt, Human
acuuuuaaggggccuugauuua

SEQ ID NO: 1072495 - RNA, 22 nt, Human
caaggcaggcaguucacuugag

SEQ ID NO: 1072496 - RNA, 16 nt, Human
aggcucagaggcugga

SEQ ID NO: 1072497 - RNA, 22 nt, Human
cuggggcccaucgagggcugag

SEQ ID NO: 1072498 - RNA, 22 nt, Human
gugggugauguacuggaggcca

SEQ ID NO: 1072499 - RNA, 22 nt, Human
cuguccccgcgaguccagagcu

SEQ ID NO: 1072500 - RNA, 17 nt, Human
uccuccccgcaguugca

SEQ ID NO: 1072501 - RNA, 22 nt, Human
ucccagagaagagcuggaugga

SEQ ID NO: 1072502 - RNA, 22 nt, Human
uggaacacaggacuaucagcug

SEQ ID NO: 1072503 - RNA, 22 nt, Human
ucccagcagcauagcucagaau

SEQ ID NO: 1072504 - RNA, 22 nt, Human
ccaucccuccuccaccagcuag

SEQ ID NO: 1072505 - RNA, 22 nt, Human
uuuaagcacagggauaaaguua

SEQ ID NO: 1072506 - RNA, 21 nt, Human
uaagugcaaagagacagauac

SEQ ID NO: 1072507 - RNA, 22 nt, Human
ggcacugaucugauuucccucc

SEQ ID NO: 1072508 - RNA, 22 nt, Human
gcaugguggccuuaggguagcc

SEQ ID NO: 1072509 - RNA, 22 nt, Human
ucucagaguuuacggggcugaa

SEQ ID NO: 1072510 - RNA, 22 nt, Human
caauuucaauacaaaauacauu

SEQ ID NO: 1072511 - RNA, 22 nt, Human
ucagagugugagacauauugga

SEQ ID NO: 1072512 - RNA, 22 nt, Human
gcagcaggagaguuuguccugc

SEQ ID NO: 1072513 - RNA, 22 nt, Human
uuugugugaaaauauuuaaguu

SEQ ID NO: 1072514 - RNA, 22 nt, Human
caaggccaagguuuugugaacu

SEQ ID NO: 1072515 - RNA, 22 nt, Human
uuuaauugcauuuaaagaugga

SEQ ID NO: 1072516 - RNA, 22 nt, Human
auacaaaaauuagccgggagua

SEQ ID NO: 1072517 - RNA, 22 nt, Human
cucuggagcaccgggcuaucca

SEQ ID NO: 1072518 - RNA, 18 nt, Human
ccugccagucuggagcag

SEQ ID NO: 1072519 - RNA, 22 nt, Human
ugaaauuagugaaguuacaguu

SEQ ID NO: 1072520 - RNA, 22 nt, Human
ucacaaauguuugcaugugucu

SEQ ID NO: 1072521 - RNA, 20 nt, Human
caaagcaguaggauaaaaau

SEQ ID NO: 1072522 - RNA, 22 nt, Human
aagccaggccauucucugguuc

SEQ ID NO: 1072523 - RNA, 22 nt, Human
aggggcucaaagugugcaggga

SEQ ID NO: 1072524 - RNA, 22 nt, Human
ccugggcuugguuguugagaac

SEQ ID NO: 1072525 - RNA, 22 nt, Human
aaagcagagguugcagugagcu

SEQ ID NO: 1072526 - RNA, 22 nt, Human
ugcaggaauagcuacagagcug

SEQ ID NO: 1072527 - RNA, 22 nt, Human
cugcacagagcagggcagacac

SEQ ID NO: 1072528 - RNA, 22 nt, Human
auuucucauuaagaucuuccaa

SEQ ID NO: 1072529 - RNA, 22 nt, Human
cagcccugagaaggaggaucuc

SEQ ID NO: 1072530 - RNA, 22 nt, Human
aagaacaugaacacaauguuua

SEQ ID NO: 1072531 - RNA, 22 nt, Human
gaaaauuuagaacugaacuucu

SEQ ID NO: 1072532 - RNA, 22 nt, Human
caucaaauaggaauauuuggca

SEQ ID NO: 1072533 - RNA, 23 nt, Human
aaguacauauauuuagauaguga

SEQ ID NO: 1072534 - RNA, 22 nt, Human
ccugagagcgaguggccucaug

SEQ ID NO: 1072535 - RNA, 22 nt, Human
cugacucagcagcugaugaucc

SEQ ID NO: 1072536 - RNA, 22 nt, Human
gcucuggagauggagccuugag

SEQ ID NO: 1072537 - RNA, 22 nt, Human
agccuguggaucccugcacugg

SEQ ID NO: 1072538 - RNA, 20 nt, Human
cacaggcuauaugagagcca

SEQ ID NO: 1072539 - RNA, 22 nt, Human
gacagguggggaaacuaaggua

SEQ ID NO: 1072540 - RNA, 21 nt, Human
uauuucuuugacucucucccu

SEQ ID NO: 1072541 - RNA, 22 nt, Human
aggagcugcaaauauuaguaau

SEQ ID NO: 1072542 - RNA, 22 nt, Human
cuuccucuauguucagguagaa

SEQ ID NO: 1072543 - RNA, 22 nt, Human
ugccugucuccucugcagggug

SEQ ID NO: 1072544 - RNA, 22 nt, Human
augcacuugcguguuugcaaau

SEQ ID NO: 1072545 - RNA, 22 nt, Human
aacauuuauauggguucaugaa

SEQ ID NO: 1072546 - RNA, 22 nt, Human
uggccugggucacaccaggguc

SEQ ID NO: 1072547 - RNA, 22 nt, Human
aguuacauauaagaagacagac

SEQ ID NO: 1072548 - RNA, 22 nt, Human
gaggaaccuaugauuuagagca

SEQ ID NO: 1072549 - RNA, 22 nt, Human
ucugagagauacaaggaggcaa

SEQ ID NO: 1072550 - RNA, 22 nt, Human
uaggcagggauuaggguugauu

SEQ ID NO: 1072551 - RNA, 22 nt, Human
uuuguucauuuugagcucauca

SEQ ID NO: 1072552 - RNA, 22 nt, Human
caauguuugugaucuacugacu

SEQ ID NO: 1072553 - RNA, 22 nt, Human
cagcuuccaucuccacugcccu

SEQ ID NO: 1072554 - RNA, 22 nt, Human
ucaguaacuuacuuauucaccu

SEQ ID NO: 1072555 - RNA, 22 nt, Human
ccuggaguuuuuugguugacuc

SEQ ID NO: 1072556 - RNA, 22 nt, Human
ucagccuccgaaagugcuggga

SEQ ID NO: 1072557 - RNA, 22 nt, Human
acaauucuggguauuuauauag

SEQ ID NO: 1072558 - RNA, 22 nt, Human
gucagcuaggcagcugcgaugg

SEQ ID NO: 1072559 - RNA, 23 nt, Human
agaguuuucuguuuucuguaggg

SEQ ID NO: 1072560 - RNA, 22 nt, Human
cugcuggguuugccuuucacca

SEQ ID NO: 1072561 - RNA, 22 nt, Human
uucaauucuaaacuaauauucu

SEQ ID NO: 1072562 - RNA, 22 nt, Human
gcaauuauuuuugcaccaaugu

SEQ ID NO: 1072563 - RNA, 22 nt, Human
agguggggaggagugucucuuu

SEQ ID NO: 1072564 - RNA, 22 nt, Human
uuuuuccuuggaugugucucuc

SEQ ID NO: 1072565 - RNA, 22 nt, Human
agccaggaaccagcuacagucu

SEQ ID NO: 1072566 - RNA, 22 nt, Human
cucuuacaagcucccgauauaa

SEQ ID NO: 1072567 - RNA, 22 nt, Human
gcuaccugagcaagagcuucaa

SEQ ID NO: 1072568 - RNA, 22 nt, Human
cagggcagggccacacccccug

SEQ ID NO: 1072569 - RNA, 22 nt, Human
ggaggagguggguuaaguugua

SEQ ID NO: 1072570 - RNA, 22 nt, Human
gccuuccuuacaccugcucagc

SEQ ID NO: 1072571 - RNA, 19 nt, Human
cuucuagaccuuauaccac

SEQ ID NO: 1072572 - RNA, 23 nt, Human
ucccuggaggcagguccagggcc

SEQ ID NO: 1072573 - RNA, 22 nt, Human
uaugugcagcacuugccauuac

SEQ ID NO: 1072574 - RNA, 22 nt, Human
aagaaucauccugcaagagucu

SEQ ID NO: 1072575 - RNA, 22 nt, Human
acauuucuuucuauucaguagc

SEQ ID NO: 1072576 - RNA, 21 nt, Human
uuugcugaaugauuccagggc

SEQ ID NO: 1072577 - RNA, 19 nt, Human
ugccugucaguagaucuca

SEQ ID NO: 1072578 - RNA, 22 nt, Human
cugccaggggccucacaggcca

SEQ ID NO: 1072579 - RNA, 19 nt, Human
uguuuacauguuucuucag

SEQ ID NO: 1072580 - RNA, 22 nt, Human
aagggugggcccuggcagccau

SEQ ID NO: 1072581 - RNA, 22 nt, Human
uguuucuuuguagauauucuuu

SEQ ID NO: 1072582 - RNA, 22 nt, Human
uaauuuuccacucuguuuaucu

SEQ ID NO: 1072583 - RNA, 22 nt, Human
cugucccaggagcuguaagaca

SEQ ID NO: 1072584 - RNA, 22 nt, Human
gccagcucagugccaggccccu

SEQ ID NO: 1072585 - RNA, 22 nt, Human
caggcacacauccgugagagau

SEQ ID NO: 1072586 - RNA, 22 nt, Human
cccaggaauucagggcucaagg

SEQ ID NO: 1072587 - RNA, 22 nt, Human
uccuggccugucuggaguagcu

SEQ ID NO: 1072588 - RNA, 22 nt, Human
uuuaacauguucaagaaacaua

SEQ ID NO: 1072589 - RNA, 19 nt, Human
ugcacacagauaaguaucu

SEQ ID NO: 1072590 - RNA, 22 nt, Human
uagcugcccaucuuuccuuuag

SEQ ID NO: 1072591 - RNA, 22 nt, Human
cagaggaagcuggguguggagu

SEQ ID NO: 1072592 - RNA, 22 nt, Human
uguccaaugcccuuuccacaug

SEQ ID NO: 1072593 - RNA, 19 nt, Human
guggccucggagcgcgcgg

SEQ ID NO: 1072594 - RNA, 22 nt, Human
ucuggccuauuucugucagauc

SEQ ID NO: 1072595 - RNA, 22 nt, Human
caaugauucugcaacugugugc

SEQ ID NO: 1072596 - RNA, 19 nt, Human
aggcagcauucuggggcuu

SEQ ID NO: 1072597 - RNA, 21 nt, Human
aggugcaggccucaagcccca

SEQ ID NO: 1072598 - RNA, 20 nt, Human
cugugccuaaaccuccgggu

SEQ ID NO: 1072599 - RNA, 22 nt, Human
cagagccaggccugcccucuuu

SEQ ID NO: 1072600 - RNA, 22 nt, Human
gcugcuuccuuuccugcugacc

SEQ ID NO: 1072601 - RNA, 22 nt, Human
ucuugauuguuuucugaccuua

SEQ ID NO: 1072602 - RNA, 22 nt, Human
ccugagugcuuccagagucaug

SEQ ID NO: 1072603 - RNA, 22 nt, Human
ggaggugggagacauaggcggc

SEQ ID NO: 1072604 - RNA, 22 nt, Human
uccuucagcuuauuucuuagga

SEQ ID NO: 1072605 - RNA, 22 nt, Human
uguacagaaauuccuacuacau

SEQ ID NO: 1072606 - RNA, 21 nt, Human
uccuuccuugagguccuuucc

SEQ ID NO: 1072607 - RNA, 22 nt, Human
ugacuuccugcacucaggugau

SEQ ID NO: 1072608 - RNA, 22 nt, Human
auuguacaaugccuggaacauu

SEQ ID NO: 1072609 - RNA, 22 nt, Human
gcuggucacucugggagcugcu

SEQ ID NO: 1072610 - RNA, 22 nt, Human
uacaaagucuuggguucuaggc

SEQ ID NO: 1072611 - RNA, 22 nt, Human
auucuacaccucucucauuuag

SEQ ID NO: 1072612 - RNA, 22 nt, Human
cuggcagcagcuucuggaucga

SEQ ID NO: 1072613 - RNA, 22 nt, Human
augccagacauuaacgacuaug

SEQ ID NO: 1072614 - RNA, 23 nt, Human
agaggcaggaguggcuugcccgg

SEQ ID NO: 1072615 - RNA, 22 nt, Human
ucuuuccuacuuuauugugaac

SEQ ID NO: 1072616 - RNA, 22 nt, Human
gcccgcagagaucuuuaacaaa

SEQ ID NO: 1072617 - RNA, 22 nt, Human
ccaaaguccuuucuccaccugc

SEQ ID NO: 1072618 - RNA, 22 nt, Human
aacacuuucuuccuugcucagg

SEQ ID NO: 1072619 - RNA, 18 nt, Human
ggcucaggcuauccuaac

SEQ ID NO: 1072620 - RNA, 22 nt, Human
cagggccacuguagaugaggag

SEQ ID NO: 1072621 - RNA, 21 nt, Human
accauuaacacccagguuucu

SEQ ID NO: 1072622 - RNA, 20 nt, Human
uccuuuccuccuucuaaaug

SEQ ID NO: 1072623 - RNA, 22 nt, Human
aguuucacaugcauggaugugu

SEQ ID NO: 1072624 - RNA, 22 nt, Human
aucaaagaaugugacugaaaua

SEQ ID NO: 1072625 - RNA, 22 nt, Human
auuccagugugcaugguacaca

SEQ ID NO: 1072626 - RNA, 22 nt, Human
caggcagcagaggaguguggga

SEQ ID NO: 1072627 - RNA, 22 nt, Human
aaguccagacuccuuugcgugg

SEQ ID NO: 1072628 - RNA, 19 nt, Human
auaaggcaggaggaaauuu

SEQ ID NO: 1072629 - RNA, 22 nt, Human
acauaacaaucauaggacauag

SEQ ID NO: 1072630 - RNA, 22 nt, Human
ccugagagugcgugccuccuua

SEQ ID NO: 1072631 - RNA, 22 nt, Human
ucccauggauagugaccuuguu

SEQ ID NO: 1072632 - RNA, 22 nt, Human
caaaugcuaugauuuugaguuu

SEQ ID NO: 1072633 - RNA, 22 nt, Human
aacuucauguaauuuaaaacag

SEQ ID NO: 1072634 - RNA, 23 nt, Human
aaggccagaauuucaauggugcc

SEQ ID NO: 1072635 - RNA, 22 nt, Human
uccuuccucggggacccagauc

SEQ ID NO: 1072636 - RNA, 22 nt, Human
ucagaauuuuaaaccaaggaaa

SEQ ID NO: 1072637 - RNA, 22 nt, Human
ucacgagaggcacagaauagag

SEQ ID NO: 1072638 - RNA, 23 nt, Human
gccugggacucaggaggagcuca

SEQ ID NO: 1072639 - RNA, 22 nt, Human
caggcacaaauuucuagauaag

SEQ ID NO: 1072640 - RNA, 22 nt, Human
uucaagaugccagggacgcggc

SEQ ID NO: 1072641 - RNA, 22 nt, Human
caacugugaauuuuaugauacc

SEQ ID NO: 1072642 - RNA, 22 nt, Human
cuggccugaggucggcuguagg

SEQ ID NO: 1072643 - RNA, 22 nt, Human
aauauaaugcuguuuuaugcca

SEQ ID NO: 1072644 - RNA, 22 nt, Human
gggcaagcacagcgagcgugcg

SEQ ID NO: 1072645 - RNA, 22 nt, Human
uggguagagcaggcuggggcuu

SEQ ID NO: 1072646 - RNA, 21 nt, Human
ucugggcagcccaguccugag

SEQ ID NO: 1072647 - RNA, 20 nt, Human
uugauaggcagcuugucagg

SEQ ID NO: 1072648 - RNA, 22 nt, Human
gcaagauguuaacauagggaga

SEQ ID NO: 1072649 - RNA, 22 nt, Human
auacaaugauaauaguacuuua

SEQ ID NO: 1072650 - RNA, 22 nt, Human
uggcacaguccugggugccugc

SEQ ID NO: 1072651 - RNA, 22 nt, Human
uggggcagggaugggaaacuau

SEQ ID NO: 1072652 - RNA, 21 nt, Human
ucagggcagugggagguuccu

SEQ ID NO: 1072653 - RNA, 22 nt, Human
cugcugugagugguucuugccu

SEQ ID NO: 1072654 - RNA, 22 nt, Human
ugacaggcagugcugggcaugu

SEQ ID NO: 1072655 - RNA, 22 nt, Human
gagcuggugaucagcuggagga

SEQ ID NO: 1072656 - RNA, 22 nt, Human
ucaguaauauucuuuaaaauac

SEQ ID NO: 1072657 - RNA, 19 nt, Human
ugcagaggguaggaaggcc

SEQ ID NO: 1072658 - RNA, 22 nt, Human
uuuaucugaaaaaacucuugga

SEQ ID NO: 1072659 - RNA, 22 nt, Human
uagcagaggaaauccagaguaa

SEQ ID NO: 1072660 - RNA, 22 nt, Human
uuugaaaggaaguuaauacuuu

SEQ ID NO: 1072661 - RNA, 21 nt, Human
ucuggaagaaaaaaguauuau

SEQ ID NO: 1072662 - RNA, 22 nt, Human
ucccagagucagagguggggcc

SEQ ID NO: 1072663 - RNA, 22 nt, Human
uacaaacucuuuauauuucaua

SEQ ID NO: 1072664 - RNA, 22 nt, Human
ccagggcaucacauccaguguu

SEQ ID NO: 1072665 - RNA, 16 nt, Human
ccagguggggcuguga

SEQ ID NO: 1072666 - RNA, 22 nt, Human
auucuggaagcaagcuuuuaaa

SEQ ID NO: 1072667 - RNA, 22 nt, Human
auuucuguaguccacauucuuu

SEQ ID NO: 1072668 - RNA, 22 nt, Human
aguccaggaguugggugacauu

SEQ ID NO: 1072669 - RNA, 22 nt, Human
uauuuugagguauuuuugagcu

SEQ ID NO: 1072670 - RNA, 22 nt, Human
cuggggcucucuggaaugcuug

SEQ ID NO: 1072671 - RNA, 22 nt, Human
ugaaaucauaacaguuuggcuu

SEQ ID NO: 1072672 - RNA, 22 nt, Human
gcccauggucagggaggcaggg

SEQ ID NO: 1072673 - RNA, 22 nt, Human
ucugcucagugcuuaucucuaa

SEQ ID NO: 1072674 - RNA, 22 nt, Human
aaguauaagcuauucuucauga

SEQ ID NO: 1072675 - RNA, 22 nt, Human
agagacaaugccaaugcacacg

SEQ ID NO: 1072676 - RNA, 22 nt, Human
uccugccuaccuugcggaggug

SEQ ID NO: 1072677 - RNA, 22 nt, Human
gaacagacuuggaggagugauc

SEQ ID NO: 1072678 - RNA, 22 nt, Human
gggauggacuuggggacuccag

SEQ ID NO: 1072679 - RNA, 22 nt, Human
auaaggcagucacuggaauguu

SEQ ID NO: 1072680 - RNA, 22 nt, Human
aggucagcugcugauaggcagc

SEQ ID NO: 1072681 - RNA, 22 nt, Human
ucucugagcaugccauauugcu

SEQ ID NO: 1072682 - RNA, 22 nt, Human
gggcugacaaccaucugacaag

SEQ ID NO: 1072683 - RNA, 22 nt, Human
agccucucuccagcuuggcaga

SEQ ID NO: 1072684 - RNA, 22 nt, Human
uccaggagggauugggcugugg

SEQ ID NO: 1072685 - RNA, 22 nt, Human
uuuccaaaggcuaaacucaguu

SEQ ID NO: 1072686 - RNA, 22 nt, Human
aaguuuaacuugaauucuuucu

SEQ ID NO: 1072687 - RNA, 23 nt, Human
cccuuuaagauuugaauagucag

SEQ ID NO: 1072688 - RNA, 19 nt, Human
accaaacaguggacggagc

SEQ ID NO: 1072689 - RNA, 22 nt, Human
aacaguguuuuucuucagcacu

SEQ ID NO: 1072690 - RNA, 22 nt, Human
uccuggcucgauugcuaccaau

SEQ ID NO: 1072691 - RNA, 18 nt, Human
ugagagaauguucaugcu

SEQ ID NO: 1072692 - RNA, 22 nt, Human
acuuaaaaacagauccagcagg

SEQ ID NO: 1072693 - RNA, 22 nt, Human
acaggccacaguggagucucug

SEQ ID NO: 1072694 - RNA, 22 nt, Human
caauguuugaguaggagcauaa

SEQ ID NO: 1072695 - RNA, 22 nt, Human
gcagcugagagaagaacagggc

SEQ ID NO: 1072696 - RNA, 22 nt, Human
uuagaaagcuuuccauagucaa

SEQ ID NO: 1072697 - RNA, 22 nt, Human
uuucaaagacagccauauuugu

SEQ ID NO: 1072698 - RNA, 22 nt, Human
caggugaccuuuguccuaaguu

SEQ ID NO: 1072699 - RNA, 23 nt, Human
ucaucaaaggaaguacgugucac

SEQ ID NO: 1072700 - RNA, 22 nt, Human
uuuccuuccagguuccuaaggc

SEQ ID NO: 1072701 - RNA, 22 nt, Human
cagcuguguagaugcaggguca

SEQ ID NO: 1072702 - RNA, 22 nt, Human
guccucuguuagaaaugugcuu

SEQ ID NO: 1072703 - RNA, 22 nt, Human
agggggaggcugugcugcgucu

SEQ ID NO: 1072704 - RNA, 22 nt, Human
gcagagugaggaagagcuucca

SEQ ID NO: 1072705 - RNA, 22 nt, Human
ggggagcuuagggucucugaau

SEQ ID NO: 1072706 - RNA, 22 nt, Human
uuaaaugaggcugauguagauu

SEQ ID NO: 1072707 - RNA, 22 nt, Human
uuucuuuccauacauauugcua

SEQ ID NO: 1072708 - RNA, 22 nt, Human
ucauauaagagcuuuagaguca

SEQ ID NO: 1072709 - RNA, 19 nt, Human
cgcaggagccgaggugacc

SEQ ID NO: 1072710 - RNA, 22 nt, Human
guaucuagucaaugcuguucaa

SEQ ID NO: 1072711 - RNA, 22 nt, Human
ucuuugcugaguacaucuccaa

SEQ ID NO: 1072712 - RNA, 22 nt, Human
ccagugcccagcugcccaggca

SEQ ID NO: 1072713 - RNA, 22 nt, Human
cauuguauugaggauacuuaag

SEQ ID NO: 1072714 - RNA, 22 nt, Human
ugucagggcaugcgguccagcc

SEQ ID NO: 1072715 - RNA, 22 nt, Human
ucagggcauccauugccuguug

SEQ ID NO: 1072716 - RNA, 22 nt, Human
ugcuuccuucccguucuucucc

SEQ ID NO: 1072717 - RNA, 22 nt, Human
caggcugaggcaguaggguuug

SEQ ID NO: 1072718 - RNA, 22 nt, Human
uaacagaagaaaacauauugga

SEQ ID NO: 1072719 - RNA, 22 nt, Human
gcugcaggggggucuggacuug

SEQ ID NO: 1072720 - RNA, 22 nt, Human
ccagggguuggagguugcagug

SEQ ID NO: 1072721 - RNA, 22 nt, Human
ggccugcuucucagugagcuug

SEQ ID NO: 1072722 - RNA, 22 nt, Human
gggcuucaggagggucagccca

SEQ ID NO: 1072723 - RNA, 22 nt, Human
caggacgggcaaacaggauggu

SEQ ID NO: 1072724 - RNA, 22 nt, Human
acaaggcugaacagugaagccg

SEQ ID NO: 1072725 - RNA, 22 nt, Human
cugugcccuggccaggccucuc

SEQ ID NO: 1072726 - RNA, 22 nt, Human
ucaaaggcaccaaggucacugc

SEQ ID NO: 1072727 - RNA, 19 nt, Human
cccaggggacccagcccua

SEQ ID NO: 1072728 - RNA, 22 nt, Human
aagagcugugggugguaguccu

SEQ ID NO: 1072729 - RNA, 22 nt, Human
ggcaggcuccaagcauccuaug

SEQ ID NO: 1072730 - RNA, 22 nt, Human
cucugagguuuccucacaagcu

SEQ ID NO: 1072731 - RNA, 22 nt, Human
uaggcugggcugagcuggacgg

SEQ ID NO: 1072732 - RNA, 22 nt, Human
aagaaugucguugguauuuuaa

SEQ ID NO: 1072733 - RNA, 22 nt, Human
ucccaagugucuuggaccaggg

SEQ ID NO: 1072734 - RNA, 22 nt, Human
gcauggcauuugaagguagaag

SEQ ID NO: 1072735 - RNA, 22 nt, Human
acccugggucauauacagugug

SEQ ID NO: 1072736 - RNA, 22 nt, Human
ccacuugugaaauaaucaaaua

SEQ ID NO: 1072737 - RNA, 22 nt, Human
cugccaggacugacgucuucag

SEQ ID NO: 1072738 - RNA, 22 nt, Human
aucugccugagucuagguuuuc

SEQ ID NO: 1072739 - RNA, 22 nt, Human
aauguuucauuuaguugucucc

SEQ ID NO: 1072740 - RNA, 22 nt, Human
uggcaggagguuuucuccagga

SEQ ID NO: 1072741 - RNA, 22 nt, Human
ccugccagauccccugagcuga

SEQ ID NO: 1072742 - RNA, 22 nt, Human
cgaggcagacaaaaguuggaag

SEQ ID NO: 1072743 - RNA, 22 nt, Human
ucuggcuccuggcuccacugcc

SEQ ID NO: 1072744 - RNA, 22 nt, Human
uuauauuucugguagccuucag

SEQ ID NO: 1072745 - RNA, 22 nt, Human
uagauguuccacauauauaugu

SEQ ID NO: 1072746 - RNA, 22 nt, Human
aaacaguuaauugcuuucaguu

SEQ ID NO: 1072747 - RNA, 22 nt, Human
gaaaucauuagcaaagauaugu

SEQ ID NO: 1072748 - RNA, 22 nt, Human
caagaugccccugguagggauc

SEQ ID NO: 1072749 - RNA, 22 nt, Human
gcagugccuugcuucucugucu

SEQ ID NO: 1072750 - RNA, 22 nt, Human
auggacagugugucuguuucca

SEQ ID NO: 1072751 - RNA, 22 nt, Human
ccucagacgcaggccuaugggc

SEQ ID NO: 1072752 - RNA, 22 nt, Human
ucuggcucucaacaaauauuua

SEQ ID NO: 1072753 - RNA, 22 nt, Human
cugggagagguggugggaagua

SEQ ID NO: 1072754 - RNA, 20 nt, Human
cuccaugacuugaauuagua

SEQ ID NO: 1072755 - RNA, 22 nt, Human
cucugauuuauauuauaaagug

SEQ ID NO: 1072756 - RNA, 22 nt, Human
uuccaggggcagcagugauggu

SEQ ID NO: 1072757 - RNA, 22 nt, Human
uggcccugcuuaugucucucuu

SEQ ID NO: 1072758 - RNA, 22 nt, Human
cagagugagggccugcaccugc

SEQ ID NO: 1072759 - RNA, 22 nt, Human
aucaguuucugugaagaacaca

SEQ ID NO: 1072760 - RNA, 22 nt, Human
uuacauacuuacuagaucuaug

SEQ ID NO: 1072761 - RNA, 22 nt, Human
ucaggugggaccugcuaggaca

SEQ ID NO: 1072762 - RNA, 22 nt, Human
aucaguggggacgagaaguuua

SEQ ID NO: 1072763 - RNA, 22 nt, Human
uccuggcuccacugagcaggcc

SEQ ID NO: 1072764 - RNA, 22 nt, Human
gagagaagggggauaugagccu

SEQ ID NO: 1072765 - RNA, 22 nt, Human
aaagucauguaaugauaugauu

SEQ ID NO: 1072766 - RNA, 22 nt, Human
aggaaauugucuuuuuccuugu

SEQ ID NO: 1072767 - RNA, 22 nt, Human
cucagccccaauucuccccauu

SEQ ID NO: 1072768 - RNA, 22 nt, Human
cuccugggaauuuaguugugag

SEQ ID NO: 1072769 - RNA, 22 nt, Human
cagggcaggacagauacauuac

SEQ ID NO: 1072770 - RNA, 22 nt, Human
agccaggcggggcagguuuccu

SEQ ID NO: 1072771 - RNA, 22 nt, Human
cggcuggguucggcugcaggcc

SEQ ID NO: 1072772 - RNA, 18 nt, Human
ccuggcuuuucuacuugc

SEQ ID NO: 1072773 - RNA, 22 nt, Human
uauuuguagcuucccaaagcuu

SEQ ID NO: 1072774 - RNA, 22 nt, Human
cccagcauggagugaggacuca

SEQ ID NO: 1072775 - RNA, 22 nt, Human
aggucacccguuugacuaucca

SEQ ID NO: 1072776 - RNA, 22 nt, Human
uuacauuaagccaauggauucu

SEQ ID NO: 1072777 - RNA, 20 nt, Human
cagaggcaaggagacuugga

SEQ ID NO: 1072778 - RNA, 22 nt, Human
gcagagacuccacugucuugug

SEQ ID NO: 1072779 - RNA, 22 nt, Human
cagagggcucaguccugcugga

SEQ ID NO: 1072780 - RNA, 22 nt, Human
acaguuauuuacugcauaaacu

SEQ ID NO: 1072781 - RNA, 22 nt, Human
cacaacuuuaggaaccacauuc

SEQ ID NO: 1072782 - RNA, 22 nt, Human
cuggguggaaagugcugagaau

SEQ ID NO: 1072783 - RNA, 22 nt, Human
gaaugcucucauuuuccaacau

SEQ ID NO: 1072784 - RNA, 22 nt, Human
acauagcucaguaucacuuacu

SEQ ID NO: 1072785 - RNA, 19 nt, Human
uccucaggggcucacagac

SEQ ID NO: 1072786 - RNA, 22 nt, Human
cugcuuuggcucagugacauca

SEQ ID NO: 1072787 - RNA, 21 nt, Human
acugggcuagccugacuucug

SEQ ID NO: 1072788 - RNA, 20 nt, Human
uagcagcagaaagaacuuag

SEQ ID NO: 1072789 - RNA, 22 nt, Human
ggaaagaccugagauaggaaua

SEQ ID NO: 1072790 - RNA, 22 nt, Human
aauagauacuacuuagauguag

SEQ ID NO: 1072791 - RNA, 20 nt, Human
ucauuguguugccaauuccc

SEQ ID NO: 1072792 - RNA, 22 nt, Human
aacagaacuguuguucuggagg

SEQ ID NO: 1072793 - RNA, 19 nt, Human
agacagagacugaaauaga

SEQ ID NO: 1072794 - RNA, 22 nt, Human
uagaggugucacuuugggaagu

SEQ ID NO: 1072795 - RNA, 22 nt, Human
aacaugaaaagcccagagaggu

SEQ ID NO: 1072796 - RNA, 22 nt, Human
agguccaggauuuguggggucu

SEQ ID NO: 1072797 - RNA, 22 nt, Human
gcaccaugauggagccucauua

SEQ ID NO: 1072798 - RNA, 22 nt, Human
aguguuaaggcugguugcuaua

SEQ ID NO: 1072799 - RNA, 22 nt, Human
uucauacaugagacuagaugca

SEQ ID NO: 1072800 - RNA, 22 nt, Human
cugcugugugcuuacuuggguu

SEQ ID NO: 1072801 - RNA, 17 nt, Human
uuguuucuucucugugg

SEQ ID NO: 1072802 - RNA, 23 nt, Human
cucaacauccauucuugcccuuc

SEQ ID NO: 1072803 - RNA, 22 nt, Human
ucagagugcagggaguagcagc

SEQ ID NO: 1072804 - RNA, 22 nt, Human
cagcagaggugguucacauugu

SEQ ID NO: 1072805 - RNA, 22 nt, Human
cugagaaggaagccuccacucu

SEQ ID NO: 1072806 - RNA, 22 nt, Human
ucugagacccauacaggcccac

SEQ ID NO: 1072807 - RNA, 22 nt, Human
agagccagccuucucagcuuac

SEQ ID NO: 1072808 - RNA, 22 nt, Human
cuugcuuaccuaguuagcucca

SEQ ID NO: 1072809 - RNA, 22 nt, Human
uuccucuuauauagccuuggcc

SEQ ID NO: 1072810 - RNA, 22 nt, Human
caacaacaugggauucauuucu

SEQ ID NO: 1072811 - RNA, 22 nt, Human
ugcuugugagaguuuuuucaga

SEQ ID NO: 1072812 - RNA, 22 nt, Human
ucuggggauaagacccagguau

SEQ ID NO: 1072813 - RNA, 22 nt, Human
aggagaaagacuggacagccaa

SEQ ID NO: 1072814 - RNA, 22 nt, Human
cagaggccuuucuacagugaua

SEQ ID NO: 1072815 - RNA, 19 nt, Human
cccaggaagcggagguugc

SEQ ID NO: 1072816 - RNA, 22 nt, Human
uuccaaagaaguucacauuuac

SEQ ID NO: 1072817 - RNA, 22 nt, Human
cccagccuuccacccuggacua

SEQ ID NO: 1072818 - RNA, 22 nt, Human
aaaaaucacuuuuauaggcagc

SEQ ID NO: 1072819 - RNA, 22 nt, Human
aggaagggugucaugagcccuu

SEQ ID NO: 1072820 - RNA, 22 nt, Human
gagccagguuggaggcugcagu

SEQ ID NO: 1072821 - RNA, 22 nt, Human
guccucuggugaaagcauuccc

SEQ ID NO: 1072822 - RNA, 22 nt, Human
uucucagaauugacugggagca

SEQ ID NO: 1072823 - RNA, 22 nt, Human
acugagagggaggcuguccggu

SEQ ID NO: 1072824 - RNA, 22 nt, Human
ccugggcaacauagugagaccc

SEQ ID NO: 1072825 - RNA, 17 nt, Human
uuucuggaaugggcaaa

SEQ ID NO: 1072826 - RNA, 19 nt, Human
ccagguggaacugagguag

SEQ ID NO: 1072827 - RNA, 22 nt, Human
acagaugguagcauuauguugg

SEQ ID NO: 1072828 - RNA, 22 nt, Human
gggguggcccuacccucuggaa

SEQ ID NO: 1072829 - RNA, 22 nt, Human
gaguguuccagaaacuggcccu

SEQ ID NO: 1072830 - RNA, 22 nt, Human
acugccugugcacuggucuuuu

SEQ ID NO: 1072831 - RNA, 22 nt, Human
auugaaagauuuugggcucaug

SEQ ID NO: 1072832 - RNA, 22 nt, Human
accaagcucucuucccggcucu

SEQ ID NO: 1072833 - RNA, 22 nt, Human
guuuuaguggguggccacugau

SEQ ID NO: 1072834 - RNA, 22 nt, Human
ggauggcauguugggcucuguu

SEQ ID NO: 1072835 - RNA, 22 nt, Human
acgagguuggagaguuguuugg

SEQ ID NO: 1072836 - RNA, 22 nt, Human
gcugccugucccaggaugagga

SEQ ID NO: 1072837 - RNA, 22 nt, Human
cggggcugcucguccuccugug

SEQ ID NO: 1072838 - RNA, 22 nt, Human
ggggcuguuuuuggaauggcug

SEQ ID NO: 1072839 - RNA, 22 nt, Human
aauugcuaaagauuauguuuuc

SEQ ID NO: 1072840 - RNA, 22 nt, Human
gggucucucucggcuccacgcg

SEQ ID NO: 1072841 - RNA, 20 nt, Human
ugccaggcacggagugcaug

SEQ ID NO: 1072842 - RNA, 22 nt, Human
guggcauuaggccaggugcaua

SEQ ID NO: 1072843 - RNA, 22 nt, Human
agcuggagaugcccagcaccgg

SEQ ID NO: 1072844 - RNA, 18 nt, Human
ugaaauugcauccaugag

SEQ ID NO: 1072845 - RNA, 22 nt, Human
auaguuguguggggauucuggu

SEQ ID NO: 1072846 - RNA, 17 nt, Human
ugccagccugucccagg

SEQ ID NO: 1072847 - RNA, 20 nt, Human
ggcagggcaucaacagcucu

SEQ ID NO: 1072848 - RNA, 22 nt, Human
gaggcugcccaacuggagugga

SEQ ID NO: 1072849 - RNA, 22 nt, Human
gucacacagagcccugugcuca

SEQ ID NO: 1072850 - RNA, 22 nt, Human
ucccagcagggccgaccagccu

SEQ ID NO: 1072851 - RNA, 22 nt, Human
gagagucuagugcaccuaguuu

SEQ ID NO: 1072852 - RNA, 22 nt, Human
aggaaaugcugaugcuccugga

SEQ ID NO: 1072853 - RNA, 22 nt, Human
uuuagacuaauuccuaaagggc

SEQ ID NO: 1072854 - RNA, 22 nt, Human
ggaagaggaggagccaggcuuu

SEQ ID NO: 1072855 - RNA, 22 nt, Human
uugggcaaaguguuucuggagc

SEQ ID NO: 1072856 - RNA, 22 nt, Human
augaagaaacuguucugggugg

SEQ ID NO: 1072857 - RNA, 22 nt, Human
agcccagguugaggcugcagug

SEQ ID NO: 1072858 - RNA, 22 nt, Human
gcuggccucgcaggcaggaugu

SEQ ID NO: 1072859 - RNA, 22 nt, Human
agccagggcugcgagcagacag

SEQ ID NO: 1072860 - RNA, 22 nt, Human
aaaguguugggaagaaagugca

SEQ ID NO: 1072861 - RNA, 22 nt, Human
caguccugugucccuugguggg

SEQ ID NO: 1072862 - RNA, 21 nt, Human
aagaagcaauuuauuggaagg

SEQ ID NO: 1072863 - RNA, 17 nt, Human
cucugggcagccugggg

SEQ ID NO: 1072864 - RNA, 22 nt, Human
cacagaauuuucucuuuacaau

SEQ ID NO: 1072865 - RNA, 22 nt, Human
ccuggcagcgccgaagcuggcc

SEQ ID NO: 1072866 - RNA, 22 nt, Human
guucaaauggcugcaguuacca

SEQ ID NO: 1072867 - RNA, 22 nt, Human
gcuuuggaugugugccugaggu

SEQ ID NO: 1072868 - RNA, 22 nt, Human
ugggcucuggguggccugagca

SEQ ID NO: 1072869 - RNA, 18 nt, Human
uguggcaggggugggaga

SEQ ID NO: 1072870 - RNA, 18 nt, Human
gcagauggagauucaggg

SEQ ID NO: 1072871 - RNA, 22 nt, Human
accuccuggcugcucauggaac

SEQ ID NO: 1072872 - RNA, 22 nt, Human
uccagagugacaaaugacugau

SEQ ID NO: 1072873 - RNA, 22 nt, Human
uggcagagguaauucaaauccc

SEQ ID NO: 1072874 - RNA, 22 nt, Human
gggagggaagguaccuguguga

SEQ ID NO: 1072875 - RNA, 22 nt, Human
cuuggaguagagauuuagugaa

SEQ ID NO: 1072876 - RNA, 22 nt, Human
ccagggucucugcugccugaga

SEQ ID NO: 1072877 - RNA, 22 nt, Human
auuguauaagucuauuuacaau

SEQ ID NO: 1072878 - RNA, 22 nt, Human
uggaggcaugacagugucugga

SEQ ID NO: 1072879 - RNA, 22 nt, Human
auguccuuugcuucucuggucc

SEQ ID NO: 1072880 - RNA, 22 nt, Human
auuuugcuggucugaauuacuu

SEQ ID NO: 1072881 - RNA, 22 nt, Human
cuggcuuccucaggagcagugg

SEQ ID NO: 1072882 - RNA, 22 nt, Human
guugacagcuggugagcugcua

SEQ ID NO: 1072883 - RNA, 22 nt, Human
gauucagugggcuuugggacag

SEQ ID NO: 1072884 - RNA, 22 nt, Human
agucccagcuacucaagaggcu

SEQ ID NO: 1072885 - RNA, 22 nt, Human
caggcagcguccugcuuccugu

SEQ ID NO: 1072886 - RNA, 23 nt, Human
gcccucaguagaaaauguuagaa

SEQ ID NO: 1072887 - RNA, 22 nt, Human
acaggcucacagucauuucauu

SEQ ID NO: 1072888 - RNA, 22 nt, Human
aauuaguauugcgauucauuag

SEQ ID NO: 1072889 - RNA, 22 nt, Human
gugccaggugcuaagcugugcu

SEQ ID NO: 1072890 - RNA, 22 nt, Human
caaagucccagcugcuuagaga

SEQ ID NO: 1072891 - RNA, 22 nt, Human
ucucuggcugauauuccucugc

SEQ ID NO: 1072892 - RNA, 22 nt, Human
ucaggaacauaaugugagucag

SEQ ID NO: 1072893 - RNA, 22 nt, Human
caaggcugcugcgggucgcacc

SEQ ID NO: 1072894 - RNA, 22 nt, Human
cagauguauaugcauaaaaagu

SEQ ID NO: 1072895 - RNA, 22 nt, Human
caguuaaugugggccaaguucu

SEQ ID NO: 1072896 - RNA, 22 nt, Human
accauuaacaugauuuugggga

SEQ ID NO: 1072897 - RNA, 22 nt, Human
cagagacaguuucacagggucu

SEQ ID NO: 1072898 - RNA, 19 nt, Human
gggcaguggcacuagggag

SEQ ID NO: 1072899 - RNA, 22 nt, Human
uccaauuuucugauuucacuug

SEQ ID NO: 1072900 - RNA, 22 nt, Human
aaggagaaaugguagaugugca

SEQ ID NO: 1072901 - RNA, 22 nt, Human
gcagugaaaaagugcacccugu

SEQ ID NO: 1072902 - RNA, 22 nt, Human
uaaggcacacaguugcugcaug

SEQ ID NO: 1072903 - RNA, 22 nt, Human
ugcaaaagaauauagauauugu

SEQ ID NO: 1072904 - RNA, 22 nt, Human
uagaaacaaugacaugcuugua

SEQ ID NO: 1072905 - RNA, 22 nt, Human
uccugagagucaagaaugcagg

SEQ ID NO: 1072906 - RNA, 22 nt, Human
ggucacugcucuaaacaaaagu

SEQ ID NO: 1072907 - RNA, 22 nt, Human
aagucauagucgggaaagacau

SEQ ID NO: 1072908 - RNA, 22 nt, Human
aggaaacagugaacuuggcagg

SEQ ID NO: 1072909 - RNA, 22 nt, Human
cagcucuacguuucuaugaauc

SEQ ID NO: 1072910 - RNA, 22 nt, Human
ucuacuuuucccuauacaguuu

SEQ ID NO: 1072911 - RNA, 22 nt, Human
cagugcagguggcagaggacag

SEQ ID NO: 1072912 - RNA, 22 nt, Human
cacccuagcugucauuucaguu

SEQ ID NO: 1072913 - RNA, 22 nt, Human
uaaggccaaguucauauacaac

SEQ ID NO: 1072914 - RNA, 22 nt, Human
ucccaaggauaagagagucuga

SEQ ID NO: 1072915 - RNA, 22 nt, Human
auaugaaaagaagucaccauug

SEQ ID NO: 1072916 - RNA, 22 nt, Human
aagacauugcaugauaaugcug

SEQ ID NO: 1072917 - RNA, 22 nt, Human
cccucaggagaugucagcugga

SEQ ID NO: 1072918 - RNA, 17 nt, Human
uuucuccuuccaucuca

SEQ ID NO: 1072919 - RNA, 22 nt, Human
uaacaguguggacuugagaucu

SEQ ID NO: 1072920 - RNA, 22 nt, Human
gcagggacagggcagggccuuu

SEQ ID NO: 1072921 - RNA, 22 nt, Human
uacagugaaugaauggcugugc

SEQ ID NO: 1072922 - RNA, 22 nt, Human
aggcucagucuguucaugcacu

SEQ ID NO: 1072923 - RNA, 22 nt, Human
gcugugagccgcugcugagcau

SEQ ID NO: 1072924 - RNA, 22 nt, Human
cugcaucaggccaauuaagaau

SEQ ID NO: 1072925 - RNA, 22 nt, Human
ugccaggcucagccccuaucuu

SEQ ID NO: 1072926 - RNA, 22 nt, Human
cagcaggcccaggugcugguga

SEQ ID NO: 1072927 - RNA, 22 nt, Human
uaugcaauucucuuaauauucu

SEQ ID NO: 1072928 - RNA, 22 nt, Human
guaauauucagcuauugaguug

SEQ ID NO: 1072929 - RNA, 22 nt, Human
gcugagcccucaucccuaguuu

SEQ ID NO: 1072930 - RNA, 22 nt, Human
caacuauagaucaaaugaguuu

SEQ ID NO: 1072931 - RNA, 22 nt, Human
uccugggcuuaagugauccucc

SEQ ID NO: 1072932 - RNA, 22 nt, Human
gcaaagcaaucaggaguagcau

SEQ ID NO: 1072933 - RNA, 22 nt, Human
ccagugcuaagguagccucugc

SEQ ID NO: 1072934 - RNA, 23 nt, Human
acacaauagaguacuauucagcc

SEQ ID NO: 1072935 - RNA, 22 nt, Human
gcccucaggacaagguuacgcu

SEQ ID NO: 1072936 - RNA, 22 nt, Human
aaggcaguuaauuuggcuagaa

SEQ ID NO: 1072937 - RNA, 22 nt, Human
aggccagcaagaaagagagucu

SEQ ID NO: 1072938 - RNA, 22 nt, Human
uccuggccucacaguccugggu

SEQ ID NO: 1072939 - RNA, 22 nt, Human
aggcccaaaagaaaccacuggg

SEQ ID NO: 1072940 - RNA, 22 nt, Human
cugagcugcggcaggcaccugg

SEQ ID NO: 1072941 - RNA, 22 nt, Human
aggagguguagauuuccuguca

SEQ ID NO: 1072942 - RNA, 21 nt, Human
aaugcauuaacauaaagcuga

SEQ ID NO: 1072943 - RNA, 22 nt, Human
ggagauagacuuggugagccac

SEQ ID NO: 1072944 - RNA, 22 nt, Human
cugacuuugcucauaggucaaa

SEQ ID NO: 1072945 - RNA, 21 nt, Human
ucauuugugaucugauuucca

SEQ ID NO: 1072946 - RNA, 20 nt, Human
ccccacacuauugagcacuu

SEQ ID NO: 1072947 - RNA, 22 nt, Human
cugggaagaagugggcuacauu

SEQ ID NO: 1072948 - RNA, 20 nt, Human
ugcagggcucugcuucucuc

SEQ ID NO: 1072949 - RNA, 22 nt, Human
ccuggcagguuacaaccaguua

SEQ ID NO: 1072950 - RNA, 22 nt, Human
ucggagcgucacuggcuggagg

SEQ ID NO: 1072951 - RNA, 17 nt, Human
uccuucagggccucaca

SEQ ID NO: 1072952 - RNA, 22 nt, Human
ugaaucaguauaaauucucaaa

SEQ ID NO: 1072953 - RNA, 22 nt, Human
agaaaauaaauugaugguggaa

SEQ ID NO: 1072954 - RNA, 22 nt, Human
caaggccaguuucuccuaguca

SEQ ID NO: 1072955 - RNA, 22 nt, Human
caauuucagaccuuuccuugga

SEQ ID NO: 1072956 - RNA, 22 nt, Human
acagcagcuggguucccaccau

SEQ ID NO: 1072957 - RNA, 22 nt, Human
cucccaagcugugcugaacugu

SEQ ID NO: 1072958 - RNA, 21 nt, Human
guuuuaagggagaaaaccuag

SEQ ID NO: 1072959 - RNA, 22 nt, Human
ccaucuccaaauaccaucacau

SEQ ID NO: 1072960 - RNA, 22 nt, Human
acagguggccccgagggagugg

SEQ ID NO: 1072961 - RNA, 21 nt, Human
agcagccauggaugguaugua

SEQ ID NO: 1072962 - RNA, 22 nt, Human
ugcuucuguauugaaauuguua

SEQ ID NO: 1072963 - RNA, 22 nt, Human
agaaacaucauuggaacacaag

SEQ ID NO: 1072964 - RNA, 22 nt, Human
ucaucucaaaauuaugcugcac

SEQ ID NO: 1072965 - RNA, 22 nt, Human
gggcugagggguaucucauggg

SEQ ID NO: 1072966 - RNA, 22 nt, Human
aguuucacagaauaugaagguu

SEQ ID NO: 1072967 - RNA, 22 nt, Human
agacacauaggaccacacugug

SEQ ID NO: 1072968 - RNA, 22 nt, Human
agacauaagcgagcaucacagg

SEQ ID NO: 1072969 - RNA, 22 nt, Human
uaugaagacucauuuauugggu

SEQ ID NO: 1072970 - RNA, 22 nt, Human
ugaugagagaggucauugaaau

SEQ ID NO: 1072971 - RNA, 22 nt, Human
gggaacacuccagggcuuggaa

SEQ ID NO: 1072972 - RNA, 22 nt, Human
aaauuucuaagucaagaagaac

SEQ ID NO: 1072973 - RNA, 22 nt, Human
ucaaaguaaaaguauagaguuu

SEQ ID NO: 1072974 - RNA, 22 nt, Human
aaggcaguaggaucuuccacag

SEQ ID NO: 1072975 - RNA, 21 nt, Human
cacuggaauuuucugugacau

SEQ ID NO: 1072976 - RNA, 22 nt, Human
ucagccagugccuugaucuugc

SEQ ID NO: 1072977 - RNA, 22 nt, Human
gcucaggaaaacagucuaguaa

SEQ ID NO: 1072978 - RNA, 22 nt, Human
uauuuggaaaggacauguaagu

SEQ ID NO: 1072979 - RNA, 22 nt, Human
gaacaugauggcuguuauuuug

SEQ ID NO: 1072980 - RNA, 22 nt, Human
ccaccagcagugugcaaggauu

SEQ ID NO: 1072981 - RNA, 22 nt, Human
uacuuuuugucucuuugaaugu

SEQ ID NO: 1072982 - RNA, 22 nt, Human
ucuggagauaagacagacagau

SEQ ID NO: 1072983 - RNA, 22 nt, Human
aucucacacuggguuugagggu

SEQ ID NO: 1072984 - RNA, 22 nt, Human
cuucaaagauuauugaaaacaa

SEQ ID NO: 1072985 - RNA, 22 nt, Human
gcugcagcagaaguucucagag

SEQ ID NO: 1072986 - RNA, 22 nt, Human
guuccaaagcaaaggaggugag

SEQ ID NO: 1072987 - RNA, 22 nt, Human
aaaauuuccaccaucuuugugu

SEQ ID NO: 1072988 - RNA, 22 nt, Human
ucagagaguuagugucuuagcu

SEQ ID NO: 1072989 - RNA, 22 nt, Human
uucuacaauaugaauaaugaag

SEQ ID NO: 1072990 - RNA, 22 nt, Human
uggggcuagaauccugcaggaa

SEQ ID NO: 1072991 - RNA, 22 nt, Human
gggcugugagaguggggcugcu

SEQ ID NO: 1072992 - RNA, 22 nt, Human
auucacauugagcuucacugug

SEQ ID NO: 1072993 - RNA, 22 nt, Human
ccagcagaggggcggagugcag

SEQ ID NO: 1072994 - RNA, 22 nt, Human
gugagacaauuccucaguagac

SEQ ID NO: 1072995 - RNA, 22 nt, Human
gaugauauauauggaaagccua

SEQ ID NO: 1072996 - RNA, 22 nt, Human
cucagaguucuccugggaggug

SEQ ID NO: 1072997 - RNA, 22 nt, Human
agucucuggacugggagauggc

SEQ ID NO: 1072998 - RNA, 22 nt, Human
cuggugucugcucccucacagc

SEQ ID NO: 1072999 - RNA, 22 nt, Human
agaaagccucaaucuucaggcc

SEQ ID NO: 1073000 - RNA, 22 nt, Human
aggagccagaauccagacucgg

SEQ ID NO: 1073001 - RNA, 22 nt, Human
cccagggguucuagaccagcuu

SEQ ID NO: 1073002 - RNA, 22 nt, Human
gcugagagcacauagaaggggc

SEQ ID NO: 1073003 - RNA, 20 nt, Human
uucuuuguuccuuacauuug

SEQ ID NO: 1073004 - RNA, 22 nt, Human
uacauucagcaaaagaaugguu

SEQ ID NO: 1073005 - RNA, 21 nt, Human
aaacugaccuugccugagaca

SEQ ID NO: 1073006 - RNA, 19 nt, Human
ccuuggaguuccaggugga

SEQ ID NO: 1073007 - RNA, 22 nt, Human
cugagaagguguggagaugggc

SEQ ID NO: 1073008 - RNA, 22 nt, Human
auuuuguuauagaacucuguga

SEQ ID NO: 1073009 - RNA, 22 nt, Human
ccucacugcuauguguuugcuc

SEQ ID NO: 1073010 - RNA, 22 nt, Human
agcacccuccaacuucccugua

SEQ ID NO: 1073011 - RNA, 22 nt, Human
auuucuuaaaacuucagggaga

SEQ ID NO: 1073012 - RNA, 22 nt, Human
uggggacccggacuccuggguc

SEQ ID NO: 1073013 - RNA, 22 nt, Human
uuauuauggcaguuuucuaggu

SEQ ID NO: 1073014 - RNA, 22 nt, Human
uugaaauaaggaagcucgaaau

SEQ ID NO: 1073015 - RNA, 22 nt, Human
aaacaugaauagauauuaaaca

SEQ ID NO: 1073016 - RNA, 22 nt, Human
uuugaaguguuauuucuaucac

SEQ ID NO: 1073017 - RNA, 21 nt, Human
aacauuaguaauuugacuuuu

SEQ ID NO: 1073018 - RNA, 22 nt, Human
auguacaggauggugcucaucu

SEQ ID NO: 1073019 - RNA, 22 nt, Human
ccagguggugccucuguucgca

SEQ ID NO: 1073020 - RNA, 22 nt, Human
uggggaagggcacccuggagac

SEQ ID NO: 1073021 - RNA, 21 nt, Human
agugaaauugcaucagaggga

SEQ ID NO: 1073022 - RNA, 22 nt, Human
agugaaauugcuguaagaggaa

SEQ ID NO: 1073023 - RNA, 22 nt, Human
ucugaaaugaccuuuccccacu

SEQ ID NO: 1073024 - RNA, 22 nt, Human
uccucugcuguucugguucuuu

SEQ ID NO: 1073025 - RNA, 22 nt, Human
ccagaauagaaggcagcuguca

SEQ ID NO: 1073026 - RNA, 22 nt, Human
cacagggcagugcugcccacuc

SEQ ID NO: 1073027 - RNA, 22 nt, Human
cuggcucaauaaauauuagcug

SEQ ID NO: 1073028 - RNA, 20 nt, Human
aauguucaguaauuguuuua

SEQ ID NO: 1073029 - RNA, 18 nt, Human
ccucugccauagccagca

SEQ ID NO: 1073030 - RNA, 22 nt, Human
aagauucuuugaggauuuuacu

SEQ ID NO: 1073031 - RNA, 22 nt, Human
ccccucauucauguccuugcuu

SEQ ID NO: 1073032 - RNA, 22 nt, Human
gugcagauccugauugcaguuc

SEQ ID NO: 1073033 - RNA, 22 nt, Human
auaugauuguccuuagcaaauu

SEQ ID NO: 1073034 - RNA, 22 nt, Human
agggcucaguaaacgguggauu

SEQ ID NO: 1073035 - RNA, 21 nt, Human
acacacugaguuuuccacugu

SEQ ID NO: 1073036 - RNA, 22 nt, Human
gccuggagcucaugugggcauu

SEQ ID NO: 1073037 - RNA, 22 nt, Human
gguggccugcccugaucccugg

SEQ ID NO: 1073038 - RNA, 20 nt, Human
ggaagcuguggguccccagg

SEQ ID NO: 1073039 - RNA, 22 nt, Human
cguggccuuugagugagcuccc

SEQ ID NO: 1073040 - RNA, 22 nt, Human
ugcugaugcuguucuguuagga

SEQ ID NO: 1073041 - RNA, 22 nt, Human
ucagaacauuuaaaaagugguu

SEQ ID NO: 1073042 - RNA, 20 nt, Human
ucugcucagcccucaguggc

SEQ ID NO: 1073043 - RNA, 23 nt, Human
agucagagagugugagacaacug

SEQ ID NO: 1073044 - RNA, 22 nt, Human
cugaggcucaagggcagguggg

SEQ ID NO: 1073045 - RNA, 22 nt, Human
uguacagaacuugcugucccuu

SEQ ID NO: 1073046 - RNA, 22 nt, Human
gaagcuggggugcugagggcaa

SEQ ID NO: 1073047 - RNA, 22 nt, Human
aaauuauuaguuaaguugggca

SEQ ID NO: 1073048 - RNA, 22 nt, Human
uuugcuauaaaagggucacacg

SEQ ID NO: 1073049 - RNA, 22 nt, Human
gcucucugccuuucucaaugac

SEQ ID NO: 1073050 - RNA, 22 nt, Human
cuaugcaucugaacaauagaga

SEQ ID NO: 1073051 - RNA, 22 nt, Human
gagaaguuagcucuguuuaggu

SEQ ID NO: 1073052 - RNA, 22 nt, Human
uuucuaaucuuuaguuacaaaa

SEQ ID NO: 1073053 - RNA, 20 nt, Human
ccaagagcaugcaugaggaa

SEQ ID NO: 1073054 - RNA, 22 nt, Human
ggaaggggagcuggaaagggua

SEQ ID NO: 1073055 - RNA, 22 nt, Human
agucaauaaaagcuuuagauuc

SEQ ID NO: 1073056 - RNA, 22 nt, Human
gcugaugagagagacaaaugcu

SEQ ID NO: 1073057 - RNA, 22 nt, Human
uuccaaaaugccuugauaugau

SEQ ID NO: 1073058 - RNA, 22 nt, Human
guccugggccugcugaggcuga

SEQ ID NO: 1073059 - RNA, 22 nt, Human
ugcucaaugucuuaugagacug

SEQ ID NO: 1073060 - RNA, 22 nt, Human
cagaaagaccugauuggcaguu

SEQ ID NO: 1073061 - RNA, 18 nt, Human
gaggccugagaaccaggu

SEQ ID NO: 1073062 - RNA, 23 nt, Human
uggggccaagugaggaagggucu

SEQ ID NO: 1073063 - RNA, 22 nt, Human
uuugaaaggguuaugagacuga

SEQ ID NO: 1073064 - RNA, 22 nt, Human
cagaggugcauacaggucauua

SEQ ID NO: 1073065 - RNA, 22 nt, Human
uuugguuuuuaccugcugagag

SEQ ID NO: 1073066 - RNA, 22 nt, Human
aaguacagaaauagcaggugca

SEQ ID NO: 1073067 - RNA, 22 nt, Human
cagcugggugaucuugggcagg

SEQ ID NO: 1073068 - RNA, 22 nt, Human
cauugcacgggcgucugucugu

SEQ ID NO: 1073069 - RNA, 22 nt, Human
ccugggaggcugugggucugcu

SEQ ID NO: 1073070 - RNA, 22 nt, Human
agagcugagcaccaagcauggu

SEQ ID NO: 1073071 - RNA, 19 nt, Human
uggcuccugccugccuucu

SEQ ID NO: 1073072 - RNA, 22 nt, Human
cagagagagugggguguggauu

SEQ ID NO: 1073073 - RNA, 22 nt, Human
agggccuguccgcucccgcccg

SEQ ID NO: 1073074 - RNA, 22 nt, Human
ccaaggagaaaugcugugcuuu

SEQ ID NO: 1073075 - RNA, 22 nt, Human
agcagcauccccggccuccacc

SEQ ID NO: 1073076 - RNA, 22 nt, Human
cagggccaugaggcacaggguc

SEQ ID NO: 1073077 - RNA, 22 nt, Human
ucacagaaucucugauaagucu

SEQ ID NO: 1073078 - RNA, 19 nt, Human
gcagguggauguggucagc

SEQ ID NO: 1073079 - RNA, 21 nt, Human
cuucagcaaauacuuggcagg

SEQ ID NO: 1073080 - RNA, 22 nt, Human
agggcaaguugagugugcgugg

SEQ ID NO: 1073081 - RNA, 22 nt, Human
aguauuuucgccaucacaagaa

SEQ ID NO: 1073082 - RNA, 22 nt, Human
guucauucagcuggguaggagg

SEQ ID NO: 1073083 - RNA, 22 nt, Human
cacagaaguguguauaacucuu

SEQ ID NO: 1073084 - RNA, 22 nt, Human
cacugcagcaccaugcagggcu

SEQ ID NO: 1073085 - RNA, 22 nt, Human
cuggccucagagggucauggug

SEQ ID NO: 1073086 - RNA, 22 nt, Human
guuucuggcgccggggcaggcc

SEQ ID NO: 1073087 - RNA, 22 nt, Human
uuuccucuucuucccaugucau

SEQ ID NO: 1073088 - RNA, 21 nt, Human
auauuuuuguuuggacuguca

SEQ ID NO: 1073089 - RNA, 22 nt, Human
uccugccugcaaucccagcacu

SEQ ID NO: 1073090 - RNA, 21 nt, Human
gccaaggaggcuagagaacau

SEQ ID NO: 1073091 - RNA, 22 nt, Human
caggagaagguuuggagugcag

SEQ ID NO: 1073092 - RNA, 22 nt, Human
uauuacauccacuuuuauugca

SEQ ID NO: 1073093 - RNA, 22 nt, Human
aaaucagaucuuacacaauugu

SEQ ID NO: 1073094 - RNA, 22 nt, Human
gugaggugggcuggccagagac

SEQ ID NO: 1073095 - RNA, 22 nt, Human
uucaagucuguuucauugcaug

SEQ ID NO: 1073096 - RNA, 22 nt, Human
uagcagcaggggaaacagcugu

SEQ ID NO: 1073097 - RNA, 22 nt, Human
gggagccacagugaggugcaug

SEQ ID NO: 1073098 - RNA, 22 nt, Human
ucugagagagggucagaugcua

SEQ ID NO: 1073099 - RNA, 22 nt, Human
uuuuuaguagagguggguuuca

SEQ ID NO: 1073100 - RNA, 22 nt, Human
ucacagacaauuguuuuggugu

SEQ ID NO: 1073101 - RNA, 22 nt, Human
cuuauacagaucaagggaaaag

SEQ ID NO: 1073102 - RNA, 21 nt, Human
acacugugucauaaugcuuaa

SEQ ID NO: 1073103 - RNA, 20 nt, Human
ccagagcugauggcugcccg

SEQ ID NO: 1073104 - RNA, 22 nt, Human
cagcucuggcagagcccaaccc

SEQ ID NO: 1073105 - RNA, 22 nt, Human
acuggacagguucaugguuuua

SEQ ID NO: 1073106 - RNA, 22 nt, Human
gugugcagugagcaaaagaucu

SEQ ID NO: 1073107 - RNA, 22 nt, Human
ugaggccugcuuggaauugaau

SEQ ID NO: 1073108 - RNA, 22 nt, Human
uuuguauaaaugaagaugcugg

SEQ ID NO: 1073109 - RNA, 18 nt, Human
cagcagagacauucaaaa

SEQ ID NO: 1073110 - RNA, 22 nt, Human
cacaugaaggcuggggucguga

SEQ ID NO: 1073111 - RNA, 22 nt, Human
agagccugaggaugucccagcu

SEQ ID NO: 1073112 - RNA, 22 nt, Human
agacuuuauaaaucuuaauuuc

SEQ ID NO: 1073113 - RNA, 22 nt, Human
aguuugaagauuaugccagagu

SEQ ID NO: 1073114 - RNA, 21 nt, Human
aggcagcucaggcccagagag

SEQ ID NO: 1073115 - RNA, 22 nt, Human
aggcuucagguuugcuuugcag

SEQ ID NO: 1073116 - RNA, 18 nt, Human
ggcuguggacaagauuag

SEQ ID NO: 1073117 - RNA, 22 nt, Human
uauccaaagagauucauguucu

SEQ ID NO: 1073118 - RNA, 22 nt, Human
aguaaaaaguucagaaugguug

SEQ ID NO: 1073119 - RNA, 22 nt, Human
uccagagggcgauggcuggggg

SEQ ID NO: 1073120 - RNA, 22 nt, Human
ugucuccauuuucaaguagcag

SEQ ID NO: 1073121 - RNA, 22 nt, Human
cauuuaaucuggcucaugagca

SEQ ID NO: 1073122 - RNA, 22 nt, Human
aauaugauccuuaaccuucaug

SEQ ID NO: 1073123 - RNA, 22 nt, Human
gagccagccgcaagagcuguga

SEQ ID NO: 1073124 - RNA, 22 nt, Human
ugcccaggcuccucgcagccuu

SEQ ID NO: 1073125 - RNA, 23 nt, Human
cagaagacagucucaagacaagg

SEQ ID NO: 1073126 - RNA, 22 nt, Human
cugcugugacagcugccguguu

SEQ ID NO: 1073127 - RNA, 22 nt, Human
aauuuauuuccugccaguacac

SEQ ID NO: 1073128 - RNA, 20 nt, Human
auaaaacucuaaucuggccu

SEQ ID NO: 1073129 - RNA, 22 nt, Human
gcucaggcaggagugcaguggc

SEQ ID NO: 1073130 - RNA, 22 nt, Human
ucaggcagaguuaauuugcucc

SEQ ID NO: 1073131 - RNA, 22 nt, Human
agcaggugaucgcgugugcucc

SEQ ID NO: 1073132 - RNA, 22 nt, Human
acagcuaugacagauggauaau

SEQ ID NO: 1073133 - RNA, 22 nt, Human
ccacugccaugggcuaggcaug

SEQ ID NO: 1073134 - RNA, 22 nt, Human
uggccuggcccugaggcccugu

SEQ ID NO: 1073135 - RNA, 22 nt, Human
augggcuggccuuucccgcucu

SEQ ID NO: 1073136 - RNA, 22 nt, Human
cauuucaguguuauucuaauuu

SEQ ID NO: 1073137 - RNA, 21 nt, Human
ugucagaaauaagcaugugau

SEQ ID NO: 1073138 - RNA, 22 nt, Human
cugggaggauucauugagguga

SEQ ID NO: 1073139 - RNA, 22 nt, Human
gaugauuuuaugucuugucauu

SEQ ID NO: 1073140 - RNA, 22 nt, Human
uuaaugaaacauugacuaugau

SEQ ID NO: 1073141 - RNA, 22 nt, Human
ugcauuguuugauaggugaauu

SEQ ID NO: 1073142 - RNA, 22 nt, Human
cacagcagucuuucacuaaaua

SEQ ID NO: 1073143 - RNA, 22 nt, Human
agagccaguuacaacuguggag

SEQ ID NO: 1073144 - RNA, 22 nt, Human
uccugagauguggagcuccaug

SEQ ID NO: 1073145 - RNA, 22 nt, Human
uggggcagccacauagacaaca

SEQ ID NO: 1073146 - RNA, 17 nt, Human
uauacacagacagacug

SEQ ID NO: 1073147 - RNA, 22 nt, Human
ugcacacaguucucaggaaaga

SEQ ID NO: 1073148 - RNA, 22 nt, Human
gcccagcagcugguggagaagg

SEQ ID NO: 1073149 - RNA, 22 nt, Human
cuagggaguggcagagcuggga

SEQ ID NO: 1073150 - RNA, 22 nt, Human
uuccagaacucaagaaaugccc

SEQ ID NO: 1073151 - RNA, 22 nt, Human
caaggcaggucugaggagguug

SEQ ID NO: 1073152 - RNA, 22 nt, Human
ucaaaucagcaagcagcuuccc

SEQ ID NO: 1073153 - RNA, 22 nt, Human
ugcaagagcuguggcaaaagca

SEQ ID NO: 1073154 - RNA, 22 nt, Human
uuacuuuggguccugcuuauaa

SEQ ID NO: 1073155 - RNA, 22 nt, Human
aaguucaaucagaugaaaaagc

SEQ ID NO: 1073156 - RNA, 22 nt, Human
uaagacaauucuucagucacaa

SEQ ID NO: 1073157 - RNA, 22 nt, Human
gcagugacagggcugcugccuu

SEQ ID NO: 1073158 - RNA, 22 nt, Human
cuaaaaacucuacgaugcacag

SEQ ID NO: 1073159 - RNA, 22 nt, Human
aaaaaccauugucuucagucuc

SEQ ID NO: 1073160 - RNA, 22 nt, Human
ugagaguuccuccucuuuccac

SEQ ID NO: 1073161 - RNA, 22 nt, Human
acuuuuugcauaguaagugucu

SEQ ID NO: 1073162 - RNA, 22 nt, Human
gagggccaauggauuucaacug

SEQ ID NO: 1073163 - RNA, 22 nt, Human
guggugaagccccaucucugcu

SEQ ID NO: 1073164 - RNA, 22 nt, Human
ggaggcggagcuugcagugagc

SEQ ID NO: 1073165 - RNA, 21 nt, Human
gacaaagugaagcaggcagga

SEQ ID NO: 1073166 - RNA, 22 nt, Human
aagaaauguagagccuaguaaa

SEQ ID NO: 1073167 - RNA, 22 nt, Human
aaacuucuugcugcauuuucug

SEQ ID NO: 1073168 - RNA, 22 nt, Human
ucucuuuuauguacacccugac

SEQ ID NO: 1073169 - RNA, 22 nt, Human
uccacacacauuucuaugugca

SEQ ID NO: 1073170 - RNA, 22 nt, Human
gggggacuaacuggauccugga

SEQ ID NO: 1073171 - RNA, 22 nt, Human
uucucagauccaucagaagucc

SEQ ID NO: 1073172 - RNA, 22 nt, Human
gccaggacugagaaugggagca

SEQ ID NO: 1073173 - RNA, 22 nt, Human
cccagaggugcuucagaggugc

SEQ ID NO: 1073174 - RNA, 22 nt, Human
cauuucaaugccuucaacauag

SEQ ID NO: 1073175 - RNA, 22 nt, Human
agcugcuccuuuccugcaggcg

SEQ ID NO: 1073176 - RNA, 22 nt, Human
aaauuguugaucuacaguaagg

SEQ ID NO: 1073177 - RNA, 22 nt, Human
cugaaauauagaugugaacagu

SEQ ID NO: 1073178 - RNA, 22 nt, Human
cagggccauuggcguggcuguc

SEQ ID NO: 1073179 - RNA, 22 nt, Human
uggagcagccaugaugacagag

SEQ ID NO: 1073180 - RNA, 22 nt, Human
ugcaagagguuggauuuuaaga

SEQ ID NO: 1073181 - RNA, 22 nt, Human
uauguuuuucaagugcacacua

SEQ ID NO: 1073182 - RNA, 22 nt, Human
auuucuucaggucagaaauaga

SEQ ID NO: 1073183 - RNA, 21 nt, Human
uccccacauuucuaaacagac

SEQ ID NO: 1073184 - RNA, 22 nt, Human
uggcuggggagccccgacuccc

SEQ ID NO: 1073185 - RNA, 22 nt, Human
ggaggacaggggcugcagcaca

SEQ ID NO: 1073186 - RNA, 22 nt, Human
guccucugagggggcugcacgc

SEQ ID NO: 1073187 - RNA, 22 nt, Human
uugauuucuauucagauguaga

SEQ ID NO: 1073188 - RNA, 22 nt, Human
agcaccaugaccuugccauuga

SEQ ID NO: 1073189 - RNA, 22 nt, Human
gaugaaaaauugcugugucaua

SEQ ID NO: 1073190 - RNA, 22 nt, Human
ggugaggcguccccaccauggg

SEQ ID NO: 1073191 - RNA, 22 nt, Human
aucuugaaauacuuucuagaau

SEQ ID NO: 1073192 - RNA, 22 nt, Human
ucagccugcuccaagugcugcc

SEQ ID NO: 1073193 - RNA, 22 nt, Human
uaaaggcuuuuacaggagugca

SEQ ID NO: 1073194 - RNA, 22 nt, Human
acuuuuuacaggguguauacca

SEQ ID NO: 1073195 - RNA, 22 nt, Human
gccuggaguucagccaaguccc

SEQ ID NO: 1073196 - RNA, 22 nt, Human
agugcuuugagcguuugaaaag

SEQ ID NO: 1073197 - RNA, 22 nt, Human
cagagggcucuuggcugccugc

SEQ ID NO: 1073198 - RNA, 19 nt, Human
agagaggcugugugaggga

SEQ ID NO: 1073199 - RNA, 22 nt, Human
uaaggccagccagcaaaucugu

SEQ ID NO: 1073200 - RNA, 22 nt, Human
aggcauaugauuguaaccuuua

SEQ ID NO: 1073201 - RNA, 22 nt, Human
agaaaaaucuuggcgcuugucu

SEQ ID NO: 1073202 - RNA, 20 nt, Human
cuuugccuauucucugccug

SEQ ID NO: 1073203 - RNA, 22 nt, Human
uucacaucuauaacuuagauaa

SEQ ID NO: 1073204 - RNA, 22 nt, Human
ugguuuugcuaaaauagaaaga

SEQ ID NO: 1073205 - RNA, 22 nt, Human
uucaagaugucuucacaauagu

SEQ ID NO: 1073206 - RNA, 22 nt, Human
ugcaggcuuggaucacaucucc

SEQ ID NO: 1073207 - RNA, 22 nt, Human
auguacauuuagaucauuucug

SEQ ID NO: 1073208 - RNA, 22 nt, Human
ugccuuuuccaguuccuagaag

SEQ ID NO: 1073209 - RNA, 22 nt, Human
aguuucacauagcucagugcuc

SEQ ID NO: 1073210 - RNA, 19 nt, Human
agcaguggagccaugccug

SEQ ID NO: 1073211 - RNA, 22 nt, Human
cugugcaguggcagcguguggg

SEQ ID NO: 1073212 - RNA, 18 nt, Human
ggcugugcguggaggcug

SEQ ID NO: 1073213 - RNA, 22 nt, Human
ccaggagucaauaaaggaagcu

SEQ ID NO: 1073214 - RNA, 22 nt, Human
auuucaugguacaucgugacuu

SEQ ID NO: 1073215 - RNA, 22 nt, Human
agcaggaguguccccuggcugu

SEQ ID NO: 1073216 - RNA, 22 nt, Human
aucaggaugaagcuguagcgaa

SEQ ID NO: 1073217 - RNA, 18 nt, Human
uucuuuaauucaguuuga

SEQ ID NO: 1073218 - RNA, 22 nt, Human
gccaggaagcaguuagaugggu

SEQ ID NO: 1073219 - RNA, 22 nt, Human
uggcauuuguagccacuugccu

SEQ ID NO: 1073220 - RNA, 22 nt, Human
guuacaaacucaggugccaaaa

SEQ ID NO: 1073221 - RNA, 22 nt, Human
cagagucauaucagagaauaug

SEQ ID NO: 1073222 - RNA, 23 nt, Human
gugagucuugccuuugcugugga

SEQ ID NO: 1073223 - RNA, 22 nt, Human
ccagacuguggaguuccuggug

SEQ ID NO: 1073224 - RNA, 22 nt, Human
ucugcaggaggcuggcugcagg

SEQ ID NO: 1073225 - RNA, 21 nt, Human
uccuccuguagaggguccugg

SEQ ID NO: 1073226 - RNA, 22 nt, Human
gccaggcugcuggcugcugucc

SEQ ID NO: 1073227 - RNA, 22 nt, Human
cuauuuuaacuugauuaccucu

SEQ ID NO: 1073228 - RNA, 22 nt, Human
ugcaucuuucugcauauguaaa

SEQ ID NO: 1073229 - RNA, 22 nt, Human
acacagaagaucucuuaaugcu

SEQ ID NO: 1073230 - RNA, 22 nt, Human
ggcuccugaaagacuaugggaa

SEQ ID NO: 1073231 - RNA, 17 nt, Human
gagauggguggaucacc

SEQ ID NO: 1073232 - RNA, 22 nt, Human
gggcuguaggagcuggaauggg

SEQ ID NO: 1073233 - RNA, 22 nt, Human
ccagggcagcagaauuggggca

SEQ ID NO: 1073234 - RNA, 22 nt, Human
ggucauuuucacuuucaaguua

SEQ ID NO: 1073235 - RNA, 22 nt, Human
gcagggcugcagagggcacugu

SEQ ID NO: 1073236 - RNA, 22 nt, Human
acaaagauguuuaaagcauuua

SEQ ID NO: 1073237 - RNA, 22 nt, Human
ccucaggcuuacgggcaaugga

SEQ ID NO: 1073238 - RNA, 22 nt, Human
aaggaagagcaaagaauuaugu

SEQ ID NO: 1073239 - RNA, 22 nt, Human
ugcagguguagaguugggcucc

SEQ ID NO: 1073240 - RNA, 22 nt, Human
uagaacugcucucauacuugcu

SEQ ID NO: 1073241 - RNA, 22 nt, Human
uacuuugauaagguucuucuau

SEQ ID NO: 1073242 - RNA, 22 nt, Human
accuggcacuacaggcaccugu

SEQ ID NO: 1073243 - RNA, 22 nt, Human
cacaggagcuguggggcagugu

SEQ ID NO: 1073244 - RNA, 22 nt, Human
ugcugagucguauuauuuuuua

SEQ ID NO: 1073245 - RNA, 22 nt, Human
agguaguguagcugagugggau

SEQ ID NO: 1073246 - RNA, 22 nt, Human
uguaggcugaagaugaagugga

SEQ ID NO: 1073247 - RNA, 22 nt, Human
agcagguguauauaaggcugag

SEQ ID NO: 1073248 - RNA, 22 nt, Human
cagcuggcagaaccugcaucca

SEQ ID NO: 1073249 - RNA, 22 nt, Human
cugucagguuggucucagagcu

SEQ ID NO: 1073250 - RNA, 22 nt, Human
cuauuauuagauaaucuacuug

SEQ ID NO: 1073251 - RNA, 22 nt, Human
ucaaauucuauucuauacucag

SEQ ID NO: 1073252 - RNA, 21 nt, Human
gggccuggcugcgcaggacgg

SEQ ID NO: 1073253 - RNA, 22 nt, Human
ggcaaggguugaagauaaggua

SEQ ID NO: 1073254 - RNA, 22 nt, Human
uacaaagugugcccaugcugag

SEQ ID NO: 1073255 - RNA, 22 nt, Human
guugaaaguggagaaccugguu

SEQ ID NO: 1073256 - RNA, 22 nt, Human
uaagacuucauuaguaauaugg

SEQ ID NO: 1073257 - RNA, 22 nt, Human
acaugaaacuguugcauuagaa

SEQ ID NO: 1073258 - RNA, 22 nt, Human
uagccaggucacacuguguguu

SEQ ID NO: 1073259 - RNA, 22 nt, Human
auuuagcaagaguacaaaauaa

SEQ ID NO: 1073260 - RNA, 22 nt, Human
uaagaaacaugauacuuuuccu

SEQ ID NO: 1073261 - RNA, 22 nt, Human
uggcucagauaauucaaggggc

SEQ ID NO: 1073262 - RNA, 22 nt, Human
uguaacaucacagugauguuug

SEQ ID NO: 1073263 - RNA, 19 nt, Human
ugcagccacgugagagacu

SEQ ID NO: 1073264 - RNA, 22 nt, Human
gcugcuucucugauggagucca

SEQ ID NO: 1073265 - RNA, 22 nt, Human
gcacugggaagaaugagccugu

SEQ ID NO: 1073266 - RNA, 22 nt, Human
auuauacauuuuguguagagau

SEQ ID NO: 1073267 - RNA, 22 nt, Human
gaguucaguguuucuaguagug

SEQ ID NO: 1073268 - RNA, 22 nt, Human
uugcuuugccaccagaagucua

SEQ ID NO: 1073269 - RNA, 22 nt, Human
ugaagacagaccaaggagaaug

SEQ ID NO: 1073270 - RNA, 22 nt, Human
ucuuuagcuagaaauacucuaa

SEQ ID NO: 1073271 - RNA, 22 nt, Human
agauuuccugcacugccuuuga

SEQ ID NO: 1073272 - RNA, 22 nt, Human
uaaaaaacauuacucuguccug

SEQ ID NO: 1073273 - RNA, 22 nt, Human
uggcaugggccagggagagcug

SEQ ID NO: 1073274 - RNA, 22 nt, Human
gaugucaucaggcuaagacacu

SEQ ID NO: 1073275 - RNA, 22 nt, Human
uggcaggcgggagccauagagg

SEQ ID NO: 1073276 - RNA, 22 nt, Human
ccaggaagccucagaugcugag

SEQ ID NO: 1073277 - RNA, 22 nt, Human
ggaaaaaugacacauaucucaa

SEQ ID NO: 1073278 - RNA, 22 nt, Human
ggaugcugucuaagcugaggac

SEQ ID NO: 1073279 - RNA, 17 nt, Human
ugguggcuggagucagg

SEQ ID NO: 1073280 - RNA, 22 nt, Human
gagaaacuuggaguuauucugg

SEQ ID NO: 1073281 - RNA, 22 nt, Human
auacuacacauugacuauauuu

SEQ ID NO: 1073282 - RNA, 22 nt, Human
guuugcauggaagacagugagu

SEQ ID NO: 1073283 - RNA, 17 nt, Human
cuggagccuccaacucc

SEQ ID NO: 1073284 - RNA, 22 nt, Human
cugggguggaggagcuccccug

SEQ ID NO: 1073285 - RNA, 22 nt, Human
ucacuguauuugcugaugcaua

SEQ ID NO: 1073286 - RNA, 22 nt, Human
cagggcccaggccacuggguug

SEQ ID NO: 1073287 - RNA, 22 nt, Human
acaaaguuauucuuucagagga

SEQ ID NO: 1073288 - RNA, 22 nt, Human
cauaucaaagagaaggauagga

SEQ ID NO: 1073289 - RNA, 22 nt, Human
ccuggcagcuaagugcuuugag

SEQ ID NO: 1073290 - RNA, 20 nt, Human
auuaaugaauacauuuugau

SEQ ID NO: 1073291 - RNA, 22 nt, Human
ccauggagcgggugagugagug

SEQ ID NO: 1073292 - RNA, 21 nt, Human
ugggcucuuuaacccaggcac

SEQ ID NO: 1073293 - RNA, 22 nt, Human
ugccuagaacuuuauucuuuau

SEQ ID NO: 1073294 - RNA, 22 nt, Human
uuugcaaauaccaugaaacuug

SEQ ID NO: 1073295 - RNA, 22 nt, Human
gaggcugcaggcaaugcugccc

SEQ ID NO: 1073296 - RNA, 18 nt, Human
cacagugacuucugauac

SEQ ID NO: 1073297 - RNA, 17 nt, Human
uucaaugauuaaugcau

SEQ ID NO: 1073298 - RNA, 22 nt, Human
guucaugugacuacuaugaccu

SEQ ID NO: 1073299 - RNA, 22 nt, Human
ggggcccagcaccccuccucgc

SEQ ID NO: 1073300 - RNA, 22 nt, Human
ucgauguggugacaagguacgu

SEQ ID NO: 1073301 - RNA, 22 nt, Human
gccaggcagcaggaagccagug

SEQ ID NO: 1073302 - RNA, 22 nt, Human
gagggggcgugcaaggcuccgc

SEQ ID NO: 1073303 - RNA, 22 nt, Human
ggcugaguggcugggucuaguu

SEQ ID NO: 1073304 - RNA, 22 nt, Human
uggcagcaauuagcuagagcug

SEQ ID NO: 1073305 - RNA, 22 nt, Human
ggcugcaguugugugaaggccg

SEQ ID NO: 1073306 - RNA, 21 nt, Human
uacagaugaggagaccaaggc

SEQ ID NO: 1073307 - RNA, 22 nt, Human
ccuggccuccuggccuucucau

SEQ ID NO: 1073308 - RNA, 22 nt, Human
ugucacuucaggaaugcaggga

SEQ ID NO: 1073309 - RNA, 22 nt, Human
guuucuuagacagacauuaucu

SEQ ID NO: 1073310 - RNA, 22 nt, Human
agcagagcccuuccauggccuu

SEQ ID NO: 1073311 - RNA, 22 nt, Human
gcauuucauguaagucagacca

SEQ ID NO: 1073312 - RNA, 22 nt, Human
ggcuuuaacaacagaaauuuau

SEQ ID NO: 1073313 - RNA, 22 nt, Human
caguacuucuuggaaacuggau

SEQ ID NO: 1073314 - RNA, 22 nt, Human
aagcuuccugaaugcucauuua

SEQ ID NO: 1073315 - RNA, 22 nt, Human
ugcagccaucgcagagucugua

SEQ ID NO: 1073316 - RNA, 22 nt, Human
ggcaggcucuuggccuuaugag

SEQ ID NO: 1073317 - RNA, 22 nt, Human
cgcaggugggcccuucauugau

SEQ ID NO: 1073318 - RNA, 22 nt, Human
guuuuucuaaguagcgauauuu

SEQ ID NO: 1073319 - RNA, 22 nt, Human
uaauacaauggaguugggcccc

SEQ ID NO: 1073320 - RNA, 22 nt, Human
aaugguuuaacauaugcuugag

SEQ ID NO: 1073321 - RNA, 22 nt, Human
cugagcugggaguggauagugg

SEQ ID NO: 1073322 - RNA, 22 nt, Human
uguguccauucaggcacugacc

SEQ ID NO: 1073323 - RNA, 22 nt, Human
accaggaaauuuggcaacaaag

SEQ ID NO: 1073324 - RNA, 22 nt, Human
auguuauuuuggaaaauacaaa

SEQ ID NO: 1073325 - RNA, 21 nt, Human
ggcagcccgcccucuccuggc

SEQ ID NO: 1073326 - RNA, 22 nt, Human
uuuagcaucgaaguaaauuuag

SEQ ID NO: 1073327 - RNA, 22 nt, Human
guccaagagucaagaagggggc

SEQ ID NO: 1073328 - RNA, 22 nt, Human
auuucuucagguucuucuagga

SEQ ID NO: 1073329 - RNA, 22 nt, Human
cacacagguauauauauguaca

SEQ ID NO: 1073330 - RNA, 22 nt, Human
ccaggugggaggaaagcagaga

SEQ ID NO: 1073331 - RNA, 22 nt, Human
aggccuguuucuuguccagcuc

SEQ ID NO: 1073332 - RNA, 22 nt, Human
gaaggucaccuccccucucugg

SEQ ID NO: 1073333 - RNA, 22 nt, Human
aaaagcaguaaauguaugaccu

SEQ ID NO: 1073334 - RNA, 22 nt, Human
ucuuuuuauauugacaaaaggu

SEQ ID NO: 1073335 - RNA, 22 nt, Human
ggcuuaagaaaugucuaguuuu

SEQ ID NO: 1073336 - RNA, 22 nt, Human
acaguaaaucaacagaauaucu

SEQ ID NO: 1073337 - RNA, 22 nt, Human
uuccaagugcccauauuucauc

SEQ ID NO: 1073338 - RNA, 22 nt, Human
uggaacacuggcuuuccacugu

SEQ ID NO: 1073339 - RNA, 22 nt, Human
uuuuacacuucgguugugugca

SEQ ID NO: 1073340 - RNA, 22 nt, Human
augggaggaaggaggcccuuga

SEQ ID NO: 1073341 - RNA, 22 nt, Human
caggccucuauggucagcugag

SEQ ID NO: 1073342 - RNA, 20 nt, Human
ggagaugcagcccaggugcc

SEQ ID NO: 1073343 - RNA, 20 nt, Human
ugucugugccacggcacucc

SEQ ID NO: 1073344 - RNA, 22 nt, Human
ugaggcaggagaaucacaugaa

SEQ ID NO: 1073345 - RNA, 22 nt, Human
ugcauaaagugccauaguauua

SEQ ID NO: 1073346 - RNA, 22 nt, Human
cucuuuucaaaauuucacugca

SEQ ID NO: 1073347 - RNA, 22 nt, Human
uuaaauaguaggucuauuuugg

SEQ ID NO: 1073348 - RNA, 22 nt, Human
ugggcucacuggggcagggacc

SEQ ID NO: 1073349 - RNA, 22 nt, Human
acacuuuaucaauauucaaaaa

SEQ ID NO: 1073350 - RNA, 22 nt, Human
uucacagacuuuccauagauug

SEQ ID NO: 1073351 - RNA, 23 nt, Human
agcuggguggccugcgugaagcu

SEQ ID NO: 1073352 - RNA, 19 nt, Human
ugcauauaucuaugaaaga

SEQ ID NO: 1073353 - RNA, 22 nt, Human
uagauucagauauuuaggacaa

SEQ ID NO: 1073354 - RNA, 22 nt, Human
auucuaaauguaauuuagaauu

SEQ ID NO: 1073355 - RNA, 22 nt, Human
uauuagucuguaaauugaugcu

SEQ ID NO: 1073356 - RNA, 22 nt, Human
caguuuuaugaaugcuuauuag

SEQ ID NO: 1073357 - RNA, 22 nt, Human
ugaagccaucaggaagccagca

SEQ ID NO: 1073358 - RNA, 22 nt, Human
acuucacaacuguacauggcag

SEQ ID NO: 1073359 - RNA, 22 nt, Human
uggcaggggaggugcuugcuua

SEQ ID NO: 1073360 - RNA, 22 nt, Human
gcacugggaaugcugaugggcu

SEQ ID NO: 1073361 - RNA, 22 nt, Human
agcaccauugcaaauauggcag

SEQ ID NO: 1073362 - RNA, 22 nt, Human
cuggcucauuuuagcaucaggu

SEQ ID NO: 1073363 - RNA, 22 nt, Human
cuggagccagccagggcccucu

SEQ ID NO: 1073364 - RNA, 22 nt, Human
uucaaacuaugacuucagcuac

SEQ ID NO: 1073365 - RNA, 22 nt, Human
cucaggguaaugaaagacgaau

SEQ ID NO: 1073366 - RNA, 22 nt, Human
gccaggcucucagugacugccc

SEQ ID NO: 1073367 - RNA, 22 nt, Human
uacagagaacucauagaaagaa

SEQ ID NO: 1073368 - RNA, 22 nt, Human
ucacagcaaaagugugcagagc

SEQ ID NO: 1073369 - RNA, 22 nt, Human
aaaguauucaaaaauauuuggu

SEQ ID NO: 1073370 - RNA, 22 nt, Human
acuuuacacaucuuuucucauu

SEQ ID NO: 1073371 - RNA, 22 nt, Human
cucuggaguuagugaucugggc

SEQ ID NO: 1073372 - RNA, 22 nt, Human
aucuaagagagagagcaugucu

SEQ ID NO: 1073373 - RNA, 22 nt, Human
ugugcaaauuaaguagauuuuc

SEQ ID NO: 1073374 - RNA, 22 nt, Human
caccagguuccgggcagagcug

SEQ ID NO: 1073375 - RNA, 19 nt, Human
uggcagaggcaguuuguac

SEQ ID NO: 1073376 - RNA, 22 nt, Human
cauggaaggcaaaagacacaga

SEQ ID NO: 1073377 - RNA, 22 nt, Human
guccaaauuccacagauuucuc

SEQ ID NO: 1073378 - RNA, 22 nt, Human
uucuggagaugacuuuuagaaa

SEQ ID NO: 1073379 - RNA, 22 nt, Human
ugggcugagcagugaagcucau

SEQ ID NO: 1073380 - RNA, 22 nt, Human
acacacuuuaaauuaaaccucu

SEQ ID NO: 1073381 - RNA, 22 nt, Human
cagggcuggauccuccagacuc

SEQ ID NO: 1073382 - RNA, 22 nt, Human
gcagagcugucuaagucacuuc

SEQ ID NO: 1073383 - RNA, 22 nt, Human
caugaaaaugucaaguucugcu

SEQ ID NO: 1073384 - RNA, 22 nt, Human
ccagugcccagucucccugguc

SEQ ID NO: 1073385 - RNA, 21 nt, Human
uuucuuaggcucuaaaaugac

SEQ ID NO: 1073386 - RNA, 20 nt, Human
ucagccagcuaacaugggga

SEQ ID NO: 1073387 - RNA, 19 nt, Human
uccaggggcuccaccuccu

SEQ ID NO: 1073388 - RNA, 22 nt, Human
aaucaaguauuuuccaguggca

SEQ ID NO: 1073389 - RNA, 22 nt, Human
ucuggcuuucauuuguuuaaag

SEQ ID NO: 1073390 - RNA, 22 nt, Human
cugcaggaauucaaagugagcu

SEQ ID NO: 1073391 - RNA, 22 nt, Human
cuggcuggucaucagcaguacg

SEQ ID NO: 1073392 - RNA, 22 nt, Human
ggguccagcgacagcaggcuca

SEQ ID NO: 1073393 - RNA, 22 nt, Human
uuguaugaucccauuuagugaa

SEQ ID NO: 1073394 - RNA, 22 nt, Human
ugggacacccucacgccugcac

SEQ ID NO: 1073395 - RNA, 22 nt, Human
cccaggucuaugccagcucuga

SEQ ID NO: 1073396 - RNA, 22 nt, Human
aaggaaauacuucugcagagca

SEQ ID NO: 1073397 - RNA, 21 nt, Human
uaacaagucugcauacauuca

SEQ ID NO: 1073398 - RNA, 22 nt, Human
agcugaguuaauucaucacuua

SEQ ID NO: 1073399 - RNA, 22 nt, Human
uuuaccaagcuuuaauuacaua

SEQ ID NO: 1073400 - RNA, 17 nt, Human
ugagcaguagaagaugc

SEQ ID NO: 1073401 - RNA, 22 nt, Human
ccacagaauucugucuccagga

SEQ ID NO: 1073402 - RNA, 22 nt, Human
cugaggccagcugcagagcucu

SEQ ID NO: 1073403 - RNA, 22 nt, Human
agauguuccagccaaugggaau

SEQ ID NO: 1073404 - RNA, 22 nt, Human
gaauuuaaggaccaagcauuuu

SEQ ID NO: 1073405 - RNA, 19 nt, Human
agaggcagucuccaacagg

SEQ ID NO: 1073406 - RNA, 22 nt, Human
ugaaacaaauuuggaaaaucua

SEQ ID NO: 1073407 - RNA, 22 nt, Human
ccagcagcuguggcuuugccuc

SEQ ID NO: 1073408 - RNA, 22 nt, Human
gccuucaguaguauccucauga

SEQ ID NO: 1073409 - RNA, 22 nt, Human
uugcugaagaaaaaauauguua

SEQ ID NO: 1073410 - RNA, 22 nt, Human
acucaggaauggggcugggacu

SEQ ID NO: 1073411 - RNA, 22 nt, Human
aacuaacagucauuaaaagaac

SEQ ID NO: 1073412 - RNA, 22 nt, Human
cuccugcaagccuccccaagca

SEQ ID NO: 1073413 - RNA, 22 nt, Human
caggauggccccggggcugugc

SEQ ID NO: 1073414 - RNA, 22 nt, Human
uggcuagguagcuuucugcugu

SEQ ID NO: 1073415 - RNA, 22 nt, Human
agugugggggcuuuggugucac

SEQ ID NO: 1073416 - RNA, 22 nt, Human
gugguaaucggauucuuaccgg

SEQ ID NO: 1073417 - RNA, 22 nt, Human
aguuucacaaauugucaauagc

SEQ ID NO: 1073418 - RNA, 22 nt, Human
aucucagacauguuguccauga

SEQ ID NO: 1073419 - RNA, 22 nt, Human
guguugaugacauuuuagaaac

SEQ ID NO: 1073420 - RNA, 22 nt, Human
aguguuccugcucucaggaagc

SEQ ID NO: 1073421 - RNA, 22 nt, Human
ugugauuacugaauagaaaaua

SEQ ID NO: 1073422 - RNA, 22 nt, Human
uuuuuguauagaaaugaacuaa

SEQ ID NO: 1073423 - RNA, 22 nt, Human
uuuacagaauguugaauuuggg

SEQ ID NO: 1073424 - RNA, 22 nt, Human
cuuccaaguugcucugcugacc

SEQ ID NO: 1073425 - RNA, 22 nt, Human
ugccagcacuucuggcugucug

SEQ ID NO: 1073426 - RNA, 22 nt, Human
uuuuccuaguaggccuauuaga

SEQ ID NO: 1073427 - RNA, 22 nt, Human
acaggcugcugggcuccgugcu

SEQ ID NO: 1073428 - RNA, 20 nt, Human
uuaagaaaagcacauccugc

SEQ ID NO: 1073429 - RNA, 20 nt, Human
aaaaugaugggcagggcagg

SEQ ID NO: 1073430 - RNA, 22 nt, Human
ggcuuuaauagauaagguuucu

SEQ ID NO: 1073431 - RNA, 22 nt, Human
aucuaggauuugaaugcacagu

SEQ ID NO: 1073432 - RNA, 22 nt, Human
acaugcuguccugucuuuguca

SEQ ID NO: 1073433 - RNA, 22 nt, Human
uucaagucuuccaugguauucu

SEQ ID NO: 1073434 - RNA, 22 nt, Human
gaacuaaaagcuaacaucaggc

SEQ ID NO: 1073435 - RNA, 22 nt, Human
uauuccaacugucauagucaua

SEQ ID NO: 1073436 - RNA, 22 nt, Human
uauagcauauacagauaagcug

SEQ ID NO: 1073437 - RNA, 20 nt, Human
ugcuuuuauaccuauaauga

SEQ ID NO: 1073438 - RNA, 22 nt, Human
aggcucagagagcuguguccau

SEQ ID NO: 1073439 - RNA, 22 nt, Human
cuccucugucuggcccugagcc

SEQ ID NO: 1073440 - RNA, 22 nt, Human
ugccuuccuggagcugaaggcu

SEQ ID NO: 1073441 - RNA, 18 nt, Human
gcagggcugcacacgcau

SEQ ID NO: 1073442 - RNA, 22 nt, Human
uggucagacaaaggagaauguu

SEQ ID NO: 1073443 - RNA, 22 nt, Human
guccaaauaaguugcaaaauag

SEQ ID NO: 1073444 - RNA, 22 nt, Human
gguccccagcaguggcugcuuc

SEQ ID NO: 1073445 - RNA, 22 nt, Human
cucaggagacaguguccacaug

SEQ ID NO: 1073446 - RNA, 21 nt, Human
gacaggggaagaagcaaggag

SEQ ID NO: 1073447 - RNA, 22 nt, Human
aacccucagcuguuugaggaga

SEQ ID NO: 1073448 - RNA, 22 nt, Human
ggagcaguggucauucagcugg

SEQ ID NO: 1073449 - RNA, 22 nt, Human
caguuacauaaaugauaaaaug

SEQ ID NO: 1073450 - RNA, 22 nt, Human
uggcagcacaagguggcccaug

SEQ ID NO: 1073451 - RNA, 22 nt, Human
uccugagauaggaguugaaggc

SEQ ID NO: 1073452 - RNA, 22 nt, Human
ugaacccaggagguugcaguga

SEQ ID NO: 1073453 - RNA, 22 nt, Human
gaggccaaguuggagaccaggu

SEQ ID NO: 1073454 - RNA, 22 nt, Human
gggcuucucccuaaggacucug

SEQ ID NO: 1073455 - RNA, 22 nt, Human
caauauucaguggaaaagccau

SEQ ID NO: 1073456 - RNA, 22 nt, Human
ugcauguguguguauuuauaaa

SEQ ID NO: 1073457 - RNA, 22 nt, Human
agggagaagguuuagcugugag

SEQ ID NO: 1073458 - RNA, 22 nt, Human
agccacaccuguccugccagcu

SEQ ID NO: 1073459 - RNA, 22 nt, Human
cagggcuguaaauuagugcuga

SEQ ID NO: 1073460 - RNA, 22 nt, Human
guauuugucuuguuggucucca

SEQ ID NO: 1073461 - RNA, 22 nt, Human
uuagcauucucauuugcauaaa

SEQ ID NO: 1073462 - RNA, 22 nt, Human
aggcaggccccugagaauagac

SEQ ID NO: 1073463 - RNA, 22 nt, Human
uacauuaucuuguuaucuuuca

SEQ ID NO: 1073464 - RNA, 22 nt, Human
gcagaggccaucaacuuugcca

SEQ ID NO: 1073465 - RNA, 22 nt, Human
cugggaggcagucucucuagaa

SEQ ID NO: 1073466 - RNA, 22 nt, Human
uagcauuuuagcuguuuucucu

SEQ ID NO: 1073467 - RNA, 23 nt, Human
uuacuuuugcaccaaccuaauau

SEQ ID NO: 1073468 - RNA, 22 nt, Human
uaauuuugucccccugcacaua

SEQ ID NO: 1073469 - RNA, 22 nt, Human
ucaguguuuacaugcauccuug

SEQ ID NO: 1073470 - RNA, 22 nt, Human
aaaaaugaaacggcugguuggc

SEQ ID NO: 1073471 - RNA, 16 nt, Human
gcuggucaagcagcag

SEQ ID NO: 1073472 - RNA, 22 nt, Human
uggcagcuccggguaggggcug

SEQ ID NO: 1073473 - RNA, 22 nt, Human
augugaaaauccaauggcagca

SEQ ID NO: 1073474 - RNA, 22 nt, Human
uggcugaggagggucuucuggu

SEQ ID NO: 1073475 - RNA, 22 nt, Human
auugcaccuuggguuuugaaag

SEQ ID NO: 1073476 - RNA, 22 nt, Human
uccaggaaacaucuccgccuaa

SEQ ID NO: 1073477 - RNA, 21 nt, Human
gcugggcuccagucugccgcu

SEQ ID NO: 1073478 - RNA, 22 nt, Human
ggccucggcccacugcugcggu

SEQ ID NO: 1073479 - RNA, 22 nt, Human
aacaaaguguacuuccauacug

SEQ ID NO: 1073480 - RNA, 22 nt, Human
ccuggcagcccagagcgccgcu

SEQ ID NO: 1073481 - RNA, 22 nt, Human
guaucacuuuugagagugagaa

SEQ ID NO: 1073482 - RNA, 22 nt, Human
uggccacccagcugacgccuuc

SEQ ID NO: 1073483 - RNA, 22 nt, Human
cugcugaggccuucccuguccu

SEQ ID NO: 1073484 - RNA, 22 nt, Human
gcccaggccggagagcagugcu

SEQ ID NO: 1073485 - RNA, 20 nt, Human
agagcugggaagcucccuau

SEQ ID NO: 1073486 - RNA, 22 nt, Human
caaaugauacuguuuuuagucu

SEQ ID NO: 1073487 - RNA, 20 nt, Human
gugccuggagaagaggcugu

SEQ ID NO: 1073488 - RNA, 19 nt, Human
cagagcugcuggccucguc

SEQ ID NO: 1073489 - RNA, 22 nt, Human
uugcugaauugaauccuuuggu

SEQ ID NO: 1073490 - RNA, 23 nt, Human
acaaaugucuagagaggguguga

SEQ ID NO: 1073491 - RNA, 23 nt, Human
gcagaggagcaagcuggacacca

SEQ ID NO: 1073492 - RNA, 22 nt, Human
cccagccagccucuucccauau

SEQ ID NO: 1073493 - RNA, 22 nt, Human
aauucacaaaaguuagauccau

SEQ ID NO: 1073494 - RNA, 22 nt, Human
gacagccaacuggggagggcau

SEQ ID NO: 1073495 - RNA, 22 nt, Human
aggauugugccuccagucagaa

SEQ ID NO: 1073496 - RNA, 21 nt, Human
ggggcagagcuaggcccugca

SEQ ID NO: 1073497 - RNA, 22 nt, Human
uucaagauccagcacaacagug

SEQ ID NO: 1073498 - RNA, 22 nt, Human
acacuucagcaguaugcuuggg

SEQ ID NO: 1073499 - RNA, 22 nt, Human
gauuuuauauggcauacugugg

SEQ ID NO: 1073500 - RNA, 22 nt, Human
ugcccugcggcuaucuagauga

SEQ ID NO: 1073501 - RNA, 22 nt, Human
ugcaaauuuauauggugacugc

SEQ ID NO: 1073502 - RNA, 22 nt, Human
aggggugaaagagggcccucaa

SEQ ID NO: 1073503 - RNA, 23 nt, Human
gugagcagcaccaugaggcuaga

SEQ ID NO: 1073504 - RNA, 22 nt, Human
ccugcagcuguaggagaaggcg

SEQ ID NO: 1073505 - RNA, 22 nt, Human
uucaggauuguguuuuuccuga

SEQ ID NO: 1073506 - RNA, 22 nt, Human
gguggcucggccagugcaggcc

SEQ ID NO: 1073507 - RNA, 22 nt, Human
uugaaacuuagaaauugagcug

SEQ ID NO: 1073508 - RNA, 22 nt, Human
uuccucagaaaauacuguccaa

SEQ ID NO: 1073509 - RNA, 22 nt, Human
ucaaaguuuguggcaauuuauu

SEQ ID NO: 1073510 - RNA, 21 nt, Human
ucugccugagacuuugcuggu

SEQ ID NO: 1073511 - RNA, 22 nt, Human
ccagcugguguuccuuaggacc

SEQ ID NO: 1073512 - RNA, 22 nt, Human
aaugaugguuucaucacuugaa

SEQ ID NO: 1073513 - RNA, 22 nt, Human
uaugucaaaguuaagaaauagg

SEQ ID NO: 1073514 - RNA, 22 nt, Human
ugcagcccuuccuuccucuggg

SEQ ID NO: 1073515 - RNA, 22 nt, Human
aagcagagaaucugggagcgag

SEQ ID NO: 1073516 - RNA, 23 nt, Human
ggucccaguggagaggccucacc

SEQ ID NO: 1073517 - RNA, 22 nt, Human
acauuucagcgugcaugacaug

SEQ ID NO: 1073518 - RNA, 22 nt, Human
ggucagggcucuuccaguggcu

SEQ ID NO: 1073519 - RNA, 22 nt, Human
ucugaagccaccucugcuuguc

SEQ ID NO: 1073520 - RNA, 22 nt, Human
guacaaguguauuuggcuugau

SEQ ID NO: 1073521 - RNA, 18 nt, Human
gcuuuauuucuuggggaa

SEQ ID NO: 1073522 - RNA, 20 nt, Human
gaggaaaagcugccaggccu

SEQ ID NO: 1073523 - RNA, 22 nt, Human
caggaaaugcuaucauagcuga

SEQ ID NO: 1073524 - RNA, 22 nt, Human
ugugagcaagauucagagauuc

SEQ ID NO: 1073525 - RNA, 22 nt, Human
ugccuguguggggucugccgcc

SEQ ID NO: 1073526 - RNA, 22 nt, Human
gagcugggaguuauagcauguu

SEQ ID NO: 1073527 - RNA, 22 nt, Human
aaucagaaaggcuaaggaagca

SEQ ID NO: 1073528 - RNA, 22 nt, Human
uuacaguagauuuugaaugugg

SEQ ID NO: 1073529 - RNA, 18 nt, Human
gcuuuuuagugcaucuuc

SEQ ID NO: 1073530 - RNA, 22 nt, Human
agguggggaaaccagcgauccc

SEQ ID NO: 1073531 - RNA, 22 nt, Human
augcugugucuagcaggaacac

SEQ ID NO: 1073532 - RNA, 22 nt, Human
gcagugguccaguucacaccca

SEQ ID NO: 1073533 - RNA, 22 nt, Human
caggcagaguuagugauuuagg

SEQ ID NO: 1073534 - RNA, 22 nt, Human
cagcugcccauccugggaaaug

SEQ ID NO: 1073535 - RNA, 22 nt, Human
aaaaccugauugaauucuauuu

SEQ ID NO: 1073536 - RNA, 22 nt, Human
uguuuguucccucucuuuccug

SEQ ID NO: 1073537 - RNA, 22 nt, Human
caggugggccgggguuuguucu

SEQ ID NO: 1073538 - RNA, 22 nt, Human
aaauauuugucugaggcgguug

SEQ ID NO: 1073539 - RNA, 22 nt, Human
caggacaccuuagcuaaaauuc

SEQ ID NO: 1073540 - RNA, 22 nt, Human
ccagaugggccagggguuuguu

SEQ ID NO: 1073541 - RNA, 22 nt, Human
cugccugcuuuucugggagccg

SEQ ID NO: 1073542 - RNA, 23 nt, Human
augcccugugcagaaauguggaa

SEQ ID NO: 1073543 - RNA, 22 nt, Human
agcagggggccacagucacagc

SEQ ID NO: 1073544 - RNA, 22 nt, Human
aaggcauaugcuguguacaguu

SEQ ID NO: 1073545 - RNA, 22 nt, Human
cuuccucaugugcaaugcaagc

SEQ ID NO: 1073546 - RNA, 22 nt, Human
aauuacuguaauuuucuacagc

SEQ ID NO: 1073547 - RNA, 22 nt, Human
agggcagaaaccaccuugaugg

SEQ ID NO: 1073548 - RNA, 22 nt, Human
uuugcauaaaggagcauuucuc

SEQ ID NO: 1073549 - RNA, 21 nt, Human
gcugugcaggugccccugcuc

SEQ ID NO: 1073550 - RNA, 22 nt, Human
gaggagguugacggcacuguga

SEQ ID NO: 1073551 - RNA, 22 nt, Human
uucauuugucugcuauagaucc

SEQ ID NO: 1073552 - RNA, 22 nt, Human
uggcccuguucuguaccucaua

SEQ ID NO: 1073553 - RNA, 18 nt, Human
caauuuuacccagucccu

SEQ ID NO: 1073554 - RNA, 22 nt, Human
auauuagcagugaucaaaaugg

SEQ ID NO: 1073555 - RNA, 22 nt, Human
ggcagcaugagccuggugaauu

SEQ ID NO: 1073556 - RNA, 20 nt, Human
cccagggguuguggugagga

SEQ ID NO: 1073557 - RNA, 22 nt, Human
gggcugacuccuauuggaugaa

SEQ ID NO: 1073558 - RNA, 18 nt, Human
uugagaaauaagcacuaa

SEQ ID NO: 1073559 - RNA, 22 nt, Human
gcaaagcaucaguagaaauguu

SEQ ID NO: 1073560 - RNA, 22 nt, Human
uuaggaagagcuuucaaucacu

SEQ ID NO: 1073561 - RNA, 20 nt, Human
accuggcucucaggagcaac

SEQ ID NO: 1073562 - RNA, 22 nt, Human
ugggagagcagagaacccucuu

SEQ ID NO: 1073563 - RNA, 21 nt, Human
accuccuggcauccuguuccc

SEQ ID NO: 1073564 - RNA, 22 nt, Human
auugaaaaaugacuauugcuua

SEQ ID NO: 1073565 - RNA, 22 nt, Human
acugccugagcuauuggaaaag

SEQ ID NO: 1073566 - RNA, 22 nt, Human
ucucgacagccuggcacagugg

SEQ ID NO: 1073567 - RNA, 23 nt, Human
cagaaaacccagagcucaguccc

SEQ ID NO: 1073568 - RNA, 22 nt, Human
uacauuguuuuuucuugccauc

SEQ ID NO: 1073569 - RNA, 22 nt, Human
uuaaagcaaaaacuaggaugga

SEQ ID NO: 1073570 - RNA, 20 nt, Human
caugacacuguuccucugcc

SEQ ID NO: 1073571 - RNA, 22 nt, Human
cucccuggaggcccagaccugg

SEQ ID NO: 1073572 - RNA, 22 nt, Human
gaccaaggaagaggggagccag

SEQ ID NO: 1073573 - RNA, 22 nt, Human
ucugccugaaauucacauguaa

SEQ ID NO: 1073574 - RNA, 22 nt, Human
cuggccagggugcgaucguggu

SEQ ID NO: 1073575 - RNA, 22 nt, Human
ugccugugaaaacccugggguu

SEQ ID NO: 1073576 - RNA, 22 nt, Human
cucuguccuaugcuugauagaa

SEQ ID NO: 1073577 - RNA, 22 nt, Human
gugugggcugcagaggcacagc

SEQ ID NO: 1073578 - RNA, 22 nt, Human
caggaacaggcugaugggcagg

SEQ ID NO: 1073579 - RNA, 22 nt, Human
agacaggacacaagcugcauaa

SEQ ID NO: 1073580 - RNA, 22 nt, Human
ggaccagagcucgggcuucuca

SEQ ID NO: 1073581 - RNA, 22 nt, Human
uucuuaagcaguuuggcauguu

SEQ ID NO: 1073582 - RNA, 23 nt, Human
aguaacaugcaaauaacagucug

SEQ ID NO: 1073583 - RNA, 22 nt, Human
ugggcucugaagucagucugcu

SEQ ID NO: 1073584 - RNA, 22 nt, Human
ggcucaccauuuucacucucug

SEQ ID NO: 1073585 - RNA, 22 nt, Human
caguguuccaggcggcagugaa

SEQ ID NO: 1073586 - RNA, 22 nt, Human
ugcaaaaugacuucugaaaaga

SEQ ID NO: 1073587 - RNA, 22 nt, Human
cagggcugaaaucaagguguag

SEQ ID NO: 1073588 - RNA, 20 nt, Human
auuauucauacaugugugac

SEQ ID NO: 1073589 - RNA, 22 nt, Human
augcacuacuagaugcaaaagu

SEQ ID NO: 1073590 - RNA, 22 nt, Human
cucugcccgcggaugccacguc

SEQ ID NO: 1073591 - RNA, 22 nt, Human
gcuggccucuggagaagggcuu

SEQ ID NO: 1073592 - RNA, 19 nt, Human
ggaccagguccugggcagc

SEQ ID NO: 1073593 - RNA, 22 nt, Human
cugaagcaggccuacuucauug

SEQ ID NO: 1073594 - RNA, 22 nt, Human
ugaaccaggaggcagccagcac

SEQ ID NO: 1073595 - RNA, 22 nt, Human
cagaaauuggaauagagaaaua

SEQ ID NO: 1073596 - RNA, 22 nt, Human
gcacaugguaggcauuugaugu

SEQ ID NO: 1073597 - RNA, 22 nt, Human
gcugcuggcuuccugcuguuuu

SEQ ID NO: 1073598 - RNA, 22 nt, Human
caugggcugcugacaggggcuc

SEQ ID NO: 1073599 - RNA, 22 nt, Human
acuuuagauauuccucuguaca

SEQ ID NO: 1073600 - RNA, 22 nt, Human
agagccagcauuugacacuggc

SEQ ID NO: 1073601 - RNA, 19 nt, Human
gcucugugaugcugagggg

SEQ ID NO: 1073602 - RNA, 22 nt, Human
auuuguaacacgugacagguug

SEQ ID NO: 1073603 - RNA, 22 nt, Human
uggugccuugggccuacagcgc

SEQ ID NO: 1073604 - RNA, 22 nt, Human
cacugcaguaacucuaggacug

SEQ ID NO: 1073605 - RNA, 22 nt, Human
uuacugaugguggagcugguau

SEQ ID NO: 1073606 - RNA, 22 nt, Human
auaacagugaccucucagcacc

SEQ ID NO: 1073607 - RNA, 22 nt, Human
aaggcacuuaacgugggaggau

SEQ ID NO: 1073608 - RNA, 22 nt, Human
gcuuuaagucucaguuuguuag

SEQ ID NO: 1073609 - RNA, 22 nt, Human
cagugcauagauccugaggccu

SEQ ID NO: 1073610 - RNA, 22 nt, Human
uuagucuucucauaguaaaacu

SEQ ID NO: 1073611 - RNA, 22 nt, Human
caguuacuguaugucaaagacu

SEQ ID NO: 1073612 - RNA, 22 nt, Human
ugcagcucauugguguccuggu

SEQ ID NO: 1073613 - RNA, 22 nt, Human
aggggagcaacauagucacucu

SEQ ID NO: 1073614 - RNA, 22 nt, Human
uccagcuuauagguagauuuaa

SEQ ID NO: 1073615 - RNA, 20 nt, Human
gaacauuuggccauacugag

SEQ ID NO: 1073616 - RNA, 22 nt, Human
cugggagcuagcucugagcuga

SEQ ID NO: 1073617 - RNA, 19 nt, Human
gucacauuugucucccagg

SEQ ID NO: 1073618 - RNA, 20 nt, Human
gcugccagugccugaugcuu

SEQ ID NO: 1073619 - RNA, 22 nt, Human
ucccagccggugccuggguccc

SEQ ID NO: 1073620 - RNA, 22 nt, Human
cucccagagagcaggugggccg

SEQ ID NO: 1073621 - RNA, 22 nt, Human
acauaaugagcucuuuauaaau

SEQ ID NO: 1073622 - RNA, 22 nt, Human
uugcucuguccagccagcaggu

SEQ ID NO: 1073623 - RNA, 22 nt, Human
cccaggaggcagaaguugcagu

SEQ ID NO: 1073624 - RNA, 22 nt, Human
aaucauaauuuugugaauguag

SEQ ID NO: 1073625 - RNA, 22 nt, Human
gagcuucccucugcagucccug

SEQ ID NO: 1073626 - RNA, 22 nt, Human
accucugcucaagaccccuccg

SEQ ID NO: 1073627 - RNA, 22 nt, Human
uggcugagagaagacggggaag

SEQ ID NO: 1073628 - RNA, 22 nt, Human
aggcugucucaccucaggaggg

SEQ ID NO: 1073629 - RNA, 22 nt, Human
acagaguaucuaucaggaguau

SEQ ID NO: 1073630 - RNA, 22 nt, Human
uucuggagccgggccugggcag

SEQ ID NO: 1073631 - RNA, 22 nt, Human
uggccagaaccugcaguaggcc

SEQ ID NO: 1073632 - RNA, 20 nt, Human
agaagccaagugacauguuu

SEQ ID NO: 1073633 - RNA, 18 nt, Human
uuauucagacgcauauga

SEQ ID NO: 1073634 - RNA, 22 nt, Human
gccugugacucgucuugggcca

SEQ ID NO: 1073635 - RNA, 22 nt, Human
uaaugaacaauauaucaauagc

SEQ ID NO: 1073636 - RNA, 22 nt, Human
acuucuggugucauacugcauu

SEQ ID NO: 1073637 - RNA, 22 nt, Human
aagugcaagcaggacuuaguuu

SEQ ID NO: 1073638 - RNA, 22 nt, Human
ugguggcaucacucagccuccc

SEQ ID NO: 1073639 - RNA, 22 nt, Human
gaagaauauggcucucagcaau

SEQ ID NO: 1073640 - RNA, 22 nt, Human
uugcauuugaucuuggguucuc

SEQ ID NO: 1073641 - RNA, 21 nt, Human
gucuuuaaaaaaggcugauac

SEQ ID NO: 1073642 - RNA, 22 nt, Human
agagcuggaaucagaccucagg

SEQ ID NO: 1073643 - RNA, 22 nt, Human
agugacaggggaggcaggugug

SEQ ID NO: 1073644 - RNA, 22 nt, Human
gaggaaccaaaucagcuugcac

SEQ ID NO: 1073645 - RNA, 22 nt, Human
cccuggcugcuaccagguagcu

SEQ ID NO: 1073646 - RNA, 22 nt, Human
uucugaaaggcagguuguuugc

SEQ ID NO: 1073647 - RNA, 22 nt, Human
ucucagagccuaacuaaccuaa

SEQ ID NO: 1073648 - RNA, 22 nt, Human
gcuggccugggcagaggcuaug

SEQ ID NO: 1073649 - RNA, 22 nt, Human
uucuaaguccuaccugaaagca

SEQ ID NO: 1073650 - RNA, 22 nt, Human
guggucagagaugacagugggu

SEQ ID NO: 1073651 - RNA, 22 nt, Human
cugauauuucucuuaacacuag

SEQ ID NO: 1073652 - RNA, 22 nt, Human
ugcuggcuuugcgagaugcauu

SEQ ID NO: 1073653 - RNA, 18 nt, Human
gccagagggcccaagguc

SEQ ID NO: 1073654 - RNA, 22 nt, Human
agagccuggacuuuucugagcc

SEQ ID NO: 1073655 - RNA, 22 nt, Human
uuaguacauugauucauuaugu

SEQ ID NO: 1073656 - RNA, 22 nt, Human
aagagagagugcgcucacagaa

SEQ ID NO: 1073657 - RNA, 22 nt, Human
ccuggcacgaagggcugagguu

SEQ ID NO: 1073658 - RNA, 22 nt, Human
ugaggcuugauuugcccgagag

SEQ ID NO: 1073659 - RNA, 21 nt, Human
agaaaaaccagcauguuuuca

SEQ ID NO: 1073660 - RNA, 22 nt, Human
cugggaguacugggggauguca

SEQ ID NO: 1073661 - RNA, 22 nt, Human
ggcaggaggugaguggcgggug

SEQ ID NO: 1073662 - RNA, 22 nt, Human
uugcuuuguuacugcaguuucc

SEQ ID NO: 1073663 - RNA, 23 nt, Human
gcauugucuccccacuucugggc

SEQ ID NO: 1073664 - RNA, 19 nt, Human
gcugcuggcucuggcugga

SEQ ID NO: 1073665 - RNA, 22 nt, Human
aggcagaugguaacugugauau

SEQ ID NO: 1073666 - RNA, 22 nt, Human
uuuguggauggaaaauagcagg

SEQ ID NO: 1073667 - RNA, 22 nt, Human
gugcugagugcagagugcagag

SEQ ID NO: 1073668 - RNA, 22 nt, Human
ucccuggguccugcuugcucuc

SEQ ID NO: 1073669 - RNA, 22 nt, Human
cagacaggcaggugagagcucc

SEQ ID NO: 1073670 - RNA, 22 nt, Human
agauaaauuccuaagauuucag

SEQ ID NO: 1073671 - RNA, 20 nt, Human
uuguuuuaaauccuggauga

SEQ ID NO: 1073672 - RNA, 22 nt, Human
cagcagaguauggcacucaacu

SEQ ID NO: 1073673 - RNA, 20 nt, Human
uuggcucugaucaguggagc

SEQ ID NO: 1073674 - RNA, 22 nt, Human
aaagguuuauuuguugcucaca

SEQ ID NO: 1073675 - RNA, 22 nt, Human
ucucagggugaggaaagaauuu

SEQ ID NO: 1073676 - RNA, 22 nt, Human
aaugucuuuuaaauguugaggu

SEQ ID NO: 1073677 - RNA, 22 nt, Human
gugcacaucgugcagguuuguu

SEQ ID NO: 1073678 - RNA, 22 nt, Human
acaggaagugggaagaaacagg

SEQ ID NO: 1073679 - RNA, 22 nt, Human
cagcugccagcuucucuccauc

SEQ ID NO: 1073680 - RNA, 22 nt, Human
cauuuguacuguucaaugucau

SEQ ID NO: 1073681 - RNA, 19 nt, Human
cagguggcgcucuacaggg

SEQ ID NO: 1073682 - RNA, 22 nt, Human
aaacuaaggugcuguggacuga

SEQ ID NO: 1073683 - RNA, 22 nt, Human
uucuuuuaauuucugucugcag

SEQ ID NO: 1073684 - RNA, 22 nt, Human
uugcaauagccuuauuuccaaa

SEQ ID NO: 1073685 - RNA, 22 nt, Human
cccugcugugucccaccuggaa

SEQ ID NO: 1073686 - RNA, 16 nt, Human
auucugcugccugcuc

SEQ ID NO: 1073687 - RNA, 20 nt, Human
cacugaagacuucuugcuca

SEQ ID NO: 1073688 - RNA, 22 nt, Human
gggcuggggcucaauaauuugu

SEQ ID NO: 1073689 - RNA, 22 nt, Human
gccuggaguggacuuggccccu

SEQ ID NO: 1073690 - RNA, 22 nt, Human
cagcagaggcacgucugugaau

SEQ ID NO: 1073691 - RNA, 19 nt, Human
uaugagcugacaaaggccu

SEQ ID NO: 1073692 - RNA, 22 nt, Human
ugauuuccaauaaggagaaugu

SEQ ID NO: 1073693 - RNA, 22 nt, Human
acagauacuauaauguaaagug

SEQ ID NO: 1073694 - RNA, 22 nt, Human
agucugcacucagguggagguc

SEQ ID NO: 1073695 - RNA, 20 nt, Human
accugccacagagaaaggua

SEQ ID NO: 1073696 - RNA, 22 nt, Human
ugagcugcaagaaaauuucagu

SEQ ID NO: 1073697 - RNA, 23 nt, Human
ggguccagagacaggcaugggug

SEQ ID NO: 1073698 - RNA, 22 nt, Human
ccaggccauucccagaguugcu

SEQ ID NO: 1073699 - RNA, 22 nt, Human
aggcucagggacucccucccuc

SEQ ID NO: 1073700 - RNA, 22 nt, Human
ucuuuuuuuccugugcagagcu

SEQ ID NO: 1073701 - RNA, 22 nt, Human
aaaaguauuuauggcuauguaa

SEQ ID NO: 1073702 - RNA, 20 nt, Human
cagagccaagagcagcaucu

SEQ ID NO: 1073703 - RNA, 22 nt, Human
guccucagaugcugcugaaaug

SEQ ID NO: 1073704 - RNA, 22 nt, Human
uuucauaugggcauuggcaaua

SEQ ID NO: 1073705 - RNA, 20 nt, Human
gcuccccuucucugggccuc

SEQ ID NO: 1073706 - RNA, 22 nt, Human
ugagcauggugggugcagagca

SEQ ID NO: 1073707 - RNA, 22 nt, Human
uccaauggggccucucugucag

SEQ ID NO: 1073708 - RNA, 22 nt, Human
gcaaagacggacucaggagugc

SEQ ID NO: 1073709 - RNA, 22 nt, Human
caucacagauguuguguggagu

SEQ ID NO: 1073710 - RNA, 22 nt, Human
aacacagaagugccaagagcca

SEQ ID NO: 1073711 - RNA, 22 nt, Human
ugcaguggaagagguggagauc

SEQ ID NO: 1073712 - RNA, 22 nt, Human
uacaguauggaaaauguauagu

SEQ ID NO: 1073713 - RNA, 22 nt, Human
ugcuugucaggauaagcucugg

SEQ ID NO: 1073714 - RNA, 22 nt, Human
gcucccaccuuugcuaucagua

SEQ ID NO: 1073715 - RNA, 22 nt, Human
ggccugcuauuggugggcagac

SEQ ID NO: 1073716 - RNA, 22 nt, Human
ugaaagguuauuuaggucugcu

SEQ ID NO: 1073717 - RNA, 22 nt, Human
aagaucaggcguggaaaacacu

SEQ ID NO: 1073718 - RNA, 22 nt, Human
ucauacaaggaggguguucaaa

SEQ ID NO: 1073719 - RNA, 22 nt, Human
ccaggguaccccaagggcaggu

SEQ ID NO: 1073720 - RNA, 18 nt, Human
agccuggaggguugaagu

SEQ ID NO: 1073721 - RNA, 19 nt, Human
ucaguggaugaacauguuu

SEQ ID NO: 1073722 - RNA, 19 nt, Human
auacagauguauccaugau

SEQ ID NO: 1073723 - RNA, 22 nt, Human
aggcuuuguaccuggggucuua

SEQ ID NO: 1073724 - RNA, 22 nt, Human
acugcuuuucuaagauucugug

SEQ ID NO: 1073725 - RNA, 22 nt, Human
caaaggaggugauaggcccucu

SEQ ID NO: 1073726 - RNA, 22 nt, Human
accugaggcuguuagucuaggu

SEQ ID NO: 1073727 - RNA, 22 nt, Human
ggcacugauuccauucaugaag

SEQ ID NO: 1073728 - RNA, 22 nt, Human
gguguugggagagcugguuuug

SEQ ID NO: 1073729 - RNA, 22 nt, Human
ggcuccaggugcaugccaggcu

SEQ ID NO: 1073730 - RNA, 22 nt, Human
cucuuuuucaccucugucagcg

SEQ ID NO: 1073731 - RNA, 22 nt, Human
ucaguuuuuaagaguuaugcga

SEQ ID NO: 1073732 - RNA, 22 nt, Human
augcaaugguauauggucaccu

SEQ ID NO: 1073733 - RNA, 22 nt, Human
agcugccagcaaguuucaaaca

SEQ ID NO: 1073734 - RNA, 22 nt, Human
gaggaagucucucuacaagaaa

SEQ ID NO: 1073735 - RNA, 22 nt, Human
ugaaaugucucacuuagacuuu

SEQ ID NO: 1073736 - RNA, 19 nt, Human
gcacacccugcaccaccau

SEQ ID NO: 1073737 - RNA, 22 nt, Human
uccugggccuguacuccauccg

SEQ ID NO: 1073738 - RNA, 22 nt, Human
aaauuaagaguaacucuguaga

SEQ ID NO: 1073739 - RNA, 22 nt, Human
agagccugcaucaggcuugggg

SEQ ID NO: 1073740 - RNA, 22 nt, Human
cuccuucccuucaaguguuccu

SEQ ID NO: 1073741 - RNA, 22 nt, Human
uuucuuuauccuccuuugcaca

SEQ ID NO: 1073742 - RNA, 22 nt, Human
ucuuucuacauuuuauaugcuu

SEQ ID NO: 1073743 - RNA, 22 nt, Human
aaaugucagaaaacauggagug

SEQ ID NO: 1073744 - RNA, 22 nt, Human
ugcccuguggguaucugauggc

SEQ ID NO: 1073745 - RNA, 22 nt, Human
gcugcuaagcguuucuguucca

SEQ ID NO: 1073746 - RNA, 22 nt, Human
gcacacacuguuuuccucacau

SEQ ID NO: 1073747 - RNA, 22 nt, Human
cugggcaguuuuacaucauugc

SEQ ID NO: 1073748 - RNA, 22 nt, Human
ucaaagaagauuacccucccau

SEQ ID NO: 1073749 - RNA, 22 nt, Human
gaaagagaggggcugagaugca

SEQ ID NO: 1073750 - RNA, 23 nt, Human
aaauuauugcucuucaauugccu

SEQ ID NO: 1073751 - RNA, 22 nt, Human
ccugggcaaaugccagagacaa

SEQ ID NO: 1073752 - RNA, 22 nt, Human
cuacaaagcucuucuacaggca

SEQ ID NO: 1073753 - RNA, 22 nt, Human
aaugaagccacugaagacaauc

SEQ ID NO: 1073754 - RNA, 20 nt, Human
gucucaaguaucucacaguc

SEQ ID NO: 1073755 - RNA, 22 nt, Human
aucacagauuugauacuuuugu

SEQ ID NO: 1073756 - RNA, 18 nt, Human
agcugguggggagacagc

SEQ ID NO: 1073757 - RNA, 22 nt, Human
uccuggagcuuccuucauggua

SEQ ID NO: 1073758 - RNA, 22 nt, Human
gggcucugcgcucagcuccagc

SEQ ID NO: 1073759 - RNA, 22 nt, Human
ucuggcagcaagucuguuucuc

SEQ ID NO: 1073760 - RNA, 22 nt, Human
auucuucauuguugauucaugu

SEQ ID NO: 1073761 - RNA, 22 nt, Human
cuauuuggccaagcugcccaca

SEQ ID NO: 1073762 - RNA, 22 nt, Human
cugccuuugcccuugacacugu

SEQ ID NO: 1073763 - RNA, 22 nt, Human
ccaggcaggcagcguucucagg

SEQ ID NO: 1073764 - RNA, 22 nt, Human
aucuguagucacugcacagcuc

SEQ ID NO: 1073765 - RNA, 22 nt, Human
uuaacacuugaacucuacaugu

SEQ ID NO: 1073766 - RNA, 22 nt, Human
agcugcucaggagagccagguc

SEQ ID NO: 1073767 - RNA, 19 nt, Human
cugggagguguucagagaa

SEQ ID NO: 1073768 - RNA, 22 nt, Human
uauagcaauucagaauacaugu

SEQ ID NO: 1073769 - RNA, 22 nt, Human
auaucaagauuauuagggucau

SEQ ID NO: 1073770 - RNA, 22 nt, Human
ucuuucaaugagcauucuuucc

SEQ ID NO: 1073771 - RNA, 22 nt, Human
ucauuucagccauuuuuaaaug

SEQ ID NO: 1073772 - RNA, 22 nt, Human
uugggcuuggucgguuugaggc

SEQ ID NO: 1073773 - RNA, 22 nt, Human
agagcugcaggguggacccagg

SEQ ID NO: 1073774 - RNA, 22 nt, Human
aucagaauagugggggacaguc

SEQ ID NO: 1073775 - RNA, 22 nt, Human
uaagaaucaguagauauagauu

SEQ ID NO: 1073776 - RNA, 21 nt, Human
agcagaggcagaauguaugca

SEQ ID NO: 1073777 - RNA, 22 nt, Human
aauucacauguugaaguccuaa

SEQ ID NO: 1073778 - RNA, 22 nt, Human
cuugaucuacauagugaaaccc

SEQ ID NO: 1073779 - RNA, 22 nt, Human
guuucauaauucaaucaaauga

SEQ ID NO: 1073780 - RNA, 20 nt, Human
ugccugggaaggcguggagg

SEQ ID NO: 1073781 - RNA, 22 nt, Human
aaagacagagcuguaggggaaa

SEQ ID NO: 1073782 - RNA, 22 nt, Human
aggugauguccacagcuugcag

SEQ ID NO: 1073783 - RNA, 22 nt, Human
augcagaagacugaaaagcuga

SEQ ID NO: 1073784 - RNA, 23 nt, Human
ugcuguccaacagacuggccaug

SEQ ID NO: 1073785 - RNA, 22 nt, Human
uggggacauagccagucuggcu

SEQ ID NO: 1073786 - RNA, 21 nt, Human
agcuuacauuaccauuguugc

SEQ ID NO: 1073787 - RNA, 22 nt, Human
aucuuauuuaacacagcaaaac

SEQ ID NO: 1073788 - RNA, 22 nt, Human
cauggccucaaaggacugcaga

SEQ ID NO: 1073789 - RNA, 22 nt, Human
aggggagcuugaggcauggccu

SEQ ID NO: 1073790 - RNA, 22 nt, Human
uucuuuccacagaggggaugau

SEQ ID NO: 1073791 - RNA, 22 nt, Human
gaggcagcucuucugaaugggg

SEQ ID NO: 1073792 - RNA, 22 nt, Human
uguaauuugcauggcugaaugc

SEQ ID NO: 1073793 - RNA, 22 nt, Human
cccagacucaucccugggagcu

SEQ ID NO: 1073794 - RNA, 22 nt, Human
auuacaguaacagcuacaaugc

SEQ ID NO: 1073795 - RNA, 22 nt, Human
gcacacagaaucagugggcaua

SEQ ID NO: 1073796 - RNA, 22 nt, Human
caggcagcaggagcccugcucg

SEQ ID NO: 1073797 - RNA, 22 nt, Human
gccugccugcugucaucugccu

SEQ ID NO: 1073798 - RNA, 22 nt, Human
aacagcuuagaaauguugcuaa

SEQ ID NO: 1073799 - RNA, 22 nt, Human
gcagacaauuuauuagcagauu

SEQ ID NO: 1073800 - RNA, 22 nt, Human
acagaguaggugcugucgacug

SEQ ID NO: 1073801 - RNA, 18 nt, Human
uugagggaggggcagagu

SEQ ID NO: 1073802 - RNA, 22 nt, Human
caugcaguuucucuaugcguag

SEQ ID NO: 1073803 - RNA, 22 nt, Human
uuuuaaaggcuguaugaccaag

SEQ ID NO: 1073804 - RNA, 22 nt, Human
aggcugaggggcgagggacccu

SEQ ID NO: 1073805 - RNA, 22 nt, Human
ucagaauuuaaaauguguagau

SEQ ID NO: 1073806 - RNA, 22 nt, Human
ugcuccaggcaagcugagaguu

SEQ ID NO: 1073807 - RNA, 22 nt, Human
gggugggguguaucggauccua

SEQ ID NO: 1073808 - RNA, 22 nt, Human
cucagagcaaugaacaugcaaa

SEQ ID NO: 1073809 - RNA, 22 nt, Human
ugcauuaucuuuaauguucuca

SEQ ID NO: 1073810 - RNA, 22 nt, Human
ucaucucagggcgacaucaugu

SEQ ID NO: 1073811 - RNA, 22 nt, Human
uauuuaagaugugucauaaaga

SEQ ID NO: 1073812 - RNA, 22 nt, Human
ugacagcauaacacuggucuug

SEQ ID NO: 1073813 - RNA, 22 nt, Human
agagccugcagcugugaagaaa

SEQ ID NO: 1073814 - RNA, 21 nt, Human
uggcagaguugaguaguuaug

SEQ ID NO: 1073815 - RNA, 22 nt, Human
gcuggagguagggagguccugu

SEQ ID NO: 1073816 - RNA, 22 nt, Human
uugaaagggauauaucuuucug

SEQ ID NO: 1073817 - RNA, 22 nt, Human
agcagccaaaugaagauuuuac

SEQ ID NO: 1073818 - RNA, 22 nt, Human
ugcuguggcaguuuauguauag

SEQ ID NO: 1073819 - RNA, 22 nt, Human
agcaggaaguagucuguaagca

SEQ ID NO: 1073820 - RNA, 22 nt, Human
ugaacacacacaucuuaauaau

SEQ ID NO: 1073821 - RNA, 22 nt, Human
caaggccaguccauuuuggaag

SEQ ID NO: 1073822 - RNA, 22 nt, Human
guucacauguguuaucuucuuu

SEQ ID NO: 1073823 - RNA, 22 nt, Human
acuauaacccauggaauauaag

SEQ ID NO: 1073824 - RNA, 22 nt, Human
ugaggaggcccagguuggggcu

SEQ ID NO: 1073825 - RNA, 22 nt, Human
aaaagacauaugugggcauucu

SEQ ID NO: 1073826 - RNA, 22 nt, Human
aguacuuugcacuuugcucaga

SEQ ID NO: 1073827 - RNA, 22 nt, Human
uccaggccuaggccaagugauu

SEQ ID NO: 1073828 - RNA, 22 nt, Human
auccaggguguggagagagcuc

SEQ ID NO: 1073829 - RNA, 22 nt, Human
guugaguggguuaggaugcuga

SEQ ID NO: 1073830 - RNA, 22 nt, Human
uaauaccuugaucucucuuguc

SEQ ID NO: 1073831 - RNA, 22 nt, Human
auauuuguaguggguaagaagu

SEQ ID NO: 1073832 - RNA, 22 nt, Human
ugcccugcuugguuuauuuuca

SEQ ID NO: 1073833 - RNA, 22 nt, Human
uuuauauuguaaaaaugguucu

SEQ ID NO: 1073834 - RNA, 22 nt, Human
aaaugcaaggccaugugaagga

SEQ ID NO: 1073835 - RNA, 22 nt, Human
aaggcucuccaaaugauauaau

SEQ ID NO: 1073836 - RNA, 22 nt, Human
gccaggacuagagggaggugag

SEQ ID NO: 1073837 - RNA, 22 nt, Human
cuguauuugaaagaaaagauuu

SEQ ID NO: 1073838 - RNA, 22 nt, Human
uaacaguauccccauuugcaag

SEQ ID NO: 1073839 - RNA, 18 nt, Human
ucagaggagauaccuaaa

SEQ ID NO: 1073840 - RNA, 22 nt, Human
auucuggauuaucaguccacca

SEQ ID NO: 1073841 - RNA, 19 nt, Human
uagcugccuguuaccucca

SEQ ID NO: 1073842 - RNA, 23 nt, Human
uuccuuaacuguuaagauugucu

SEQ ID NO: 1073843 - RNA, 22 nt, Human
ucuggaguguccaguucuacuc

SEQ ID NO: 1073844 - RNA, 22 nt, Human
acccugagugcaacggugagga

SEQ ID NO: 1073845 - RNA, 22 nt, Human
acaaauauuuacugaauccacu

SEQ ID NO: 1073846 - RNA, 22 nt, Human
augggcugagaaucaagaauau

SEQ ID NO: 1073847 - RNA, 22 nt, Human
gcucccugccuacacggaccuu

SEQ ID NO: 1073848 - RNA, 22 nt, Human
cagggugcgccacucagaugua

SEQ ID NO: 1073849 - RNA, 22 nt, Human
ucacagacacagggagaagcau

SEQ ID NO: 1073850 - RNA, 22 nt, Human
accagccaccaccaggagaucg

SEQ ID NO: 1073851 - RNA, 22 nt, Human
aacuccagcaggaaggugagaa

SEQ ID NO: 1073852 - RNA, 22 nt, Human
cuuacaaauacacuuaggagag

SEQ ID NO: 1073853 - RNA, 22 nt, Human
uuucaaagggaaguuaugaagu

SEQ ID NO: 1073854 - RNA, 22 nt, Human
cuugcugucccuugguaugaac

SEQ ID NO: 1073855 - RNA, 22 nt, Human
uagucucuggagacucuagggg

SEQ ID NO: 1073856 - RNA, 22 nt, Human
caaggaaaacagaugaucaaca

SEQ ID NO: 1073857 - RNA, 22 nt, Human
uucaaagauaauguagcauuuu

SEQ ID NO: 1073858 - RNA, 22 nt, Human
ugcuuuauagacaaggaaguag

SEQ ID NO: 1073859 - RNA, 22 nt, Human
uugaagaccuuuagugcuaugu

SEQ ID NO: 1073860 - RNA, 22 nt, Human
ucagaauucagagggagugggg

SEQ ID NO: 1073861 - RNA, 22 nt, Human
cagaggaaaugggaaggagaua

SEQ ID NO: 1073862 - RNA, 22 nt, Human
gcaggaacagggcuucaagcuu

SEQ ID NO: 1073863 - RNA, 18 nt, Human
ucauagaagugaaucaga

SEQ ID NO: 1073864 - RNA, 22 nt, Human
ccagcugcugugcagggaggcu

SEQ ID NO: 1073865 - RNA, 22 nt, Human
ucaugcuauuucgaauguaaua

SEQ ID NO: 1073866 - RNA, 22 nt, Human
augcagagacagauguggcaug

SEQ ID NO: 1073867 - RNA, 22 nt, Human
gcucugggauuaccagccuuag

SEQ ID NO: 1073868 - RNA, 22 nt, Human
gcuggaaaugauuaaaugguga

SEQ ID NO: 1073869 - RNA, 22 nt, Human
ccacagagacagagcccagggu

SEQ ID NO: 1073870 - RNA, 17 nt, Human
ccuggcugggaaucuga

SEQ ID NO: 1073871 - RNA, 18 nt, Human
acacacacaccuguguau

SEQ ID NO: 1073872 - RNA, 22 nt, Human
gaggagguggaauuccaggaau

SEQ ID NO: 1073873 - RNA, 22 nt, Human
aucuaacugggcuauuuuauug

SEQ ID NO: 1073874 - RNA, 22 nt, Human
ucuguuuaggcaaaauagcuac

SEQ ID NO: 1073875 - RNA, 22 nt, Human
gcaguggauggccagcaggggc

SEQ ID NO: 1073876 - RNA, 22 nt, Human
uacaaaguuuucuuggauugag

SEQ ID NO: 1073877 - RNA, 22 nt, Human
acagcugauaguuaccucuguc

SEQ ID NO: 1073878 - RNA, 22 nt, Human
uuuaaacuaacaguacacguug

SEQ ID NO: 1073879 - RNA, 22 nt, Human
uauucucagugcuauaaguaga

SEQ ID NO: 1073880 - RNA, 22 nt, Human
cugggcuggagugcaauggcgc

SEQ ID NO: 1073881 - RNA, 22 nt, Human
aaggcaguacuuuauguccaua

SEQ ID NO: 1073882 - RNA, 22 nt, Human
ugaaguuuaagguuagauaagu

SEQ ID NO: 1073883 - RNA, 22 nt, Human
acuucacauuagcuaaaaggga

SEQ ID NO: 1073884 - RNA, 22 nt, Human
gaggguggguacaccagcccuc

SEQ ID NO: 1073885 - RNA, 22 nt, Human
cugggcagaauuuuaggauggc

SEQ ID NO: 1073886 - RNA, 22 nt, Human
gaacagacagaagcuuaucucc

SEQ ID NO: 1073887 - RNA, 22 nt, Human
uggcagaggaaaaagucacugg

SEQ ID NO: 1073888 - RNA, 22 nt, Human
ugucuucaguaaaauacacuau

SEQ ID NO: 1073889 - RNA, 22 nt, Human
ccugaggcuuaaucugucccaa

SEQ ID NO: 1073890 - RNA, 22 nt, Human
caguaauagauuugagaguggu

SEQ ID NO: 1073891 - RNA, 22 nt, Human
cagaguuuuaucauacguggau

SEQ ID NO: 1073892 - RNA, 22 nt, Human
gccuggcuggucacugccuggc

SEQ ID NO: 1073893 - RNA, 22 nt, Human
accucugccacuuucuaacucu

SEQ ID NO: 1073894 - RNA, 22 nt, Human
aagccaggaccaaacucauccu

SEQ ID NO: 1073895 - RNA, 22 nt, Human
agagaauuuuaaaagccuugaa

SEQ ID NO: 1073896 - RNA, 22 nt, Human
gaauacaaacuuaaggcuuuac

SEQ ID NO: 1073897 - RNA, 22 nt, Human
cauuuguuaaccaguguggauu

SEQ ID NO: 1073898 - RNA, 22 nt, Human
ucaggggcccuucccucagcag

SEQ ID NO: 1073899 - RNA, 22 nt, Human
uucaggaugacaccauguccag

SEQ ID NO: 1073900 - RNA, 22 nt, Human
agaacaauugccccaaagcuug

SEQ ID NO: 1073901 - RNA, 22 nt, Human
caaugucaugauuuuccauuag

SEQ ID NO: 1073902 - RNA, 22 nt, Human
uacugaaagacugaauauuuag

SEQ ID NO: 1073903 - RNA, 22 nt, Human
acaauagaaauaauuaagcaca

SEQ ID NO: 1073904 - RNA, 15 nt, Human
ccaggcucugcacuc

SEQ ID NO: 1073905 - RNA, 20 nt, Human
guuuuucuugggcgagcuau

SEQ ID NO: 1073906 - RNA, 22 nt, Human
ggacacaguggaagacagcuug

SEQ ID NO: 1073907 - RNA, 22 nt, Human
auggcagcaaaugucuggcugg

SEQ ID NO: 1073908 - RNA, 22 nt, Human
gugggcaggaggcccugcccug

SEQ ID NO: 1073909 - RNA, 22 nt, Human
gcaguuaccuauuuuguagaaa

SEQ ID NO: 1073910 - RNA, 22 nt, Human
uguggccaccagagcugcuauu

SEQ ID NO: 1073911 - RNA, 22 nt, Human
cauuaacacuuuggauuuagac

SEQ ID NO: 1073912 - RNA, 22 nt, Human
cccuggaggaaaaucugaggcu

SEQ ID NO: 1073913 - RNA, 22 nt, Human
aagcaaguagguauuugacaaa

SEQ ID NO: 1073914 - RNA, 22 nt, Human
ccagcuaguuggguauuauaag

SEQ ID NO: 1073915 - RNA, 22 nt, Human
ucccucaggacccaacuuguaa

SEQ ID NO: 1073916 - RNA, 22 nt, Human
aaaguguugaagaaaauguuca

SEQ ID NO: 1073917 - RNA, 22 nt, Human
auuauuagugauguuguuacug

SEQ ID NO: 1073918 - RNA, 22 nt, Human
uugaagcauuguggcuuguauu

SEQ ID NO: 1073919 - RNA, 21 nt, Human
aaguaacaccacuccuggagu

SEQ ID NO: 1073920 - RNA, 22 nt, Human
ugcacacagaugguacaugcau

SEQ ID NO: 1073921 - RNA, 22 nt, Human
uuuccuaagauagauacuucag

SEQ ID NO: 1073922 - RNA, 22 nt, Human
agggguagagauugcuggugua

SEQ ID NO: 1073923 - RNA, 22 nt, Human
gguggcagcgucuaucugacau

SEQ ID NO: 1073924 - RNA, 22 nt, Human
aggccuggcuuugguuugcuga

SEQ ID NO: 1073925 - RNA, 22 nt, Human
auuugucaaaacacagagaaca

SEQ ID NO: 1073926 - RNA, 22 nt, Human
ggcaggcucagcagccaaggag

SEQ ID NO: 1073927 - RNA, 22 nt, Human
cagagcugcagauugaaggcau

SEQ ID NO: 1073928 - RNA, 22 nt, Human
guccucagucaguuuggugggg

SEQ ID NO: 1073929 - RNA, 22 nt, Human
aggcugcuggcaggcguggacg

SEQ ID NO: 1073930 - RNA, 22 nt, Human
agacaguaugauauaugaauac

SEQ ID NO: 1073931 - RNA, 22 nt, Human
gaguucuucuauauaguaugag

SEQ ID NO: 1073932 - RNA, 22 nt, Human
ccagguggaaggucugugcucu

SEQ ID NO: 1073933 - RNA, 22 nt, Human
cagugagggcauucagugcugg

SEQ ID NO: 1073934 - RNA, 22 nt, Human
ggcagcuguggacgucgucauu

SEQ ID NO: 1073935 - RNA, 22 nt, Human
aggaagagcaucuuugggucug

SEQ ID NO: 1073936 - RNA, 22 nt, Human
aggagugcaaauaguccagaga

SEQ ID NO: 1073937 - RNA, 22 nt, Human
aggauccuuuuucugcuguuug

SEQ ID NO: 1073938 - RNA, 22 nt, Human
acagagaccaguuacagcgucc

SEQ ID NO: 1073939 - RNA, 22 nt, Human
cuucuugcaauuuucaucuuau

SEQ ID NO: 1073940 - RNA, 22 nt, Human
uguuccaucaguuuuugguuga

SEQ ID NO: 1073941 - RNA, 22 nt, Human
ccagggcacuuaggcccagccc

SEQ ID NO: 1073942 - RNA, 22 nt, Human
uggcacauaguaggugcucaau

SEQ ID NO: 1073943 - RNA, 22 nt, Human
cagggccuccuaaggcaucuaa

SEQ ID NO: 1073944 - RNA, 22 nt, Human
ugccuggcaagaggggcuggcu

SEQ ID NO: 1073945 - RNA, 20 nt, Human
uggacagaauuagacacuuu

SEQ ID NO: 1073946 - RNA, 22 nt, Human
ggugcagaucuuucucuucagg

SEQ ID NO: 1073947 - RNA, 22 nt, Human
agugauggagcuuccucugcua

SEQ ID NO: 1073948 - RNA, 22 nt, Human
auuccacagcuacaucaaucua

SEQ ID NO: 1073949 - RNA, 22 nt, Human
acaaaauuaccuaguuauuuuc

SEQ ID NO: 1073950 - RNA, 22 nt, Human
uugcauaaaagaguauaucuua

SEQ ID NO: 1073951 - RNA, 22 nt, Human
ccucagcucuucccugugcaca

SEQ ID NO: 1073952 - RNA, 22 nt, Human
guccucuuagccacuuaauuau

SEQ ID NO: 1073953 - RNA, 22 nt, Human
caacuucagggaaacaugaagc

SEQ ID NO: 1073954 - RNA, 22 nt, Human
cugcccugcuuguuuccagugg

SEQ ID NO: 1073955 - RNA, 22 nt, Human
uuccaagucacccuuaggguca

SEQ ID NO: 1073956 - RNA, 22 nt, Human
agguggcuccucccauggcugg

SEQ ID NO: 1073957 - RNA, 22 nt, Human
uucuaaacggcuucacaggaau

SEQ ID NO: 1073958 - RNA, 22 nt, Human
ccaacucugaaaauccagauau

SEQ ID NO: 1073959 - RNA, 21 nt, Human
auacagaacauugauccaaga

SEQ ID NO: 1073960 - RNA, 22 nt, Human
uaauacaaggcaggaagcagua

SEQ ID NO: 1073961 - RNA, 21 nt, Human
aaggagccuaggaggcucagg

SEQ ID NO: 1073962 - RNA, 22 nt, Human
uccuugaaaggggcugcagggc

SEQ ID NO: 1073963 - RNA, 19 nt, Human
uaaggccaaaaguaagugu

SEQ ID NO: 1073964 - RNA, 20 nt, Human
gcccacucuaauccacuguc

SEQ ID NO: 1073965 - RNA, 22 nt, Human
uuauuauuccccaagucauuau

SEQ ID NO: 1073966 - RNA, 22 nt, Human
uaacugaacaucucaaaucaag

SEQ ID NO: 1073967 - RNA, 22 nt, Human
cagcacaguacaaggcacggau

SEQ ID NO: 1073968 - RNA, 20 nt, Human
uaugauaauuacaaaauagu

SEQ ID NO: 1073969 - RNA, 22 nt, Human
aaacuagccacacagaauacac

SEQ ID NO: 1073970 - RNA, 22 nt, Human
cagcugggccuccugagcccug

SEQ ID NO: 1073971 - RNA, 22 nt, Human
aagccagguguuuaggccagcg

SEQ ID NO: 1073972 - RNA, 22 nt, Human
uuucuucuguuuguaguuacac

SEQ ID NO: 1073973 - RNA, 22 nt, Human
guuuacaaauauuuuaaauggu

SEQ ID NO: 1073974 - RNA, 22 nt, Human
ucucugagcccaauguagcaau

SEQ ID NO: 1073975 - RNA, 22 nt, Human
cagugcuccugauguacccuug

SEQ ID NO: 1073976 - RNA, 22 nt, Human
acagucauagcagccuuuguua

SEQ ID NO: 1073977 - RNA, 22 nt, Human
caggcccugcugcugagaccuu

SEQ ID NO: 1073978 - RNA, 22 nt, Human
uucaaauuugguaugcaagcca

SEQ ID NO: 1073979 - RNA, 22 nt, Human
acagacuggccugucucgcacc

SEQ ID NO: 1073980 - RNA, 22 nt, Human
auacauguugagaaaauaucug

SEQ ID NO: 1073981 - RNA, 22 nt, Human
guacacacuguuugaucauuuc

SEQ ID NO: 1073982 - RNA, 22 nt, Human
auugaaagcauggauuuggauu

SEQ ID NO: 1073983 - RNA, 22 nt, Human
accuuucaaaguggcuaucacu

SEQ ID NO: 1073984 - RNA, 22 nt, Human
aggcugaggcaagaggaucacu

SEQ ID NO: 1073985 - RNA, 22 nt, Human
cacagcuuguuuagugacucac

SEQ ID NO: 1073986 - RNA, 22 nt, Human
ugaggccuggagggaggaguuu

SEQ ID NO: 1073987 - RNA, 22 nt, Human
acuugguugcaaaugaauuauu

SEQ ID NO: 1073988 - RNA, 22 nt, Human
gcuggccuugugucugaggaag

SEQ ID NO: 1073989 - RNA, 22 nt, Human
ggcagcucacugauuagcaauu

SEQ ID NO: 1073990 - RNA, 22 nt, Human
cuuccugagcaaggaacuauag

SEQ ID NO: 1073991 - RNA, 22 nt, Human
ccuccaguacuccaguccagcg

SEQ ID NO: 1073992 - RNA, 22 nt, Human
ccgggccucgggacaccgggua

SEQ ID NO: 1073993 - RNA, 22 nt, Human
gccacagggcagaugcgcagag

SEQ ID NO: 1073994 - RNA, 22 nt, Human
acacucuugcauuaccugaaua

SEQ ID NO: 1073995 - RNA, 22 nt, Human
ugucaugccaccguuucccaga

SEQ ID NO: 1073996 - RNA, 22 nt, Human
agagccugugggagaugcagcu

SEQ ID NO: 1073997 - RNA, 22 nt, Human
ggcucuuuaacuugucuaaauu

SEQ ID NO: 1073998 - RNA, 22 nt, Human
caggcugaucagggcugggaug

SEQ ID NO: 1073999 - RNA, 22 nt, Human
cugugccuccaaguggucucug

SEQ ID NO: 1074000 - RNA, 20 nt, Human
acagcagccuugcuagaaac

SEQ ID NO: 1074001 - RNA, 22 nt, Human
acccaaaagucacucaggagca

SEQ ID NO: 1074002 - RNA, 21 nt, Human
ucuugaaaauuguagcaguuu

SEQ ID NO: 1074003 - RNA, 22 nt, Human
ugcuggaggcaguggaggugcc

SEQ ID NO: 1074004 - RNA, 22 nt, Human
cucccagagaccaagcugagaa

SEQ ID NO: 1074005 - RNA, 22 nt, Human
uuaauacagaagcaagacacug

SEQ ID NO: 1074006 - RNA, 22 nt, Human
guuuccaaccccaccaaagugc

SEQ ID NO: 1074007 - RNA, 22 nt, Human
uugaaagugauggggaagaugg

SEQ ID NO: 1074008 - RNA, 22 nt, Human
ggaauacaaaucuuuguucucu

SEQ ID NO: 1074009 - RNA, 22 nt, Human
ccugggaguggcacucacagca

SEQ ID NO: 1074010 - RNA, 22 nt, Human
acauuucucccugcaugccugc

SEQ ID NO: 1074011 - RNA, 22 nt, Human
uuugucuuaaaucuuguuacug

SEQ ID NO: 1074012 - RNA, 22 nt, Human
augcaaggacauguaaugaugu

SEQ ID NO: 1074013 - RNA, 22 nt, Human
uuaaggcacagagagguuaagu

SEQ ID NO: 1074014 - RNA, 22 nt, Human
aacaaacaaacauuuugucauc

SEQ ID NO: 1074015 - RNA, 22 nt, Human
gcuggcuguaucaccuggccag

SEQ ID NO: 1074016 - RNA, 22 nt, Human
ucaccuuagcuagaggaagaga

SEQ ID NO: 1074017 - RNA, 22 nt, Human
acagggccucagccagggcaga

SEQ ID NO: 1074018 - RNA, 22 nt, Human
uaagucauaagucaacaaagga

SEQ ID NO: 1074019 - RNA, 23 nt, Human
cauggcagcaagagcucauggcc

SEQ ID NO: 1074020 - RNA, 22 nt, Human
ggauuaagaccugucaguacac

SEQ ID NO: 1074021 - RNA, 22 nt, Human
ucucuguggcaagcaugcugcu

SEQ ID NO: 1074022 - RNA, 22 nt, Human
gugcccugucucuugucuccag

SEQ ID NO: 1074023 - RNA, 22 nt, Human
acagcuugcaauggcuuucaac

SEQ ID NO: 1074024 - RNA, 22 nt, Human
aagguuuccagugauauugugg

SEQ ID NO: 1074025 - RNA, 22 nt, Human
acuuccuggcugggugaccugg

SEQ ID NO: 1074026 - RNA, 21 nt, Human
ugcagccauucagcccuaugc

SEQ ID NO: 1074027 - RNA, 22 nt, Human
cuuuuucuucuaggugugccug

SEQ ID NO: 1074028 - RNA, 22 nt, Human
auacagaugagaucaggcauaa

SEQ ID NO: 1074029 - RNA, 22 nt, Human
aaagaaucuauauaucaccacc

SEQ ID NO: 1074030 - RNA, 22 nt, Human
cuauuuggauguuagccucagu

SEQ ID NO: 1074031 - RNA, 22 nt, Human
gaaaaccaccucccaucaagca

SEQ ID NO: 1074032 - RNA, 22 nt, Human
aaucagaaaauucaguggaauu

SEQ ID NO: 1074033 - RNA, 22 nt, Human
ugcuucugggccugguguuccc

SEQ ID NO: 1074034 - RNA, 15 nt, Human
gcagaugggggugau

SEQ ID NO: 1074035 - RNA, 22 nt, Human
ggagaguggauuccagcuguau

SEQ ID NO: 1074036 - RNA, 22 nt, Human
ucucagguuucaagacaggaaa

SEQ ID NO: 1074037 - RNA, 22 nt, Human
ucaaagaagugcaaaccucauc

SEQ ID NO: 1074038 - RNA, 22 nt, Human
uugguuuucuaauguauuaagg

SEQ ID NO: 1074039 - RNA, 19 nt, Human
cugagcaggcagguaggau

SEQ ID NO: 1074040 - RNA, 22 nt, Human
ugcacacacgcggcacaucugu

SEQ ID NO: 1074041 - RNA, 20 nt, Human
gggcagcaagacauuugaca

SEQ ID NO: 1074042 - RNA, 22 nt, Human
agucaguagauccaaacuuuug

SEQ ID NO: 1074043 - RNA, 22 nt, Human
ccucugagaccagcucugcacc

SEQ ID NO: 1074044 - RNA, 22 nt, Human
guuucaaguagcugcugauuau

SEQ ID NO: 1074045 - RNA, 22 nt, Human
aguuuucugccucuggaugcgu

SEQ ID NO: 1074046 - RNA, 22 nt, Human
ccaggccagcaggcacaccugc

SEQ ID NO: 1074047 - RNA, 23 nt, Human
agguagguuauugcugcuaccug

SEQ ID NO: 1074048 - RNA, 22 nt, Human
aauaauuacccaucuuuuugua

SEQ ID NO: 1074049 - RNA, 22 nt, Human
cucuccuggggagcacacacac

SEQ ID NO: 1074050 - RNA, 22 nt, Human
cucagaguggggcucccugagg

SEQ ID NO: 1074051 - RNA, 22 nt, Human
acacagggcugcgccugacccc

SEQ ID NO: 1074052 - RNA, 22 nt, Human
aagaagugguccuuuucuuucu

SEQ ID NO: 1074053 - RNA, 22 nt, Human
ucuggcugccaccauccucccc

SEQ ID NO: 1074054 - RNA, 22 nt, Human
aaagauuugaaauuaggcauca

SEQ ID NO: 1074055 - RNA, 22 nt, Human
agugcaaagcugcugcuguggu

SEQ ID NO: 1074056 - RNA, 22 nt, Human
uguuuuaaucucccauugcucu

SEQ ID NO: 1074057 - RNA, 22 nt, Human
uugucuguccaggcaccccaag

SEQ ID NO: 1074058 - RNA, 22 nt, Human
gagugagggccaacauccagcu

SEQ ID NO: 1074059 - RNA, 22 nt, Human
acucagaagauauaaugacuca

SEQ ID NO: 1074060 - RNA, 22 nt, Human
caaagcagugauccuuaaagga

SEQ ID NO: 1074061 - RNA, 22 nt, Human
ugacuuuuggaccucacugucc

SEQ ID NO: 1074062 - RNA, 22 nt, Human
aaugagcuagaccugcuuccuc

SEQ ID NO: 1074063 - RNA, 22 nt, Human
agugaagaggaaguggggcaca

SEQ ID NO: 1074064 - RNA, 22 nt, Human
aggaaagcucccaguagggcuc

SEQ ID NO: 1074065 - RNA, 22 nt, Human
cagacccuuuucugagaggacc

SEQ ID NO: 1074066 - RNA, 22 nt, Human
cuguagccagaagcagaaggcc

SEQ ID NO: 1074067 - RNA, 22 nt, Human
uuuccuaaggcucauuuuaaaa

SEQ ID NO: 1074068 - RNA, 22 nt, Human
acauuuaccuaguuaagucaau

SEQ ID NO: 1074069 - RNA, 22 nt, Human
ucaacacuaaagaauaaucuuu

SEQ ID NO: 1074070 - RNA, 22 nt, Human
gcuugcauuuggaauagauuaa

SEQ ID NO: 1074071 - RNA, 22 nt, Human
guuacauuaggauaauuugcug

SEQ ID NO: 1074072 - RNA, 22 nt, Human
ugaauucaccugaaagucugga

SEQ ID NO: 1074073 - RNA, 21 nt, Human
cuggacugaggagacagucgc

SEQ ID NO: 1074074 - RNA, 22 nt, Human
aagaaguuggaaaugauugaga

SEQ ID NO: 1074075 - RNA, 22 nt, Human
gcugucugcugugcacugagca

SEQ ID NO: 1074076 - RNA, 22 nt, Human
aggacagagcccuaguuucaua

SEQ ID NO: 1074077 - RNA, 22 nt, Human
uggcucagcuuacuuuugaggg

SEQ ID NO: 1074078 - RNA, 22 nt, Human
cucacagauguucuccuuuagg

SEQ ID NO: 1074079 - RNA, 22 nt, Human
agugggcagugcgcucggaugc

SEQ ID NO: 1074080 - RNA, 22 nt, Human
caggaacagcugaccugacaau

SEQ ID NO: 1074081 - RNA, 22 nt, Human
augaaauuuuaauuauaccucu

SEQ ID NO: 1074082 - RNA, 22 nt, Human
acaacuuucuggguuaucugau

SEQ ID NO: 1074083 - RNA, 22 nt, Human
ucugagugcacuaggaggggca

SEQ ID NO: 1074084 - RNA, 22 nt, Human
accagagcuuacaugcuagaaa

SEQ ID NO: 1074085 - RNA, 19 nt, Human
gcaggguguugacuguccc

SEQ ID NO: 1074086 - RNA, 22 nt, Human
gcagacagaugagggugcuggg

SEQ ID NO: 1074087 - RNA, 22 nt, Human
uugaaaggugaacaugaugcac

SEQ ID NO: 1074088 - RNA, 22 nt, Human
gaacuuuaccauuuagguaacu

SEQ ID NO: 1074089 - RNA, 22 nt, Human
ugaaggcuguuggauggggaag

SEQ ID NO: 1074090 - RNA, 22 nt, Human
guagcccaccuggggagggcga

SEQ ID NO: 1074091 - RNA, 22 nt, Human
uccaggcccagacggggugagg

SEQ ID NO: 1074092 - RNA, 21 nt, Human
uuugagaauuggucagagugc

SEQ ID NO: 1074093 - RNA, 22 nt, Human
aagaaggcuucagagcccagga

SEQ ID NO: 1074094 - RNA, 22 nt, Human
ggcucuggugaggguaggagau

SEQ ID NO: 1074095 - RNA, 22 nt, Human
gugggacucuucuuuggcagug

SEQ ID NO: 1074096 - RNA, 22 nt, Human
aaaggccacuugaaggauuuuu

SEQ ID NO: 1074097 - RNA, 22 nt, Human
cagcaucuucaugugcaucucc

SEQ ID NO: 1074098 - RNA, 22 nt, Human
gaaagcaguaaaugggucccau

SEQ ID NO: 1074099 - RNA, 22 nt, Human
aaacaaagccagggaaguuaug

SEQ ID NO: 1074100 - RNA, 22 nt, Human
uuuguucaugccuauauucuca

SEQ ID NO: 1074101 - RNA, 22 nt, Human
aaaguugugaaaccgaacaugu

SEQ ID NO: 1074102 - RNA, 22 nt, Human
ugcagaaggaggaggaaaucca

SEQ ID NO: 1074103 - RNA, 22 nt, Human
auggaaagccaguguuccauca

SEQ ID NO: 1074104 - RNA, 22 nt, Human
ccaggcucugcgcuggacaugg

SEQ ID NO: 1074105 - RNA, 22 nt, Human
aguggagguuauugaguuaagg

SEQ ID NO: 1074106 - RNA, 22 nt, Human
ucaugcaaggcugaaacauggu

SEQ ID NO: 1074107 - RNA, 22 nt, Human
gaggcugcuguuagcccugggc

SEQ ID NO: 1074108 - RNA, 22 nt, Human
gcagaaggauccgcaggugcaa

SEQ ID NO: 1074109 - RNA, 22 nt, Human
uccagcagaaaagagguaggga

SEQ ID NO: 1074110 - RNA, 22 nt, Human
aggcucaguauagcuggcaagu

SEQ ID NO: 1074111 - RNA, 22 nt, Human
gcagaaggucuggcacuucagg

SEQ ID NO: 1074112 - RNA, 22 nt, Human
cugacuguaauucuguucuuaa

SEQ ID NO: 1074113 - RNA, 22 nt, Human
ccugccucaggacucugcauau

SEQ ID NO: 1074114 - RNA, 22 nt, Human
uacuuagagcgauaauuuauac

SEQ ID NO: 1074115 - RNA, 22 nt, Human
gcagcuguguaaugagcccaca

SEQ ID NO: 1074116 - RNA, 22 nt, Human
gcaaagaaaugucagugagagg

SEQ ID NO: 1074117 - RNA, 23 nt, Human
gaagccacacaaaggucgccaag

SEQ ID NO: 1074118 - RNA, 22 nt, Human
ucuuuagaguuaacaauaauga

SEQ ID NO: 1074119 - RNA, 22 nt, Human
cuucccagacgggguggcagcc

SEQ ID NO: 1074120 - RNA, 22 nt, Human
gagaggugaauguggaugccac

SEQ ID NO: 1074121 - RNA, 22 nt, Human
cagucccaugagcccagaacau

SEQ ID NO: 1074122 - RNA, 22 nt, Human
aaacuugaggcaaugaaggugu

SEQ ID NO: 1074123 - RNA, 22 nt, Human
caaugucauuucacugggcuua

SEQ ID NO: 1074124 - RNA, 22 nt, Human
uuuauucuugagagugagaaga

SEQ ID NO: 1074125 - RNA, 22 nt, Human
aucaguuugauaauaaggcuug

SEQ ID NO: 1074126 - RNA, 22 nt, Human
uucccucccccagccuggcagg

SEQ ID NO: 1074127 - RNA, 22 nt, Human
uacauguaauuuucauaguaag

SEQ ID NO: 1074128 - RNA, 22 nt, Human
guucacaucacuucacugaacc

SEQ ID NO: 1074129 - RNA, 22 nt, Human
ggagggcaucaaucaggccugg

SEQ ID NO: 1074130 - RNA, 22 nt, Human
agccccacacucucucugagaa

SEQ ID NO: 1074131 - RNA, 22 nt, Human
agcagggcugcggccccaccac

SEQ ID NO: 1074132 - RNA, 18 nt, Human
gcuucauggaaggguugu

SEQ ID NO: 1074133 - RNA, 22 nt, Human
uuugcauuauauuuauagaaga

SEQ ID NO: 1074134 - RNA, 22 nt, Human
ggaucauuaacacauccaucac

SEQ ID NO: 1074135 - RNA, 22 nt, Human
aucuuauugcuguugccagaua

SEQ ID NO: 1074136 - RNA, 22 nt, Human
gcugcuggcacuggagugagcc

SEQ ID NO: 1074137 - RNA, 22 nt, Human
uagggcagagcuuguacacgau

SEQ ID NO: 1074138 - RNA, 22 nt, Human
agcuguggggcaggcagcgagg

SEQ ID NO: 1074139 - RNA, 22 nt, Human
cccugggacccgcugcagaggc

SEQ ID NO: 1074140 - RNA, 22 nt, Human
cacagcugcacagaggaggugc

SEQ ID NO: 1074141 - RNA, 22 nt, Human
cggcugagcagugcugauggaa

SEQ ID NO: 1074142 - RNA, 22 nt, Human
aguguuaagagaaaauucugcu

SEQ ID NO: 1074143 - RNA, 22 nt, Human
uccucucagugugguuguggga

SEQ ID NO: 1074144 - RNA, 22 nt, Human
guggcuuggaccagucacagug

SEQ ID NO: 1074145 - RNA, 22 nt, Human
uguccuuuaugaaaugguguuu

SEQ ID NO: 1074146 - RNA, 22 nt, Human
aaggcaguuugggccaccaucu

SEQ ID NO: 1074147 - RNA, 22 nt, Human
agaucaaagccaugagagauuu

SEQ ID NO: 1074148 - RNA, 22 nt, Human
cagcaacucuccugugcucaaa

SEQ ID NO: 1074149 - RNA, 22 nt, Human
cauugcuuugugcauauuuaaa

SEQ ID NO: 1074150 - RNA, 22 nt, Human
accauuuuggguauuuucagag

SEQ ID NO: 1074151 - RNA, 22 nt, Human
acauacuuuuuaaaagauugcu

SEQ ID NO: 1074152 - RNA, 22 nt, Human
ugucccucauugacgcugugcc

SEQ ID NO: 1074153 - RNA, 22 nt, Human
cugagccaaccacagcaggagc

SEQ ID NO: 1074154 - RNA, 22 nt, Human
agcugaagaaaugggaagcauu

SEQ ID NO: 1074155 - RNA, 22 nt, Human
uugcaacauuguaaguuuauau

SEQ ID NO: 1074156 - RNA, 22 nt, Human
ccagccugaaaugccucauccu

SEQ ID NO: 1074157 - RNA, 22 nt, Human
cccaggaggcagagcuugcagu

SEQ ID NO: 1074158 - RNA, 22 nt, Human
gaugaaaugugaaaguucuggg

SEQ ID NO: 1074159 - RNA, 22 nt, Human
gccaggugggagacagacagca

SEQ ID NO: 1074160 - RNA, 22 nt, Human
gaaaauaguucaucacaaugau

SEQ ID NO: 1074161 - RNA, 21 nt, Human
acugagagauguuggaucaua

SEQ ID NO: 1074162 - RNA, 22 nt, Human
ugagcaggagauaaacagguag

SEQ ID NO: 1074163 - RNA, 22 nt, Human
auugacaagcaguaugucuuag

SEQ ID NO: 1074164 - RNA, 22 nt, Human
ggcuuugccuggaauuuccuug

SEQ ID NO: 1074165 - RNA, 20 nt, Human
ggcaggugcucgcuuggucu

SEQ ID NO: 1074166 - RNA, 22 nt, Human
gccucuggggcagcugagucau

SEQ ID NO: 1074167 - RNA, 19 nt, Human
ccucccacggauuccuucc

SEQ ID NO: 1074168 - RNA, 23 nt, Human
ccaggcaguagcuauugaaguga

SEQ ID NO: 1074169 - RNA, 22 nt, Human
uggaacacaagucauugagggg

SEQ ID NO: 1074170 - RNA, 21 nt, Human
agcagaggggacauguuugau

SEQ ID NO: 1074171 - RNA, 22 nt, Human
caggauccuggcugcauggacg

SEQ ID NO: 1074172 - RNA, 22 nt, Human
ggaaagagggacccagcuuggu

SEQ ID NO: 1074173 - RNA, 22 nt, Human
acagguggagugguuagcaggc

SEQ ID NO: 1074174 - RNA, 22 nt, Human
auuucauccagaguccuauuag

SEQ ID NO: 1074175 - RNA, 22 nt, Human
ccugggcaacauagggagaccc

SEQ ID NO: 1074176 - RNA, 22 nt, Human
uuaucaagggagaaacaggagg

SEQ ID NO: 1074177 - RNA, 22 nt, Human
agggcucuguccccagaggccc

SEQ ID NO: 1074178 - RNA, 22 nt, Human
agaggagcugggaggcccucgu

SEQ ID NO: 1074179 - RNA, 19 nt, Human
aaaugugaugguacaauuc

SEQ ID NO: 1074180 - RNA, 22 nt, Human
agcuggcagucauccuagugag

SEQ ID NO: 1074181 - RNA, 22 nt, Human
caguuucuuggaugccaauuuc

SEQ ID NO: 1074182 - RNA, 22 nt, Human
cccagcagaccgcugugauggc

SEQ ID NO: 1074183 - RNA, 22 nt, Human
aaugugguuaaaauuugguugu

SEQ ID NO: 1074184 - RNA, 22 nt, Human
ucacagaagggaaagaugccaa

SEQ ID NO: 1074185 - RNA, 22 nt, Human
cugagagaucaagccacaggau

SEQ ID NO: 1074186 - RNA, 22 nt, Human
uguacagaaggcacuaagguca

SEQ ID NO: 1074187 - RNA, 22 nt, Human
cugagaguguggcuuccaggcc

SEQ ID NO: 1074188 - RNA, 22 nt, Human
aacaaaagccgaaguagguguc

SEQ ID NO: 1074189 - RNA, 22 nt, Human
gagccugagugcugccuccccu

SEQ ID NO: 1074190 - RNA, 22 nt, Human
cagcccagccuugucucuuuau

SEQ ID NO: 1074191 - RNA, 22 nt, Human
auuucacaaagaacagaugcag

SEQ ID NO: 1074192 - RNA, 22 nt, Human
gggggaagaggcaugaaguccu

SEQ ID NO: 1074193 - RNA, 22 nt, Human
augauauagagaguagauuaaa

SEQ ID NO: 1074194 - RNA, 22 nt, Human
gcagaucaauugauuguucacu

SEQ ID NO: 1074195 - RNA, 22 nt, Human
guuccaaagucucugagcugag

SEQ ID NO: 1074196 - RNA, 23 nt, Human
ccaaagucgaagucuaguccaga

SEQ ID NO: 1074197 - RNA, 22 nt, Human
ccucuuugugccugcaggcugc

SEQ ID NO: 1074198 - RNA, 22 nt, Human
ggcagguguggugaccagagau

SEQ ID NO: 1074199 - RNA, 20 nt, Human
ggcugcugugggcagagagg

SEQ ID NO: 1074200 - RNA, 22 nt, Human
agcaaagaaauggaggcucaga

SEQ ID NO: 1074201 - RNA, 22 nt, Human
gcugugcccagcuccagcucug

SEQ ID NO: 1074202 - RNA, 22 nt, Human
aaguaacaggcaugugaaugac

SEQ ID NO: 1074203 - RNA, 22 nt, Human
cugaggcucccucgggucugcu

SEQ ID NO: 1074204 - RNA, 22 nt, Human
uuggaagacagugaaacagcac

SEQ ID NO: 1074205 - RNA, 22 nt, Human
gcccagaagugacucagcacug

SEQ ID NO: 1074206 - RNA, 22 nt, Human
acaccacaaguaacucuuuucc

SEQ ID NO: 1074207 - RNA, 22 nt, Human
aggagcugacuuguaaagcauu

SEQ ID NO: 1074208 - RNA, 22 nt, Human
gggacuucauagcuaggcacuu

SEQ ID NO: 1074209 - RNA, 22 nt, Human
uauuucugucagccagauaugg

SEQ ID NO: 1074210 - RNA, 22 nt, Human
cauuucaauuauuugcucuucu

SEQ ID NO: 1074211 - RNA, 18 nt, Human
ucucagggcauacccaga

SEQ ID NO: 1074212 - RNA, 22 nt, Human
uguacaguguagucaugagguu

SEQ ID NO: 1074213 - RNA, 22 nt, Human
acacauuauagagaguauaaua

SEQ ID NO: 1074214 - RNA, 22 nt, Human
aauucuagcccaggcaaaacua

SEQ ID NO: 1074215 - RNA, 22 nt, Human
auauuuuggggugaugugcauc

SEQ ID NO: 1074216 - RNA, 22 nt, Human
gaaguuaguaccugguauacuu

SEQ ID NO: 1074217 - RNA, 22 nt, Human
agggaguguuacauaauggguu

SEQ ID NO: 1074218 - RNA, 22 nt, Human
auugauuuagcucaagacacau

SEQ ID NO: 1074219 - RNA, 22 nt, Human
ucucuucauagugacacccauc

SEQ ID NO: 1074220 - RNA, 22 nt, Human
gcugggcaccggagagacccca

SEQ ID NO: 1074221 - RNA, 22 nt, Human
gaacaguuucccuguagaaaau

SEQ ID NO: 1074222 - RNA, 22 nt, Human
gaggggcuggguagggcaaccc

SEQ ID NO: 1074223 - RNA, 22 nt, Human
augaaauggugguuuuccauuu

SEQ ID NO: 1074224 - RNA, 22 nt, Human
ggcaggagauaaaauauuaguu

SEQ ID NO: 1074225 - RNA, 22 nt, Human
uaugugcaaauuaauugcuaga

SEQ ID NO: 1074226 - RNA, 22 nt, Human
cuucuuuacuuucuagaaauaa

SEQ ID NO: 1074227 - RNA, 22 nt, Human
gaauguuuaaggaaggcguggc

SEQ ID NO: 1074228 - RNA, 22 nt, Human
gaggucaggcuugcagcagggu

SEQ ID NO: 1074229 - RNA, 22 nt, Human
agggaaagguagugaggucaca

SEQ ID NO: 1074230 - RNA, 22 nt, Human
cuccucuggcuuccuggaggca

SEQ ID NO: 1074231 - RNA, 22 nt, Human
agccuccaucccaugcacaaag

SEQ ID NO: 1074232 - RNA, 22 nt, Human
agaauuuaggaugcaugugaau

SEQ ID NO: 1074233 - RNA, 22 nt, Human
aaaucuguuguaauguuuuuua

SEQ ID NO: 1074234 - RNA, 22 nt, Human
ccuccugguccagcaucucuuu

SEQ ID NO: 1074235 - RNA, 22 nt, Human
auguaaaagauuauuuuccugu

SEQ ID NO: 1074236 - RNA, 21 nt, Human
ggcuaggaugcugggguuucc

SEQ ID NO: 1074237 - RNA, 22 nt, Human
aggcaguuguugcugagcagcu

SEQ ID NO: 1074238 - RNA, 22 nt, Human
auauuacauaaacaugagugaa

SEQ ID NO: 1074239 - RNA, 17 nt, Human
gagauuuucguccugaa

SEQ ID NO: 1074240 - RNA, 22 nt, Human
cagcaacauauaugaaacugug

SEQ ID NO: 1074241 - RNA, 22 nt, Human
ucagcugccccaguggccccag

SEQ ID NO: 1074242 - RNA, 22 nt, Human
cagaaauguacugacaugcagu

SEQ ID NO: 1074243 - RNA, 22 nt, Human
uccaggaaggacuaaugguuug

SEQ ID NO: 1074244 - RNA, 22 nt, Human
cacugaaggacaguaggaaggg

SEQ ID NO: 1074245 - RNA, 22 nt, Human
gagcaguggucugaucuucuaa

SEQ ID NO: 1074246 - RNA, 22 nt, Human
gcugggagcaaagccaugcaua

SEQ ID NO: 1074247 - RNA, 22 nt, Human
gaggcagcaauaaaaagaauuu

SEQ ID NO: 1074248 - RNA, 22 nt, Human
ucaaagucuaucuguaauuacu

SEQ ID NO: 1074249 - RNA, 22 nt, Human
gaggacagcuuagggcuuccug

SEQ ID NO: 1074250 - RNA, 21 nt, Human
uugauuuuaggaaguuuguca

SEQ ID NO: 1074251 - RNA, 22 nt, Human
cuggcucacuagcccugcccug

SEQ ID NO: 1074252 - RNA, 22 nt, Human
aaucauaauucaaauaagcuua

SEQ ID NO: 1074253 - RNA, 22 nt, Human
aauagcauccuaaaacauacuu

SEQ ID NO: 1074254 - RNA, 22 nt, Human
aagcagagaccggcuaauggag

SEQ ID NO: 1074255 - RNA, 22 nt, Human
uucaggaucaaguugccaguag

SEQ ID NO: 1074256 - RNA, 22 nt, Human
aaaguucuaaaacucuuuguga

SEQ ID NO: 1074257 - RNA, 22 nt, Human
uggaaggcaacggagugagcug

SEQ ID NO: 1074258 - RNA, 22 nt, Human
ccugguguugugaaguagccgu

SEQ ID NO: 1074259 - RNA, 22 nt, Human
gaguguucccacaccccaguug

SEQ ID NO: 1074260 - RNA, 22 nt, Human
cgcaggcuggcgcggaguggca

SEQ ID NO: 1074261 - RNA, 23 nt, Human
ucagagaaguuguaggcugggga

SEQ ID NO: 1074262 - RNA, 22 nt, Human
cuggccuguccugacccagccu

SEQ ID NO: 1074263 - RNA, 21 nt, Human
aucaccagcagaagcugcaga

SEQ ID NO: 1074264 - RNA, 22 nt, Human
cagggacauuuccaagagaauu

SEQ ID NO: 1074265 - RNA, 22 nt, Human
uucaaacuguguaauuuauaaa

SEQ ID NO: 1074266 - RNA, 22 nt, Human
cugccgaguacagccauagaaa

SEQ ID NO: 1074267 - RNA, 22 nt, Human
cuccucacacccacugcaacca

SEQ ID NO: 1074268 - RNA, 23 nt, Human
agaagcagcuucuggaguaucgg

SEQ ID NO: 1074269 - RNA, 22 nt, Human
uucuuauuucccccuucaucau

SEQ ID NO: 1074270 - RNA, 22 nt, Human
uuuauuauucucuggagaaugu

SEQ ID NO: 1074271 - RNA, 22 nt, Human
cacucaggguacaauggagggc

SEQ ID NO: 1074272 - RNA, 22 nt, Human
cagggacagccuugggguggcg

SEQ ID NO: 1074273 - RNA, 22 nt, Human
ggugggcacauucagucucugu

SEQ ID NO: 1074274 - RNA, 22 nt, Human
aaacagcugucauuguuuuaaa

SEQ ID NO: 1074275 - RNA, 22 nt, Human
aaagcuggccucucaggcuuua

SEQ ID NO: 1074276 - RNA, 22 nt, Human
cccugcacacucgugucuugac

SEQ ID NO: 1074277 - RNA, 20 nt, Human
aggccaggaaauguaguucu

SEQ ID NO: 1074278 - RNA, 22 nt, Human
acuguguggaccacucugaggc

SEQ ID NO: 1074279 - RNA, 22 nt, Human
gccaggagagcuccuucagguu

SEQ ID NO: 1074280 - RNA, 22 nt, Human
cguguggucccggcaaggcaag

SEQ ID NO: 1074281 - RNA, 22 nt, Human
aaaaccuucagguuuggaguuu

SEQ ID NO: 1074282 - RNA, 22 nt, Human
gagugcaguuggggugagggga

SEQ ID NO: 1074283 - RNA, 22 nt, Human
guucuucaucuuaaccaucugu

SEQ ID NO: 1074284 - RNA, 22 nt, Human
aggcagaaaauagucauccaaa

SEQ ID NO: 1074285 - RNA, 22 nt, Human
uuuucaucucugcuuuguaccu

SEQ ID NO: 1074286 - RNA, 22 nt, Human
acagugacguuuauuugagacg

SEQ ID NO: 1074287 - RNA, 22 nt, Human
uagcagaggcugucugacuuaa

SEQ ID NO: 1074288 - RNA, 22 nt, Human
acauguuuaaguuuguuauaug

SEQ ID NO: 1074289 - RNA, 21 nt, Human
cacaccaaacaggaacaggga

SEQ ID NO: 1074290 - RNA, 22 nt, Human
gaaaagggcaagagagagggca

SEQ ID NO: 1074291 - RNA, 22 nt, Human
cuggccuagcucucugcuugaa

SEQ ID NO: 1074292 - RNA, 22 nt, Human
uguucuuuggcuucacagcucu

SEQ ID NO: 1074293 - RNA, 22 nt, Human
ccugggacuuggucugggguuu

SEQ ID NO: 1074294 - RNA, 22 nt, Human
uuauugaaauggaagcuauaac

SEQ ID NO: 1074295 - RNA, 22 nt, Human
caggaggagcauuagcgucuca

SEQ ID NO: 1074296 - RNA, 22 nt, Human
uuaugggagcaauuggggaggu

SEQ ID NO: 1074297 - RNA, 22 nt, Human
ugaaaguugcacauaagagaau

SEQ ID NO: 1074298 - RNA, 22 nt, Human
guacucaguaauauaacauauu

SEQ ID NO: 1074299 - RNA, 22 nt, Human
caaaugaauagggagugugaug

SEQ ID NO: 1074300 - RNA, 22 nt, Human
aauuugauucagcaaauguuca

SEQ ID NO: 1074301 - RNA, 22 nt, Human
cacugggcaauucugagccuaa

SEQ ID NO: 1074302 - RNA, 22 nt, Human
ugucccagguccuagaugacca

SEQ ID NO: 1074303 - RNA, 22 nt, Human
ucaacacuggcuacaguuaugc

SEQ ID NO: 1074304 - RNA, 22 nt, Human
agccagagcugaugucauucuc

SEQ ID NO: 1074305 - RNA, 22 nt, Human
acuuggagggagcuggguggaa

SEQ ID NO: 1074306 - RNA, 22 nt, Human
cugcugggcuccucaugugacu

SEQ ID NO: 1074307 - RNA, 21 nt, Human
aggaagaucuggaggucggcg

SEQ ID NO: 1074308 - RNA, 22 nt, Human
uuaaagcaccuccuuggaugug

SEQ ID NO: 1074309 - RNA, 22 nt, Human
ucugagggcuugaggggaagua

SEQ ID NO: 1074310 - RNA, 22 nt, Human
caggagccagcugucccaacca

SEQ ID NO: 1074311 - RNA, 22 nt, Human
gcaguggcuaagcucgcaugca

SEQ ID NO: 1074312 - RNA, 18 nt, Human
auacaagcucuguuacuu

SEQ ID NO: 1074313 - RNA, 22 nt, Human
ggccucagugggccgcugcagg

SEQ ID NO: 1074314 - RNA, 22 nt, Human
uuacaaguauuuaagaugcugu

SEQ ID NO: 1074315 - RNA, 22 nt, Human
agacaucauguuacagauuaag

SEQ ID NO: 1074316 - RNA, 22 nt, Human
ccugccugggcucacuugccag

SEQ ID NO: 1074317 - RNA, 22 nt, Human
aagacaugcaguuuguuccauu

SEQ ID NO: 1074318 - RNA, 22 nt, Human
aauacuauguugugacacauga

SEQ ID NO: 1074319 - RNA, 22 nt, Human
cucccuggcagccgcacuccug

SEQ ID NO: 1074320 - RNA, 22 nt, Human
gaggaaagagucaaaucugaag

SEQ ID NO: 1074321 - RNA, 15 nt, Human
uuuaauauggaguua

SEQ ID NO: 1074322 - RNA, 17 nt, Human
aguguuuccuuaucauu

SEQ ID NO: 1074323 - RNA, 22 nt, Human
uggcacugggaugcuacuguua

SEQ ID NO: 1074324 - RNA, 22 nt, Human
ggcagcagaacuggcccuguau

SEQ ID NO: 1074325 - RNA, 22 nt, Human
agccagugaugaagacucugga

SEQ ID NO: 1074326 - RNA, 22 nt, Human
cucugcccgugccuuucccagu

SEQ ID NO: 1074327 - RNA, 22 nt, Human
caugaaauauuaguaacuguuu

SEQ ID NO: 1074328 - RNA, 22 nt, Human
agcaggggcuccuccacagcca

SEQ ID NO: 1074329 - RNA, 22 nt, Human
gauacuuuccauccaaaugcau

SEQ ID NO: 1074330 - RNA, 22 nt, Human
cugccaggccucaucccagcca

SEQ ID NO: 1074331 - RNA, 22 nt, Human
ggcuccugaugcucagauuuca

SEQ ID NO: 1074332 - RNA, 22 nt, Human
cuccacagccccuccaguggca

SEQ ID NO: 1074333 - RNA, 19 nt, Human
aaggcagaaguuggauaug

SEQ ID NO: 1074334 - RNA, 22 nt, Human
uucauucaagggguuccugauu

SEQ ID NO: 1074335 - RNA, 22 nt, Human
uagugcuuggcccuaccagaua

SEQ ID NO: 1074336 - RNA, 22 nt, Human
acagcagaccacuacuaguagg

SEQ ID NO: 1074337 - RNA, 22 nt, Human
uaaaucacccaucuccuaaucu

SEQ ID NO: 1074338 - RNA, 22 nt, Human
ucacuuaaaaauucuaguuaug

SEQ ID NO: 1074339 - RNA, 22 nt, Human
uacagguaaaauuaucagaaac

SEQ ID NO: 1074340 - RNA, 22 nt, Human
cugggagcugaggcugacgcug

SEQ ID NO: 1074341 - RNA, 22 nt, Human
gggccuggggugacguaccccu

SEQ ID NO: 1074342 - RNA, 22 nt, Human
gcagaggaggacccaggaauua

SEQ ID NO: 1074343 - RNA, 22 nt, Human
aucuggcucucucauuuacaaa

SEQ ID NO: 1074344 - RNA, 22 nt, Human
gccuggcacugggcuccuggcc

SEQ ID NO: 1074345 - RNA, 22 nt, Human
augaauugaggaaaacagucgu

SEQ ID NO: 1074346 - RNA, 22 nt, Human
cauccaauguccuauuaagacu

SEQ ID NO: 1074347 - RNA, 22 nt, Human
uuuucucuacaaaauaaccagc

SEQ ID NO: 1074348 - RNA, 22 nt, Human
acaggggcaggcaggacccuuu

SEQ ID NO: 1074349 - RNA, 22 nt, Human
cccagccucuggauucugcccu

SEQ ID NO: 1074350 - RNA, 22 nt, Human
ccaagggcucugacuugccugc

SEQ ID NO: 1074351 - RNA, 22 nt, Human
uuacuuugcuuucucauuacag

SEQ ID NO: 1074352 - RNA, 22 nt, Human
aaggugucacugggacaggaaa

SEQ ID NO: 1074353 - RNA, 22 nt, Human
ugcuuuauguuaucagaagggu

SEQ ID NO: 1074354 - RNA, 22 nt, Human
acagggaccugugagcuccaua

SEQ ID NO: 1074355 - RNA, 22 nt, Human
uucaaacucuugcucugcuagu

SEQ ID NO: 1074356 - RNA, 22 nt, Human
ugaagccaccgaaccagaagag

SEQ ID NO: 1074357 - RNA, 22 nt, Human
cuggcagcucugagucccuucu

SEQ ID NO: 1074358 - RNA, 20 nt, Human
agagugagacuccaucucag

SEQ ID NO: 1074359 - RNA, 22 nt, Human
aaaaguuugugcaaacacucag

SEQ ID NO: 1074360 - RNA, 22 nt, Human
agaaagggagcguggaucaauu

SEQ ID NO: 1074361 - RNA, 22 nt, Human
gggagcugagcuggaagagaau

SEQ ID NO: 1074362 - RNA, 22 nt, Human
gacaugcaacaauuuggcauuu

SEQ ID NO: 1074363 - RNA, 21 nt, Human
gucuuucuaccucuauguggc

SEQ ID NO: 1074364 - RNA, 22 nt, Human
aggagcagaacuguuguggagg

SEQ ID NO: 1074365 - RNA, 22 nt, Human
aauguuaaguuuagauuauaac

SEQ ID NO: 1074366 - RNA, 19 nt, Human
ucugccugcuuguaggggc

SEQ ID NO: 1074367 - RNA, 22 nt, Human
gaggucaggggagaggcugaug

SEQ ID NO: 1074368 - RNA, 22 nt, Human
aucugcuuguugcaugucuguu

SEQ ID NO: 1074369 - RNA, 22 nt, Human
gcugcugcgcuugucuacuguu

SEQ ID NO: 1074370 - RNA, 22 nt, Human
ucagcacuauacauuuugaaua

SEQ ID NO: 1074371 - RNA, 22 nt, Human
aggacagaaucuauauucaguu

SEQ ID NO: 1074372 - RNA, 22 nt, Human
auuuaauuuacauuugacagag

SEQ ID NO: 1074373 - RNA, 22 nt, Human
cccacagguccccaugaacucg

SEQ ID NO: 1074374 - RNA, 22 nt, Human
ucugaggccuugggacagaagu

SEQ ID NO: 1074375 - RNA, 22 nt, Human
auucuauagacagaaggucaau

SEQ ID NO: 1074376 - RNA, 22 nt, Human
gaaaaaggauaaauacaguguu

SEQ ID NO: 1074377 - RNA, 22 nt, Human
uggccuuggcagugagaagagu

SEQ ID NO: 1074378 - RNA, 22 nt, Human
uugcccugcguuaccaucucuu

SEQ ID NO: 1074379 - RNA, 22 nt, Human
uacagagacccacaagagacug

SEQ ID NO: 1074380 - RNA, 22 nt, Human
augcauauugauuauagauuca

SEQ ID NO: 1074381 - RNA, 22 nt, Human
uagaaacaaguuucucuuuggg

SEQ ID NO: 1074382 - RNA, 22 nt, Human
gucauuuucuagaauuauuuga

SEQ ID NO: 1074383 - RNA, 22 nt, Human
gcauuucaaaauuccaggcaag

SEQ ID NO: 1074384 - RNA, 22 nt, Human
cagaagaaaguggggagacaag

SEQ ID NO: 1074385 - RNA, 22 nt, Human
ccagcucaucucagugaaaugc

SEQ ID NO: 1074386 - RNA, 22 nt, Human
cacaauuuggugcuaaagaaag

SEQ ID NO: 1074387 - RNA, 22 nt, Human
uggccucugugggagcugagca

SEQ ID NO: 1074388 - RNA, 22 nt, Human
cauuucaaaagaauugccagaa

SEQ ID NO: 1074389 - RNA, 22 nt, Human
cugugcaaugccuaaucacaaa

SEQ ID NO: 1074390 - RNA, 22 nt, Human
ucagccugcgucauggugacac

SEQ ID NO: 1074391 - RNA, 22 nt, Human
auaaaguucugcuggcauauau

SEQ ID NO: 1074392 - RNA, 22 nt, Human
cagguaacaugauaaaacuuac

SEQ ID NO: 1074393 - RNA, 19 nt, Human
gcagagucaagagcugcug

SEQ ID NO: 1074394 - RNA, 22 nt, Human
ggaugcaggaguugaagaagga

SEQ ID NO: 1074395 - RNA, 22 nt, Human
ugaaaaggguagaucccuaagu

SEQ ID NO: 1074396 - RNA, 22 nt, Human
gaauuugaaaagugaugggaau

SEQ ID NO: 1074397 - RNA, 22 nt, Human
uacuuguuaucaucuuuuccuu

SEQ ID NO: 1074398 - RNA, 22 nt, Human
agggcugccugcucugcauuga

SEQ ID NO: 1074399 - RNA, 21 nt, Human
ggaagggguccucccaacagu

SEQ ID NO: 1074400 - RNA, 22 nt, Human
guauucuugguuaucaaaauac

SEQ ID NO: 1074401 - RNA, 22 nt, Human
uuccagcccgcgacuuguucag

SEQ ID NO: 1074402 - RNA, 22 nt, Human
gugggcuucccuuaagccagag

SEQ ID NO: 1074403 - RNA, 23 nt, Human
caagcugcaguuugguugguggg

SEQ ID NO: 1074404 - RNA, 22 nt, Human
ucuaggaaccugacaucucuca

SEQ ID NO: 1074405 - RNA, 22 nt, Human
caaaaaacacagaugucugugu

SEQ ID NO: 1074406 - RNA, 22 nt, Human
uguggcaggcaagauguacaga

SEQ ID NO: 1074407 - RNA, 22 nt, Human
aucuuacacgauaacuguuagu

SEQ ID NO: 1074408 - RNA, 22 nt, Human
ugaaugugaugcuaaacauaug

SEQ ID NO: 1074409 - RNA, 22 nt, Human
cagggccugccugguuccugga

SEQ ID NO: 1074410 - RNA, 22 nt, Human
aucuagaaaguguugaagauca

SEQ ID NO: 1074411 - RNA, 22 nt, Human
gacauaaaauucaauaauuugu

SEQ ID NO: 1074412 - RNA, 17 nt, Human
ggcuucagggagcuggg

SEQ ID NO: 1074413 - RNA, 22 nt, Human
cacaugcaucugucauguuugg

SEQ ID NO: 1074414 - RNA, 22 nt, Human
gggcagcucucacagcagccaa

SEQ ID NO: 1074415 - RNA, 22 nt, Human
agagaucaguuaaaaucuuuuu

SEQ ID NO: 1074416 - RNA, 22 nt, Human
uaugaaauuucuaguucugcuu

SEQ ID NO: 1074417 - RNA, 22 nt, Human
uugcauugaaugcacauuuuua

SEQ ID NO: 1074418 - RNA, 22 nt, Human
ggaugcuuagguuguuuuauua

SEQ ID NO: 1074419 - RNA, 22 nt, Human
ucauugcagcuucagguguuca

SEQ ID NO: 1074420 - RNA, 22 nt, Human
cuacagaagaaacuaucacuau

SEQ ID NO: 1074421 - RNA, 22 nt, Human
uuaacaauagaguuucuucagg

SEQ ID NO: 1074422 - RNA, 22 nt, Human
ugcagcugaggccagcuaugcc

SEQ ID NO: 1074423 - RNA, 22 nt, Human
aacuuucuaaagucaaauuggu

SEQ ID NO: 1074424 - RNA, 22 nt, Human
cagcuggccugaucccuguggc

SEQ ID NO: 1074425 - RNA, 22 nt, Human
gccuggcuccuaagagcacaac

SEQ ID NO: 1074426 - RNA, 22 nt, Human
ugcuaacuauuccuaaagauca

SEQ ID NO: 1074427 - RNA, 22 nt, Human
uggcagagaauaaaucuugacu

SEQ ID NO: 1074428 - RNA, 23 nt, Human
uuguauuuuuaguagagacaggg

SEQ ID NO: 1074429 - RNA, 22 nt, Human
caggugccgggaaugcagcaau

SEQ ID NO: 1074430 - RNA, 22 nt, Human
augcacaugaggcaagcaaaau

SEQ ID NO: 1074431 - RNA, 20 nt, Human
ugaaaaggucaggagacaug

SEQ ID NO: 1074432 - RNA, 22 nt, Human
ccaggaguuugaggcugcagug

SEQ ID NO: 1074433 - RNA, 23 nt, Human
ucuuuucaaugguucuuuaugug

SEQ ID NO: 1074434 - RNA, 22 nt, Human
ccauaaggagccagacauucca

SEQ ID NO: 1074435 - RNA, 22 nt, Human
gccccacagccugcggucucag

SEQ ID NO: 1074436 - RNA, 22 nt, Human
acauuuuacaguugucuggcua

SEQ ID NO: 1074437 - RNA, 16 nt, Human
ccccucaggaaguaca

SEQ ID NO: 1074438 - RNA, 22 nt, Human
uagacagagugaagacaagugg

SEQ ID NO: 1074439 - RNA, 22 nt, Human
auuauuucucacucacauaaua

SEQ ID NO: 1074440 - RNA, 22 nt, Human
ugggucagaaucagagaguugc

SEQ ID NO: 1074441 - RNA, 22 nt, Human
gauggcagguaguggucucauc

SEQ ID NO: 1074442 - RNA, 21 nt, Human
gcugcaaauucuaacaauuau

SEQ ID NO: 1074443 - RNA, 22 nt, Human
uggcugggagcuggaacugggc

SEQ ID NO: 1074444 - RNA, 22 nt, Human
uaagaauagucccuagaugugu

SEQ ID NO: 1074445 - RNA, 22 nt, Human
acaugcauacaagcacauguag

SEQ ID NO: 1074446 - RNA, 22 nt, Human
ucucugauguauaucagagaac

SEQ ID NO: 1074447 - RNA, 22 nt, Human
ugggacagagugagcuuuggcc

SEQ ID NO: 1074448 - RNA, 22 nt, Human
cagagagggcggcccuggcuuc

SEQ ID NO: 1074449 - RNA, 22 nt, Human
acaguauuugcgauacugauga

SEQ ID NO: 1074450 - RNA, 22 nt, Human
cccugccuuguuggagccuaug

SEQ ID NO: 1074451 - RNA, 22 nt, Human
uggcucagagcagggacucugg

SEQ ID NO: 1074452 - RNA, 22 nt, Human
ucugaacauccuacaacauuuu

SEQ ID NO: 1074453 - RNA, 22 nt, Human
cucaagacugaucgcaguggaa

SEQ ID NO: 1074454 - RNA, 22 nt, Human
acacauuucucccagucuccau

SEQ ID NO: 1074455 - RNA, 22 nt, Human
aaauuccaguucuuuuaccugc

SEQ ID NO: 1074456 - RNA, 19 nt, Human
gggaccugacuaauuggca

SEQ ID NO: 1074457 - RNA, 22 nt, Human
aagccagcauuuucccauuccu

SEQ ID NO: 1074458 - RNA, 22 nt, Human
uggcuuucucccccagcuucuc

SEQ ID NO: 1074459 - RNA, 22 nt, Human
acagauaauuagcauaaaugcu

SEQ ID NO: 1074460 - RNA, 22 nt, Human
gagccagguuugaaucucaguc

SEQ ID NO: 1074461 - RNA, 22 nt, Human
aucaggauucaccccagagcug

SEQ ID NO: 1074462 - RNA, 22 nt, Human
cagcugagaaggucugaucagg

SEQ ID NO: 1074463 - RNA, 22 nt, Human
aucacaaucuucaaaucgauuc

SEQ ID NO: 1074464 - RNA, 22 nt, Human
caaaugcagauucaggaguucu

SEQ ID NO: 1074465 - RNA, 22 nt, Human
aauucuucaagugcuuuggaga

SEQ ID NO: 1074466 - RNA, 21 nt, Human
ucccagggccaggugccauca

SEQ ID NO: 1074467 - RNA, 22 nt, Human
ugccugccaugcagaaagcuga

SEQ ID NO: 1074468 - RNA, 22 nt, Human
gucaacauuuacugcccuggcc

SEQ ID NO: 1074469 - RNA, 22 nt, Human
ccuauuuguaggcugggccagu

SEQ ID NO: 1074470 - RNA, 22 nt, Human
cugggcagugguggcccuuccc

SEQ ID NO: 1074471 - RNA, 22 nt, Human
uuuuuggguccaggcuguaucu

SEQ ID NO: 1074472 - RNA, 22 nt, Human
cuuuggcaugguccucacuaua

SEQ ID NO: 1074473 - RNA, 22 nt, Human
cauuuacaauguacagguugug

SEQ ID NO: 1074474 - RNA, 17 nt, Human
uuccuggaagucauucc

SEQ ID NO: 1074475 - RNA, 22 nt, Human
agagcuuauaucuuggccaucc

SEQ ID NO: 1074476 - RNA, 22 nt, Human
uuucacauaugguuguugauug

SEQ ID NO: 1074477 - RNA, 22 nt, Human
cugcugugcaggugccuaugau

SEQ ID NO: 1074478 - RNA, 22 nt, Human
aggacagcccuugagagcacau

SEQ ID NO: 1074479 - RNA, 22 nt, Human
gcagggcagggcaagaacuggg

SEQ ID NO: 1074480 - RNA, 22 nt, Human
caugucuguguacacaugcaca

SEQ ID NO: 1074481 - RNA, 22 nt, Human
aucuauuucugcuaauaacaau

SEQ ID NO: 1074482 - RNA, 22 nt, Human
aggaauuaacaauauauuuagg

SEQ ID NO: 1074483 - RNA, 22 nt, Human
uagcagcucugauucugggccc

SEQ ID NO: 1074484 - RNA, 22 nt, Human
cuggcagguggauggggacucc

SEQ ID NO: 1074485 - RNA, 22 nt, Human
gcucagggagagagggcagccg

SEQ ID NO: 1074486 - RNA, 22 nt, Human
cuucccugauaagagccucaga

SEQ ID NO: 1074487 - RNA, 22 nt, Human
ugccacugggcaugcagauguc

SEQ ID NO: 1074488 - RNA, 22 nt, Human
gggaagggagcuggguauuuag

SEQ ID NO: 1074489 - RNA, 17 nt, Human
ucugccgacugccagcu

SEQ ID NO: 1074490 - RNA, 22 nt, Human
ugaguucauauaguucaagaua

SEQ ID NO: 1074491 - RNA, 22 nt, Human
aaacagcugggagguagaggcg

SEQ ID NO: 1074492 - RNA, 22 nt, Human
uucuuguauauaaaaaucauuu

SEQ ID NO: 1074493 - RNA, 22 nt, Human
uucuccaggcuugggccagguc

SEQ ID NO: 1074494 - RNA, 22 nt, Human
aggcagugugggccaagcuucc

SEQ ID NO: 1074495 - RNA, 22 nt, Human
cucaggccauucuuccagcugc

SEQ ID NO: 1074496 - RNA, 22 nt, Human
acugaaggcuuucccaagguca

SEQ ID NO: 1074497 - RNA, 22 nt, Human
aggccucuugucuuccucacau

SEQ ID NO: 1074498 - RNA, 22 nt, Human
gacagacagggguucuccugga

SEQ ID NO: 1074499 - RNA, 22 nt, Human
uacaaagugauuuuggaauuga

SEQ ID NO: 1074500 - RNA, 22 nt, Human
accaagcuucguggaggaaguu

SEQ ID NO: 1074501 - RNA, 17 nt, Human
uguggccuucugagcuu

SEQ ID NO: 1074502 - RNA, 22 nt, Human
cagaccagaaggaagccgacaa

SEQ ID NO: 1074503 - RNA, 22 nt, Human
uggagcagaggcugagguuggg

SEQ ID NO: 1074504 - RNA, 20 nt, Human
uaacacuugcuuuuugacuu

SEQ ID NO: 1074505 - RNA, 20 nt, Human
aacagugaaugaggccagag

SEQ ID NO: 1074506 - RNA, 22 nt, Human
gggccucugugcagaggggccu

SEQ ID NO: 1074507 - RNA, 22 nt, Human
uuuuauauggcacauugguugg

SEQ ID NO: 1074508 - RNA, 22 nt, Human
ucucagugagcuuuucuauguu

SEQ ID NO: 1074509 - RNA, 22 nt, Human
uucuuaagcguaugauaaugaa

SEQ ID NO: 1074510 - RNA, 22 nt, Human
ugccagggugucaggagagcua

SEQ ID NO: 1074511 - RNA, 22 nt, Human
aaagguuuccgagcuuuaauuu

SEQ ID NO: 1074512 - RNA, 22 nt, Human
uucuuucucagugggcagauac

SEQ ID NO: 1074513 - RNA, 22 nt, Human
gcagaggauagcauaugaaccu

SEQ ID NO: 1074514 - RNA, 22 nt, Human
acaaauuaccauggaauuuggg

SEQ ID NO: 1074515 - RNA, 22 nt, Human
gagggcugaugcuuacuuauuu

SEQ ID NO: 1074516 - RNA, 23 nt, Human
cuucacaaucaaaaucaguucug

SEQ ID NO: 1074517 - RNA, 22 nt, Human
gggaaggaaaguuauuagcaga

SEQ ID NO: 1074518 - RNA, 17 nt, Human
aagcauuuaauuugcua

SEQ ID NO: 1074519 - RNA, 22 nt, Human
ucagcagugcagggugaggcag

SEQ ID NO: 1074520 - RNA, 22 nt, Human
uacauuccuucguuuagagauu

SEQ ID NO: 1074521 - RNA, 22 nt, Human
cuguucucuggcgguggcuguu

SEQ ID NO: 1074522 - RNA, 23 nt, Human
uuccagaguccacaucugccacc

SEQ ID NO: 1074523 - RNA, 22 nt, Human
aaacuucagugaaugacuuaug

SEQ ID NO: 1074524 - RNA, 22 nt, Human
cugcuuugaggggcucuguaua

SEQ ID NO: 1074525 - RNA, 20 nt, Human
uguccuaauagacaagcaga

SEQ ID NO: 1074526 - RNA, 22 nt, Human
gagcagaugugugccaggaugc

SEQ ID NO: 1074527 - RNA, 22 nt, Human
ugccagaguuacaugaggguca

SEQ ID NO: 1074528 - RNA, 22 nt, Human
uauuacugucaauaucacagaa

SEQ ID NO: 1074529 - RNA, 22 nt, Human
guauuuuucauuccaagugaga

SEQ ID NO: 1074530 - RNA, 22 nt, Human
uuguccaaggucccacaguuag

SEQ ID NO: 1074531 - RNA, 22 nt, Human
ucucuggagggcuccaggcggg

SEQ ID NO: 1074532 - RNA, 22 nt, Human
cccaggcugaugggaugggcca

SEQ ID NO: 1074533 - RNA, 23 nt, Human
acagacaacacugaugagagaaa

SEQ ID NO: 1074534 - RNA, 22 nt, Human
accuuggaaaguuuaauugagg

SEQ ID NO: 1074535 - RNA, 22 nt, Human
ugaugcccccaaaucuggcuca

SEQ ID NO: 1074536 - RNA, 22 nt, Human
ugagaagcugcuugugcuguau

SEQ ID NO: 1074537 - RNA, 22 nt, Human
gugguccuuuagaggauguaau

SEQ ID NO: 1074538 - RNA, 22 nt, Human
ucaauucaacacaugcacauug

SEQ ID NO: 1074539 - RNA, 22 nt, Human
auauacagggagaaacagcuua

SEQ ID NO: 1074540 - RNA, 22 nt, Human
gggaggaaaugugcagcgaauu

SEQ ID NO: 1074541 - RNA, 23 nt, Human
uuucacauuuacuguuagauggc

SEQ ID NO: 1074542 - RNA, 22 nt, Human
ucaagucucaauguauuauggu

SEQ ID NO: 1074543 - RNA, 22 nt, Human
ggccugugagcccuugcaugua

SEQ ID NO: 1074544 - RNA, 22 nt, Human
aaauguacaacauccauauaua

SEQ ID NO: 1074545 - RNA, 22 nt, Human
auugaaaauaaggccagaaaca

SEQ ID NO: 1074546 - RNA, 22 nt, Human
agugacucacuagcucucagug

SEQ ID NO: 1074547 - RNA, 22 nt, Human
gcugccugccuugccuggagga

SEQ ID NO: 1074548 - RNA, 23 nt, Human
ggagacaagguaccacguuaaca

SEQ ID NO: 1074549 - RNA, 22 nt, Human
gaagcagcuggugagauggagc

SEQ ID NO: 1074550 - RNA, 22 nt, Human
gauuuguuucaaguuagcaucu

SEQ ID NO: 1074551 - RNA, 22 nt, Human
augggcuggcagccugaacagc

SEQ ID NO: 1074552 - RNA, 22 nt, Human
caguucugagcuuucccagaag

SEQ ID NO: 1074553 - RNA, 22 nt, Human
agcaauauaaauguuggguaga

SEQ ID NO: 1074554 - RNA, 22 nt, Human
guggggcaugcacgcugcuccu

SEQ ID NO: 1074555 - RNA, 22 nt, Human
cccaggccagaacuugguugcu

SEQ ID NO: 1074556 - RNA, 22 nt, Human
aaacaaugagcuuuuacacacu

SEQ ID NO: 1074557 - RNA, 21 nt, Human
uuaagaccugcaucaucauua

SEQ ID NO: 1074558 - RNA, 22 nt, Human
uggagacugugcuaagggaguu

SEQ ID NO: 1074559 - RNA, 22 nt, Human
caggggcucccugggugccagu

SEQ ID NO: 1074560 - RNA, 22 nt, Human
uuugucuuauccaaucucucag

SEQ ID NO: 1074561 - RNA, 22 nt, Human
cuucugggugccugugaguguu

SEQ ID NO: 1074562 - RNA, 22 nt, Human
gcucagagcaucccagugaaug

SEQ ID NO: 1074563 - RNA, 22 nt, Human
aaggcacuuuuccugagaugau

SEQ ID NO: 1074564 - RNA, 22 nt, Human
agagccuggcucccagcuaccg

SEQ ID NO: 1074565 - RNA, 22 nt, Human
ugcuggcccaugaagacgcagu

SEQ ID NO: 1074566 - RNA, 22 nt, Human
acacauaagccuaaucaucucc

SEQ ID NO: 1074567 - RNA, 22 nt, Human
auugacaauguauuuguaucug

SEQ ID NO: 1074568 - RNA, 17 nt, Human
agccgggcauggaccag

SEQ ID NO: 1074569 - RNA, 22 nt, Human
uugcucagcacuggagccagcu

SEQ ID NO: 1074570 - RNA, 22 nt, Human
uauuugcaggacauagauaugg

SEQ ID NO: 1074571 - RNA, 22 nt, Human
ugcuagugcaggguuuucaguu

SEQ ID NO: 1074572 - RNA, 22 nt, Human
cauguuuaauugcgauguuuga

SEQ ID NO: 1074573 - RNA, 22 nt, Human
ggagccaggggaccuucacaga

SEQ ID NO: 1074574 - RNA, 22 nt, Human
ggaggcugaggccccucacagg

SEQ ID NO: 1074575 - RNA, 22 nt, Human
aggcaggugcuuaugacuugcu

SEQ ID NO: 1074576 - RNA, 22 nt, Human
uccugcuccaccgugggcugga

SEQ ID NO: 1074577 - RNA, 22 nt, Human
uagaaaauccaguguggggaga

SEQ ID NO: 1074578 - RNA, 22 nt, Human
ugcaggcuggcagugcugaaau

SEQ ID NO: 1074579 - RNA, 22 nt, Human
uguaucuuagugugaaaauauu

SEQ ID NO: 1074580 - RNA, 22 nt, Human
augcagaaagagaauguaaugu

SEQ ID NO: 1074581 - RNA, 22 nt, Human
acagaggaaggcugagcugccc

SEQ ID NO: 1074582 - RNA, 22 nt, Human
accagggcacaggagucugaag

SEQ ID NO: 1074583 - RNA, 22 nt, Human
caggagcaguuagaagcccacu

SEQ ID NO: 1074584 - RNA, 22 nt, Human
cccaaccagaaauugacagaca

SEQ ID NO: 1074585 - RNA, 22 nt, Human
gcagggcaugggcccugucugc

SEQ ID NO: 1074586 - RNA, 22 nt, Human
uggagcugagaaguggagcucu

SEQ ID NO: 1074587 - RNA, 22 nt, Human
ccaagggaaaccgagaggcugg

SEQ ID NO: 1074588 - RNA, 22 nt, Human
cuaggcuguucaugcucagacc

SEQ ID NO: 1074589 - RNA, 22 nt, Human
ugcuugucacauacaggagcau

SEQ ID NO: 1074590 - RNA, 22 nt, Human
acaacaucagcugagaccuuca

SEQ ID NO: 1074591 - RNA, 22 nt, Human
gggccucucccuucucacgcau

SEQ ID NO: 1074592 - RNA, 17 nt, Human
acacaguacuuuuuugc

SEQ ID NO: 1074593 - RNA, 22 nt, Human
auuuuuucagauugaguguuaa

SEQ ID NO: 1074594 - RNA, 22 nt, Human
uuugaaguucccccauaucaga

SEQ ID NO: 1074595 - RNA, 22 nt, Human
cagcucauuccucaaucuagga

SEQ ID NO: 1074596 - RNA, 22 nt, Human
gcugcugggguggagaaacgcu

SEQ ID NO: 1074597 - RNA, 17 nt, Human
uggcacagaggugcuau

SEQ ID NO: 1074598 - RNA, 22 nt, Human
uucacagcuaagagcuaaguaa

SEQ ID NO: 1074599 - RNA, 22 nt, Human
cucuggagagguucccauggga

SEQ ID NO: 1074600 - RNA, 21 nt, Human
cagugggcugcugcgcuccag

SEQ ID NO: 1074601 - RNA, 22 nt, Human
cuaggcaaaguauuaaugagug

SEQ ID NO: 1074602 - RNA, 22 nt, Human
gcucugugggugaguagaaucu

SEQ ID NO: 1074603 - RNA, 22 nt, Human
accaggaacucacccgcagagg

SEQ ID NO: 1074604 - RNA, 22 nt, Human
gagacauggcaaaagcacuggu

SEQ ID NO: 1074605 - RNA, 20 nt, Human
gggcucuuagguagcagggg

SEQ ID NO: 1074606 - RNA, 22 nt, Human
uugaaaugagacuaauugauug

SEQ ID NO: 1074607 - RNA, 22 nt, Human
aguuucuucauccaaaaaaugg

SEQ ID NO: 1074608 - RNA, 20 nt, Human
gggaguggugguagccugug

SEQ ID NO: 1074609 - RNA, 22 nt, Human
ucagaggacgcacuaggguugu

SEQ ID NO: 1074610 - RNA, 18 nt, Human
uuuguccuguggcagcug

SEQ ID NO: 1074611 - RNA, 22 nt, Human
augcauaagugcagcagauuug

SEQ ID NO: 1074612 - RNA, 21 nt, Human
gcacagggacagaucaucaca

SEQ ID NO: 1074613 - RNA, 23 nt, Human
ugcauaucagaaauuucauaugg

SEQ ID NO: 1074614 - RNA, 22 nt, Human
uucuuuugcaagacuauugauu

SEQ ID NO: 1074615 - RNA, 22 nt, Human
gcaguggggcgcugggaguugg

SEQ ID NO: 1074616 - RNA, 22 nt, Human
gggcugcugccaaucacagccu

SEQ ID NO: 1074617 - RNA, 22 nt, Human
agaccauggccauccuaggaaa

SEQ ID NO: 1074618 - RNA, 22 nt, Human
gagccugaauuugaccugcuua

SEQ ID NO: 1074619 - RNA, 22 nt, Human
gaacugaguuuucugccuggac

SEQ ID NO: 1074620 - RNA, 22 nt, Human
ugagugccugaacauagaguag

SEQ ID NO: 1074621 - RNA, 22 nt, Human
gaaaguauuagccuagaaguca

SEQ ID NO: 1074622 - RNA, 22 nt, Human
caaggccaaagggccacuguca

SEQ ID NO: 1074623 - RNA, 22 nt, Human
gccuggcacucacugaagaggc

SEQ ID NO: 1074624 - RNA, 22 nt, Human
ucagagugugacuuggucauga

SEQ ID NO: 1074625 - RNA, 22 nt, Human
agugcagagagcaauacucuac

SEQ ID NO: 1074626 - RNA, 22 nt, Human
ccccucauucucugagcuaguu

SEQ ID NO: 1074627 - RNA, 22 nt, Human
agguaauaggguucagaauuau

SEQ ID NO: 1074628 - RNA, 22 nt, Human
caagagcuacccugugccauau

SEQ ID NO: 1074629 - RNA, 22 nt, Human
ugcagaggagucagccugggca

SEQ ID NO: 1074630 - RNA, 22 nt, Human
aaauaauuauagcgagucuauc

SEQ ID NO: 1074631 - RNA, 22 nt, Human
ugcugaggagguggcugugcuu

SEQ ID NO: 1074632 - RNA, 22 nt, Human
gggccugugcacaguucuguua

SEQ ID NO: 1074633 - RNA, 22 nt, Human
aaggccagccugagagcuaaca

SEQ ID NO: 1074634 - RNA, 16 nt, Human
uguuagcugugcauua

SEQ ID NO: 1074635 - RNA, 22 nt, Human
ggcaggcugggagucaucagag

SEQ ID NO: 1074636 - RNA, 20 nt, Human
ccugugcuuaucacuugcug

SEQ ID NO: 1074637 - RNA, 22 nt, Human
acacacagguaaaggagccugg

SEQ ID NO: 1074638 - RNA, 22 nt, Human
uuccucucaacaugccugccgg

SEQ ID NO: 1074639 - RNA, 22 nt, Human
aggaagauguguuuagcagguu

SEQ ID NO: 1074640 - RNA, 22 nt, Human
cuccacucaccagaugccagga

SEQ ID NO: 1074641 - RNA, 22 nt, Human
aguggcaggcggagauguagga

SEQ ID NO: 1074642 - RNA, 22 nt, Human
acaaaguagucaaaguagauga

SEQ ID NO: 1074643 - RNA, 22 nt, Human
acagggccagccugggaccugg

SEQ ID NO: 1074644 - RNA, 21 nt, Human
cugcaucucauagaacauguc

SEQ ID NO: 1074645 - RNA, 22 nt, Human
uucagaauguacugauagaaca

SEQ ID NO: 1074646 - RNA, 22 nt, Human
aggugaaguugaggaggcagaa

SEQ ID NO: 1074647 - RNA, 22 nt, Human
cagguagguauggugcagucuu

SEQ ID NO: 1074648 - RNA, 21 nt, Human
ugcugccaucaugcagagaug

SEQ ID NO: 1074649 - RNA, 22 nt, Human
acaguggaauggugggccugca

SEQ ID NO: 1074650 - RNA, 22 nt, Human
ggaggccaaggugggcggauca

SEQ ID NO: 1074651 - RNA, 22 nt, Human
aagauuuuuuuccacagacuca

SEQ ID NO: 1074652 - RNA, 22 nt, Human
auuaggcauucaugcagcuccu

SEQ ID NO: 1074653 - RNA, 22 nt, Human
cagcagccuacaaugcacagaa

SEQ ID NO: 1074654 - RNA, 22 nt, Human
uuucuucauugaugucaggugg

SEQ ID NO: 1074655 - RNA, 22 nt, Human
gaggaagagagcucugccuugu

SEQ ID NO: 1074656 - RNA, 22 nt, Human
gccacagcagggcccucucagg

SEQ ID NO: 1074657 - RNA, 20 nt, Human
uccuggccucccuggggcuc

SEQ ID NO: 1074658 - RNA, 22 nt, Human
guuuuauuggaacacagccaug

SEQ ID NO: 1074659 - RNA, 22 nt, Human
cugcuguggguuaagacacugu

SEQ ID NO: 1074660 - RNA, 22 nt, Human
cagcugugagagugcauugaag

SEQ ID NO: 1074661 - RNA, 22 nt, Human
gcccaggaguugaagggcugac

SEQ ID NO: 1074662 - RNA, 22 nt, Human
gucagaggggacaagacacaga

SEQ ID NO: 1074663 - RNA, 22 nt, Human
ccuggagguggagguugcagug

SEQ ID NO: 1074664 - RNA, 22 nt, Human
guaagggauuugaacauagguu

SEQ ID NO: 1074665 - RNA, 23 nt, Human
uggcaccaggcauucuaggggua

SEQ ID NO: 1074666 - RNA, 22 nt, Human
gaagccagccuugucugccucu

SEQ ID NO: 1074667 - RNA, 22 nt, Human
cgcaggugccggcagauggggu

SEQ ID NO: 1074668 - RNA, 22 nt, Human
ggaagagggaaccacgacugua

SEQ ID NO: 1074669 - RNA, 22 nt, Human
cugggccagauccagccucaca

SEQ ID NO: 1074670 - RNA, 22 nt, Human
gaauguuuaaaaggugcaguuu

SEQ ID NO: 1074671 - RNA, 22 nt, Human
auggaacaugaauuaauauggu

SEQ ID NO: 1074672 - RNA, 22 nt, Human
aaaccagugauagacuagacac

SEQ ID NO: 1074673 - RNA, 22 nt, Human
gccuggugcuaugagggccagc

SEQ ID NO: 1074674 - RNA, 22 nt, Human
aggcuggguaccugucauaugc

SEQ ID NO: 1074675 - RNA, 22 nt, Human
caguuaaucuugccauuauauc

SEQ ID NO: 1074676 - RNA, 22 nt, Human
uagguucaggagauauugcaca

SEQ ID NO: 1074677 - RNA, 22 nt, Human
cuggcuggccggaggcaucccu

SEQ ID NO: 1074678 - RNA, 22 nt, Human
ccugcuguucuguuuagugaac

SEQ ID NO: 1074679 - RNA, 22 nt, Human
ccugugugcacacgaggccaug

SEQ ID NO: 1074680 - RNA, 22 nt, Human
gagcugagccuggguggaccgc

SEQ ID NO: 1074681 - RNA, 22 nt, Human
aaggugucggcagagccgcuuc

SEQ ID NO: 1074682 - RNA, 22 nt, Human
caggagcaaggagcagugggau

SEQ ID NO: 1074683 - RNA, 22 nt, Human
uuaacauuugugaagcauuuag

SEQ ID NO: 1074684 - RNA, 22 nt, Human
caaauacuguacugaacacugu

SEQ ID NO: 1074685 - RNA, 22 nt, Human
cacauucaauuacacagauagg

SEQ ID NO: 1074686 - RNA, 22 nt, Human
aaggcgacacaggcagcaggcc

SEQ ID NO: 1074687 - RNA, 22 nt, Human
gcuggcucagggacuagaguuu

SEQ ID NO: 1074688 - RNA, 22 nt, Human
ucuccugcucccaacugcugca

SEQ ID NO: 1074689 - RNA, 19 nt, Human
uugcauuguaguuggacug

SEQ ID NO: 1074690 - RNA, 22 nt, Human
gaguucugugagccauccuagc

SEQ ID NO: 1074691 - RNA, 22 nt, Human
ccagcagccaccuucucgaaau

SEQ ID NO: 1074692 - RNA, 22 nt, Human
uucugucucuguguuuacauua

SEQ ID NO: 1074693 - RNA, 18 nt, Human
agcagaauucuaggguuc

SEQ ID NO: 1074694 - RNA, 22 nt, Human
gagccaaggguugccauggaga

SEQ ID NO: 1074695 - RNA, 22 nt, Human
uuugaaguccaucuggcccagu

SEQ ID NO: 1074696 - RNA, 20 nt, Human
caucagugccugacaggucc

SEQ ID NO: 1074697 - RNA, 22 nt, Human
ugcauacacacaucaaauguuu

SEQ ID NO: 1074698 - RNA, 22 nt, Human
aaagcagccgguucccuggucu

SEQ ID NO: 1074699 - RNA, 22 nt, Human
cugccugcugccuguggagggu

SEQ ID NO: 1074700 - RNA, 22 nt, Human
gggccuggugcuucugacuccu

SEQ ID NO: 1074701 - RNA, 22 nt, Human
auuagcuuuggauucagaagau

SEQ ID NO: 1074702 - RNA, 23 nt, Human
aguuuccacccaggguagaaggg

SEQ ID NO: 1074703 - RNA, 22 nt, Human
guggccagaaucuugaggccuu

SEQ ID NO: 1074704 - RNA, 22 nt, Human
agagcagcguuuguggaacacu

SEQ ID NO: 1074705 - RNA, 22 nt, Human
gcuucccacagcuggacugggg

SEQ ID NO: 1074706 - RNA, 22 nt, Human
acaaaguauuuuuagguuugua

SEQ ID NO: 1074707 - RNA, 22 nt, Human
cugcagcuuuggaaaccuguuu

SEQ ID NO: 1074708 - RNA, 21 nt, Human
ugagccaggcugacggcugug

SEQ ID NO: 1074709 - RNA, 22 nt, Human
acugucaggauggcagcuuguu

SEQ ID NO: 1074710 - RNA, 22 nt, Human
uugcaagacacuuggaagcaca

SEQ ID NO: 1074711 - RNA, 22 nt, Human
gccagagguucaacaacugucu

SEQ ID NO: 1074712 - RNA, 22 nt, Human
cugaggcaugaaugugggcuuu

SEQ ID NO: 1074713 - RNA, 22 nt, Human
acagccuguguaccagcuggga

SEQ ID NO: 1074714 - RNA, 22 nt, Human
ggaaagaggauaguggguaggu

SEQ ID NO: 1074715 - RNA, 22 nt, Human
aacaucuugaagauugggaaag

SEQ ID NO: 1074716 - RNA, 22 nt, Human
ucuuccaagguugcacacuauc

SEQ ID NO: 1074717 - RNA, 23 nt, Human
uuucuaagguuuuuaucugcuac

SEQ ID NO: 1074718 - RNA, 22 nt, Human
uuucucuaaauagggaggcuua

SEQ ID NO: 1074719 - RNA, 22 nt, Human
ugugagacguaggccaucgagg

SEQ ID NO: 1074720 - RNA, 22 nt, Human
ccagaagagaucacaguucuug

SEQ ID NO: 1074721 - RNA, 23 nt, Human
auaauaauuauggcagcaaagug

SEQ ID NO: 1074722 - RNA, 22 nt, Human
uguuaauauacuaaaauccacu

SEQ ID NO: 1074723 - RNA, 22 nt, Human
uuuccuuccaaaugcccgggag

SEQ ID NO: 1074724 - RNA, 18 nt, Human
aggugcagccucugaggc

SEQ ID NO: 1074725 - RNA, 22 nt, Human
aacauuuauugagcaccuacug

SEQ ID NO: 1074726 - RNA, 22 nt, Human
aaacaauguugucuccaagagg

SEQ ID NO: 1074727 - RNA, 22 nt, Human
agcacuuuauucaggaacucca

SEQ ID NO: 1074728 - RNA, 23 nt, Human
ugagcugguauuguccaucucca

SEQ ID NO: 1074729 - RNA, 22 nt, Human
gccacuggacccagaaagggaa

SEQ ID NO: 1074730 - RNA, 22 nt, Human
uaguuuuacuugcgaugauaau

SEQ ID NO: 1074731 - RNA, 17 nt, Human
agcagcugaagcagcca

SEQ ID NO: 1074732 - RNA, 22 nt, Human
acauuugagaugccuuuuaggu

SEQ ID NO: 1074733 - RNA, 22 nt, Human
gaagggggaaaaugacaacaga

SEQ ID NO: 1074734 - RNA, 22 nt, Human
agccaggcgcaguggcuuaugc

SEQ ID NO: 1074735 - RNA, 22 nt, Human
cuggagcaggcuugucccagcu

SEQ ID NO: 1074736 - RNA, 22 nt, Human
agcuggaggggccagcaggugu

SEQ ID NO: 1074737 - RNA, 22 nt, Human
gcugcucuugaggggcucacug

SEQ ID NO: 1074738 - RNA, 22 nt, Human
aggugccaauuuucagugaaca

SEQ ID NO: 1074739 - RNA, 22 nt, Human
aacacagacauagugauuacag

SEQ ID NO: 1074740 - RNA, 22 nt, Human
gauguuucccguuaagagaaaa

SEQ ID NO: 1074741 - RNA, 17 nt, Human
cagucgaggaggaccug

SEQ ID NO: 1074742 - RNA, 22 nt, Human
ucuucuuccuccacagggccca

SEQ ID NO: 1074743 - RNA, 22 nt, Human
gaggccaggguaccaucaacau

SEQ ID NO: 1074744 - RNA, 22 nt, Human
auagacacauguuauuauacuu

SEQ ID NO: 1074745 - RNA, 22 nt, Human
cagcagaguaggugcuacuucu

SEQ ID NO: 1074746 - RNA, 22 nt, Human
uuuuccucaggaaugcuaagcu

SEQ ID NO: 1074747 - RNA, 22 nt, Human
cuucacaaagcucucuuuaugu

SEQ ID NO: 1074748 - RNA, 22 nt, Human
auggauauuggccaaacucauu

SEQ ID NO: 1074749 - RNA, 22 nt, Human
ccagcccuugcugaaggguggc

SEQ ID NO: 1074750 - RNA, 22 nt, Human
acauucauggguuuuacauuau

SEQ ID NO: 1074751 - RNA, 22 nt, Human
uaacagcaggguuacaggcauu

SEQ ID NO: 1074752 - RNA, 22 nt, Human
agcaggugcauggcgagcgcgg

SEQ ID NO: 1074753 - RNA, 22 nt, Human
ccagcugcagguguuccagaug

SEQ ID NO: 1074754 - RNA, 22 nt, Human
guuacaauguucuucaguucug

SEQ ID NO: 1074755 - RNA, 22 nt, Human
ucuccugggaggacaaggaagg

SEQ ID NO: 1074756 - RNA, 22 nt, Human
accaggacauuuuagucaucuu

SEQ ID NO: 1074757 - RNA, 22 nt, Human
ucaaacuucuauucucuguuuu

SEQ ID NO: 1074758 - RNA, 22 nt, Human
cccaggaacagggcucagaccc

SEQ ID NO: 1074759 - RNA, 22 nt, Human
aggcucuucuuuuauuaacuga

SEQ ID NO: 1074760 - RNA, 18 nt, Human
gccagagggaagcaggug

SEQ ID NO: 1074761 - RNA, 22 nt, Human
cucugagaauauaagacuauuu

SEQ ID NO: 1074762 - RNA, 22 nt, Human
cugggcugcucagcccccucgc

SEQ ID NO: 1074763 - RNA, 22 nt, Human
auguuugucaggauuguaauua

SEQ ID NO: 1074764 - RNA, 22 nt, Human
ugcccucagcagcagcuccugc

SEQ ID NO: 1074765 - RNA, 22 nt, Human
gugaaauauuuuguuuauguca

SEQ ID NO: 1074766 - RNA, 22 nt, Human
ugcaaucucggcacuuugggag

SEQ ID NO: 1074767 - RNA, 22 nt, Human
ccaugggcuggcugccuuauca

SEQ ID NO: 1074768 - RNA, 22 nt, Human
auuuuccagccuuucuagaacu

SEQ ID NO: 1074769 - RNA, 22 nt, Human
ggcagauguuauaugaucugag

SEQ ID NO: 1074770 - RNA, 22 nt, Human
cccucauugccuccugcgugca

SEQ ID NO: 1074771 - RNA, 22 nt, Human
ccuggcaguucaucaaauggca

SEQ ID NO: 1074772 - RNA, 22 nt, Human
uaccaggcagcugcacagaggc

SEQ ID NO: 1074773 - RNA, 22 nt, Human
caggaggcagagguugcaguga

SEQ ID NO: 1074774 - RNA, 17 nt, Human
aggcaggagauuggaga

SEQ ID NO: 1074775 - RNA, 22 nt, Human
auuaauuuuucugacagccaca

SEQ ID NO: 1074776 - RNA, 22 nt, Human
agcauguugggaugagaaggaa

SEQ ID NO: 1074777 - RNA, 22 nt, Human
caggcuggagugcaauggcaca

SEQ ID NO: 1074778 - RNA, 22 nt, Human
uauaagaagugaagaagaguua

SEQ ID NO: 1074779 - RNA, 23 nt, Human
ugaagugaaauuucacaagggac

SEQ ID NO: 1074780 - RNA, 18 nt, Human
ccuguggcucagcccaca

SEQ ID NO: 1074781 - RNA, 22 nt, Human
aaagacuagcauuuauauguac

SEQ ID NO: 1074782 - RNA, 22 nt, Human
ccaggagcauuaagagaacaua

SEQ ID NO: 1074783 - RNA, 22 nt, Human
gagaggcugaaaucacaggagc

SEQ ID NO: 1074784 - RNA, 22 nt, Human
caguacuugggggguucuaagu

SEQ ID NO: 1074785 - RNA, 22 nt, Human
ugucuuuggaauauuuagcuga

SEQ ID NO: 1074786 - RNA, 22 nt, Human
ugcccugguuacacuggagucc

SEQ ID NO: 1074787 - RNA, 22 nt, Human
uggcuggcccugggagugcaga

SEQ ID NO: 1074788 - RNA, 22 nt, Human
aggccugagcagaggaguggac

SEQ ID NO: 1074789 - RNA, 22 nt, Human
uaaauuauguuccauguccuuu

SEQ ID NO: 1074790 - RNA, 22 nt, Human
gaacacagcagggauaaccacu

SEQ ID NO: 1074791 - RNA, 22 nt, Human
agcuggcagagcauuuguggcc

SEQ ID NO: 1074792 - RNA, 22 nt, Human
ggaacugaaugucucgguauaa

SEQ ID NO: 1074793 - RNA, 22 nt, Human
ccagaagaacuuaauucaaaac

SEQ ID NO: 1074794 - RNA, 22 nt, Human
uuuuuacacuuagcauugagcg

SEQ ID NO: 1074795 - RNA, 23 nt, Human
gccaggaguggguagacuaaugc

SEQ ID NO: 1074796 - RNA, 22 nt, Human
uugccauuaucauuuaugauac

SEQ ID NO: 1074797 - RNA, 22 nt, Human
agggugccuggaagccacucac

SEQ ID NO: 1074798 - RNA, 22 nt, Human
acuacauuuccugaccccugug

SEQ ID NO: 1074799 - RNA, 22 nt, Human
ugccagcacaaguuaagagauc

SEQ ID NO: 1074800 - RNA, 22 nt, Human
caucugcuguuccuuggacuca

SEQ ID NO: 1074801 - RNA, 22 nt, Human
cacagguguucuugcagugaaa

SEQ ID NO: 1074802 - RNA, 22 nt, Human
auuuccauuuucagccauuacu

SEQ ID NO: 1074803 - RNA, 22 nt, Human
cuuugcuaauguugcauuuuca

SEQ ID NO: 1074804 - RNA, 22 nt, Human
ggaacauaccgaaaauacuuaa

SEQ ID NO: 1074805 - RNA, 22 nt, Human
uaaacaagaaacauuuucuguu

SEQ ID NO: 1074806 - RNA, 22 nt, Human
uccaggcaagggaggagcaugg

SEQ ID NO: 1074807 - RNA, 22 nt, Human
aaauaagaggacagauguuugg

SEQ ID NO: 1074808 - RNA, 22 nt, Human
ucaucacauaugucaugauuug

SEQ ID NO: 1074809 - RNA, 22 nt, Human
caaagauaaucacagaauaccc

SEQ ID NO: 1074810 - RNA, 22 nt, Human
aggacccugagcgggcaugccg

SEQ ID NO: 1074811 - RNA, 22 nt, Human
ccaggcugugguuuagauagag

SEQ ID NO: 1074812 - RNA, 22 nt, Human
gcgaaaaauguguaaauauguu

SEQ ID NO: 1074813 - RNA, 22 nt, Human
gaaaacuuggaucucuagaaug

SEQ ID NO: 1074814 - RNA, 22 nt, Human
agagccagcaacucuagcccug

SEQ ID NO: 1074815 - RNA, 22 nt, Human
ucagagaacacagaggugaugu

SEQ ID NO: 1074816 - RNA, 22 nt, Human
aagcaagccaaucuguuuuguu

SEQ ID NO: 1074817 - RNA, 22 nt, Human
uagauguugaagucauauuugg

SEQ ID NO: 1074818 - RNA, 22 nt, Human
uuacuuuccagcucuagcuuca

SEQ ID NO: 1074819 - RNA, 22 nt, Human
gaaaucugcggugaggccugag

SEQ ID NO: 1074820 - RNA, 22 nt, Human
aaagucaucauuucuuuucaaa

SEQ ID NO: 1074821 - RNA, 22 nt, Human
ggccagggccuggggacugucc

SEQ ID NO: 1074822 - RNA, 22 nt, Human
aaguaacuuauuugcaaacagg

SEQ ID NO: 1074823 - RNA, 22 nt, Human
uuuccucacuucaugagaguuu

SEQ ID NO: 1074824 - RNA, 22 nt, Human
cugccuguuuucugauagauuu

SEQ ID NO: 1074825 - RNA, 22 nt, Human
accugucuauaaaagugaauac

SEQ ID NO: 1074826 - RNA, 22 nt, Human
uccaagcucucuaugccaugau

SEQ ID NO: 1074827 - RNA, 22 nt, Human
ggggccagcuucgcgugcucuu

SEQ ID NO: 1074828 - RNA, 22 nt, Human
uuaaauuucuacgugauccagg

SEQ ID NO: 1074829 - RNA, 22 nt, Human
acaggcagagaacucagccaga

SEQ ID NO: 1074830 - RNA, 22 nt, Human
gacauguauuagucaugcacag

SEQ ID NO: 1074831 - RNA, 22 nt, Human
ggcaugugccugaggucacaca

SEQ ID NO: 1074832 - RNA, 22 nt, Human
aaagcauggcaugaagaacaug

SEQ ID NO: 1074833 - RNA, 22 nt, Human
aagcugccagauucagucugcu

SEQ ID NO: 1074834 - RNA, 22 nt, Human
gccuguguggaugcgccggugc

SEQ ID NO: 1074835 - RNA, 17 nt, Human
uaaguuauagcagaaga

SEQ ID NO: 1074836 - RNA, 22 nt, Human
aagcuagauaacuuuuauauuu

SEQ ID NO: 1074837 - RNA, 22 nt, Human
uggcuucagacuucugcuacgu

SEQ ID NO: 1074838 - RNA, 22 nt, Human
gaggcaugucuggccuguccca

SEQ ID NO: 1074839 - RNA, 22 nt, Human
ugcuucuggggacaggcugccu

SEQ ID NO: 1074840 - RNA, 22 nt, Human
gcugaaggucucuggagagguc

SEQ ID NO: 1074841 - RNA, 22 nt, Human
aggugaggauagguggccaagg

SEQ ID NO: 1074842 - RNA, 22 nt, Human
uccucaggaugugggguagaau

SEQ ID NO: 1074843 - RNA, 22 nt, Human
agcauaaaauaaauaguuugca

SEQ ID NO: 1074844 - RNA, 19 nt, Human
aagggcugggcaccucacu

SEQ ID NO: 1074845 - RNA, 19 nt, Human
uccaggcauccuucaggcu

SEQ ID NO: 1074846 - RNA, 22 nt, Human
caguuuuagcuagagcaaacca

SEQ ID NO: 1074847 - RNA, 21 nt, Human
auaagcaugcugauuacauuu

SEQ ID NO: 1074848 - RNA, 22 nt, Human
ggccucucucccuggcuugcag

SEQ ID NO: 1074849 - RNA, 20 nt, Human
gggcuggcgcauggggaaag

SEQ ID NO: 1074850 - RNA, 22 nt, Human
uuuuuauacuuugcucaagauu

SEQ ID NO: 1074851 - RNA, 22 nt, Human
agguggcuguggcuucccuugu

SEQ ID NO: 1074852 - RNA, 22 nt, Human
aaguggugguaugaaccgaggg

SEQ ID NO: 1074853 - RNA, 22 nt, Human
augcugaucuguaauaagauuu

SEQ ID NO: 1074854 - RNA, 22 nt, Human
accuggcuuuggggauaggcuu

SEQ ID NO: 1074855 - RNA, 22 nt, Human
gcagccaccucccauggcgggg

SEQ ID NO: 1074856 - RNA, 22 nt, Human
ucugucacuuauuaagauggau

SEQ ID NO: 1074857 - RNA, 22 nt, Human
uguaggauuuucaccagaccuu

SEQ ID NO: 1074858 - RNA, 22 nt, Human
agugcugacucugggcacagug

SEQ ID NO: 1074859 - RNA, 22 nt, Human
gggcuucagcuggggauggagc

SEQ ID NO: 1074860 - RNA, 22 nt, Human
auuucuuucuggccacgguuuu

SEQ ID NO: 1074861 - RNA, 22 nt, Human
uuugaagugggcauuagaaccu

SEQ ID NO: 1074862 - RNA, 22 nt, Human
caaauguaauaaggaguuuccc

SEQ ID NO: 1074863 - RNA, 22 nt, Human
cugggagauaugaggaucugga

SEQ ID NO: 1074864 - RNA, 22 nt, Human
uuccaagugggggaagcugagu

SEQ ID NO: 1074865 - RNA, 22 nt, Human
ucuuagaaauuccccaguggcu

SEQ ID NO: 1074866 - RNA, 22 nt, Human
ucucugagacaguagccucugc

SEQ ID NO: 1074867 - RNA, 21 nt, Human
aaggcagaagcauggaaugag

SEQ ID NO: 1074868 - RNA, 22 nt, Human
agaaaagaggcuuucuaagcau

SEQ ID NO: 1074869 - RNA, 22 nt, Human
aucuggcuauuucuggucgggg

SEQ ID NO: 1074870 - RNA, 15 nt, Human
gcagguggaucacuu

SEQ ID NO: 1074871 - RNA, 22 nt, Human
agaaauguauagugaauuuuuc

SEQ ID NO: 1074872 - RNA, 22 nt, Human
gacagacauuuccugauccaau

SEQ ID NO: 1074873 - RNA, 22 nt, Human
caguggagagacuuuuacucuu

SEQ ID NO: 1074874 - RNA, 22 nt, Human
aaagcaagucucuacaaaguac

SEQ ID NO: 1074875 - RNA, 22 nt, Human
gauaaacacaaggugauuucau

SEQ ID NO: 1074876 - RNA, 22 nt, Human
ggcaggcaggagcgugcuuggg

SEQ ID NO: 1074877 - RNA, 22 nt, Human
gcugcagccaaauucauuguca

SEQ ID NO: 1074878 - RNA, 22 nt, Human
cuucuucucuacauccuuugau

SEQ ID NO: 1074879 - RNA, 22 nt, Human
cuccagggaaaggggcguccgc

SEQ ID NO: 1074880 - RNA, 20 nt, Human
cucuuauugcauuaguuucu

SEQ ID NO: 1074881 - RNA, 22 nt, Human
agcuggcagucggccuugaugc

SEQ ID NO: 1074882 - RNA, 22 nt, Human
gccuggugugcgccgcgcagcu

SEQ ID NO: 1074883 - RNA, 22 nt, Human
uuccaagucuaaguuauaaauc

SEQ ID NO: 1074884 - RNA, 22 nt, Human
gcuggaguccagugguaugauc

SEQ ID NO: 1074885 - RNA, 22 nt, Human
gggcugacgaaggccaugugug

SEQ ID NO: 1074886 - RNA, 22 nt, Human
cagagcagcagagcuuccaugg

SEQ ID NO: 1074887 - RNA, 19 nt, Human
agcugggcugucacaguga

SEQ ID NO: 1074888 - RNA, 22 nt, Human
ggggacaguuaaagaccaagac

SEQ ID NO: 1074889 - RNA, 22 nt, Human
gugggggacccaggugcugucc

SEQ ID NO: 1074890 - RNA, 22 nt, Human
gucagaggaauggaugagugau

SEQ ID NO: 1074891 - RNA, 22 nt, Human
uagcccagagucccaauuccag

SEQ ID NO: 1074892 - RNA, 22 nt, Human
ugaaauguuaaacaaguggcuc

SEQ ID NO: 1074893 - RNA, 22 nt, Human
ccauuucacuggguaguugugg

SEQ ID NO: 1074894 - RNA, 22 nt, Human
gacuuucugcuauacuuucugu

SEQ ID NO: 1074895 - RNA, 23 nt, Human
uugucugugcuuuuccaguugcu

SEQ ID NO: 1074896 - RNA, 22 nt, Human
auucauacaggcuuugcucuua

SEQ ID NO: 1074897 - RNA, 22 nt, Human
ggucaggguauaaucaagugag

SEQ ID NO: 1074898 - RNA, 22 nt, Human
ugucuauuuuuacuggaccaug

SEQ ID NO: 1074899 - RNA, 22 nt, Human
ccagcucucuuugaagcauaaa

SEQ ID NO: 1074900 - RNA, 22 nt, Human
aaaagcaaggcagucugucuga

SEQ ID NO: 1074901 - RNA, 22 nt, Human
auguacuaaagaaauuugcagg

SEQ ID NO: 1074902 - RNA, 22 nt, Human
cuggcugggagcgagcugcuca

SEQ ID NO: 1074903 - RNA, 22 nt, Human
aggaaaggccucagcagaaacc

SEQ ID NO: 1074904 - RNA, 22 nt, Human
aaaaagcuuaaaugagcaguuc

SEQ ID NO: 1074905 - RNA, 22 nt, Human
gcuuggcauuugcugggagcug

SEQ ID NO: 1074906 - RNA, 22 nt, Human
gaggcugcggggaggagccugc

SEQ ID NO: 1074907 - RNA, 22 nt, Human
cuucaguguccucucuaguaga

SEQ ID NO: 1074908 - RNA, 22 nt, Human
uucaaaucucuccuaauccacu

SEQ ID NO: 1074909 - RNA, 22 nt, Human
ggcagugaugucaaacagugaa

SEQ ID NO: 1074910 - RNA, 22 nt, Human
aagauacacguuguauugaaua

SEQ ID NO: 1074911 - RNA, 22 nt, Human
auucugauucauuaggucuagg

SEQ ID NO: 1074912 - RNA, 22 nt, Human
aauuucuguaugaauagagaaa

SEQ ID NO: 1074913 - RNA, 20 nt, Human
aucagcaacugccacucagu

SEQ ID NO: 1074914 - RNA, 22 nt, Human
gugaagcaguugcguggguucc

SEQ ID NO: 1074915 - RNA, 19 nt, Human
ucugcuggcagaauucccu

SEQ ID NO: 1074916 - RNA, 22 nt, Human
uagcagcacaaauggacuauga

SEQ ID NO: 1074917 - RNA, 22 nt, Human
aggcugaggugugcugugaucg

SEQ ID NO: 1074918 - RNA, 19 nt, Human
ugaggccaaggucacagau

SEQ ID NO: 1074919 - RNA, 22 nt, Human
ccccucauuacaggcggggagc

SEQ ID NO: 1074920 - RNA, 22 nt, Human
cugcucugaguauuaacggagg

SEQ ID NO: 1074921 - RNA, 22 nt, Human
cuggagccaugucuugacugcu

SEQ ID NO: 1074922 - RNA, 20 nt, Human
agucccagaucaaauuucug

SEQ ID NO: 1074923 - RNA, 22 nt, Human
ccaggaggggucucugucuccc

SEQ ID NO: 1074924 - RNA, 22 nt, Human
gagugcaguaucuucugugucc

SEQ ID NO: 1074925 - RNA, 22 nt, Human
gaguuaauguguacacaaaggg

SEQ ID NO: 1074926 - RNA, 23 nt, Human
cucugagacccagguggacacgg

SEQ ID NO: 1074927 - RNA, 22 nt, Human
ugggccagggcacccaguccag

SEQ ID NO: 1074928 - RNA, 19 nt, Human
cucugccucuggcuguggc

SEQ ID NO: 1074929 - RNA, 22 nt, Human
aaauuauaggugccaccuugga

SEQ ID NO: 1074930 - RNA, 22 nt, Human
cuuguugcuaacauaugcuucu

SEQ ID NO: 1074931 - RNA, 22 nt, Human
uuauuuaggaggaaacugaggu

SEQ ID NO: 1074932 - RNA, 22 nt, Human
uggugcaggaguuggcagggac

SEQ ID NO: 1074933 - RNA, 22 nt, Human
aaguuuguuuuagucuaaugau

SEQ ID NO: 1074934 - RNA, 22 nt, Human
ucuucagugcauguuaccuaua

SEQ ID NO: 1074935 - RNA, 22 nt, Human
ucuucccucuucugccaaauac

SEQ ID NO: 1074936 - RNA, 22 nt, Human
aauguguacaugacagauagaa

SEQ ID NO: 1074937 - RNA, 20 nt, Human
uugaaaaugcauugugcagu

SEQ ID NO: 1074938 - RNA, 22 nt, Human
ugaggccugcccuggggaaguu

SEQ ID NO: 1074939 - RNA, 22 nt, Human
gguugccggggcaggacuggaa

SEQ ID NO: 1074940 - RNA, 19 nt, Human
ugaggggaggagaggccug

SEQ ID NO: 1074941 - RNA, 19 nt, Human
agggccaggauucuggaac

SEQ ID NO: 1074942 - RNA, 22 nt, Human
uuucacagauccuacagcuugu

SEQ ID NO: 1074943 - RNA, 22 nt, Human
aagggugggcaccgccagguca

SEQ ID NO: 1074944 - RNA, 22 nt, Human
agagaacauuagcaaaaacagc

SEQ ID NO: 1074945 - RNA, 22 nt, Human
gggcugacaguuuccccugaaa

SEQ ID NO: 1074946 - RNA, 22 nt, Human
uuucuauucuggaucuguggca

SEQ ID NO: 1074947 - RNA, 22 nt, Human
acaacaguccaguauagacugu

SEQ ID NO: 1074948 - RNA, 22 nt, Human
ugucaugccauuuaaaauguuu

SEQ ID NO: 1074949 - RNA, 22 nt, Human
ugcagaagacacaagguaacgu

SEQ ID NO: 1074950 - RNA, 22 nt, Human
uagaauaaguugaugauauaug

SEQ ID NO: 1074951 - RNA, 22 nt, Human
acccucagacauauuccaucau

SEQ ID NO: 1074952 - RNA, 22 nt, Human
uuuacagcuucuauacuaugug

SEQ ID NO: 1074953 - RNA, 22 nt, Human
acaaagugcacaagaugagaac

SEQ ID NO: 1074954 - RNA, 22 nt, Human
agguagaggccuccaggcagca

SEQ ID NO: 1074955 - RNA, 20 nt, Human
ccagcuuucccugcagcauc

SEQ ID NO: 1074956 - RNA, 22 nt, Human
ugggccaggucugugucagcug

SEQ ID NO: 1074957 - RNA, 22 nt, Human
ggucagguuuuuaggagugacc

SEQ ID NO: 1074958 - RNA, 22 nt, Human
cucacuguccaacaggcuuuac

SEQ ID NO: 1074959 - RNA, 22 nt, Human
acuuccugcaaucguccacucc

SEQ ID NO: 1074960 - RNA, 22 nt, Human
uggaauuaucugaagugauuug

SEQ ID NO: 1074961 - RNA, 22 nt, Human
ugcuggaggaguuuacuguggc

SEQ ID NO: 1074962 - RNA, 22 nt, Human
auuauucaauguuauuucagug

SEQ ID NO: 1074963 - RNA, 22 nt, Human
gccaggugcauggcugagucuc

SEQ ID NO: 1074964 - RNA, 22 nt, Human
aagauggagcacgagcagaagc

SEQ ID NO: 1074965 - RNA, 22 nt, Human
uccuggcuaguuuugcugaaau

SEQ ID NO: 1074966 - RNA, 22 nt, Human
uuuauucugugcuacaugaaga

SEQ ID NO: 1074967 - RNA, 22 nt, Human
uacagcuuuucauauuuguguu

SEQ ID NO: 1074968 - RNA, 22 nt, Human
acagcagagacacucaggaggc

SEQ ID NO: 1074969 - RNA, 22 nt, Human
acauguaaacauuuacaguauu

SEQ ID NO: 1074970 - RNA, 17 nt, Human
ccagguggaaucgugga

SEQ ID NO: 1074971 - RNA, 22 nt, Human
uccuggcuaacacggugacacc

SEQ ID NO: 1074972 - RNA, 22 nt, Human
caugauuuacuaaaauuuguuu

SEQ ID NO: 1074973 - RNA, 23 nt, Human
ucucaggguggcugggcccaucc

SEQ ID NO: 1074974 - RNA, 21 nt, Human
ucacagacuggucagugaggc

SEQ ID NO: 1074975 - RNA, 22 nt, Human
agccccaggcccggacgccucu

SEQ ID NO: 1074976 - RNA, 22 nt, Human
ggggaugguagaccggugacgu

SEQ ID NO: 1074977 - RNA, 22 nt, Human
agucugggagggaugccagugu

SEQ ID NO: 1074978 - RNA, 22 nt, Human
gccuggagcuacuggacacuga

SEQ ID NO: 1074979 - RNA, 22 nt, Human
auuuuacuuugugaauauugac

SEQ ID NO: 1074980 - RNA, 22 nt, Human
gcuuccuggagggagagagcug

SEQ ID NO: 1074981 - RNA, 22 nt, Human
auguccaauuucugaggcugcu

SEQ ID NO: 1074982 - RNA, 22 nt, Human
uguacagcugccuuuuuuacuu

SEQ ID NO: 1074983 - RNA, 22 nt, Human
cugccgagugggucaugaggca

SEQ ID NO: 1074984 - RNA, 22 nt, Human
gugcucaggggcaauccuggga

SEQ ID NO: 1074985 - RNA, 22 nt, Human
caagagcucuccacuagguugg

SEQ ID NO: 1074986 - RNA, 22 nt, Human
gcagccccaggagacgcccagg

SEQ ID NO: 1074987 - RNA, 22 nt, Human
uccugucugcucacagagcugg

SEQ ID NO: 1074988 - RNA, 22 nt, Human
uuacuuuagaaauagucaucaa

SEQ ID NO: 1074989 - RNA, 20 nt, Human
aagggcagagggaacagacu

SEQ ID NO: 1074990 - RNA, 22 nt, Human
ucuucucuccugcuuggcagaa

SEQ ID NO: 1074991 - RNA, 22 nt, Human
acugagcugugacaaugcuuaa

SEQ ID NO: 1074992 - RNA, 22 nt, Human
agggaagggcagggucuaugca

SEQ ID NO: 1074993 - RNA, 22 nt, Human
auuaaauguuccuuaaauuaua

SEQ ID NO: 1074994 - RNA, 20 nt, Human
ccucugccuuucuagucuga

SEQ ID NO: 1074995 - RNA, 22 nt, Human
ccuggccucgugcucacggcuc

SEQ ID NO: 1074996 - RNA, 22 nt, Human
gacaauuucucaauauagaaac

SEQ ID NO: 1074997 - RNA, 22 nt, Human
aaauuucaguuaccuuuacguu

SEQ ID NO: 1074998 - RNA, 21 nt, Human
acugccugucuccauagucua

SEQ ID NO: 1074999 - RNA, 22 nt, Human
cagaagggacaggguuuguaga

SEQ ID NO: 1075000 - RNA, 22 nt, Human
cccaggcugaguuagagguguc

SEQ ID NO: 1075001 - RNA, 22 nt, Human
ugaacacauuugggaaaaucuu

SEQ ID NO: 1075002 - RNA, 22 nt, Human
uuugauaauacacaagagaaag

SEQ ID NO: 1075003 - RNA, 22 nt, Human
acacagaaccucauagccucuc

SEQ ID NO: 1075004 - RNA, 19 nt, Human
uuuauuugagacaugccuu

SEQ ID NO: 1075005 - RNA, 22 nt, Human
aguuacaaacacuaucaguucu

SEQ ID NO: 1075006 - RNA, 18 nt, Human
uuccauaauguauguaac

SEQ ID NO: 1075007 - RNA, 22 nt, Human
uggggugugcucagagcagggg

SEQ ID NO: 1075008 - RNA, 21 nt, Human
auacuacauuucucugacuuu

SEQ ID NO: 1075009 - RNA, 20 nt, Human
ccagaagagaugaucaucca

SEQ ID NO: 1075010 - RNA, 19 nt, Human
gcuguuaaggacccucgga

SEQ ID NO: 1075011 - RNA, 22 nt, Human
aucauuccacauguaccacuag

SEQ ID NO: 1075012 - RNA, 22 nt, Human
ccagguggaggugugagguccu

SEQ ID NO: 1075013 - RNA, 22 nt, Human
aaacaguauuaucaauauauuu

SEQ ID NO: 1075014 - RNA, 22 nt, Human
ccagguaacuugagaacaugag

SEQ ID NO: 1075015 - RNA, 20 nt, Human
gagcagugagccagggaaag

SEQ ID NO: 1075016 - RNA, 22 nt, Human
ugcucccaggcauucucuguug

SEQ ID NO: 1075017 - RNA, 22 nt, Human
accaaaaauuguggggcugaau

SEQ ID NO: 1075018 - RNA, 22 nt, Human
cagugguggaaugaggaauugu

SEQ ID NO: 1075019 - RNA, 22 nt, Human
ugccugaugcaggaguaucaga

SEQ ID NO: 1075020 - RNA, 22 nt, Human
uagaaaagaauuuuauuugaua

SEQ ID NO: 1075021 - RNA, 22 nt, Human
gccugcagaggugcugcuagcu

SEQ ID NO: 1075022 - RNA, 21 nt, Human
ccccugggagcccugucagua

SEQ ID NO: 1075023 - RNA, 22 nt, Human
uaaaggcuuuuagugaugguaa

SEQ ID NO: 1075024 - RNA, 22 nt, Human
ugcaggagaaaguacggagcgu

SEQ ID NO: 1075025 - RNA, 22 nt, Human
uuacaaagcaggucagcugaaa

SEQ ID NO: 1075026 - RNA, 22 nt, Human
aagugauucuagucaugauucu

SEQ ID NO: 1075027 - RNA, 22 nt, Human
acugaaaaugaauuagaaacag

SEQ ID NO: 1075028 - RNA, 22 nt, Human
gcucugcucuugacuuaccagg

SEQ ID NO: 1075029 - RNA, 22 nt, Human
ucuucagcuguagucauuguuc

SEQ ID NO: 1075030 - RNA, 22 nt, Human
uuugaaauaugugaugagagag

SEQ ID NO: 1075031 - RNA, 23 nt, Human
ggagccagccuguggggagcggg

SEQ ID NO: 1075032 - RNA, 22 nt, Human
gcagccacagaggagggaugca

SEQ ID NO: 1075033 - RNA, 22 nt, Human
cacauuuaggagguggggaagc

SEQ ID NO: 1075034 - RNA, 22 nt, Human
aagcauuuuagauaaagcauca

SEQ ID NO: 1075035 - RNA, 22 nt, Human
cagcagaaauggauuuugagau

SEQ ID NO: 1075036 - RNA, 22 nt, Human
aggcugagaaagugggaagaug

SEQ ID NO: 1075037 - RNA, 22 nt, Human
uuugugcuaaugcuagauuacu

SEQ ID NO: 1075038 - RNA, 18 nt, Human
agcagcuuugugcuugau

SEQ ID NO: 1075039 - RNA, 22 nt, Human
ucauuucuauugcuacugucug

SEQ ID NO: 1075040 - RNA, 18 nt, Human
uacagauuauagauacau

SEQ ID NO: 1075041 - RNA, 22 nt, Human
accugaggccuccccagcagac

SEQ ID NO: 1075042 - RNA, 22 nt, Human
cugagagcagggacuugagcca

SEQ ID NO: 1075043 - RNA, 22 nt, Human
aggagugggggcgagaaguuaa

SEQ ID NO: 1075044 - RNA, 22 nt, Human
cugagcugcucccgcugcagcg

SEQ ID NO: 1075045 - RNA, 22 nt, Human
ucaagcagagucaaaaguacca

SEQ ID NO: 1075046 - RNA, 22 nt, Human
acugccuguuuggcauggcccc

SEQ ID NO: 1075047 - RNA, 22 nt, Human
caggguggaagcuguagagugg

SEQ ID NO: 1075048 - RNA, 20 nt, Human
aaaaacaguaaugcugaaga

SEQ ID NO: 1075049 - RNA, 22 nt, Human
cuggcagcuucaggacacucgg

SEQ ID NO: 1075050 - RNA, 22 nt, Human
aauaagaugugcuugaguuugg

SEQ ID NO: 1075051 - RNA, 22 nt, Human
gauggcagucaaccaggugagg

SEQ ID NO: 1075052 - RNA, 22 nt, Human
cugccucuauucacugaggcag

SEQ ID NO: 1075053 - RNA, 22 nt, Human
cccagcucuuuuagcggcaucu

SEQ ID NO: 1075054 - RNA, 22 nt, Human
gaacagcagcuuccugggaauu

SEQ ID NO: 1075055 - RNA, 22 nt, Human
accugagaccuaaucugacugu

SEQ ID NO: 1075056 - RNA, 22 nt, Human
gaacagcuauaaucaucugucc

SEQ ID NO: 1075057 - RNA, 22 nt, Human
ccagauggguuacuucaagcaa

SEQ ID NO: 1075058 - RNA, 22 nt, Human
cucuggccugcuuccucaggua

SEQ ID NO: 1075059 - RNA, 22 nt, Human
gcacacagagaggugguauguc

SEQ ID NO: 1075060 - RNA, 22 nt, Human
aagggcagaauagagaagaugg

SEQ ID NO: 1075061 - RNA, 22 nt, Human
cacaguuuuaucuuauacugau

SEQ ID NO: 1075062 - RNA, 22 nt, Human
ucaaaauuuuauuucucaagga

SEQ ID NO: 1075063 - RNA, 22 nt, Human
aacagaauuguacaccagggag

SEQ ID NO: 1075064 - RNA, 22 nt, Human
ggcuggagacaacguccugccc

SEQ ID NO: 1075065 - RNA, 22 nt, Human
aaagcaauggaugagaaucugu

SEQ ID NO: 1075066 - RNA, 22 nt, Human
cagagaagagucuggccucucu

SEQ ID NO: 1075067 - RNA, 22 nt, Human
ggccugucucacccccgggugc

SEQ ID NO: 1075068 - RNA, 22 nt, Human
cucuggacacuggcaugggguc

SEQ ID NO: 1075069 - RNA, 22 nt, Human
ccagagucuaugaguccucauu

SEQ ID NO: 1075070 - RNA, 21 nt, Human
caguauuuuaagcagugaguu

SEQ ID NO: 1075071 - RNA, 22 nt, Human
uggccugggcaugaagcaucgu

SEQ ID NO: 1075072 - RNA, 22 nt, Human
agcaaagcuuccauaaagcagc

SEQ ID NO: 1075073 - RNA, 22 nt, Human
uuguaagauggauaggaacagc

SEQ ID NO: 1075074 - RNA, 22 nt, Human
cagcagaaguccgacuccaguc

SEQ ID NO: 1075075 - RNA, 22 nt, Human
cacccucaagcaguggcacgug

SEQ ID NO: 1075076 - RNA, 22 nt, Human
agcacaggacguagagcuugga

SEQ ID NO: 1075077 - RNA, 22 nt, Human
ggaggaagugcaguucuacuac

SEQ ID NO: 1075078 - RNA, 22 nt, Human
ccugggaaucggugcguugagg

SEQ ID NO: 1075079 - RNA, 22 nt, Human
cgggcagaucacacagggcuug

SEQ ID NO: 1075080 - RNA, 22 nt, Human
uggagaaggccggccaggagug

SEQ ID NO: 1075081 - RNA, 22 nt, Human
cagaggcagaggucaucucugg

SEQ ID NO: 1075082 - RNA, 21 nt, Human
uuucuaaguaacuggcagcau

SEQ ID NO: 1075083 - RNA, 22 nt, Human
gcaggaacuggagcuggauguu

SEQ ID NO: 1075084 - RNA, 22 nt, Human
gagcagugguugaacagaggca

SEQ ID NO: 1075085 - RNA, 22 nt, Human
gcuucauuuugcccucuggugg

SEQ ID NO: 1075086 - RNA, 22 nt, Human
uuuaccaaauagauuaugucag

SEQ ID NO: 1075087 - RNA, 22 nt, Human
cuggggcugcagcgaucuucau

SEQ ID NO: 1075088 - RNA, 22 nt, Human
uuguguguacugguuaugggca

SEQ ID NO: 1075089 - RNA, 22 nt, Human
uaggaacaguccuagaaaucug

SEQ ID NO: 1075090 - RNA, 22 nt, Human
gauguuuggcucaaacgagugu

SEQ ID NO: 1075091 - RNA, 22 nt, Human
auguuacacuguuucacguucc

SEQ ID NO: 1075092 - RNA, 22 nt, Human
guacuucuuuagucaauaugua

SEQ ID NO: 1075093 - RNA, 22 nt, Human
ggcugcagaaguacuuccggau

SEQ ID NO: 1075094 - RNA, 22 nt, Human
gcuuuuuuagguaagacccagg

SEQ ID NO: 1075095 - RNA, 22 nt, Human
agugcuuucccugaaaccuucc

SEQ ID NO: 1075096 - RNA, 22 nt, Human
cccagcugcaccucuauggccu

SEQ ID NO: 1075097 - RNA, 22 nt, Human
cugccuuggcccuaguucaugg

SEQ ID NO: 1075098 - RNA, 22 nt, Human
uccauucauucauugaugaaca

SEQ ID NO: 1075099 - RNA, 22 nt, Human
cagguugguauucaucuccaca

SEQ ID NO: 1075100 - RNA, 22 nt, Human
uuacuugacauaaaugaguuua

SEQ ID NO: 1075101 - RNA, 19 nt, Human
ccuuccuccccagggccau

SEQ ID NO: 1075102 - RNA, 22 nt, Human
ucugagagcaaggcauuagcag

SEQ ID NO: 1075103 - RNA, 22 nt, Human
uucaaacuuaaggagcagcaga

SEQ ID NO: 1075104 - RNA, 22 nt, Human
agauauuuguaucuugcuauug

SEQ ID NO: 1075105 - RNA, 23 nt, Human
aacaauagguuuuggcagaauag

SEQ ID NO: 1075106 - RNA, 22 nt, Human
gugggccuugcagggugcaggg

SEQ ID NO: 1075107 - RNA, 22 nt, Human
ggcugccuggaccuccucuuuc

SEQ ID NO: 1075108 - RNA, 22 nt, Human
cuggcagcgcagcaugaagucg

SEQ ID NO: 1075109 - RNA, 20 nt, Human
ggcuuucugugauccucagu

SEQ ID NO: 1075110 - RNA, 22 nt, Human
ucagaggccugaaagaauuugg

SEQ ID NO: 1075111 - RNA, 23 nt, Human
agaggcacuaauuauucagagau

SEQ ID NO: 1075112 - RNA, 22 nt, Human
gagggccacguucagggcucuc

SEQ ID NO: 1075113 - RNA, 22 nt, Human
uuuucuuaggugcuccaaguag

SEQ ID NO: 1075114 - RNA, 22 nt, Human
uugcagagcaguaggaauauag

SEQ ID NO: 1075115 - RNA, 22 nt, Human
ugcuuccuugagcucuccaauc

SEQ ID NO: 1075116 - RNA, 22 nt, Human
gaaaugucucuugauuuuugga

SEQ ID NO: 1075117 - RNA, 22 nt, Human
uuugcauugcauuaaguauucu

SEQ ID NO: 1075118 - RNA, 22 nt, Human
aauuccaaaucaacuagucuag

SEQ ID NO: 1075119 - RNA, 22 nt, Human
gacccugccaugagugacaggg

SEQ ID NO: 1075120 - RNA, 22 nt, Human
agugacugggcagggcagggcc

SEQ ID NO: 1075121 - RNA, 22 nt, Human
aucuaagauuuugcuaagauca

SEQ ID NO: 1075122 - RNA, 22 nt, Human
gcugugcagucuuuggugugcc

SEQ ID NO: 1075123 - RNA, 22 nt, Human
gcugucaagguagaaaacagag

SEQ ID NO: 1075124 - RNA, 22 nt, Human
uuuguaagcaaguuaacauuuu

SEQ ID NO: 1075125 - RNA, 22 nt, Human
cagccaucccagccugugguuc

SEQ ID NO: 1075126 - RNA, 22 nt, Human
ucacagaauuuuugcuuccagu

SEQ ID NO: 1075127 - RNA, 18 nt, Human
cccugagaugaugcugug

SEQ ID NO: 1075128 - RNA, 22 nt, Human
uuucuaaacaaagggaguuugg

SEQ ID NO: 1075129 - RNA, 22 nt, Human
ccuggccuuaagggcagggagc

SEQ ID NO: 1075130 - RNA, 22 nt, Human
cuacauuaaauuggcuuacuua

SEQ ID NO: 1075131 - RNA, 22 nt, Human
aaaauauuuuagggccaggaga

SEQ ID NO: 1075132 - RNA, 22 nt, Human
ugcuucuggcuuaucucgugcc

SEQ ID NO: 1075133 - RNA, 22 nt, Human
acauauguuguaaacauuccaa

SEQ ID NO: 1075134 - RNA, 22 nt, Human
ugagaauaagagauaguuuauu

SEQ ID NO: 1075135 - RNA, 22 nt, Human
agcagcugggcucagagcuggg

SEQ ID NO: 1075136 - RNA, 22 nt, Human
agaaagggucacugaaagagga

SEQ ID NO: 1075137 - RNA, 22 nt, Human
uuuugucuaagaacuuugcaaa

SEQ ID NO: 1075138 - RNA, 22 nt, Human
gguuuccugcauugggaaauuu

SEQ ID NO: 1075139 - RNA, 22 nt, Human
ggccuuggugcucuguguugca

SEQ ID NO: 1075140 - RNA, 22 nt, Human
agcuggcuucacaggcagugug

SEQ ID NO: 1075141 - RNA, 22 nt, Human
gggcucucaugaguguguggua

SEQ ID NO: 1075142 - RNA, 22 nt, Human
caggcuugauuauucagacaau

SEQ ID NO: 1075143 - RNA, 22 nt, Human
acuggauugggaaaguacuuca

SEQ ID NO: 1075144 - RNA, 23 nt, Human
ucugcucugaaguucggcugagc

SEQ ID NO: 1075145 - RNA, 22 nt, Human
gcugggagaggcccugaaguga

SEQ ID NO: 1075146 - RNA, 22 nt, Human
ugcaagaggguguucaguuugu

SEQ ID NO: 1075147 - RNA, 22 nt, Human
gugguccuuacaggaggcuuac

SEQ ID NO: 1075148 - RNA, 22 nt, Human
ccaaggcuccucagcuggucuu

SEQ ID NO: 1075149 - RNA, 22 nt, Human
aggcugagcugguagugaguac

SEQ ID NO: 1075150 - RNA, 22 nt, Human
cccagcagccagaaugaggagc

SEQ ID NO: 1075151 - RNA, 22 nt, Human
aauucacauauacauuauuccu

SEQ ID NO: 1075152 - RNA, 18 nt, Human
ucacagugcucuugccua

SEQ ID NO: 1075153 - RNA, 22 nt, Human
agcagggcagguaaggaucaga

SEQ ID NO: 1075154 - RNA, 22 nt, Human
aagggcagcuuaaauugguagc

SEQ ID NO: 1075155 - RNA, 22 nt, Human
agaaaucacuuagaggaaguga

SEQ ID NO: 1075156 - RNA, 22 nt, Human
ugcugccacugguagucucauu

SEQ ID NO: 1075157 - RNA, 21 nt, Human
ucugcccuccaggagcucaua

SEQ ID NO: 1075158 - RNA, 22 nt, Human
ggcucaggaccugggauugcca

SEQ ID NO: 1075159 - RNA, 22 nt, Human
agaaaguuuugugcuauauaug

SEQ ID NO: 1075160 - RNA, 22 nt, Human
ucccagggauuaggacauggau

SEQ ID NO: 1075161 - RNA, 22 nt, Human
cagcaguguacaaggugucaga

SEQ ID NO: 1075162 - RNA, 22 nt, Human
ugggagcagccaacauggccuu

SEQ ID NO: 1075163 - RNA, 22 nt, Human
aggcugaggaucguacuuucca

SEQ ID NO: 1075164 - RNA, 22 nt, Human
caaauuuaaguuagaaagcaau

SEQ ID NO: 1075165 - RNA, 22 nt, Human
ucccaggcuaggccucugcguu

SEQ ID NO: 1075166 - RNA, 22 nt, Human
ggcccugcaagguacccaggcc

SEQ ID NO: 1075167 - RNA, 22 nt, Human
cagcuguggcugccacugcucc

SEQ ID NO: 1075168 - RNA, 22 nt, Human
gcauagcuuugaugcugccuua

SEQ ID NO: 1075169 - RNA, 22 nt, Human
gaggggcagaaugugaucaggg

SEQ ID NO: 1075170 - RNA, 22 nt, Human
ccuccagguguuacauaugacu

SEQ ID NO: 1075171 - RNA, 22 nt, Human
auggggaagagccagugagcug

SEQ ID NO: 1075172 - RNA, 22 nt, Human
gcagagugggagcccagggcug

SEQ ID NO: 1075173 - RNA, 22 nt, Human
ccugggagggcaagugcugaug

SEQ ID NO: 1075174 - RNA, 22 nt, Human
uaggaacaugcccuuaccuucc

SEQ ID NO: 1075175 - RNA, 22 nt, Human
uaaguuagcccuauuaaauuaa

SEQ ID NO: 1075176 - RNA, 22 nt, Human
acaguggagcucagaugaaaau

SEQ ID NO: 1075177 - RNA, 22 nt, Human
cccuuccuccucgccugucaga

SEQ ID NO: 1075178 - RNA, 22 nt, Human
ggcugcuguacugaugucaguu

SEQ ID NO: 1075179 - RNA, 22 nt, Human
cugucccuucauuauucacuac

SEQ ID NO: 1075180 - RNA, 22 nt, Human
ucuaguuuuagcuugaguugca

SEQ ID NO: 1075181 - RNA, 22 nt, Human
agucagcacuccugaggaucac

SEQ ID NO: 1075182 - RNA, 22 nt, Human
agccagacauggcuccugcucc

SEQ ID NO: 1075183 - RNA, 22 nt, Human
ucuggcucugaauucacuucug

SEQ ID NO: 1075184 - RNA, 22 nt, Human
aauaucuuggcccaacuccaga

SEQ ID NO: 1075185 - RNA, 22 nt, Human
cgagcagaagccugguggucug

SEQ ID NO: 1075186 - RNA, 22 nt, Human
cucaggauuuacuaauuucaag

SEQ ID NO: 1075187 - RNA, 22 nt, Human
cucuuuucaaaccuguuuaugg

SEQ ID NO: 1075188 - RNA, 22 nt, Human
uucugucacuuaggaggucaua

SEQ ID NO: 1075189 - RNA, 22 nt, Human
ggaguaggaguagaacucauca

SEQ ID NO: 1075190 - RNA, 19 nt, Human
augagcuggcauuucaggu

SEQ ID NO: 1075191 - RNA, 22 nt, Human
cacacaaauauucuggaggcaa

SEQ ID NO: 1075192 - RNA, 21 nt, Human
acuggcugccaugauccaggg

SEQ ID NO: 1075193 - RNA, 22 nt, Human
gcaggagagccagcaggcuucc

SEQ ID NO: 1075194 - RNA, 22 nt, Human
uccuccagaaacugaggcagaa

SEQ ID NO: 1075195 - RNA, 22 nt, Human
agaagagaguccuaccccauac

SEQ ID NO: 1075196 - RNA, 22 nt, Human
cauucauuuacuuucaacagcu

SEQ ID NO: 1075197 - RNA, 22 nt, Human
aucauucagccuaagcaaguac

SEQ ID NO: 1075198 - RNA, 22 nt, Human
cuggccgguauuugccucuggg

SEQ ID NO: 1075199 - RNA, 22 nt, Human
gaguguuuuacucaaagaaaga

SEQ ID NO: 1075200 - RNA, 21 nt, Human
ggcagcugaccgcgcggugca

SEQ ID NO: 1075201 - RNA, 22 nt, Human
ugaagauaaauuguacugaaga

SEQ ID NO: 1075202 - RNA, 22 nt, Human
gcagcagcccagggcucucaga

SEQ ID NO: 1075203 - RNA, 23 nt, Human
uuucacaaugagcauuacagaau

SEQ ID NO: 1075204 - RNA, 22 nt, Human
uaauacuuaccuugcagagucu

SEQ ID NO: 1075205 - RNA, 22 nt, Human
ccucagggaggccucuguggcu

SEQ ID NO: 1075206 - RNA, 22 nt, Human
ggcaccuggagguuuacuggau

SEQ ID NO: 1075207 - RNA, 22 nt, Human
agacagggagggagcgcggcug

SEQ ID NO: 1075208 - RNA, 22 nt, Human
aauucuacauugguucacauuu

SEQ ID NO: 1075209 - RNA, 22 nt, Human
caaauuaaugugucucaaaaua

SEQ ID NO: 1075210 - RNA, 22 nt, Human
gaggcucagggaaacagcgcag

SEQ ID NO: 1075211 - RNA, 20 nt, Human
aguaccuuuuguauguuacc

SEQ ID NO: 1075212 - RNA, 22 nt, Human
gucacuggggccacaugcagaa

SEQ ID NO: 1075213 - RNA, 21 nt, Human
guucaaauccugacacuacac

SEQ ID NO: 1075214 - RNA, 22 nt, Human
uguauuuuuagaccuuuagacc

SEQ ID NO: 1075215 - RNA, 22 nt, Human
uuugauaacagugaauaucaug

SEQ ID NO: 1075216 - RNA, 22 nt, Human
ccugugugcugaugacgacaga

SEQ ID NO: 1075217 - RNA, 22 nt, Human
ugaagcaggaaccagcagcauu

SEQ ID NO: 1075218 - RNA, 23 nt, Human
acagaucaucucgaaacaacuau

SEQ ID NO: 1075219 - RNA, 22 nt, Human
cagcagaguuuggcuucuaaug

SEQ ID NO: 1075220 - RNA, 22 nt, Human
agcaaugacuuugaaaucauga

SEQ ID NO: 1075221 - RNA, 22 nt, Human
ucaguggagagcuuccaggauu

SEQ ID NO: 1075222 - RNA, 22 nt, Human
uuugauuuacuggauauucuca

SEQ ID NO: 1075223 - RNA, 22 nt, Human
ucagauggauuuauacuauuuc

SEQ ID NO: 1075224 - RNA, 23 nt, Human
uccucccugacuucuacagcaca

SEQ ID NO: 1075225 - RNA, 22 nt, Human
agagacuggagaugggcagugu

SEQ ID NO: 1075226 - RNA, 22 nt, Human
gagugagggcagcaggggcugc

SEQ ID NO: 1075227 - RNA, 22 nt, Human
cauugucacccaaagcucauag

SEQ ID NO: 1075228 - RNA, 22 nt, Human
aaucacauuagugaaacacuga

SEQ ID NO: 1075229 - RNA, 22 nt, Human
uuagucuucuuccuuauauguu

SEQ ID NO: 1075230 - RNA, 18 nt, Human
aguggucuguuauaucau

SEQ ID NO: 1075231 - RNA, 22 nt, Human
cuguuucaauuugaggaucagc

SEQ ID NO: 1075232 - RNA, 22 nt, Human
cccuuucccuucuggcucaggg

SEQ ID NO: 1075233 - RNA, 22 nt, Human
agcagggcuccugaaagccgcg

SEQ ID NO: 1075234 - RNA, 19 nt, Human
guaacaguggacauuuuag

SEQ ID NO: 1075235 - RNA, 22 nt, Human
ccugcugucccucugggcucca

SEQ ID NO: 1075236 - RNA, 22 nt, Human
cugggcacuugcucacagcucu

SEQ ID NO: 1075237 - RNA, 22 nt, Human
caggaacauguuggaaagaaau

SEQ ID NO: 1075238 - RNA, 22 nt, Human
uucuucuuuccuauaauuaauu

SEQ ID NO: 1075239 - RNA, 22 nt, Human
auugucuucuggucuuaucuuu

SEQ ID NO: 1075240 - RNA, 22 nt, Human
ugcugugagguugagaaggaag

SEQ ID NO: 1075241 - RNA, 22 nt, Human
uggagccaggcuggcccugcca

SEQ ID NO: 1075242 - RNA, 22 nt, Human
gcagauggcucagacacugggg

SEQ ID NO: 1075243 - RNA, 22 nt, Human
auacagauugcuauacuuacaa

SEQ ID NO: 1075244 - RNA, 22 nt, Human
aucuuuagagucaucugagugu

SEQ ID NO: 1075245 - RNA, 22 nt, Human
ucaaggugcugugcugugcuag

SEQ ID NO: 1075246 - RNA, 22 nt, Human
uuacagaaaagggcuuuaagag

SEQ ID NO: 1075247 - RNA, 22 nt, Human
aggcagggugaugauaaugauu

SEQ ID NO: 1075248 - RNA, 22 nt, Human
augauucagcccaauuuuucua

SEQ ID NO: 1075249 - RNA, 22 nt, Human
gaggggcugcccuggugucagg

SEQ ID NO: 1075250 - RNA, 22 nt, Human
uacuugcuguuaguauuuuaca

SEQ ID NO: 1075251 - RNA, 20 nt, Human
caguagcaauaauuagaagc

SEQ ID NO: 1075252 - RNA, 22 nt, Human
gagaaggagcucaaauauggcu

SEQ ID NO: 1075253 - RNA, 21 nt, Human
ucagguggcagaguguuuaug

SEQ ID NO: 1075254 - RNA, 22 nt, Human
ccugggcuguugcaucauccuu

SEQ ID NO: 1075255 - RNA, 22 nt, Human
cuggagcugucuucacaggccu

SEQ ID NO: 1075256 - RNA, 22 nt, Human
agcugguaugaacaggauagga

SEQ ID NO: 1075257 - RNA, 22 nt, Human
gaggugaguggaucacgagguc

SEQ ID NO: 1075258 - RNA, 22 nt, Human
ggcaggcuguucaccugcuuuu

SEQ ID NO: 1075259 - RNA, 22 nt, Human
uuuguuuugaacuagcucagaa

SEQ ID NO: 1075260 - RNA, 22 nt, Human
uuucuaagacauuugucaucuu

SEQ ID NO: 1075261 - RNA, 22 nt, Human
ucagacagggagucagaaaaua

SEQ ID NO: 1075262 - RNA, 22 nt, Human
cagaaacacuguauuuagggaa

SEQ ID NO: 1075263 - RNA, 22 nt, Human
ccagguguaggacaccaaggga

SEQ ID NO: 1075264 - RNA, 22 nt, Human
ugcuuggccuacuuguccuuug

SEQ ID NO: 1075265 - RNA, 22 nt, Human
caggcugggaacgccacccgcu

SEQ ID NO: 1075266 - RNA, 22 nt, Human
augcccgauaccuaguuaacuc

SEQ ID NO: 1075267 - RNA, 22 nt, Human
gcugaaguguggagugacaguu

SEQ ID NO: 1075268 - RNA, 22 nt, Human
uauaacuaauacuggccaugag

SEQ ID NO: 1075269 - RNA, 22 nt, Human
gucuuucuaugaugaacuguug

SEQ ID NO: 1075270 - RNA, 22 nt, Human
ggcagacacaaaaacauaaggu

SEQ ID NO: 1075271 - RNA, 22 nt, Human
aggccagaugucgggcuagaag

SEQ ID NO: 1075272 - RNA, 22 nt, Human
ugagguggcacacacuuccugc

SEQ ID NO: 1075273 - RNA, 22 nt, Human
agucucagaaaagaagcaugga

SEQ ID NO: 1075274 - RNA, 22 nt, Human
uggcccugaaggccuugagcau

SEQ ID NO: 1075275 - RNA, 22 nt, Human
cauugcacuccacccuaggcaa

SEQ ID NO: 1075276 - RNA, 22 nt, Human
gcuaaggagggucuugcaaauu

SEQ ID NO: 1075277 - RNA, 22 nt, Human
cuggaaaggguccucauucugu

SEQ ID NO: 1075278 - RNA, 22 nt, Human
auuucauguuaacugaacagaa

SEQ ID NO: 1075279 - RNA, 22 nt, Human
gcugggagaggcagcuuucgga

SEQ ID NO: 1075280 - RNA, 22 nt, Human
ucauuucaguccucugugugag

SEQ ID NO: 1075281 - RNA, 23 nt, Human
uucaacauuuauugagcguccgu

SEQ ID NO: 1075282 - RNA, 22 nt, Human
cucuggggaagcagccagcugg

SEQ ID NO: 1075283 - RNA, 22 nt, Human
aggcccuggguuagggcccacu

SEQ ID NO: 1075284 - RNA, 22 nt, Human
ugcuuccaauucaaaucugugg

SEQ ID NO: 1075285 - RNA, 22 nt, Human
aaagaauacccugggucauaaa

SEQ ID NO: 1075286 - RNA, 22 nt, Human
gaugauuuuguuggugauucaa

SEQ ID NO: 1075287 - RNA, 19 nt, Human
gcugcucugggucucaucu

SEQ ID NO: 1075288 - RNA, 22 nt, Human
gcugggcucagaccuagugaac

SEQ ID NO: 1075289 - RNA, 22 nt, Human
cccuccuggaggcggaugccca

SEQ ID NO: 1075290 - RNA, 22 nt, Human
gagauaaauuuuugauaaauau

SEQ ID NO: 1075291 - RNA, 23 nt, Human
gccucuggagccccagugcucag

SEQ ID NO: 1075292 - RNA, 22 nt, Human
uggccuggcucacagugagauu

SEQ ID NO: 1075293 - RNA, 22 nt, Human
ugggcucucgucccugcagaag

SEQ ID NO: 1075294 - RNA, 22 nt, Human
agagcagugcugaagaguaggg

SEQ ID NO: 1075295 - RNA, 22 nt, Human
gcaguggcuaggagucuggcgu

SEQ ID NO: 1075296 - RNA, 22 nt, Human
ucucccaaggcacagaaagagu

SEQ ID NO: 1075297 - RNA, 22 nt, Human
uauacagauggaaagauacaca

SEQ ID NO: 1075298 - RNA, 22 nt, Human
ggacaugauauuucaggaagac

SEQ ID NO: 1075299 - RNA, 22 nt, Human
ccagaggcuggguucaccucag

SEQ ID NO: 1075300 - RNA, 22 nt, Human
cuguacaggugaggagggggcu

SEQ ID NO: 1075301 - RNA, 22 nt, Human
uacacacuuacuggagaugaag

SEQ ID NO: 1075302 - RNA, 22 nt, Human
cugcagaggucuugcugauggu

SEQ ID NO: 1075303 - RNA, 22 nt, Human
ccuucucuacuccugaugcaug

SEQ ID NO: 1075304 - RNA, 22 nt, Human
ugcacacauaugagcaugugug

SEQ ID NO: 1075305 - RNA, 22 nt, Human
aacaagaagagagggacguaau

SEQ ID NO: 1075306 - RNA, 22 nt, Human
ccauguggugggaaggagaaug

SEQ ID NO: 1075307 - RNA, 22 nt, Human
cuggaacaguguuggagcuuga

SEQ ID NO: 1075308 - RNA, 22 nt, Human
uaggccauuccuucucuugauc

SEQ ID NO: 1075309 - RNA, 22 nt, Human
cuggcucaggaaaguugcugcu

SEQ ID NO: 1075310 - RNA, 22 nt, Human
cugaggcaggagaauugcugga

SEQ ID NO: 1075311 - RNA, 22 nt, Human
gcugaguggagcagucagcgcu

SEQ ID NO: 1075312 - RNA, 22 nt, Human
uaugaagcucucacuguguguc

SEQ ID NO: 1075313 - RNA, 22 nt, Human
uaagcaaauagcuagaucagag

SEQ ID NO: 1075314 - RNA, 22 nt, Human
uuugcauugcagugguuuacag

SEQ ID NO: 1075315 - RNA, 22 nt, Human
accugagcaugccaggagagug

SEQ ID NO: 1075316 - RNA, 22 nt, Human
uuucuucucugauuaaggcuca

SEQ ID NO: 1075317 - RNA, 22 nt, Human
uccuugaaugaagagaggugac

SEQ ID NO: 1075318 - RNA, 22 nt, Human
ggcuugcuucuuguccaggaau

SEQ ID NO: 1075319 - RNA, 18 nt, Human
uccgaggcaccauaaaaa

SEQ ID NO: 1075320 - RNA, 22 nt, Human
ggaugcugcuaucaggcuucga

SEQ ID NO: 1075321 - RNA, 22 nt, Human
aagcauuugugaaauucagaug

SEQ ID NO: 1075322 - RNA, 22 nt, Human
acagauacaaauauacaaauac

SEQ ID NO: 1075323 - RNA, 22 nt, Human
ucucccacugcaagcccaggcu

SEQ ID NO: 1075324 - RNA, 22 nt, Human
ugguccuggggugcaggcugac

SEQ ID NO: 1075325 - RNA, 22 nt, Human
agucagcugcugcacacagcag

SEQ ID NO: 1075326 - RNA, 22 nt, Human
ucagcaaugugauacugugcaa

SEQ ID NO: 1075327 - RNA, 22 nt, Human
aagcauuuuucacagcaacagc

SEQ ID NO: 1075328 - RNA, 22 nt, Human
cucccucugucuuguccagaaa

SEQ ID NO: 1075329 - RNA, 22 nt, Human
ugggccugugaugcugggcuau

SEQ ID NO: 1075330 - RNA, 22 nt, Human
augcaagagcaauaugguaugc

SEQ ID NO: 1075331 - RNA, 22 nt, Human
gucccagagagcacuaguccau

SEQ ID NO: 1075332 - RNA, 22 nt, Human
ucucagugcuauccauauucca

SEQ ID NO: 1075333 - RNA, 22 nt, Human
gugcuuuccauccucccugcug

SEQ ID NO: 1075334 - RNA, 22 nt, Human
acugacuuuggaauauuucuag

SEQ ID NO: 1075335 - RNA, 21 nt, Human
uccaggaguggcugggcaggg

SEQ ID NO: 1075336 - RNA, 22 nt, Human
gguggcucagugucaggcccug

SEQ ID NO: 1075337 - RNA, 22 nt, Human
cuucaauugccaccagcuagca

SEQ ID NO: 1075338 - RNA, 22 nt, Human
caugcaaaauguauuuuauuag

SEQ ID NO: 1075339 - RNA, 22 nt, Human
gaaaggagggcucacaaaagug

SEQ ID NO: 1075340 - RNA, 22 nt, Human
uuacaguggucauuugggaaaa

SEQ ID NO: 1075341 - RNA, 22 nt, Human
uagaaacagcauauauuagccc

SEQ ID NO: 1075342 - RNA, 22 nt, Human
caaagcaggaagaauauugaaa

SEQ ID NO: 1075343 - RNA, 22 nt, Human
uugcauuguugcaaugaaguau

SEQ ID NO: 1075344 - RNA, 22 nt, Human
aaacuccagugaauacuagaau

SEQ ID NO: 1075345 - RNA, 22 nt, Human
cugagcagaccauggcagaggu

SEQ ID NO: 1075346 - RNA, 22 nt, Human
cacugaaauauuaauaucuuau

SEQ ID NO: 1075347 - RNA, 22 nt, Human
gcagcagagaccccaggaagga

SEQ ID NO: 1075348 - RNA, 22 nt, Human
ugaauuuaucaaagauucuuaa

SEQ ID NO: 1075349 - RNA, 22 nt, Human
guguuuaauagguagcugaauc

SEQ ID NO: 1075350 - RNA, 22 nt, Human
uagccaggcgaggucagugucg

SEQ ID NO: 1075351 - RNA, 21 nt, Human
aguuggaggcaguuuggcaau

SEQ ID NO: 1075352 - RNA, 22 nt, Human
aucauaagacccagccaguauu

SEQ ID NO: 1075353 - RNA, 22 nt, Human
gguggcagaauaauugaagguc

SEQ ID NO: 1075354 - RNA, 22 nt, Human
aggccagaaauuuggaguaugu

SEQ ID NO: 1075355 - RNA, 22 nt, Human
uaacacauuuuccucauacgga

SEQ ID NO: 1075356 - RNA, 22 nt, Human
aaugaugacaggauaaagaaca

SEQ ID NO: 1075357 - RNA, 16 nt, Human
uggaaggggucuccgg

SEQ ID NO: 1075358 - RNA, 21 nt, Human
ccuggcuucagggugcacugg

SEQ ID NO: 1075359 - RNA, 23 nt, Human
gccugggacugguagugugaccu

SEQ ID NO: 1075360 - RNA, 22 nt, Human
aacuggaagagugaauauaacu

SEQ ID NO: 1075361 - RNA, 22 nt, Human
auuucucugccucagcuucugc

SEQ ID NO: 1075362 - RNA, 22 nt, Human
uacaaaugccugacacacagau

SEQ ID NO: 1075363 - RNA, 22 nt, Human
caggcacugugcaagggucucg

SEQ ID NO: 1075364 - RNA, 22 nt, Human
caccugccugguccuuagggcu

SEQ ID NO: 1075365 - RNA, 22 nt, Human
ggcaaaaacagcaaugacuuuu

SEQ ID NO: 1075366 - RNA, 22 nt, Human
agagcugcaccuaugcagaccu

SEQ ID NO: 1075367 - RNA, 22 nt, Human
guuacaaaugccaaagcugaga

SEQ ID NO: 1075368 - RNA, 22 nt, Human
ucugucugcucauuuaccucag

SEQ ID NO: 1075369 - RNA, 22 nt, Human
guccagggcuaaaucagguucc

SEQ ID NO: 1075370 - RNA, 22 nt, Human
agggaugguggagguugcaagu

SEQ ID NO: 1075371 - RNA, 16 nt, Human
cagaggcaccuggcuc

SEQ ID NO: 1075372 - RNA, 22 nt, Human
augagcuucccagacaggaugg

SEQ ID NO: 1075373 - RNA, 22 nt, Human
cuggccagaguuggagggugug

SEQ ID NO: 1075374 - RNA, 22 nt, Human
auugcuaggaacagguugcacc

SEQ ID NO: 1075375 - RNA, 22 nt, Human
acugccugccuuccagguacug

SEQ ID NO: 1075376 - RNA, 22 nt, Human
ccagauggugccugucagaagg

SEQ ID NO: 1075377 - RNA, 22 nt, Human
agacaaaggauuaaugaugaug

SEQ ID NO: 1075378 - RNA, 21 nt, Human
cucuugugucagagccagagg

SEQ ID NO: 1075379 - RNA, 22 nt, Human
cuuaacauccugcauuuuucuu

SEQ ID NO: 1075380 - RNA, 22 nt, Human
uaaggccaccguuauagaacca

SEQ ID NO: 1075381 - RNA, 22 nt, Human
agcagauggugucaugggaugg

SEQ ID NO: 1075382 - RNA, 22 nt, Human
acaaauucuuucugccuauugg

SEQ ID NO: 1075383 - RNA, 22 nt, Human
auuuuacuaaguggauaucugu

SEQ ID NO: 1075384 - RNA, 21 nt, Human
ucugucuuccucagccuaagg

SEQ ID NO: 1075385 - RNA, 22 nt, Human
aguuacuugagacguuuaugaa

SEQ ID NO: 1075386 - RNA, 22 nt, Human
ccucugugugugcaugcaugcg

SEQ ID NO: 1075387 - RNA, 22 nt, Human
uacugaaauggcagauauauaa

SEQ ID NO: 1075388 - RNA, 22 nt, Human
aaaucagucccucuuggaauuu

SEQ ID NO: 1075389 - RNA, 22 nt, Human
uaauaaaugaaagugcuggcau

SEQ ID NO: 1075390 - RNA, 18 nt, Human
ugcucuguuuaaugauuu

SEQ ID NO: 1075391 - RNA, 22 nt, Human
cugcagccacgagucacagccc

SEQ ID NO: 1075392 - RNA, 22 nt, Human
agcaggguuccaggaguugcag

SEQ ID NO: 1075393 - RNA, 22 nt, Human
ggcucuggagcacagacgucug

SEQ ID NO: 1075394 - RNA, 22 nt, Human
uuuaauuuguauuucuagaggg

SEQ ID NO: 1075395 - RNA, 20 nt, Human
uccugggguaagccaugguc

SEQ ID NO: 1075396 - RNA, 22 nt, Human
aucacuguuaucuagaagcaca

SEQ ID NO: 1075397 - RNA, 22 nt, Human
agaaaucacuuaaugaacguag

SEQ ID NO: 1075398 - RNA, 22 nt, Human
acacucuuuuugugguugucua

SEQ ID NO: 1075399 - RNA, 22 nt, Human
uuuaaauaggacuccugggggu

SEQ ID NO: 1075400 - RNA, 22 nt, Human
uuaugcauauagcagauacgag

SEQ ID NO: 1075401 - RNA, 22 nt, Human
ggcagcuccucaaaaaauuaaa

SEQ ID NO: 1075402 - RNA, 22 nt, Human
ugaggcaguucuuacuuguauu

SEQ ID NO: 1075403 - RNA, 22 nt, Human
agcaggcugaugggcaugcuug

SEQ ID NO: 1075404 - RNA, 22 nt, Human
gcuggcucccauugguccuucc

SEQ ID NO: 1075405 - RNA, 17 nt, Human
agcugccagggagugug

SEQ ID NO: 1075406 - RNA, 22 nt, Human
auaacaauagugguagugcugg

SEQ ID NO: 1075407 - RNA, 22 nt, Human
uucuucaggauacgucauccag

SEQ ID NO: 1075408 - RNA, 22 nt, Human
cacaugcaggagccaauguaca

SEQ ID NO: 1075409 - RNA, 22 nt, Human
cagguuggagaucugucuaugg

SEQ ID NO: 1075410 - RNA, 19 nt, Human
caugagcugcucacuuccc

SEQ ID NO: 1075411 - RNA, 22 nt, Human
cuccaagucggcugcagcugga

SEQ ID NO: 1075412 - RNA, 22 nt, Human
uaaacaaggguuacugagcaug

SEQ ID NO: 1075413 - RNA, 22 nt, Human
ccacagccauuccagggaggcu

SEQ ID NO: 1075414 - RNA, 22 nt, Human
guguuuuauuggugcagucaga

SEQ ID NO: 1075415 - RNA, 20 nt, Human
gcagggcaucuuggccccca

SEQ ID NO: 1075416 - RNA, 19 nt, Human
uuccaaaaucaggauuuga

SEQ ID NO: 1075417 - RNA, 22 nt, Human
uuccagccaugguuucccuaug

SEQ ID NO: 1075418 - RNA, 22 nt, Human
aagaagaugguuaacuuucagu

SEQ ID NO: 1075419 - RNA, 20 nt, Human
ccugcugagccagugugagg

SEQ ID NO: 1075420 - RNA, 22 nt, Human
gaauaauagcagaaauuagcag

SEQ ID NO: 1075421 - RNA, 22 nt, Human
guuucacaagcaacggguaagg

SEQ ID NO: 1075422 - RNA, 19 nt, Human
ugaagcagcaaacucucag

SEQ ID NO: 1075423 - RNA, 22 nt, Human
cccuuuaacacacagaggcugc

SEQ ID NO: 1075424 - RNA, 22 nt, Human
gcaugugucuccccaguggagg

SEQ ID NO: 1075425 - RNA, 22 nt, Human
uuucacagcagaauuucugagg

SEQ ID NO: 1075426 - RNA, 22 nt, Human
gagcugccugaacaagcagcag

SEQ ID NO: 1075427 - RNA, 22 nt, Human
ggcuuccuaauacucccuacac

SEQ ID NO: 1075428 - RNA, 22 nt, Human
agggguggagaguguugccagu

SEQ ID NO: 1075429 - RNA, 22 nt, Human
aaggccagacaggaccacaucu

SEQ ID NO: 1075430 - RNA, 22 nt, Human
ugugauuagcugaauacacugg

SEQ ID NO: 1075431 - RNA, 22 nt, Human
ucagaagacuacuaggacacau

SEQ ID NO: 1075432 - RNA, 22 nt, Human
ccagggaaucaggcagaaguca

SEQ ID NO: 1075433 - RNA, 22 nt, Human
acccacgaagaugagcggcaug

SEQ ID NO: 1075434 - RNA, 22 nt, Human
uccauauuaacuaaaacuagaa

SEQ ID NO: 1075435 - RNA, 22 nt, Human
auuccugagacuuaucuguuuc

SEQ ID NO: 1075436 - RNA, 22 nt, Human
ccagggagccuggugugucagc

SEQ ID NO: 1075437 - RNA, 22 nt, Human
gcaggugagggugucugaauag

SEQ ID NO: 1075438 - RNA, 18 nt, Human
aguguuaaguaaguagca

SEQ ID NO: 1075439 - RNA, 21 nt, Human
agugugugauaggcaggaaga

SEQ ID NO: 1075440 - RNA, 22 nt, Human
agaggugggagccuggucacau

SEQ ID NO: 1075441 - RNA, 22 nt, Human
aagauggcaggaaucauaagcu

SEQ ID NO: 1075442 - RNA, 22 nt, Human
aagagagagcauucuucuguua

SEQ ID NO: 1075443 - RNA, 23 nt, Human
uggcauuuuaguuagcuucagug

SEQ ID NO: 1075444 - RNA, 22 nt, Human
ugaacacaaauauuuugggguu

SEQ ID NO: 1075445 - RNA, 22 nt, Human
auucaaaguaauaaccagaacu

SEQ ID NO: 1075446 - RNA, 22 nt, Human
auguggaaugaacaaaggaggc

SEQ ID NO: 1075447 - RNA, 22 nt, Human
ugaaacaauuagaauguaauga

SEQ ID NO: 1075448 - RNA, 22 nt, Human
agcaggaaggcuuuggggguuc

SEQ ID NO: 1075449 - RNA, 22 nt, Human
accagagaaaacacagcaggcu

SEQ ID NO: 1075450 - RNA, 22 nt, Human
ccucuucuagguuucagccugc

SEQ ID NO: 1075451 - RNA, 22 nt, Human
gcacagggagcaggucucuggu

SEQ ID NO: 1075452 - RNA, 22 nt, Human
uccucuggggcgugguccugga

SEQ ID NO: 1075453 - RNA, 19 nt, Human
ccucuccgcccaccagccc

SEQ ID NO: 1075454 - RNA, 22 nt, Human
uagccgggugugguggaacucc

SEQ ID NO: 1075455 - RNA, 22 nt, Human
ccagggaaugugggaugacucu

SEQ ID NO: 1075456 - RNA, 21 nt, Human
uagcagagaucauuuucuccu

SEQ ID NO: 1075457 - RNA, 23 nt, Human
uagagcagggaaaucugucagag

SEQ ID NO: 1075458 - RNA, 22 nt, Human
agaggccacuuugccugugaug

SEQ ID NO: 1075459 - RNA, 22 nt, Human
gaaacagguggcaggcuagauu

SEQ ID NO: 1075460 - RNA, 19 nt, Human
ccuuuuuuaacuucagcaa

SEQ ID NO: 1075461 - RNA, 22 nt, Human
caugucuuuguuaugcucacca

SEQ ID NO: 1075462 - RNA, 22 nt, Human
gggguggccaaggacucugacc

SEQ ID NO: 1075463 - RNA, 22 nt, Human
ggaccacaauauuugugagguu

SEQ ID NO: 1075464 - RNA, 22 nt, Human
gaaagccaucuggcugcuggga

SEQ ID NO: 1075465 - RNA, 22 nt, Human
ucaggagauggucuuuauaggc

SEQ ID NO: 1075466 - RNA, 22 nt, Human
cuggagugaggucugggagccu

SEQ ID NO: 1075467 - RNA, 20 nt, Human
auuuuguuuauguuccucuc

SEQ ID NO: 1075468 - RNA, 22 nt, Human
uuuugccugagagugaaaauaa

SEQ ID NO: 1075469 - RNA, 22 nt, Human
caggaagagguaucaccgagca

SEQ ID NO: 1075470 - RNA, 22 nt, Human
caggggacaguaugguggauga

SEQ ID NO: 1075471 - RNA, 22 nt, Human
ucagagaguuggaaagaauuaa

SEQ ID NO: 1075472 - RNA, 22 nt, Human
agcagaugcgucugagugggag

SEQ ID NO: 1075473 - RNA, 22 nt, Human
gaagcaaagagcuagugccgcu

SEQ ID NO: 1075474 - RNA, 22 nt, Human
aguuuguaaguucauuaugagu

SEQ ID NO: 1075475 - RNA, 22 nt, Human
ccucacaguuuggcuaacugug

SEQ ID NO: 1075476 - RNA, 22 nt, Human
aaaguguuuucugauguguucu

SEQ ID NO: 1075477 - RNA, 18 nt, Human
ugggaaaguuuauagaau

SEQ ID NO: 1075478 - RNA, 22 nt, Human
ugaaggaagaauaggcaguguu

SEQ ID NO: 1075479 - RNA, 22 nt, Human
ucagccuuguggcccugcucca

SEQ ID NO: 1075480 - RNA, 22 nt, Human
ugggcucaggaccccagaggcc

SEQ ID NO: 1075481 - RNA, 22 nt, Human
gggcagguggcaaagccagagg

SEQ ID NO: 1075482 - RNA, 22 nt, Human
agccaggaaugcaugcucugcu

SEQ ID NO: 1075483 - RNA, 22 nt, Human
acacugaauaauugagaguuga

SEQ ID NO: 1075484 - RNA, 22 nt, Human
ucacagaagagauauugacaga

SEQ ID NO: 1075485 - RNA, 22 nt, Human
aaagcucacaguaauacaaggc

SEQ ID NO: 1075486 - RNA, 22 nt, Human
ggcugagcccccucugcguagg

SEQ ID NO: 1075487 - RNA, 22 nt, Human
uuucaaagucaagaaggauacu

SEQ ID NO: 1075488 - RNA, 22 nt, Human
uuuccuuucucaagagccggca

SEQ ID NO: 1075489 - RNA, 21 nt, Human
ucucugugucuuuaagcugga

SEQ ID NO: 1075490 - RNA, 18 nt, Human
uccauuguucuacuguga

SEQ ID NO: 1075491 - RNA, 22 nt, Human
agacauuuuacauucuuccauu

SEQ ID NO: 1075492 - RNA, 22 nt, Human
ugagcagggacuuugaguguag

SEQ ID NO: 1075493 - RNA, 22 nt, Human
uuuuacaagcugagucguuaaa

SEQ ID NO: 1075494 - RNA, 22 nt, Human
ucaaaguagggguaagccaggc

SEQ ID NO: 1075495 - RNA, 22 nt, Human
uguuccauaaguggugcuuugu

SEQ ID NO: 1075496 - RNA, 22 nt, Human
cccucugcucaggugcauaggc

SEQ ID NO: 1075497 - RNA, 22 nt, Human
cccuggaggcggagcuugcagu

SEQ ID NO: 1075498 - RNA, 22 nt, Human
ugcuucugcugauauuuuguga

SEQ ID NO: 1075499 - RNA, 22 nt, Human
aagguaauccauaauaguuacu

SEQ ID NO: 1075500 - RNA, 22 nt, Human
cagcugccacaccucuuucucu

SEQ ID NO: 1075501 - RNA, 22 nt, Human
agcugugaauuuuaugcuagug

SEQ ID NO: 1075502 - RNA, 21 nt, Human
uuugaaagugggugauucuuu

SEQ ID NO: 1075503 - RNA, 23 nt, Human
cagaggguuccauggagcauggu

SEQ ID NO: 1075504 - RNA, 22 nt, Human
ugcauguuuauaacagaugagg

SEQ ID NO: 1075505 - RNA, 22 nt, Human
cagggagcuuucccaggacccu

SEQ ID NO: 1075506 - RNA, 20 nt, Human
aauuucuccuggguaacaga

SEQ ID NO: 1075507 - RNA, 22 nt, Human
ugggccaggcaugugaucagca

SEQ ID NO: 1075508 - RNA, 22 nt, Human
uauuucuugaguggucaguuuc

SEQ ID NO: 1075509 - RNA, 22 nt, Human
ugaugugugggcaugcagacag

SEQ ID NO: 1075510 - RNA, 22 nt, Human
uucagcagucguccaggaaaag

SEQ ID NO: 1075511 - RNA, 22 nt, Human
ccaaaggcggaacugagucucu

SEQ ID NO: 1075512 - RNA, 22 nt, Human
caucaguucccaggcccagaca

SEQ ID NO: 1075513 - RNA, 22 nt, Human
cugggcuguuuguucuggucuc

SEQ ID NO: 1075514 - RNA, 20 nt, Human
accccagccccucuaucuga

SEQ ID NO: 1075515 - RNA, 22 nt, Human
aggauccuguauggagaagcug

SEQ ID NO: 1075516 - RNA, 22 nt, Human
uuugaaaggaauuaggaugaca

SEQ ID NO: 1075517 - RNA, 19 nt, Human
acuugaaagcagagaguuu

SEQ ID NO: 1075518 - RNA, 22 nt, Human
guaaaucauaaaauuugagcuc

SEQ ID NO: 1075519 - RNA, 22 nt, Human
ucagccacuacccaccuuaaca

SEQ ID NO: 1075520 - RNA, 22 nt, Human
gcagagaaaguuuuguccucag

SEQ ID NO: 1075521 - RNA, 22 nt, Human
ugauuucccuguagccucugaa

SEQ ID NO: 1075522 - RNA, 22 nt, Human
ugccaggcagugucagauugag

SEQ ID NO: 1075523 - RNA, 22 nt, Human
gaugcagaaaguagacaccauc

SEQ ID NO: 1075524 - RNA, 22 nt, Human
aucacugucgucaucugagauu

SEQ ID NO: 1075525 - RNA, 22 nt, Human
ccagggcaacgcugucucagag

SEQ ID NO: 1075526 - RNA, 22 nt, Human
ggcaagaaggcuucagguagcu

SEQ ID NO: 1075527 - RNA, 22 nt, Human
gccaggcagcagcgaggauggu

SEQ ID NO: 1075528 - RNA, 22 nt, Human
aagauuauggcagauaacaauu

SEQ ID NO: 1075529 - RNA, 22 nt, Human
gauagaaagaauauagauucca

SEQ ID NO: 1075530 - RNA, 22 nt, Human
uaaguuagaucuuaauuaaagu

SEQ ID NO: 1075531 - RNA, 22 nt, Human
agggugccugcugcagguucag

SEQ ID NO: 1075532 - RNA, 22 nt, Human
ucaggaagugcugaggcugcuu

SEQ ID NO: 1075533 - RNA, 22 nt, Human
cuggccugcugggugagguccu

SEQ ID NO: 1075534 - RNA, 22 nt, Human
cauuuacagugagaguuuuuac

SEQ ID NO: 1075535 - RNA, 19 nt, Human
aguuaaugagcuuuugauc

SEQ ID NO: 1075536 - RNA, 22 nt, Human
cuauuugucacaacugguguuu

SEQ ID NO: 1075537 - RNA, 22 nt, Human
gcguggggcagcccagggcuuc

SEQ ID NO: 1075538 - RNA, 22 nt, Human
agcagggccugagugaccuaac

SEQ ID NO: 1075539 - RNA, 22 nt, Human
cacagggccuggggcagcugcu

SEQ ID NO: 1075540 - RNA, 21 nt, Human
ccaggcugggagggcaguucc

SEQ ID NO: 1075541 - RNA, 22 nt, Human
agcagccaggaaucugcagagc

SEQ ID NO: 1075542 - RNA, 22 nt, Human
ugugaggagaggcccagcuccc

SEQ ID NO: 1075543 - RNA, 22 nt, Human
aaggucauggcaaauuacuuuu

SEQ ID NO: 1075544 - RNA, 22 nt, Human
uucagcuaugcgcuuugggcaa

SEQ ID NO: 1075545 - RNA, 22 nt, Human
caucaguuuggucaaugauggg

SEQ ID NO: 1075546 - RNA, 22 nt, Human
uuuaagaugguauuuuauaaag

SEQ ID NO: 1075547 - RNA, 22 nt, Human
gcugccugaagugucuacacug

SEQ ID NO: 1075548 - RNA, 21 nt, Human
gugguucuagagaaacagaau

SEQ ID NO: 1075549 - RNA, 22 nt, Human
ugccucagucuaaagucucuca

SEQ ID NO: 1075550 - RNA, 22 nt, Human
gucuccagggcugcuggcgccu

SEQ ID NO: 1075551 - RNA, 23 nt, Human
cuguaugauguuaaguggaaagc

SEQ ID NO: 1075552 - RNA, 22 nt, Human
agcagauguuucagagcaggcu

SEQ ID NO: 1075553 - RNA, 20 nt, Human
uauuuacaacuuagagccuc

SEQ ID NO: 1075554 - RNA, 22 nt, Human
ugugacuaucauucuaaacauc

SEQ ID NO: 1075555 - RNA, 22 nt, Human
agcagcugagccccagcuguga

SEQ ID NO: 1075556 - RNA, 22 nt, Human
gccugcuguugagggaagagcu

SEQ ID NO: 1075557 - RNA, 20 nt, Human
agaaacauuucuugagaacu

SEQ ID NO: 1075558 - RNA, 22 nt, Human
aguaaauuauuuagcuuccaga

SEQ ID NO: 1075559 - RNA, 22 nt, Human
ugcacacauucuauggggcuga

SEQ ID NO: 1075560 - RNA, 22 nt, Human
ugucaccaugccagcuucugcc

SEQ ID NO: 1075561 - RNA, 22 nt, Human
cacugggcguguccugggugag

SEQ ID NO: 1075562 - RNA, 22 nt, Human
uucugggggccaggacaguggu

SEQ ID NO: 1075563 - RNA, 22 nt, Human
ucuggcagugaagucaugaggu

SEQ ID NO: 1075564 - RNA, 22 nt, Human
uguggccuggaaggggcugcuc

SEQ ID NO: 1075565 - RNA, 22 nt, Human
acucagagaauaucuagaagga

SEQ ID NO: 1075566 - RNA, 22 nt, Human
caggcucagccacaggggaagg

SEQ ID NO: 1075567 - RNA, 22 nt, Human
uucuuaaagaggcaaaacacag

SEQ ID NO: 1075568 - RNA, 22 nt, Human
auuguuaaacugaagcauuacu

SEQ ID NO: 1075569 - RNA, 22 nt, Human
cacugcuuauaaauucuaggca

SEQ ID NO: 1075570 - RNA, 22 nt, Human
caggugggaccaugauagggca

SEQ ID NO: 1075571 - RNA, 22 nt, Human
agggcaguguggugggacugac

SEQ ID NO: 1075572 - RNA, 22 nt, Human
aacuuuaaagaggaggcuuggg

SEQ ID NO: 1075573 - RNA, 22 nt, Human
agacacaggauucugcauuucu

SEQ ID NO: 1075574 - RNA, 23 nt, Human
auaaggcauaaagguacauugga

SEQ ID NO: 1075575 - RNA, 22 nt, Human
ugcuucuguauuuugggcuuga

SEQ ID NO: 1075576 - RNA, 22 nt, Human
ucagcagcagcucagcauguuu

SEQ ID NO: 1075577 - RNA, 22 nt, Human
gcuuugaagacuuuuccagggu

SEQ ID NO: 1075578 - RNA, 18 nt, Human
gugacagcugcuagcuca

SEQ ID NO: 1075579 - RNA, 22 nt, Human
ucacugcaaccucugccuuccg

SEQ ID NO: 1075580 - RNA, 21 nt, Human
gaaguacaccaggaaggccac

SEQ ID NO: 1075581 - RNA, 22 nt, Human
ggugggugagcccugggagcug

SEQ ID NO: 1075582 - RNA, 22 nt, Human
guuguuuugcaggauccuuaca

SEQ ID NO: 1075583 - RNA, 22 nt, Human
gguaggggcagggccaagcugu

SEQ ID NO: 1075584 - RNA, 22 nt, Human
cagucacauagguauacacaua

SEQ ID NO: 1075585 - RNA, 20 nt, Human
gccuguccugagugucaugg

SEQ ID NO: 1075586 - RNA, 22 nt, Human
gaggaacccaagcucaccguca

SEQ ID NO: 1075587 - RNA, 22 nt, Human
ucacagaaguugaauuugcaug

SEQ ID NO: 1075588 - RNA, 22 nt, Human
uggaccacauagugaggccccc

SEQ ID NO: 1075589 - RNA, 22 nt, Human
aggagccugagucacagugccu

SEQ ID NO: 1075590 - RNA, 22 nt, Human
guccucagcaccagaacuaggg

SEQ ID NO: 1075591 - RNA, 22 nt, Human
aucaacauuugcauccuuccac

SEQ ID NO: 1075592 - RNA, 22 nt, Human
ugggagaagcagcagccaagug

SEQ ID NO: 1075593 - RNA, 22 nt, Human
ccuggcagucaggggaguccuu

SEQ ID NO: 1075594 - RNA, 22 nt, Human
cgugacacauucuggacauggu

SEQ ID NO: 1075595 - RNA, 22 nt, Human
guauguguaaguaugccaccuu

SEQ ID NO: 1075596 - RNA, 22 nt, Human
aagggagacaguugugugagga

SEQ ID NO: 1075597 - RNA, 22 nt, Human
gcagggguuuucugacuugagu

SEQ ID NO: 1075598 - RNA, 22 nt, Human
uugcauugcuuggucuucaaga

SEQ ID NO: 1075599 - RNA, 22 nt, Human
aaguacaacgcauacagagaaa

SEQ ID NO: 1075600 - RNA, 18 nt, Human
aggcuucccaggcaggcc

SEQ ID NO: 1075601 - RNA, 20 nt, Human
auaugcugagugaaggcaga

SEQ ID NO: 1075602 - RNA, 23 nt, Human
acagagaucuugacuuguaugga

SEQ ID NO: 1075603 - RNA, 22 nt, Human
caauguuuuuccuuccuuaaua

SEQ ID NO: 1075604 - RNA, 22 nt, Human
agagcugaauuuggguggugga

SEQ ID NO: 1075605 - RNA, 22 nt, Human
cagcccugagagaaccaucuau

SEQ ID NO: 1075606 - RNA, 22 nt, Human
uaauuucaaauuucuuagcgug

SEQ ID NO: 1075607 - RNA, 22 nt, Human
gcaggcaguugcaguuuucuag

SEQ ID NO: 1075608 - RNA, 22 nt, Human
cagagguguuggugaauggaga

SEQ ID NO: 1075609 - RNA, 21 nt, Human
ugggggagaauugguugcuuu

SEQ ID NO: 1075610 - RNA, 22 nt, Human
cugucaaauucauaacacuuau

SEQ ID NO: 1075611 - RNA, 22 nt, Human
gggcagagacucagaaacagaa

SEQ ID NO: 1075612 - RNA, 22 nt, Human
aggaggcaggaagucuauggga

SEQ ID NO: 1075613 - RNA, 21 nt, Human
cacaggugggucagugaggcc

SEQ ID NO: 1075614 - RNA, 22 nt, Human
auucacaaagaagggaaguaca

SEQ ID NO: 1075615 - RNA, 22 nt, Human
uuugugcacuucuguagcugcc

SEQ ID NO: 1075616 - RNA, 22 nt, Human
ucugccuugagguccucagcuc

SEQ ID NO: 1075617 - RNA, 20 nt, Human
acauugauuauguuuguaga

SEQ ID NO: 1075618 - RNA, 22 nt, Human
aagcaaguucucaucauuuaua

SEQ ID NO: 1075619 - RNA, 22 nt, Human
caagccucagaaucuucuccau

SEQ ID NO: 1075620 - RNA, 22 nt, Human
acaaaggcauagugaauguuuu

SEQ ID NO: 1075621 - RNA, 22 nt, Human
ugggcacuggaagccugcugug

SEQ ID NO: 1075622 - RNA, 22 nt, Human
aacaucuuuacaacagaccuag

SEQ ID NO: 1075623 - RNA, 22 nt, Human
ugcaugugugacaaggacaguu

SEQ ID NO: 1075624 - RNA, 22 nt, Human
ugauuacaguauuugagaucca

SEQ ID NO: 1075625 - RNA, 22 nt, Human
ucaccagucuuucuuaccauug

SEQ ID NO: 1075626 - RNA, 22 nt, Human
auuuaauuaaucauggugaauu

SEQ ID NO: 1075627 - RNA, 22 nt, Human
cuguccuugcuggccagguaug

SEQ ID NO: 1075628 - RNA, 22 nt, Human
gcaggaaccccgggaggcuggc

SEQ ID NO: 1075629 - RNA, 21 nt, Human
uugaagcaaggguggcucuga

SEQ ID NO: 1075630 - RNA, 22 nt, Human
cggcugagacggccauagacac

SEQ ID NO: 1075631 - RNA, 22 nt, Human
ucauuucuguugugcaucacug

SEQ ID NO: 1075632 - RNA, 22 nt, Human
agaggcaacauggggaacagau

SEQ ID NO: 1075633 - RNA, 22 nt, Human
uuugcaguagacaucuuauuuu

SEQ ID NO: 1075634 - RNA, 22 nt, Human
cuggucccuggaccucccugga

SEQ ID NO: 1075635 - RNA, 23 nt, Human
ggcaccaggccauggagcgggag

SEQ ID NO: 1075636 - RNA, 22 nt, Human
gcucccagcauugcuucccagg

SEQ ID NO: 1075637 - RNA, 22 nt, Human
gggcagugucgaggucuggucc

SEQ ID NO: 1075638 - RNA, 22 nt, Human
uucaaagucagccaucuggcua

SEQ ID NO: 1075639 - RNA, 22 nt, Human
acaguacuguguuaacugaacc

SEQ ID NO: 1075640 - RNA, 19 nt, Human
gaacaaacuuaaacuuuuc

SEQ ID NO: 1075641 - RNA, 22 nt, Human
gcaaagaaugcagauuugccuc

SEQ ID NO: 1075642 - RNA, 22 nt, Human
auuuuuuauauaccaagguggg

SEQ ID NO: 1075643 - RNA, 22 nt, Human
ucagugucuugaccugggugug

SEQ ID NO: 1075644 - RNA, 22 nt, Human
ccucagaccccugcugagcuuc

SEQ ID NO: 1075645 - RNA, 22 nt, Human
aacauuuaggaaggaccuccuc

SEQ ID NO: 1075646 - RNA, 22 nt, Human
aaguguuuccgggagacuuggu

SEQ ID NO: 1075647 - RNA, 22 nt, Human
caguuacauuaauaaugcacau

SEQ ID NO: 1075648 - RNA, 22 nt, Human
ggaaggggucaccuccugauga

SEQ ID NO: 1075649 - RNA, 18 nt, Human
aaugaaauguacaccuuu

SEQ ID NO: 1075650 - RNA, 22 nt, Human
aagaugcuuauugcuccugcag

SEQ ID NO: 1075651 - RNA, 21 nt, Human
cucagaccacagcucacaccc

SEQ ID NO: 1075652 - RNA, 23 nt, Human
acucagagaccccgggaagugac

SEQ ID NO: 1075653 - RNA, 22 nt, Human
aucagaaacucuuagagcaggg

SEQ ID NO: 1075654 - RNA, 21 nt, Human
aucugcuuagguuuguucaga

SEQ ID NO: 1075655 - RNA, 22 nt, Human
uacaguagaauuuuuaguaacu

SEQ ID NO: 1075656 - RNA, 22 nt, Human
gcugccuucccggaaugucauc

SEQ ID NO: 1075657 - RNA, 22 nt, Human
uguuuuaguucugucuugcaug

SEQ ID NO: 1075658 - RNA, 22 nt, Human
gccaggcuggugucacaacucu

SEQ ID NO: 1075659 - RNA, 22 nt, Human
ucacauuugcaauugcauuguu

SEQ ID NO: 1075660 - RNA, 22 nt, Human
auucuuuauugcugaugguuau

SEQ ID NO: 1075661 - RNA, 22 nt, Human
uaaauucuacaacuucaaagau

SEQ ID NO: 1075662 - RNA, 22 nt, Human
cagccccucacagagcuguccu

SEQ ID NO: 1075663 - RNA, 22 nt, Human
cuuuucaugagucuguuauggg

SEQ ID NO: 1075664 - RNA, 22 nt, Human
ugcagaagcagagaguugccaa

SEQ ID NO: 1075665 - RNA, 18 nt, Human
agucuucugauccauuuu

SEQ ID NO: 1075666 - RNA, 22 nt, Human
uuuauuuggcauccagggagaa

SEQ ID NO: 1075667 - RNA, 22 nt, Human
gccuggaaucaugcagggguua

SEQ ID NO: 1075668 - RNA, 22 nt, Human
gcaggaaagguugagacuuugc

SEQ ID NO: 1075669 - RNA, 19 nt, Human
uggcuucuguuuucauguu

SEQ ID NO: 1075670 - RNA, 22 nt, Human
agggccaggaacaccugaaggg

SEQ ID NO: 1075671 - RNA, 22 nt, Human
gcccaggcuagcguagagugca

SEQ ID NO: 1075672 - RNA, 22 nt, Human
uucagaaaugucagccaucaga

SEQ ID NO: 1075673 - RNA, 22 nt, Human
gucugggcucccagggucggcg

SEQ ID NO: 1075674 - RNA, 22 nt, Human
ccugccuggcacauaguacucu

SEQ ID NO: 1075675 - RNA, 22 nt, Human
cugguguuuaucugacugccua

SEQ ID NO: 1075676 - RNA, 22 nt, Human
agcagaacugaugagacuugag

SEQ ID NO: 1075677 - RNA, 22 nt, Human
uacuuuucauaaugaagcagca

SEQ ID NO: 1075678 - RNA, 22 nt, Human
cccucugccugggaccaagucc

SEQ ID NO: 1075679 - RNA, 23 nt, Human
cagcugguugugggaguggcugc

SEQ ID NO: 1075680 - RNA, 22 nt, Human
ccaggugugcucugcaguggau

SEQ ID NO: 1075681 - RNA, 22 nt, Human
uuccagcaggcagacaggagau

SEQ ID NO: 1075682 - RNA, 22 nt, Human
cuggcuggucaugucaugagcc

SEQ ID NO: 1075683 - RNA, 22 nt, Human
cagcuagaaagucuguuaggga

SEQ ID NO: 1075684 - RNA, 22 nt, Human
acuuuguaaauuguugugacuc

SEQ ID NO: 1075685 - RNA, 22 nt, Human
guggcagggcaaugcucccucu

SEQ ID NO: 1075686 - RNA, 22 nt, Human
cagguggguguaugaaugcaaa

SEQ ID NO: 1075687 - RNA, 22 nt, Human
aaauuauucucauguguuucuu

SEQ ID NO: 1075688 - RNA, 22 nt, Human
caggcagagaggagcauuuaau

SEQ ID NO: 1075689 - RNA, 22 nt, Human
ugcaggcuggauuugcuuuugu

SEQ ID NO: 1075690 - RNA, 22 nt, Human
gagcuagagggagaagggcacu

SEQ ID NO: 1075691 - RNA, 22 nt, Human
uaggacaggugaggggcugugg

SEQ ID NO: 1075692 - RNA, 22 nt, Human
uaaugaaugagaauauaacaga

SEQ ID NO: 1075693 - RNA, 22 nt, Human
uccaagaagucaucuaaacugu

SEQ ID NO: 1075694 - RNA, 22 nt, Human
acauucugaaugccugacagua

SEQ ID NO: 1075695 - RNA, 22 nt, Human
gaaugcagauggcugguguaug

SEQ ID NO: 1075696 - RNA, 22 nt, Human
gagaggagucccuaucacaguu

SEQ ID NO: 1075697 - RNA, 22 nt, Human
caccaggagcaucuaggaggcg

SEQ ID NO: 1075698 - RNA, 22 nt, Human
auauuauuuucccuggaguugu

SEQ ID NO: 1075699 - RNA, 22 nt, Human
ucacagcauugucacaaggcug

SEQ ID NO: 1075700 - RNA, 18 nt, Human
ggcagggaaaagauaggg

SEQ ID NO: 1075701 - RNA, 22 nt, Human
gcuuccugucccucagccauga

SEQ ID NO: 1075702 - RNA, 18 nt, Human
uauguauaacauaguuca

SEQ ID NO: 1075703 - RNA, 22 nt, Human
uggcucagaagaaaagguaaac

SEQ ID NO: 1075704 - RNA, 22 nt, Human
uguuugcauuaauuagaaggua

SEQ ID NO: 1075705 - RNA, 22 nt, Human
aaauaguuuagcucucauuuca

SEQ ID NO: 1075706 - RNA, 22 nt, Human
aaauagauuuaacauccauccc

SEQ ID NO: 1075707 - RNA, 22 nt, Human
cuaucuuucgauucuagcuuaa

SEQ ID NO: 1075708 - RNA, 22 nt, Human
uauuucugauugcucaugaggc

SEQ ID NO: 1075709 - RNA, 22 nt, Human
ucuuaacauauuauuuuagcac

SEQ ID NO: 1075710 - RNA, 22 nt, Human
caaaucugagucuacaauuuua

SEQ ID NO: 1075711 - RNA, 22 nt, Human
gacuccagggauuggaagaugu

SEQ ID NO: 1075712 - RNA, 22 nt, Human
gugacaggcauggggucaugca

SEQ ID NO: 1075713 - RNA, 22 nt, Human
cugccucuugacagaucguggc

SEQ ID NO: 1075714 - RNA, 20 nt, Human
cagaaagaagguagauuuuu

SEQ ID NO: 1075715 - RNA, 22 nt, Human
gaggcugccccuuccucagcug

SEQ ID NO: 1075716 - RNA, 22 nt, Human
aagauuuaccacuuuauucaag

SEQ ID NO: 1075717 - RNA, 21 nt, Human
ccuuuagauuucuaugcaguu

SEQ ID NO: 1075718 - RNA, 22 nt, Human
ugcaggcuguaaucugaggcua

SEQ ID NO: 1075719 - RNA, 22 nt, Human
aaaauacacauacuaggggaaa

SEQ ID NO: 1075720 - RNA, 22 nt, Human
agugaucagcuugaaguaguuu

SEQ ID NO: 1075721 - RNA, 22 nt, Human
ggggcagccuccaggaaagcug

SEQ ID NO: 1075722 - RNA, 22 nt, Human
uccaagcuacugaagguuuggg

SEQ ID NO: 1075723 - RNA, 22 nt, Human
gacagggaggaaagagacugcu

SEQ ID NO: 1075724 - RNA, 22 nt, Human
gaauucugggagagaucugaca

SEQ ID NO: 1075725 - RNA, 22 nt, Human
ugaaaaacugaauaguugagua

SEQ ID NO: 1075726 - RNA, 22 nt, Human
acuuccuguguuggucuugcug

SEQ ID NO: 1075727 - RNA, 22 nt, Human
caggggcucuaaugcaugauca

SEQ ID NO: 1075728 - RNA, 21 nt, Human
ccucugcucgggcaugcguuu

SEQ ID NO: 1075729 - RNA, 22 nt, Human
uuugagaaaggggauuuaauuc

SEQ ID NO: 1075730 - RNA, 22 nt, Human
gggcugcuguagagaacauguu

SEQ ID NO: 1075731 - RNA, 22 nt, Human
ugaaggcagcaugcacacuagu

SEQ ID NO: 1075732 - RNA, 22 nt, Human
uguggccagcagguggcugugu

SEQ ID NO: 1075733 - RNA, 22 nt, Human
acuuuguuuccauauuuguagc

SEQ ID NO: 1075734 - RNA, 22 nt, Human
ggucuuccgagaggccugugcu

SEQ ID NO: 1075735 - RNA, 22 nt, Human
gucccaggcuccauggcagcca

SEQ ID NO: 1075736 - RNA, 22 nt, Human
ucccagagacaucauuucuccg

SEQ ID NO: 1075737 - RNA, 22 nt, Human
agacagcugcucgcagagcuau

SEQ ID NO: 1075738 - RNA, 22 nt, Human
acacaggggaaaguggagcuga

SEQ ID NO: 1075739 - RNA, 22 nt, Human
acaaggcuguuggucacaaacc

SEQ ID NO: 1075740 - RNA, 22 nt, Human
uacuguucaugccuucauaaag

SEQ ID NO: 1075741 - RNA, 20 nt, Human
ucugcuggccaaaacuucac

SEQ ID NO: 1075742 - RNA, 22 nt, Human
cugagagugcucuuugauguca

SEQ ID NO: 1075743 - RNA, 22 nt, Human
cauuccuuaacguggggagucu

SEQ ID NO: 1075744 - RNA, 22 nt, Human
gcugccuggagaggcagggaug

SEQ ID NO: 1075745 - RNA, 22 nt, Human
cagagcggccacuagagggcgc

SEQ ID NO: 1075746 - RNA, 23 nt, Human
gggaagugaggagccccucagcc

SEQ ID NO: 1075747 - RNA, 22 nt, Human
gagugaugucuguagugaagaa

SEQ ID NO: 1075748 - RNA, 22 nt, Human
ucaucucagagagguauguuag

SEQ ID NO: 1075749 - RNA, 19 nt, Human
ggccugugcagagcccguc

SEQ ID NO: 1075750 - RNA, 20 nt, Human
ucaccuaaaccagcaguuuc

SEQ ID NO: 1075751 - RNA, 22 nt, Human
uucuuaagucaguaagaugcaa

SEQ ID NO: 1075752 - RNA, 22 nt, Human
uggugcugauaauggcaggauu

SEQ ID NO: 1075753 - RNA, 22 nt, Human
ccuucaaaguacacaucuuuau

SEQ ID NO: 1075754 - RNA, 22 nt, Human
uuacugaaaguauacauuucug

SEQ ID NO: 1075755 - RNA, 22 nt, Human
uaaugcaguagguauuaaagaa

SEQ ID NO: 1075756 - RNA, 22 nt, Human
ugaagcagauggucuggucauu

SEQ ID NO: 1075757 - RNA, 22 nt, Human
gccaagcuuugcaggaguguug

SEQ ID NO: 1075758 - RNA, 22 nt, Human
aacauuucagcaccugauuccu

SEQ ID NO: 1075759 - RNA, 22 nt, Human
uuauucacuucuuggucccuca

SEQ ID NO: 1075760 - RNA, 22 nt, Human
gggggcucugacucccucagcu

SEQ ID NO: 1075761 - RNA, 18 nt, Human
gccaggaagcauggggac

SEQ ID NO: 1075762 - RNA, 22 nt, Human
aggucuggaggcggagucagga

SEQ ID NO: 1075763 - RNA, 22 nt, Human
uggggagugaugccucggauaa

SEQ ID NO: 1075764 - RNA, 22 nt, Human
cugagaggugacagcgugcugg

SEQ ID NO: 1075765 - RNA, 22 nt, Human
aaaagcaguuaucugggaggaa

SEQ ID NO: 1075766 - RNA, 22 nt, Human
ucugccagaaguucugagagua

SEQ ID NO: 1075767 - RNA, 22 nt, Human
ugcuugaaagggguuucccagu

SEQ ID NO: 1075768 - RNA, 21 nt, Human
ugcuggccucaagggugacuu

SEQ ID NO: 1075769 - RNA, 22 nt, Human
cuucugugaaugaaguguggga

SEQ ID NO: 1075770 - RNA, 22 nt, Human
gcugagaguccaggaaaacauc

SEQ ID NO: 1075771 - RNA, 22 nt, Human
ucaggcugcuguacugugaaug

SEQ ID NO: 1075772 - RNA, 22 nt, Human
cugauuuucaaaauguguuaaa

SEQ ID NO: 1075773 - RNA, 22 nt, Human
cagcugugggccugacguggca

SEQ ID NO: 1075774 - RNA, 22 nt, Human
ugacacagaaauuaagcuguca

SEQ ID NO: 1075775 - RNA, 22 nt, Human
ugcagugguugagagcccagac

SEQ ID NO: 1075776 - RNA, 22 nt, Human
aggaacccugcgccauacuuug

SEQ ID NO: 1075777 - RNA, 22 nt, Human
cuguguccaauggccuuagcag

SEQ ID NO: 1075778 - RNA, 22 nt, Human
acaaggcuaugaaguauuaguu

SEQ ID NO: 1075779 - RNA, 22 nt, Human
gugagagccugucuggaugucg

SEQ ID NO: 1075780 - RNA, 22 nt, Human
uagagcuauuuagagcauuuua

SEQ ID NO: 1075781 - RNA, 22 nt, Human
gcucccaccuccagccugaguu

SEQ ID NO: 1075782 - RNA, 22 nt, Human
ggagccaggcauaucggggcac

SEQ ID NO: 1075783 - RNA, 22 nt, Human
uucaacaaugcacuugaguaua

SEQ ID NO: 1075784 - RNA, 22 nt, Human
gaacuugagauaugaguaggua

SEQ ID NO: 1075785 - RNA, 22 nt, Human
aggcuucacgaugggugaggug

SEQ ID NO: 1075786 - RNA, 22 nt, Human
uaaagucaucuuuacaucuuug

SEQ ID NO: 1075787 - RNA, 22 nt, Human
caaggccaguucaccaagggca

SEQ ID NO: 1075788 - RNA, 22 nt, Human
uuuuaaguuaauauaauugagg

SEQ ID NO: 1075789 - RNA, 22 nt, Human
gccuucagcccugacuggccag

SEQ ID NO: 1075790 - RNA, 17 nt, Human
acucaggaucugggagu

SEQ ID NO: 1075791 - RNA, 22 nt, Human
cagcuguugcagcacugagaga

SEQ ID NO: 1075792 - RNA, 22 nt, Human
uuucucaguuacuagcuguggu

SEQ ID NO: 1075793 - RNA, 22 nt, Human
gcaggaguguauuugcauguaa

SEQ ID NO: 1075794 - RNA, 22 nt, Human
ggccaggcacugugugagauau

SEQ ID NO: 1075795 - RNA, 22 nt, Human
uguacagauaucaggagugagg

SEQ ID NO: 1075796 - RNA, 22 nt, Human
aauauauuugaaucaggaacaa

SEQ ID NO: 1075797 - RNA, 23 nt, Human
acugccugcuacuaugcccacgg

SEQ ID NO: 1075798 - RNA, 22 nt, Human
guucagcccacagagggggccg

SEQ ID NO: 1075799 - RNA, 22 nt, Human
ccuggccugcucggcucuuaag

SEQ ID NO: 1075800 - RNA, 22 nt, Human
auauacacuccacugauacagg

SEQ ID NO: 1075801 - RNA, 22 nt, Human
gagcugcagcggcugacgcaac

SEQ ID NO: 1075802 - RNA, 22 nt, Human
ucaaaguacuacucaguucagc

SEQ ID NO: 1075803 - RNA, 22 nt, Human
cuucuuaaauuggauugcuauu

SEQ ID NO: 1075804 - RNA, 19 nt, Human
acucaagucuaaugaaauc

SEQ ID NO: 1075805 - RNA, 22 nt, Human
agugugggugagggaggcccuc

SEQ ID NO: 1075806 - RNA, 22 nt, Human
cagcucaggcucuccaugcucc

SEQ ID NO: 1075807 - RNA, 20 nt, Human
cccaggugucugaagcucug

SEQ ID NO: 1075808 - RNA, 22 nt, Human
agccuggccacucagggccuga

SEQ ID NO: 1075809 - RNA, 22 nt, Human
acacacacaagcagguugugga

SEQ ID NO: 1075810 - RNA, 22 nt, Human
uggugcagauagugguguagua

SEQ ID NO: 1075811 - RNA, 22 nt, Human
auuucacauuaauuugaugcuc

SEQ ID NO: 1075812 - RNA, 22 nt, Human
uucagugugugauaccugcugu

SEQ ID NO: 1075813 - RNA, 21 nt, Human
uucuucuuggacuguuuuggc

SEQ ID NO: 1075814 - RNA, 22 nt, Human
uaaggccaaacuauuauaguuc

SEQ ID NO: 1075815 - RNA, 22 nt, Human
cuggggccacaacggcgcacgc

SEQ ID NO: 1075816 - RNA, 20 nt, Human
agaaucugacccagagagac

SEQ ID NO: 1075817 - RNA, 22 nt, Human
agugggcaugaucuggugucug

SEQ ID NO: 1075818 - RNA, 22 nt, Human
agcucccagaguccucugccca

SEQ ID NO: 1075819 - RNA, 19 nt, Human
aagauuuggucauugauaa

SEQ ID NO: 1075820 - RNA, 22 nt, Human
agagagaggggcgagcaaacac

SEQ ID NO: 1075821 - RNA, 22 nt, Human
aggcgcaggguuuggacccagg

SEQ ID NO: 1075822 - RNA, 22 nt, Human
ggcucuggcuacuccacccugu

SEQ ID NO: 1075823 - RNA, 22 nt, Human
acucugaggagugacuagaggu

SEQ ID NO: 1075824 - RNA, 22 nt, Human
gcagagcagcaaauggaaagga

SEQ ID NO: 1075825 - RNA, 22 nt, Human
cagauaauccaaguaguuuuca

SEQ ID NO: 1075826 - RNA, 22 nt, Human
aguagcaauguuugagaagcac

SEQ ID NO: 1075827 - RNA, 22 nt, Human
guuuauaauccaacucugcucc

SEQ ID NO: 1075828 - RNA, 22 nt, Human
uucuucaauuauuggaaagaaa

SEQ ID NO: 1075829 - RNA, 22 nt, Human
uguucuuacggaacuuaucuuu

SEQ ID NO: 1075830 - RNA, 22 nt, Human
cuggcuucugggccagggcaga

SEQ ID NO: 1075831 - RNA, 22 nt, Human
cuggccagcauuuuugcuuuag

SEQ ID NO: 1075832 - RNA, 22 nt, Human
uccaauauuucucacauaugga

SEQ ID NO: 1075833 - RNA, 22 nt, Human
augaggcaucuaacauugcaaa

SEQ ID NO: 1075834 - RNA, 19 nt, Human
gcugucugaugcugagguc

SEQ ID NO: 1075835 - RNA, 22 nt, Human
ucaggaguaaagacagaguucc

SEQ ID NO: 1075836 - RNA, 22 nt, Human
aagacaaugcauuacuaagaag

SEQ ID NO: 1075837 - RNA, 23 nt, Human
aagcugccagucugaagccuggg

SEQ ID NO: 1075838 - RNA, 22 nt, Human
uguaacagcucuccaugugggg

SEQ ID NO: 1075839 - RNA, 22 nt, Human
caaaugcuaacuucuuuccaaa

SEQ ID NO: 1075840 - RNA, 22 nt, Human
caguggagaggcaugcuuggca

SEQ ID NO: 1075841 - RNA, 22 nt, Human
cugggcugaaaguguuccuuga

SEQ ID NO: 1075842 - RNA, 22 nt, Human
gguaggggaagacaagugaaaa

SEQ ID NO: 1075843 - RNA, 22 nt, Human
aagcaccuggguuauaucuuag

SEQ ID NO: 1075844 - RNA, 22 nt, Human
cccagcaugcacgcugacacuc

SEQ ID NO: 1075845 - RNA, 22 nt, Human
aaggaaccauuugugugcaugg

SEQ ID NO: 1075846 - RNA, 22 nt, Human
agaagccaaaugccagugaccu

SEQ ID NO: 1075847 - RNA, 22 nt, Human
uaaauguuguaaguacaucuaa

SEQ ID NO: 1075848 - RNA, 22 nt, Human
aagaguggagaauaaaauagga

SEQ ID NO: 1075849 - RNA, 22 nt, Human
aggugcagcugacaccaugugg

SEQ ID NO: 1075850 - RNA, 22 nt, Human
ugucccagggaaggcccagcac

SEQ ID NO: 1075851 - RNA, 22 nt, Human
guaacagaggguuugcagauau

SEQ ID NO: 1075852 - RNA, 19 nt, Human
agacagagcucaguggguu

SEQ ID NO: 1075853 - RNA, 20 nt, Human
uacauuguagaaauauucaa

SEQ ID NO: 1075854 - RNA, 22 nt, Human
ggagcuguuggcagcuaucuug

SEQ ID NO: 1075855 - RNA, 18 nt, Human
ggcggguguuuuauucac

SEQ ID NO: 1075856 - RNA, 22 nt, Human
augugaggaagaaagagguaag

SEQ ID NO: 1075857 - RNA, 22 nt, Human
cuuaagaugaggucaugcuaua

SEQ ID NO: 1075858 - RNA, 22 nt, Human
uguccucaggaccuggcacagu

SEQ ID NO: 1075859 - RNA, 20 nt, Human
uucaaagacccucaggucca

SEQ ID NO: 1075860 - RNA, 22 nt, Human
ucugagagguuaagcaauuuga

SEQ ID NO: 1075861 - RNA, 22 nt, Human
cacaggagaacccacagauucu

SEQ ID NO: 1075862 - RNA, 22 nt, Human
ucuggggcaguuacuggggccu

SEQ ID NO: 1075863 - RNA, 22 nt, Human
aaauaugagggugaugcccaga

SEQ ID NO: 1075864 - RNA, 21 nt, Human
aacacauccagaguauuugac

SEQ ID NO: 1075865 - RNA, 22 nt, Human
cuguguggccucaagccagccu

SEQ ID NO: 1075866 - RNA, 22 nt, Human
cagggugcuuagaaauggaccu

SEQ ID NO: 1075867 - RNA, 22 nt, Human
uaacauuucggugacaguggga

SEQ ID NO: 1075868 - RNA, 22 nt, Human
uaugacaugugaucucaagagg

SEQ ID NO: 1075869 - RNA, 22 nt, Human
ugucugagugugccugggcauu

SEQ ID NO: 1075870 - RNA, 22 nt, Human
ggcugccucugaugugcagacg

SEQ ID NO: 1075871 - RNA, 22 nt, Human
cccucccaagcacucugacaua

SEQ ID NO: 1075872 - RNA, 22 nt, Human
uuugaacagacacuuucuacag

SEQ ID NO: 1075873 - RNA, 22 nt, Human
ucagagcugcccaugcaagggg

SEQ ID NO: 1075874 - RNA, 22 nt, Human
guucaauuuagaaagcacaguu

SEQ ID NO: 1075875 - RNA, 22 nt, Human
gaauaauauugacuuugcaggc

SEQ ID NO: 1075876 - RNA, 21 nt, Human
agcuccaggcuccugggguuc

SEQ ID NO: 1075877 - RNA, 22 nt, Human
aaaaaccuuucccauacuaaga

SEQ ID NO: 1075878 - RNA, 22 nt, Human
ucucaggggccuggaguccugg

SEQ ID NO: 1075879 - RNA, 22 nt, Human
agcagcucacaggauuccugaa

SEQ ID NO: 1075880 - RNA, 22 nt, Human
guauuuuauggccuggggccua

SEQ ID NO: 1075881 - RNA, 22 nt, Human
uggaacaaucccgguuuagcuc

SEQ ID NO: 1075882 - RNA, 22 nt, Human
ucacauuuuaucuauuuuaagu

SEQ ID NO: 1075883 - RNA, 23 nt, Human
ucuccagugucucuucauugagu

SEQ ID NO: 1075884 - RNA, 22 nt, Human
ucagcccugaggacagaggcag

SEQ ID NO: 1075885 - RNA, 22 nt, Human
aagucauugguagcuugauagg

SEQ ID NO: 1075886 - RNA, 22 nt, Human
guauuccugcaaauagcaguga

SEQ ID NO: 1075887 - RNA, 20 nt, Human
gcagcugcccccagucccug

SEQ ID NO: 1075888 - RNA, 22 nt, Human
gauuaauagacacaaccaagcu

SEQ ID NO: 1075889 - RNA, 22 nt, Human
uaaagucacagagcaggugcaa

SEQ ID NO: 1075890 - RNA, 22 nt, Human
gccccagccaaggugacacgaa

SEQ ID NO: 1075891 - RNA, 22 nt, Human
agaggagguccuuuucugaugu

SEQ ID NO: 1075892 - RNA, 22 nt, Human
uuaaauucauuccaacuuuuga

SEQ ID NO: 1075893 - RNA, 22 nt, Human
gaggggaagacuucuggacagu

SEQ ID NO: 1075894 - RNA, 22 nt, Human
gcuguccugggaacaggcacua

SEQ ID NO: 1075895 - RNA, 22 nt, Human
gucccagggaagaaggcagcac

SEQ ID NO: 1075896 - RNA, 22 nt, Human
cacuggugacuucugagcugga

SEQ ID NO: 1075897 - RNA, 22 nt, Human
ucaagaaagggcuucaccagga

SEQ ID NO: 1075898 - RNA, 22 nt, Human
cuucagaagccugcagccuuug

SEQ ID NO: 1075899 - RNA, 22 nt, Human
uguucucacuggaugcuucaca

SEQ ID NO: 1075900 - RNA, 22 nt, Human
gccugggagagggauagugcag

SEQ ID NO: 1075901 - RNA, 22 nt, Human
ccacugucagaggggcugugcc

SEQ ID NO: 1075902 - RNA, 22 nt, Human
ugaguccaccuuaguauauggg

SEQ ID NO: 1075903 - RNA, 22 nt, Human
ggggcaggagguguucucuuuu

SEQ ID NO: 1075904 - RNA, 19 nt, Human
cagagcagugguuccugaa

SEQ ID NO: 1075905 - RNA, 22 nt, Human
gacagugauuaguuacuauaaa

SEQ ID NO: 1075906 - RNA, 22 nt, Human
caucuucagguguuuuccauca

SEQ ID NO: 1075907 - RNA, 22 nt, Human
uucugagagagccucucauguu

SEQ ID NO: 1075908 - RNA, 17 nt, Human
ggccuguguggcugcag

SEQ ID NO: 1075909 - RNA, 22 nt, Human
uggcuuccugcauggauccucu

SEQ ID NO: 1075910 - RNA, 22 nt, Human
uuuaaauuuagaagaaacacug

SEQ ID NO: 1075911 - RNA, 22 nt, Human
uggacagguuugggugccuguu

SEQ ID NO: 1075912 - RNA, 22 nt, Human
gcccuuccaacccagagggcaa

SEQ ID NO: 1075913 - RNA, 22 nt, Human
uugggcuugacaagcugucaag

SEQ ID NO: 1075914 - RNA, 22 nt, Human
gccagggaggcuguaggguccu

SEQ ID NO: 1075915 - RNA, 22 nt, Human
aucuggcuuacgaagcacuggu

SEQ ID NO: 1075916 - RNA, 22 nt, Human
gccucugcccuccugggacugc

SEQ ID NO: 1075917 - RNA, 22 nt, Human
uguuuuucaaauauugcucugu

SEQ ID NO: 1075918 - RNA, 22 nt, Human
auuucuguuauaccuuucucag

SEQ ID NO: 1075919 - RNA, 22 nt, Human
ggacacagguaaauaccacuga

SEQ ID NO: 1075920 - RNA, 22 nt, Human
aagcagcauguggguuaucggg

SEQ ID NO: 1075921 - RNA, 22 nt, Human
uccuggagauaauugcagugaa

SEQ ID NO: 1075922 - RNA, 22 nt, Human
uuucauugcagagucugugugc

SEQ ID NO: 1075923 - RNA, 22 nt, Human
auaugugaaugauaucacuuug

SEQ ID NO: 1075924 - RNA, 22 nt, Human
agggccuggaacuggagaccac

SEQ ID NO: 1075925 - RNA, 22 nt, Human
uucuuucuuagcaaucuauggu

SEQ ID NO: 1075926 - RNA, 22 nt, Human
ggaaagauuugucacaugaaug

SEQ ID NO: 1075927 - RNA, 22 nt, Human
acagguggggaggcugagguuc

SEQ ID NO: 1075928 - RNA, 22 nt, Human
gggcacuggaaggcucucaggc

SEQ ID NO: 1075929 - RNA, 22 nt, Human
aagcagccuggcaugaugcuuu

SEQ ID NO: 1075930 - RNA, 22 nt, Human
ccugcugggacgugugguugcc

SEQ ID NO: 1075931 - RNA, 22 nt, Human
ugaaucaaagcugaaguuuuca

SEQ ID NO: 1075932 - RNA, 22 nt, Human
auucaaagcccaguaaacauug

SEQ ID NO: 1075933 - RNA, 22 nt, Human
uagagagcuguuugaaagcagg

SEQ ID NO: 1075934 - RNA, 22 nt, Human
auauacaugggaauauguggag

SEQ ID NO: 1075935 - RNA, 22 nt, Human
agcaggcuuacuuucugauuag

SEQ ID NO: 1075936 - RNA, 22 nt, Human
auggggcugggauucuccucgg

SEQ ID NO: 1075937 - RNA, 22 nt, Human
ucuguuuuugaggcuaucuucu

SEQ ID NO: 1075938 - RNA, 22 nt, Human
gccuggagaccugcuccucuac

SEQ ID NO: 1075939 - RNA, 22 nt, Human
uggcaguguauagguggcuccu

SEQ ID NO: 1075940 - RNA, 22 nt, Human
ugcccaggcuggagugcagagg

SEQ ID NO: 1075941 - RNA, 22 nt, Human
cugcuuuggacaacuauucuug

SEQ ID NO: 1075942 - RNA, 22 nt, Human
agaaagcacucugucuuuuacc

SEQ ID NO: 1075943 - RNA, 22 nt, Human
ugcagaagaccuuccagggcug

SEQ ID NO: 1075944 - RNA, 22 nt, Human
uacagauauauagugugugccu

SEQ ID NO: 1075945 - RNA, 22 nt, Human
uuacauauugucuauuguucaa

SEQ ID NO: 1075946 - RNA, 22 nt, Human
ccuggcuuccuggagcucacaa

SEQ ID NO: 1075947 - RNA, 22 nt, Human
aauuuuguuuaagugaucugcu

SEQ ID NO: 1075948 - RNA, 22 nt, Human
acaaacuuccaucaugaauuuu

SEQ ID NO: 1075949 - RNA, 22 nt, Human
gccucagggauaggaugagcau

SEQ ID NO: 1075950 - RNA, 20 nt, Human
cucaggauugucuagccccu

SEQ ID NO: 1075951 - RNA, 22 nt, Human
cucagggccaaggaugcuguug

SEQ ID NO: 1075952 - RNA, 22 nt, Human
ccagguggacaaggcuuucaca

SEQ ID NO: 1075953 - RNA, 22 nt, Human
ugggcagaguagcucagaagaa

SEQ ID NO: 1075954 - RNA, 22 nt, Human
uggaugugucgcccuggcucuc

SEQ ID NO: 1075955 - RNA, 22 nt, Human
gcagauggauguggacggcgcc

SEQ ID NO: 1075956 - RNA, 22 nt, Human
ucuguguaagaccagugcuggg

SEQ ID NO: 1075957 - RNA, 22 nt, Human
ugguccuggccuugaccccagg

SEQ ID NO: 1075958 - RNA, 22 nt, Human
ccacagggauaggaauggggcu

SEQ ID NO: 1075959 - RNA, 22 nt, Human
gcugccuguguggccacucacu

SEQ ID NO: 1075960 - RNA, 22 nt, Human
acagaacugggggcacagauag

SEQ ID NO: 1075961 - RNA, 22 nt, Human
cacaagagagugcgcguugcaa

SEQ ID NO: 1075962 - RNA, 22 nt, Human
ugcaauaucagauucaacacau

SEQ ID NO: 1075963 - RNA, 22 nt, Human
uucuuuauugagacuucauugu

SEQ ID NO: 1075964 - RNA, 22 nt, Human
ggaaaguggugguggaaagagg

SEQ ID NO: 1075965 - RNA, 22 nt, Human
uggaagaaugcuccacagggaa

SEQ ID NO: 1075966 - RNA, 22 nt, Human
aggcacugagaggcuguguugc

SEQ ID NO: 1075967 - RNA, 22 nt, Human
gggcacugaaugccaagcuagg

SEQ ID NO: 1075968 - RNA, 22 nt, Human
cugaaccacuaauauuuugauu

SEQ ID NO: 1075969 - RNA, 20 nt, Human
aaagcaguaugcaaguagag

SEQ ID NO: 1075970 - RNA, 22 nt, Human
gaggaagaaucaggguggugag

SEQ ID NO: 1075971 - RNA, 22 nt, Human
aaggaggcccucuccuucugga

SEQ ID NO: 1075972 - RNA, 22 nt, Human
uccauuuuucaugacuccucaa

SEQ ID NO: 1075973 - RNA, 22 nt, Human
auucucugaagucaauggaaau

SEQ ID NO: 1075974 - RNA, 22 nt, Human
aaggaaccucuaagccucuguu

SEQ ID NO: 1075975 - RNA, 22 nt, Human
uauucacauguacauaugcuca

SEQ ID NO: 1075976 - RNA, 22 nt, Human
ccagaugguauaguagggagag

SEQ ID NO: 1075977 - RNA, 22 nt, Human
cuggagcuggcuuccuuccacu

SEQ ID NO: 1075978 - RNA, 18 nt, Human
augugcaauuuuguauuu

SEQ ID NO: 1075979 - RNA, 22 nt, Human
gcucagagaaucagcagacacc

SEQ ID NO: 1075980 - RNA, 22 nt, Human
agggucagggagugaguauuua

SEQ ID NO: 1075981 - RNA, 22 nt, Human
uggcacugaccccaggccugug

SEQ ID NO: 1075982 - RNA, 22 nt, Human
ucaguagcagaaagcaaugagu

SEQ ID NO: 1075983 - RNA, 22 nt, Human
aacauugcagcuuaauugcagg

SEQ ID NO: 1075984 - RNA, 22 nt, Human
aguaacagguguacagacuauc

SEQ ID NO: 1075985 - RNA, 22 nt, Human
ucccagagguugagucacuuau

SEQ ID NO: 1075986 - RNA, 22 nt, Human
ugugccugucacccucagagag

SEQ ID NO: 1075987 - RNA, 22 nt, Human
aaggcacuugcccagagcugca

SEQ ID NO: 1075988 - RNA, 22 nt, Human
agggcagccaugagccuucagg

SEQ ID NO: 1075989 - RNA, 22 nt, Human
aaaagcucuuucugcuguagau

SEQ ID NO: 1075990 - RNA, 22 nt, Human
guguaugaacgaaagaauggau

SEQ ID NO: 1075991 - RNA, 22 nt, Human
uugagaaaccuggcaguagaga

SEQ ID NO: 1075992 - RNA, 22 nt, Human
gcugccucaggcaccuccuggc

SEQ ID NO: 1075993 - RNA, 22 nt, Human
gcaggguggauggcagggccag

SEQ ID NO: 1075994 - RNA, 23 nt, Human
cuggaacauaguagauggucaga

SEQ ID NO: 1075995 - RNA, 22 nt, Human
cauuugcauaugaagaaguaag

SEQ ID NO: 1075996 - RNA, 22 nt, Human
aaggcuuuccuguaggaagaca

SEQ ID NO: 1075997 - RNA, 22 nt, Human
uugacaauugggagauauaaag

SEQ ID NO: 1075998 - RNA, 22 nt, Human
ccuuuuaagggagacuagagau

SEQ ID NO: 1075999 - RNA, 23 nt, Human
acauagaacagaauauauuugug

SEQ ID NO: 1076000 - RNA, 21 nt, Human
gaggcugucugcugcuggccu

SEQ ID NO: 1076001 - RNA, 22 nt, Human
guucacaugcucucaugcuuuu

SEQ ID NO: 1076002 - RNA, 22 nt, Human
gaucuuuaaggcuuacccugga

SEQ ID NO: 1076003 - RNA, 22 nt, Human
uuggguaggagaaagaacagau

SEQ ID NO: 1076004 - RNA, 22 nt, Human
auuuuagauuuaagaauaaggu

SEQ ID NO: 1076005 - RNA, 22 nt, Human
uugcaaaugugaguuuagacug

SEQ ID NO: 1076006 - RNA, 22 nt, Human
gcaggugaaugauggacuagga

SEQ ID NO: 1076007 - RNA, 22 nt, Human
ucccaaagcuacucuucugacu

SEQ ID NO: 1076008 - RNA, 22 nt, Human
agaaaguuguuggaggaaauga

SEQ ID NO: 1076009 - RNA, 22 nt, Human
cagugauuuucucagaacuuga

SEQ ID NO: 1076010 - RNA, 22 nt, Human
ggcacuguuuuuguauucaguu

SEQ ID NO: 1076011 - RNA, 22 nt, Human
agcuguguggugucugacagcu

SEQ ID NO: 1076012 - RNA, 22 nt, Human
gcaucuaaauaaacgugggagu

SEQ ID NO: 1076013 - RNA, 22 nt, Human
agaaaauuuaaagagacacaca

SEQ ID NO: 1076014 - RNA, 19 nt, Human
ccagucccauacaggagau

SEQ ID NO: 1076015 - RNA, 22 nt, Human
aauauuucuccuucguuauagc

SEQ ID NO: 1076016 - RNA, 22 nt, Human
acauuucuuccuaauuaucccu

SEQ ID NO: 1076017 - RNA, 22 nt, Human
uuuuuaagagucuggaaauagu

SEQ ID NO: 1076018 - RNA, 22 nt, Human
caauuaaagaagaccugccuca

SEQ ID NO: 1076019 - RNA, 22 nt, Human
gcugucuucacuuccugguuuc

SEQ ID NO: 1076020 - RNA, 22 nt, Human
cugucaguucuuccagauagag

SEQ ID NO: 1076021 - RNA, 22 nt, Human
uggagaaggggcagggucucca

SEQ ID NO: 1076022 - RNA, 22 nt, Human
ucagaauucugaagggcacaaa

SEQ ID NO: 1076023 - RNA, 22 nt, Human
cuucacagcaugagcuuuggag

SEQ ID NO: 1076024 - RNA, 22 nt, Human
aaagguuuuauguuuuccacuu

SEQ ID NO: 1076025 - RNA, 22 nt, Human
agggccugagaccguggcuuga

SEQ ID NO: 1076026 - RNA, 22 nt, Human
agauacauuaguaguuacuugu

SEQ ID NO: 1076027 - RNA, 22 nt, Human
gugacaguggucacuuguaguu

SEQ ID NO: 1076028 - RNA, 22 nt, Human
agugucaaugccaacaguauau

SEQ ID NO: 1076029 - RNA, 22 nt, Human
ucugccagugguuuggcccuga

SEQ ID NO: 1076030 - RNA, 22 nt, Human
accaggaagagauuccaauuua

SEQ ID NO: 1076031 - RNA, 22 nt, Human
caguacuuuucuggcuuucuac

SEQ ID NO: 1076032 - RNA, 16 nt, Human
caguuuuaaggcccaa

SEQ ID NO: 1076033 - RNA, 22 nt, Human
agggccagccaggcccuacaaa

SEQ ID NO: 1076034 - RNA, 22 nt, Human
ucuuuguaacugucuauugaga

SEQ ID NO: 1076035 - RNA, 22 nt, Human
agcaggcaggaggcuacuaagg

SEQ ID NO: 1076036 - RNA, 22 nt, Human
gcagcugaaagggaucucuaca

SEQ ID NO: 1076037 - RNA, 22 nt, Human
agauaauuugaguaaauuaauu

SEQ ID NO: 1076038 - RNA, 22 nt, Human
augaaauuaaucaacacauaca

SEQ ID NO: 1076039 - RNA, 22 nt, Human
agucacuuucuacuugguuucu

SEQ ID NO: 1076040 - RNA, 22 nt, Human
augaggcaguacacacaaagcc

SEQ ID NO: 1076041 - RNA, 22 nt, Human
uuugcauuccugccugcauuca

SEQ ID NO: 1076042 - RNA, 22 nt, Human
ucuuccucuagaucugaggccc

SEQ ID NO: 1076043 - RNA, 22 nt, Human
uggaaugacagagagucugaau

SEQ ID NO: 1076044 - RNA, 22 nt, Human
ggcagggcaggaaagucaggaa

SEQ ID NO: 1076045 - RNA, 22 nt, Human
gggcugcaucagcaggacccgg

SEQ ID NO: 1076046 - RNA, 22 nt, Human
cagaagaauggugucugagcuc

SEQ ID NO: 1076047 - RNA, 22 nt, Human
uaggaagaucaaguuuaucuca

SEQ ID NO: 1076048 - RNA, 22 nt, Human
ugcauguuuguagguucuucua

SEQ ID NO: 1076049 - RNA, 22 nt, Human
caguacuugggaaugcugggga

SEQ ID NO: 1076050 - RNA, 22 nt, Human
gccuggcuccuaaggacuggcu

SEQ ID NO: 1076051 - RNA, 22 nt, Human
gccaccagggggugcaaggucc

SEQ ID NO: 1076052 - RNA, 22 nt, Human
ugggaggaucgcuugagcccag

SEQ ID NO: 1076053 - RNA, 22 nt, Human
ggaaucagaugaggggcagagc

SEQ ID NO: 1076054 - RNA, 23 nt, Human
ucugaguuauguccuuacauuug

SEQ ID NO: 1076055 - RNA, 22 nt, Human
aucagaaaauacccaguguuua

SEQ ID NO: 1076056 - RNA, 22 nt, Human
gacuuuaaaaugcuagaacagg

SEQ ID NO: 1076057 - RNA, 22 nt, Human
ucagcacugucuuuuauuugaa

SEQ ID NO: 1076058 - RNA, 22 nt, Human
agccaggcucaaggccugcucc

SEQ ID NO: 1076059 - RNA, 22 nt, Human
ugaggcagugauguuuaagcac

SEQ ID NO: 1076060 - RNA, 22 nt, Human
gccugcagggccugggccuacc

SEQ ID NO: 1076061 - RNA, 22 nt, Human
uacauacaguggaugcuuuagg

SEQ ID NO: 1076062 - RNA, 22 nt, Human
agucuugcucuugcaucugcuu

SEQ ID NO: 1076063 - RNA, 20 nt, Human
agcccuguuuccuggagaga

SEQ ID NO: 1076064 - RNA, 19 nt, Human
uggggccuccugucccugg

SEQ ID NO: 1076065 - RNA, 22 nt, Human
ugccugucucugacugccauua

SEQ ID NO: 1076066 - RNA, 22 nt, Human
gagccuggauugucaccgacuu

SEQ ID NO: 1076067 - RNA, 20 nt, Human
ggccuuggccucuuugcagc

SEQ ID NO: 1076068 - RNA, 22 nt, Human
uucaguauguuggacguuaugu

SEQ ID NO: 1076069 - RNA, 22 nt, Human
aaggaaccugggaaccuaucau

SEQ ID NO: 1076070 - RNA, 22 nt, Human
gaacacagugugaucguauguc

SEQ ID NO: 1076071 - RNA, 22 nt, Human
caucacaguuugucagaaauca

SEQ ID NO: 1076072 - RNA, 22 nt, Human
auucucaguucacuaguuucuu

SEQ ID NO: 1076073 - RNA, 22 nt, Human
auggcuuugcucaaguuuagcc

SEQ ID NO: 1076074 - RNA, 22 nt, Human
ucaggugggucuacaauuaguu

SEQ ID NO: 1076075 - RNA, 22 nt, Human
cucacagaugaugucuaugugg

SEQ ID NO: 1076076 - RNA, 22 nt, Human
guggcugcuaagucuccuuccu

SEQ ID NO: 1076077 - RNA, 22 nt, Human
ucuggagccacaaaccucagcu

SEQ ID NO: 1076078 - RNA, 22 nt, Human
ggcccugggaugcucagcagug

SEQ ID NO: 1076079 - RNA, 20 nt, Human
gaauuuuaugaacacuacca

SEQ ID NO: 1076080 - RNA, 22 nt, Human
gaugccucuuuuggcugaauua

SEQ ID NO: 1076081 - RNA, 22 nt, Human
ccuaggcccuaggcuuccauca

SEQ ID NO: 1076082 - RNA, 22 nt, Human
uguggggacugaguggaggcuu

SEQ ID NO: 1076083 - RNA, 22 nt, Human
uguuagaaauuauuaguaauau

SEQ ID NO: 1076084 - RNA, 21 nt, Human
ugaaugaggaggauggcauuu

SEQ ID NO: 1076085 - RNA, 22 nt, Human
uggaagcacuuggguuuuguug

SEQ ID NO: 1076086 - RNA, 22 nt, Human
gaauucuaaccauuaagccaag

SEQ ID NO: 1076087 - RNA, 22 nt, Human
ucaauucuagagccuuacauug

SEQ ID NO: 1076088 - RNA, 22 nt, Human
acaggaacagcuugauggcauc

SEQ ID NO: 1076089 - RNA, 22 nt, Human
aaugggagagaacacaaagucc

SEQ ID NO: 1076090 - RNA, 22 nt, Human
ggagccugacagugcccagcau

SEQ ID NO: 1076091 - RNA, 22 nt, Human
agucugcaggcugugauuuuuu

SEQ ID NO: 1076092 - RNA, 22 nt, Human
agggccagcuagagcccucgcc

SEQ ID NO: 1076093 - RNA, 22 nt, Human
caggcagaagaaguggaaggac

SEQ ID NO: 1076094 - RNA, 22 nt, Human
ggcugagcguggcugccguggg

SEQ ID NO: 1076095 - RNA, 22 nt, Human
caugaauauuuaguauuuacuu

SEQ ID NO: 1076096 - RNA, 22 nt, Human
gaguuauuggguggaaagguag

SEQ ID NO: 1076097 - RNA, 22 nt, Human
aaguccaccagucagacuagga

SEQ ID NO: 1076098 - RNA, 22 nt, Human
gaucaauacuauuaagaucaua

SEQ ID NO: 1076099 - RNA, 22 nt, Human
uaagucguggaugauucuucgg

SEQ ID NO: 1076100 - RNA, 22 nt, Human
caggaaccaugaagacauauac

SEQ ID NO: 1076101 - RNA, 22 nt, Human
uaaauacuuaguuuugugucua

SEQ ID NO: 1076102 - RNA, 22 nt, Human
ggagucccagcaaagccuuccc

SEQ ID NO: 1076103 - RNA, 22 nt, Human
uuuuccucugcaauaaaagcag

SEQ ID NO: 1076104 - RNA, 22 nt, Human
uguggggcucccuggcagccug

SEQ ID NO: 1076105 - RNA, 18 nt, Human
uucagcagcagacacacu

SEQ ID NO: 1076106 - RNA, 22 nt, Human
cagccaggcccccgagucguug

SEQ ID NO: 1076107 - RNA, 21 nt, Human
ugagagccuccaaccggcuac

SEQ ID NO: 1076108 - RNA, 22 nt, Human
auuaauaugagaaaguggcaga

SEQ ID NO: 1076109 - RNA, 22 nt, Human
agucucugggcaugguugugac

SEQ ID NO: 1076110 - RNA, 22 nt, Human
gcuuccuaaaugcacagggcag

SEQ ID NO: 1076111 - RNA, 23 nt, Human
ugcaagaguuccaaacuguucaa

SEQ ID NO: 1076112 - RNA, 22 nt, Human
agcagcuagacuucagaaucug

SEQ ID NO: 1076113 - RNA, 22 nt, Human
auuuccugaucuguaaaauagc

SEQ ID NO: 1076114 - RNA, 20 nt, Human
uauuucugggcaaccauuua

SEQ ID NO: 1076115 - RNA, 17 nt, Human
gcaagggaugggagauu

SEQ ID NO: 1076116 - RNA, 22 nt, Human
cggggccuagucuaccucggca

SEQ ID NO: 1076117 - RNA, 22 nt, Human
caaacauucaaguacaagucuu

SEQ ID NO: 1076118 - RNA, 22 nt, Human
aggcagacucaauggcuagaua

SEQ ID NO: 1076119 - RNA, 22 nt, Human
gcugccuccugaaagcgcucug

SEQ ID NO: 1076120 - RNA, 22 nt, Human
ucucugcugagaagggcuggca

SEQ ID NO: 1076121 - RNA, 20 nt, Human
ugccuuuuauaccuuuaaac

SEQ ID NO: 1076122 - RNA, 22 nt, Human
uccugggcuucacagacucugu

SEQ ID NO: 1076123 - RNA, 22 nt, Human
aggcugcuuucauggccgcccc

SEQ ID NO: 1076124 - RNA, 22 nt, Human
ucccagggacaccaagcuguuu

SEQ ID NO: 1076125 - RNA, 22 nt, Human
ugaugguuuuauuaauaggacc

SEQ ID NO: 1076126 - RNA, 22 nt, Human
uuaaggcuguggggauuacugc

SEQ ID NO: 1076127 - RNA, 22 nt, Human
guggccucaugucuauaaagag

SEQ ID NO: 1076128 - RNA, 22 nt, Human
cuugcuuuaucugguuucucau

SEQ ID NO: 1076129 - RNA, 22 nt, Human
cagcaauauacacagucuaugg

SEQ ID NO: 1076130 - RNA, 22 nt, Human
cauacaaauguguccaggcucu

SEQ ID NO: 1076131 - RNA, 22 nt, Human
uauuugucacugcacuugaaau

SEQ ID NO: 1076132 - RNA, 15 nt, Human
aacaucacuauuuug

SEQ ID NO: 1076133 - RNA, 22 nt, Human
caggucagagguagaugagaug

SEQ ID NO: 1076134 - RNA, 22 nt, Human
gccuggcuugccagcccuggcg

SEQ ID NO: 1076135 - RNA, 22 nt, Human
cuuaauaaaugguagcuguuau

SEQ ID NO: 1076136 - RNA, 22 nt, Human
aggcucagcccaagguggagag

SEQ ID NO: 1076137 - RNA, 19 nt, Human
ugcuucuggggcuucucca

SEQ ID NO: 1076138 - RNA, 22 nt, Human
uucucuggaacugaaacaagau

SEQ ID NO: 1076139 - RNA, 18 nt, Human
cacaggcaggugauaggu

SEQ ID NO: 1076140 - RNA, 22 nt, Human
uuuuacagucagucaaacucag

SEQ ID NO: 1076141 - RNA, 22 nt, Human
aacauaauguggccaaagucac

SEQ ID NO: 1076142 - RNA, 22 nt, Human
uccuuuggagcuugacugguag

SEQ ID NO: 1076143 - RNA, 22 nt, Human
cuggagcucuccagagccccgu

SEQ ID NO: 1076144 - RNA, 22 nt, Human
guuauucuacagucauugaagu

SEQ ID NO: 1076145 - RNA, 22 nt, Human
augcuuaaugaggguauauaug

SEQ ID NO: 1076146 - RNA, 22 nt, Human
agucucaggcagaggaaggcua

SEQ ID NO: 1076147 - RNA, 22 nt, Human
gagcugggagcugggauuugga

SEQ ID NO: 1076148 - RNA, 20 nt, Human
cuucuucagccuaugcuuca

SEQ ID NO: 1076149 - RNA, 22 nt, Human
aaauuauuacaagcuaguuggc

SEQ ID NO: 1076150 - RNA, 22 nt, Human
uuuguaagagcauauguaaagg

SEQ ID NO: 1076151 - RNA, 22 nt, Human
cugagccuuauucaccagcccu

SEQ ID NO: 1076152 - RNA, 22 nt, Human
gggaugucacugugccuggcac

SEQ ID NO: 1076153 - RNA, 22 nt, Human
uacaaacuuguuuuaaguaagu

SEQ ID NO: 1076154 - RNA, 22 nt, Human
uggccaccccuuucucugcacu

SEQ ID NO: 1076155 - RNA, 22 nt, Human
ucucagagaccugaacucccug

SEQ ID NO: 1076156 - RNA, 22 nt, Human
cucuucagccuauuugagugca

SEQ ID NO: 1076157 - RNA, 22 nt, Human
agaccaagugcaggugccacua

SEQ ID NO: 1076158 - RNA, 21 nt, Human
gaguuaauuugaccccugccu

SEQ ID NO: 1076159 - RNA, 22 nt, Human
gcugggaggaucucucccuguc

SEQ ID NO: 1076160 - RNA, 22 nt, Human
ugggcagccaucccagccucuc

SEQ ID NO: 1076161 - RNA, 22 nt, Human
cauuacauuucaaaauguuucc

SEQ ID NO: 1076162 - RNA, 22 nt, Human
caguggcaaugggacagagcac

SEQ ID NO: 1076163 - RNA, 22 nt, Human
gagggcagagucuaaugaugca

SEQ ID NO: 1076164 - RNA, 22 nt, Human
ggagcagggaauuacagcgcag

SEQ ID NO: 1076165 - RNA, 22 nt, Human
ggaaaugacuuggugcuucguu

SEQ ID NO: 1076166 - RNA, 20 nt, Human
ucagauuuuucuaacuuuga

SEQ ID NO: 1076167 - RNA, 22 nt, Human
ugucccauggacacaacuucuu

SEQ ID NO: 1076168 - RNA, 23 nt, Human
ugcucaauagaccauaauaucca

SEQ ID NO: 1076169 - RNA, 19 nt, Human
gcaggcacagcccugggug

SEQ ID NO: 1076170 - RNA, 22 nt, Human
uuccuuaguugacugucuuagu

SEQ ID NO: 1076171 - RNA, 19 nt, Human
acagggcagcaauaggaua

SEQ ID NO: 1076172 - RNA, 22 nt, Human
cuggcaggcggagguugcagug

SEQ ID NO: 1076173 - RNA, 22 nt, Human
cuggaauugcauaauauguccu

SEQ ID NO: 1076174 - RNA, 22 nt, Human
ucugagaagcuagaggacaaag

SEQ ID NO: 1076175 - RNA, 22 nt, Human
auuuuugcccugcaguacauaa

SEQ ID NO: 1076176 - RNA, 22 nt, Human
ucagugauugguggacugccua

SEQ ID NO: 1076177 - RNA, 22 nt, Human
gggcuguguacuaugaggaggg

SEQ ID NO: 1076178 - RNA, 22 nt, Human
gagagcugggcuuugggugaag

SEQ ID NO: 1076179 - RNA, 22 nt, Human
cagcucuucccucuucuuguag

SEQ ID NO: 1076180 - RNA, 22 nt, Human
gccugugcuuucuucccuccug

SEQ ID NO: 1076181 - RNA, 22 nt, Human
uauauucugauuccaucugugu

SEQ ID NO: 1076182 - RNA, 16 nt, Human
uuuguucacuccaugg

SEQ ID NO: 1076183 - RNA, 22 nt, Human
ugcacagagggaggcauaaaau

SEQ ID NO: 1076184 - RNA, 22 nt, Human
uaauacaucauucaucuaagga

SEQ ID NO: 1076185 - RNA, 22 nt, Human
acacaagauuguguauugaauu

SEQ ID NO: 1076186 - RNA, 18 nt, Human
ugggccugcauccuaguc

SEQ ID NO: 1076187 - RNA, 19 nt, Human
ggccaccucucuucccagg

SEQ ID NO: 1076188 - RNA, 22 nt, Human
gccagccccuuagggcucuccc

SEQ ID NO: 1076189 - RNA, 22 nt, Human
cccaggaggucgaagcugcagu

SEQ ID NO: 1076190 - RNA, 22 nt, Human
cccagaaggucgaggcugcagu

SEQ ID NO: 1076191 - RNA, 22 nt, Human
ggcaguggugggaggcucgcuc

SEQ ID NO: 1076192 - RNA, 22 nt, Human
uuuacagucugucuagcaaugu

SEQ ID NO: 1076193 - RNA, 19 nt, Human
aggaaaggaucaaaauagc

SEQ ID NO: 1076194 - RNA, 23 nt, Human
acucaaaauuuggcauuugagga

SEQ ID NO: 1076195 - RNA, 22 nt, Human
augcucugaugcuguuaaaugu

SEQ ID NO: 1076196 - RNA, 22 nt, Human
uacuaaacccucgauggaucuu

SEQ ID NO: 1076197 - RNA, 22 nt, Human
cugggaggcggagguuguagug

SEQ ID NO: 1076198 - RNA, 22 nt, Human
ggcaaaaaccacaauuacuuuu

SEQ ID NO: 1076199 - RNA, 22 nt, Human
gcccagaguucaaggcugcagu

SEQ ID NO: 1076200 - RNA, 22 nt, Human
caugggaggccugcugcuggug

SEQ ID NO: 1076201 - RNA, 22 nt, Human
accaggcuugaugauuugcuua

SEQ ID NO: 1076202 - RNA, 22 nt, Human
agagcccugaagcagagcuaaa

SEQ ID NO: 1076203 - RNA, 22 nt, Human
caggaaaucacucugauuuugg

SEQ ID NO: 1076204 - RNA, 21 nt, Human
gggaaauuaggauugcucauc

SEQ ID NO: 1076205 - RNA, 22 nt, Human
ggccacagcaaugcugugaugu

SEQ ID NO: 1076206 - RNA, 22 nt, Human
ugaaacaagauccacagacuug

SEQ ID NO: 1076207 - RNA, 22 nt, Human
aucaguuuguauaugaaacacu

SEQ ID NO: 1076208 - RNA, 22 nt, Human
ccugaggggcugcaggccagcu

SEQ ID NO: 1076209 - RNA, 19 nt, Human
aaacacagauuucuuacca

SEQ ID NO: 1076210 - RNA, 22 nt, Human
caugauuuugucuuguguuaau

SEQ ID NO: 1076211 - RNA, 22 nt, Human
aguguuguaugggaugacugcu

SEQ ID NO: 1076212 - RNA, 22 nt, Human
guuggaagaagacuguaaauua

SEQ ID NO: 1076213 - RNA, 22 nt, Human
cucaggcccacagcagacccac

SEQ ID NO: 1076214 - RNA, 22 nt, Human
ccugccaggacauugcuugaag

SEQ ID NO: 1076215 - RNA, 22 nt, Human
gccucugcaucaucacuccagc

SEQ ID NO: 1076216 - RNA, 19 nt, Human
ggcuucaguuuagcaggcu

SEQ ID NO: 1076217 - RNA, 22 nt, Human
aggaagagcccgggugacauaa

SEQ ID NO: 1076218 - RNA, 22 nt, Human
augaaugauuuuauguaaauga

SEQ ID NO: 1076219 - RNA, 19 nt, Human
aaauaucagagagaugaua

SEQ ID NO: 1076220 - RNA, 22 nt, Human
caacagagagaccagaaacagg

SEQ ID NO: 1076221 - RNA, 22 nt, Human
agcacugauuuuguugcacuua

SEQ ID NO: 1076222 - RNA, 22 nt, Human
ucaggcucagguuaggggccaa

SEQ ID NO: 1076223 - RNA, 20 nt, Human
guauuacaggcuuagaacca

SEQ ID NO: 1076224 - RNA, 22 nt, Human
cugggaugucuauagaacacuu

SEQ ID NO: 1076225 - RNA, 20 nt, Human
gcuuuaagacacagcuaaaa

SEQ ID NO: 1076226 - RNA, 22 nt, Human
ggggcagaguagcuggggugug

SEQ ID NO: 1076227 - RNA, 22 nt, Human
ggaggccaaggcagguggaucg

SEQ ID NO: 1076228 - RNA, 22 nt, Human
uaguuugucaaccacugucaca

SEQ ID NO: 1076229 - RNA, 22 nt, Human
uuuguccagaugcacagauaau

SEQ ID NO: 1076230 - RNA, 21 nt, Human
uccuggcuuuaugcuaccucu

SEQ ID NO: 1076231 - RNA, 22 nt, Human
ggcuggcacucuguccaguguc

SEQ ID NO: 1076232 - RNA, 22 nt, Human
gaugaaaaucuugagaugucga

SEQ ID NO: 1076233 - RNA, 22 nt, Human
accaggggaugguuggcacugu

SEQ ID NO: 1076234 - RNA, 22 nt, Human
cugugcccuguggcuggcaccu

SEQ ID NO: 1076235 - RNA, 22 nt, Human
guuugucuuaauuaggcaucga

SEQ ID NO: 1076236 - RNA, 22 nt, Human
cagccugggcuccagagucccu

SEQ ID NO: 1076237 - RNA, 22 nt, Human
auccaaaucuucacacauaaca

SEQ ID NO: 1076238 - RNA, 22 nt, Human
gcuggggagaauuggguuaucu

SEQ ID NO: 1076239 - RNA, 22 nt, Human
gcugcccugugguccagcaggu

SEQ ID NO: 1076240 - RNA, 22 nt, Human
gcagaugguggaggcaagaggc

SEQ ID NO: 1076241 - RNA, 22 nt, Human
guucuccauucagcuuccugug

SEQ ID NO: 1076242 - RNA, 22 nt, Human
aggcaguuuauccccagagccu

SEQ ID NO: 1076243 - RNA, 22 nt, Human
ggcagcaaauauugucagcugu

SEQ ID NO: 1076244 - RNA, 23 nt, Human
ucaucaaacagcugcucaagaaa

SEQ ID NO: 1076245 - RNA, 22 nt, Human
uuuccuuugugcaggccuuggg

SEQ ID NO: 1076246 - RNA, 22 nt, Human
ccuuucaaauuacaugacugcu

SEQ ID NO: 1076247 - RNA, 22 nt, Human
uuucaucuuccuuggcauaggu

SEQ ID NO: 1076248 - RNA, 22 nt, Human
uaacuguaauauaaauaugagu

SEQ ID NO: 1076249 - RNA, 21 nt, Human
ugcaggcuacuucugacucua

SEQ ID NO: 1076250 - RNA, 22 nt, Human
ucagagaaguaagguggggugc

SEQ ID NO: 1076251 - RNA, 22 nt, Human
cugugcaguccagcccuggaca

SEQ ID NO: 1076252 - RNA, 22 nt, Human
ggggcagggagguuaucgccga

SEQ ID NO: 1076253 - RNA, 22 nt, Human
ccaggggcuggugcugagcugg

SEQ ID NO: 1076254 - RNA, 22 nt, Human
gccucugcacuguggcacacca

SEQ ID NO: 1076255 - RNA, 22 nt, Human
acuaaauaguuuugacagaaca

SEQ ID NO: 1076256 - RNA, 22 nt, Human
cgcagaagagguugucuagucc

SEQ ID NO: 1076257 - RNA, 22 nt, Human
augaagcugaccuugucuugcu

SEQ ID NO: 1076258 - RNA, 22 nt, Human
uuuaguauccuaucucauuuaa

SEQ ID NO: 1076259 - RNA, 18 nt, Human
agugugugcccuuucagg

SEQ ID NO: 1076260 - RNA, 22 nt, Human
uacauaugaacuuuauaacuug

SEQ ID NO: 1076261 - RNA, 22 nt, Human
gagccuggggacccuccugagu

SEQ ID NO: 1076262 - RNA, 19 nt, Human
aggcagucauuggaauaua

SEQ ID NO: 1076263 - RNA, 22 nt, Human
uccucaggauguggaguagaau

SEQ ID NO: 1076264 - RNA, 22 nt, Human
acagcagcuugucuguucuuua

SEQ ID NO: 1076265 - RNA, 22 nt, Human
gccuggagccucagcaaggagg

SEQ ID NO: 1076266 - RNA, 22 nt, Human
ccaggcucagcuauuaagaaac

SEQ ID NO: 1076267 - RNA, 22 nt, Human
guuuuuucaugaguaguuaucu

SEQ ID NO: 1076268 - RNA, 22 nt, Human
uugcauugauguuccuucuugc

SEQ ID NO: 1076269 - RNA, 22 nt, Human
gcagguguggauuugcauccag

SEQ ID NO: 1076270 - RNA, 19 nt, Human
cuucugugauacaucaguc

SEQ ID NO: 1076271 - RNA, 22 nt, Human
augggccuguuccuaugcuggu

SEQ ID NO: 1076272 - RNA, 22 nt, Human
aaacaauguacacaugaauguu

SEQ ID NO: 1076273 - RNA, 22 nt, Human
agggcugcuccuccuucaggcc

SEQ ID NO: 1076274 - RNA, 22 nt, Human
gugguccuguccugacggcuuc

SEQ ID NO: 1076275 - RNA, 22 nt, Human
aaacauguaauucugcuuaaga

SEQ ID NO: 1076276 - RNA, 22 nt, Human
acugcagggcauccuggccaag

SEQ ID NO: 1076277 - RNA, 22 nt, Human
guaacaaaguuucuaggugcug

SEQ ID NO: 1076278 - RNA, 22 nt, Human
guggacugcgcuugagggggcc

SEQ ID NO: 1076279 - RNA, 22 nt, Human
cagaggguugaugugaggcuua

SEQ ID NO: 1076280 - RNA, 22 nt, Human
aacacuaucugccuuacaggga

SEQ ID NO: 1076281 - RNA, 22 nt, Human
gugucacaagagcccaggaaac

SEQ ID NO: 1076282 - RNA, 22 nt, Human
aagacaaagggguccuuggaug

SEQ ID NO: 1076283 - RNA, 22 nt, Human
cugggcagugguggcaucuuug

SEQ ID NO: 1076284 - RNA, 22 nt, Human
aagaauucacugguagagucaa

SEQ ID NO: 1076285 - RNA, 22 nt, Human
caucuugucuuuuugggccuga

SEQ ID NO: 1076286 - RNA, 22 nt, Human
aacagaauaucaaaagauuaug

SEQ ID NO: 1076287 - RNA, 22 nt, Human
acagaaagaagguguauuugag

SEQ ID NO: 1076288 - RNA, 22 nt, Human
caggcagccuucucgucucaca

SEQ ID NO: 1076289 - RNA, 22 nt, Human
ugcccugcccaucuacccuguc

SEQ ID NO: 1076290 - RNA, 22 nt, Human
gugcagugaaaaaagaaugucc

SEQ ID NO: 1076291 - RNA, 22 nt, Human
gaagcccauuuguacagcacau

SEQ ID NO: 1076292 - RNA, 22 nt, Human
ccuuuuuucuaugccaacucug

SEQ ID NO: 1076293 - RNA, 23 nt, Human
aagaaucaguaaguaaggagacc

SEQ ID NO: 1076294 - RNA, 22 nt, Human
ugccugggguuggcaaacugcu

SEQ ID NO: 1076295 - RNA, 22 nt, Human
acacauuuagcaccagguuuau

SEQ ID NO: 1076296 - RNA, 22 nt, Human
gugcaagaaggggagacugggu

SEQ ID NO: 1076297 - RNA, 22 nt, Human
ucuucaaauacagucauauuga

SEQ ID NO: 1076298 - RNA, 22 nt, Human
acugccugugucccuucagugc

SEQ ID NO: 1076299 - RNA, 22 nt, Human
acagcaggcaugaagaaauguu

SEQ ID NO: 1076300 - RNA, 22 nt, Human
agcagaaccacagcacuguuga

SEQ ID NO: 1076301 - RNA, 22 nt, Human
uacaggcauguagcauggugau

SEQ ID NO: 1076302 - RNA, 22 nt, Human
cugcagccuccugggguacaug

SEQ ID NO: 1076303 - RNA, 22 nt, Human
gggacugggagauccuccuggc

SEQ ID NO: 1076304 - RNA, 22 nt, Human
uccucagaaaccccugugaggu

SEQ ID NO: 1076305 - RNA, 22 nt, Human
ugccuggcaacuguggugggcu

SEQ ID NO: 1076306 - RNA, 22 nt, Human
ggaagagauucuuuacauucau

SEQ ID NO: 1076307 - RNA, 22 nt, Human
ugaagccacagagcaucugccu

SEQ ID NO: 1076308 - RNA, 22 nt, Human
aguaugaagauuauaauuuuuc

SEQ ID NO: 1076309 - RNA, 22 nt, Human
cuaaacaagggauuauaauuga

SEQ ID NO: 1076310 - RNA, 22 nt, Human
ugaaggcccagccacagaaugg

SEQ ID NO: 1076311 - RNA, 22 nt, Human
aggugucuggauggguguccuu

SEQ ID NO: 1076312 - RNA, 22 nt, Human
aaagguuuugcccuggguauuc

SEQ ID NO: 1076313 - RNA, 22 nt, Human
ucugucaggagauuggcagcug

SEQ ID NO: 1076314 - RNA, 21 nt, Human
uuuaaggccagcaggagguga

SEQ ID NO: 1076315 - RNA, 22 nt, Human
uaggcaggugugcacugcccac

SEQ ID NO: 1076316 - RNA, 22 nt, Human
aaagccagagcaagcugucaca

SEQ ID NO: 1076317 - RNA, 22 nt, Human
gagggcugcuggaaaaaugcag

SEQ ID NO: 1076318 - RNA, 22 nt, Human
agggccuggacuaauuggaucc

SEQ ID NO: 1076319 - RNA, 22 nt, Human
ucucccaaccucuggugggugc

SEQ ID NO: 1076320 - RNA, 22 nt, Human
ggugaccucaccuggucccacc

SEQ ID NO: 1076321 - RNA, 22 nt, Human
uucuccagaccuugugacuaug

SEQ ID NO: 1076322 - RNA, 20 nt, Human
cuaauauucuacucuaagga

SEQ ID NO: 1076323 - RNA, 22 nt, Human
agccugugugcuuuggacaggg

SEQ ID NO: 1076324 - RNA, 22 nt, Human
cagagccagcaguggggacagg

SEQ ID NO: 1076325 - RNA, 21 nt, Human
aaaugaaugugguagugcaag

SEQ ID NO: 1076326 - RNA, 21 nt, Human
aggcagccagucaugcucccu

SEQ ID NO: 1076327 - RNA, 22 nt, Human
agccucugguccucccucagcu

SEQ ID NO: 1076328 - RNA, 22 nt, Human
uggccugauuuugcuaagagaa

SEQ ID NO: 1076329 - RNA, 22 nt, Human
aggagcuggaguccaggcaagu

SEQ ID NO: 1076330 - RNA, 22 nt, Human
aauaagacucugcuagaaauuc

SEQ ID NO: 1076331 - RNA, 22 nt, Human
gccuccugaaaggaagagcucc

SEQ ID NO: 1076332 - RNA, 22 nt, Human
ugagccuggagucguggagggg

SEQ ID NO: 1076333 - RNA, 22 nt, Human
uccaggaaaaggcuugcagggg

SEQ ID NO: 1076334 - RNA, 22 nt, Human
aagggcugagcacagugagcca

SEQ ID NO: 1076335 - RNA, 22 nt, Human
gagcacagggaauagacagaua

SEQ ID NO: 1076336 - RNA, 22 nt, Human
gggaguggauuauguggaccca

SEQ ID NO: 1076337 - RNA, 22 nt, Human
uuucaacagcucucaaaugauc

SEQ ID NO: 1076338 - RNA, 22 nt, Human
gacccggcuccaggcccagcag

SEQ ID NO: 1076339 - RNA, 22 nt, Human
acagaagacagaguguucaucu

SEQ ID NO: 1076340 - RNA, 22 nt, Human
gcucugcuugcaucaugacugc

SEQ ID NO: 1076341 - RNA, 22 nt, Human
ugcccaagcagaggagugauuc

SEQ ID NO: 1076342 - RNA, 22 nt, Human
uuauuacaaugcagaaaauaga

SEQ ID NO: 1076343 - RNA, 22 nt, Human
gaggguggaaaggguguaccug

SEQ ID NO: 1076344 - RNA, 22 nt, Human
aacauuagauuuguuuuucuag

SEQ ID NO: 1076345 - RNA, 22 nt, Human
agcuagaggugaaacaugccaa

SEQ ID NO: 1076346 - RNA, 22 nt, Human
agcucccaggcagucaugagga

SEQ ID NO: 1076347 - RNA, 22 nt, Human
acagaaagaccuuguaacacuu

SEQ ID NO: 1076348 - RNA, 22 nt, Human
cacugcaaccuccgccuaccgg

SEQ ID NO: 1076349 - RNA, 21 nt, Human
caaaacuuaggugacuuagga

SEQ ID NO: 1076350 - RNA, 22 nt, Human
ucagaggaggcauuuaaacaga

SEQ ID NO: 1076351 - RNA, 22 nt, Human
uccaggccacugcagaggcucu

SEQ ID NO: 1076352 - RNA, 22 nt, Human
aggagccaaauuuuagacucug

SEQ ID NO: 1076353 - RNA, 22 nt, Human
auagugggaauuacgauauacu

SEQ ID NO: 1076354 - RNA, 22 nt, Human
ucaaaagacacaggaggcuagu

SEQ ID NO: 1076355 - RNA, 22 nt, Human
gugaagcacgcugccgcacugg

SEQ ID NO: 1076356 - RNA, 22 nt, Human
ucuuuucuggacucugcaugga

SEQ ID NO: 1076357 - RNA, 22 nt, Human
uuuccuucaucaucugagagcu

SEQ ID NO: 1076358 - RNA, 22 nt, Human
uuguauuuggguaguauagaga

SEQ ID NO: 1076359 - RNA, 22 nt, Human
aaugccaguguguugauuccag

SEQ ID NO: 1076360 - RNA, 22 nt, Human
aucuggcugacuuugugggaca

SEQ ID NO: 1076361 - RNA, 22 nt, Human
aggccaggguagggcccauugu

SEQ ID NO: 1076362 - RNA, 22 nt, Human
cucuggaguucccuugaucuga

SEQ ID NO: 1076363 - RNA, 22 nt, Human
aaaacacacuggaccaauuuaa

SEQ ID NO: 1076364 - RNA, 22 nt, Human
uauuuguugaguuguuaugucu

SEQ ID NO: 1076365 - RNA, 22 nt, Human
ucaggcucaaagggccggauga

SEQ ID NO: 1076366 - RNA, 22 nt, Human
uccaucaccauuucugcgagcu

SEQ ID NO: 1076367 - RNA, 22 nt, Human
aggagucagauuguuugaaugu

SEQ ID NO: 1076368 - RNA, 22 nt, Human
uggcauuucuggccauuugugu

SEQ ID NO: 1076369 - RNA, 19 nt, Human
agcaggcuaggcugccucu

SEQ ID NO: 1076370 - RNA, 22 nt, Human
guagccauuggcaaugaagccu

SEQ ID NO: 1076371 - RNA, 22 nt, Human
cccaggaagagugaguggcauu

SEQ ID NO: 1076372 - RNA, 22 nt, Human
gggcaaagugguggaggcaguu

SEQ ID NO: 1076373 - RNA, 22 nt, Human
gauuuccucacuaacauccauc

SEQ ID NO: 1076374 - RNA, 22 nt, Human
uuuucucaggugcuuaucuaag

SEQ ID NO: 1076375 - RNA, 22 nt, Human
ggccugccucacagucagcacc

SEQ ID NO: 1076376 - RNA, 22 nt, Human
acauugaucagccucccaugca

SEQ ID NO: 1076377 - RNA, 22 nt, Human
aaaggcaggacugcagcauagg

SEQ ID NO: 1076378 - RNA, 22 nt, Human
ggagcugcucagagccaguccc

SEQ ID NO: 1076379 - RNA, 22 nt, Human
ggucccugaagaggccuggggu

SEQ ID NO: 1076380 - RNA, 20 nt, Human
uccaggccuuguucucagau

SEQ ID NO: 1076381 - RNA, 19 nt, Human
cacaaaugaugaggaccug

SEQ ID NO: 1076382 - RNA, 22 nt, Human
ugggccacacacagaagaauca

SEQ ID NO: 1076383 - RNA, 22 nt, Human
aguaaugaauacgguauuugaa

SEQ ID NO: 1076384 - RNA, 19 nt, Human
uccauaagcuuguguucau

SEQ ID NO: 1076385 - RNA, 22 nt, Human
auccuugacacacuccaguacu

SEQ ID NO: 1076386 - RNA, 22 nt, Human
ccuguccuccaagagcacaucu

SEQ ID NO: 1076387 - RNA, 22 nt, Human
acuggcugcgggguggaagaag

SEQ ID NO: 1076388 - RNA, 22 nt, Human
ccaggcucacagcaucccagga

SEQ ID NO: 1076389 - RNA, 22 nt, Human
caggaacacaaguucagggaug

SEQ ID NO: 1076390 - RNA, 22 nt, Human
ucuucuucccaucccucaaaug

SEQ ID NO: 1076391 - RNA, 22 nt, Human
gcuguguccucacacagccuuu

SEQ ID NO: 1076392 - RNA, 18 nt, Human
agaagcagguaaaauucu

SEQ ID NO: 1076393 - RNA, 19 nt, Human
ugcccugcccgcagccuug

SEQ ID NO: 1076394 - RNA, 22 nt, Human
acagguggcacugcuguuacuc

SEQ ID NO: 1076395 - RNA, 22 nt, Human
ucauucccccauaaugguauuu

SEQ ID NO: 1076396 - RNA, 22 nt, Human
gggcuccugccuccuggcaccu

SEQ ID NO: 1076397 - RNA, 22 nt, Human
ucaccgccuugcccggccgggc

SEQ ID NO: 1076398 - RNA, 22 nt, Human
uccuuacaacuuguuauuuuuc

SEQ ID NO: 1076399 - RNA, 22 nt, Human
auguuuguagguaagugacacu

SEQ ID NO: 1076400 - RNA, 22 nt, Human
ucagggcagccuaaggcaccuc

SEQ ID NO: 1076401 - RNA, 22 nt, Human
uuuaagguggacaucuaaguca

SEQ ID NO: 1076402 - RNA, 22 nt, Human
gagacagaguuucacucuuguu

SEQ ID NO: 1076403 - RNA, 22 nt, Human
uugagaaauaagcaugucuaga

SEQ ID NO: 1076404 - RNA, 22 nt, Human
cuuguggcccauggcuuccugc

SEQ ID NO: 1076405 - RNA, 23 nt, Human
ugcaggugugcagagggcucuug

SEQ ID NO: 1076406 - RNA, 22 nt, Human
aguggcagagcugugucuugaa

SEQ ID NO: 1076407 - RNA, 20 nt, Human
uggagccacagucagguucc

SEQ ID NO: 1076408 - RNA, 22 nt, Human
uucuuucugucaugguguacug

SEQ ID NO: 1076409 - RNA, 22 nt, Human
agagagguuaaggagcucuugu

SEQ ID NO: 1076410 - RNA, 22 nt, Human
aucauguugcucaaaauuaaac

SEQ ID NO: 1076411 - RNA, 22 nt, Human
ggcaaggccuugcccagcauuc

SEQ ID NO: 1076412 - RNA, 22 nt, Human
cagaaucagugacacauguaua

SEQ ID NO: 1076413 - RNA, 22 nt, Human
agaaaaggauugauggaucaga

SEQ ID NO: 1076414 - RNA, 22 nt, Human
aguauuugaucagaugauagua

SEQ ID NO: 1076415 - RNA, 22 nt, Human
caauuucaucuugugcuucaau

SEQ ID NO: 1076416 - RNA, 22 nt, Human
ggcaggcaacggaccacuaguc

SEQ ID NO: 1076417 - RNA, 22 nt, Human
ugcuuuauaaccauuucugugg

SEQ ID NO: 1076418 - RNA, 22 nt, Human
ucuguggccuguguccaagugc

SEQ ID NO: 1076419 - RNA, 22 nt, Human
ucugggcugggagcguguggac

SEQ ID NO: 1076420 - RNA, 22 nt, Human
aguggcagaagccaagucugca

SEQ ID NO: 1076421 - RNA, 22 nt, Human
uuaauacaagcauaugcacaca

SEQ ID NO: 1076422 - RNA, 22 nt, Human
guuuguaaccagaacagagagu

SEQ ID NO: 1076423 - RNA, 22 nt, Human
ucaauucagacugagaaaugau

SEQ ID NO: 1076424 - RNA, 22 nt, Human
gagggcagugaauuuugaagcu

SEQ ID NO: 1076425 - RNA, 22 nt, Human
uggaaggcaugggaacuguucu

SEQ ID NO: 1076426 - RNA, 22 nt, Human
uuucuuguaagauguuuauuaa

SEQ ID NO: 1076427 - RNA, 20 nt, Human
acaauuuccucacuauaugc

SEQ ID NO: 1076428 - RNA, 22 nt, Human
auagcaaaggacaauagucagu

SEQ ID NO: 1076429 - RNA, 22 nt, Human
gaagagcugcucagaacaugau

SEQ ID NO: 1076430 - RNA, 22 nt, Human
aggucauuuuugccuucuauuu

SEQ ID NO: 1076431 - RNA, 22 nt, Human
auuuaaugucgagcuauuguag

SEQ ID NO: 1076432 - RNA, 22 nt, Human
agcagggcaugaauaaggguuu

SEQ ID NO: 1076433 - RNA, 22 nt, Human
aggaaaaaccuguuaaugguag

SEQ ID NO: 1076434 - RNA, 22 nt, Human
ucaauauucuucuuuaguagga

SEQ ID NO: 1076435 - RNA, 22 nt, Human
uaggccagaggagcagcuuugg

SEQ ID NO: 1076436 - RNA, 22 nt, Human
cuggccuuggaagggagcccgu

SEQ ID NO: 1076437 - RNA, 22 nt, Human
agggaggugguuccccagugga

SEQ ID NO: 1076438 - RNA, 22 nt, Human
acacaaugugcaggacaccugu

SEQ ID NO: 1076439 - RNA, 21 nt, Human
uaauacugaaagugacaucug

SEQ ID NO: 1076440 - RNA, 22 nt, Human
uagcagagcagggaucagagcc

SEQ ID NO: 1076441 - RNA, 22 nt, Human
uggaggaaguggcuggccagaa

SEQ ID NO: 1076442 - RNA, 22 nt, Human
acuggcuugaaguagauucaaa

SEQ ID NO: 1076443 - RNA, 22 nt, Human
agauacaacuguuuaaacauua

SEQ ID NO: 1076444 - RNA, 22 nt, Human
aucaauaucagaucagacagga

SEQ ID NO: 1076445 - RNA, 23 nt, Human
gaauacaaagcagaugguccagc

SEQ ID NO: 1076446 - RNA, 22 nt, Human
aagacaggaaaagcuccaggcc

SEQ ID NO: 1076447 - RNA, 22 nt, Human
gagcaggccagcaauggaaggg

SEQ ID NO: 1076448 - RNA, 16 nt, Human
ucuuaguuguguggua

SEQ ID NO: 1076449 - RNA, 22 nt, Human
cagaggacaauagaauggaaag

SEQ ID NO: 1076450 - RNA, 22 nt, Human
uaugcauaauuggauaaguaga

SEQ ID NO: 1076451 - RNA, 22 nt, Human
aagagcagauuccuaguggagc

SEQ ID NO: 1076452 - RNA, 22 nt, Human
aaaggccacugcaagggaaggu

SEQ ID NO: 1076453 - RNA, 22 nt, Human
ccugugcuucagcuggaggagg

SEQ ID NO: 1076454 - RNA, 22 nt, Human
ucacaaaagcuuuugaauuugg

SEQ ID NO: 1076455 - RNA, 22 nt, Human
guuccaaacaagucauaaagua

SEQ ID NO: 1076456 - RNA, 20 nt, Human
uuggaugugcauggccgugc

SEQ ID NO: 1076457 - RNA, 22 nt, Human
ugcauuuuuaacaaggcuaauu

SEQ ID NO: 1076458 - RNA, 22 nt, Human
ccugcagacacuuguccagcaa

SEQ ID NO: 1076459 - RNA, 22 nt, Human
caaauuuagguaacagucugua

SEQ ID NO: 1076460 - RNA, 22 nt, Human
uccugcaggccuguucccagua

SEQ ID NO: 1076461 - RNA, 22 nt, Human
aaugaagccagcugggaugcga

SEQ ID NO: 1076462 - RNA, 22 nt, Human
acacuuuacagaauguuuugau

SEQ ID NO: 1076463 - RNA, 22 nt, Human
cccaagcagggugcagaggcau

SEQ ID NO: 1076464 - RNA, 23 nt, Human
cacaccaggagccgucugggcca

SEQ ID NO: 1076465 - RNA, 22 nt, Human
aaagccaguucuuagagaaagc

SEQ ID NO: 1076466 - RNA, 22 nt, Human
cuggccugagcacagcggcugc

SEQ ID NO: 1076467 - RNA, 19 nt, Human
ccagcccacagugacuuuc

SEQ ID NO: 1076468 - RNA, 22 nt, Human
ccuucaaauucucuuagcugaa

SEQ ID NO: 1076469 - RNA, 19 nt, Human
ccuguucaugacucugucc

SEQ ID NO: 1076470 - RNA, 22 nt, Human
uuccaauugcagaucagauaca

SEQ ID NO: 1076471 - RNA, 22 nt, Human
ggaagggcaaaagagaugaacu

SEQ ID NO: 1076472 - RNA, 22 nt, Human
uaacaguuuugaguuuugcuuc

SEQ ID NO: 1076473 - RNA, 22 nt, Human
gagggucccgagcccugucaga

SEQ ID NO: 1076474 - RNA, 22 nt, Human
ucuggccaggauggcaagacca

SEQ ID NO: 1076475 - RNA, 22 nt, Human
gagccagcgccuugccucuggg

SEQ ID NO: 1076476 - RNA, 22 nt, Human
ucagcauuguggcagagaaugg

SEQ ID NO: 1076477 - RNA, 22 nt, Human
caggagugucuccacacagcaa

SEQ ID NO: 1076478 - RNA, 22 nt, Human
uccugggcuguggccccgggca

SEQ ID NO: 1076479 - RNA, 22 nt, Human
aaacuuuaaauuuguaccucug

SEQ ID NO: 1076480 - RNA, 22 nt, Human
gaagccagcaguggagaaagga

SEQ ID NO: 1076481 - RNA, 20 nt, Human
uaaaugcaucuguucaacug

SEQ ID NO: 1076482 - RNA, 22 nt, Human
ugaagagauuaaguugguuuug

SEQ ID NO: 1076483 - RNA, 22 nt, Human
gggcuccuccucugacuguggc

SEQ ID NO: 1076484 - RNA, 22 nt, Human
ugaggaagaacaagaauuuaga

SEQ ID NO: 1076485 - RNA, 22 nt, Human
gaucuugagcaaguuguguaac

SEQ ID NO: 1076486 - RNA, 22 nt, Human
accuuaaaacugacacauggag

SEQ ID NO: 1076487 - RNA, 22 nt, Human
uucucagagugaccaagucuuu

SEQ ID NO: 1076488 - RNA, 22 nt, Human
cucaaauauaagcuaaaugugg

SEQ ID NO: 1076489 - RNA, 22 nt, Human
cuucacagagucccugauuguu

SEQ ID NO: 1076490 - RNA, 18 nt, Human
uccagagguguuggagcc

SEQ ID NO: 1076491 - RNA, 22 nt, Human
aggagccagcguuccucaggau

SEQ ID NO: 1076492 - RNA, 22 nt, Human
uaacagaaauaguaggugaggg

SEQ ID NO: 1076493 - RNA, 22 nt, Human
ucagauggaggcaauguuaccu

SEQ ID NO: 1076494 - RNA, 22 nt, Human
uccugggaggcugugccuggcu

SEQ ID NO: 1076495 - RNA, 22 nt, Human
uaagacacaugcguacaagaua

SEQ ID NO: 1076496 - RNA, 19 nt, Human
gucucugcuccagggucuc

SEQ ID NO: 1076497 - RNA, 21 nt, Human
gccagagcaguacaaugaggu

SEQ ID NO: 1076498 - RNA, 22 nt, Human
cccugaccccacggcuggagaa

SEQ ID NO: 1076499 - RNA, 23 nt, Human
cccuguagcccaggacaggcuuu

SEQ ID NO: 1076500 - RNA, 22 nt, Human
aguggcaguuugggagcuacag

SEQ ID NO: 1076501 - RNA, 22 nt, Human
ucaggcucuacacuugacacac

SEQ ID NO: 1076502 - RNA, 22 nt, Human
acaggcacucucauuaaaauag

SEQ ID NO: 1076503 - RNA, 22 nt, Human
ggaggccauaguuugggaguca

SEQ ID NO: 1076504 - RNA, 22 nt, Human
uucacauaauccuccaguggca

SEQ ID NO: 1076505 - RNA, 22 nt, Human
aaucuagagacaauuugaauau

SEQ ID NO: 1076506 - RNA, 22 nt, Human
gggcugaaaggccgccucagau

SEQ ID NO: 1076507 - RNA, 22 nt, Human
ucaguggaguauggaugaaguc

SEQ ID NO: 1076508 - RNA, 22 nt, Human
aguguuuuauuucagcacuuug

SEQ ID NO: 1076509 - RNA, 22 nt, Human
agaugaagacucaggagcaggu

SEQ ID NO: 1076510 - RNA, 22 nt, Human
cucuucaguucaccccuaagca

SEQ ID NO: 1076511 - RNA, 22 nt, Human
uggaaaacauugagauaccaag

SEQ ID NO: 1076512 - RNA, 22 nt, Human
uuuacuuugugucaagucaaga

SEQ ID NO: 1076513 - RNA, 20 nt, Human
ggaaaaaugcaugcucaaga

SEQ ID NO: 1076514 - RNA, 22 nt, Human
gcaguaggagaagaggaugcuu

SEQ ID NO: 1076515 - RNA, 19 nt, Human
acagaagcauagaaaagga

SEQ ID NO: 1076516 - RNA, 18 nt, Human
aguuuuuaggaagaaaug

SEQ ID NO: 1076517 - RNA, 19 nt, Human
ucuaaacuagucccauaac

SEQ ID NO: 1076518 - RNA, 22 nt, Human
acagggcaaccucugggagacu

SEQ ID NO: 1076519 - RNA, 22 nt, Human
ggcccugcucaggcugcgauga

SEQ ID NO: 1076520 - RNA, 22 nt, Human
uauagagguggaaacugagguu

SEQ ID NO: 1076521 - RNA, 18 nt, Human
cauaauuuucuuucuuua

SEQ ID NO: 1076522 - RNA, 22 nt, Human
uaguggaggguguagcugcugg

SEQ ID NO: 1076523 - RNA, 22 nt, Human
cuuugcauacaauuuuuagaaa

SEQ ID NO: 1076524 - RNA, 22 nt, Human
aauaucuucuaaggauagaacu

SEQ ID NO: 1076525 - RNA, 22 nt, Human
gggcauggaggucugucugcag

SEQ ID NO: 1076526 - RNA, 22 nt, Human
acagugauuggcacugauucag

SEQ ID NO: 1076527 - RNA, 17 nt, Human
agguggguggaucaccu

SEQ ID NO: 1076528 - RNA, 22 nt, Human
caaugugguggcagaugucagu

SEQ ID NO: 1076529 - RNA, 22 nt, Human
uuacacaugcuuuguguguaug

SEQ ID NO: 1076530 - RNA, 22 nt, Human
cucugagcugaaacaugagcau

SEQ ID NO: 1076531 - RNA, 22 nt, Human
gaaggaaguuuauuuuagaaga

SEQ ID NO: 1076532 - RNA, 22 nt, Human
aagacagaccacgugacagggc

SEQ ID NO: 1076533 - RNA, 22 nt, Human
cgcauacauagaaacacacaga

SEQ ID NO: 1076534 - RNA, 22 nt, Human
cuacauuucccagcugccuucc

SEQ ID NO: 1076535 - RNA, 22 nt, Human
uccagccaagggagguuacuag

SEQ ID NO: 1076536 - RNA, 22 nt, Human
agggaucaaaaaauguacaugc

SEQ ID NO: 1076537 - RNA, 22 nt, Human
gaaaagcuaggccaguucagcu

SEQ ID NO: 1076538 - RNA, 22 nt, Human
cugugcuugcggguguggagcc

SEQ ID NO: 1076539 - RNA, 22 nt, Human
ucagaaaggccacauggugcag

SEQ ID NO: 1076540 - RNA, 22 nt, Human
ccugggcaacauagugagaccu

SEQ ID NO: 1076541 - RNA, 22 nt, Human
aacaugugucuugcauuucuug

SEQ ID NO: 1076542 - RNA, 22 nt, Human
ugaagcuugagugucaguuccu

SEQ ID NO: 1076543 - RNA, 23 nt, Human
uaaauuucuugauucuuauguga

SEQ ID NO: 1076544 - RNA, 23 nt, Human
auggaaauagcaugugucauuua

SEQ ID NO: 1076545 - RNA, 22 nt, Human
gguggcucaaagagagcacaga

SEQ ID NO: 1076546 - RNA, 22 nt, Human
ugcugcuccccagcacacagca

SEQ ID NO: 1076547 - RNA, 22 nt, Human
ugggcucaugcuggagaugaga

SEQ ID NO: 1076548 - RNA, 20 nt, Human
caggaugauuggacacgaug

SEQ ID NO: 1076549 - RNA, 22 nt, Human
gcuggggagcaagaguagugag

SEQ ID NO: 1076550 - RNA, 22 nt, Human
gccagcucagaugcaggaagga

SEQ ID NO: 1076551 - RNA, 22 nt, Human
acauuuauuuuggcacggcaca

SEQ ID NO: 1076552 - RNA, 22 nt, Human
uggcagaguaggauggcccugu

SEQ ID NO: 1076553 - RNA, 18 nt, Human
uucacaggaaaugucuuu

SEQ ID NO: 1076554 - RNA, 22 nt, Human
gaauuagguaauagaacuagua

SEQ ID NO: 1076555 - RNA, 22 nt, Human
guuucacacauccugcacauag

SEQ ID NO: 1076556 - RNA, 22 nt, Human
uucaguaucugcaaaaugggga

SEQ ID NO: 1076557 - RNA, 22 nt, Human
aggcagcaaugaaugaaaugga

SEQ ID NO: 1076558 - RNA, 22 nt, Human
cucaggauauugggcuggagca

SEQ ID NO: 1076559 - RNA, 22 nt, Human
acuuuucugcagaugaucucuu

SEQ ID NO: 1076560 - RNA, 22 nt, Human
cugccuggaaggagcaagggga

SEQ ID NO: 1076561 - RNA, 22 nt, Human
uccaaacgggagccaaaugagc

SEQ ID NO: 1076562 - RNA, 22 nt, Human
cagcuccugcagcuggcuccca

SEQ ID NO: 1076563 - RNA, 22 nt, Human
ccugucugcaagggguggaucc

SEQ ID NO: 1076564 - RNA, 22 nt, Human
ccuggagcacagcccaguccca

SEQ ID NO: 1076565 - RNA, 22 nt, Human
caggaaacauucccauaacaca

SEQ ID NO: 1076566 - RNA, 21 nt, Human
ugggcacugagggugcugcuc

SEQ ID NO: 1076567 - RNA, 22 nt, Human
acugccuguagcucuucaucuc

SEQ ID NO: 1076568 - RNA, 22 nt, Human
uguccucagauaugucuacucu

SEQ ID NO: 1076569 - RNA, 22 nt, Human
ccuccaggauaagucagggccu

SEQ ID NO: 1076570 - RNA, 22 nt, Human
caaagcagccugcaguguggac

SEQ ID NO: 1076571 - RNA, 22 nt, Human
caucacagguccugaugacauu

SEQ ID NO: 1076572 - RNA, 22 nt, Human
ugccugggaaccaauccuggcu

SEQ ID NO: 1076573 - RNA, 22 nt, Human
aucuggcucauucagggaacgg

SEQ ID NO: 1076574 - RNA, 22 nt, Human
uagaaaagauaacauucugugc

SEQ ID NO: 1076575 - RNA, 22 nt, Human
ccuggccagccagggcuggggu

SEQ ID NO: 1076576 - RNA, 22 nt, Human
uggccaggcuggucuggaacgc

SEQ ID NO: 1076577 - RNA, 22 nt, Human
uggaaaaugugacuauucuaaa

SEQ ID NO: 1076578 - RNA, 22 nt, Human
aguggcugcuggaguggagaug

SEQ ID NO: 1076579 - RNA, 22 nt, Human
cugcccugggugcuggggaucc

SEQ ID NO: 1076580 - RNA, 22 nt, Human
acaauauuguacccagaaguuu

SEQ ID NO: 1076581 - RNA, 22 nt, Human
gcacagaagagcuuuggaauga

SEQ ID NO: 1076582 - RNA, 22 nt, Human
uccugaggaaaguucaugaaug

SEQ ID NO: 1076583 - RNA, 20 nt, Human
cugcccugcccuggguccug

SEQ ID NO: 1076584 - RNA, 22 nt, Human
ggcucuugggagcucagaguug

SEQ ID NO: 1076585 - RNA, 23 nt, Human
acaggcucuuaaucagugcuccu

SEQ ID NO: 1076586 - RNA, 22 nt, Human
ugggacagguuggagagaagca

SEQ ID NO: 1076587 - RNA, 22 nt, Human
agcugccuccauggucaaagau

SEQ ID NO: 1076588 - RNA, 22 nt, Human
ucacacagugguaaaacccuga

SEQ ID NO: 1076589 - RNA, 22 nt, Human
agggcugcugaggaagccuugc

SEQ ID NO: 1076590 - RNA, 22 nt, Human
gccaagcuguuuuucagagacg

SEQ ID NO: 1076591 - RNA, 22 nt, Human
uaaguuagcaaggccaagguaa

SEQ ID NO: 1076592 - RNA, 22 nt, Human
ugaggcucacaaaucugcauuu

SEQ ID NO: 1076593 - RNA, 19 nt, Human
acacauuugcacaauccac

SEQ ID NO: 1076594 - RNA, 22 nt, Human
ggcugagcucaggggcagcagg

SEQ ID NO: 1076595 - RNA, 22 nt, Human
caagaaauuucuuaagaacuaa

SEQ ID NO: 1076596 - RNA, 19 nt, Human
uuagccauccacagugaaa

SEQ ID NO: 1076597 - RNA, 22 nt, Human
cuccauugaacauccucucaga

SEQ ID NO: 1076598 - RNA, 22 nt, Human
guuucuuuugugaucaccaacc

SEQ ID NO: 1076599 - RNA, 18 nt, Human
ccugagcccugcuuacuu

SEQ ID NO: 1076600 - RNA, 22 nt, Human
gaucauuuacuuguucuggacu

SEQ ID NO: 1076601 - RNA, 22 nt, Human
cugugggcugaaagugcucccg

SEQ ID NO: 1076602 - RNA, 22 nt, Human
aaauuauugggucccaccccag

SEQ ID NO: 1076603 - RNA, 20 nt, Human
aguuauaguaucuagccaug

SEQ ID NO: 1076604 - RNA, 22 nt, Human
ugguccugucucaaggagccuu

SEQ ID NO: 1076605 - RNA, 22 nt, Human
ccaggugugccagcagggacug

SEQ ID NO: 1076606 - RNA, 22 nt, Human
uugcuaaauguguuauaucugu

SEQ ID NO: 1076607 - RNA, 22 nt, Human
aggagucauaaaugugaacaaa

SEQ ID NO: 1076608 - RNA, 22 nt, Human
uccaggaaugugugugggcuag

SEQ ID NO: 1076609 - RNA, 22 nt, Human
agcagggccaacaguaaacacc

SEQ ID NO: 1076610 - RNA, 22 nt, Human
ccacagggaacaugacagccuu

SEQ ID NO: 1076611 - RNA, 17 nt, Human
gcagccagugcagcagg

SEQ ID NO: 1076612 - RNA, 22 nt, Human
acacugaauauacaaugaauau

SEQ ID NO: 1076613 - RNA, 22 nt, Human
gcuagaggcaacaacuuuauag

SEQ ID NO: 1076614 - RNA, 22 nt, Human
uuugcauaagucauguccagug

SEQ ID NO: 1076615 - RNA, 22 nt, Human
aucagcaagauguaauuucuau

SEQ ID NO: 1076616 - RNA, 22 nt, Human
aggagccaagauggggcaagua

SEQ ID NO: 1076617 - RNA, 22 nt, Human
ggcugcagcagagggacucacg

SEQ ID NO: 1076618 - RNA, 22 nt, Human
aggagccccucuucaguccugg

SEQ ID NO: 1076619 - RNA, 22 nt, Human
gugggcuggacccuccugcucc

SEQ ID NO: 1076620 - RNA, 22 nt, Human
acagauuuuugguaaauaauuu

SEQ ID NO: 1076621 - RNA, 22 nt, Human
gcuaggaggaagaaugugaauu

SEQ ID NO: 1076622 - RNA, 22 nt, Human
caggcccaggccagugguuccc

SEQ ID NO: 1076623 - RNA, 22 nt, Human
ugugggcacuaaugacaugcag

SEQ ID NO: 1076624 - RNA, 22 nt, Human
gcaggcagaucaccugucagga

SEQ ID NO: 1076625 - RNA, 22 nt, Human
aauauguucaaaauagaucacu

SEQ ID NO: 1076626 - RNA, 18 nt, Human
uggagcagguaggcauga

SEQ ID NO: 1076627 - RNA, 22 nt, Human
ucucuucuaauuaggguccaug

SEQ ID NO: 1076628 - RNA, 22 nt, Human
cuguggcauugugaggacugca

SEQ ID NO: 1076629 - RNA, 22 nt, Human
uuucuaaggcuaggucuuaagg

SEQ ID NO: 1076630 - RNA, 22 nt, Human
agcagguguaucggucaccuac

SEQ ID NO: 1076631 - RNA, 22 nt, Human
gcuuccugagaaacaaucugau

SEQ ID NO: 1076632 - RNA, 22 nt, Human
aaagcagaggugauaugacuua

SEQ ID NO: 1076633 - RNA, 22 nt, Human
uaaaggaagaauucucugugau

SEQ ID NO: 1076634 - RNA, 22 nt, Human
agcccaggagguggagguugca

SEQ ID NO: 1076635 - RNA, 22 nt, Human
augggcugaaagaguaagcugu

SEQ ID NO: 1076636 - RNA, 22 nt, Human
aaguggacuaauacaaggacua

SEQ ID NO: 1076637 - RNA, 20 nt, Human
aguaggggaaugcaagagca

SEQ ID NO: 1076638 - RNA, 22 nt, Human
ucccagaguuuccuguguccca

SEQ ID NO: 1076639 - RNA, 22 nt, Human
uccugccuugccugggacauca

SEQ ID NO: 1076640 - RNA, 22 nt, Human
uaagcugugggagauuggcaua

SEQ ID NO: 1076641 - RNA, 22 nt, Human
ugucaccucuuuggcugcagcu

SEQ ID NO: 1076642 - RNA, 22 nt, Human
uaaaggcaugcaggugaaugua

SEQ ID NO: 1076643 - RNA, 22 nt, Human
aggaacacuuaauucgauacua

SEQ ID NO: 1076644 - RNA, 22 nt, Human
uaguuuuauaauguuaacaucu

SEQ ID NO: 1076645 - RNA, 22 nt, Human
uacaugaaguugucuaaacugg

SEQ ID NO: 1076646 - RNA, 22 nt, Human
aggagcagcuucugaaccaugu

SEQ ID NO: 1076647 - RNA, 22 nt, Human
caaggccauauugccuguaugu

SEQ ID NO: 1076648 - RNA, 22 nt, Human
uaugagaaaggagaaugacuuu

SEQ ID NO: 1076649 - RNA, 22 nt, Human
agcccagaaaugaaaggaugau

SEQ ID NO: 1076650 - RNA, 22 nt, Human
ucugggcccuaaaccagcucua

SEQ ID NO: 1076651 - RNA, 22 nt, Human
uucacauuaagccuccuccuac

SEQ ID NO: 1076652 - RNA, 22 nt, Human
aggcaguuuaggcagcgauuua

SEQ ID NO: 1076653 - RNA, 22 nt, Human
ugcccugcugugccuggagcca

SEQ ID NO: 1076654 - RNA, 22 nt, Human
augacagaggagugcaggugau

SEQ ID NO: 1076655 - RNA, 22 nt, Human
ggagagagagauuguguuuauu

SEQ ID NO: 1076656 - RNA, 22 nt, Human
guggggggacguuggucacuuu

SEQ ID NO: 1076657 - RNA, 22 nt, Human
cacacaucaaccuagacauugu

SEQ ID NO: 1076658 - RNA, 19 nt, Human
ccacagagcaugcugaggc

SEQ ID NO: 1076659 - RNA, 22 nt, Human
auaaagcaaauaggacuauugc

SEQ ID NO: 1076660 - RNA, 22 nt, Human
caagcuggcugggagaggcacg

SEQ ID NO: 1076661 - RNA, 22 nt, Human
aaggcacuacgcugcuggggcg

SEQ ID NO: 1076662 - RNA, 22 nt, Human
uaaguucaguuggucgaaguag

SEQ ID NO: 1076663 - RNA, 22 nt, Human
ggggaggcugaugugggcaaag

SEQ ID NO: 1076664 - RNA, 22 nt, Human
gaggcagcagaacauggaagag

SEQ ID NO: 1076665 - RNA, 22 nt, Human
aucuucaaagaauuucuugucc

SEQ ID NO: 1076666 - RNA, 22 nt, Human
gcccucccuacagccuauuucu

SEQ ID NO: 1076667 - RNA, 22 nt, Human
uccuggcucugcugccuccuag

SEQ ID NO: 1076668 - RNA, 22 nt, Human
aaaugcuuauuagugucacaaa

SEQ ID NO: 1076669 - RNA, 22 nt, Human
cccucaguuuuccagugugggc

SEQ ID NO: 1076670 - RNA, 22 nt, Human
gaugugagugguagcugggauu

SEQ ID NO: 1076671 - RNA, 22 nt, Human
cacccaggcagguggcugagaa

SEQ ID NO: 1076672 - RNA, 22 nt, Human
aaaagagcaaacauguaauagu

SEQ ID NO: 1076673 - RNA, 22 nt, Human
ugccuuggugcuucuucaugug

SEQ ID NO: 1076674 - RNA, 22 nt, Human
acagguggcagaagcauuuacu

SEQ ID NO: 1076675 - RNA, 22 nt, Human
cagggccucucaucccacgggc

SEQ ID NO: 1076676 - RNA, 22 nt, Human
agcccugcaggaugagggaggu

SEQ ID NO: 1076677 - RNA, 22 nt, Human
ggugggaaauaauuaggauuau

SEQ ID NO: 1076678 - RNA, 22 nt, Human
gccuggcucugagggagcuccu

SEQ ID NO: 1076679 - RNA, 22 nt, Human
uaggugggugacuuccaugggg

SEQ ID NO: 1076680 - RNA, 22 nt, Human
auuucaucccaggcucuggaag

SEQ ID NO: 1076681 - RNA, 22 nt, Human
acaaaguccugguguauggcca

SEQ ID NO: 1076682 - RNA, 22 nt, Human
gccagagcugagugagguucuu

SEQ ID NO: 1076683 - RNA, 22 nt, Human
caggcagccaggggaccugucc

SEQ ID NO: 1076684 - RNA, 22 nt, Human
gucauucuccaagaacccgcug

SEQ ID NO: 1076685 - RNA, 22 nt, Human
gucuugaucuccugaccuugug

SEQ ID NO: 1076686 - RNA, 22 nt, Human
uagaaucugaauauucuuauuu

SEQ ID NO: 1076687 - RNA, 22 nt, Human
aauguuacgaucaacaacacau

SEQ ID NO: 1076688 - RNA, 22 nt, Human
ucuuugaauuucugacugucuu

SEQ ID NO: 1076689 - RNA, 22 nt, Human
ggcagggucuggacugaaagcu

SEQ ID NO: 1076690 - RNA, 22 nt, Human
gaggccuggguuggaggugcau

SEQ ID NO: 1076691 - RNA, 22 nt, Human
uacagauacagaucuagauaca

SEQ ID NO: 1076692 - RNA, 22 nt, Human
gcacccaggccggcgacugcag

SEQ ID NO: 1076693 - RNA, 22 nt, Human
acacacuguaaggacuaucacu

SEQ ID NO: 1076694 - RNA, 22 nt, Human
gcugucuguucgagcguguguu

SEQ ID NO: 1076695 - RNA, 22 nt, Human
aggcucagggacggggccccuu

SEQ ID NO: 1076696 - RNA, 22 nt, Human
gacaggggucccucugggcugu

SEQ ID NO: 1076697 - RNA, 22 nt, Human
cuccuuccccuacucagcaucc

SEQ ID NO: 1076698 - RNA, 22 nt, Human
gacuguguccaugugcuggauu

SEQ ID NO: 1076699 - RNA, 22 nt, Human
agcugggagcagagccacagcc

SEQ ID NO: 1076700 - RNA, 22 nt, Human
gcacccagaggucagcagugcu

SEQ ID NO: 1076701 - RNA, 22 nt, Human
uauacucugagaaacgugucac

SEQ ID NO: 1076702 - RNA, 22 nt, Human
guauaucaggcagaauguucuc

SEQ ID NO: 1076703 - RNA, 22 nt, Human
uugaauaguguuuucaguauac

SEQ ID NO: 1076704 - RNA, 21 nt, Human
uuucccagcugaaaauaaaug

SEQ ID NO: 1076705 - RNA, 22 nt, Human
aaucuaacuucauagcugauuu

SEQ ID NO: 1076706 - RNA, 23 nt, Human
agucuuaauacagcucuuuucua

SEQ ID NO: 1076707 - RNA, 22 nt, Human
uugaaacugggaagcagggggu

SEQ ID NO: 1076708 - RNA, 22 nt, Human
uguucauucgcuauugucuaug

SEQ ID NO: 1076709 - RNA, 22 nt, Human
uagauuucgcugcaucucaauc

SEQ ID NO: 1076710 - RNA, 21 nt, Human
uggcucuggguaggagagugc

SEQ ID NO: 1076711 - RNA, 22 nt, Human
gcagggcuaauggggcaaguag

SEQ ID NO: 1076712 - RNA, 22 nt, Human
ggcucugggucuguggggagcg

SEQ ID NO: 1076713 - RNA, 22 nt, Human
ggccagggccaaggcuuuccca

SEQ ID NO: 1076714 - RNA, 22 nt, Human
acugggccaggugugggugagu

SEQ ID NO: 1076715 - RNA, 22 nt, Human
ucagacccaggugccaagcugu

SEQ ID NO: 1076716 - RNA, 22 nt, Human
ccaggcccuugcaagucccacc

SEQ ID NO: 1076717 - RNA, 22 nt, Human
cccaggagagaggccaguuggc

SEQ ID NO: 1076718 - RNA, 22 nt, Human
aucagaaugcagccagcaguua

SEQ ID NO: 1076719 - RNA, 22 nt, Human
aagaguuucuuuauuaaccuuu

SEQ ID NO: 1076720 - RNA, 22 nt, Human
uucuguauuuaguuugaggaca

SEQ ID NO: 1076721 - RNA, 22 nt, Human
ugccugaggagucagggcaggu

SEQ ID NO: 1076722 - RNA, 22 nt, Human
cuuuucuuguauuggaugcccc

SEQ ID NO: 1076723 - RNA, 22 nt, Human
ucacagaagaugcuggauguug

SEQ ID NO: 1076724 - RNA, 19 nt, Human
uccaggccauucccagagc

SEQ ID NO: 1076725 - RNA, 19 nt, Human
uucauuuguaucugcucac

SEQ ID NO: 1076726 - RNA, 22 nt, Human
aaagaacuuauccuagaauuug

SEQ ID NO: 1076727 - RNA, 22 nt, Human
uguuuaagcugaugagguaucg

SEQ ID NO: 1076728 - RNA, 22 nt, Human
caaauacaaauacgggcagcuu

SEQ ID NO: 1076729 - RNA, 22 nt, Human
cuuuggaauauuuuauugagaa

SEQ ID NO: 1076730 - RNA, 22 nt, Human
ugccugugucacagugauguuu

SEQ ID NO: 1076731 - RNA, 22 nt, Human
caguucuuuguggggaguucuc

SEQ ID NO: 1076732 - RNA, 22 nt, Human
uggaaguggcagaaaaugaaca

SEQ ID NO: 1076733 - RNA, 22 nt, Human
cucucuucccgugaguguugca

SEQ ID NO: 1076734 - RNA, 22 nt, Human
augaaacuaaacuacauaaguu

SEQ ID NO: 1076735 - RNA, 22 nt, Human
ccucagggccaucucugucccu

SEQ ID NO: 1076736 - RNA, 22 nt, Human
uggcugcagaucaagggcaggc

SEQ ID NO: 1076737 - RNA, 22 nt, Human
gcuucugguagaauucaauaga

SEQ ID NO: 1076738 - RNA, 22 nt, Human
gggaggcuggcucuggccacag

SEQ ID NO: 1076739 - RNA, 22 nt, Human
gcccagcuccucugcagacccu

SEQ ID NO: 1076740 - RNA, 23 nt, Human
cccagcgcugagcccugcaggca

SEQ ID NO: 1076741 - RNA, 22 nt, Human
gcagagcugggucuguauccaa

SEQ ID NO: 1076742 - RNA, 22 nt, Human
gaguucuguagggugaaauagu

SEQ ID NO: 1076743 - RNA, 22 nt, Human
agcagccacagucugggacagg

SEQ ID NO: 1076744 - RNA, 22 nt, Human
caugaaaauaacauuguuguga

SEQ ID NO: 1076745 - RNA, 22 nt, Human
cugagacccagacaccugagga

SEQ ID NO: 1076746 - RNA, 22 nt, Human
ucauucauaucucucaagcuua

SEQ ID NO: 1076747 - RNA, 22 nt, Human
agaaaguucugugaguuguuca

SEQ ID NO: 1076748 - RNA, 22 nt, Human
gggcagcaugucacuagcaugg

SEQ ID NO: 1076749 - RNA, 22 nt, Human
uauauuaaaugaccaguuuuaa

SEQ ID NO: 1076750 - RNA, 22 nt, Human
uuagagucaagcugcauguucu

SEQ ID NO: 1076751 - RNA, 22 nt, Human
aaugagaaccuugaaaggaacu

SEQ ID NO: 1076752 - RNA, 21 nt, Human
gcccccuggacuccucaucca

SEQ ID NO: 1076753 - RNA, 22 nt, Human
gaguccagacaccauaccugau

SEQ ID NO: 1076754 - RNA, 22 nt, Human
aauggccagcaacaggagugaa

SEQ ID NO: 1076755 - RNA, 22 nt, Human
uacugugaauacaaaauaaauu

SEQ ID NO: 1076756 - RNA, 22 nt, Human
cuauuauuuccucaucuauaaa

SEQ ID NO: 1076757 - RNA, 22 nt, Human
aacauauaaacucuuaaguuca

SEQ ID NO: 1076758 - RNA, 22 nt, Human
agaugcugucacacacacuguu

SEQ ID NO: 1076759 - RNA, 22 nt, Human
ucacacagcugacagagccuuu

SEQ ID NO: 1076760 - RNA, 19 nt, Human
ucugaaguccagggcauac

SEQ ID NO: 1076761 - RNA, 22 nt, Human
gggcccuggauuuaagcaugga

SEQ ID NO: 1076762 - RNA, 22 nt, Human
agguggcugagcugugccccug

SEQ ID NO: 1076763 - RNA, 22 nt, Human
ucaauucugguccucaggaacu

SEQ ID NO: 1076764 - RNA, 23 nt, Human
uggcagugaucaaaagcuuacau

SEQ ID NO: 1076765 - RNA, 22 nt, Human
aauuaacuaaaauucacuuuau

SEQ ID NO: 1076766 - RNA, 22 nt, Human
aggccaaagcacagagcuggaa

SEQ ID NO: 1076767 - RNA, 22 nt, Human
uggcagcugauuagauggugcc

SEQ ID NO: 1076768 - RNA, 19 nt, Human
cauauuuuugggcuggcau

SEQ ID NO: 1076769 - RNA, 22 nt, Human
cagcagugucuccagcaucaca

SEQ ID NO: 1076770 - RNA, 22 nt, Human
uugcccugcggguccugcgcaa

SEQ ID NO: 1076771 - RNA, 22 nt, Human
ucuggcucccuggagcuccaca

SEQ ID NO: 1076772 - RNA, 22 nt, Human
agaauucuccuucagggcagga

SEQ ID NO: 1076773 - RNA, 22 nt, Human
acaauagaaggaaacugacaua

SEQ ID NO: 1076774 - RNA, 19 nt, Human
agccaggguccagacaugu

SEQ ID NO: 1076775 - RNA, 17 nt, Human
ucauuucaguaaaucca

SEQ ID NO: 1076776 - RNA, 22 nt, Human
gagcagugaagacagaaguaca

SEQ ID NO: 1076777 - RNA, 22 nt, Human
ggggugggcgugcagggacacc

SEQ ID NO: 1076778 - RNA, 22 nt, Human
agaugaaagauuuuuauagaga

SEQ ID NO: 1076779 - RNA, 22 nt, Human
ccagagugacgugaagugugaa

SEQ ID NO: 1076780 - RNA, 22 nt, Human
gugccuggcaugcgccggugcu

SEQ ID NO: 1076781 - RNA, 22 nt, Human
caggaguccagagugucauuuu

SEQ ID NO: 1076782 - RNA, 22 nt, Human
ugggauggcauccugggccuug

SEQ ID NO: 1076783 - RNA, 22 nt, Human
cuggagagggagcccuggcagu

SEQ ID NO: 1076784 - RNA, 23 nt, Human
ccuggcuguggauuugggccugc

SEQ ID NO: 1076785 - RNA, 22 nt, Human
cagaggaggccaccgcauaggc

SEQ ID NO: 1076786 - RNA, 22 nt, Human
aguaaaucagaccucauuaugu

SEQ ID NO: 1076787 - RNA, 20 nt, Human
caucagaaauccugacccac

SEQ ID NO: 1076788 - RNA, 23 nt, Human
cuuuccuuucuuugacacccagc

SEQ ID NO: 1076789 - RNA, 20 nt, Human
aagagcauaguacaggaaga

SEQ ID NO: 1076790 - RNA, 22 nt, Human
ucagagaugcagugccaccuac

SEQ ID NO: 1076791 - RNA, 22 nt, Human
gaaaaucugcuuauauuauuuu

SEQ ID NO: 1076792 - RNA, 22 nt, Human
aaguuuuauuggaacauagcca

SEQ ID NO: 1076793 - RNA, 22 nt, Human
agggcccuccccgcucagggca

SEQ ID NO: 1076794 - RNA, 22 nt, Human
gcacagagggcagugagccucu

SEQ ID NO: 1076795 - RNA, 22 nt, Human
uggcucaguuucugcccagcug

SEQ ID NO: 1076796 - RNA, 22 nt, Human
ggagcugcauuuagggagccuu

SEQ ID NO: 1076797 - RNA, 22 nt, Human
cauaucauaggucuuggauaau

SEQ ID NO: 1076798 - RNA, 23 nt, Human
uauugcacacauagaaacauaga

SEQ ID NO: 1076799 - RNA, 22 nt, Human
aagcugaaucugaaauagaauu

SEQ ID NO: 1076800 - RNA, 22 nt, Human
ucacaucucccuggaggacaca

SEQ ID NO: 1076801 - RNA, 22 nt, Human
agccagcagggcuuagaggaca

SEQ ID NO: 1076802 - RNA, 22 nt, Human
cugucucagcaggaagucauca

SEQ ID NO: 1076803 - RNA, 22 nt, Human
uauuuggagccuauccauagau

SEQ ID NO: 1076804 - RNA, 21 nt, Human
accucaagcaacaaccaaggu

SEQ ID NO: 1076805 - RNA, 22 nt, Human
ucauuuauuuauaccauugccu

SEQ ID NO: 1076806 - RNA, 22 nt, Human
ggcugagcuuuucaugaugguu

SEQ ID NO: 1076807 - RNA, 22 nt, Human
agcacuagagccaaaauuuggg

SEQ ID NO: 1076808 - RNA, 22 nt, Human
uuaaguaagaccuuaugucuug

SEQ ID NO: 1076809 - RNA, 22 nt, Human
ccuaagaucugguaugugacag

SEQ ID NO: 1076810 - RNA, 22 nt, Human
gcuuuacauaaacauuuauuau

SEQ ID NO: 1076811 - RNA, 22 nt, Human
aucuacagcugucugcacagua

SEQ ID NO: 1076812 - RNA, 22 nt, Human
acaggcucuggggcaggauggc

SEQ ID NO: 1076813 - RNA, 17 nt, Human
gccucugcuugugucau

SEQ ID NO: 1076814 - RNA, 22 nt, Human
aggccugggucucgugccuacc

SEQ ID NO: 1076815 - RNA, 22 nt, Human
cauaaaauggcuuguucuuuaa

SEQ ID NO: 1076816 - RNA, 23 nt, Human
agggcccaagccuggacagcagg

SEQ ID NO: 1076817 - RNA, 19 nt, Human
aggucauugauagugcagg

SEQ ID NO: 1076818 - RNA, 22 nt, Human
cugagucucccggcaguggagg

SEQ ID NO: 1076819 - RNA, 22 nt, Human
gcuuuggagccuguguucugcc

SEQ ID NO: 1076820 - RNA, 22 nt, Human
agcacuuaugugauuaggacag

SEQ ID NO: 1076821 - RNA, 22 nt, Human
cugaaaauguuacacaggaaga

SEQ ID NO: 1076822 - RNA, 20 nt, Human
agucucuguagugccugaga

SEQ ID NO: 1076823 - RNA, 22 nt, Human
ggagcagagcauuucacagccu

SEQ ID NO: 1076824 - RNA, 22 nt, Human
ucuuuccucugagcuccuguag

SEQ ID NO: 1076825 - RNA, 19 nt, Human
uugaauaugcaaacugaag

SEQ ID NO: 1076826 - RNA, 22 nt, Human
aacaagaacaccuacaguucua

SEQ ID NO: 1076827 - RNA, 22 nt, Human
gugccucagcaccgccugcagc

SEQ ID NO: 1076828 - RNA, 22 nt, Human
ucauuuucaaguuugaacagga

SEQ ID NO: 1076829 - RNA, 22 nt, Human
agaugagggguagaaaggacuu

SEQ ID NO: 1076830 - RNA, 22 nt, Human
ugccaaggagcuggaucagggc

SEQ ID NO: 1076831 - RNA, 22 nt, Human
gucccagaaacauauugcuggu

SEQ ID NO: 1076832 - RNA, 22 nt, Human
ugccugucuuaauaucuggaaa

SEQ ID NO: 1076833 - RNA, 20 nt, Human
agggcagagggauuacaggc

SEQ ID NO: 1076834 - RNA, 22 nt, Human
uggcugagaaaaaagagcuaua

SEQ ID NO: 1076835 - RNA, 18 nt, Human
gcuuccugaaagcugccc

SEQ ID NO: 1076836 - RNA, 22 nt, Human
gucccaggugggcuccaccucu

SEQ ID NO: 1076837 - RNA, 22 nt, Human
gagaaaugcaugcaugucauca

SEQ ID NO: 1076838 - RNA, 22 nt, Human
ucacaaagggagggauagcugg

SEQ ID NO: 1076839 - RNA, 22 nt, Human
agcagggcaguuaaaggguccu

SEQ ID NO: 1076840 - RNA, 22 nt, Human
uggugcaagucucugaggaggg

SEQ ID NO: 1076841 - RNA, 21 nt, Human
acagagccgggcacaaagcug

SEQ ID NO: 1076842 - RNA, 22 nt, Human
uuggcaguagucucggcuaccc

SEQ ID NO: 1076843 - RNA, 22 nt, Human
uguguucagcaggcaccuucuu

SEQ ID NO: 1076844 - RNA, 22 nt, Human
aaaagagaauccuguacagaga

SEQ ID NO: 1076845 - RNA, 22 nt, Human
gcugcccugucugcagcaggac

SEQ ID NO: 1076846 - RNA, 22 nt, Human
aggcuuccucgugccuuagaua

SEQ ID NO: 1076847 - RNA, 22 nt, Human
uggccugcagaggcuguggggc

SEQ ID NO: 1076848 - RNA, 19 nt, Human
uugagaaaugggaaaagca

SEQ ID NO: 1076849 - RNA, 22 nt, Human
gaugcugcucgggugccuggga

SEQ ID NO: 1076850 - RNA, 22 nt, Human
caagcucugggauagcagagag

SEQ ID NO: 1076851 - RNA, 22 nt, Human
ccaaagugcugagauuacaggu

SEQ ID NO: 1076852 - RNA, 22 nt, Human
gaggaggguuggccuuagguag

SEQ ID NO: 1076853 - RNA, 22 nt, Human
uacuugcuggguguaauuuucu

SEQ ID NO: 1076854 - RNA, 22 nt, Human
ccugcuggacguggaggagggg

SEQ ID NO: 1076855 - RNA, 21 nt, Human
ucugucucuccacugcccugc

SEQ ID NO: 1076856 - RNA, 22 nt, Human
agauggggcucaguguggaggc

SEQ ID NO: 1076857 - RNA, 20 nt, Human
ccagcugagccaaggggaga

SEQ ID NO: 1076858 - RNA, 22 nt, Human
caugaaauguguuaaucucuug

SEQ ID NO: 1076859 - RNA, 22 nt, Human
cugccuggaugaauggcgccuu

SEQ ID NO: 1076860 - RNA, 22 nt, Human
uacaacauaacgggcauucagu

SEQ ID NO: 1076861 - RNA, 22 nt, Human
cugcuuccaugcaauggcaguc

SEQ ID NO: 1076862 - RNA, 22 nt, Human
gaacagguaaucaguaaaaugu

SEQ ID NO: 1076863 - RNA, 22 nt, Human
gaaggaaaaauacucuguaagg

SEQ ID NO: 1076864 - RNA, 22 nt, Human
caugggcugugaacccaggcug

SEQ ID NO: 1076865 - RNA, 18 nt, Human
cguuuuuccgggauugca

SEQ ID NO: 1076866 - RNA, 22 nt, Human
acaggcagcgucauugcugcuc

SEQ ID NO: 1076867 - RNA, 22 nt, Human
agacacagugaguuucuuuccc

SEQ ID NO: 1076868 - RNA, 22 nt, Human
uacauugacuuggauuguuaga

SEQ ID NO: 1076869 - RNA, 22 nt, Human
cucaaauauguggucagaaagc

SEQ ID NO: 1076870 - RNA, 17 nt, Human
cugagcauccgugcucu

SEQ ID NO: 1076871 - RNA, 22 nt, Human
caauagaaaacucaauacuuaa

SEQ ID NO: 1076872 - RNA, 22 nt, Human
gaucuuuacuacugccuucucu

SEQ ID NO: 1076873 - RNA, 22 nt, Human
uuauuaugugcuagagaaugua

SEQ ID NO: 1076874 - RNA, 18 nt, Human
gucauugcaacauacugu

SEQ ID NO: 1076875 - RNA, 22 nt, Human
caggcugcagugcaguggcuau

SEQ ID NO: 1076876 - RNA, 22 nt, Human
auuucacagcgugguugacugc

SEQ ID NO: 1076877 - RNA, 22 nt, Human
gaacaaauucucaucaacuugu

SEQ ID NO: 1076878 - RNA, 22 nt, Human
aaggcagcucagcucauggcag

SEQ ID NO: 1076879 - RNA, 17 nt, Human
acaacagaaauguauuc

SEQ ID NO: 1076880 - RNA, 22 nt, Human
ccugggaagcccauagcagcuu

SEQ ID NO: 1076881 - RNA, 22 nt, Human
uggcccagugcuuaugcucuga

SEQ ID NO: 1076882 - RNA, 22 nt, Human
aguuuccaaaaggagacaggga

SEQ ID NO: 1076883 - RNA, 22 nt, Human
uuucugaagauacagcuuugcu

SEQ ID NO: 1076884 - RNA, 18 nt, Human
caggugggucuccugccc

SEQ ID NO: 1076885 - RNA, 22 nt, Human
auucugauaucuuauucuagcu

SEQ ID NO: 1076886 - RNA, 22 nt, Human
aggugaguuacaggaggagguc

SEQ ID NO: 1076887 - RNA, 22 nt, Human
gcuguccucugaucucuggagg

SEQ ID NO: 1076888 - RNA, 22 nt, Human
aauguugauguuuucagugagc

SEQ ID NO: 1076889 - RNA, 21 nt, Human
ccagagagagggaaguggguu

SEQ ID NO: 1076890 - RNA, 22 nt, Human
uccuuacaugcuuccuuauaca

SEQ ID NO: 1076891 - RNA, 19 nt, Human
gggguggcuggggcuccag

SEQ ID NO: 1076892 - RNA, 22 nt, Human
ggggaccuggccacccauccuu

SEQ ID NO: 1076893 - RNA, 20 nt, Human
gcucccugguagaaauguuu

SEQ ID NO: 1076894 - RNA, 22 nt, Human
ucagaaagcugauucuugauac

SEQ ID NO: 1076895 - RNA, 22 nt, Human
uauacacauccuccaaagauag

SEQ ID NO: 1076896 - RNA, 22 nt, Human
ugcuucugaaaugcaggucuuc

SEQ ID NO: 1076897 - RNA, 22 nt, Human
uuugcuuugggagguugucugg

SEQ ID NO: 1076898 - RNA, 21 nt, Human
cucaggauggcggccuggugg

SEQ ID NO: 1076899 - RNA, 22 nt, Human
uggagagcaagucgcagacaug

SEQ ID NO: 1076900 - RNA, 22 nt, Human
caacagcugaucuuugaugaag

SEQ ID NO: 1076901 - RNA, 22 nt, Human
agggacacugaugagaaauucu

SEQ ID NO: 1076902 - RNA, 22 nt, Human
cuuuuuauaccgugccaguuga

SEQ ID NO: 1076903 - RNA, 22 nt, Human
ucccagagcagaugugcuaaag

SEQ ID NO: 1076904 - RNA, 22 nt, Human
accauuaaagagauccugggga

SEQ ID NO: 1076905 - RNA, 17 nt, Human
agcagcuggcacaggag

SEQ ID NO: 1076906 - RNA, 22 nt, Human
ccauccuaucugaccuacuugu

SEQ ID NO: 1076907 - RNA, 22 nt, Human
agcccucauggaacagcuccua

SEQ ID NO: 1076908 - RNA, 22 nt, Human
ggcaaggccugcagcucagugu

SEQ ID NO: 1076909 - RNA, 22 nt, Human
cuggcugggagcucgccugcgg

SEQ ID NO: 1076910 - RNA, 22 nt, Human
ucaggaaguuuugaaucaacug

SEQ ID NO: 1076911 - RNA, 21 nt, Human
gggcucugcccuccuggagcu

SEQ ID NO: 1076912 - RNA, 22 nt, Human
ucugagagcaucacugggguac

SEQ ID NO: 1076913 - RNA, 22 nt, Human
cagacagagucuucccaucagu

SEQ ID NO: 1076914 - RNA, 22 nt, Human
cuuagaugaagucacagaaccc

SEQ ID NO: 1076915 - RNA, 22 nt, Human
ggcagguggaaggucuccauuc

SEQ ID NO: 1076916 - RNA, 19 nt, Human
acauauguggauauacaug

SEQ ID NO: 1076917 - RNA, 22 nt, Human
guucccauacaguaucagugcu

SEQ ID NO: 1076918 - RNA, 21 nt, Human
agaugaggauacugaggccua

SEQ ID NO: 1076919 - RNA, 22 nt, Human
aaugucauugagcuccaauccu

SEQ ID NO: 1076920 - RNA, 22 nt, Human
cagucccaucucccagguggcu

SEQ ID NO: 1076921 - RNA, 22 nt, Human
uaguuaaaauaauggagauguu

SEQ ID NO: 1076922 - RNA, 22 nt, Human
cugggcaguaugaauauucaaa

SEQ ID NO: 1076923 - RNA, 22 nt, Human
caguucaggccggcugacucag

SEQ ID NO: 1076924 - RNA, 22 nt, Human
ugggccugggcuccuguccucu

SEQ ID NO: 1076925 - RNA, 22 nt, Human
uccuuuuugguccaaggugacc

SEQ ID NO: 1076926 - RNA, 22 nt, Human
ccuuucagaugggcauggaccg

SEQ ID NO: 1076927 - RNA, 22 nt, Human
aguauggggcugugugugcaca

SEQ ID NO: 1076928 - RNA, 21 nt, Human
ccuccaggagcagagcccuga

SEQ ID NO: 1076929 - RNA, 20 nt, Human
ggaagccagggugcagggga

SEQ ID NO: 1076930 - RNA, 22 nt, Human
uuugcaaagaaauuauugcugu

SEQ ID NO: 1076931 - RNA, 22 nt, Human
gcucccagcauugcugcugaau

SEQ ID NO: 1076932 - RNA, 22 nt, Human
uuauuuuuaaaaguucacacag

SEQ ID NO: 1076933 - RNA, 22 nt, Human
ggcucaguguuuguggaacaua

SEQ ID NO: 1076934 - RNA, 22 nt, Human
ucugcaggacugaggccuguuu

SEQ ID NO: 1076935 - RNA, 22 nt, Human
auugucuguacuuuaaaaaugu

SEQ ID NO: 1076936 - RNA, 22 nt, Human
cugaggccuggugaggugguga

SEQ ID NO: 1076937 - RNA, 22 nt, Human
aggcaugugacccuggacucag

SEQ ID NO: 1076938 - RNA, 22 nt, Human
uggucucuucuuccaagauggc

SEQ ID NO: 1076939 - RNA, 22 nt, Human
acagagucauaagcggagcucg

SEQ ID NO: 1076940 - RNA, 22 nt, Human
gaaggaagccguuucucuccag

SEQ ID NO: 1076941 - RNA, 22 nt, Human
gggguggauuccuacaggucca

SEQ ID NO: 1076942 - RNA, 22 nt, Human
aaggcccuaauagagcacauau

SEQ ID NO: 1076943 - RNA, 19 nt, Human
ugacaggcuguugccuuga

SEQ ID NO: 1076944 - RNA, 19 nt, Human
gugauuucuuuccacaagc

SEQ ID NO: 1076945 - RNA, 21 nt, Human
caaaugcuggcuggaugagga

SEQ ID NO: 1076946 - RNA, 22 nt, Human
ugugcagcuaguccuggacuug

SEQ ID NO: 1076947 - RNA, 22 nt, Human
cuggacaggcuggggacugcaa

SEQ ID NO: 1076948 - RNA, 22 nt, Human
uuuccuuugaggguccuacacu

SEQ ID NO: 1076949 - RNA, 22 nt, Human
uaaggccaggcuguggucggca

SEQ ID NO: 1076950 - RNA, 23 nt, Human
aggagaagagauuuccacaugca

SEQ ID NO: 1076951 - RNA, 22 nt, Human
gauuucucaauccuaguacuau

SEQ ID NO: 1076952 - RNA, 22 nt, Human
agcaaacacaagagguaauuuc

SEQ ID NO: 1076953 - RNA, 22 nt, Human
cuggcuccuccaaggccuggag

SEQ ID NO: 1076954 - RNA, 22 nt, Human
ugcccugcagugagugcgucug

SEQ ID NO: 1076955 - RNA, 22 nt, Human
ugcagaagaauguaggcauaag

SEQ ID NO: 1076956 - RNA, 22 nt, Human
augcaagaucacaccaaacacg

SEQ ID NO: 1076957 - RNA, 20 nt, Human
cucuggcuccgcgugaccgc

SEQ ID NO: 1076958 - RNA, 22 nt, Human
caggcagcgcucguggccuggc

SEQ ID NO: 1076959 - RNA, 22 nt, Human
gcccagcacauugcugaggacc

SEQ ID NO: 1076960 - RNA, 22 nt, Human
uggcugaauaauauucuguugu

SEQ ID NO: 1076961 - RNA, 22 nt, Human
agagcuggauggucaagauggc

SEQ ID NO: 1076962 - RNA, 22 nt, Human
ugcuuuauaggggauugcaggc

SEQ ID NO: 1076963 - RNA, 22 nt, Human
ccuggcugugcauugccggccc

SEQ ID NO: 1076964 - RNA, 22 nt, Human
aagaaucuuaauccagaaaccu

SEQ ID NO: 1076965 - RNA, 22 nt, Human
ugcuccagggccuccagugggg

SEQ ID NO: 1076966 - RNA, 22 nt, Human
caggggcagucugugugcgugg

SEQ ID NO: 1076967 - RNA, 22 nt, Human
uguuuuuaaauaaugauagaaa

SEQ ID NO: 1076968 - RNA, 22 nt, Human
aauauaaauuccugggcccagc

SEQ ID NO: 1076969 - RNA, 22 nt, Human
gggaagaagacauggugaaggc

SEQ ID NO: 1076970 - RNA, 22 nt, Human
cucucccagucaggcucaggau

SEQ ID NO: 1076971 - RNA, 22 nt, Human
cuguggcuucugcuugggccuc

SEQ ID NO: 1076972 - RNA, 22 nt, Human
uuuacagagagagaacuggacu

SEQ ID NO: 1076973 - RNA, 22 nt, Human
gaauguuugugcagagucaucu

SEQ ID NO: 1076974 - RNA, 22 nt, Human
aaagcuauagggucaagcauuu

SEQ ID NO: 1076975 - RNA, 23 nt, Human
cuggcucuguagguggcauccuu

SEQ ID NO: 1076976 - RNA, 22 nt, Human
cauacauuuugcauauuuacca

SEQ ID NO: 1076977 - RNA, 22 nt, Human
aauggccuggagggaauacaga

SEQ ID NO: 1076978 - RNA, 22 nt, Human
gggcagugucggggcccaggga

SEQ ID NO: 1076979 - RNA, 22 nt, Human
ugugaaaugcuauugugacaaa

SEQ ID NO: 1076980 - RNA, 18 nt, Human
agcaggugugcagaaugu

SEQ ID NO: 1076981 - RNA, 22 nt, Human
agagacugucacauaacagagg

SEQ ID NO: 1076982 - RNA, 22 nt, Human
aacacagaucaaaauauuuccu

SEQ ID NO: 1076983 - RNA, 22 nt, Human
cugcugggcagaggcugcauga

SEQ ID NO: 1076984 - RNA, 22 nt, Human
guacauuucauuuaaaugaugu

SEQ ID NO: 1076985 - RNA, 22 nt, Human
gugcuccuggccacaugaagcu

SEQ ID NO: 1076986 - RNA, 22 nt, Human
acuuccagaccugugcuugcuc

SEQ ID NO: 1076987 - RNA, 22 nt, Human
cuuucucuucgaaaaccugccc

SEQ ID NO: 1076988 - RNA, 22 nt, Human
agcugacauaagcacuuucuaa

SEQ ID NO: 1076989 - RNA, 22 nt, Human
uacaaagucagaauaacaggug

SEQ ID NO: 1076990 - RNA, 22 nt, Human
ucacagaaguguagugaggaaa

SEQ ID NO: 1076991 - RNA, 22 nt, Human
gggcucagucggcaagccccuu

SEQ ID NO: 1076992 - RNA, 22 nt, Human
aguuuguaaccuaagauucagg

SEQ ID NO: 1076993 - RNA, 23 nt, Human
uuggaccacuacuguuuucucuu

SEQ ID NO: 1076994 - RNA, 22 nt, Human
gaaagagaaccugggccuagau

SEQ ID NO: 1076995 - RNA, 22 nt, Human
aggggcuggcuuaucugagagu

SEQ ID NO: 1076996 - RNA, 22 nt, Human
gugagagcucagcugcccuggg

SEQ ID NO: 1076997 - RNA, 22 nt, Human
cuuacacuucaucucauccagg

SEQ ID NO: 1076998 - RNA, 22 nt, Human
gcucagagauggggaaugaaaa

SEQ ID NO: 1076999 - RNA, 22 nt, Human
uauccaaaggaacaaucacagc

SEQ ID NO: 1077000 - RNA, 22 nt, Human
cugcagagcuaggcugagugaa

SEQ ID NO: 1077001 - RNA, 23 nt, Human
ggcagcucucaucugaugacuga

SEQ ID NO: 1077002 - RNA, 22 nt, Human
cugcugugcacccaggaaggcu

SEQ ID NO: 1077003 - RNA, 22 nt, Human
auuauuaaagcuacaucaagga

SEQ ID NO: 1077004 - RNA, 22 nt, Human
agccugccuugggcugcuugag

SEQ ID NO: 1077005 - RNA, 22 nt, Human
aggugcaguggcucaugccugu

SEQ ID NO: 1077006 - RNA, 22 nt, Human
aucaugcugacacaguuuaucu

SEQ ID NO: 1077007 - RNA, 22 nt, Human
aguugcuggcaccugugaguau

SEQ ID NO: 1077008 - RNA, 23 nt, Human
gcugucaguuguuuuugucucua

SEQ ID NO: 1077009 - RNA, 22 nt, Human
uuaaagucccugccuuaauucc

SEQ ID NO: 1077010 - RNA, 22 nt, Human
cuuuaugguaaguauagaugac

SEQ ID NO: 1077011 - RNA, 22 nt, Human
uacugaaagagugguggacucu

SEQ ID NO: 1077012 - RNA, 22 nt, Human
uguggcugcucaggugcagacc

SEQ ID NO: 1077013 - RNA, 22 nt, Human
uucagaaguuuucaaaacuaag

SEQ ID NO: 1077014 - RNA, 22 nt, Human
cucuucagauaaaagggauauu

SEQ ID NO: 1077015 - RNA, 23 nt, Human
acagucguagguauccuuuuccu

SEQ ID NO: 1077016 - RNA, 22 nt, Human
uguaggaguccaaucaggagac

SEQ ID NO: 1077017 - RNA, 22 nt, Human
ucaggcugcagcugucagcagc

SEQ ID NO: 1077018 - RNA, 20 nt, Human
uugaaauuggaugguagcua

SEQ ID NO: 1077019 - RNA, 22 nt, Human
cauguaaaacacucagaacagu

SEQ ID NO: 1077020 - RNA, 22 nt, Human
auauuguugacuauaagaguaa

SEQ ID NO: 1077021 - RNA, 22 nt, Human
ugcagggcccuugggguugaac

SEQ ID NO: 1077022 - RNA, 22 nt, Human
gaugaggcucaugcacccugcg

SEQ ID NO: 1077023 - RNA, 22 nt, Human
aggaaauguaguccucaucucc

SEQ ID NO: 1077024 - RNA, 22 nt, Human
ugaggugaccgcagaugggaag

SEQ ID NO: 1077025 - RNA, 22 nt, Human
gauuuacagcuauacccaaugg

SEQ ID NO: 1077026 - RNA, 22 nt, Human
ugcagagaaaccaguggaggac

SEQ ID NO: 1077027 - RNA, 22 nt, Human
ucauggaagagguauuuuuugu

SEQ ID NO: 1077028 - RNA, 23 nt, Human
ccugccuguucuaacuccauuuc

SEQ ID NO: 1077029 - RNA, 17 nt, Human
aggccucccuccaggcc

SEQ ID NO: 1077030 - RNA, 22 nt, Human
gcugccacgaucucugcuguag

SEQ ID NO: 1077031 - RNA, 22 nt, Human
guggcaggagacuggaagaugg

SEQ ID NO: 1077032 - RNA, 22 nt, Human
ugucucaguucccuucucugga

SEQ ID NO: 1077033 - RNA, 22 nt, Human
aggacacagacuuagauuuaaa

SEQ ID NO: 1077034 - RNA, 20 nt, Human
gugugaagcccucaggagga

SEQ ID NO: 1077035 - RNA, 22 nt, Human
caggcaccccaggugagcacug

SEQ ID NO: 1077036 - RNA, 22 nt, Human
uuuuuuauaucaacugaagucu

SEQ ID NO: 1077037 - RNA, 22 nt, Human
caaaggcuuugcuaugaugcau

SEQ ID NO: 1077038 - RNA, 22 nt, Human
cugccucuguugggcauggucu

SEQ ID NO: 1077039 - RNA, 22 nt, Human
ugcaggcugcuggcaguagcuu

SEQ ID NO: 1077040 - RNA, 22 nt, Human
uccuuuaaagaacugugcuuuu

SEQ ID NO: 1077041 - RNA, 15 nt, Human
ucccucagcuaaaga

SEQ ID NO: 1077042 - RNA, 22 nt, Human
ucagggcaagucucagaagguu

SEQ ID NO: 1077043 - RNA, 22 nt, Human
gugaggugguacaauauuaacu

SEQ ID NO: 1077044 - RNA, 20 nt, Human
ccuuuauuauuuguaugaug

SEQ ID NO: 1077045 - RNA, 19 nt, Human
gaaggagagcugaguuagg

SEQ ID NO: 1077046 - RNA, 22 nt, Human
gagggcaggggucuugcacggu

SEQ ID NO: 1077047 - RNA, 22 nt, Human
ugcuggggucauggggcgcccg

SEQ ID NO: 1077048 - RNA, 17 nt, Human
aggcaggcagagcggga

SEQ ID NO: 1077049 - RNA, 21 nt, Human
uuuuacagaugaggggaaggg

SEQ ID NO: 1077050 - RNA, 22 nt, Human
acugaaauacugcucuuggauu

SEQ ID NO: 1077051 - RNA, 22 nt, Human
uuuccucuccggggccuccagg

SEQ ID NO: 1077052 - RNA, 22 nt, Human
gucugucaucugagauggagug

SEQ ID NO: 1077053 - RNA, 19 nt, Human
gacaggaaggcuaccagua

SEQ ID NO: 1077054 - RNA, 21 nt, Human
agcagcugcaguuucuaucug

SEQ ID NO: 1077055 - RNA, 22 nt, Human
uuuucagagagcuuuuaugucc

SEQ ID NO: 1077056 - RNA, 21 nt, Human
aaauacugggcagugacuuga

SEQ ID NO: 1077057 - RNA, 23 nt, Human
aggaggaaaaguuaucugcugag

SEQ ID NO: 1077058 - RNA, 22 nt, Human
aaggcagagggcuggaucagag

SEQ ID NO: 1077059 - RNA, 22 nt, Human
ugaaagaaggguggaaaaugua

SEQ ID NO: 1077060 - RNA, 22 nt, Human
gcucuggcuacuguggcuaccg

SEQ ID NO: 1077061 - RNA, 22 nt, Human
gcugggcugagcuagacuuggc

SEQ ID NO: 1077062 - RNA, 20 nt, Human
cauuuguuagcuuucuacug

SEQ ID NO: 1077063 - RNA, 22 nt, Human
cugggcagcuguaucagggagu

SEQ ID NO: 1077064 - RNA, 22 nt, Human
ucaagauaccaccauuauaugu

SEQ ID NO: 1077065 - RNA, 22 nt, Human
guacaaaugagaguucuguuuu

SEQ ID NO: 1077066 - RNA, 22 nt, Human
uaauauaccaaacuguaauuuu

SEQ ID NO: 1077067 - RNA, 22 nt, Human
ucacaacucuuuccauuuaaua

SEQ ID NO: 1077068 - RNA, 22 nt, Human
uaucuuuagaggaagagaaucu

SEQ ID NO: 1077069 - RNA, 22 nt, Human
ucauugaacgaagagcuccauu

SEQ ID NO: 1077070 - RNA, 22 nt, Human
caugaagcucuugcaccucuag

SEQ ID NO: 1077071 - RNA, 22 nt, Human
gcuaggaguggugggucaagga

SEQ ID NO: 1077072 - RNA, 22 nt, Human
gcauugucaaaagugguaugac

SEQ ID NO: 1077073 - RNA, 22 nt, Human
gcauggcaagaucaggagacca

SEQ ID NO: 1077074 - RNA, 22 nt, Human
aaauugagacuuuuuuccucca

SEQ ID NO: 1077075 - RNA, 22 nt, Human
uccuugaagcaacgugcagaca

SEQ ID NO: 1077076 - RNA, 22 nt, Human
ugaaccagagucuccagugguu

SEQ ID NO: 1077077 - RNA, 22 nt, Human
auguuacacauaggcauaaaug

SEQ ID NO: 1077078 - RNA, 22 nt, Human
gcaggaugggagcuucacuuug

SEQ ID NO: 1077079 - RNA, 22 nt, Human
ggggagaguccuuuccaguucc

SEQ ID NO: 1077080 - RNA, 22 nt, Human
gcuggcccagggucaccuagga

SEQ ID NO: 1077081 - RNA, 22 nt, Human
ggcagagguagcuggaaccagg

SEQ ID NO: 1077082 - RNA, 22 nt, Human
agucaacaguuuuugauguaaa

SEQ ID NO: 1077083 - RNA, 22 nt, Human
augggcugaggugggauagaag

SEQ ID NO: 1077084 - RNA, 22 nt, Human
gagcagugagugaauguugccu

SEQ ID NO: 1077085 - RNA, 22 nt, Human
uuuucuuccuggauuuuggcau

SEQ ID NO: 1077086 - RNA, 22 nt, Human
ccuguguguaggccaggggagu

SEQ ID NO: 1077087 - RNA, 20 nt, Human
ggccugagcauggcuggcag

SEQ ID NO: 1077088 - RNA, 21 nt, Human
agggccugugcucuccagguc

SEQ ID NO: 1077089 - RNA, 20 nt, Human
aggaagccaaaggcugucuu

SEQ ID NO: 1077090 - RNA, 22 nt, Human
cuucugggcauucagcugcaca

SEQ ID NO: 1077091 - RNA, 22 nt, Human
caaaguauauuggauugaaugg

SEQ ID NO: 1077092 - RNA, 22 nt, Human
ugauuaaguucaaaauauagaa

SEQ ID NO: 1077093 - RNA, 18 nt, Human
ugaacuggcaucagaauc

SEQ ID NO: 1077094 - RNA, 22 nt, Human
uaggcucagggcugggugacgg

SEQ ID NO: 1077095 - RNA, 22 nt, Human
uguggggaucuucuagcuuuuc

SEQ ID NO: 1077096 - RNA, 22 nt, Human
ucaggaaggagcuggccugcca

SEQ ID NO: 1077097 - RNA, 22 nt, Human
gaguaacagcauaaauuuguga

SEQ ID NO: 1077098 - RNA, 22 nt, Human
gccugucugcagggcugucauu

SEQ ID NO: 1077099 - RNA, 22 nt, Human
cuggagggcugcagcgaggcug

SEQ ID NO: 1077100 - RNA, 23 nt, Human
agcuguuucauuauuacaacacc

SEQ ID NO: 1077101 - RNA, 22 nt, Human
acagagcugggugcccccugga

SEQ ID NO: 1077102 - RNA, 22 nt, Human
ugcugcucucagccaccaggaa

SEQ ID NO: 1077103 - RNA, 22 nt, Human
aagccgggccugagaaaugaca

SEQ ID NO: 1077104 - RNA, 22 nt, Human
gaaggaggcguuagcccuagga

SEQ ID NO: 1077105 - RNA, 22 nt, Human
agaaaugcaguuucaagacaaa

SEQ ID NO: 1077106 - RNA, 22 nt, Human
cagggugcagugucgcugcuag

SEQ ID NO: 1077107 - RNA, 23 nt, Human
agggaaaguaguaauggccuuug

SEQ ID NO: 1077108 - RNA, 22 nt, Human
gcuggaaggcuaggcucaguug

SEQ ID NO: 1077109 - RNA, 22 nt, Human
cccaagaucuuucgugcacuaa

SEQ ID NO: 1077110 - RNA, 18 nt, Human
ucugucucuguccuugcu

SEQ ID NO: 1077111 - RNA, 22 nt, Human
aagggcagcuauuaucgucauc

SEQ ID NO: 1077112 - RNA, 22 nt, Human
gccuguguccuucccagugggg

SEQ ID NO: 1077113 - RNA, 22 nt, Human
uuccugagggacuuuugagauu

SEQ ID NO: 1077114 - RNA, 23 nt, Human
ggcuggcccggggcugcuccuga

SEQ ID NO: 1077115 - RNA, 22 nt, Human
gauccucuuuuccuaggaaggu

SEQ ID NO: 1077116 - RNA, 22 nt, Human
uaacugauauugaaaaacauca

SEQ ID NO: 1077117 - RNA, 22 nt, Human
cagcugccaagaaucuuuucua

SEQ ID NO: 1077118 - RNA, 22 nt, Human
gggggcagaauguacucuuguc

SEQ ID NO: 1077119 - RNA, 22 nt, Human
accaggagccauagagucaggc

SEQ ID NO: 1077120 - RNA, 23 nt, Human
acagcaagaggaccagaugugag

SEQ ID NO: 1077121 - RNA, 22 nt, Human
aagccaggaagagagccuucac

SEQ ID NO: 1077122 - RNA, 20 nt, Human
caucaucacaugagccaauu

SEQ ID NO: 1077123 - RNA, 22 nt, Human
ucacauuuauuucaaaguuacu

SEQ ID NO: 1077124 - RNA, 22 nt, Human
gcagggcuguggacacuuuggu

SEQ ID NO: 1077125 - RNA, 22 nt, Human
aaaguucuauguaauguuuuuu

SEQ ID NO: 1077126 - RNA, 22 nt, Human
gggaugcagacuacagggcuua

SEQ ID NO: 1077127 - RNA, 22 nt, Human
aggccagguggucaugcuugcu

SEQ ID NO: 1077128 - RNA, 22 nt, Human
ucucaggguuuccugggggcug

SEQ ID NO: 1077129 - RNA, 22 nt, Human
ggcaguggguuccccaaggcac

SEQ ID NO: 1077130 - RNA, 22 nt, Human
aaacuucagggaauaaaagagu

SEQ ID NO: 1077131 - RNA, 22 nt, Human
agagauaugaguaguugugaca

SEQ ID NO: 1077132 - RNA, 22 nt, Human
ccugggcuuucggcggcuuccu

SEQ ID NO: 1077133 - RNA, 22 nt, Human
uuuuuaagcuccuuugauguca

SEQ ID NO: 1077134 - RNA, 22 nt, Human
ccagucagagcagcgcucgcau

SEQ ID NO: 1077135 - RNA, 22 nt, Human
caggcagagugagguggucuaa

SEQ ID NO: 1077136 - RNA, 22 nt, Human
uuaacaaggugacugcauuaaa

SEQ ID NO: 1077137 - RNA, 22 nt, Human
cagggccaaguuggugccuuuu

SEQ ID NO: 1077138 - RNA, 22 nt, Human
aagggcugcaauccaaaacacu

SEQ ID NO: 1077139 - RNA, 22 nt, Human
aacuuaguuaagauuaagucuc

SEQ ID NO: 1077140 - RNA, 22 nt, Human
ggggccagcacugugccuuugu

SEQ ID NO: 1077141 - RNA, 22 nt, Human
uuuuuagaguguuaccaguaua

SEQ ID NO: 1077142 - RNA, 22 nt, Human
gggcagguggagggcccagcca

SEQ ID NO: 1077143 - RNA, 22 nt, Human
aacuguaagagaauaaaugugu

SEQ ID NO: 1077144 - RNA, 22 nt, Human
uucaggauucuuucagacuggg

SEQ ID NO: 1077145 - RNA, 22 nt, Human
ucccacauuacccugacugaca

SEQ ID NO: 1077146 - RNA, 22 nt, Human
aaagguuuuuauuuauccugga

SEQ ID NO: 1077147 - RNA, 22 nt, Human
acugcagcaaagcccgugucuu

SEQ ID NO: 1077148 - RNA, 22 nt, Human
agcagugggggaguguuaguuu

SEQ ID NO: 1077149 - RNA, 22 nt, Human
cucagcaacagcgacuuaaggg

SEQ ID NO: 1077150 - RNA, 22 nt, Human
aagcagugcgcucaucuaaggg

SEQ ID NO: 1077151 - RNA, 22 nt, Human
caggaugggauguagugggccc

SEQ ID NO: 1077152 - RNA, 22 nt, Human
gugaagcagaguguggaagcaa

SEQ ID NO: 1077153 - RNA, 22 nt, Human
aucugacaucuacuagaacaga

SEQ ID NO: 1077154 - RNA, 22 nt, Human
agacuucuugagcuggcacuuc

SEQ ID NO: 1077155 - RNA, 22 nt, Human
aacagcaauagcacuauucauu

SEQ ID NO: 1077156 - RNA, 22 nt, Human
ucacauuuucauauucucugag

SEQ ID NO: 1077157 - RNA, 22 nt, Human
uacacagauaugugaucaauca

SEQ ID NO: 1077158 - RNA, 22 nt, Human
uagcuugucagugaauagcugu

SEQ ID NO: 1077159 - RNA, 22 nt, Human
gaauuuuaucuuauuacuugca

SEQ ID NO: 1077160 - RNA, 22 nt, Human
auacuucaugcuucaugucugu

SEQ ID NO: 1077161 - RNA, 22 nt, Human
ucacagaacaauguuuaguucu

SEQ ID NO: 1077162 - RNA, 22 nt, Human
ugaagagauagaaguacaugcu

SEQ ID NO: 1077163 - RNA, 23 nt, Human
aacacaaagcugauuccaguggc

SEQ ID NO: 1077164 - RNA, 22 nt, Human
caauuucacuaauaauauuuac

SEQ ID NO: 1077165 - RNA, 22 nt, Human
acugaaaaaguaugauucacug

SEQ ID NO: 1077166 - RNA, 22 nt, Human
agaggccaguggcugugcuguc

SEQ ID NO: 1077167 - RNA, 22 nt, Human
gcaggcaggagcccaacugccu

SEQ ID NO: 1077168 - RNA, 22 nt, Human
agaacuguccuuggaggagagu

SEQ ID NO: 1077169 - RNA, 22 nt, Human
uuacaguugcuacaaaggauaa

SEQ ID NO: 1077170 - RNA, 22 nt, Human
agugaggucaggaucucaggga

SEQ ID NO: 1077171 - RNA, 22 nt, Human
uuaauuaauuaguuaagcaugu

SEQ ID NO: 1077172 - RNA, 23 nt, Human
uuucacagaaggauuguagggcc

SEQ ID NO: 1077173 - RNA, 22 nt, Human
ucagcuaggcacuucucacuga

SEQ ID NO: 1077174 - RNA, 23 nt, Human
uggcauuucuauacuggcaagug

SEQ ID NO: 1077175 - RNA, 19 nt, Human
cuuauuagagugagagcuu

SEQ ID NO: 1077176 - RNA, 22 nt, Human
aggcucaggcaggaauggcgga

SEQ ID NO: 1077177 - RNA, 22 nt, Human
gcuggcagggacagcugcgugu

SEQ ID NO: 1077178 - RNA, 22 nt, Human
augcuuuguuuaaagauuuuca

SEQ ID NO: 1077179 - RNA, 19 nt, Human
ugguggcaaugucagcuaa

SEQ ID NO: 1077180 - RNA, 22 nt, Human
ugucacaguuuguacuuuauag

SEQ ID NO: 1077181 - RNA, 22 nt, Human
cugccuggcauggagaagagaa

SEQ ID NO: 1077182 - RNA, 22 nt, Human
aaaggcuuagacacagaacugu

SEQ ID NO: 1077183 - RNA, 22 nt, Human
uugcugaaaagcuggccuuugu

SEQ ID NO: 1077184 - RNA, 22 nt, Human
uugugaauagugcugcaauaaa

SEQ ID NO: 1077185 - RNA, 22 nt, Human
ccugccuguaagauggguacaa

SEQ ID NO: 1077186 - RNA, 17 nt, Human
cccagcuggcagugccg

SEQ ID NO: 1077187 - RNA, 22 nt, Human
cacaagacuuauuuguguagaa

SEQ ID NO: 1077188 - RNA, 22 nt, Human
ucacauacacuaggauauuuuu

SEQ ID NO: 1077189 - RNA, 22 nt, Human
agaguccaugaagacagcugag

SEQ ID NO: 1077190 - RNA, 22 nt, Human
aaauacaauuucaggcuguaau

SEQ ID NO: 1077191 - RNA, 22 nt, Human
agaaagacaaaaugcaguggcu

SEQ ID NO: 1077192 - RNA, 22 nt, Human
gggcuggcaggaccugggcuga

SEQ ID NO: 1077193 - RNA, 22 nt, Human
aagaauuaucugaaagcugugu

SEQ ID NO: 1077194 - RNA, 23 nt, Human
acuucauggcacugucuuagagg

SEQ ID NO: 1077195 - RNA, 22 nt, Human
gcagcccaaaaaagagguagau

SEQ ID NO: 1077196 - RNA, 22 nt, Human
gagaaggggugauguggguaau

SEQ ID NO: 1077197 - RNA, 22 nt, Human
aaagcaccuagcauagugcuua

SEQ ID NO: 1077198 - RNA, 22 nt, Human
cauguuaaugaauuuuugcagu

SEQ ID NO: 1077199 - RNA, 22 nt, Human
gccuggcaggggccugggagug

SEQ ID NO: 1077200 - RNA, 22 nt, Human
aaaagacaucuauuucaggcag

SEQ ID NO: 1077201 - RNA, 22 nt, Human
agugcacuggcaccaucucagc

SEQ ID NO: 1077202 - RNA, 22 nt, Human
gcagggugauagugaggcucag

SEQ ID NO: 1077203 - RNA, 23 nt, Human
cugugcccggggcuccaccugau

SEQ ID NO: 1077204 - RNA, 22 nt, Human
augaaugcuuauuaaauugaaa

SEQ ID NO: 1077205 - RNA, 22 nt, Human
ggcugccaggagggaggccagu

SEQ ID NO: 1077206 - RNA, 22 nt, Human
uucuuaagaaaccaucacauuc

SEQ ID NO: 1077207 - RNA, 22 nt, Human
cuucccuuggugaacagagcau

SEQ ID NO: 1077208 - RNA, 22 nt, Human
agaguaaaguacuuggaauacc

SEQ ID NO: 1077209 - RNA, 22 nt, Human
uccucacagucaacacuuugag

SEQ ID NO: 1077210 - RNA, 22 nt, Human
uaggaaaagucuagauugauga

SEQ ID NO: 1077211 - RNA, 22 nt, Human
cagcuagaaaugggauugguau

SEQ ID NO: 1077212 - RNA, 22 nt, Human
auguucuuugaaauauuuuaga

SEQ ID NO: 1077213 - RNA, 22 nt, Human
gaacaucagucauaauuuaacg

SEQ ID NO: 1077214 - RNA, 22 nt, Human
uacuuucaugucuauacauauu

SEQ ID NO: 1077215 - RNA, 21 nt, Human
ucuccaguauccuucucugag

SEQ ID NO: 1077216 - RNA, 22 nt, Human
gcaugggcaagaggacuggggg

SEQ ID NO: 1077217 - RNA, 22 nt, Human
ccagugacuggcuuucuggugu

SEQ ID NO: 1077218 - RNA, 22 nt, Human
uacagaaagggaugauugaucu

SEQ ID NO: 1077219 - RNA, 22 nt, Human
caguagcacucugucagugaag

SEQ ID NO: 1077220 - RNA, 23 nt, Human
cccagcuuucccacugccgagag

SEQ ID NO: 1077221 - RNA, 22 nt, Human
agguuacagugauuauagguuu

SEQ ID NO: 1077222 - RNA, 23 nt, Human
uggaggaaacacaucagaagacc

SEQ ID NO: 1077223 - RNA, 22 nt, Human
agaacaaugcguauuuuacucc

SEQ ID NO: 1077224 - RNA, 22 nt, Human
gagcugucucuauaugaaugcu

SEQ ID NO: 1077225 - RNA, 18 nt, Human
uacaaacuccuugaaggc

SEQ ID NO: 1077226 - RNA, 22 nt, Human
ccugagggaggguauaggcugu

SEQ ID NO: 1077227 - RNA, 22 nt, Human
cugaaggagcauagucaguuuu

SEQ ID NO: 1077228 - RNA, 22 nt, Human
cugaugcuauaagccacagugg

SEQ ID NO: 1077229 - RNA, 22 nt, Human
ugaaaucaucaaaagagccauu

SEQ ID NO: 1077230 - RNA, 22 nt, Human
gccugguggugugcucaagugg

SEQ ID NO: 1077231 - RNA, 22 nt, Human
cccagacugcagagcgggcaga

SEQ ID NO: 1077232 - RNA, 22 nt, Human
acaguuuaggaugagagaacac

SEQ ID NO: 1077233 - RNA, 22 nt, Human
aucaggaucagggcuagcagag

SEQ ID NO: 1077234 - RNA, 22 nt, Human
uuuccuuccuugcuagccugag

SEQ ID NO: 1077235 - RNA, 19 nt, Human
gugaggauacugcucagag

SEQ ID NO: 1077236 - RNA, 22 nt, Human
uaaggcagaaauaugagcaggg

SEQ ID NO: 1077237 - RNA, 22 nt, Human
cuauuuggccauagugcaguua

SEQ ID NO: 1077238 - RNA, 22 nt, Human
uguuugcucugacuaucuugcg

SEQ ID NO: 1077239 - RNA, 22 nt, Human
cuggugggaggcaagguggaag

SEQ ID NO: 1077240 - RNA, 22 nt, Human
cuggaguguaaagagcauagaa

SEQ ID NO: 1077241 - RNA, 21 nt, Human
ugaagccugaggcauagcccc

SEQ ID NO: 1077242 - RNA, 21 nt, Human
agcagcagaucuggugagggc

SEQ ID NO: 1077243 - RNA, 22 nt, Human
gcauuucagagaaaaucugcuu

SEQ ID NO: 1077244 - RNA, 22 nt, Human
uccaggaggaggaaggcugcca

SEQ ID NO: 1077245 - RNA, 22 nt, Human
ucuguggauuuuaguguucaug

SEQ ID NO: 1077246 - RNA, 19 nt, Human
ccucugccagcccgccucu

SEQ ID NO: 1077247 - RNA, 22 nt, Human
ccugggcuggaguacagcagug

SEQ ID NO: 1077248 - RNA, 22 nt, Human
ggcagugagucccggagaggcc

SEQ ID NO: 1077249 - RNA, 22 nt, Human
uuucccuuguuccuuccucuga

SEQ ID NO: 1077250 - RNA, 22 nt, Human
acuggaagccaguugacaauca

SEQ ID NO: 1077251 - RNA, 22 nt, Human
aguuuacagaugcuacaggagc

SEQ ID NO: 1077252 - RNA, 20 nt, Human
uauuggaucuaagaaauggg

SEQ ID NO: 1077253 - RNA, 22 nt, Human
uggagugaaguaaagaggacaa

SEQ ID NO: 1077254 - RNA, 22 nt, Human
aguggcagaagucacuggguag

SEQ ID NO: 1077255 - RNA, 22 nt, Human
caggaugaagggcaaaggcaag

SEQ ID NO: 1077256 - RNA, 22 nt, Human
agcaagaagggcaaggaaguuu

SEQ ID NO: 1077257 - RNA, 22 nt, Human
uucagcuauuauacccacuuuu

SEQ ID NO: 1077258 - RNA, 22 nt, Human
agcuggccuccgggugccuggg

SEQ ID NO: 1077259 - RNA, 22 nt, Human
ggagaugguggaagcuggugca

SEQ ID NO: 1077260 - RNA, 22 nt, Human
uaauagaaagguauuuuuugca

SEQ ID NO: 1077261 - RNA, 22 nt, Human
acaguuuaugguguuuuauaua

SEQ ID NO: 1077262 - RNA, 20 nt, Human
gucugaggagcagugggaaa

SEQ ID NO: 1077263 - RNA, 22 nt, Human
ugaaggccucugguacaugcca

SEQ ID NO: 1077264 - RNA, 22 nt, Human
uaggcaggcugaauguagauuu

SEQ ID NO: 1077265 - RNA, 22 nt, Human
aucuguuguuuucucauauguu

SEQ ID NO: 1077266 - RNA, 22 nt, Human
ugggcagaggacagggaagauc

SEQ ID NO: 1077267 - RNA, 22 nt, Human
agucccagaucuccauucgguc

SEQ ID NO: 1077268 - RNA, 22 nt, Human
ugacacaguaucaaacaugauu

SEQ ID NO: 1077269 - RNA, 22 nt, Human
ugacauuucuuguugauauaaa

SEQ ID NO: 1077270 - RNA, 22 nt, Human
ggcuagaguggaacuggagcgg

SEQ ID NO: 1077271 - RNA, 22 nt, Human
gccagcagcccagaaggacuuu

SEQ ID NO: 1077272 - RNA, 18 nt, Human
ugggagugggaguggaua

SEQ ID NO: 1077273 - RNA, 22 nt, Human
gcaggaagggaaagguugacuc

SEQ ID NO: 1077274 - RNA, 22 nt, Human
agcacagauggauguauucauu

SEQ ID NO: 1077275 - RNA, 22 nt, Human
aagcagagugauauaaacaugg

SEQ ID NO: 1077276 - RNA, 22 nt, Human
aucauaauugcuccagugauau

SEQ ID NO: 1077277 - RNA, 22 nt, Human
caggaagagaacauggaggcug

SEQ ID NO: 1077278 - RNA, 22 nt, Human
aucucagucagguugaauuugg

SEQ ID NO: 1077279 - RNA, 22 nt, Human
cagaaucugagucgugauugua

SEQ ID NO: 1077280 - RNA, 17 nt, Human
ggagagugggaauggcc

SEQ ID NO: 1077281 - RNA, 22 nt, Human
uuacaauaguuccuucuuuugu

SEQ ID NO: 1077282 - RNA, 22 nt, Human
gagauuggauuuaauggccaaa

SEQ ID NO: 1077283 - RNA, 22 nt, Human
ucuggcucaggucagacaggga

SEQ ID NO: 1077284 - RNA, 22 nt, Human
aaaacauugaauugcacacuau

SEQ ID NO: 1077285 - RNA, 22 nt, Human
ggcaaaaaccauaauuacuuuu

SEQ ID NO: 1077286 - RNA, 22 nt, Human
cuuauucagaaggagaaaugga

SEQ ID NO: 1077287 - RNA, 22 nt, Human
ggcgcaggccuuggauccuggu

SEQ ID NO: 1077288 - RNA, 22 nt, Human
aagacauugucauuuuauaauu

SEQ ID NO: 1077289 - RNA, 22 nt, Human
ucagauggcacacagagccugc

SEQ ID NO: 1077290 - RNA, 22 nt, Human
uucuguaucucuguguuucuug

SEQ ID NO: 1077291 - RNA, 22 nt, Human
caggguccggcugccuggcugu

SEQ ID NO: 1077292 - RNA, 22 nt, Human
aaauuuuaguaaggaaguugag

SEQ ID NO: 1077293 - RNA, 22 nt, Human
cucaggaugcaauuccaucaag

SEQ ID NO: 1077294 - RNA, 22 nt, Human
gcaggagcucguuuccaggcug

SEQ ID NO: 1077295 - RNA, 22 nt, Human
aaacucaaauuaaacuagcuua

SEQ ID NO: 1077296 - RNA, 22 nt, Human
ugcaggcucugguuuauagugc

SEQ ID NO: 1077297 - RNA, 22 nt, Human
agggccuggcuucacuuucuca

SEQ ID NO: 1077298 - RNA, 22 nt, Human
caggaacaaggccuaugggacu

SEQ ID NO: 1077299 - RNA, 22 nt, Human
cagggccucuccuccaggaacu

SEQ ID NO: 1077300 - RNA, 22 nt, Human
uacaguguauguauuuguaggu

SEQ ID NO: 1077301 - RNA, 22 nt, Human
ugggugcaggucuugugccagg

SEQ ID NO: 1077302 - RNA, 22 nt, Human
aaggcagcagugcacgacugau

SEQ ID NO: 1077303 - RNA, 22 nt, Human
aaucacagaaggcagucuucua

SEQ ID NO: 1077304 - RNA, 22 nt, Human
uccugucagugaggcagaugaa

SEQ ID NO: 1077305 - RNA, 22 nt, Human
cuucaaagggucacuauuuauc

SEQ ID NO: 1077306 - RNA, 22 nt, Human
ugucauuuugucucacugcuau

SEQ ID NO: 1077307 - RNA, 22 nt, Human
cuuggagugaaugggggcaggu

SEQ ID NO: 1077308 - RNA, 22 nt, Human
agggccagaggcaccuugcagc

SEQ ID NO: 1077309 - RNA, 22 nt, Human
ugggccccagcacgucugggga

SEQ ID NO: 1077310 - RNA, 22 nt, Human
ugcagaaacagucauuaaugua

SEQ ID NO: 1077311 - RNA, 22 nt, Human
ugggggcugugcacaggcucac

SEQ ID NO: 1077312 - RNA, 22 nt, Human
agcagggcugcagugugucuuu

SEQ ID NO: 1077313 - RNA, 22 nt, Human
uaguauaucuuuaguacauagu

SEQ ID NO: 1077314 - RNA, 22 nt, Human
acugggaauggagccugggccu

SEQ ID NO: 1077315 - RNA, 22 nt, Human
cucugcccucgcacaucugcca

SEQ ID NO: 1077316 - RNA, 22 nt, Human
ugccuuuuccaguuucuagggg

SEQ ID NO: 1077317 - RNA, 22 nt, Human
gagauaaugaugcuaacccagu

SEQ ID NO: 1077318 - RNA, 22 nt, Human
cuggaagggucuacuuagcaga

SEQ ID NO: 1077319 - RNA, 22 nt, Human
ccugccuggcccaccuugccac

SEQ ID NO: 1077320 - RNA, 22 nt, Human
agcugccugugcugggagccca

SEQ ID NO: 1077321 - RNA, 22 nt, Human
accaguccgcggagcuccgggg

SEQ ID NO: 1077322 - RNA, 22 nt, Human
cugggcacaaguggcccuggau

SEQ ID NO: 1077323 - RNA, 22 nt, Human
uucuggggccaauugccacugc

SEQ ID NO: 1077324 - RNA, 22 nt, Human
uaacaguauauuuaccaaaccu

SEQ ID NO: 1077325 - RNA, 22 nt, Human
uccagagucuccuguuguuguu

SEQ ID NO: 1077326 - RNA, 22 nt, Human
gggcugcuuuuaagggucucag

SEQ ID NO: 1077327 - RNA, 22 nt, Human
agaauaaaucaaauguccugag

SEQ ID NO: 1077328 - RNA, 22 nt, Human
uugcauccgaaacaauuucucu

SEQ ID NO: 1077329 - RNA, 22 nt, Human
uccaauuugaaaugguauaugu

SEQ ID NO: 1077330 - RNA, 22 nt, Human
cuguguagccucaugugggcuu

SEQ ID NO: 1077331 - RNA, 22 nt, Human
auugcuuuugagcuagaauuuu

SEQ ID NO: 1077332 - RNA, 22 nt, Human
agggcagagauuaauuaagaca

SEQ ID NO: 1077333 - RNA, 19 nt, Human
ucauggaagaaaugugaua

SEQ ID NO: 1077334 - RNA, 22 nt, Human
gagacacaggcacagaagaggc

SEQ ID NO: 1077335 - RNA, 22 nt, Human
cucaggcugugccaccugugug

SEQ ID NO: 1077336 - RNA, 22 nt, Human
gugcagggcuggcaccggaggc

SEQ ID NO: 1077337 - RNA, 22 nt, Human
uauuuuguaauuggucauagcu

SEQ ID NO: 1077338 - RNA, 21 nt, Human
ccagcccagcugugucccagc

SEQ ID NO: 1077339 - RNA, 22 nt, Human
uagcacauuguugaccagaagg

SEQ ID NO: 1077340 - RNA, 22 nt, Human
aaauuucaguuggaaugagcuc

SEQ ID NO: 1077341 - RNA, 23 nt, Human
aggagacagggaagugccuggcu

SEQ ID NO: 1077342 - RNA, 22 nt, Human
ucugcugcacaaauucaucucu

SEQ ID NO: 1077343 - RNA, 22 nt, Human
aaagcagagaucauggcuugua

SEQ ID NO: 1077344 - RNA, 22 nt, Human
aggcuggcugagcugcagccug

SEQ ID NO: 1077345 - RNA, 22 nt, Human
auauucaucguguagaaauacu

SEQ ID NO: 1077346 - RNA, 22 nt, Human
caccaggauaaaaccucuagau

SEQ ID NO: 1077347 - RNA, 22 nt, Human
gcagcuguggguuccaagucua

SEQ ID NO: 1077348 - RNA, 22 nt, Human
cgguggucauaaguggcuggcg

SEQ ID NO: 1077349 - RNA, 22 nt, Human
uccagcuugacaaaugauuuua

SEQ ID NO: 1077350 - RNA, 22 nt, Human
gagauuggccuggcuugccaac

SEQ ID NO: 1077351 - RNA, 22 nt, Human
aggcugagcugaccugguuugg

SEQ ID NO: 1077352 - RNA, 22 nt, Human
ucaagagaagugcuccacagua

SEQ ID NO: 1077353 - RNA, 22 nt, Human
ggggucccugcaccagcauguc

SEQ ID NO: 1077354 - RNA, 22 nt, Human
aggcugggaagguaaaguugua

SEQ ID NO: 1077355 - RNA, 17 nt, Human
ccagagcuacugagacu

SEQ ID NO: 1077356 - RNA, 22 nt, Human
gauucuuuacaucucugcugac

SEQ ID NO: 1077357 - RNA, 22 nt, Human
uuaaucacagauauuaaacaug

SEQ ID NO: 1077358 - RNA, 21 nt, Human
gacuuucuuaccagauuuuug

SEQ ID NO: 1077359 - RNA, 22 nt, Human
ucagguggcuucggggaguggc

SEQ ID NO: 1077360 - RNA, 22 nt, Human
aggccagcucacccuggcuccu

SEQ ID NO: 1077361 - RNA, 22 nt, Human
augaaucagaaucugcauuuua

SEQ ID NO: 1077362 - RNA, 22 nt, Human
cuucuaggcuucucagggggca

SEQ ID NO: 1077363 - RNA, 22 nt, Human
auggacagugugaagcagauag

SEQ ID NO: 1077364 - RNA, 22 nt, Human
uugcucugauuagguggaaaca

SEQ ID NO: 1077365 - RNA, 22 nt, Human
aauguuuaauguuagugguaau

SEQ ID NO: 1077366 - RNA, 22 nt, Human
cagcgucucguugugggccucg

SEQ ID NO: 1077367 - RNA, 22 nt, Human
uucauauuugaaacagaaguua

SEQ ID NO: 1077368 - RNA, 22 nt, Human
agggugcauguuugcaagagug

SEQ ID NO: 1077369 - RNA, 22 nt, Human
cagacagcaaaucugcuugcau

SEQ ID NO: 1077370 - RNA, 22 nt, Human
aucuuucagagcuccaucaggg

SEQ ID NO: 1077371 - RNA, 22 nt, Human
agcagcugagaugguaagauuc

SEQ ID NO: 1077372 - RNA, 21 nt, Human
gaguggaacgcucuucacacc

SEQ ID NO: 1077373 - RNA, 22 nt, Human
ugcagugauuaaaguguuaaau

SEQ ID NO: 1077374 - RNA, 21 nt, Human
aggcugcuggcucaggguccu

SEQ ID NO: 1077375 - RNA, 22 nt, Human
uagaaacagaaaacuguaauag

SEQ ID NO: 1077376 - RNA, 18 nt, Human
cagggcuguggggucacu

SEQ ID NO: 1077377 - RNA, 22 nt, Human
agcagggcuuuggcuggcuuuc

SEQ ID NO: 1077378 - RNA, 22 nt, Human
uccucuucuaagcucauucagg

SEQ ID NO: 1077379 - RNA, 22 nt, Human
gugagcuguuggaguggcagag

SEQ ID NO: 1077380 - RNA, 22 nt, Human
agagugguggccguggugucac

SEQ ID NO: 1077381 - RNA, 22 nt, Human
uccuucagcucucuauuuagau

SEQ ID NO: 1077382 - RNA, 22 nt, Human
uuauccaacaugacuuaugucc

SEQ ID NO: 1077383 - RNA, 22 nt, Human
uccauuggucucugugcccagg

SEQ ID NO: 1077384 - RNA, 22 nt, Human
gcugagcucccagcaguaucug

SEQ ID NO: 1077385 - RNA, 22 nt, Human
uaacugcucagugaguauuuuu

SEQ ID NO: 1077386 - RNA, 22 nt, Human
uuguuuuuagagaagcccugaa

SEQ ID NO: 1077387 - RNA, 22 nt, Human
auggaauauagucuuauaucuc

SEQ ID NO: 1077388 - RNA, 19 nt, Human
cacauuuugagucugagau

SEQ ID NO: 1077389 - RNA, 22 nt, Human
aaugauaugcaaauuaucauca

SEQ ID NO: 1077390 - RNA, 22 nt, Human
uuuguguggcguuggccggcgg

SEQ ID NO: 1077391 - RNA, 22 nt, Human
uacuacuuucccccacauauuu

SEQ ID NO: 1077392 - RNA, 22 nt, Human
auccaagucagggauaguuuga

SEQ ID NO: 1077393 - RNA, 20 nt, Human
uuuuauauguaggguauaug

SEQ ID NO: 1077394 - RNA, 22 nt, Human
uaccugggaagugggaccugag

SEQ ID NO: 1077395 - RNA, 22 nt, Human
uggaacacaucucgcugcaggg

SEQ ID NO: 1077396 - RNA, 22 nt, Human
gcugccuggagcucagccugcc

SEQ ID NO: 1077397 - RNA, 22 nt, Human
ccaggcucaggugcgagagaca

SEQ ID NO: 1077398 - RNA, 22 nt, Human
agaauuagucacaauuauagga

SEQ ID NO: 1077399 - RNA, 22 nt, Human
cagagccuaaaacgacuccacu

SEQ ID NO: 1077400 - RNA, 22 nt, Human
ucaguuuuaagguuugagaauu

SEQ ID NO: 1077401 - RNA, 22 nt, Human
aaauacuguugaaugaaguaag

SEQ ID NO: 1077402 - RNA, 22 nt, Human
ucaauuaagaggcuaaguuacu

SEQ ID NO: 1077403 - RNA, 22 nt, Human
cagcugcccaggccaccuggag

SEQ ID NO: 1077404 - RNA, 22 nt, Human
cucucagacugaagggccugug

SEQ ID NO: 1077405 - RNA, 22 nt, Human
ccaggccucccuuuuccagcca

SEQ ID NO: 1077406 - RNA, 22 nt, Human
ucuuccaaaugcagcuaaagcu

SEQ ID NO: 1077407 - RNA, 22 nt, Human
aaaggccaagcaugagguggac

SEQ ID NO: 1077408 - RNA, 22 nt, Human
gccaggaaagcaaaaucaccca

SEQ ID NO: 1077409 - RNA, 22 nt, Human
uuaacagagugccuggcaugua

SEQ ID NO: 1077410 - RNA, 22 nt, Human
uaagguuucuaguuucuaaacu

SEQ ID NO: 1077411 - RNA, 21 nt, Human
uggcaggcagcuggaagcuug

SEQ ID NO: 1077412 - RNA, 22 nt, Human
aauuucagaugucauaaauaua

SEQ ID NO: 1077413 - RNA, 23 nt, Human
gugauuucagggaacagaaucag

SEQ ID NO: 1077414 - RNA, 22 nt, Human
gacagugcauuuccuggcaugg

SEQ ID NO: 1077415 - RNA, 22 nt, Human
uguacagauugaucauggagag

SEQ ID NO: 1077416 - RNA, 22 nt, Human
uggacucagaaguguucuuuua

SEQ ID NO: 1077417 - RNA, 22 nt, Human
cagauggcaacagcucugugac

SEQ ID NO: 1077418 - RNA, 22 nt, Human
agucucugcacaguaagaagca

SEQ ID NO: 1077419 - RNA, 22 nt, Human
cagggcagcuuccuuuguuagg

SEQ ID NO: 1077420 - RNA, 22 nt, Human
ucaggaugagcucauaacuaug

SEQ ID NO: 1077421 - RNA, 22 nt, Human
aacauucuuuggaggauuauuc

SEQ ID NO: 1077422 - RNA, 21 nt, Human
ggccugagcaccuguccaccu

SEQ ID NO: 1077423 - RNA, 22 nt, Human
ggaaggggagcuaaaucuacug

SEQ ID NO: 1077424 - RNA, 22 nt, Human
uagagcuggaaaacugcaggua

SEQ ID NO: 1077425 - RNA, 22 nt, Human
gcagucaguaaggcagccagaa

SEQ ID NO: 1077426 - RNA, 17 nt, Human
cagagucugucugcauc

SEQ ID NO: 1077427 - RNA, 16 nt, Human
ccuuucucugccuucc

SEQ ID NO: 1077428 - RNA, 22 nt, Human
gcccagaaguugaggcugcagu

SEQ ID NO: 1077429 - RNA, 22 nt, Human
agccuccaucucccaucuguga

SEQ ID NO: 1077430 - RNA, 20 nt, Human
agguccugguucucugggau

SEQ ID NO: 1077431 - RNA, 22 nt, Human
ugugggaagagcaguggcagca

SEQ ID NO: 1077432 - RNA, 22 nt, Human
acagaaugcguagugcauguug

SEQ ID NO: 1077433 - RNA, 22 nt, Human
uucacaaaaugguuuguugaug

SEQ ID NO: 1077434 - RNA, 22 nt, Human
uggguagggagcuggaauccua

SEQ ID NO: 1077435 - RNA, 22 nt, Human
ggaaggaggggcaaagcaguuc

SEQ ID NO: 1077436 - RNA, 22 nt, Human
cccaaggcauggcaugguggca

SEQ ID NO: 1077437 - RNA, 20 nt, Human
aauauaauucucugaauuua

SEQ ID NO: 1077438 - RNA, 22 nt, Human
cugcccugggauggucugugcg

SEQ ID NO: 1077439 - RNA, 22 nt, Human
gccugguggacacugggcauca

SEQ ID NO: 1077440 - RNA, 22 nt, Human
accaggaaacugugcccacgac

SEQ ID NO: 1077441 - RNA, 22 nt, Human
cccugccuacaggguuuucuuu

SEQ ID NO: 1077442 - RNA, 22 nt, Human
ugcauuguugaccaguugugca

SEQ ID NO: 1077443 - RNA, 21 nt, Human
cuucaauucaacacugccaug

SEQ ID NO: 1077444 - RNA, 22 nt, Human
caacauaugauuuuguauauaa

SEQ ID NO: 1077445 - RNA, 22 nt, Human
ccagggcugagcugugaccaug

SEQ ID NO: 1077446 - RNA, 22 nt, Human
ccuggcugcauuuugcuggaug

SEQ ID NO: 1077447 - RNA, 22 nt, Human
ucugggcuuuugcacuggccau

SEQ ID NO: 1077448 - RNA, 22 nt, Human
uccaggcuccccugcgugcucc

SEQ ID NO: 1077449 - RNA, 22 nt, Human
uucacagacauugcagacugaa

SEQ ID NO: 1077450 - RNA, 22 nt, Human
acauaauagguaccugaauaau

SEQ ID NO: 1077451 - RNA, 22 nt, Human
uuaaaguucauuaaaugagcca

SEQ ID NO: 1077452 - RNA, 22 nt, Human
uuacaguuuaguccaagccaga

SEQ ID NO: 1077453 - RNA, 23 nt, Human
uuuaugcagcauguagaacaugg

SEQ ID NO: 1077454 - RNA, 22 nt, Human
aaggagcugggagggacacaug

SEQ ID NO: 1077455 - RNA, 22 nt, Human
auggauaagucaaagaguaucc

SEQ ID NO: 1077456 - RNA, 22 nt, Human
accucugcaacccuggaauggg

SEQ ID NO: 1077457 - RNA, 22 nt, Human
uagauuuccucuuccucauucc

SEQ ID NO: 1077458 - RNA, 22 nt, Human
uauuucacagcagcucauuuaa

SEQ ID NO: 1077459 - RNA, 22 nt, Human
ugguaaauauguccauucucuu

SEQ ID NO: 1077460 - RNA, 22 nt, Human
uggaaacaucucugccuuuauu

SEQ ID NO: 1077461 - RNA, 22 nt, Human
ucuuggucuuucauccuucaac

SEQ ID NO: 1077462 - RNA, 22 nt, Human
cccaguggcccagcauguggug

SEQ ID NO: 1077463 - RNA, 20 nt, Human
gauacacagcacagagggcc

SEQ ID NO: 1077464 - RNA, 22 nt, Human
aggagggugauccgggcugguc

SEQ ID NO: 1077465 - RNA, 22 nt, Human
cugagggaguuccugagcccac

SEQ ID NO: 1077466 - RNA, 22 nt, Human
aggugcuguuugucagcaguuu

SEQ ID NO: 1077467 - RNA, 22 nt, Human
uuauuggaaaagggcuguaauu

SEQ ID NO: 1077468 - RNA, 17 nt, Human
ggcaggugacagacacc

SEQ ID NO: 1077469 - RNA, 22 nt, Human
uaacagaaauagaaaugagagu

SEQ ID NO: 1077470 - RNA, 22 nt, Human
gagucgagcagaaagccgucgg

SEQ ID NO: 1077471 - RNA, 22 nt, Human
ucuuugcagaauuuaacuuugc

SEQ ID NO: 1077472 - RNA, 22 nt, Human
aaaacauaaacugacagcccau

SEQ ID NO: 1077473 - RNA, 22 nt, Human
caaaaguagugaaguuguacau

SEQ ID NO: 1077474 - RNA, 22 nt, Human
aaacacagcauguccuugggga

SEQ ID NO: 1077475 - RNA, 22 nt, Human
augggaggaucacuugaggcca

SEQ ID NO: 1077476 - RNA, 22 nt, Human
uuucacaaacugaggagacaau

SEQ ID NO: 1077477 - RNA, 22 nt, Human
ucagaauuguggagaaagggga

SEQ ID NO: 1077478 - RNA, 22 nt, Human
gaaaucaaggcuacauucaggu

SEQ ID NO: 1077479 - RNA, 22 nt, Human
uaugauauucuaaauugacacc

SEQ ID NO: 1077480 - RNA, 22 nt, Human
ucuggagcaacagagcaggaca

SEQ ID NO: 1077481 - RNA, 22 nt, Human
ugauuucaaguagugacaugcu

SEQ ID NO: 1077482 - RNA, 22 nt, Human
cccaggaaaucaggcuuucuag

SEQ ID NO: 1077483 - RNA, 22 nt, Human
augcaguacugauacaugccac

SEQ ID NO: 1077484 - RNA, 22 nt, Human
aaagcaggguccaaggagaugu

SEQ ID NO: 1077485 - RNA, 22 nt, Human
aguaaacauaauuuaccuguag

SEQ ID NO: 1077486 - RNA, 22 nt, Human
agcaggcuugguccccagccuc

SEQ ID NO: 1077487 - RNA, 19 nt, Human
gaggaggcuucagcuuucu

SEQ ID NO: 1077488 - RNA, 22 nt, Human
agggcugggcugcuuguuguca

SEQ ID NO: 1077489 - RNA, 22 nt, Human
cugagcauggccgguccauggu

SEQ ID NO: 1077490 - RNA, 22 nt, Human
cugcugugccuuaaaaugcaag

SEQ ID NO: 1077491 - RNA, 22 nt, Human
ugcuucuggcagauugagugag

SEQ ID NO: 1077492 - RNA, 21 nt, Human
ucucuguguucaaggugccag

SEQ ID NO: 1077493 - RNA, 22 nt, Human
agcagagccagaauuggaccag

SEQ ID NO: 1077494 - RNA, 19 nt, Human
gggcaaagugaucguccug

SEQ ID NO: 1077495 - RNA, 22 nt, Human
acauguuagggacagaguaugu

SEQ ID NO: 1077496 - RNA, 22 nt, Human
cugggcucagcccaugcugucc

SEQ ID NO: 1077497 - RNA, 22 nt, Human
gccuaggaucaaccacaugaaa

SEQ ID NO: 1077498 - RNA, 20 nt, Human
uaacacagaaagcuuccuuc

SEQ ID NO: 1077499 - RNA, 19 nt, Human
ugagcaugcgagcugagaa

SEQ ID NO: 1077500 - RNA, 22 nt, Human
gucacacucagaaugacuagag

SEQ ID NO: 1077501 - RNA, 22 nt, Human
gccucugccaagggggcugcgg

SEQ ID NO: 1077502 - RNA, 20 nt, Human
cagagacccaggcuucagcu

SEQ ID NO: 1077503 - RNA, 22 nt, Human
acugaaauauuuagaagugaag

SEQ ID NO: 1077504 - RNA, 22 nt, Human
cuccugguucagagagcugaga

SEQ ID NO: 1077505 - RNA, 21 nt, Human
aaggccugcuuacugcuaguu

SEQ ID NO: 1077506 - RNA, 22 nt, Human
ugaaacaaaauuaagauucucg

SEQ ID NO: 1077507 - RNA, 22 nt, Human
auguaugaagcuuuguuuggga

SEQ ID NO: 1077508 - RNA, 21 nt, Human
cagaggcugagagggcaaucu

SEQ ID NO: 1077509 - RNA, 22 nt, Human
cagagccauccaggugccuguu

SEQ ID NO: 1077510 - RNA, 22 nt, Human
uuucucaaggugucauguauuu

SEQ ID NO: 1077511 - RNA, 22 nt, Human
aaaggagacuucagaucuccuu

SEQ ID NO: 1077512 - RNA, 22 nt, Human
agcuuuggagacugacuccauc

SEQ ID NO: 1077513 - RNA, 22 nt, Human
guccugggcccaggggcugccu

SEQ ID NO: 1077514 - RNA, 22 nt, Human
ucaggcugagaaaaucuggacc

SEQ ID NO: 1077515 - RNA, 22 nt, Human
uaagcaguuuuucuuguauuaa

SEQ ID NO: 1077516 - RNA, 22 nt, Human
agaaaguuuguuuuuauccaua

SEQ ID NO: 1077517 - RNA, 22 nt, Human
uaaaagagaauggauaacagag

SEQ ID NO: 1077518 - RNA, 23 nt, Human
uguaaauuuuguagucacauuuu

SEQ ID NO: 1077519 - RNA, 19 nt, Human
ggcuggcaagugacagugu

SEQ ID NO: 1077520 - RNA, 22 nt, Human
ucuggcagggucagggcccagg

SEQ ID NO: 1077521 - RNA, 22 nt, Human
gcaacacagaucuucuuuguug

SEQ ID NO: 1077522 - RNA, 22 nt, Human
uuacagugagggugacauuuac

SEQ ID NO: 1077523 - RNA, 18 nt, Human
uagauuaaaauugaauuc

SEQ ID NO: 1077524 - RNA, 23 nt, Human
auuugacagagcauagcauuucu

SEQ ID NO: 1077525 - RNA, 22 nt, Human
ucccagauucuucugugugggc

SEQ ID NO: 1077526 - RNA, 22 nt, Human
ggcccucccugagccagguggg

SEQ ID NO: 1077527 - RNA, 22 nt, Human
cacaggaagagguauacaauuc

SEQ ID NO: 1077528 - RNA, 22 nt, Human
aaguuacagucagagguuaaca

SEQ ID NO: 1077529 - RNA, 22 nt, Human
agagcugggacuuggacucaau

SEQ ID NO: 1077530 - RNA, 22 nt, Human
ucacuccucauugcugcccauu

SEQ ID NO: 1077531 - RNA, 22 nt, Human
agauaaaaugauuuucuggauc

SEQ ID NO: 1077532 - RNA, 22 nt, Human
guuaauguuaucugaagacagu

SEQ ID NO: 1077533 - RNA, 19 nt, Human
gcaggugugaauccguaga

SEQ ID NO: 1077534 - RNA, 23 nt, Human
augugcaaagugcuacaguauag

SEQ ID NO: 1077535 - RNA, 23 nt, Human
gcugggcuuacucuuucagugag

SEQ ID NO: 1077536 - RNA, 21 nt, Human
ccugcugugaucuuagugagu

SEQ ID NO: 1077537 - RNA, 22 nt, Human
gccugggugucgaucacuagug

SEQ ID NO: 1077538 - RNA, 22 nt, Human
aggagcugcagauucugccuug

SEQ ID NO: 1077539 - RNA, 22 nt, Human
ucaauucugccucuaaauauuu

SEQ ID NO: 1077540 - RNA, 22 nt, Human
uuaaagcugagcccucagaagc

SEQ ID NO: 1077541 - RNA, 22 nt, Human
ugcagcagggcccaggcacaga

SEQ ID NO: 1077542 - RNA, 22 nt, Human
uucaacuagaggugauuuugcc

SEQ ID NO: 1077543 - RNA, 23 nt, Human
uccuccuuuugcuugugcuuccc

SEQ ID NO: 1077544 - RNA, 22 nt, Human
aaacaguaaguucuaguauuau

SEQ ID NO: 1077545 - RNA, 22 nt, Human
cagucuucuaaccuagcagccu

SEQ ID NO: 1077546 - RNA, 22 nt, Human
cacaggaaucugcauuuugacc

SEQ ID NO: 1077547 - RNA, 22 nt, Human
cugggagucuggccucuggucc

SEQ ID NO: 1077548 - RNA, 22 nt, Human
ucaaaacaacacucagguguaa

SEQ ID NO: 1077549 - RNA, 22 nt, Human
aauguucugcaacuguuuucau

SEQ ID NO: 1077550 - RNA, 22 nt, Human
ucucuggaauuuugagagugac

SEQ ID NO: 1077551 - RNA, 22 nt, Human
uggggcugucccgguuuggcga

SEQ ID NO: 1077552 - RNA, 22 nt, Human
ucacuguauuuggaagggaugg

SEQ ID NO: 1077553 - RNA, 22 nt, Human
uaauguuuccagucuaugaugg

SEQ ID NO: 1077554 - RNA, 22 nt, Human
gguaugaauucacuacuuccaa

SEQ ID NO: 1077555 - RNA, 20 nt, Human
uggggucuaguuggccuggg

SEQ ID NO: 1077556 - RNA, 22 nt, Human
agagacaccgcgcaucauggcu

SEQ ID NO: 1077557 - RNA, 22 nt, Human
aaggugguuugauuaucccacu

SEQ ID NO: 1077558 - RNA, 21 nt, Human
gagcugggcgaggcuccgggg

SEQ ID NO: 1077559 - RNA, 18 nt, Human
gggaagaggaucuggccc

SEQ ID NO: 1077560 - RNA, 22 nt, Human
gcagaggagugauuaugccgug

SEQ ID NO: 1077561 - RNA, 22 nt, Human
aacuagaaaucacuacagguau

SEQ ID NO: 1077562 - RNA, 22 nt, Human
ucagggcaccaaaaaagaugcc

SEQ ID NO: 1077563 - RNA, 22 nt, Human
auaaugaaucagcauaggguga

SEQ ID NO: 1077564 - RNA, 22 nt, Human
caggugggcuugggagaacacu

SEQ ID NO: 1077565 - RNA, 22 nt, Human
gccaaugacagucucaguucug

SEQ ID NO: 1077566 - RNA, 22 nt, Human
cuggauucucaucagagccaga

SEQ ID NO: 1077567 - RNA, 22 nt, Human
uaacagaauagcagaaacagaa

SEQ ID NO: 1077568 - RNA, 22 nt, Human
ccagcugcaggggagcagugga

SEQ ID NO: 1077569 - RNA, 22 nt, Human
aaugagauguugaauuauuguu

SEQ ID NO: 1077570 - RNA, 22 nt, Human
uuugcaauuugugcugcaaaug

SEQ ID NO: 1077571 - RNA, 22 nt, Human
uaaguuuaaauguacaugaagc

SEQ ID NO: 1077572 - RNA, 22 nt, Human
ggaaggaagugaccaggauauc

SEQ ID NO: 1077573 - RNA, 22 nt, Human
aaagauacuuaauaguugucug

SEQ ID NO: 1077574 - RNA, 22 nt, Human
agccacagagguugaugugguu

SEQ ID NO: 1077575 - RNA, 22 nt, Human
uaggaaaaagaggcuggcaagg

SEQ ID NO: 1077576 - RNA, 22 nt, Human
gagacaauuucuaagaugcuuc

SEQ ID NO: 1077577 - RNA, 22 nt, Human
ugguggcuguugcagaacugag

SEQ ID NO: 1077578 - RNA, 22 nt, Human
uugucugugaaauggaaauagu

SEQ ID NO: 1077579 - RNA, 22 nt, Human
ugcuccuggaugagguacucca

SEQ ID NO: 1077580 - RNA, 22 nt, Human
acugucaauagugcugagcuug

SEQ ID NO: 1077581 - RNA, 22 nt, Human
cagcauggagacaaagugggca

SEQ ID NO: 1077582 - RNA, 22 nt, Human
acagcugacauuggcagcuauu

SEQ ID NO: 1077583 - RNA, 22 nt, Human
gaagcaaaaugucugcacauau

SEQ ID NO: 1077584 - RNA, 19 nt, Human
cugggccugcaugguuguu

SEQ ID NO: 1077585 - RNA, 22 nt, Human
ccugggcuuucaaaaccagccu

SEQ ID NO: 1077586 - RNA, 22 nt, Human
ugauuuccaaaaggcuucuaag

SEQ ID NO: 1077587 - RNA, 22 nt, Human
agccugguguggggcugcagag

SEQ ID NO: 1077588 - RNA, 22 nt, Human
gcuuccagccuuuucuccucug

SEQ ID NO: 1077589 - RNA, 22 nt, Human
uuacuuuguuugcacuucaccu

SEQ ID NO: 1077590 - RNA, 22 nt, Human
uuuccucugagugagcugggag

SEQ ID NO: 1077591 - RNA, 22 nt, Human
acuuugcugcagguuuaaagag

SEQ ID NO: 1077592 - RNA, 22 nt, Human
auuccaaaggcuggccuggagg

SEQ ID NO: 1077593 - RNA, 22 nt, Human
gcagcagaaguagaaguacagg

SEQ ID NO: 1077594 - RNA, 22 nt, Human
ugccuggguguaaagggccaac

SEQ ID NO: 1077595 - RNA, 21 nt, Human
uucccagcaccuagcacaggu

SEQ ID NO: 1077596 - RNA, 22 nt, Human
agccagggugggugaaugcuau

SEQ ID NO: 1077597 - RNA, 22 nt, Human
uugcaaauucgucacuguuaaa

SEQ ID NO: 1077598 - RNA, 22 nt, Human
cagaguguugaccauaagccca

SEQ ID NO: 1077599 - RNA, 23 nt, Human
agucucagcuggaaacauguguc

SEQ ID NO: 1077600 - RNA, 22 nt, Human
gggcuucuagaccagcagugag

SEQ ID NO: 1077601 - RNA, 22 nt, Human
agggcugcuauguugauucaga

SEQ ID NO: 1077602 - RNA, 22 nt, Human
ccaaagcaagucacaugaucaa

SEQ ID NO: 1077603 - RNA, 22 nt, Human
uugcaggauuuuagagaugaca

SEQ ID NO: 1077604 - RNA, 22 nt, Human
ugaacacacaccuauguacaaa

SEQ ID NO: 1077605 - RNA, 22 nt, Human
ugggaagaugauaauucacagu

SEQ ID NO: 1077606 - RNA, 22 nt, Human
ucagcagggagaggagaaugca

SEQ ID NO: 1077607 - RNA, 22 nt, Human
aucuucucaagcagcauccugu

SEQ ID NO: 1077608 - RNA, 22 nt, Human
uaacuacaagggcggucucugu

SEQ ID NO: 1077609 - RNA, 22 nt, Human
cauagauuuuagguuagaucga

SEQ ID NO: 1077610 - RNA, 22 nt, Human
uuauuuagucuagaugaauuuu

SEQ ID NO: 1077611 - RNA, 22 nt, Human
ccugaccuaccugaagucuaca

SEQ ID NO: 1077612 - RNA, 22 nt, Human
uucaagaagguacauuuacauc

SEQ ID NO: 1077613 - RNA, 22 nt, Human
cagggacauaagaggaacaugg

SEQ ID NO: 1077614 - RNA, 22 nt, Human
gcugcagugagccaagaucgug

SEQ ID NO: 1077615 - RNA, 22 nt, Human
aacagaauaguugauguacagu

SEQ ID NO: 1077616 - RNA, 22 nt, Human
ccagagccucgcccggagccuc

SEQ ID NO: 1077617 - RNA, 22 nt, Human
cugucuuuuuagagaguaggau

SEQ ID NO: 1077618 - RNA, 22 nt, Human
ugucucugcuuuccuugcaggg

SEQ ID NO: 1077619 - RNA, 22 nt, Human
ugcugggggugucucaccaggc

SEQ ID NO: 1077620 - RNA, 22 nt, Human
acuccagaauccuagggucagc

SEQ ID NO: 1077621 - RNA, 20 nt, Human
uuuacauuuugaaacaguga

SEQ ID NO: 1077622 - RNA, 18 nt, Human
aaggcuucaaagaguaga

SEQ ID NO: 1077623 - RNA, 22 nt, Human
uggccugguaccacauagauuu

SEQ ID NO: 1077624 - RNA, 22 nt, Human
ggacaccccggguaccaggucu

SEQ ID NO: 1077625 - RNA, 22 nt, Human
ccaggagcuggagggugcagug

SEQ ID NO: 1077626 - RNA, 23 nt, Human
cagaaauaaacugguuuguagau

SEQ ID NO: 1077627 - RNA, 22 nt, Human
ccagagggcaaaaugaagcuua

SEQ ID NO: 1077628 - RNA, 23 nt, Human
ucucccucaugccuaggccuggg

SEQ ID NO: 1077629 - RNA, 22 nt, Human
guuauuuucauuggcucagacu

SEQ ID NO: 1077630 - RNA, 21 nt, Human
cugagaccugcauuagagagg

SEQ ID NO: 1077631 - RNA, 22 nt, Human
ucugccugucuccuugaauugu

SEQ ID NO: 1077632 - RNA, 22 nt, Human
gcuggagucuggaggugugcca

SEQ ID NO: 1077633 - RNA, 22 nt, Human
ugcuuucacugauguaucauuu

SEQ ID NO: 1077634 - RNA, 22 nt, Human
cuggggcucacuuuggucaggc

SEQ ID NO: 1077635 - RNA, 22 nt, Human
agccuggaguucccaggagaag

SEQ ID NO: 1077636 - RNA, 22 nt, Human
caaggccugacugcuugucuaa

SEQ ID NO: 1077637 - RNA, 19 nt, Human
ggcaggugugcuuaugcuu

SEQ ID NO: 1077638 - RNA, 22 nt, Human
guguccuuuuaugugacugguu

SEQ ID NO: 1077639 - RNA, 22 nt, Human
gaaauacugcacacccuguaag

SEQ ID NO: 1077640 - RNA, 22 nt, Human
agcacagcuucaccgagcccau

SEQ ID NO: 1077641 - RNA, 22 nt, Human
aggcucugaucagguggcugug

SEQ ID NO: 1077642 - RNA, 22 nt, Human
uccuccugcuguuagucuugaa

SEQ ID NO: 1077643 - RNA, 22 nt, Human
gcugcucucucccuaaguuggg

SEQ ID NO: 1077644 - RNA, 22 nt, Human
aggagcagaccguaguccugca

SEQ ID NO: 1077645 - RNA, 22 nt, Human
uucuggagguuauuaggagucu

SEQ ID NO: 1077646 - RNA, 22 nt, Human
gaagauuuaagcacaauagucu

SEQ ID NO: 1077647 - RNA, 22 nt, Human
gagcagcuuaugucaagccaga

SEQ ID NO: 1077648 - RNA, 20 nt, Human
gucuccacuggggguuaacc

SEQ ID NO: 1077649 - RNA, 22 nt, Human
aguuguaagagacagauauaaa

SEQ ID NO: 1077650 - RNA, 20 nt, Human
guucucacugaucugcaggg

SEQ ID NO: 1077651 - RNA, 22 nt, Human
cuggcagcgugagcagcaucca

SEQ ID NO: 1077652 - RNA, 22 nt, Human
ucuauuagauuauucucaagga

SEQ ID NO: 1077653 - RNA, 20 nt, Human
aucaaaauccuauugagguu

SEQ ID NO: 1077654 - RNA, 22 nt, Human
ccuggcagcauugguagagauu

SEQ ID NO: 1077655 - RNA, 22 nt, Human
uucuuccucagcagggcugccu

SEQ ID NO: 1077656 - RNA, 22 nt, Human
acauugaagcugugaaaucaaa

SEQ ID NO: 1077657 - RNA, 22 nt, Human
caggcagccugcggucugcaca

SEQ ID NO: 1077658 - RNA, 22 nt, Human
uaucuguuugcucacagguguu

SEQ ID NO: 1077659 - RNA, 22 nt, Human
uauucccagccucuuucuaucu

SEQ ID NO: 1077660 - RNA, 22 nt, Human
aggacaaaggaccagaucugga

SEQ ID NO: 1077661 - RNA, 22 nt, Human
augcaacagagaaaauauugag

SEQ ID NO: 1077662 - RNA, 22 nt, Human
uuggugucuuuuuuauacaugu

SEQ ID NO: 1077663 - RNA, 22 nt, Human
gcccugugcgacucuagagguu

SEQ ID NO: 1077664 - RNA, 22 nt, Human
uaacagcauuugaaugaguaac

SEQ ID NO: 1077665 - RNA, 22 nt, Human
uggccugccucccggcuucuuu

SEQ ID NO: 1077666 - RNA, 22 nt, Human
augugagaauaacucaaaacaa

SEQ ID NO: 1077667 - RNA, 22 nt, Human
agaggcaccgucugcagcgugc

SEQ ID NO: 1077668 - RNA, 22 nt, Human
acuaaaguguuggagaaugagg

SEQ ID NO: 1077669 - RNA, 21 nt, Human
uucucaugggauaaguacaug

SEQ ID NO: 1077670 - RNA, 22 nt, Human
cugggaagaagggacaacagcg

SEQ ID NO: 1077671 - RNA, 22 nt, Human
ccuggcaccuucacagacuacu

SEQ ID NO: 1077672 - RNA, 22 nt, Human
agcuuccucaccucagaggucu

SEQ ID NO: 1077673 - RNA, 22 nt, Human
aaagcacaugaguaguguagua

SEQ ID NO: 1077674 - RNA, 20 nt, Human
augguucaggccagcugucu

SEQ ID NO: 1077675 - RNA, 22 nt, Human
aagauauuuuagaacauucacu

SEQ ID NO: 1077676 - RNA, 22 nt, Human
aucagcaagcauuuauugagug

SEQ ID NO: 1077677 - RNA, 22 nt, Human
ucaggugggcaguggguugagc

SEQ ID NO: 1077678 - RNA, 20 nt, Human
ugcacacacccuguccucca

SEQ ID NO: 1077679 - RNA, 22 nt, Human
gccagcagguggagagaucaag

SEQ ID NO: 1077680 - RNA, 22 nt, Human
gugagcaggauuucauggugua

SEQ ID NO: 1077681 - RNA, 22 nt, Human
uagaaaggauauugagaugaau

SEQ ID NO: 1077682 - RNA, 22 nt, Human
cuggcagcugugugaagaacug

SEQ ID NO: 1077683 - RNA, 22 nt, Human
ucuccugcucagaacagccuca

SEQ ID NO: 1077684 - RNA, 22 nt, Human
uugcuaaaaggugaaaagugua

SEQ ID NO: 1077685 - RNA, 22 nt, Human
uggccuggcagagcaaggccug

SEQ ID NO: 1077686 - RNA, 20 nt, Human
agugcaagaaagcacagcug

SEQ ID NO: 1077687 - RNA, 22 nt, Human
cugugggagggugagagaacca

SEQ ID NO: 1077688 - RNA, 22 nt, Human
auugcuuuuagugaaauuauau

SEQ ID NO: 1077689 - RNA, 22 nt, Human
gugaauggggcaggaaggaugg

SEQ ID NO: 1077690 - RNA, 22 nt, Human
aacauuuaugauugagguaaau

SEQ ID NO: 1077691 - RNA, 22 nt, Human
ugggacaguuguccuccacucu

SEQ ID NO: 1077692 - RNA, 22 nt, Human
ggaaacuuggcauaauuuuaag

SEQ ID NO: 1077693 - RNA, 22 nt, Human
acaggcagguugagaaacauuu

SEQ ID NO: 1077694 - RNA, 22 nt, Human
aggcccugcccagagcuccucg

SEQ ID NO: 1077695 - RNA, 19 nt, Human
ggaaacaggggccagagga

SEQ ID NO: 1077696 - RNA, 22 nt, Human
ugaaauuagaaauauguauggg

SEQ ID NO: 1077697 - RNA, 22 nt, Human
cagaggcauacucccagucuug

SEQ ID NO: 1077698 - RNA, 22 nt, Human
ugagugaggaagcgguggagga

SEQ ID NO: 1077699 - RNA, 22 nt, Human
agugcuuugaacgaaaggcuga

SEQ ID NO: 1077700 - RNA, 21 nt, Human
aggccucuucauggccaugau

SEQ ID NO: 1077701 - RNA, 22 nt, Human
uuugaaucugauauggcagcau

SEQ ID NO: 1077702 - RNA, 22 nt, Human
ugcugccaagcccgugcuccug

SEQ ID NO: 1077703 - RNA, 22 nt, Human
cugagauggaguuucgcucuuc

SEQ ID NO: 1077704 - RNA, 22 nt, Human
auucauuugcuauuguguaugg

SEQ ID NO: 1077705 - RNA, 22 nt, Human
cagccagguaugggcgugcggg

SEQ ID NO: 1077706 - RNA, 22 nt, Human
acagggcauuuccucuaugugu

SEQ ID NO: 1077707 - RNA, 22 nt, Human
aacauguauuuuccuuggcaac

SEQ ID NO: 1077708 - RNA, 17 nt, Human
guuugcaugguguuaac

SEQ ID NO: 1077709 - RNA, 22 nt, Human
uugaagcaaauucugugcagua

SEQ ID NO: 1077710 - RNA, 22 nt, Human
ggagagagaugccgccuugcuc

SEQ ID NO: 1077711 - RNA, 20 nt, Human
ugcucuggggguggagagac

SEQ ID NO: 1077712 - RNA, 22 nt, Human
ugguccugagcaccagccugac

SEQ ID NO: 1077713 - RNA, 22 nt, Human
caggccugggcuucggggcuga

SEQ ID NO: 1077714 - RNA, 22 nt, Human
ugguggggauucccucccuggc

SEQ ID NO: 1077715 - RNA, 20 nt, Human
ugcagguguuggagaaggua

SEQ ID NO: 1077716 - RNA, 22 nt, Human
cugcuuuaauguaagauauacc

SEQ ID NO: 1077717 - RNA, 22 nt, Human
uggcaacaugucgaagugcugu

SEQ ID NO: 1077718 - RNA, 22 nt, Human
guucauuuuuacuuugaucuac

SEQ ID NO: 1077719 - RNA, 22 nt, Human
uccaggccacauggauggcgau

SEQ ID NO: 1077720 - RNA, 22 nt, Human
ucaauguucaaguaugacaaug

SEQ ID NO: 1077721 - RNA, 18 nt, Human
cgcccugcuauaaaugac

SEQ ID NO: 1077722 - RNA, 22 nt, Human
cagcagggggcagcgcagauca

SEQ ID NO: 1077723 - RNA, 21 nt, Human
gcccagcaaggugagaaggcc

SEQ ID NO: 1077724 - RNA, 22 nt, Human
uaauugaacuaacaugcaaaca

SEQ ID NO: 1077725 - RNA, 21 nt, Human
ucccucagaagguagccaagc

SEQ ID NO: 1077726 - RNA, 22 nt, Human
ugugcccauuacacagaggcau

SEQ ID NO: 1077727 - RNA, 22 nt, Human
aaagauuuaugaaguucaauua

SEQ ID NO: 1077728 - RNA, 22 nt, Human
gaggccuggugugucucccgcu

SEQ ID NO: 1077729 - RNA, 22 nt, Human
guucaaauucuaugaaauaugu

SEQ ID NO: 1077730 - RNA, 22 nt, Human
auaaagaggauguauuuacagc

SEQ ID NO: 1077731 - RNA, 22 nt, Human
agcagugggugacagagcugag

SEQ ID NO: 1077732 - RNA, 22 nt, Human
acagagcuucccagccugagca

SEQ ID NO: 1077733 - RNA, 22 nt, Human
ggcagccauggacacuggcuag

SEQ ID NO: 1077734 - RNA, 22 nt, Human
gauggcagcagcagccagggau

SEQ ID NO: 1077735 - RNA, 22 nt, Human
aagcaggcauuccagagacaau

SEQ ID NO: 1077736 - RNA, 18 nt, Human
gagucuuuguuacugcug

SEQ ID NO: 1077737 - RNA, 22 nt, Human
uggacaguauugugaagcaggc

SEQ ID NO: 1077738 - RNA, 21 nt, Human
gcuggcugucccagggaagca

SEQ ID NO: 1077739 - RNA, 22 nt, Human
auucuuuucccaacugcuuuaa

SEQ ID NO: 1077740 - RNA, 22 nt, Human
aaggaagagaauccuucucaga

SEQ ID NO: 1077741 - RNA, 22 nt, Human
uccuggagagugggcgagcaca

SEQ ID NO: 1077742 - RNA, 22 nt, Human
cuucuggaggcuccagggaggu

SEQ ID NO: 1077743 - RNA, 22 nt, Human
ucugggagagcugcugucagag

SEQ ID NO: 1077744 - RNA, 22 nt, Human
gccagagcacaggcugguagua

SEQ ID NO: 1077745 - RNA, 22 nt, Human
ggcagugaacagaaaugcagaa

SEQ ID NO: 1077746 - RNA, 22 nt, Human
ugggcuccggcggccucaggcu

SEQ ID NO: 1077747 - RNA, 22 nt, Human
cugaaguggacaaauggagugg

SEQ ID NO: 1077748 - RNA, 22 nt, Human
ccucuguccuggggaguggagc

SEQ ID NO: 1077749 - RNA, 22 nt, Human
caagaucaaggugucagcaggu

SEQ ID NO: 1077750 - RNA, 22 nt, Human
caagaucaagguaucagcagau

SEQ ID NO: 1077751 - RNA, 20 nt, Human
uuucacaucugucccuuuaa

SEQ ID NO: 1077752 - RNA, 22 nt, Human
gcaggccuuggcaaugagccug

SEQ ID NO: 1077753 - RNA, 21 nt, Human
agcagcugggcaacauggagg

SEQ ID NO: 1077754 - RNA, 22 nt, Human
uucauugucucuguuugccuuc

SEQ ID NO: 1077755 - RNA, 22 nt, Human
aguggcagggcuggcugcugca

SEQ ID NO: 1077756 - RNA, 22 nt, Human
agccacccuaccagcccugaaa

SEQ ID NO: 1077757 - RNA, 22 nt, Human
cucucugggcccaguuggcacc

SEQ ID NO: 1077758 - RNA, 22 nt, Human
auauguccaccuguaugcuaaa

SEQ ID NO: 1077759 - RNA, 23 nt, Human
uguaaacaucacccccuggaguu

SEQ ID NO: 1077760 - RNA, 22 nt, Human
cuggagccggcgagccccagcc

SEQ ID NO: 1077761 - RNA, 22 nt, Human
ucaggccucagcagcccacagg

SEQ ID NO: 1077762 - RNA, 22 nt, Human
uaaugccuagauuauucuguuu

SEQ ID NO: 1077763 - RNA, 20 nt, Human
ucagugauuaucucugagug

SEQ ID NO: 1077764 - RNA, 22 nt, Human
acugggccuugccauggcagcc

SEQ ID NO: 1077765 - RNA, 22 nt, Human
aucugaaacucugacauugucu

SEQ ID NO: 1077766 - RNA, 22 nt, Human
uauuuacccuggcagcuguagc

SEQ ID NO: 1077767 - RNA, 18 nt, Human
gcuguucuucgcacuggc

SEQ ID NO: 1077768 - RNA, 22 nt, Human
acauuuaaugauccuacuguga

SEQ ID NO: 1077769 - RNA, 22 nt, Human
uuaauugagccagaaaguaucu

SEQ ID NO: 1077770 - RNA, 22 nt, Human
ccaggacaggaguuggcuucgc

SEQ ID NO: 1077771 - RNA, 20 nt, Human
uuggaacaguggaucagcag

SEQ ID NO: 1077772 - RNA, 22 nt, Human
uuccagaggcucuaggggagaa

SEQ ID NO: 1077773 - RNA, 20 nt, Human
uccaagcccuccuuccauuc

SEQ ID NO: 1077774 - RNA, 22 nt, Human
auguaauuuauguuauccauaa

SEQ ID NO: 1077775 - RNA, 22 nt, Human
aaacaccaagagcuagcuauua

SEQ ID NO: 1077776 - RNA, 22 nt, Human
uuccagccuuuauccauccaga

SEQ ID NO: 1077777 - RNA, 22 nt, Human
ugcagggcuccuggcuccaauc

SEQ ID NO: 1077778 - RNA, 22 nt, Human
uucucagaugauucagauaaac

SEQ ID NO: 1077779 - RNA, 22 nt, Human
uggcucagaacuacuucuaguu

SEQ ID NO: 1077780 - RNA, 22 nt, Human
ugagcagaaaagaaugcugagc

SEQ ID NO: 1077781 - RNA, 22 nt, Human
ggccccuggcaccaggcugauu

SEQ ID NO: 1077782 - RNA, 19 nt, Human
cuucauucuucagcuuuug

SEQ ID NO: 1077783 - RNA, 22 nt, Human
ugccuucaaucaggauggucuc

SEQ ID NO: 1077784 - RNA, 22 nt, Human
uucugcauugacuuuuauuucc

SEQ ID NO: 1077785 - RNA, 22 nt, Human
agcauccaacaggagggaaggg

SEQ ID NO: 1077786 - RNA, 17 nt, Human
agcaggcugcagaggcc

SEQ ID NO: 1077787 - RNA, 22 nt, Human
ccaaaauuauuacauuuguagg

SEQ ID NO: 1077788 - RNA, 22 nt, Human
aauguuucuggauauugugggu

SEQ ID NO: 1077789 - RNA, 22 nt, Human
aaagcuuuguaaauaaacaggu

SEQ ID NO: 1077790 - RNA, 22 nt, Human
aaagaacaauguggaaucuccu

SEQ ID NO: 1077791 - RNA, 20 nt, Human
agauggugaaggccagggag

SEQ ID NO: 1077792 - RNA, 22 nt, Human
acagaauauuguaagugccacu

SEQ ID NO: 1077793 - RNA, 18 nt, Human
ccauuucaugauuauuac

SEQ ID NO: 1077794 - RNA, 21 nt, Human
ccuauugaauauaggaagauu

SEQ ID NO: 1077795 - RNA, 22 nt, Human
augccacugacauggacaauuu

SEQ ID NO: 1077796 - RNA, 22 nt, Human
augaaaacuuuagccucauuag

SEQ ID NO: 1077797 - RNA, 22 nt, Human
aucacgucaugguuugaucugg

SEQ ID NO: 1077798 - RNA, 22 nt, Human
cagagagaggccacugcuauua

SEQ ID NO: 1077799 - RNA, 22 nt, Human
uucucagguagugcugaugcug

SEQ ID NO: 1077800 - RNA, 22 nt, Human
gucaauauagaucaaugcacag

SEQ ID NO: 1077801 - RNA, 22 nt, Human
ggcuguggcauuaggugaggcc

SEQ ID NO: 1077802 - RNA, 22 nt, Human
aaugaacacagcccucuacuuu

SEQ ID NO: 1077803 - RNA, 22 nt, Human
caaauauuccagguacaucccu

SEQ ID NO: 1077804 - RNA, 23 nt, Human
aggagcacuuucaguuuguaaag

SEQ ID NO: 1077805 - RNA, 22 nt, Human
ucaggcagguuggcugcagguc

SEQ ID NO: 1077806 - RNA, 22 nt, Human
agagugagggggcacugagacg

SEQ ID NO: 1077807 - RNA, 22 nt, Human
uauacacauaucuucuaggccu

SEQ ID NO: 1077808 - RNA, 22 nt, Human
uagggcaguuauaacauuagug

SEQ ID NO: 1077809 - RNA, 22 nt, Human
ucuucagauugcacugagcaag

SEQ ID NO: 1077810 - RNA, 22 nt, Human
ugagagggcccagagcacacca

SEQ ID NO: 1077811 - RNA, 22 nt, Human
ugaacacauuucuggccaauuu

SEQ ID NO: 1077812 - RNA, 22 nt, Human
ucaggcucaggaauguguuuau

SEQ ID NO: 1077813 - RNA, 22 nt, Human
ugugagacaggaccuguugacu

SEQ ID NO: 1077814 - RNA, 22 nt, Human
cacauauuugaugaagcuuugu

SEQ ID NO: 1077815 - RNA, 22 nt, Human
uuuuuaaugcagucugagacau

SEQ ID NO: 1077816 - RNA, 22 nt, Human
augcaagagauggacuuguguu

SEQ ID NO: 1077817 - RNA, 22 nt, Human
cagcuggaugggagaccauguu

SEQ ID NO: 1077818 - RNA, 22 nt, Human
agucccaggcagccgagccggu

SEQ ID NO: 1077819 - RNA, 23 nt, Human
gaaaucuagucauuuuuagucug

SEQ ID NO: 1077820 - RNA, 22 nt, Human
ugcccccugguggccagagccg

SEQ ID NO: 1077821 - RNA, 22 nt, Human
aacuucuaaucuguacaguuuu

SEQ ID NO: 1077822 - RNA, 22 nt, Human
cucaagucagaaauaaaagcau

SEQ ID NO: 1077823 - RNA, 22 nt, Human
uaaagcaggccacauaugugau

SEQ ID NO: 1077824 - RNA, 22 nt, Human
ugcacacauacaugggaagugc

SEQ ID NO: 1077825 - RNA, 22 nt, Human
gcagggcagagggagaaucucu

SEQ ID NO: 1077826 - RNA, 22 nt, Human
cuggccuuuagccccagugucu

SEQ ID NO: 1077827 - RNA, 21 nt, Human
aguguguguggaaugagaaua

SEQ ID NO: 1077828 - RNA, 22 nt, Human
gcacaggcacagagggccacug

SEQ ID NO: 1077829 - RNA, 22 nt, Human
gaaggcuaaaggggcagagguu

SEQ ID NO: 1077830 - RNA, 22 nt, Human
acagaauauuuuauuuagauca

SEQ ID NO: 1077831 - RNA, 22 nt, Human
aggcagcaagauuauuuaaucc

SEQ ID NO: 1077832 - RNA, 22 nt, Human
cacaggaaagucagccagaaga

SEQ ID NO: 1077833 - RNA, 22 nt, Human
uuuauuugaaucaggggagaau

SEQ ID NO: 1077834 - RNA, 22 nt, Human
agggccucgaaggcagagggau

SEQ ID NO: 1077835 - RNA, 22 nt, Human
cucccaggcacagggaggagcc

SEQ ID NO: 1077836 - RNA, 22 nt, Human
cagcaggaccauugaggcauca

SEQ ID NO: 1077837 - RNA, 19 nt, Human
uuggaaggagccagagugg

SEQ ID NO: 1077838 - RNA, 22 nt, Human
uuuuuguucccagagaauuugu

SEQ ID NO: 1077839 - RNA, 22 nt, Human
gaagcccagcaaacugugauca

SEQ ID NO: 1077840 - RNA, 22 nt, Human
caggacacauuucuuguucagg

SEQ ID NO: 1077841 - RNA, 22 nt, Human
ugggagcucagaaagggagguc

SEQ ID NO: 1077842 - RNA, 19 nt, Human
auuuuucuuccucugugca

SEQ ID NO: 1077843 - RNA, 22 nt, Human
agaaaugucaaguguucuuguu

SEQ ID NO: 1077844 - RNA, 22 nt, Human
cuauuuguaaagugccuggugu

SEQ ID NO: 1077845 - RNA, 22 nt, Human
gaugagugaggacaggguggca

SEQ ID NO: 1077846 - RNA, 20 nt, Human
uuguuucugcuauuuucuaa

SEQ ID NO: 1077847 - RNA, 17 nt, Human
ucucaggggcuagcccu

SEQ ID NO: 1077848 - RNA, 22 nt, Human
ucucugggauaaacugggccag

SEQ ID NO: 1077849 - RNA, 22 nt, Human
uccacaauggcagagaaauguc

SEQ ID NO: 1077850 - RNA, 22 nt, Human
agggccagaaucccucagucua

SEQ ID NO: 1077851 - RNA, 22 nt, Human
ccucacugaagaggugacauuu

SEQ ID NO: 1077852 - RNA, 22 nt, Human
ucauuaagaaaugaggaguccc

SEQ ID NO: 1077853 - RNA, 22 nt, Human
ucagacaaguaaaauaauguaa

SEQ ID NO: 1077854 - RNA, 22 nt, Human
agggagugguuaagaaggugca

SEQ ID NO: 1077855 - RNA, 22 nt, Human
guuuguguaacaugaugaugau

SEQ ID NO: 1077856 - RNA, 22 nt, Human
ucaaagaauguuaugaggguag

SEQ ID NO: 1077857 - RNA, 22 nt, Human
uguaacaguaguuacuauucuu

SEQ ID NO: 1077858 - RNA, 20 nt, Human
uuuauucagccuacccucuu

SEQ ID NO: 1077859 - RNA, 22 nt, Human
agcuagagaaugacagagucug

SEQ ID NO: 1077860 - RNA, 22 nt, Human
gcugagagcaaggacaaagcau

SEQ ID NO: 1077861 - RNA, 23 nt, Human
uggccuggagagaaaagaugagu

SEQ ID NO: 1077862 - RNA, 22 nt, Human
augcuucagugcuaccuucaaa

SEQ ID NO: 1077863 - RNA, 22 nt, Human
aggcuggaguacaguggcuauu

SEQ ID NO: 1077864 - RNA, 22 nt, Human
gaaugaauagguguccagaugg

SEQ ID NO: 1077865 - RNA, 20 nt, Human
gcagugauuugucuauguuu

SEQ ID NO: 1077866 - RNA, 22 nt, Human
agcagcuucuuucacuccugga

SEQ ID NO: 1077867 - RNA, 22 nt, Human
cguaugaaauuuuugacauuug

SEQ ID NO: 1077868 - RNA, 22 nt, Human
ugaagggcaaccccaggcccag

SEQ ID NO: 1077869 - RNA, 22 nt, Human
aggugccaacaguauuucugcc

SEQ ID NO: 1077870 - RNA, 22 nt, Human
uucaaugaggauagaacuggau

SEQ ID NO: 1077871 - RNA, 22 nt, Human
agcagguggucuguugcugcug

SEQ ID NO: 1077872 - RNA, 18 nt, Human
ugcccagaaaagcaggga

SEQ ID NO: 1077873 - RNA, 21 nt, Human
gagagggcauuauaggaagug

SEQ ID NO: 1077874 - RNA, 22 nt, Human
uuucaaagaccauuaacuauca

SEQ ID NO: 1077875 - RNA, 22 nt, Human
ucuccugguuuguuaaauaauu

SEQ ID NO: 1077876 - RNA, 22 nt, Human
ucagggaccccucugaguggag

SEQ ID NO: 1077877 - RNA, 22 nt, Human
cuccuuccugguuagcaccuua

SEQ ID NO: 1077878 - RNA, 22 nt, Human
ggguuggggcccagcagucugc

SEQ ID NO: 1077879 - RNA, 22 nt, Human
ugggccuucuaaucuggucccu

SEQ ID NO: 1077880 - RNA, 22 nt, Human
ggaugcccacuaucugcuggcu

SEQ ID NO: 1077881 - RNA, 22 nt, Human
gggaccugccaaggccacccag

SEQ ID NO: 1077882 - RNA, 22 nt, Human
caacauauuuuccaagagugaa

SEQ ID NO: 1077883 - RNA, 22 nt, Human
cagagccaacgccaccugccca

SEQ ID NO: 1077884 - RNA, 22 nt, Human
gaugaagccugacuucucggug

SEQ ID NO: 1077885 - RNA, 22 nt, Human
uucccagauuggagggcagggg

SEQ ID NO: 1077886 - RNA, 23 nt, Human
ugauuacaggaaguucaaguguu

SEQ ID NO: 1077887 - RNA, 23 nt, Human
uagauguuuggggaacuuugccc

SEQ ID NO: 1077888 - RNA, 22 nt, Human
aaaacuacauuugacauuuugu

SEQ ID NO: 1077889 - RNA, 22 nt, Human
cugcuuauggagaugaguaaga

SEQ ID NO: 1077890 - RNA, 22 nt, Human
guccucugggagccuugagccu

SEQ ID NO: 1077891 - RNA, 20 nt, Human
cuuggccuacuuagcuuugu

SEQ ID NO: 1077892 - RNA, 22 nt, Human
cugcaggcccccuuccuggagu

SEQ ID NO: 1077893 - RNA, 22 nt, Human
uaagcagaaaaagugggaguua

SEQ ID NO: 1077894 - RNA, 22 nt, Human
cugccacuuacuaggcauggug

SEQ ID NO: 1077895 - RNA, 22 nt, Human
gauuucuguggcuuguacauau

SEQ ID NO: 1077896 - RNA, 22 nt, Human
aagaaucugacauaauuuccug

SEQ ID NO: 1077897 - RNA, 21 nt, Human
uccucugcagugagguggccu

SEQ ID NO: 1077898 - RNA, 22 nt, Human
cauuuagagaagauuacaagga

SEQ ID NO: 1077899 - RNA, 22 nt, Human
acaaaguuaacaguuggauagu

SEQ ID NO: 1077900 - RNA, 22 nt, Human
aucuggcuuuuaccccacggcc

SEQ ID NO: 1077901 - RNA, 22 nt, Human
uuuguuuagaaagagauuggug

SEQ ID NO: 1077902 - RNA, 18 nt, Human
ugggcugccuggccucug

SEQ ID NO: 1077903 - RNA, 22 nt, Human
gaggguggguuucuugcacguc

SEQ ID NO: 1077904 - RNA, 22 nt, Human
uuucuaaggugagguagaaaau

SEQ ID NO: 1077905 - RNA, 22 nt, Human
uaggugugggcucaggaaugug

SEQ ID NO: 1077906 - RNA, 19 nt, Human
cugaaaaacauucucagga

SEQ ID NO: 1077907 - RNA, 22 nt, Human
acuguucauuuggauuucucug

SEQ ID NO: 1077908 - RNA, 22 nt, Human
acacacugggcaugguuuaugc

SEQ ID NO: 1077909 - RNA, 22 nt, Human
gccugccccuuccugggcaggg

SEQ ID NO: 1077910 - RNA, 22 nt, Human
agcagguguuagggauccaaug

SEQ ID NO: 1077911 - RNA, 22 nt, Human
acauuaaaaaauguugcaugaa

SEQ ID NO: 1077912 - RNA, 22 nt, Human
ucagaaagguugagucaugugc

SEQ ID NO: 1077913 - RNA, 22 nt, Human
auaugcuuacagcuuaaaaucc

SEQ ID NO: 1077914 - RNA, 21 nt, Human
gucagcagauccagcacuugu

SEQ ID NO: 1077915 - RNA, 22 nt, Human
uccagcagcccgaaggcccauc

SEQ ID NO: 1077916 - RNA, 22 nt, Human
ucuggcucauacaagccugcaa

SEQ ID NO: 1077917 - RNA, 22 nt, Human
ggcuucugagugcucugcuguu

SEQ ID NO: 1077918 - RNA, 22 nt, Human
acagacauggaccaagcacugu

SEQ ID NO: 1077919 - RNA, 22 nt, Human
gugcucaggaagcuguuccugc

SEQ ID NO: 1077920 - RNA, 22 nt, Human
ccacauuuuugauacucucacu

SEQ ID NO: 1077921 - RNA, 22 nt, Human
agagugauucuaguuagggaau

SEQ ID NO: 1077922 - RNA, 22 nt, Human
uaucuguucaauggaagaugac

SEQ ID NO: 1077923 - RNA, 22 nt, Human
uacauuguacuuacaaauagug

SEQ ID NO: 1077924 - RNA, 22 nt, Human
ucugaaauuguuaguaaaaaug

SEQ ID NO: 1077925 - RNA, 22 nt, Human
gccacauagaggaggauauuaa

SEQ ID NO: 1077926 - RNA, 20 nt, Human
caugccugcugguaucuggc

SEQ ID NO: 1077927 - RNA, 22 nt, Human
caaugguggugucagaagagau

SEQ ID NO: 1077928 - RNA, 22 nt, Human
aucuagaaaaggugacuaaaau

SEQ ID NO: 1077929 - RNA, 22 nt, Human
gccuggcacucaaucaucugcu

SEQ ID NO: 1077930 - RNA, 21 nt, Human
uuugaaagcuacaucuauagc

SEQ ID NO: 1077931 - RNA, 18 nt, Human
cagagugggccaagagac

SEQ ID NO: 1077932 - RNA, 22 nt, Human
ggaaaucaaggggacaaauugu

SEQ ID NO: 1077933 - RNA, 22 nt, Human
aacauugaaauauuugcaauag

SEQ ID NO: 1077934 - RNA, 22 nt, Human
ccaggagcccugccacaauggu

SEQ ID NO: 1077935 - RNA, 22 nt, Human
cuggcugcaggaaggagugggc

SEQ ID NO: 1077936 - RNA, 22 nt, Human
gauuuccuugcauauugguaau

SEQ ID NO: 1077937 - RNA, 23 nt, Human
uauuacaauuggucuuauuaaga

SEQ ID NO: 1077938 - RNA, 22 nt, Human
gggacagacccaugggccaggu

SEQ ID NO: 1077939 - RNA, 22 nt, Human
gaacuucagaaucagcauaucu

SEQ ID NO: 1077940 - RNA, 22 nt, Human
ccuuucaaaguuuugccaugcu

SEQ ID NO: 1077941 - RNA, 22 nt, Human
cugcuguguugccagugucacc

SEQ ID NO: 1077942 - RNA, 22 nt, Human
ucacauuuuuuacuggacuuaa

SEQ ID NO: 1077943 - RNA, 22 nt, Human
agcagcaauggaaagcaacaca

SEQ ID NO: 1077944 - RNA, 22 nt, Human
aucaacauggcaaugcccaucu

SEQ ID NO: 1077945 - RNA, 22 nt, Human
ggcaggcaagucugcucuguga

SEQ ID NO: 1077946 - RNA, 22 nt, Human
ucucaguguguuuucucucaga

SEQ ID NO: 1077947 - RNA, 22 nt, Human
ccaaacaaauccccauucuuag

SEQ ID NO: 1077948 - RNA, 22 nt, Human
aguagaaagaaggcacugggcc

SEQ ID NO: 1077949 - RNA, 22 nt, Human
caggaaccugugcguagggaug

SEQ ID NO: 1077950 - RNA, 22 nt, Human
caagagcuagacuuugucagga

SEQ ID NO: 1077951 - RNA, 22 nt, Human
uacuuuuuaugauaagaacuga

SEQ ID NO: 1077952 - RNA, 22 nt, Human
augggcugacaagacaugcaua

SEQ ID NO: 1077953 - RNA, 22 nt, Human
agcuggggguuggauaagggua

SEQ ID NO: 1077954 - RNA, 22 nt, Human
auuccacuuuaugucuguauga

SEQ ID NO: 1077955 - RNA, 23 nt, Human
gccugccugaccugugcaaaguc

SEQ ID NO: 1077956 - RNA, 22 nt, Human
gcaagcuggcuguuagaggaug

SEQ ID NO: 1077957 - RNA, 22 nt, Human
aagcuggacucugccauuuacu

SEQ ID NO: 1077958 - RNA, 22 nt, Human
cucacagaugcugugggucagg

SEQ ID NO: 1077959 - RNA, 22 nt, Human
aggugggcaaugaggccugagu

SEQ ID NO: 1077960 - RNA, 21 nt, Human
ugcugaugucagagaagcaag

SEQ ID NO: 1077961 - RNA, 22 nt, Human
caggauggucuucauuuggcuc

SEQ ID NO: 1077962 - RNA, 22 nt, Human
uuuuuaccuggaggauaaaugu

SEQ ID NO: 1077963 - RNA, 22 nt, Human
gaggcacaguguuuggucagug

SEQ ID NO: 1077964 - RNA, 22 nt, Human
cucaggauuaaggaaucuaaau

SEQ ID NO: 1077965 - RNA, 22 nt, Human
acacagaugcuauuuagucucu

SEQ ID NO: 1077966 - RNA, 22 nt, Human
uuuguacauccuaauucugagu

SEQ ID NO: 1077967 - RNA, 23 nt, Human
uggccucuccccaccuggcagaa

SEQ ID NO: 1077968 - RNA, 22 nt, Human
gcugugcuggaaggggaccugc

SEQ ID NO: 1077969 - RNA, 22 nt, Human
uaagaacauuuucggaaagaua

SEQ ID NO: 1077970 - RNA, 22 nt, Human
ucagggcauacucuucaagguc

SEQ ID NO: 1077971 - RNA, 22 nt, Human
aauuaauuuuguucauucaguc

SEQ ID NO: 1077972 - RNA, 23 nt, Human
uugaaagguagcuggcagcuaga

SEQ ID NO: 1077973 - RNA, 22 nt, Human
uucuggcaaggcaagccuggcu

SEQ ID NO: 1077974 - RNA, 22 nt, Human
cugcccugaccugccucagagu

SEQ ID NO: 1077975 - RNA, 22 nt, Human
auauugcaauagaugcaucauu

SEQ ID NO: 1077976 - RNA, 22 nt, Human
aguuacaacuguuugaauguca

SEQ ID NO: 1077977 - RNA, 20 nt, Human
cagggcacacugcagccucg

SEQ ID NO: 1077978 - RNA, 22 nt, Human
gaaaguacagauuccuggccag

SEQ ID NO: 1077979 - RNA, 22 nt, Human
uacacacagaggccaugggauu

SEQ ID NO: 1077980 - RNA, 22 nt, Human
gaagccacuauagauauucuaa

SEQ ID NO: 1077981 - RNA, 22 nt, Human
aaugauguauguauaaggcagg

SEQ ID NO: 1077982 - RNA, 22 nt, Human
uaguaacacacugguauuugga

SEQ ID NO: 1077983 - RNA, 22 nt, Human
cacccacauuccaucacucugc

SEQ ID NO: 1077984 - RNA, 22 nt, Human
ugcccugucuaagcugucagua

SEQ ID NO: 1077985 - RNA, 22 nt, Human
ggcagcuccaaaaggaaacacu

SEQ ID NO: 1077986 - RNA, 22 nt, Human
gagauuucuuuugaugccuguc

SEQ ID NO: 1077987 - RNA, 22 nt, Human
gagugguaggcaguguuaggaa

SEQ ID NO: 1077988 - RNA, 22 nt, Human
gggcaagcucuucagaagcucu

SEQ ID NO: 1077989 - RNA, 22 nt, Human
ucuggagcuuccucauuuacag

SEQ ID NO: 1077990 - RNA, 22 nt, Human
cccuggcuuaaaaaccucauau

SEQ ID NO: 1077991 - RNA, 22 nt, Human
uucucagaggagucgggagcug

SEQ ID NO: 1077992 - RNA, 22 nt, Human
gcugcucugcuguguaagcagg

SEQ ID NO: 1077993 - RNA, 22 nt, Human
agggcaugaagcaguggacagc

SEQ ID NO: 1077994 - RNA, 22 nt, Human
ucuagaaaguuuguacugauuu

SEQ ID NO: 1077995 - RNA, 22 nt, Human
aacaagugauauauaauggaag

SEQ ID NO: 1077996 - RNA, 22 nt, Human
aguggcagaucucuggucugga

SEQ ID NO: 1077997 - RNA, 22 nt, Human
agcagaaccugcagaccugucu

SEQ ID NO: 1077998 - RNA, 22 nt, Human
guaaaauagaauaacguggcua

SEQ ID NO: 1077999 - RNA, 22 nt, Human
cuguggcucucagaggcugcug

SEQ ID NO: 1078000 - RNA, 22 nt, Human
aaacuugauuuagaacuaaggc

SEQ ID NO: 1078001 - RNA, 22 nt, Human
cugggaggugaacagaaaaacu

SEQ ID NO: 1078002 - RNA, 22 nt, Human
aacagugucaggauuacagaua

SEQ ID NO: 1078003 - RNA, 22 nt, Human
uugggaaggcguggaagcagaa

SEQ ID NO: 1078004 - RNA, 21 nt, Human
agcaccuuacagcuauaaugg

SEQ ID NO: 1078005 - RNA, 22 nt, Human
cuauuuguacagcauucgaguu

SEQ ID NO: 1078006 - RNA, 22 nt, Human
ggcaggguuuacaauagcaaua

SEQ ID NO: 1078007 - RNA, 22 nt, Human
auggcucauuuaucuugcagcc

SEQ ID NO: 1078008 - RNA, 22 nt, Human
agaguccauaugugggaggagu

SEQ ID NO: 1078009 - RNA, 22 nt, Human
agcagcuguggggacaagggua

SEQ ID NO: 1078010 - RNA, 22 nt, Human
gcuucaugaaaaucacugguca

SEQ ID NO: 1078011 - RNA, 22 nt, Human
auuguaacaacaauaguuuagg

SEQ ID NO: 1078012 - RNA, 22 nt, Human
agggaagaaucacugggauguu

SEQ ID NO: 1078013 - RNA, 22 nt, Human
gcagcuggaagugacacucugu

SEQ ID NO: 1078014 - RNA, 22 nt, Human
uacacagauuuaaaagcaggga

SEQ ID NO: 1078015 - RNA, 22 nt, Human
gucaugccuggcuucuuagaca

SEQ ID NO: 1078016 - RNA, 22 nt, Human
cccaggagguggagguugcagu

SEQ ID NO: 1078017 - RNA, 22 nt, Human
ucacuguaucauguugcacuua

SEQ ID NO: 1078018 - RNA, 22 nt, Human
cugugccuccagucucgcuucu

SEQ ID NO: 1078019 - RNA, 22 nt, Human
uuuuaaucaugcuucuaugucc

SEQ ID NO: 1078020 - RNA, 22 nt, Human
ucaaaggcauugccaauaagua

SEQ ID NO: 1078021 - RNA, 22 nt, Human
cucaggauggaagccuacagga

SEQ ID NO: 1078022 - RNA, 22 nt, Human
gcacugcagguggguggagagg

SEQ ID NO: 1078023 - RNA, 22 nt, Human
aagucauagucuaacccagcca

SEQ ID NO: 1078024 - RNA, 20 nt, Human
gucagaggacccuagagcga

SEQ ID NO: 1078025 - RNA, 18 nt, Human
uaugugcauaugugugua

SEQ ID NO: 1078026 - RNA, 22 nt, Human
aucuccaggcauuucaagagac

SEQ ID NO: 1078027 - RNA, 22 nt, Human
ugcccugcaugcagggagcugu

SEQ ID NO: 1078028 - RNA, 21 nt, Human
ucuucaguacacuugcacgcc

SEQ ID NO: 1078029 - RNA, 22 nt, Human
ggcucaggaugagccuucucau

SEQ ID NO: 1078030 - RNA, 22 nt, Human
uaguuuuagucccauuuuacag

SEQ ID NO: 1078031 - RNA, 22 nt, Human
ugcugccucagcuuccugggcu

SEQ ID NO: 1078032 - RNA, 22 nt, Human
acagaagagcacauuuaguaug

SEQ ID NO: 1078033 - RNA, 22 nt, Human
aaggaagacacagaugaaguga

SEQ ID NO: 1078034 - RNA, 22 nt, Human
gaaacaaucaucaugugauuug

SEQ ID NO: 1078035 - RNA, 22 nt, Human
acacuucagcuccacaaacauu

SEQ ID NO: 1078036 - RNA, 22 nt, Human
uuuugcuugagugcacaaaaug

SEQ ID NO: 1078037 - RNA, 22 nt, Human
cccaggaaagugaaucuaauug

SEQ ID NO: 1078038 - RNA, 22 nt, Human
cacugaaucucaaggggagggu

SEQ ID NO: 1078039 - RNA, 23 nt, Human
agcugggccagguggucagaccu

SEQ ID NO: 1078040 - RNA, 22 nt, Human
agagaacagccuccuagagaaa

SEQ ID NO: 1078041 - RNA, 22 nt, Human
uuucacagagaauauugccuug

SEQ ID NO: 1078042 - RNA, 22 nt, Human
cagaagaaaucauuaucuggac

SEQ ID NO: 1078043 - RNA, 22 nt, Human
augcaaauuaacauauaguaga

SEQ ID NO: 1078044 - RNA, 22 nt, Human
ggaucacacaugcacuguuuga

SEQ ID NO: 1078045 - RNA, 22 nt, Human
cugggcaugaaaaggaugccag

SEQ ID NO: 1078046 - RNA, 22 nt, Human
acugucuguccugcucuccgug

SEQ ID NO: 1078047 - RNA, 21 nt, Human
gagauggcccaguagcgggcc

SEQ ID NO: 1078048 - RNA, 22 nt, Human
uaacacuugaagccauuuuugc

SEQ ID NO: 1078049 - RNA, 22 nt, Human
uuauuucauugauuucuaagac

SEQ ID NO: 1078050 - RNA, 22 nt, Human
augggcugggaauacacagggg

SEQ ID NO: 1078051 - RNA, 19 nt, Human
aauucuguuucagcagauc

SEQ ID NO: 1078052 - RNA, 22 nt, Human
uggccuggaaaaaugcagaugg

SEQ ID NO: 1078053 - RNA, 22 nt, Human
cugcuuugcauagcugccagag

SEQ ID NO: 1078054 - RNA, 22 nt, Human
acaggcuguugggguccagggu

SEQ ID NO: 1078055 - RNA, 22 nt, Human
ugcagccauuuucugccaaugc

SEQ ID NO: 1078056 - RNA, 20 nt, Human
ucugcccaccccggcuccca

SEQ ID NO: 1078057 - RNA, 22 nt, Human
cugccaucugagccaaaagugc

SEQ ID NO: 1078058 - RNA, 22 nt, Human
gaguccaggcucagaaacccgu

SEQ ID NO: 1078059 - RNA, 22 nt, Human
gccugagaguugaaguucagug

SEQ ID NO: 1078060 - RNA, 22 nt, Human
uauuuccaagcugaauccaaug

SEQ ID NO: 1078061 - RNA, 22 nt, Human
gcuggcagagagcuggugagga

SEQ ID NO: 1078062 - RNA, 22 nt, Human
agagacaagggaccucuggaga

SEQ ID NO: 1078063 - RNA, 22 nt, Human
agucuucccugugccagagugu

SEQ ID NO: 1078064 - RNA, 22 nt, Human
cuguauuuucaugccuacguac

SEQ ID NO: 1078065 - RNA, 22 nt, Human
gcaggcucacucuguuuggcuc

SEQ ID NO: 1078066 - RNA, 19 nt, Human
uuuggcacucugaaguguu

SEQ ID NO: 1078067 - RNA, 18 nt, Human
agcaaagcaagagaucac

SEQ ID NO: 1078068 - RNA, 22 nt, Human
uacugccuggagcauuggugcu

SEQ ID NO: 1078069 - RNA, 22 nt, Human
uccucagacuucccuuugugua

SEQ ID NO: 1078070 - RNA, 22 nt, Human
cugaggcaggauggccuggcug

SEQ ID NO: 1078071 - RNA, 22 nt, Human
uuuguguuuucccauacuauug

SEQ ID NO: 1078072 - RNA, 20 nt, Human
cuuuuucuccagcucugagc

SEQ ID NO: 1078073 - RNA, 22 nt, Human
ccaagcuacuuaggagucugag

SEQ ID NO: 1078074 - RNA, 22 nt, Human
cagugaggaguccagggcagag

SEQ ID NO: 1078075 - RNA, 20 nt, Human
ccagacagcaccugccuggu

SEQ ID NO: 1078076 - RNA, 22 nt, Human
gaaauacaaaugccuagauccu

SEQ ID NO: 1078077 - RNA, 22 nt, Human
agagcugguuuacucaggaauu

SEQ ID NO: 1078078 - RNA, 22 nt, Human
acucuugauugauuuagucuuu

SEQ ID NO: 1078079 - RNA, 22 nt, Human
caggcccaaaugcaaccuucuu

SEQ ID NO: 1078080 - RNA, 22 nt, Human
ggaaccaggaguuacacgaguu

SEQ ID NO: 1078081 - RNA, 22 nt, Human
aggcugcaggucugggucaugu

SEQ ID NO: 1078082 - RNA, 22 nt, Human
acaugcuaugagagauuacuuc

SEQ ID NO: 1078083 - RNA, 19 nt, Human
acagagcucucugcuucug

SEQ ID NO: 1078084 - RNA, 22 nt, Human
uccuccugucuaccaguuccug

SEQ ID NO: 1078085 - RNA, 22 nt, Human
gauuucaaagguucugcaugcc

SEQ ID NO: 1078086 - RNA, 22 nt, Human
uuccuauggcucaguugcauuu

SEQ ID NO: 1078087 - RNA, 22 nt, Human
uucucuagguuuuagaugaaga

SEQ ID NO: 1078088 - RNA, 22 nt, Human
ccaaaauauuagugcuuaagua

SEQ ID NO: 1078089 - RNA, 22 nt, Human
gugauuucagguuuuucauacu

SEQ ID NO: 1078090 - RNA, 22 nt, Human
uacagcagagugggaugcaucu

SEQ ID NO: 1078091 - RNA, 22 nt, Human
aaucaguuguccaaaguucaca

SEQ ID NO: 1078092 - RNA, 22 nt, Human
auucacagagugguuaguggua

SEQ ID NO: 1078093 - RNA, 22 nt, Human
ccuggggagaagagcuuccccc

SEQ ID NO: 1078094 - RNA, 22 nt, Human
auugcuguacacuucuagaucu

SEQ ID NO: 1078095 - RNA, 22 nt, Human
cuggcuuucucugugguguuca

SEQ ID NO: 1078096 - RNA, 22 nt, Human
gaaauauacaugaagucggcug

SEQ ID NO: 1078097 - RNA, 22 nt, Human
aaucuucacucauucagaguug

SEQ ID NO: 1078098 - RNA, 22 nt, Human
ggcagcucaccucugguccagg

SEQ ID NO: 1078099 - RNA, 22 nt, Human
acugccuggccuggccucacug

SEQ ID NO: 1078100 - RNA, 22 nt, Human
agaaugauacucuaugccaaau

SEQ ID NO: 1078101 - RNA, 22 nt, Human
cugggcugugguguggcccaaa

SEQ ID NO: 1078102 - RNA, 22 nt, Human
uacuguuuuaaaagguacuugu

SEQ ID NO: 1078103 - RNA, 22 nt, Human
ccagggcaggagaaagacucac

SEQ ID NO: 1078104 - RNA, 22 nt, Human
auuuguugcuagcagcacugau

SEQ ID NO: 1078105 - RNA, 22 nt, Human
ugcccauguuucucuguauccc

SEQ ID NO: 1078106 - RNA, 22 nt, Human
uucuuucccuuccagcagcucc

SEQ ID NO: 1078107 - RNA, 20 nt, Human
aaauuacugccacacauuuc

SEQ ID NO: 1078108 - RNA, 22 nt, Human
ugcaucaaccuaauaucagcuc

SEQ ID NO: 1078109 - RNA, 22 nt, Human
gccagaaacauacacaucacuu

SEQ ID NO: 1078110 - RNA, 22 nt, Human
aggaagugcuaagagaacauca

SEQ ID NO: 1078111 - RNA, 22 nt, Human
guuacacaggaaaacauuagca

SEQ ID NO: 1078112 - RNA, 22 nt, Human
ugccucagagugggcuugcuau

SEQ ID NO: 1078113 - RNA, 22 nt, Human
ucacagaaaagcugagcaucag

SEQ ID NO: 1078114 - RNA, 22 nt, Human
uguuuuuaucucuguguacaac

SEQ ID NO: 1078115 - RNA, 22 nt, Human
gcugcagccuucuugccauuaa

SEQ ID NO: 1078116 - RNA, 22 nt, Human
gccugagauucugcauuucuaa

SEQ ID NO: 1078117 - RNA, 22 nt, Human
aggagaauuaggaacucaagau

SEQ ID NO: 1078118 - RNA, 22 nt, Human
ugccuuuuccagcuuccaggag

SEQ ID NO: 1078119 - RNA, 22 nt, Human
acaaauccagugaacuccagug

SEQ ID NO: 1078120 - RNA, 22 nt, Human
acauugaagggaaugcaaagau

SEQ ID NO: 1078121 - RNA, 22 nt, Human
gucccaggaguugcugggccuu

SEQ ID NO: 1078122 - RNA, 22 nt, Human
gaagaauauucuugaucuuaga

SEQ ID NO: 1078123 - RNA, 22 nt, Human
ucacauuucucagcacugauga

SEQ ID NO: 1078124 - RNA, 22 nt, Human
agaggccuaaccaagauguccu

SEQ ID NO: 1078125 - RNA, 19 nt, Human
ugggcuuccccagggcaga

SEQ ID NO: 1078126 - RNA, 22 nt, Human
ccagcugauucgguggugguug

SEQ ID NO: 1078127 - RNA, 22 nt, Human
gaaggaagugcucauacuaguu

SEQ ID NO: 1078128 - RNA, 18 nt, Human
uuucucaaggcugacauu

SEQ ID NO: 1078129 - RNA, 22 nt, Human
cagaagcaaguagugauucuuu

SEQ ID NO: 1078130 - RNA, 22 nt, Human
agaggcuccuagccacuggcuu

SEQ ID NO: 1078131 - RNA, 17 nt, Human
aagacaagacaaaugca

SEQ ID NO: 1078132 - RNA, 19 nt, Human
acagcacagaaauauuuca

SEQ ID NO: 1078133 - RNA, 22 nt, Human
ugcacuggggucccagcgcacg

SEQ ID NO: 1078134 - RNA, 22 nt, Human
gcagggcauagaggcacggagg

SEQ ID NO: 1078135 - RNA, 22 nt, Human
agcuuguuuuguugaauacuua

SEQ ID NO: 1078136 - RNA, 22 nt, Human
uuucuggaggcccaagggcaga

SEQ ID NO: 1078137 - RNA, 22 nt, Human
gacugcagugaaggcacauggg

SEQ ID NO: 1078138 - RNA, 22 nt, Human
cauauuuuaguugcugaacagc

SEQ ID NO: 1078139 - RNA, 22 nt, Human
aagcacagcagagccuugcuug

SEQ ID NO: 1078140 - RNA, 22 nt, Human
cuuuggcaaugucauuuucaau

SEQ ID NO: 1078141 - RNA, 22 nt, Human
ggcucagacucccaggcccucu

SEQ ID NO: 1078142 - RNA, 22 nt, Human
ccacagcaugcaggccugacac

SEQ ID NO: 1078143 - RNA, 22 nt, Human
cuaccuaauaauuugauauuca

SEQ ID NO: 1078144 - RNA, 22 nt, Human
ccugcagguccccggaugcgca

SEQ ID NO: 1078145 - RNA, 21 nt, Human
aucuggaagaacugguaagug

SEQ ID NO: 1078146 - RNA, 22 nt, Human
aggggcuguggaaaccaacucu

SEQ ID NO: 1078147 - RNA, 22 nt, Human
aaugaagccagguagaagagaa

SEQ ID NO: 1078148 - RNA, 22 nt, Human
gagggguguggagccaucaguu

SEQ ID NO: 1078149 - RNA, 22 nt, Human
uucuagaaacacaugcaaacag

SEQ ID NO: 1078150 - RNA, 22 nt, Human
gcagcugaagcugcaguuccag

SEQ ID NO: 1078151 - RNA, 22 nt, Human
uggcaaauucaucuuuaguucu

SEQ ID NO: 1078152 - RNA, 22 nt, Human
uaucucuuuauugacaauaaaa

SEQ ID NO: 1078153 - RNA, 22 nt, Human
gcagcugucacuuucacaaugc

SEQ ID NO: 1078154 - RNA, 22 nt, Human
auacaugacucacacauucugc

SEQ ID NO: 1078155 - RNA, 22 nt, Human
auacuuugcuaguaucagugug

SEQ ID NO: 1078156 - RNA, 22 nt, Human
gaggcagcggcucacagagaaa

SEQ ID NO: 1078157 - RNA, 22 nt, Human
uccugccugagcguggaggagg

SEQ ID NO: 1078158 - RNA, 22 nt, Human
ugcccaaguccuccaccgaggu

SEQ ID NO: 1078159 - RNA, 22 nt, Human
uccuccagcaggacugaggccc

SEQ ID NO: 1078160 - RNA, 22 nt, Human
uccagugguuugaaaggggugu

SEQ ID NO: 1078161 - RNA, 22 nt, Human
cagacagaaggaaggccaacau

SEQ ID NO: 1078162 - RNA, 22 nt, Human
agguccuguuucuucccugggg

SEQ ID NO: 1078163 - RNA, 22 nt, Human
guuucuuaaaagaggaguuaga

SEQ ID NO: 1078164 - RNA, 22 nt, Human
aguaugaagaugaugaaaaaua

SEQ ID NO: 1078165 - RNA, 21 nt, Human
ugaaaugagaaugcugagcac

SEQ ID NO: 1078166 - RNA, 22 nt, Human
auacacacugcuauccuuuuuu

SEQ ID NO: 1078167 - RNA, 22 nt, Human
agcugugcacacugugaaguag

SEQ ID NO: 1078168 - RNA, 22 nt, Human
agggcugcaggcaagauauggc

SEQ ID NO: 1078169 - RNA, 22 nt, Human
uugaaggacaucuuguuucuag

SEQ ID NO: 1078170 - RNA, 22 nt, Human
ccugucagaugaaguaauugug

SEQ ID NO: 1078171 - RNA, 22 nt, Human
acauguaggagagucacaaugc

SEQ ID NO: 1078172 - RNA, 22 nt, Human
uggagcaggugcucaggguaau

SEQ ID NO: 1078173 - RNA, 22 nt, Human
cucucugguuucagcgaagggg

SEQ ID NO: 1078174 - RNA, 23 nt, Human
gugcucuucaguuuuagggucau

SEQ ID NO: 1078175 - RNA, 22 nt, Human
auuuuucaacuuuggaaauggc

SEQ ID NO: 1078176 - RNA, 22 nt, Human
aguugaaauuagaguccuggcu

SEQ ID NO: 1078177 - RNA, 22 nt, Human
uugaggagcaggaugggaggcu

SEQ ID NO: 1078178 - RNA, 22 nt, Human
ucagaucacaaaaguuucuauu

SEQ ID NO: 1078179 - RNA, 22 nt, Human
cuccagauuccguuuauucagg

SEQ ID NO: 1078180 - RNA, 22 nt, Human
aauaguccuuaguaagcuguga

SEQ ID NO: 1078181 - RNA, 22 nt, Human
gggcugaccccaccccucacuc

SEQ ID NO: 1078182 - RNA, 22 nt, Human
ccugucagcugauggcuaugua

SEQ ID NO: 1078183 - RNA, 22 nt, Human
uguuucuugauaaagcagaaaa

SEQ ID NO: 1078184 - RNA, 22 nt, Human
aaguguuucaauaauuuggacc

SEQ ID NO: 1078185 - RNA, 22 nt, Human
guccucugcccaggucaagguu

SEQ ID NO: 1078186 - RNA, 22 nt, Human
ccaggugguucaggucaccaua

SEQ ID NO: 1078187 - RNA, 22 nt, Human
ugccugugggugaugauuugau

SEQ ID NO: 1078188 - RNA, 22 nt, Human
ugugugugacaaccuaguucag

SEQ ID NO: 1078189 - RNA, 22 nt, Human
uagcagggucucaggagucagg

SEQ ID NO: 1078190 - RNA, 17 nt, Human
uucaagauauugaaaug

SEQ ID NO: 1078191 - RNA, 19 nt, Human
ugcagggcugcgccugggg

SEQ ID NO: 1078192 - RNA, 22 nt, Human
uuucuaaggugauccuuucuua

SEQ ID NO: 1078193 - RNA, 22 nt, Human
caaggcaguuccccagagggcu

SEQ ID NO: 1078194 - RNA, 22 nt, Human
cagagcagugggguuggucaga

SEQ ID NO: 1078195 - RNA, 22 nt, Human
aucugccucuucuucauugcga

SEQ ID NO: 1078196 - RNA, 19 nt, Human
gcacacaguagggcuggca

SEQ ID NO: 1078197 - RNA, 22 nt, Human
uagaaacagauguuuuugaaga

SEQ ID NO: 1078198 - RNA, 22 nt, Human
acuggaaaaccacugaaaugag

SEQ ID NO: 1078199 - RNA, 19 nt, Human
gcuggggccugaccagaca

SEQ ID NO: 1078200 - RNA, 22 nt, Human
caggugggagcggagacugauu

SEQ ID NO: 1078201 - RNA, 22 nt, Human
agggucagagaucggccaugug

SEQ ID NO: 1078202 - RNA, 22 nt, Human
uucuucaaccaucuacauaaac

SEQ ID NO: 1078203 - RNA, 22 nt, Human
acuugguuggucucacccuguu

SEQ ID NO: 1078204 - RNA, 22 nt, Human
aucaaagugaaaagugcugaug

SEQ ID NO: 1078205 - RNA, 22 nt, Human
ccuguggcugccacuuggguga

SEQ ID NO: 1078206 - RNA, 22 nt, Human
cuacaucacuuaauucuuagaa

SEQ ID NO: 1078207 - RNA, 22 nt, Human
uuuaauuagcaagccagagagc

SEQ ID NO: 1078208 - RNA, 22 nt, Human
gaauucuucugucuuuaacuga

SEQ ID NO: 1078209 - RNA, 22 nt, Human
acuggcagagguuggacaccau

SEQ ID NO: 1078210 - RNA, 22 nt, Human
uaacaucuuaacuggauacuuc

SEQ ID NO: 1078211 - RNA, 22 nt, Human
ucuguauuuuaagaugcuguuu

SEQ ID NO: 1078212 - RNA, 22 nt, Human
gccaagcuuggaaggaucaugg

SEQ ID NO: 1078213 - RNA, 22 nt, Human
aggccaggaccauuagcccaga

SEQ ID NO: 1078214 - RNA, 22 nt, Human
agcagcuccugccaugagugcu

SEQ ID NO: 1078215 - RNA, 20 nt, Human
ucaaaggcaaaggugggugu

SEQ ID NO: 1078216 - RNA, 22 nt, Human
ugugggguagcaguuuccgugu

SEQ ID NO: 1078217 - RNA, 22 nt, Human
cgguccuguacuugaugagaua

SEQ ID NO: 1078218 - RNA, 22 nt, Human
ggagaaggaauauuggaguagg

SEQ ID NO: 1078219 - RNA, 22 nt, Human
ugaaauguugguaauuuuauau

SEQ ID NO: 1078220 - RNA, 21 nt, Human
auuucacacccuccuuuuucu

SEQ ID NO: 1078221 - RNA, 22 nt, Human
cacagaauggaccaguuuuaga

SEQ ID NO: 1078222 - RNA, 19 nt, Human
ccugccugagcugucccuc

SEQ ID NO: 1078223 - RNA, 22 nt, Human
ccauggaguuccucuggucuau

SEQ ID NO: 1078224 - RNA, 22 nt, Human
uauuuccauguuagaacuaagu

SEQ ID NO: 1078225 - RNA, 22 nt, Human
agccuggauccauguggcuacc

SEQ ID NO: 1078226 - RNA, 22 nt, Human
uuacaaagagugccagagugug

SEQ ID NO: 1078227 - RNA, 22 nt, Human
gggaucagcaagccacugcacc

SEQ ID NO: 1078228 - RNA, 22 nt, Human
gcucucuggcuaguccaucggg

SEQ ID NO: 1078229 - RNA, 22 nt, Human
gcaggcugggguagccccacuu

SEQ ID NO: 1078230 - RNA, 22 nt, Human
ugguaccagggguuauuucugc

SEQ ID NO: 1078231 - RNA, 22 nt, Human
cuggggcugcgguggaggagcc

SEQ ID NO: 1078232 - RNA, 22 nt, Human
uacuuuuagccuauuugauucu

SEQ ID NO: 1078233 - RNA, 22 nt, Human
uuuugcuuuuguaacacagugu

SEQ ID NO: 1078234 - RNA, 22 nt, Human
auggauaagaacaaauaucuga

SEQ ID NO: 1078235 - RNA, 22 nt, Human
cauuguaagaggcuuugcagca

SEQ ID NO: 1078236 - RNA, 22 nt, Human
agcagcugcagagggcuccccc

SEQ ID NO: 1078237 - RNA, 22 nt, Human
gcucccagggaccgcagggcag

SEQ ID NO: 1078238 - RNA, 22 nt, Human
cuccaguaucuguaggaaaagg

SEQ ID NO: 1078239 - RNA, 22 nt, Human
uguucucucuggcugccaguac

SEQ ID NO: 1078240 - RNA, 22 nt, Human
gcagagccaggagagacccuug

SEQ ID NO: 1078241 - RNA, 22 nt, Human
caguaaauuugagggaucuaau

SEQ ID NO: 1078242 - RNA, 22 nt, Human
caggaggaacaagagguucugg

SEQ ID NO: 1078243 - RNA, 22 nt, Human
ucugcagcuuuuugguggggug

SEQ ID NO: 1078244 - RNA, 22 nt, Human
cgaggcagaggcugaaacggcu

SEQ ID NO: 1078245 - RNA, 22 nt, Human
cccagcccugaccuauuggaaa

SEQ ID NO: 1078246 - RNA, 18 nt, Human
ggcagcaagaagggaggg

SEQ ID NO: 1078247 - RNA, 23 nt, Human
uucuggauguucuagucugagag

SEQ ID NO: 1078248 - RNA, 22 nt, Human
ccuggaagucauuccucguucc

SEQ ID NO: 1078249 - RNA, 21 nt, Human
aggugccaaggagaagcaggc

SEQ ID NO: 1078250 - RNA, 22 nt, Human
aagccagggauuccugagggag

SEQ ID NO: 1078251 - RNA, 22 nt, Human
aguuucuuauucuuaguuaugu

SEQ ID NO: 1078252 - RNA, 22 nt, Human
uggccugguuauauugcuauca

SEQ ID NO: 1078253 - RNA, 22 nt, Human
ugcugcucuguaaagugaugag

SEQ ID NO: 1078254 - RNA, 22 nt, Human
uucauugugauucuuggcuagc

SEQ ID NO: 1078255 - RNA, 22 nt, Human
cagggacagacagauauauuug

SEQ ID NO: 1078256 - RNA, 22 nt, Human
auuuuuuagccaagacucugca

SEQ ID NO: 1078257 - RNA, 22 nt, Human
ucacuuuggauuauguaauuuc

SEQ ID NO: 1078258 - RNA, 22 nt, Human
uggcauuuagaaaacaacaugu

SEQ ID NO: 1078259 - RNA, 22 nt, Human
ggcuggcagaggggagucugug

SEQ ID NO: 1078260 - RNA, 22 nt, Human
cacacaucuuaucccaguuauu

SEQ ID NO: 1078261 - RNA, 22 nt, Human
gggcuggaccgcucgccucccu

SEQ ID NO: 1078262 - RNA, 18 nt, Human
ucuuuggacaacuacugg

SEQ ID NO: 1078263 - RNA, 22 nt, Human
agcucuguguucacagcacuaa

SEQ ID NO: 1078264 - RNA, 21 nt, Human
ugcagugucccuaacaguggu

SEQ ID NO: 1078265 - RNA, 22 nt, Human
caggaagccacaggacagguag

SEQ ID NO: 1078266 - RNA, 22 nt, Human
aaggaagguucauagucaaaga

SEQ ID NO: 1078267 - RNA, 22 nt, Human
gugagcagaauaaggguugaga

SEQ ID NO: 1078268 - RNA, 22 nt, Human
ucucccaggugggugccuggag

SEQ ID NO: 1078269 - RNA, 22 nt, Human
gggggaagacugggcuagugau

SEQ ID NO: 1078270 - RNA, 22 nt, Human
gggcaugacuuuuggaguggga

SEQ ID NO: 1078271 - RNA, 22 nt, Human
ugcagaagaaaacagcugugug

SEQ ID NO: 1078272 - RNA, 22 nt, Human
acagcacaaucugagucccaga

SEQ ID NO: 1078273 - RNA, 22 nt, Human
aauucagcacagaggaaccagu

SEQ ID NO: 1078274 - RNA, 21 nt, Human
aggagcuguguuagcuggucg

SEQ ID NO: 1078275 - RNA, 22 nt, Human
uuuccucugcugccauugcccc

SEQ ID NO: 1078276 - RNA, 22 nt, Human
acauuuacuuaucaaaagucag

SEQ ID NO: 1078277 - RNA, 22 nt, Human
ggccucugggguccugagccca

SEQ ID NO: 1078278 - RNA, 22 nt, Human
aaaggcuccuucucccaugacc

SEQ ID NO: 1078279 - RNA, 22 nt, Human
agacagcauggagcugauaaca

SEQ ID NO: 1078280 - RNA, 22 nt, Human
uccagggaccucccugagagcu

SEQ ID NO: 1078281 - RNA, 22 nt, Human
ggcaggugccaguuggcuuggg

SEQ ID NO: 1078282 - RNA, 22 nt, Human
uagauggcugguguucugagcu

SEQ ID NO: 1078283 - RNA, 22 nt, Human
augggaagguuuugagagcggg

SEQ ID NO: 1078284 - RNA, 20 nt, Human
gggcaguggcgcuaucucag

SEQ ID NO: 1078285 - RNA, 22 nt, Human
ucauugcaggcauuccccugcc

SEQ ID NO: 1078286 - RNA, 22 nt, Human
acacuguguggucucucucgga

SEQ ID NO: 1078287 - RNA, 22 nt, Human
ccagggcaauuauuuggagggu

SEQ ID NO: 1078288 - RNA, 22 nt, Human
uagcugcugcagcacagggagg

SEQ ID NO: 1078289 - RNA, 16 nt, Human
gccuggaguggcaggg

SEQ ID NO: 1078290 - RNA, 22 nt, Human
ugggcacaaacaucugccuguu

SEQ ID NO: 1078291 - RNA, 22 nt, Human
uaucagaaggcacauggagucu

SEQ ID NO: 1078292 - RNA, 21 nt, Human
auggagucaggggaaugggcc

SEQ ID NO: 1078293 - RNA, 22 nt, Human
augggugugaaaauggucaucu

SEQ ID NO: 1078294 - RNA, 22 nt, Human
ggccucagggucacucuguaga

SEQ ID NO: 1078295 - RNA, 19 nt, Human
ugugaaagcuaguguucuu

SEQ ID NO: 1078296 - RNA, 22 nt, Human
uuuaacagaugugaaauuuuca

SEQ ID NO: 1078297 - RNA, 22 nt, Human
aaguucuuguauuugccuuucu

SEQ ID NO: 1078298 - RNA, 22 nt, Human
cagagcauaauugacaugaggu

SEQ ID NO: 1078299 - RNA, 22 nt, Human
ucaacauauaggcaaccuguaa

SEQ ID NO: 1078300 - RNA, 22 nt, Human
uacagauugagguuuuuaauau

SEQ ID NO: 1078301 - RNA, 22 nt, Human
cucugagaugcuugaagaggau

SEQ ID NO: 1078302 - RNA, 22 nt, Human
aaauauagcaauuaugccuacu

SEQ ID NO: 1078303 - RNA, 22 nt, Human
uaugaaauuuaaacacagauca

SEQ ID NO: 1078304 - RNA, 22 nt, Human
aaugggaagucacuacuguuac

SEQ ID NO: 1078305 - RNA, 22 nt, Human
ugcucugcacaucccucacaaa

SEQ ID NO: 1078306 - RNA, 18 nt, Human
agaguguucucagugaaa

SEQ ID NO: 1078307 - RNA, 22 nt, Human
uucucacuauguauguagauug

SEQ ID NO: 1078308 - RNA, 22 nt, Human
gcugucaggccaugugggccuu

SEQ ID NO: 1078309 - RNA, 18 nt, Human
cagcugugcccuguuugg

SEQ ID NO: 1078310 - RNA, 22 nt, Human
uaagcucuccaggugaucauga

SEQ ID NO: 1078311 - RNA, 22 nt, Human
aagggcagccugacucacgguc

SEQ ID NO: 1078312 - RNA, 22 nt, Human
acuuucuccagaaaaccaagga

SEQ ID NO: 1078313 - RNA, 22 nt, Human
uuuguguguauauguauauaga

SEQ ID NO: 1078314 - RNA, 22 nt, Human
agcagccauuuaaaaugaauug

SEQ ID NO: 1078315 - RNA, 22 nt, Human
acuguacuuacgcauauacagg

SEQ ID NO: 1078316 - RNA, 23 nt, Human
ccucagagaggcagagccacaug

SEQ ID NO: 1078317 - RNA, 22 nt, Human
gcacagggcugccaggcggcuu

SEQ ID NO: 1078318 - RNA, 22 nt, Human
uggaacacacuucaaggagaaa

SEQ ID NO: 1078319 - RNA, 22 nt, Human
acugucagggaucaugaaagcu

SEQ ID NO: 1078320 - RNA, 22 nt, Human
gcugagcugggacaguccuggg

SEQ ID NO: 1078321 - RNA, 22 nt, Human
uaaauuuacccaaggaacaugu

SEQ ID NO: 1078322 - RNA, 22 nt, Human
uuauuucuugucuauguagcca

SEQ ID NO: 1078323 - RNA, 23 nt, Human
ggaguuggauuguacuugcugcu

SEQ ID NO: 1078324 - RNA, 22 nt, Human
ucagaagagcuggugcugccug

SEQ ID NO: 1078325 - RNA, 22 nt, Human
cuacaaagaauuucucuagcuc

SEQ ID NO: 1078326 - RNA, 20 nt, Human
gccaaggaggagaaacaggc

SEQ ID NO: 1078327 - RNA, 22 nt, Human
ggcuguccuuggccaaggcacu

SEQ ID NO: 1078328 - RNA, 22 nt, Human
cucugagcagaggccguggcua

SEQ ID NO: 1078329 - RNA, 22 nt, Human
aggucaggguauucacgucugu

SEQ ID NO: 1078330 - RNA, 22 nt, Human
ucugggccucaguuucuucauc

SEQ ID NO: 1078331 - RNA, 22 nt, Human
cccucaggaugcaguggaagug

SEQ ID NO: 1078332 - RNA, 22 nt, Human
augauugaccaucugcugggcu

SEQ ID NO: 1078333 - RNA, 22 nt, Human
gagugggcaccgugggcacacu

SEQ ID NO: 1078334 - RNA, 22 nt, Human
gaagaagcauucugcuguuuug

SEQ ID NO: 1078335 - RNA, 22 nt, Human
aacuguaauuuuuacauaguaa

SEQ ID NO: 1078336 - RNA, 22 nt, Human
gcagggcucugcuguaguccua

SEQ ID NO: 1078337 - RNA, 22 nt, Human
cugggugguuuugaugugaauu

SEQ ID NO: 1078338 - RNA, 22 nt, Human
agggccugagcucuccuccagu

SEQ ID NO: 1078339 - RNA, 18 nt, Human
aucucccauuggccaagg

SEQ ID NO: 1078340 - RNA, 22 nt, Human
gaaaagagaacaucugaggauc

SEQ ID NO: 1078341 - RNA, 22 nt, Human
aagagccagugggaaagucuug

SEQ ID NO: 1078342 - RNA, 22 nt, Human
cagcaauaguguguuuguuuca

SEQ ID NO: 1078343 - RNA, 22 nt, Human
uaugugugcuuuuuccaugcau

SEQ ID NO: 1078344 - RNA, 22 nt, Human
acagaaauucugggacagaaaa

SEQ ID NO: 1078345 - RNA, 22 nt, Human
uccucagugcuagccaacugcc

SEQ ID NO: 1078346 - RNA, 22 nt, Human
gccagcugcuggaacagcgcga

SEQ ID NO: 1078347 - RNA, 22 nt, Human
agcuggcaauguaagucccugg

SEQ ID NO: 1078348 - RNA, 22 nt, Human
uccaggaagccacacugggccu

SEQ ID NO: 1078349 - RNA, 22 nt, Human
gcagcuggucuggccuagagua

SEQ ID NO: 1078350 - RNA, 22 nt, Human
aagugugggaaguugcuaaaau

SEQ ID NO: 1078351 - RNA, 22 nt, Human
acauugaacaguacaaaugauc

SEQ ID NO: 1078352 - RNA, 22 nt, Human
cuuguccuuuacuugagacuca

SEQ ID NO: 1078353 - RNA, 22 nt, Human
uaguguuuaguacauaugcaua

SEQ ID NO: 1078354 - RNA, 22 nt, Human
gacugaaagcuuggaauguucc

SEQ ID NO: 1078355 - RNA, 22 nt, Human
aggagccauugcaggauggcag

SEQ ID NO: 1078356 - RNA, 22 nt, Human
ucuggagucugagaucugagga

SEQ ID NO: 1078357 - RNA, 22 nt, Human
uauuaguagcuugaaauuggug

SEQ ID NO: 1078358 - RNA, 22 nt, Human
gugcugagcugcagaugcgcuc

SEQ ID NO: 1078359 - RNA, 19 nt, Human
ucagaggauuuggcuauga

SEQ ID NO: 1078360 - RNA, 22 nt, Human
uuggggaagaguugacuuugga

SEQ ID NO: 1078361 - RNA, 22 nt, Human
uuggaauuucauguaagugacu

SEQ ID NO: 1078362 - RNA, 22 nt, Human
gaccagguccaaagcuacuguc

SEQ ID NO: 1078363 - RNA, 22 nt, Human
ccaugcccuugucaucuccagg

SEQ ID NO: 1078364 - RNA, 22 nt, Human
ugcacauuaguguuugagaugc

SEQ ID NO: 1078365 - RNA, 22 nt, Human
cugcccucuagaggaggacuga

SEQ ID NO: 1078366 - RNA, 22 nt, Human
aacuacauuuuacagaagauga

SEQ ID NO: 1078367 - RNA, 22 nt, Human
uauuucuguuuauuuguacauc

SEQ ID NO: 1078368 - RNA, 22 nt, Human
uugaaagcuccauauuguagag

SEQ ID NO: 1078369 - RNA, 22 nt, Human
cacugucccuguuuccuggaaa

SEQ ID NO: 1078370 - RNA, 22 nt, Human
caacuauuaccauguuauuguc

SEQ ID NO: 1078371 - RNA, 20 nt, Human
ugcuuccuggccacugcggg

SEQ ID NO: 1078372 - RNA, 22 nt, Human
cugcagggcccaaggucaacgg

SEQ ID NO: 1078373 - RNA, 22 nt, Human
acauucuaugguugaugaguug

SEQ ID NO: 1078374 - RNA, 22 nt, Human
cccagacauaacagcagagagg

SEQ ID NO: 1078375 - RNA, 22 nt, Human
caaaugcuggcccugcuacuua

SEQ ID NO: 1078376 - RNA, 22 nt, Human
gaagucuggcugacgagaguua

SEQ ID NO: 1078377 - RNA, 22 nt, Human
uucaagaugcacaguggcauuc

SEQ ID NO: 1078378 - RNA, 22 nt, Human
cagcuggcaaguggagcagggu

SEQ ID NO: 1078379 - RNA, 22 nt, Human
ccucacucugcacccugcagca

SEQ ID NO: 1078380 - RNA, 22 nt, Human
gcugccucugcgacucugggcg

SEQ ID NO: 1078381 - RNA, 22 nt, Human
ccugccagugaagcugacgggc

SEQ ID NO: 1078382 - RNA, 22 nt, Human
agagacugauggaucaccaaau

SEQ ID NO: 1078383 - RNA, 22 nt, Human
cugugcuucgcaacuccaaggu

SEQ ID NO: 1078384 - RNA, 22 nt, Human
ucugucucaaguucuugcacuc

SEQ ID NO: 1078385 - RNA, 21 nt, Human
cugcucugacagugaggccag

SEQ ID NO: 1078386 - RNA, 22 nt, Human
accccaagacaguagaagagaa

SEQ ID NO: 1078387 - RNA, 22 nt, Human
acuuccaguuuuaauuaaauug

SEQ ID NO: 1078388 - RNA, 22 nt, Human
aguauuucugaauauuaucaua

SEQ ID NO: 1078389 - RNA, 22 nt, Human
uggcuucuugggaugggucauu

SEQ ID NO: 1078390 - RNA, 22 nt, Human
agaggagguggugaugcuuuaa

SEQ ID NO: 1078391 - RNA, 22 nt, Human
uuagauaauguuauuguaauuu

SEQ ID NO: 1078392 - RNA, 22 nt, Human
agagggcccauguugggcugcu

SEQ ID NO: 1078393 - RNA, 19 nt, Human
uacaagcuuuuuuggcagg

SEQ ID NO: 1078394 - RNA, 22 nt, Human
ucaauuuuaugaaacaaaguga

SEQ ID NO: 1078395 - RNA, 22 nt, Human
uggccugacugucaggcuguau

SEQ ID NO: 1078396 - RNA, 22 nt, Human
ugcuucugcuuuacuugguuca

SEQ ID NO: 1078397 - RNA, 22 nt, Human
ugugaggaacccggaauguggg

SEQ ID NO: 1078398 - RNA, 22 nt, Human
agagugggcaggagccucgacu

SEQ ID NO: 1078399 - RNA, 22 nt, Human
aggcaucugaguuugcaagcuu

SEQ ID NO: 1078400 - RNA, 22 nt, Human
aaguacuaaggcuauuaugaug

SEQ ID NO: 1078401 - RNA, 18 nt, Human
cagagcagagguggagcg

SEQ ID NO: 1078402 - RNA, 22 nt, Human
uuuagcauuacuaaaaugaaaa

SEQ ID NO: 1078403 - RNA, 22 nt, Human
cuguuuaucauguacauuucca

SEQ ID NO: 1078404 - RNA, 22 nt, Human
uacuuaaaaauuaucaaagugg

SEQ ID NO: 1078405 - RNA, 22 nt, Human
cucugucaggcugcagaugcuc

SEQ ID NO: 1078406 - RNA, 22 nt, Human
gcccaggauucuuucuuccuua

SEQ ID NO: 1078407 - RNA, 22 nt, Human
cagccagggucaggcagcuucu

SEQ ID NO: 1078408 - RNA, 19 nt, Human
gcagcugugggaagagcca

SEQ ID NO: 1078409 - RNA, 22 nt, Human
ugggaauggaugcuaagugcua

SEQ ID NO: 1078410 - RNA, 22 nt, Human
ccaggcuccucaugaucuuguu

SEQ ID NO: 1078411 - RNA, 18 nt, Human
gggcucugauccuucacc

SEQ ID NO: 1078412 - RNA, 20 nt, Human
aaacgagccaucauucuggu

SEQ ID NO: 1078413 - RNA, 22 nt, Human
ugcaggcucucugcugccagau

SEQ ID NO: 1078414 - RNA, 22 nt, Human
agccagcugccuuucacaucug

SEQ ID NO: 1078415 - RNA, 22 nt, Human
ucucagaguaauucuuuaaggu

SEQ ID NO: 1078416 - RNA, 22 nt, Human
gcaccugggcaaggauucagag

SEQ ID NO: 1078417 - RNA, 22 nt, Human
aaaugcauuuuuaauuagaccc

SEQ ID NO: 1078418 - RNA, 22 nt, Human
cagcucucuaaggucuugcuuu

SEQ ID NO: 1078419 - RNA, 22 nt, Human
augcugugucaggaauuugaua

SEQ ID NO: 1078420 - RNA, 19 nt, Human
aaggugguuugucucugua

SEQ ID NO: 1078421 - RNA, 21 nt, Human
uaucaagauguuaugguugaa

SEQ ID NO: 1078422 - RNA, 22 nt, Human
ccuuuggguucaaucucggucu

SEQ ID NO: 1078423 - RNA, 22 nt, Human
agugcagagaccuggucaggca

SEQ ID NO: 1078424 - RNA, 22 nt, Human
uuguuuucuccacugcaucuua

SEQ ID NO: 1078425 - RNA, 22 nt, Human
uugguggguuaaugagugacug

SEQ ID NO: 1078426 - RNA, 22 nt, Human
aaagaccugaaauauaaucuag

SEQ ID NO: 1078427 - RNA, 22 nt, Human
ugagcaggugagucuagggcag

SEQ ID NO: 1078428 - RNA, 22 nt, Human
gacagggcauggugcagaguuc

SEQ ID NO: 1078429 - RNA, 22 nt, Human
caugaacagauucuucauuucu

SEQ ID NO: 1078430 - RNA, 22 nt, Human
uuacugaugucauuagaaacag

SEQ ID NO: 1078431 - RNA, 22 nt, Human
acaggcagggaccuuggcuaag

SEQ ID NO: 1078432 - RNA, 17 nt, Human
ccaggcuccaucacugu

SEQ ID NO: 1078433 - RNA, 22 nt, Human
caucaguuuggagaggcgguuu

SEQ ID NO: 1078434 - RNA, 22 nt, Human
uuucagugcuucuguuuaccgg

SEQ ID NO: 1078435 - RNA, 22 nt, Human
agccacagagcaggagaccuuu

SEQ ID NO: 1078436 - RNA, 17 nt, Human
agaguuuuaagaaauuu

SEQ ID NO: 1078437 - RNA, 19 nt, Human
uagcagcugccaaaggaga

SEQ ID NO: 1078438 - RNA, 22 nt, Human
uggccugcccagagcagcucug

SEQ ID NO: 1078439 - RNA, 22 nt, Human
uaggaaccagagcacucugggc

SEQ ID NO: 1078440 - RNA, 22 nt, Human
uggaggagggcuggugucugua

SEQ ID NO: 1078441 - RNA, 22 nt, Human
uuguuuuggagaugagcuaaaa

SEQ ID NO: 1078442 - RNA, 22 nt, Human
aaauagcagccuuuaguuaaca

SEQ ID NO: 1078443 - RNA, 19 nt, Human
cagcaagaaugaaggcaua

SEQ ID NO: 1078444 - RNA, 22 nt, Human
aguggcagagccaaguagagcc

SEQ ID NO: 1078445 - RNA, 22 nt, Human
agauuuguccugcuuucuaccu

SEQ ID NO: 1078446 - RNA, 22 nt, Human
cauugcacuuuggguccaggac

SEQ ID NO: 1078447 - RNA, 22 nt, Human
acauuugucuucuuucagauua

SEQ ID NO: 1078448 - RNA, 22 nt, Human
auuuuucucuccacuccauuaa

SEQ ID NO: 1078449 - RNA, 22 nt, Human
cagugcaggcugggggcccugc

SEQ ID NO: 1078450 - RNA, 22 nt, Human
ggcagcaguaggagcuaaucuu

SEQ ID NO: 1078451 - RNA, 22 nt, Human
aaaucagacacagugaaaguua

SEQ ID NO: 1078452 - RNA, 22 nt, Human
agaagaaaugugaaggccacug

SEQ ID NO: 1078453 - RNA, 22 nt, Human
aggcaguguauugcuagcggcu

SEQ ID NO: 1078454 - RNA, 22 nt, Human
uggcgucucucauaaguaugug

SEQ ID NO: 1078455 - RNA, 22 nt, Human
caggugcucccagagaagugcu

SEQ ID NO: 1078456 - RNA, 22 nt, Human
uuucauuaaagucaaaucuggu

SEQ ID NO: 1078457 - RNA, 22 nt, Human
caugagauaauuuuucuccagu

SEQ ID NO: 1078458 - RNA, 22 nt, Human
aauacaagauuuauaguuguuu

SEQ ID NO: 1078459 - RNA, 22 nt, Human
uccucagacacccugcuggcuu

SEQ ID NO: 1078460 - RNA, 22 nt, Human
ggagcugaugacgucaccaugg

SEQ ID NO: 1078461 - RNA, 22 nt, Human
uucuuuauguuaaugaaucuau

SEQ ID NO: 1078462 - RNA, 22 nt, Human
ugugaaaagggcuuuguacaaa

SEQ ID NO: 1078463 - RNA, 22 nt, Human
cuguggcuguauuuggccagag

SEQ ID NO: 1078464 - RNA, 22 nt, Human
uucuacaugagaaaauguauuu

SEQ ID NO: 1078465 - RNA, 22 nt, Human
cuggcagcugcccgagaugccc

SEQ ID NO: 1078466 - RNA, 23 nt, Human
uccuggcucugcacuugcuaaug

SEQ ID NO: 1078467 - RNA, 22 nt, Human
ugcccauggaccaagcaagggg

SEQ ID NO: 1078468 - RNA, 22 nt, Human
uaugaagcuuugaaaagcuuac

SEQ ID NO: 1078469 - RNA, 22 nt, Human
gugucaugggagucagaaguga

SEQ ID NO: 1078470 - RNA, 22 nt, Human
cuuaaggaguaguggugauggc

SEQ ID NO: 1078471 - RNA, 22 nt, Human
guuuuucuuugugugaagacaa

SEQ ID NO: 1078472 - RNA, 22 nt, Human
accagguggccccagcgugguu

SEQ ID NO: 1078473 - RNA, 21 nt, Human
uggcucugaaagagugcugca

SEQ ID NO: 1078474 - RNA, 22 nt, Human
ugcugcagaaauucugugagga

SEQ ID NO: 1078475 - RNA, 19 nt, Human
ucaggcaguuauucacaaa

SEQ ID NO: 1078476 - RNA, 22 nt, Human
cuccuguauguugggcuucaca

SEQ ID NO: 1078477 - RNA, 22 nt, Human
ucagaggaacuggacuaaagcc

SEQ ID NO: 1078478 - RNA, 22 nt, Human
uccaaagagguuaagaacgaga

SEQ ID NO: 1078479 - RNA, 22 nt, Human
gucagcacuuuuccgaggcaga

SEQ ID NO: 1078480 - RNA, 22 nt, Human
ucaguuuuuguuugccagauag

SEQ ID NO: 1078481 - RNA, 22 nt, Human
gcugagaguguaggauguuuac

SEQ ID NO: 1078482 - RNA, 22 nt, Human
auaaggaaugauguaucaguuu

SEQ ID NO: 1078483 - RNA, 21 nt, Human
agagacagagaaaguaacauu

SEQ ID NO: 1078484 - RNA, 22 nt, Human
uacagauauguaugcacuuuuu

SEQ ID NO: 1078485 - RNA, 22 nt, Human
cccccuggcaggcuggccucuc

SEQ ID NO: 1078486 - RNA, 18 nt, Human
cccacacagcaguagcuc

SEQ ID NO: 1078487 - RNA, 22 nt, Human
gggcccuggccgaaucccucug

SEQ ID NO: 1078488 - RNA, 22 nt, Human
guggagacuucuacuagagacc

SEQ ID NO: 1078489 - RNA, 22 nt, Human
acaguggaaaugugggagggga

SEQ ID NO: 1078490 - RNA, 21 nt, Human
gcagacugcccugcugucccc

SEQ ID NO: 1078491 - RNA, 23 nt, Human
uccuuuaaugcuggaauggcuag

SEQ ID NO: 1078492 - RNA, 22 nt, Human
uauucaugacauugcauaugca

SEQ ID NO: 1078493 - RNA, 22 nt, Human
ggucccaggaaucuguguucua

SEQ ID NO: 1078494 - RNA, 19 nt, Human
agccuggcuuugcucugcu

SEQ ID NO: 1078495 - RNA, 22 nt, Human
uggccgggccgggcgccuccac

SEQ ID NO: 1078496 - RNA, 22 nt, Human
uuugacauuauccuguuacugg

SEQ ID NO: 1078497 - RNA, 22 nt, Human
gguuugcaugugauguugggca

SEQ ID NO: 1078498 - RNA, 22 nt, Human
auucuccaucaccacuggcacu

SEQ ID NO: 1078499 - RNA, 22 nt, Human
cugaggucucuuuccauaguga

SEQ ID NO: 1078500 - RNA, 22 nt, Human
auacuuucugaccaauuaauug

SEQ ID NO: 1078501 - RNA, 22 nt, Human
cuccucccugcgauugcucugc

SEQ ID NO: 1078502 - RNA, 20 nt, Human
guuugaaaugauugguuggu

SEQ ID NO: 1078503 - RNA, 22 nt, Human
aauauaguucuagaaauauuuu

SEQ ID NO: 1078504 - RNA, 22 nt, Human
auuuagaacuuuguuugccaau

SEQ ID NO: 1078505 - RNA, 22 nt, Human
agcuccugggccaagcccaugc

SEQ ID NO: 1078506 - RNA, 22 nt, Human
aggcugucugaccccagagccc

SEQ ID NO: 1078507 - RNA, 22 nt, Human
auuuuagagaaacaaacguagg

SEQ ID NO: 1078508 - RNA, 22 nt, Human
aucuacagugcacaggacagcc

SEQ ID NO: 1078509 - RNA, 17 nt, Human
ugaguagggaagaggag

SEQ ID NO: 1078510 - RNA, 22 nt, Human
ccacagaaaauaaagcacgauu

SEQ ID NO: 1078511 - RNA, 22 nt, Human
ccuggcugcuauagcagcaugu

SEQ ID NO: 1078512 - RNA, 22 nt, Human
uguuucauuaguacugacaaua

SEQ ID NO: 1078513 - RNA, 23 nt, Human
agggaagaaacaugaagggcugu

SEQ ID NO: 1078514 - RNA, 22 nt, Human
uuguuacagcagugauuucaga

SEQ ID NO: 1078515 - RNA, 22 nt, Human
aaaagcaaguugccuagguuga

SEQ ID NO: 1078516 - RNA, 22 nt, Human
gagcacaggcuuugguggacac

SEQ ID NO: 1078517 - RNA, 22 nt, Human
gcaggcagagguggaggagaca

SEQ ID NO: 1078518 - RNA, 22 nt, Human
gagcagaacuacucacauaucg

SEQ ID NO: 1078519 - RNA, 22 nt, Human
aauuaauauuuguggaauuaau

SEQ ID NO: 1078520 - RNA, 22 nt, Human
gccagcuggagugagagugggc

SEQ ID NO: 1078521 - RNA, 22 nt, Human
auuugucaacaggcauuuaggu

SEQ ID NO: 1078522 - RNA, 22 nt, Human
gguggcagagaggagguaguuu

SEQ ID NO: 1078523 - RNA, 22 nt, Human
agaggcucugccgccucaggua

SEQ ID NO: 1078524 - RNA, 22 nt, Human
ggcugccugcucaggugcggcg

SEQ ID NO: 1078525 - RNA, 22 nt, Human
cucucagguagagcccaagaau

SEQ ID NO: 1078526 - RNA, 22 nt, Human
uggcuguguuaccacuucaugu

SEQ ID NO: 1078527 - RNA, 22 nt, Human
uccaaauugacaguagugauua

SEQ ID NO: 1078528 - RNA, 22 nt, Human
uaagaauauugggaauggaugg

SEQ ID NO: 1078529 - RNA, 22 nt, Human
uuguguguagacucagccauug

SEQ ID NO: 1078530 - RNA, 21 nt, Human
uaagccaccaugugaaaccag

SEQ ID NO: 1078531 - RNA, 22 nt, Human
acaguggaaagaaacgaauuag

SEQ ID NO: 1078532 - RNA, 19 nt, Human
cccagcuugaccaccugcu

SEQ ID NO: 1078533 - RNA, 22 nt, Human
ucauuuugcagagcugaggaac

SEQ ID NO: 1078534 - RNA, 22 nt, Human
cccucugcugccuggcuggguc

SEQ ID NO: 1078535 - RNA, 22 nt, Human
agugucauaugccacugcaucc

SEQ ID NO: 1078536 - RNA, 22 nt, Human
augccuuauuccaacaaucuag

SEQ ID NO: 1078537 - RNA, 22 nt, Human
ggggagcagaagcagcaacaac

SEQ ID NO: 1078538 - RNA, 22 nt, Human
ggagacucggguucuagccuug

SEQ ID NO: 1078539 - RNA, 22 nt, Human
cuccaggccauggcugcggagg

SEQ ID NO: 1078540 - RNA, 22 nt, Human
ucaaagucauggcuaguaauga

SEQ ID NO: 1078541 - RNA, 22 nt, Human
agagaguugaggaagcaacacu

SEQ ID NO: 1078542 - RNA, 21 nt, Human
ucucuacacuuucacuaggcu

SEQ ID NO: 1078543 - RNA, 22 nt, Human
aacauuucauaacuugacuuuu

SEQ ID NO: 1078544 - RNA, 22 nt, Human
augcaguaaauguuaagaaaaa

SEQ ID NO: 1078545 - RNA, 20 nt, Human
ugcagguguguccaagcacu

SEQ ID NO: 1078546 - RNA, 22 nt, Human
aacuaaaagugugucucuugua

SEQ ID NO: 1078547 - RNA, 22 nt, Human
uggaaauacaagaaguauguca

SEQ ID NO: 1078548 - RNA, 22 nt, Human
agagcuggggccagagucaagg

SEQ ID NO: 1078549 - RNA, 22 nt, Human
gccaggaggcuuaacuggacag

SEQ ID NO: 1078550 - RNA, 22 nt, Human
uuucuuuugaauaguguguggu

SEQ ID NO: 1078551 - RNA, 22 nt, Human
guuccaaauuuggaucuuuagg

SEQ ID NO: 1078552 - RNA, 22 nt, Human
cagcuguguaugagagcaugcu

SEQ ID NO: 1078553 - RNA, 22 nt, Human
uuucuaagaauauugcucuuaa

SEQ ID NO: 1078554 - RNA, 22 nt, Human
ggccagcagucacagggucaga

SEQ ID NO: 1078555 - RNA, 22 nt, Human
uauucacaaaaugagguccuca

SEQ ID NO: 1078556 - RNA, 22 nt, Human
gcaaaacagucgaugccuccca

SEQ ID NO: 1078557 - RNA, 23 nt, Human
ggacacugcuauaaaggaucugc

SEQ ID NO: 1078558 - RNA, 22 nt, Human
agaggccaggcugcagagggau

SEQ ID NO: 1078559 - RNA, 22 nt, Human
aguuggagugaacaugagauug

SEQ ID NO: 1078560 - RNA, 22 nt, Human
ucaccuguauuaauacagaacu

SEQ ID NO: 1078561 - RNA, 22 nt, Human
uaguuuuuucaacaaauggugc

SEQ ID NO: 1078562 - RNA, 22 nt, Human
acaggucagauaaaggcuggug

SEQ ID NO: 1078563 - RNA, 22 nt, Human
auaauggccgggggcugaaugc

SEQ ID NO: 1078564 - RNA, 22 nt, Human
gaagcucucaaacucuccccuu

SEQ ID NO: 1078565 - RNA, 20 nt, Human
uuauaucauaaugugccaau

SEQ ID NO: 1078566 - RNA, 22 nt, Human
gcucaggacccaggugugaccu

SEQ ID NO: 1078567 - RNA, 22 nt, Human
gcagagcaguacucucuugacu

SEQ ID NO: 1078568 - RNA, 22 nt, Human
gcugucaggaacaugccuuggu

SEQ ID NO: 1078569 - RNA, 22 nt, Human
uccaaaacagaacucugugaau

SEQ ID NO: 1078570 - RNA, 22 nt, Human
agggauggaagcucgucugcaa

SEQ ID NO: 1078571 - RNA, 18 nt, Human
ugcuuacaggaguuccug

SEQ ID NO: 1078572 - RNA, 17 nt, Human
agauggcaggaggcaga

SEQ ID NO: 1078573 - RNA, 22 nt, Human
ucugagaguagagcugccucuu

SEQ ID NO: 1078574 - RNA, 22 nt, Human
ucuuucuuaaauagguggauug

SEQ ID NO: 1078575 - RNA, 22 nt, Human
aaauuuuagacuccugggucua

SEQ ID NO: 1078576 - RNA, 23 nt, Human
uagggcagcugggagggacaugc

SEQ ID NO: 1078577 - RNA, 20 nt, Human
uccaagggcagcagaaucag

SEQ ID NO: 1078578 - RNA, 22 nt, Human
ccaagauaaucugugaaaaauc

SEQ ID NO: 1078579 - RNA, 22 nt, Human
aaguaccaaguuuguuugacgc

SEQ ID NO: 1078580 - RNA, 22 nt, Human
cuggugagacucagggaugcuu

SEQ ID NO: 1078581 - RNA, 22 nt, Human
agugugagcccuggaguggugc

SEQ ID NO: 1078582 - RNA, 22 nt, Human
ucagggcaggacaguguaggcc

SEQ ID NO: 1078583 - RNA, 22 nt, Human
acucuucaugcuaugcucaacu

SEQ ID NO: 1078584 - RNA, 22 nt, Human
ucuggcucaucucuccagguaa

SEQ ID NO: 1078585 - RNA, 22 nt, Human
uauuuugucuucugcucaucac

SEQ ID NO: 1078586 - RNA, 22 nt, Human
aagagggaggugcgggugcaga

SEQ ID NO: 1078587 - RNA, 18 nt, Human
ccucagggagagagacgc

SEQ ID NO: 1078588 - RNA, 22 nt, Human
agcugcccuuaauaggcauuca

SEQ ID NO: 1078589 - RNA, 22 nt, Human
uugguucagaugggaucugcga

SEQ ID NO: 1078590 - RNA, 22 nt, Human
gcaagaaaagagccuucagugg

SEQ ID NO: 1078591 - RNA, 22 nt, Human
uugauagguuuuauguauaguu

SEQ ID NO: 1078592 - RNA, 22 nt, Human
ucccaggauguuggcggcaggu

SEQ ID NO: 1078593 - RNA, 22 nt, Human
acauauaugcugggacugugac

SEQ ID NO: 1078594 - RNA, 22 nt, Human
aagaacuaucucuggcuguagg

SEQ ID NO: 1078595 - RNA, 22 nt, Human
gaggagguuccggguggagaag

SEQ ID NO: 1078596 - RNA, 22 nt, Human
cagauacagguuuuuguuagau

SEQ ID NO: 1078597 - RNA, 22 nt, Human
gaaccucagugaaacuggaggu

SEQ ID NO: 1078598 - RNA, 22 nt, Human
ccugugccauccugagcauccc

SEQ ID NO: 1078599 - RNA, 22 nt, Human
uacuucauuccuuuguaaaaug

SEQ ID NO: 1078600 - RNA, 22 nt, Human
gccuggaggggccaggguggua

SEQ ID NO: 1078601 - RNA, 22 nt, Human
cagggccaagccccuuuggcug

SEQ ID NO: 1078602 - RNA, 22 nt, Human
uguggccuuucaaggauggaau

SEQ ID NO: 1078603 - RNA, 22 nt, Human
uacaauauguggccuuuuguga

SEQ ID NO: 1078604 - RNA, 18 nt, Human
uggagccagcucuaggau

SEQ ID NO: 1078605 - RNA, 18 nt, Human
cccagccucuccuuucua

SEQ ID NO: 1078606 - RNA, 22 nt, Human
caauuucucuuuauaucucaca

SEQ ID NO: 1078607 - RNA, 22 nt, Human
gucagagauggcaugaaagauu

SEQ ID NO: 1078608 - RNA, 22 nt, Human
acugagccugugcccucaucag

SEQ ID NO: 1078609 - RNA, 22 nt, Human
ugcagucuuuccucgaguuugu

SEQ ID NO: 1078610 - RNA, 22 nt, Human
ugcuucugucucuuaugccuug

SEQ ID NO: 1078611 - RNA, 22 nt, Human
ugagcccaggaguuggaggcug

SEQ ID NO: 1078612 - RNA, 22 nt, Human
aagaggaagucuccauggagag

SEQ ID NO: 1078613 - RNA, 22 nt, Human
gcaccuggcugcccagguggag

SEQ ID NO: 1078614 - RNA, 23 nt, Human
gagauggcugguuguccucugaa

SEQ ID NO: 1078615 - RNA, 22 nt, Human
auugcaaucuggugaaaacagu

SEQ ID NO: 1078616 - RNA, 22 nt, Human
agaagccauaguaucucagggu

SEQ ID NO: 1078617 - RNA, 22 nt, Human
ugucauuuucuaaucuguuguc

SEQ ID NO: 1078618 - RNA, 18 nt, Human
gucuuuucucccuuccuc

SEQ ID NO: 1078619 - RNA, 22 nt, Human
gccaagaaaugccccucacaga

SEQ ID NO: 1078620 - RNA, 22 nt, Human
uuacaaagaguguucuuuucca

SEQ ID NO: 1078621 - RNA, 22 nt, Human
uaugagaagaacaggugacuuu

SEQ ID NO: 1078622 - RNA, 22 nt, Human
uguuauugagguuacuuauaag

SEQ ID NO: 1078623 - RNA, 22 nt, Human
aauccugugugacucuggggag

SEQ ID NO: 1078624 - RNA, 22 nt, Human
acugggcugcuugagugccuuc

SEQ ID NO: 1078625 - RNA, 22 nt, Human
caaauacuuuuagccuauugag

SEQ ID NO: 1078626 - RNA, 22 nt, Human
ucugcccucauugcugccugga

SEQ ID NO: 1078627 - RNA, 22 nt, Human
ccugugcucccuauguaucugg

SEQ ID NO: 1078628 - RNA, 22 nt, Human
aaauuuuaaggcuggaacuuaa

SEQ ID NO: 1078629 - RNA, 22 nt, Human
agaggcggagguugcagugagc

SEQ ID NO: 1078630 - RNA, 22 nt, Human
uagaagacaggaaauacaaacc

SEQ ID NO: 1078631 - RNA, 22 nt, Human
ucagcaacuauuuaucaaauuc

SEQ ID NO: 1078632 - RNA, 22 nt, Human
agagccaggaugucuucugggg

SEQ ID NO: 1078633 - RNA, 22 nt, Human
uuuuauugucaaugaagacaga

SEQ ID NO: 1078634 - RNA, 22 nt, Human
uucucucuuacugccaugcugu

SEQ ID NO: 1078635 - RNA, 23 nt, Human
aucuagaaaccugaugacucugu

SEQ ID NO: 1078636 - RNA, 22 nt, Human
aaagccuucaaguagauguaag

SEQ ID NO: 1078637 - RNA, 22 nt, Human
ucaagaaaugugcuuggauaua

SEQ ID NO: 1078638 - RNA, 22 nt, Human
guggcugcuguccucucugguu

SEQ ID NO: 1078639 - RNA, 22 nt, Human
ucuccucugcgcggcagugccc

SEQ ID NO: 1078640 - RNA, 22 nt, Human
aaaaucuugacuguuuuuagaa

SEQ ID NO: 1078641 - RNA, 22 nt, Human
aaagaagacagacauuucuuuc

SEQ ID NO: 1078642 - RNA, 22 nt, Human
ccaggacucaauuaaccucacu

SEQ ID NO: 1078643 - RNA, 22 nt, Human
cugcugcucgaccagucccagg

SEQ ID NO: 1078644 - RNA, 22 nt, Human
auuccaguccaaauguuuuccu

SEQ ID NO: 1078645 - RNA, 22 nt, Human
gcaggcucguuggaaguccccu

SEQ ID NO: 1078646 - RNA, 22 nt, Human
ucaguguaaguuauguagaugu

SEQ ID NO: 1078647 - RNA, 22 nt, Human
aagcagaguccccuucccaugg

SEQ ID NO: 1078648 - RNA, 23 nt, Human
cugugugugccgaggguggccac

SEQ ID NO: 1078649 - RNA, 22 nt, Human
ucuggcugauucccugggacug

SEQ ID NO: 1078650 - RNA, 22 nt, Human
uccugagggcgauucagcaggu

SEQ ID NO: 1078651 - RNA, 21 nt, Human
cugcuuccucucuucauggca

SEQ ID NO: 1078652 - RNA, 22 nt, Human
augccuuuaagagauacugagg

SEQ ID NO: 1078653 - RNA, 20 nt, Human
aagcccauuaccaugcuugg

SEQ ID NO: 1078654 - RNA, 22 nt, Human
ugagccugaguucaaggcugca

SEQ ID NO: 1078655 - RNA, 22 nt, Human
gacaggcuuccuaagugccaga

SEQ ID NO: 1078656 - RNA, 19 nt, Human
acagaaauuaguuauuuuc

SEQ ID NO: 1078657 - RNA, 19 nt, Human
cuggccaggccaggggccc

SEQ ID NO: 1078658 - RNA, 23 nt, Human
agggcugaaugcagagaagcaga

SEQ ID NO: 1078659 - RNA, 22 nt, Human
acagcuguauucaaguugcaag

SEQ ID NO: 1078660 - RNA, 22 nt, Human
ccucccuuggccauagccagcc

SEQ ID NO: 1078661 - RNA, 20 nt, Human
agugucugggccucaggccc

SEQ ID NO: 1078662 - RNA, 22 nt, Human
gcuggaguacaucuuuggcggc

SEQ ID NO: 1078663 - RNA, 22 nt, Human
ugagagugaaaugucacauguc

SEQ ID NO: 1078664 - RNA, 22 nt, Human
agugaaauuuguuuagauaggu

SEQ ID NO: 1078665 - RNA, 22 nt, Human
caaauacuacgauucuugcagu

SEQ ID NO: 1078666 - RNA, 22 nt, Human
ucagcaauaugauaggcuuugu

SEQ ID NO: 1078667 - RNA, 22 nt, Human
uaguaugggaagaacuuuguag

SEQ ID NO: 1078668 - RNA, 22 nt, Human
cucuggccgcagcucagcucug

SEQ ID NO: 1078669 - RNA, 22 nt, Human
agagaacaugacguaauagugg

SEQ ID NO: 1078670 - RNA, 22 nt, Human
uuuuucagccaugaauuacacu

SEQ ID NO: 1078671 - RNA, 22 nt, Human
uuucccaaguguaaacauggca

SEQ ID NO: 1078672 - RNA, 22 nt, Human
uuaaagcauguugcuuaacagg

SEQ ID NO: 1078673 - RNA, 22 nt, Human
auacaguaauuuguaacucauc

SEQ ID NO: 1078674 - RNA, 22 nt, Human
agugcuguuagguuaauauagu

SEQ ID NO: 1078675 - RNA, 22 nt, Human
cuacauuuuucaccgagccucu

SEQ ID NO: 1078676 - RNA, 22 nt, Human
uuugucaaguuugcaaauacgu

SEQ ID NO: 1078677 - RNA, 17 nt, Human
ugguucuuuucauuccc

SEQ ID NO: 1078678 - RNA, 22 nt, Human
gccaggggugcccacccaagga

SEQ ID NO: 1078679 - RNA, 22 nt, Human
ugaaggugaaugucuaugggga

SEQ ID NO: 1078680 - RNA, 22 nt, Human
agugaguggacccugcaaggaa

SEQ ID NO: 1078681 - RNA, 22 nt, Human
guuugauucaagaacaaagagu

SEQ ID NO: 1078682 - RNA, 22 nt, Human
ucuugauuuuguuaaaauuaga

SEQ ID NO: 1078683 - RNA, 22 nt, Human
aggcucugguuggcaaguaaag

SEQ ID NO: 1078684 - RNA, 22 nt, Human
ucuucuuaugugccauuaucuc

SEQ ID NO: 1078685 - RNA, 22 nt, Human
agccacagucugaugccugaga

SEQ ID NO: 1078686 - RNA, 22 nt, Human
ggugcagugguguggcaaaggg

SEQ ID NO: 1078687 - RNA, 22 nt, Human
cagcaacuuggacagcagucuu

SEQ ID NO: 1078688 - RNA, 22 nt, Human
auucuucacauaagugcuguac

SEQ ID NO: 1078689 - RNA, 22 nt, Human
gccaggcauuauuccgaucccu

SEQ ID NO: 1078690 - RNA, 22 nt, Human
cgcugccaggauccccugccgg

SEQ ID NO: 1078691 - RNA, 22 nt, Human
auuaacaugaguuggagauagg

SEQ ID NO: 1078692 - RNA, 22 nt, Human
cagccagugugaccgaggagga

SEQ ID NO: 1078693 - RNA, 22 nt, Human
cuuuaaggugaugagagaugcu

SEQ ID NO: 1078694 - RNA, 22 nt, Human
aaggaggacacccaggacuggg

SEQ ID NO: 1078695 - RNA, 22 nt, Human
agggcagaaguacagacacuua

SEQ ID NO: 1078696 - RNA, 22 nt, Human
agaggcaggaagagcugauuuu

SEQ ID NO: 1078697 - RNA, 22 nt, Human
aacccagccguguagcugccgc

SEQ ID NO: 1078698 - RNA, 22 nt, Human
cugcucuggggaagccagaugu

SEQ ID NO: 1078699 - RNA, 22 nt, Human
uugcagggcaggaccauggaca

SEQ ID NO: 1078700 - RNA, 22 nt, Human
agcuucuggaagccuggcagca

SEQ ID NO: 1078701 - RNA, 20 nt, Human
cagcaggaaaagugccucag

SEQ ID NO: 1078702 - RNA, 22 nt, Human
gaggcacugcaguacagugacu

SEQ ID NO: 1078703 - RNA, 22 nt, Human
guaacaaaggauaacuugguuu

SEQ ID NO: 1078704 - RNA, 20 nt, Human
ggggaagaaaaggaugugau

SEQ ID NO: 1078705 - RNA, 22 nt, Human
auucuguauuucuaauaagauc

SEQ ID NO: 1078706 - RNA, 20 nt, Human
ccagagcagccacugaaguu

SEQ ID NO: 1078707 - RNA, 22 nt, Human
aaugucaaaauaauugauuugu

SEQ ID NO: 1078708 - RNA, 22 nt, Human
agucaacaaaaauguggagccu

SEQ ID NO: 1078709 - RNA, 22 nt, Human
uccugaaaaauuacauguucag

SEQ ID NO: 1078710 - RNA, 22 nt, Human
auuauacaaggcuggugccuaa

SEQ ID NO: 1078711 - RNA, 22 nt, Human
uggcugcaguucacaggagcaa

SEQ ID NO: 1078712 - RNA, 20 nt, Human
ccucaggaugagggugagca

SEQ ID NO: 1078713 - RNA, 22 nt, Human
aaauaaguuagcagauuccagu

SEQ ID NO: 1078714 - RNA, 22 nt, Human
uccaggacuagcauuucugaua

SEQ ID NO: 1078715 - RNA, 22 nt, Human
agaggcuuggccucaguucugu

SEQ ID NO: 1078716 - RNA, 22 nt, Human
ugagccuggcggaagcagcgug

SEQ ID NO: 1078717 - RNA, 22 nt, Human
ucacaguaaaagcauggaagag

SEQ ID NO: 1078718 - RNA, 22 nt, Human
gggcucugguacuuccuggcuc

SEQ ID NO: 1078719 - RNA, 22 nt, Human
uccagccuuucuacucacugag

SEQ ID NO: 1078720 - RNA, 22 nt, Human
gcugcuggggucacaugguaag

SEQ ID NO: 1078721 - RNA, 22 nt, Human
cucaggcucuguacucccuuug

SEQ ID NO: 1078722 - RNA, 23 nt, Human
ggcugagacuacaggcgcuugcc

SEQ ID NO: 1078723 - RNA, 22 nt, Human
agugcagcuuauaaagcaucaa

SEQ ID NO: 1078724 - RNA, 22 nt, Human
auccucuguggauuacaccuag

SEQ ID NO: 1078725 - RNA, 19 nt, Human
uaaaggaagaagggaggau

SEQ ID NO: 1078726 - RNA, 22 nt, Human
gucuggagccacccuaagcauu

SEQ ID NO: 1078727 - RNA, 19 nt, Human
acauuuagaauguacuugc

SEQ ID NO: 1078728 - RNA, 22 nt, Human
gaagccacagagauuguggggg

SEQ ID NO: 1078729 - RNA, 22 nt, Human
guugggcuuauguaauuuuaag

SEQ ID NO: 1078730 - RNA, 22 nt, Human
aguucugggaggugcacgucca

SEQ ID NO: 1078731 - RNA, 22 nt, Human
gcugggcugcccaaccucugac

SEQ ID NO: 1078732 - RNA, 22 nt, Human
caggaaggcgcggcugugccug

SEQ ID NO: 1078733 - RNA, 23 nt, Human
aaggggauacuuccacuuucuuu

SEQ ID NO: 1078734 - RNA, 22 nt, Human
cagcugaggaauacuagaugua

SEQ ID NO: 1078735 - RNA, 22 nt, Human
ugucacagggauaccauggggc

SEQ ID NO: 1078736 - RNA, 22 nt, Human
uguaugaagccagaaucuguuu

SEQ ID NO: 1078737 - RNA, 22 nt, Human
acuguguccuauuuccuugaca

SEQ ID NO: 1078738 - RNA, 22 nt, Human
cugggcacagacccccugggcc

SEQ ID NO: 1078739 - RNA, 22 nt, Human
cuguguuugaugagaagccacc

SEQ ID NO: 1078740 - RNA, 20 nt, Human
agggucugaugugguggccc

SEQ ID NO: 1078741 - RNA, 22 nt, Human
caggaaaaggagacuuuagcac

SEQ ID NO: 1078742 - RNA, 22 nt, Human
cucugggcaccaaagagcagcu

SEQ ID NO: 1078743 - RNA, 22 nt, Human
aaggugucggguuagcucagcc

SEQ ID NO: 1078744 - RNA, 22 nt, Human
cugugggaacacugaggacuuc

SEQ ID NO: 1078745 - RNA, 22 nt, Human
gcuguauuuauuuucuaggguu

SEQ ID NO: 1078746 - RNA, 22 nt, Human
gagaauauuagaguuaguuuau

SEQ ID NO: 1078747 - RNA, 22 nt, Human
uagcagcacuauuuguuguagu

SEQ ID NO: 1078748 - RNA, 22 nt, Human
cagagcagacguugagauuaag

SEQ ID NO: 1078749 - RNA, 22 nt, Human
auaaaaguucaagagaguacag

SEQ ID NO: 1078750 - RNA, 22 nt, Human
aagagcuggucacagguccauu

SEQ ID NO: 1078751 - RNA, 22 nt, Human
uugagggucuggaucugcugcu

SEQ ID NO: 1078752 - RNA, 22 nt, Human
uggccugguuguugcugccguu

SEQ ID NO: 1078753 - RNA, 22 nt, Human
ugaagcaguuacuggguguuaa

SEQ ID NO: 1078754 - RNA, 22 nt, Human
guggagcccugguagggacccc

SEQ ID NO: 1078755 - RNA, 22 nt, Human
agcagaaacagccagucuggac

SEQ ID NO: 1078756 - RNA, 22 nt, Human
uauaaaugcacuuuugaaauau

SEQ ID NO: 1078757 - RNA, 22 nt, Human
agggaagugaaugacagauauc

SEQ ID NO: 1078758 - RNA, 22 nt, Human
ucuaaagugagucauuucgacu

SEQ ID NO: 1078759 - RNA, 22 nt, Human
gaauauauuucucuuaccuuua

SEQ ID NO: 1078760 - RNA, 22 nt, Human
gcagcuggcucagagagguggg

SEQ ID NO: 1078761 - RNA, 23 nt, Human
caguacuuaguguagcguuaauu

SEQ ID NO: 1078762 - RNA, 22 nt, Human
uuuauauuaccuggaauagcuu

SEQ ID NO: 1078763 - RNA, 22 nt, Human
caugaaauucagcaggugagua

SEQ ID NO: 1078764 - RNA, 22 nt, Human
uguguuuuccagaaugguguuu

SEQ ID NO: 1078765 - RNA, 22 nt, Human
uggcugaguguuccaaggagca

SEQ ID NO: 1078766 - RNA, 17 nt, Human
ugaggccugcaucagug

SEQ ID NO: 1078767 - RNA, 22 nt, Human
uaauuauucuagucacauagca

SEQ ID NO: 1078768 - RNA, 22 nt, Human
aaugaugguauugaugagcuaa

SEQ ID NO: 1078769 - RNA, 19 nt, Human
ucucccagcugagaagggc

SEQ ID NO: 1078770 - RNA, 22 nt, Human
uggcacauagaaaaggaucaau

SEQ ID NO: 1078771 - RNA, 22 nt, Human
ggcaggagcucagguugguucc

SEQ ID NO: 1078772 - RNA, 22 nt, Human
cugagaguauuggcaggcuugg

SEQ ID NO: 1078773 - RNA, 22 nt, Human
aaauguuuugcucccauguggu

SEQ ID NO: 1078774 - RNA, 22 nt, Human
acaggcuucucacagaaaaggg

SEQ ID NO: 1078775 - RNA, 23 nt, Human
ccugaagggucaggguccucagc

SEQ ID NO: 1078776 - RNA, 22 nt, Human
accaggggugucaacagcauuu

SEQ ID NO: 1078777 - RNA, 22 nt, Human
acuuuugaagaauuaugcaaaa

SEQ ID NO: 1078778 - RNA, 22 nt, Human
ugaggccacuuccccacagccc

SEQ ID NO: 1078779 - RNA, 22 nt, Human
ccagggcaaaugagaucauagc

SEQ ID NO: 1078780 - RNA, 22 nt, Human
cugcaggcugagcgccugccgg

SEQ ID NO: 1078781 - RNA, 22 nt, Human
agggccugguucuguguaggga

SEQ ID NO: 1078782 - RNA, 22 nt, Human
gccaccucuuugucucugccgc

SEQ ID NO: 1078783 - RNA, 22 nt, Human
ugggaaaguaauugucauccuu

SEQ ID NO: 1078784 - RNA, 19 nt, Human
acagaguccagaggaaagg

SEQ ID NO: 1078785 - RNA, 22 nt, Human
caggccagguggcaggcaaaac

SEQ ID NO: 1078786 - RNA, 22 nt, Human
aguaugaaucuuucagaccgua

SEQ ID NO: 1078787 - RNA, 17 nt, Human
ggccuuggggccucagu

SEQ ID NO: 1078788 - RNA, 22 nt, Human
ugggaaaguguagccugcaggc

SEQ ID NO: 1078789 - RNA, 22 nt, Human
aggucccaggcauagcuggucu

SEQ ID NO: 1078790 - RNA, 21 nt, Human
uucaacaaagggaauaaguuu

SEQ ID NO: 1078791 - RNA, 22 nt, Human
gcccagcacuccucucugacau

SEQ ID NO: 1078792 - RNA, 22 nt, Human
aacacauauuuauauaugcaca

SEQ ID NO: 1078793 - RNA, 22 nt, Human
auugcacaaacacagucagacu

SEQ ID NO: 1078794 - RNA, 22 nt, Human
guucacagcaaaccuaugaacu

SEQ ID NO: 1078795 - RNA, 21 nt, Human
gcagaggaaugguauacauaa

SEQ ID NO: 1078796 - RNA, 19 nt, Human
cugugcuuuaaacuccuau

SEQ ID NO: 1078797 - RNA, 22 nt, Human
acacaaaaucaaaguccuaggc

SEQ ID NO: 1078798 - RNA, 22 nt, Human
accagagucaauuauuuugcca

SEQ ID NO: 1078799 - RNA, 22 nt, Human
uagaaacaugagagaaacucuu

SEQ ID NO: 1078800 - RNA, 22 nt, Human
ucuggcucaaaauacguacucu

SEQ ID NO: 1078801 - RNA, 19 nt, Human
cuccaagugccaaggacag

SEQ ID NO: 1078802 - RNA, 22 nt, Human
aaauaugaaugauaagaguuau

SEQ ID NO: 1078803 - RNA, 22 nt, Human
aggcaacaggaaaccacaugau

SEQ ID NO: 1078804 - RNA, 22 nt, Human
cucagagcccaggguacacccg

SEQ ID NO: 1078805 - RNA, 22 nt, Human
gggaaacugcaacucagagagg

SEQ ID NO: 1078806 - RNA, 22 nt, Human
ugucccagcacuuugggagucu

SEQ ID NO: 1078807 - RNA, 22 nt, Human
gucaggcugccagucuuuauug

SEQ ID NO: 1078808 - RNA, 22 nt, Human
uagaaauguugguauuaacauu

SEQ ID NO: 1078809 - RNA, 22 nt, Human
ucugccuuuucacugccacuaa

SEQ ID NO: 1078810 - RNA, 22 nt, Human
agccacagcgaaccucucuucc

SEQ ID NO: 1078811 - RNA, 22 nt, Human
caugaacauuuguuuacaucug

SEQ ID NO: 1078812 - RNA, 22 nt, Human
agaauuacagcuuuuagaauag

SEQ ID NO: 1078813 - RNA, 22 nt, Human
cacaauaaauguuugcugauga

SEQ ID NO: 1078814 - RNA, 22 nt, Human
ucagggcaucaucaugaauaua

SEQ ID NO: 1078815 - RNA, 22 nt, Human
agcagugagugggaggaccaug

SEQ ID NO: 1078816 - RNA, 22 nt, Human
augcccaaugucacaauuuuug

SEQ ID NO: 1078817 - RNA, 22 nt, Human
ugucucugggugauucaguccu

SEQ ID NO: 1078818 - RNA, 22 nt, Human
gaugaaauuugaaaauaguguu

SEQ ID NO: 1078819 - RNA, 22 nt, Human
gguggcaggcccugagcauccc

SEQ ID NO: 1078820 - RNA, 22 nt, Human
agcugcucuuugaaggacacuu

SEQ ID NO: 1078821 - RNA, 22 nt, Human
ugagacaugugaauauuuguac

SEQ ID NO: 1078822 - RNA, 22 nt, Human
ccuuugggugaauuccucucuu

SEQ ID NO: 1078823 - RNA, 22 nt, Human
gcauguuauguaucugcccagc

SEQ ID NO: 1078824 - RNA, 22 nt, Human
auuugucaauaagaugaacaua

SEQ ID NO: 1078825 - RNA, 22 nt, Human
agaaaccuggggguuguacaua

SEQ ID NO: 1078826 - RNA, 22 nt, Human
uggagcucaaaggccuguggga

SEQ ID NO: 1078827 - RNA, 22 nt, Human
ccagcucugccaagcgucagcu

SEQ ID NO: 1078828 - RNA, 22 nt, Human
uagcugucaccagaaauggcca

SEQ ID NO: 1078829 - RNA, 22 nt, Human
uuguaaaggcuguuauugacuu

SEQ ID NO: 1078830 - RNA, 22 nt, Human
uguagcucuccagccagcaagg

SEQ ID NO: 1078831 - RNA, 21 nt, Human
agugaaaugaaguguaugcuc

SEQ ID NO: 1078832 - RNA, 22 nt, Human
uagcagaaccagcagucaauuu

SEQ ID NO: 1078833 - RNA, 22 nt, Human
ucugaagugaucaucauuucuc

SEQ ID NO: 1078834 - RNA, 21 nt, Human
aggcagcaggauccagggaca

SEQ ID NO: 1078835 - RNA, 22 nt, Human
aucaaaaccuugacuuuuaaug

SEQ ID NO: 1078836 - RNA, 22 nt, Human
gcugccacuuggucaugucaug

SEQ ID NO: 1078837 - RNA, 22 nt, Human
uuccucaggcuucccuuugucc

SEQ ID NO: 1078838 - RNA, 22 nt, Human
uuugaaagucaaccuuccaguu

SEQ ID NO: 1078839 - RNA, 22 nt, Human
uccuuuucucuaguaagcuuua

SEQ ID NO: 1078840 - RNA, 22 nt, Human
aaccauuugcaguuacugagac

SEQ ID NO: 1078841 - RNA, 22 nt, Human
cuuguauuccccuaucucuaaa

SEQ ID NO: 1078842 - RNA, 22 nt, Human
cagcauggggaucacuguaggc

SEQ ID NO: 1078843 - RNA, 22 nt, Human
cuuuguuuauauuucuccucga

SEQ ID NO: 1078844 - RNA, 22 nt, Human
caugaagcacagcucucuuuuu

SEQ ID NO: 1078845 - RNA, 22 nt, Human
ucucaguguggugcuuaggaua

SEQ ID NO: 1078846 - RNA, 20 nt, Human
gugggcagcaggcauacugg

SEQ ID NO: 1078847 - RNA, 23 nt, Human
cauauucaaaacuggaccacucu

SEQ ID NO: 1078848 - RNA, 22 nt, Human
cagcuccuagaucggcgaagug

SEQ ID NO: 1078849 - RNA, 23 nt, Human
agcaggcugcuucuccacagcug

SEQ ID NO: 1078850 - RNA, 20 nt, Human
ugccaugguaacagagugug

SEQ ID NO: 1078851 - RNA, 22 nt, Human
uuccaaucaggauaauaauuag

SEQ ID NO: 1078852 - RNA, 22 nt, Human
gagaugaauguaaacaaaggca

SEQ ID NO: 1078853 - RNA, 22 nt, Human
aucaggaucugcaucauaagaa

SEQ ID NO: 1078854 - RNA, 22 nt, Human
uggcuucaucugcagcacugcc

SEQ ID NO: 1078855 - RNA, 22 nt, Human
ccugagcaucagcgccuccuua

SEQ ID NO: 1078856 - RNA, 22 nt, Human
gguggcugguuuuauaagaggu

SEQ ID NO: 1078857 - RNA, 22 nt, Human
aauagaauguaaucuaauacau

SEQ ID NO: 1078858 - RNA, 22 nt, Human
gagagcacaugaacauggagga

SEQ ID NO: 1078859 - RNA, 22 nt, Human
aaacucuuccuuucuuuaaagu

SEQ ID NO: 1078860 - RNA, 22 nt, Human
aaacucuguagcuaaacauaau

SEQ ID NO: 1078861 - RNA, 22 nt, Human
aucccuggacggcgccucccca

SEQ ID NO: 1078862 - RNA, 22 nt, Human
gccucugcaacuccgccuuggu

SEQ ID NO: 1078863 - RNA, 22 nt, Human
aggagugaguguccucagcaga

SEQ ID NO: 1078864 - RNA, 22 nt, Human
cucccuccaaauaagacucggg

SEQ ID NO: 1078865 - RNA, 22 nt, Human
cuggaaugccucccugucagag

SEQ ID NO: 1078866 - RNA, 23 nt, Human
agagcuuagggaauucacaugag

SEQ ID NO: 1078867 - RNA, 22 nt, Human
ucuuucagccacuuaccugucu

SEQ ID NO: 1078868 - RNA, 22 nt, Human
uggucaguugcaucagagaagu

SEQ ID NO: 1078869 - RNA, 22 nt, Human
uuuccaaauaaggucacacuca

SEQ ID NO: 1078870 - RNA, 22 nt, Human
ugccuggguucccaccccaaag

SEQ ID NO: 1078871 - RNA, 22 nt, Human
aaagccagaguguguuagagac

SEQ ID NO: 1078872 - RNA, 22 nt, Human
cccagcuccaagggacagcgaa

SEQ ID NO: 1078873 - RNA, 22 nt, Human
cauuucauaguugucacaauaa

SEQ ID NO: 1078874 - RNA, 22 nt, Human
caguguaagaauucaaagccua

SEQ ID NO: 1078875 - RNA, 22 nt, Human
cagcagcugaggcgcuggcgug

SEQ ID NO: 1078876 - RNA, 22 nt, Human
gagggagugccagagggccagc

SEQ ID NO: 1078877 - RNA, 22 nt, Human
ugcuucuguucuuucaccuacg

SEQ ID NO: 1078878 - RNA, 22 nt, Human
augaugaaauuuucuaucaugu

SEQ ID NO: 1078879 - RNA, 22 nt, Human
uggcauuucuguuagacucuca

SEQ ID NO: 1078880 - RNA, 22 nt, Human
cggcagagcuuccugcucagcg

SEQ ID NO: 1078881 - RNA, 17 nt, Human
uaugcuuuucuucucca

SEQ ID NO: 1078882 - RNA, 22 nt, Human
ugaaauuaugcauuguuguacc

SEQ ID NO: 1078883 - RNA, 22 nt, Human
acaaaaccagaaaaucucuacc

SEQ ID NO: 1078884 - RNA, 22 nt, Human
gcagccucaaacuccccagcuc

SEQ ID NO: 1078885 - RNA, 23 nt, Human
ucaugcccaggcuccagauguca

SEQ ID NO: 1078886 - RNA, 22 nt, Human
cuggccaguuacugcuauuggc

SEQ ID NO: 1078887 - RNA, 22 nt, Human
aucacagagcucccuuccacug

SEQ ID NO: 1078888 - RNA, 22 nt, Human
gcagugggcaacaagagcugga

SEQ ID NO: 1078889 - RNA, 22 nt, Human
uuacugauacacauaagaauuu

SEQ ID NO: 1078890 - RNA, 22 nt, Human
auuuuuucuguaaacuggccuu

SEQ ID NO: 1078891 - RNA, 22 nt, Human
uuugucaauaacuaccaacagg

SEQ ID NO: 1078892 - RNA, 22 nt, Human
ugaaagguuaaaaguaguauug

SEQ ID NO: 1078893 - RNA, 22 nt, Human
gagaaaauagcauguguaguau

SEQ ID NO: 1078894 - RNA, 19 nt, Human
ucucaauucuccccacugc

SEQ ID NO: 1078895 - RNA, 22 nt, Human
ugcuccuggcuccuucccuaac

SEQ ID NO: 1078896 - RNA, 22 nt, Human
cgggcagugcccagcggggcag

SEQ ID NO: 1078897 - RNA, 22 nt, Human
cauuugaagaagaaacguacua

SEQ ID NO: 1078898 - RNA, 22 nt, Human
cuggcauguguuuggcuccugu

SEQ ID NO: 1078899 - RNA, 22 nt, Human
uggcucugugucucccagcagc

SEQ ID NO: 1078900 - RNA, 22 nt, Human
agcaggggcaggguuuugugcu

SEQ ID NO: 1078901 - RNA, 22 nt, Human
cugggcagagcuaacaccugag

SEQ ID NO: 1078902 - RNA, 22 nt, Human
aggcuccugcaggugaggugcu

SEQ ID NO: 1078903 - RNA, 22 nt, Human
gccugcagccucaagggcugag

SEQ ID NO: 1078904 - RNA, 22 nt, Human
auggcauuugucaagauaagua

SEQ ID NO: 1078905 - RNA, 22 nt, Human
uuguaugaguaugguguauagg

SEQ ID NO: 1078906 - RNA, 22 nt, Human
acagaaaaguuuacuuuugcuc

SEQ ID NO: 1078907 - RNA, 22 nt, Human
ggcuucagugacuggugcccuc

SEQ ID NO: 1078908 - RNA, 22 nt, Human
ggaggccuccugggggagguuc

SEQ ID NO: 1078909 - RNA, 22 nt, Human
aagccucuggggccucaucugu

SEQ ID NO: 1078910 - RNA, 22 nt, Human
uaaucacaucaggguaaauggg

SEQ ID NO: 1078911 - RNA, 22 nt, Human
cagggccucauggccggggugc

SEQ ID NO: 1078912 - RNA, 19 nt, Human
caguuacaggcacuguggg

SEQ ID NO: 1078913 - RNA, 22 nt, Human
uacagaaauacagucaggccua

SEQ ID NO: 1078914 - RNA, 22 nt, Human
aaagaagagcuggaaggagucu

SEQ ID NO: 1078915 - RNA, 22 nt, Human
cccugccucugaagcugcucag

SEQ ID NO: 1078916 - RNA, 22 nt, Human
cuggcccuaugagccuccugau

SEQ ID NO: 1078917 - RNA, 22 nt, Human
ugggccugccccaggcuucagc

SEQ ID NO: 1078918 - RNA, 22 nt, Human
ggcccagcacagugcuuggggg

SEQ ID NO: 1078919 - RNA, 22 nt, Human
uaauuucacugauaugaaguca

SEQ ID NO: 1078920 - RNA, 19 nt, Human
ucucugcuucucuuggcau

SEQ ID NO: 1078921 - RNA, 22 nt, Human
cacagcuuccauuagaaugaga

SEQ ID NO: 1078922 - RNA, 21 nt, Human
gcaaagugugggcauaaacag

SEQ ID NO: 1078923 - RNA, 19 nt, Human
acauagcuggcuacacugu

SEQ ID NO: 1078924 - RNA, 22 nt, Human
aaaugcagaucccugaaucuca

SEQ ID NO: 1078925 - RNA, 22 nt, Human
aauacuauguagccaaaauaau

SEQ ID NO: 1078926 - RNA, 22 nt, Human
uauuauguaaagguuauugcag

SEQ ID NO: 1078927 - RNA, 22 nt, Human
auucucaauggcuacuuucaua

SEQ ID NO: 1078928 - RNA, 22 nt, Human
agaagccauguuuaguaggaug

SEQ ID NO: 1078929 - RNA, 22 nt, Human
uggaaguugaaucucagucaug

SEQ ID NO: 1078930 - RNA, 22 nt, Human
aaucauguuuacgugacauguc

SEQ ID NO: 1078931 - RNA, 22 nt, Human
guucacauggcauuuucacauc

SEQ ID NO: 1078932 - RNA, 22 nt, Human
gacccaggcucgugggacggcu

SEQ ID NO: 1078933 - RNA, 22 nt, Human
auaaaaucuuuaugugcucugc

SEQ ID NO: 1078934 - RNA, 22 nt, Human
agcuuuuauuggcugucauuug

SEQ ID NO: 1078935 - RNA, 22 nt, Human
augcuguggggagugaggguag

SEQ ID NO: 1078936 - RNA, 20 nt, Human
aaucacaguuaacucuuucu

SEQ ID NO: 1078937 - RNA, 22 nt, Human
gcugagugagguccagagcuug

SEQ ID NO: 1078938 - RNA, 22 nt, Human
agcugccuguccuaggccauca

SEQ ID NO: 1078939 - RNA, 22 nt, Human
auuauugccagcuauuacaaca

SEQ ID NO: 1078940 - RNA, 22 nt, Human
uuuacaucucaccagauucaua

SEQ ID NO: 1078941 - RNA, 22 nt, Human
ggugaagggugucauggcauuu

SEQ ID NO: 1078942 - RNA, 22 nt, Human
gugaggcagcaggagccucugu

SEQ ID NO: 1078943 - RNA, 22 nt, Human
gccuggaaauugaggcacaguu

SEQ ID NO: 1078944 - RNA, 22 nt, Human
uuaggaauauuuucugaguagu

SEQ ID NO: 1078945 - RNA, 20 nt, Human
ucugagacuuguagugugga

SEQ ID NO: 1078946 - RNA, 22 nt, Human
cagacaggagacuggaucaugg

SEQ ID NO: 1078947 - RNA, 22 nt, Human
agccagaggccagccugccuca

SEQ ID NO: 1078948 - RNA, 22 nt, Human
cccucuacagggaagcgcuuuc

SEQ ID NO: 1078949 - RNA, 22 nt, Human
ggagcugugcugggugaucagg

SEQ ID NO: 1078950 - RNA, 22 nt, Human
ugcugucaagaaaacaagcaau

SEQ ID NO: 1078951 - RNA, 22 nt, Human
agguaagaauagaggauugggg

SEQ ID NO: 1078952 - RNA, 22 nt, Human
uagaaaguaaaucaguuuuauu

SEQ ID NO: 1078953 - RNA, 22 nt, Human
ugcuucugacauguucuugguu

SEQ ID NO: 1078954 - RNA, 22 nt, Human
aguggcagagcaggugcuggaa

SEQ ID NO: 1078955 - RNA, 22 nt, Human
ugcugccacauuuaaagagggg

SEQ ID NO: 1078956 - RNA, 22 nt, Human
cagaguguggcaucuuccaacu

SEQ ID NO: 1078957 - RNA, 22 nt, Human
uggccugguccuugucaaggca

SEQ ID NO: 1078958 - RNA, 22 nt, Human
ucuuucaaaugcuugaauugga

SEQ ID NO: 1078959 - RNA, 22 nt, Human
gagcuuggugaugccuccuggu

SEQ ID NO: 1078960 - RNA, 18 nt, Human
aggcacuggaauuaaggg

SEQ ID NO: 1078961 - RNA, 22 nt, Human
uuuugaaagggugauuuggcuu

SEQ ID NO: 1078962 - RNA, 22 nt, Human
uuggaccaaggucugcucuuuc

SEQ ID NO: 1078963 - RNA, 22 nt, Human
gugcaagacuuccuaagcaaua

SEQ ID NO: 1078964 - RNA, 22 nt, Human
cucccaggggaacuaucaagua

SEQ ID NO: 1078965 - RNA, 22 nt, Human
cgggcuggcugcagcugcugga

SEQ ID NO: 1078966 - RNA, 22 nt, Human
acuaaaugaacuauuaauacuu

SEQ ID NO: 1078967 - RNA, 22 nt, Human
ucucaugguuugugauucaaau

SEQ ID NO: 1078968 - RNA, 22 nt, Human
augugcucacccuauuuaugga

SEQ ID NO: 1078969 - RNA, 22 nt, Human
guuucacagucugcagaauuuu

SEQ ID NO: 1078970 - RNA, 22 nt, Human
gcucuguguugucagaggcacc

SEQ ID NO: 1078971 - RNA, 22 nt, Human
cugaaggagguagagugacaua

SEQ ID NO: 1078972 - RNA, 22 nt, Human
caccauuuaagaaagccaaauu

SEQ ID NO: 1078973 - RNA, 20 nt, Human
cugggcucgguggcccuggc

SEQ ID NO: 1078974 - RNA, 22 nt, Human
caggcagagucagauuagacuu

SEQ ID NO: 1078975 - RNA, 22 nt, Human
auaaauuuauaauuguuuccug

SEQ ID NO: 1078976 - RNA, 23 nt, Human
gaauucuuaaggucacuaaaguc

SEQ ID NO: 1078977 - RNA, 22 nt, Human
cagcaggggaacugugggccag

SEQ ID NO: 1078978 - RNA, 22 nt, Human
ucaggcagcauuaaacuucagc

SEQ ID NO: 1078979 - RNA, 22 nt, Human
agauuucaauggauauugcaag

SEQ ID NO: 1078980 - RNA, 22 nt, Human
aaauaguucagcuuguaaaccc

SEQ ID NO: 1078981 - RNA, 22 nt, Human
ugcuuuaucaaagcuauaguga

SEQ ID NO: 1078982 - RNA, 22 nt, Human
auuuucagaacauucauucacu

SEQ ID NO: 1078983 - RNA, 22 nt, Human
cugggcagcugugcaaacaaua

SEQ ID NO: 1078984 - RNA, 20 nt, Human
ccugccugccucggcucauu

SEQ ID NO: 1078985 - RNA, 22 nt, Human
agcugcagauucuaucuagaag

SEQ ID NO: 1078986 - RNA, 21 nt, Human
ucaggggcuguguuuuccauc

SEQ ID NO: 1078987 - RNA, 22 nt, Human
auguagagcaguguuguccaau

SEQ ID NO: 1078988 - RNA, 22 nt, Human
ggccucugcaacuggcuguggc

SEQ ID NO: 1078989 - RNA, 22 nt, Human
aagacuuucugggguguaaagg

SEQ ID NO: 1078990 - RNA, 22 nt, Human
uccuguaguugcuaaguuuguu

SEQ ID NO: 1078991 - RNA, 22 nt, Human
ucacagggauggaauagaaaua

SEQ ID NO: 1078992 - RNA, 22 nt, Human
uguucauuuugaaguacuucaa

SEQ ID NO: 1078993 - RNA, 23 nt, Human
ugggucagcugccuccaggacaa

SEQ ID NO: 1078994 - RNA, 22 nt, Human
uucacauuggugauauguuucu

SEQ ID NO: 1078995 - RNA, 22 nt, Human
gacuuugaacaguguaucagua

SEQ ID NO: 1078996 - RNA, 22 nt, Human
ccugaagcaaggguaggcaggu

SEQ ID NO: 1078997 - RNA, 22 nt, Human
agauuuaaauuugcuacaauuc

SEQ ID NO: 1078998 - RNA, 22 nt, Human
acaauucugaugguuucccagu

SEQ ID NO: 1078999 - RNA, 22 nt, Human
gguccuggaaauugacggaaag

SEQ ID NO: 1079000 - RNA, 22 nt, Human
aguggagaauaugcagaaagcc

SEQ ID NO: 1079001 - RNA, 22 nt, Human
ucacagaaugucagaguugggg

SEQ ID NO: 1079002 - RNA, 22 nt, Human
acuucucuucauagguggcaau

SEQ ID NO: 1079003 - RNA, 22 nt, Human
ccagccuucugagcugccugga

SEQ ID NO: 1079004 - RNA, 22 nt, Human
cccuuagcuccaagggguuugg

SEQ ID NO: 1079005 - RNA, 22 nt, Human
ucaaaucucaucuugaauugua

SEQ ID NO: 1079006 - RNA, 22 nt, Human
cagugguauuugagagaaugga

SEQ ID NO: 1079007 - RNA, 22 nt, Human
uugcuuuguuuaaaagugguau

SEQ ID NO: 1079008 - RNA, 22 nt, Human
ggcagaaggccucccagcuccu

SEQ ID NO: 1079009 - RNA, 22 nt, Human
uggcagagacaaggccgggccu

SEQ ID NO: 1079010 - RNA, 22 nt, Human
caaagugcugagauuacaggua

SEQ ID NO: 1079011 - RNA, 22 nt, Human
aaauuguggcgucuguaagagu

SEQ ID NO: 1079012 - RNA, 23 nt, Human
uacugccuuguucauguguauuu

SEQ ID NO: 1079013 - RNA, 22 nt, Human
uaggggaaagcagaauccugga

SEQ ID NO: 1079014 - RNA, 22 nt, Human
ggcucagcgcgcugggagggag

SEQ ID NO: 1079015 - RNA, 22 nt, Human
cagaacagaaguaaaauuuacc

SEQ ID NO: 1079016 - RNA, 21 nt, Human
gcccagaagacuggcucugcc

SEQ ID NO: 1079017 - RNA, 22 nt, Human
gcccucagcaggaaagaucaac

SEQ ID NO: 1079018 - RNA, 22 nt, Human
ugauuucauaguauauacauga

SEQ ID NO: 1079019 - RNA, 22 nt, Human
ggcuuuaaacacugaaauugca

SEQ ID NO: 1079020 - RNA, 22 nt, Human
acauuguauaaugauuaucaca

SEQ ID NO: 1079021 - RNA, 22 nt, Human
cagaaaauaaacauuuguggaa

SEQ ID NO: 1079022 - RNA, 22 nt, Human
auuuugugaacccucaagcaau

SEQ ID NO: 1079023 - RNA, 22 nt, Human
cugaguccagggacagaggcgu

SEQ ID NO: 1079024 - RNA, 22 nt, Human
ugagacaguucugcagcugggu

SEQ ID NO: 1079025 - RNA, 22 nt, Human
caguauuuguucccuaucaaug

SEQ ID NO: 1079026 - RNA, 22 nt, Human
gaaguuaguuggggcccaagaa

SEQ ID NO: 1079027 - RNA, 22 nt, Human
gugcaaauguaauugcaguuuu

SEQ ID NO: 1079028 - RNA, 22 nt, Human
uauuucaucuggaacaagguaa

SEQ ID NO: 1079029 - RNA, 22 nt, Human
aaagccuugcccgucacuggga

SEQ ID NO: 1079030 - RNA, 22 nt, Human
gaggaaccuccugaaaaguaua

SEQ ID NO: 1079031 - RNA, 21 nt, Human
gcagaaaggaaucuuaggucc

SEQ ID NO: 1079032 - RNA, 22 nt, Human
caugccucugcagcuguuuauu

SEQ ID NO: 1079033 - RNA, 22 nt, Human
auccugcuuguuacuuauagag

SEQ ID NO: 1079034 - RNA, 22 nt, Human
agcagaagugccuuagcaauca

SEQ ID NO: 1079035 - RNA, 22 nt, Human
acaaaauuaugaagaggccuug

SEQ ID NO: 1079036 - RNA, 22 nt, Human
ucagggcaucucuuaaguggug

SEQ ID NO: 1079037 - RNA, 22 nt, Human
gcuguguuugacaguagcagac

SEQ ID NO: 1079038 - RNA, 22 nt, Human
uggaagagggagcuggguggcc

SEQ ID NO: 1079039 - RNA, 20 nt, Human
ucauugcacauaauggaagc

SEQ ID NO: 1079040 - RNA, 22 nt, Human
ccucugcaccauagccuucagc

SEQ ID NO: 1079041 - RNA, 22 nt, Human
ucucaggaagugauauugagac

SEQ ID NO: 1079042 - RNA, 22 nt, Human
agugaggucauacuggagaggg

SEQ ID NO: 1079043 - RNA, 22 nt, Human
acuguaaaaugagauauguaua

SEQ ID NO: 1079044 - RNA, 22 nt, Human
cucagagaagucuuugcuaaac

SEQ ID NO: 1079045 - RNA, 22 nt, Human
gcagggacgccagggacagcaa

SEQ ID NO: 1079046 - RNA, 22 nt, Human
cuggcucagugccuucagaagu

SEQ ID NO: 1079047 - RNA, 22 nt, Human
acagcucuguugccagaucugc

SEQ ID NO: 1079048 - RNA, 22 nt, Human
gacaaauguaccccuagagucu

SEQ ID NO: 1079049 - RNA, 21 nt, Human
ugggccucaggcagcugugac

SEQ ID NO: 1079050 - RNA, 22 nt, Human
cuucagaagaaaagcagugugu

SEQ ID NO: 1079051 - RNA, 22 nt, Human
guucuggaagcuuuugagcaac

SEQ ID NO: 1079052 - RNA, 22 nt, Human
caguaggagguucugagguucu

SEQ ID NO: 1079053 - RNA, 22 nt, Human
agcaggugagcacagccaggcu

SEQ ID NO: 1079054 - RNA, 22 nt, Human
acugggaguucuccaugucccu

SEQ ID NO: 1079055 - RNA, 22 nt, Human
agcaggcuaggaaccucacugc

SEQ ID NO: 1079056 - RNA, 22 nt, Human
caguggguggcuaaguggcuga

SEQ ID NO: 1079057 - RNA, 22 nt, Human
cagcugcaugucuguggugguc

SEQ ID NO: 1079058 - RNA, 22 nt, Human
uaguuaaagagauccacauucc

SEQ ID NO: 1079059 - RNA, 22 nt, Human
gggaccuggcaccuuugcucug

SEQ ID NO: 1079060 - RNA, 22 nt, Human
uggcucaggggucuggcucugu

SEQ ID NO: 1079061 - RNA, 22 nt, Human
agugaaauaaagcugccuaugg

SEQ ID NO: 1079062 - RNA, 22 nt, Human
aguggagacaggacagucgaua

SEQ ID NO: 1079063 - RNA, 22 nt, Human
agggaaauuaaugugagcaaug

SEQ ID NO: 1079064 - RNA, 16 nt, Human
gcaggcagaucacaug

SEQ ID NO: 1079065 - RNA, 17 nt, Human
cucacggaggaugaauc

SEQ ID NO: 1079066 - RNA, 22 nt, Human
guuguacagcauccagugcaga

SEQ ID NO: 1079067 - RNA, 22 nt, Human
cacugaguucccugacauuuca

SEQ ID NO: 1079068 - RNA, 22 nt, Human
cauggaacuucaagaagaaagc

SEQ ID NO: 1079069 - RNA, 23 nt, Human
aggugccaacugagagcugagag

SEQ ID NO: 1079070 - RNA, 22 nt, Human
gagugcaguaugagaggcugcu

SEQ ID NO: 1079071 - RNA, 20 nt, Human
ucuggcucuuugcuccuccc

SEQ ID NO: 1079072 - RNA, 22 nt, Human
uaaguucaaugaacucaguucu

SEQ ID NO: 1079073 - RNA, 22 nt, Human
caggcaggagccagggauucca

SEQ ID NO: 1079074 - RNA, 22 nt, Human
uggccugggccggcagauauac

SEQ ID NO: 1079075 - RNA, 22 nt, Human
gaagggugugauuugccugaga

SEQ ID NO: 1079076 - RNA, 22 nt, Human
uuuuuuaucuaugguaguacca

SEQ ID NO: 1079077 - RNA, 22 nt, Human
aaaucaguuguuauauuaaaga

SEQ ID NO: 1079078 - RNA, 22 nt, Human
gcauggugacaucaugugaaug

SEQ ID NO: 1079079 - RNA, 22 nt, Human
cuggugcuguagccugauugag

SEQ ID NO: 1079080 - RNA, 19 nt, Human
ucuggcuccgccucuuagu

SEQ ID NO: 1079081 - RNA, 22 nt, Human
agugcuguccaguuucacaggu

SEQ ID NO: 1079082 - RNA, 22 nt, Human
ccugcuggcugguagaguuccg

SEQ ID NO: 1079083 - RNA, 22 nt, Human
uuucacauuggcuucuauuucu

SEQ ID NO: 1079084 - RNA, 19 nt, Human
auauccuugagaaagggaa

SEQ ID NO: 1079085 - RNA, 22 nt, Human
ggcaggcuugauauggggggac

SEQ ID NO: 1079086 - RNA, 22 nt, Human
gccaggggacgcggagcgacga

SEQ ID NO: 1079087 - RNA, 18 nt, Human
uaggaacauugauuggag

SEQ ID NO: 1079088 - RNA, 22 nt, Human
aguuuccaggcaggagcuaauu

SEQ ID NO: 1079089 - RNA, 21 nt, Human
agcagccauuucacagagacu

SEQ ID NO: 1079090 - RNA, 22 nt, Human
agcagagaggagguggcccugu

SEQ ID NO: 1079091 - RNA, 22 nt, Human
acacauauauacauauuugugc

SEQ ID NO: 1079092 - RNA, 22 nt, Human
gcuggguggaucggaggcucug

SEQ ID NO: 1079093 - RNA, 19 nt, Human
cauuuuaagcauccccagu

SEQ ID NO: 1079094 - RNA, 22 nt, Human
uugcagagagguuaggaacuca

SEQ ID NO: 1079095 - RNA, 22 nt, Human
aagaagagaacuggcauccuaa

SEQ ID NO: 1079096 - RNA, 22 nt, Human
uggagguguccaacucgugggu

SEQ ID NO: 1079097 - RNA, 22 nt, Human
uacacuuuucugguuacucuug

SEQ ID NO: 1079098 - RNA, 19 nt, Human
ucccucagucugccaggcc

SEQ ID NO: 1079099 - RNA, 22 nt, Human
ccaggugugauuuggcaguguc

SEQ ID NO: 1079100 - RNA, 22 nt, Human
aggagagagcugagcuuugcug

SEQ ID NO: 1079101 - RNA, 22 nt, Human
aggggccauuguucugcccgcu

SEQ ID NO: 1079102 - RNA, 22 nt, Human
aucagaauuagccagugaggcu

SEQ ID NO: 1079103 - RNA, 22 nt, Human
agcugagcauuugauccaccuc

SEQ ID NO: 1079104 - RNA, 22 nt, Human
uccaagaacccaagcgaaugcc

SEQ ID NO: 1079105 - RNA, 22 nt, Human
acauagaacuucgaugucuuuu

SEQ ID NO: 1079106 - RNA, 22 nt, Human
ccccagcugcauacuugccaag

SEQ ID NO: 1079107 - RNA, 20 nt, Human
uggcaggaauagggccagag

SEQ ID NO: 1079108 - RNA, 22 nt, Human
aauguacaaggguuccaguuuu

SEQ ID NO: 1079109 - RNA, 22 nt, Human
ucauucucagacucuuggccuc

SEQ ID NO: 1079110 - RNA, 22 nt, Human
gaggagaagcuaagaaacacag

SEQ ID NO: 1079111 - RNA, 22 nt, Human
gccaccagguuagauccagccu

SEQ ID NO: 1079112 - RNA, 22 nt, Human
ggcaguggaggacccugugucu

SEQ ID NO: 1079113 - RNA, 22 nt, Human
agauguaaacucucaugucauu

SEQ ID NO: 1079114 - RNA, 22 nt, Human
ucagcugagcuccagcucauag

SEQ ID NO: 1079115 - RNA, 22 nt, Human
cagggaggcugucuuaugccug

SEQ ID NO: 1079116 - RNA, 22 nt, Human
agccagggaagaggccuaccuc

SEQ ID NO: 1079117 - RNA, 17 nt, Human
agugaggagauuggaag

SEQ ID NO: 1079118 - RNA, 22 nt, Human
ggcuggucacaccacugcaggg

SEQ ID NO: 1079119 - RNA, 18 nt, Human
uguuccaaggaaggaauc

SEQ ID NO: 1079120 - RNA, 22 nt, Human
cacacuuuuggcauguuugguu

SEQ ID NO: 1079121 - RNA, 17 nt, Human
gcuaggagagggaggag

SEQ ID NO: 1079122 - RNA, 22 nt, Human
agggccucgggcucaguggguc

SEQ ID NO: 1079123 - RNA, 22 nt, Human
ugaggcaggaugcuugcacagg

SEQ ID NO: 1079124 - RNA, 22 nt, Human
ggagaaggugcuggucacugug

SEQ ID NO: 1079125 - RNA, 22 nt, Human
gaaauaacagcucuggaagagu

SEQ ID NO: 1079126 - RNA, 22 nt, Human
cauuuucagcacccaucugaaa

SEQ ID NO: 1079127 - RNA, 22 nt, Human
ccucucccacguggcagaggcu

SEQ ID NO: 1079128 - RNA, 22 nt, Human
gugcccaguugaggccaggacu

SEQ ID NO: 1079129 - RNA, 22 nt, Human
cuuucugaaagacauuuuaacu

SEQ ID NO: 1079130 - RNA, 22 nt, Human
ugaugcugagccugggacugac

SEQ ID NO: 1079131 - RNA, 22 nt, Human
cuguggcuaugguguacauacu

SEQ ID NO: 1079132 - RNA, 22 nt, Human
uuuacacauaccucuuuaaagu

SEQ ID NO: 1079133 - RNA, 22 nt, Human
ucacaggguuuggaagccuccu

SEQ ID NO: 1079134 - RNA, 22 nt, Human
caggaacagcaccaggagcuag

SEQ ID NO: 1079135 - RNA, 22 nt, Human
uucaaucauuagaaucucaggc

SEQ ID NO: 1079136 - RNA, 22 nt, Human
uuggacuuaacaaagggugaug

SEQ ID NO: 1079137 - RNA, 22 nt, Human
uagguggugggauaugagcauc

SEQ ID NO: 1079138 - RNA, 22 nt, Human
ucuuccaguguagacaucugcc

SEQ ID NO: 1079139 - RNA, 22 nt, Human
agcaggugcguuacuucacucu

SEQ ID NO: 1079140 - RNA, 22 nt, Human
agcaaauacauuuuuagcauaa

SEQ ID NO: 1079141 - RNA, 22 nt, Human
ccugucugcaugagugagcaua

SEQ ID NO: 1079142 - RNA, 22 nt, Human
cugcucuggcuguguacuucag

SEQ ID NO: 1079143 - RNA, 22 nt, Human
cagaggaaguuccuugaugaga

SEQ ID NO: 1079144 - RNA, 22 nt, Human
agauguggccggcuagggagag

SEQ ID NO: 1079145 - RNA, 23 nt, Human
ccugcucaggcgugugcccugcu

SEQ ID NO: 1079146 - RNA, 22 nt, Human
guacagauuaauaauauacuga

SEQ ID NO: 1079147 - RNA, 22 nt, Human
uuucaaaggaggcugagaggau

SEQ ID NO: 1079148 - RNA, 22 nt, Human
ugagucagccagagcugccaug

SEQ ID NO: 1079149 - RNA, 22 nt, Human
gcuguccaugucuggccucagu

SEQ ID NO: 1079150 - RNA, 20 nt, Human
caggccucugggggcccugg

SEQ ID NO: 1079151 - RNA, 22 nt, Human
acuggcugaguuuauguucaca

SEQ ID NO: 1079152 - RNA, 22 nt, Human
guccucugucccuggggcacgg

SEQ ID NO: 1079153 - RNA, 22 nt, Human
ugccacccagccaggaguggga

SEQ ID NO: 1079154 - RNA, 22 nt, Human
ggcuucuuccugugaacauguu

SEQ ID NO: 1079155 - RNA, 22 nt, Human
guuucacaugaaacuuggggaa

SEQ ID NO: 1079156 - RNA, 22 nt, Human
uugcucaggcuggugugcagug

SEQ ID NO: 1079157 - RNA, 22 nt, Human
ugcagcagacugaguaugagaa

SEQ ID NO: 1079158 - RNA, 22 nt, Human
aacugcuuuuugaucucaggag

SEQ ID NO: 1079159 - RNA, 22 nt, Human
ugggaguggggcauagaaggua

SEQ ID NO: 1079160 - RNA, 22 nt, Human
augaaauuugaccaauuauuua

SEQ ID NO: 1079161 - RNA, 19 nt, Human
ucaucucacagggccuggc

SEQ ID NO: 1079162 - RNA, 22 nt, Human
aagagcuguaugccauaugauu

SEQ ID NO: 1079163 - RNA, 22 nt, Human
uaacagcaaccacagugcuggu

SEQ ID NO: 1079164 - RNA, 22 nt, Human
uggagaugaauauguguaccug

SEQ ID NO: 1079165 - RNA, 22 nt, Human
acaugaacauuauaucagcaag

SEQ ID NO: 1079166 - RNA, 20 nt, Human
aagcuggguaggagaggagc

SEQ ID NO: 1079167 - RNA, 22 nt, Human
acuuccuggcguagcugacauu

SEQ ID NO: 1079168 - RNA, 22 nt, Human
ccaggcaggcgauggugcagug

SEQ ID NO: 1079169 - RNA, 22 nt, Human
ccuggcagacagcacugaagcu

SEQ ID NO: 1079170 - RNA, 22 nt, Human
auucuuuccagacacugauugc

SEQ ID NO: 1079171 - RNA, 22 nt, Human
uaugucaugucuuagagaauga

SEQ ID NO: 1079172 - RNA, 22 nt, Human
gcacacauucggauucuuaacc

SEQ ID NO: 1079173 - RNA, 22 nt, Human
cauucacaaagcugauugaugg

SEQ ID NO: 1079174 - RNA, 22 nt, Human
agauuuguaugucuaaauguaa

SEQ ID NO: 1079175 - RNA, 22 nt, Human
uuaacaaagcucuguuccuuuu

SEQ ID NO: 1079176 - RNA, 20 nt, Human
gggguuggcuggcacaggga

SEQ ID NO: 1079177 - RNA, 22 nt, Human
uccagucaagcuugagaauuuc

SEQ ID NO: 1079178 - RNA, 22 nt, Human
ccccaccugugcgucugccgca

SEQ ID NO: 1079179 - RNA, 22 nt, Human
cuacuugguaccugaagaucgg

SEQ ID NO: 1079180 - RNA, 22 nt, Human
ucuccaggagcaagucacccag

SEQ ID NO: 1079181 - RNA, 19 nt, Human
ucccaggcaaaggcuucuc

SEQ ID NO: 1079182 - RNA, 22 nt, Human
agcuucuccaucugcccagaga

SEQ ID NO: 1079183 - RNA, 20 nt, Human
agcuaggagaaagcauggag

SEQ ID NO: 1079184 - RNA, 22 nt, Human
ggagcugugcagugacuacaga

SEQ ID NO: 1079185 - RNA, 22 nt, Human
ugagaacugaggauuugaauuc

SEQ ID NO: 1079186 - RNA, 22 nt, Human
aagagcuguugucugcuuacug

SEQ ID NO: 1079187 - RNA, 22 nt, Human
gaggcccaguccugcaagcacg

SEQ ID NO: 1079188 - RNA, 21 nt, Human
aaaaggaggcaggugaacagc

SEQ ID NO: 1079189 - RNA, 22 nt, Human
cagaguguauucugcaguugca

SEQ ID NO: 1079190 - RNA, 22 nt, Human
cccaggccccagggcuugucag

SEQ ID NO: 1079191 - RNA, 22 nt, Human
cccagcaggucggugcugccug

SEQ ID NO: 1079192 - RNA, 22 nt, Human
gacucugcuacaggccgagguu

SEQ ID NO: 1079193 - RNA, 22 nt, Human
aaaacucugcaguuaguuucua

SEQ ID NO: 1079194 - RNA, 22 nt, Human
aggaacaauugauaaacucaca

SEQ ID NO: 1079195 - RNA, 22 nt, Human
cccacacucugagaaaugcuga

SEQ ID NO: 1079196 - RNA, 22 nt, Human
aagauaaacucuugauuucuga

SEQ ID NO: 1079197 - RNA, 22 nt, Human
acaaucacacaugcaauuauac

SEQ ID NO: 1079198 - RNA, 22 nt, Human
ugcugccaccugguggcugaag

SEQ ID NO: 1079199 - RNA, 23 nt, Human
agcaauaagaagggauacaugug

SEQ ID NO: 1079200 - RNA, 22 nt, Human
gcucacugcaaccucugcuucc

SEQ ID NO: 1079201 - RNA, 22 nt, Human
ucccagccugacagugcaucaa

SEQ ID NO: 1079202 - RNA, 22 nt, Human
acacagggcggaaagcaugaga

SEQ ID NO: 1079203 - RNA, 22 nt, Human
agaugggcgcccuggacugagg

SEQ ID NO: 1079204 - RNA, 22 nt, Human
aggcuccuaucgcuuucagcaa

SEQ ID NO: 1079205 - RNA, 21 nt, Human
uuagaagcuaaugcagcuggu

SEQ ID NO: 1079206 - RNA, 22 nt, Human
acagagcugggaucugaaccca

SEQ ID NO: 1079207 - RNA, 22 nt, Human
uaacagaauuugcuaaacuccg

SEQ ID NO: 1079208 - RNA, 22 nt, Human
guggcagguuccguagacagca

SEQ ID NO: 1079209 - RNA, 22 nt, Human
gggugggccacugagcagcgug

SEQ ID NO: 1079210 - RNA, 21 nt, Human
acacaacaggcagucauuuuc

SEQ ID NO: 1079211 - RNA, 22 nt, Human
ucucagagagaugaaacuucca

SEQ ID NO: 1079212 - RNA, 22 nt, Human
cagauggccagaggcagcugca

SEQ ID NO: 1079213 - RNA, 22 nt, Human
uuucaacaccagagaccaugcg

SEQ ID NO: 1079214 - RNA, 22 nt, Human
uccaucagauucccuccugaga

SEQ ID NO: 1079215 - RNA, 22 nt, Human
ccccagcucagugcagggacau

SEQ ID NO: 1079216 - RNA, 21 nt, Human
uucaaagacuugaugcugacc

SEQ ID NO: 1079217 - RNA, 22 nt, Human
auuauuagacuuauaugguagu

SEQ ID NO: 1079218 - RNA, 22 nt, Human
gcagccacacuguuacagaaug

SEQ ID NO: 1079219 - RNA, 22 nt, Human
gaaagcaguauuuaguucuguu

SEQ ID NO: 1079220 - RNA, 22 nt, Human
acaaaaagcuccauuacugucc

SEQ ID NO: 1079221 - RNA, 22 nt, Human
auugcauaugcagcacaucagg

SEQ ID NO: 1079222 - RNA, 22 nt, Human
agguggguccuggcucugccau

SEQ ID NO: 1079223 - RNA, 22 nt, Human
caauguaucaagaagcaucagu

SEQ ID NO: 1079224 - RNA, 22 nt, Human
aaaaguuaacuguguucaugca

SEQ ID NO: 1079225 - RNA, 22 nt, Human
aaccaggaagggcgcaaauuau

SEQ ID NO: 1079226 - RNA, 22 nt, Human
gguggcuggaggagcugaugga

SEQ ID NO: 1079227 - RNA, 22 nt, Human
ccucuggucccagcucugcugc

SEQ ID NO: 1079228 - RNA, 22 nt, Human
agcugccagaugacagugcuau

SEQ ID NO: 1079229 - RNA, 22 nt, Human
aguuauucauuuauucuguaca

SEQ ID NO: 1079230 - RNA, 22 nt, Human
gcuugcuggugccugcaggcuc

SEQ ID NO: 1079231 - RNA, 22 nt, Human
uaccucaugcuguacagcacgu

SEQ ID NO: 1079232 - RNA, 22 nt, Human
aaaugugugcacaaagacagcu

SEQ ID NO: 1079233 - RNA, 22 nt, Human
aagcugccuuccaugugaggaa

SEQ ID NO: 1079234 - RNA, 22 nt, Human
guugugcagucagacugccugg

SEQ ID NO: 1079235 - RNA, 22 nt, Human
cagugccucuuaagugucaccc

SEQ ID NO: 1079236 - RNA, 21 nt, Human
uucucagaucgaguagugaga

SEQ ID NO: 1079237 - RNA, 22 nt, Human
cacauggggcgcugcauuggcc

SEQ ID NO: 1079238 - RNA, 21 nt, Human
uuccucuugcuuccgccuugc

SEQ ID NO: 1079239 - RNA, 22 nt, Human
uuggcucaggaccccugugacu

SEQ ID NO: 1079240 - RNA, 22 nt, Human
uuuaucagaaguuagagaaaga

SEQ ID NO: 1079241 - RNA, 22 nt, Human
ugggcagauguggcucuccuug

SEQ ID NO: 1079242 - RNA, 22 nt, Human
uggugguuaugcgcuuuguggg

SEQ ID NO: 1079243 - RNA, 22 nt, Human
gggcugagaaguugaucccaag

SEQ ID NO: 1079244 - RNA, 22 nt, Human
agagaaaacucauugagguguc

SEQ ID NO: 1079245 - RNA, 22 nt, Human
cuggagugauacucagaaugug

SEQ ID NO: 1079246 - RNA, 20 nt, Human
augucugaaguaauccauuu

SEQ ID NO: 1079247 - RNA, 22 nt, Human
ugcugcaguguuugcugaaguu

SEQ ID NO: 1079248 - RNA, 23 nt, Human
gggcucagauuucauucugugcc

SEQ ID NO: 1079249 - RNA, 22 nt, Human
auuucuuaugaauauugacugu

SEQ ID NO: 1079250 - RNA, 22 nt, Human
gaaaucaauuucuugguugaua

SEQ ID NO: 1079251 - RNA, 22 nt, Human
aguuuccagcacagggcaagcu

SEQ ID NO: 1079252 - RNA, 22 nt, Human
uuguaugcugaucaaaagcuuc

SEQ ID NO: 1079253 - RNA, 22 nt, Human
gagcacagaaucuucccaugca

SEQ ID NO: 1079254 - RNA, 22 nt, Human
gcagcucugacaaugccuggaa

SEQ ID NO: 1079255 - RNA, 17 nt, Human
caggaaaauaugaguga

SEQ ID NO: 1079256 - RNA, 22 nt, Human
cacuaaaacuacauuggaaaca

SEQ ID NO: 1079257 - RNA, 19 nt, Human
ccacacagugugcaauuua

SEQ ID NO: 1079258 - RNA, 22 nt, Human
gaacacuuggcuuuggauuuaa

SEQ ID NO: 1079259 - RNA, 22 nt, Human
ggcagugaaucugagagccugg

SEQ ID NO: 1079260 - RNA, 22 nt, Human
ccuggcucgcugaccucagggg

SEQ ID NO: 1079261 - RNA, 22 nt, Human
ucccagggccgcaaacgaguuu

SEQ ID NO: 1079262 - RNA, 22 nt, Human
uggaggcaguaacugagcaaca

SEQ ID NO: 1079263 - RNA, 22 nt, Human
aaggcugcuuuuaacaugcaua

SEQ ID NO: 1079264 - RNA, 22 nt, Human
guucuuuugguagagugugcau

SEQ ID NO: 1079265 - RNA, 22 nt, Human
ugaagccauaggacagaggaua

SEQ ID NO: 1079266 - RNA, 17 nt, Human
ucaggcugggugcagug

SEQ ID NO: 1079267 - RNA, 22 nt, Human
cagcuuagauggauacaaaggu

SEQ ID NO: 1079268 - RNA, 22 nt, Human
cuagggaaauaaacugaguggu

SEQ ID NO: 1079269 - RNA, 22 nt, Human
gcucagggcuaaggcugagggg

SEQ ID NO: 1079270 - RNA, 22 nt, Human
aagcaauaggguaaucuacuca

SEQ ID NO: 1079271 - RNA, 22 nt, Human
ucaaggcuaaacuuucagagua

SEQ ID NO: 1079272 - RNA, 22 nt, Human
caugaaauaugcuaccugucuu

SEQ ID NO: 1079273 - RNA, 22 nt, Human
gggaccaggugggugcauuccg

SEQ ID NO: 1079274 - RNA, 22 nt, Human
ucucuggguuuuuguccuguac

SEQ ID NO: 1079275 - RNA, 22 nt, Human
acagcugaucauuuugaagaau

SEQ ID NO: 1079276 - RNA, 22 nt, Human
aagaggcauaaaauuuauaugg

SEQ ID NO: 1079277 - RNA, 22 nt, Human
agccacagggggugagggacaa

SEQ ID NO: 1079278 - RNA, 22 nt, Human
gaggccugcuuuggcacucugg

SEQ ID NO: 1079279 - RNA, 22 nt, Human
cagcagcuucuguugaucagaa

SEQ ID NO: 1079280 - RNA, 22 nt, Human
aggcugugaguuuugucucaga

SEQ ID NO: 1079281 - RNA, 22 nt, Human
aauguuugccugacuagagugg

SEQ ID NO: 1079282 - RNA, 22 nt, Human
uugaucauuuuucugguaaaau

SEQ ID NO: 1079283 - RNA, 22 nt, Human
ggucauugaaaucagaaggguu

SEQ ID NO: 1079284 - RNA, 23 nt, Human
ucuuuagaagaacaucagaaaug

SEQ ID NO: 1079285 - RNA, 22 nt, Human
ucuggggaauguucauuucuga

SEQ ID NO: 1079286 - RNA, 22 nt, Human
aaacaagucacuuuaucuugaa

SEQ ID NO: 1079287 - RNA, 22 nt, Human
ggcagcugcaaaucugcucugu

SEQ ID NO: 1079288 - RNA, 22 nt, Human
ugcacacacggagauaggcuuu

SEQ ID NO: 1079289 - RNA, 22 nt, Human
gaauguuuuucaaaccuguggc

SEQ ID NO: 1079290 - RNA, 22 nt, Human
uugaaaguccuucuugaguuac

SEQ ID NO: 1079291 - RNA, 22 nt, Human
uucaaaguccugucagguagcc

SEQ ID NO: 1079292 - RNA, 22 nt, Human
cugagccagcgggcucacuuuu

SEQ ID NO: 1079293 - RNA, 22 nt, Human
agcacuuuccuggcaaaugugg

SEQ ID NO: 1079294 - RNA, 22 nt, Human
uaaauucagugaguaauuucug

SEQ ID NO: 1079295 - RNA, 22 nt, Human
auacuguacgucccagauagga

SEQ ID NO: 1079296 - RNA, 22 nt, Human
aggcuaggcaugugcuaccaca

SEQ ID NO: 1079297 - RNA, 22 nt, Human
cagggcuguuagcugcugcucu

SEQ ID NO: 1079298 - RNA, 20 nt, Human
gcagagccucacugcaaggg

SEQ ID NO: 1079299 - RNA, 22 nt, Human
gagagcugucagcguagcaccg

SEQ ID NO: 1079300 - RNA, 22 nt, Human
auugcuuuagaaagaaaaauau

SEQ ID NO: 1079301 - RNA, 22 nt, Human
uugcaagggcaugugugcgugu

SEQ ID NO: 1079302 - RNA, 22 nt, Human
uaggcugggccugccuuccagg

SEQ ID NO: 1079303 - RNA, 22 nt, Human
acaaggcuuauaguugcuuuuu

SEQ ID NO: 1079304 - RNA, 22 nt, Human
gcacagaggaagcacagacucu

SEQ ID NO: 1079305 - RNA, 19 nt, Human
ucuaaacacagggacaagc

SEQ ID NO: 1079306 - RNA, 22 nt, Human
augagaauaugauuuacuauug

SEQ ID NO: 1079307 - RNA, 22 nt, Human
uaguucuucaugaauucagcuu

SEQ ID NO: 1079308 - RNA, 22 nt, Human
ucugaaauccuuuaucuuggcu

SEQ ID NO: 1079309 - RNA, 22 nt, Human
auggggcuguucucugcccugc

SEQ ID NO: 1079310 - RNA, 22 nt, Human
ggagccugcgggagcucccauu

SEQ ID NO: 1079311 - RNA, 22 nt, Human
agaaaguucacugguauauuuu

SEQ ID NO: 1079312 - RNA, 22 nt, Human
uggccaggggaguuccccucca

SEQ ID NO: 1079313 - RNA, 22 nt, Human
aaaucaguucucccuuucuuca

SEQ ID NO: 1079314 - RNA, 22 nt, Human
ccagacagcaguuaaaggacau

SEQ ID NO: 1079315 - RNA, 22 nt, Human
uacauugagcacguacuaugug

SEQ ID NO: 1079316 - RNA, 22 nt, Human
agcucugacugaagagaugcaa

SEQ ID NO: 1079317 - RNA, 22 nt, Human
ggaccaggccagccucccugcg

SEQ ID NO: 1079318 - RNA, 22 nt, Human
ggcucaggccuguaauccuagc

SEQ ID NO: 1079319 - RNA, 22 nt, Human
ugaucuccugaccuuguaaucc

SEQ ID NO: 1079320 - RNA, 21 nt, Human
ugcauucuuguguaagguagu

SEQ ID NO: 1079321 - RNA, 22 nt, Human
ggcccugcugaguggaguggag

SEQ ID NO: 1079322 - RNA, 22 nt, Human
caauuucuggaacuaauucuga

SEQ ID NO: 1079323 - RNA, 22 nt, Human
ucacaguacuccccaaaguuuc

SEQ ID NO: 1079324 - RNA, 21 nt, Human
ucacaucuauguuaagcaaac

SEQ ID NO: 1079325 - RNA, 22 nt, Human
agggggucguccggaagaccug

SEQ ID NO: 1079326 - RNA, 22 nt, Human
aucaaaguaguagguuuuggac

SEQ ID NO: 1079327 - RNA, 22 nt, Human
acuccuggguugcaguccucaa

SEQ ID NO: 1079328 - RNA, 22 nt, Human
gcugauguuuaguugauguuac

SEQ ID NO: 1079329 - RNA, 22 nt, Human
aacacuuuguugccuaugaacg

SEQ ID NO: 1079330 - RNA, 22 nt, Human
ccucaugguacuuacuguagcu

SEQ ID NO: 1079331 - RNA, 22 nt, Human
acagaacuuggaacuuuucaca

SEQ ID NO: 1079332 - RNA, 22 nt, Human
cggagcugccugccaagccugc

SEQ ID NO: 1079333 - RNA, 22 nt, Human
uuuuugaaggcugaugugauua

SEQ ID NO: 1079334 - RNA, 22 nt, Human
gcuucugaguucuugcuuaaua

SEQ ID NO: 1079335 - RNA, 22 nt, Human
ugacaguuuaguguaauaguua

SEQ ID NO: 1079336 - RNA, 22 nt, Human
acaauacucaugcucuuuuucu

SEQ ID NO: 1079337 - RNA, 22 nt, Human
uacacauuacauaauacuaucu

SEQ ID NO: 1079338 - RNA, 22 nt, Human
uguagaagcuagccuggagcca

SEQ ID NO: 1079339 - RNA, 22 nt, Human
aaggcauugagcaguuacagua

SEQ ID NO: 1079340 - RNA, 22 nt, Human
ccagcugcugugaggaccacag

SEQ ID NO: 1079341 - RNA, 22 nt, Human
ugaaaucuacccuauucagggu

SEQ ID NO: 1079342 - RNA, 22 nt, Human
gucagcaccucuuuggggagcu

SEQ ID NO: 1079343 - RNA, 22 nt, Human
gcuggcagggugguugagagag

SEQ ID NO: 1079344 - RNA, 19 nt, Human
agcuccugggcucugggcc

SEQ ID NO: 1079345 - RNA, 22 nt, Human
auauacuguaggccacuauaag

SEQ ID NO: 1079346 - RNA, 22 nt, Human
cccaggaaacccgaaggcgacc

SEQ ID NO: 1079347 - RNA, 22 nt, Human
uuacagauggcaguuucuugag

SEQ ID NO: 1079348 - RNA, 22 nt, Human
guauugcauuguuucaagcugu

SEQ ID NO: 1079349 - RNA, 22 nt, Human
cugccucucaggucccugagau

SEQ ID NO: 1079350 - RNA, 21 nt, Human
gcugucucuggcuccugggaa

SEQ ID NO: 1079351 - RNA, 22 nt, Human
ggcuggcuggcuuagcagagga

SEQ ID NO: 1079352 - RNA, 22 nt, Human
ugggaaggauaccuuggaacau

SEQ ID NO: 1079353 - RNA, 22 nt, Human
ucuguaaagacuccaaaagcca

SEQ ID NO: 1079354 - RNA, 22 nt, Human
uagcugccauugcuccaggaag

SEQ ID NO: 1079355 - RNA, 22 nt, Human
uugaaacuuuaguaaacuaagg

SEQ ID NO: 1079356 - RNA, 22 nt, Human
ggaagaggcugaggccaugcug

SEQ ID NO: 1079357 - RNA, 22 nt, Human
aaacaaauagugcaugggaauu

SEQ ID NO: 1079358 - RNA, 22 nt, Human
uccugucugucuuuggucccuu

SEQ ID NO: 1079359 - RNA, 22 nt, Human
gcugccuggcugaugaaaauuc

SEQ ID NO: 1079360 - RNA, 22 nt, Human
aaacacugguaugauguauagu

SEQ ID NO: 1079361 - RNA, 22 nt, Human
ucaccaggauuccuaucaguag

SEQ ID NO: 1079362 - RNA, 22 nt, Human
aggugagugugacugcaagaga

SEQ ID NO: 1079363 - RNA, 22 nt, Human
ggcugccucaaagcucaagcuc

SEQ ID NO: 1079364 - RNA, 22 nt, Human
ggcugugaacccuggcagugug

SEQ ID NO: 1079365 - RNA, 22 nt, Human
uuacaagcagcuacauaucaca

SEQ ID NO: 1079366 - RNA, 22 nt, Human
uggggacacagagccaaacuau

SEQ ID NO: 1079367 - RNA, 22 nt, Human
uccauggggcccaggaugagag

SEQ ID NO: 1079368 - RNA, 22 nt, Human
ugagcaggauucgccucuugca

SEQ ID NO: 1079369 - RNA, 22 nt, Human
uugccugugaggauucugguug

SEQ ID NO: 1079370 - RNA, 22 nt, Human
ugugcaugacagcauacaaacg

SEQ ID NO: 1079371 - RNA, 22 nt, Human
gagcugggauucaucuaugucu

SEQ ID NO: 1079372 - RNA, 22 nt, Human
agugaacaaguuaagaacacua

SEQ ID NO: 1079373 - RNA, 22 nt, Human
ugagugugcuaggugucucggu

SEQ ID NO: 1079374 - RNA, 22 nt, Human
uuucuaaacuggauucagccug

SEQ ID NO: 1079375 - RNA, 22 nt, Human
aguaaucaaauuaagcuaauug

SEQ ID NO: 1079376 - RNA, 22 nt, Human
ucugggcuuuacacugugcuua

SEQ ID NO: 1079377 - RNA, 21 nt, Human
uguggcagauguugggaggca

SEQ ID NO: 1079378 - RNA, 22 nt, Human
auucuggauauuacuuaucuau

SEQ ID NO: 1079379 - RNA, 20 nt, Human
aagagcugacucacaguggu

SEQ ID NO: 1079380 - RNA, 22 nt, Human
augucuuuauaaauguauaaug

SEQ ID NO: 1079381 - RNA, 22 nt, Human
ccugucuguauugguuugcuau

SEQ ID NO: 1079382 - RNA, 23 nt, Human
cagcagagagcagaccuuugugu

SEQ ID NO: 1079383 - RNA, 22 nt, Human
ucccucagaugagcuccuagca

SEQ ID NO: 1079384 - RNA, 22 nt, Human
ccagacaguuccuugagguuca

SEQ ID NO: 1079385 - RNA, 22 nt, Human
cucuggcuuugcucaugcaucc

SEQ ID NO: 1079386 - RNA, 22 nt, Human
aaggcagcaagaauuccagguu

SEQ ID NO: 1079387 - RNA, 19 nt, Human
ccagcagacacagcugccc

SEQ ID NO: 1079388 - RNA, 22 nt, Human
uagaggcauaagagggaagcag

SEQ ID NO: 1079389 - RNA, 22 nt, Human
agagcuuagaauuucagaugau

SEQ ID NO: 1079390 - RNA, 22 nt, Human
ucaaaguuggaaaagcuggccc

SEQ ID NO: 1079391 - RNA, 22 nt, Human
ucccaaagguccgagcgggaau

SEQ ID NO: 1079392 - RNA, 22 nt, Human
cacacaauuaugugugcacaau

SEQ ID NO: 1079393 - RNA, 22 nt, Human
gggggacuggaccguccugggu

SEQ ID NO: 1079394 - RNA, 21 nt, Human
ucuuugauuaagcuugacuag

SEQ ID NO: 1079395 - RNA, 22 nt, Human
uuggcuucuggcagucuggacg

SEQ ID NO: 1079396 - RNA, 22 nt, Human
uugauacccaaguguuaugggu

SEQ ID NO: 1079397 - RNA, 22 nt, Human
acaaguggguccuacauaaagc

SEQ ID NO: 1079398 - RNA, 22 nt, Human
ugggccacggggguggagagcu

SEQ ID NO: 1079399 - RNA, 22 nt, Human
ggcugggccgcggcuacccaga

SEQ ID NO: 1079400 - RNA, 22 nt, Human
gguagcagggcugugagucaga

SEQ ID NO: 1079401 - RNA, 22 nt, Human
agcaggaaggggccuagccugg

SEQ ID NO: 1079402 - RNA, 23 nt, Human
gccauggcugccccacaggccuc

SEQ ID NO: 1079403 - RNA, 22 nt, Human
uugucugaaagaucauuacauu

SEQ ID NO: 1079404 - RNA, 22 nt, Human
uggcccugcugggucagagcug

SEQ ID NO: 1079405 - RNA, 19 nt, Human
auguaugaggucuucugcu

SEQ ID NO: 1079406 - RNA, 22 nt, Human
ucucagagcuucaguuauuuuc

SEQ ID NO: 1079407 - RNA, 22 nt, Human
auucuacaacccaauaauaauu

SEQ ID NO: 1079408 - RNA, 22 nt, Human
caugaaauguuagaauuagaca

SEQ ID NO: 1079409 - RNA, 22 nt, Human
guuucgucaggcuuauucuauc

SEQ ID NO: 1079410 - RNA, 22 nt, Human
ugaaguaggcagcaugcugaga

SEQ ID NO: 1079411 - RNA, 22 nt, Human
ugcucuguauucuauggcaguu

SEQ ID NO: 1079412 - RNA, 18 nt, Human
auuuuucccagauggaua

SEQ ID NO: 1079413 - RNA, 22 nt, Human
uggcugcugagaaggcagcugu

SEQ ID NO: 1079414 - RNA, 22 nt, Human
uggcugcugcuuggucuucuuc

SEQ ID NO: 1079415 - RNA, 23 nt, Human
gggggcugguugacucucugcag

SEQ ID NO: 1079416 - RNA, 22 nt, Human
uuagaacaauauucucccuaca

SEQ ID NO: 1079417 - RNA, 22 nt, Human
uucacaggauauaugugcaggg

SEQ ID NO: 1079418 - RNA, 22 nt, Human
aaggaagaggcagguuuugcug

SEQ ID NO: 1079419 - RNA, 22 nt, Human
ucaacaauuuugagaugagaca

SEQ ID NO: 1079420 - RNA, 20 nt, Human
acaauagauuugagcaaagu

SEQ ID NO: 1079421 - RNA, 22 nt, Human
aacaguguguuuuguuauuaag

SEQ ID NO: 1079422 - RNA, 22 nt, Human
cugggccuuuaccuacggaguu

SEQ ID NO: 1079423 - RNA, 22 nt, Human
cauuuguaucauauguaucuua

SEQ ID NO: 1079424 - RNA, 22 nt, Human
cacaugaauucacauguauuuu

SEQ ID NO: 1079425 - RNA, 22 nt, Human
ugaaauguggagaugguaagua

SEQ ID NO: 1079426 - RNA, 22 nt, Human
gcagcucuuuucuuaaagagau

SEQ ID NO: 1079427 - RNA, 22 nt, Human
uacuuuaaaaacugauaauuca

SEQ ID NO: 1079428 - RNA, 22 nt, Human
aucauaaagugcuaucugauug

SEQ ID NO: 1079429 - RNA, 22 nt, Human
ucuuugaauccuuuacaucuga

SEQ ID NO: 1079430 - RNA, 22 nt, Human
cccagguggcagaagcugcagu

SEQ ID NO: 1079431 - RNA, 22 nt, Human
cacacagaugguaagggaggga

SEQ ID NO: 1079432 - RNA, 22 nt, Human
cacacaugagucuccccauugg

SEQ ID NO: 1079433 - RNA, 22 nt, Human
gcugugcaucuucauucuggac

SEQ ID NO: 1079434 - RNA, 22 nt, Human
gccugcagccccucugcaguag

SEQ ID NO: 1079435 - RNA, 22 nt, Human
acacagcaaggucugacuuugg

SEQ ID NO: 1079436 - RNA, 22 nt, Human
ucuuuauugcuacugguuuguc

SEQ ID NO: 1079437 - RNA, 22 nt, Human
guguggcugccagccaagaggc

SEQ ID NO: 1079438 - RNA, 22 nt, Human
caugucuuauauccugucuuca

SEQ ID NO: 1079439 - RNA, 22 nt, Human
ggaggagacggagugauuagug

SEQ ID NO: 1079440 - RNA, 22 nt, Human
ucaggcagagcuguggagcucu

SEQ ID NO: 1079441 - RNA, 22 nt, Human
aagauuuucagugccuaaaaca

SEQ ID NO: 1079442 - RNA, 22 nt, Human
uggggcuggggaucuugagccu

SEQ ID NO: 1079443 - RNA, 22 nt, Human
ugcagguggacacgggagacgg

SEQ ID NO: 1079444 - RNA, 22 nt, Human
ggcagagcugcaugagcacuca

SEQ ID NO: 1079445 - RNA, 22 nt, Human
acuccugguucccaguugagau

SEQ ID NO: 1079446 - RNA, 22 nt, Human
uugaaaaguuuugaaacacucu

SEQ ID NO: 1079447 - RNA, 22 nt, Human
ucagaaaccccaacaauggaga

SEQ ID NO: 1079448 - RNA, 22 nt, Human
ucagaaaauaacuguuaguuug

SEQ ID NO: 1079449 - RNA, 22 nt, Human
uucuccagacccuccugcagac

SEQ ID NO: 1079450 - RNA, 22 nt, Human
gcccagcaccucucucaggguu

SEQ ID NO: 1079451 - RNA, 22 nt, Human
gcagagucagccuccgagacag

SEQ ID NO: 1079452 - RNA, 22 nt, Human
cuggggucucaauucuagcggg

SEQ ID NO: 1079453 - RNA, 22 nt, Human
uggcuuccaaaggaaugggccu

SEQ ID NO: 1079454 - RNA, 22 nt, Human
ucccuggggauguuggccugcc

SEQ ID NO: 1079455 - RNA, 22 nt, Human
agcuggcuuuugugaagguuuu

SEQ ID NO: 1079456 - RNA, 22 nt, Human
aaacacauuuuaggaaaaucua

SEQ ID NO: 1079457 - RNA, 22 nt, Human
acaaaguaggaagauuagcuga

SEQ ID NO: 1079458 - RNA, 22 nt, Human
acuugcaugucaggaaauuaac

SEQ ID NO: 1079459 - RNA, 22 nt, Human
cagcacaggccugucuuugucu

SEQ ID NO: 1079460 - RNA, 22 nt, Human
aaucgguugaacccaggaagug

SEQ ID NO: 1079461 - RNA, 22 nt, Human
uaucaguagaacaauggacauu

SEQ ID NO: 1079462 - RNA, 22 nt, Human
uucaacaucuuggagcuggaac

SEQ ID NO: 1079463 - RNA, 22 nt, Human
agcaugcuauauugauuguagu

SEQ ID NO: 1079464 - RNA, 22 nt, Human
aagacaugcaauuagcaaggaa

SEQ ID NO: 1079465 - RNA, 22 nt, Human
acuuucauuuguaauaaacuuc

SEQ ID NO: 1079466 - RNA, 22 nt, Human
ugucucagaguaucccugaacu

SEQ ID NO: 1079467 - RNA, 22 nt, Human
uucuucaauuuuccauauacug

SEQ ID NO: 1079468 - RNA, 19 nt, Human
uggaggagaggaaaaguca

SEQ ID NO: 1079469 - RNA, 22 nt, Human
gucucagggacugcuucugggg

SEQ ID NO: 1079470 - RNA, 22 nt, Human
uuuacagaaugucaauuucuau

SEQ ID NO: 1079471 - RNA, 22 nt, Human
auacuucuagaaauacuaugca

SEQ ID NO: 1079472 - RNA, 22 nt, Human
agcacacaguauuagccauugu

SEQ ID NO: 1079473 - RNA, 22 nt, Human
ucuucaaauccuacagugucug

SEQ ID NO: 1079474 - RNA, 20 nt, Human
ugcugggcaugcaguggaaa

SEQ ID NO: 1079475 - RNA, 22 nt, Human
gaggcagcuuggggcugugggu

SEQ ID NO: 1079476 - RNA, 22 nt, Human
ggaggccaggaaggcucggaga

SEQ ID NO: 1079477 - RNA, 22 nt, Human
gaggcagaggaagguggucucu

SEQ ID NO: 1079478 - RNA, 22 nt, Human
uccugagaauagaguugcaugu

SEQ ID NO: 1079479 - RNA, 22 nt, Human
ggguccaggucuucaggcagag

SEQ ID NO: 1079480 - RNA, 22 nt, Human
uuauuuuaccuuccucugagcu

SEQ ID NO: 1079481 - RNA, 22 nt, Human
ugcaaacaggagaguaaguaua

SEQ ID NO: 1079482 - RNA, 22 nt, Human
uuggaccaucagcuccuccugg

SEQ ID NO: 1079483 - RNA, 22 nt, Human
gcuguggaguacagagcugguu

SEQ ID NO: 1079484 - RNA, 22 nt, Human
cuuggcugucuauaggaaagag

SEQ ID NO: 1079485 - RNA, 19 nt, Human
ucacaggcaucuccccaga

SEQ ID NO: 1079486 - RNA, 22 nt, Human
agcugccugcuuaugagcucca

SEQ ID NO: 1079487 - RNA, 22 nt, Human
cagcagaacaggcagggaagcu

SEQ ID NO: 1079488 - RNA, 22 nt, Human
uuccacauagaucacagguguu

SEQ ID NO: 1079489 - RNA, 22 nt, Human
uugccucccagcaugggcagcu

SEQ ID NO: 1079490 - RNA, 22 nt, Human
uuaaggcauucuccuacuaaua

SEQ ID NO: 1079491 - RNA, 22 nt, Human
ucuugaaagcauuuucuucauc

SEQ ID NO: 1079492 - RNA, 22 nt, Human
ugaaugagaacacugaaagagg

SEQ ID NO: 1079493 - RNA, 22 nt, Human
uaugagaaucugcaguaugcuu

SEQ ID NO: 1079494 - RNA, 23 nt, Human
cuucacagguucaggggauuaag

SEQ ID NO: 1079495 - RNA, 22 nt, Human
uuccgcuggggccgccuggcgg

SEQ ID NO: 1079496 - RNA, 22 nt, Human
guuaaugugauauaaaguauuu

SEQ ID NO: 1079497 - RNA, 22 nt, Human
ccaaaauuaagccucuuauguu

SEQ ID NO: 1079498 - RNA, 22 nt, Human
acuguggcucaucaggcuggug

SEQ ID NO: 1079499 - RNA, 22 nt, Human
agagauucauguuuacuguagg

SEQ ID NO: 1079500 - RNA, 19 nt, Human
ucccgcccacugagcgugc

SEQ ID NO: 1079501 - RNA, 22 nt, Human
aaggcucuggguuucauaggug

SEQ ID NO: 1079502 - RNA, 20 nt, Human
cugagagucugugcuuaguc

SEQ ID NO: 1079503 - RNA, 22 nt, Human
uccugagauucugcauuucuaa

SEQ ID NO: 1079504 - RNA, 22 nt, Human
gccugagagucugcauuucuaa

SEQ ID NO: 1079505 - RNA, 22 nt, Human
uugagaguuaccagcagaggaa

SEQ ID NO: 1079506 - RNA, 22 nt, Human
aacacaugccuuaagaauaagu

SEQ ID NO: 1079507 - RNA, 18 nt, Human
aggaagaccaucagauau

SEQ ID NO: 1079508 - RNA, 22 nt, Human
uagucucugcuuugcccuuggc

SEQ ID NO: 1079509 - RNA, 22 nt, Human
agagucagaaagcagacagggg

SEQ ID NO: 1079510 - RNA, 22 nt, Human
gacucuuucccugugacagagu

SEQ ID NO: 1079511 - RNA, 22 nt, Human
gcuggcuguuggagguaccugc

SEQ ID NO: 1079512 - RNA, 22 nt, Human
ccccucagguacccgugcagca

SEQ ID NO: 1079513 - RNA, 22 nt, Human
caaggccacugcucagguuucc

SEQ ID NO: 1079514 - RNA, 22 nt, Human
gaggaaggauuuaguuugaggg

SEQ ID NO: 1079515 - RNA, 22 nt, Human
ugaauaguucuacuacuugaca

SEQ ID NO: 1079516 - RNA, 22 nt, Human
augaggcagucuggccugaggg

SEQ ID NO: 1079517 - RNA, 22 nt, Human
gaaaaguauguuuauuuugacu

SEQ ID NO: 1079518 - RNA, 17 nt, Human
agaggcagauacuugga

SEQ ID NO: 1079519 - RNA, 22 nt, Human
acaauuucuaauauagaucuua

SEQ ID NO: 1079520 - RNA, 22 nt, Human
uauuacuaccaucugcuacuau

SEQ ID NO: 1079521 - RNA, 22 nt, Human
ugucccauggauaccaggcuau

SEQ ID NO: 1079522 - RNA, 21 nt, Human
ucuggcaggaagacggauggg

SEQ ID NO: 1079523 - RNA, 22 nt, Human
ggccugugcaagacagcacccc

SEQ ID NO: 1079524 - RNA, 22 nt, Human
caggccuggggcuggcuuccag

SEQ ID NO: 1079525 - RNA, 22 nt, Human
uuagccaugcccuagaagagga

SEQ ID NO: 1079526 - RNA, 22 nt, Human
ccugagagagugagcccugaca

SEQ ID NO: 1079527 - RNA, 22 nt, Human
ugcuuuuauuuaauaucuugca

SEQ ID NO: 1079528 - RNA, 22 nt, Human
ucuucauacaauuucagacauc

SEQ ID NO: 1079529 - RNA, 22 nt, Human
ugcugaaauuagaacauugagg

SEQ ID NO: 1079530 - RNA, 22 nt, Human
uggggguguccuggugcacaca

SEQ ID NO: 1079531 - RNA, 22 nt, Human
agucugucucugcuaaucacua

SEQ ID NO: 1079532 - RNA, 22 nt, Human
cagagcaguccuugucaaucag

SEQ ID NO: 1079533 - RNA, 22 nt, Human
ugucccagcagcuggguucucu

SEQ ID NO: 1079534 - RNA, 19 nt, Human
aaccaggaacuaaagcaga

SEQ ID NO: 1079535 - RNA, 22 nt, Human
cacugccuggaaggagagacau

SEQ ID NO: 1079536 - RNA, 22 nt, Human
caaaguuuuaguaaacauauau

SEQ ID NO: 1079537 - RNA, 22 nt, Human
uuccuaauggcaaaacauguuu

SEQ ID NO: 1079538 - RNA, 22 nt, Human
aaaccuguuaauagagcgaugc

SEQ ID NO: 1079539 - RNA, 22 nt, Human
augccuguaaucccagugcuuu

SEQ ID NO: 1079540 - RNA, 22 nt, Human
cugcagcuccccugagaucaag

SEQ ID NO: 1079541 - RNA, 22 nt, Human
ccucuucagcaaaguucggccc

SEQ ID NO: 1079542 - RNA, 20 nt, Human
gcaggcuccgggcuugggag

SEQ ID NO: 1079543 - RNA, 22 nt, Human
uccuuggcuuucuggagcuucu

SEQ ID NO: 1079544 - RNA, 22 nt, Human
gcagagugaagggagaggugug

SEQ ID NO: 1079545 - RNA, 22 nt, Human
gagaaugggaaugaaaguagca

SEQ ID NO: 1079546 - RNA, 17 nt, Human
auuucacuuagcaugag

SEQ ID NO: 1079547 - RNA, 22 nt, Human
cuggcagcauuaacagagagca

SEQ ID NO: 1079548 - RNA, 22 nt, Human
gccuccugguugcuucuccaac

SEQ ID NO: 1079549 - RNA, 22 nt, Human
ucagagcuaaggggagagcaaa

SEQ ID NO: 1079550 - RNA, 22 nt, Human
guguuccauguuugagguaguu

SEQ ID NO: 1079551 - RNA, 22 nt, Human
aagggcuggccacauucugggu

SEQ ID NO: 1079552 - RNA, 22 nt, Human
ggacaggaugcugaagaugaag

SEQ ID NO: 1079553 - RNA, 22 nt, Human
ggccugagcagacagcaugaug

SEQ ID NO: 1079554 - RNA, 22 nt, Human
gcugggagccccgagccagcgc

SEQ ID NO: 1079555 - RNA, 22 nt, Human
cuuacagugacccugcagauuu

SEQ ID NO: 1079556 - RNA, 22 nt, Human
gcaguggcaccgcuggcucugg

SEQ ID NO: 1079557 - RNA, 22 nt, Human
aucaacaugucauaaagugaaa

SEQ ID NO: 1079558 - RNA, 22 nt, Human
uggaggaugccauccaggauac

SEQ ID NO: 1079559 - RNA, 22 nt, Human
cacuucaauuaacuucagcauu

SEQ ID NO: 1079560 - RNA, 22 nt, Human
uaucaacauuaauauuuucugg

SEQ ID NO: 1079561 - RNA, 22 nt, Human
uugcaaggagccacucugccug

SEQ ID NO: 1079562 - RNA, 22 nt, Human
auggggugaccaugagcauuua

SEQ ID NO: 1079563 - RNA, 22 nt, Human
gggaguggguuuggccuaggcc

SEQ ID NO: 1079564 - RNA, 22 nt, Human
gcacacagaauugauucacugu

SEQ ID NO: 1079565 - RNA, 22 nt, Human
ucugugucugcagaaguucagc

SEQ ID NO: 1079566 - RNA, 22 nt, Human
cagacuuuugacauuaauacag

SEQ ID NO: 1079567 - RNA, 22 nt, Human
uccugugccuccaccugcuccg

SEQ ID NO: 1079568 - RNA, 22 nt, Human
acagugcuggcuacaacccugg

SEQ ID NO: 1079569 - RNA, 22 nt, Human
augagcugggccauccagugau

SEQ ID NO: 1079570 - RNA, 22 nt, Human
caggccuggagugcaauggcac

SEQ ID NO: 1079571 - RNA, 22 nt, Human
ccacagaccuuggcuuccaccu

SEQ ID NO: 1079572 - RNA, 18 nt, Human
ggagagugacagagucgu

SEQ ID NO: 1079573 - RNA, 22 nt, Human
acagagcacugcccugugccgc

SEQ ID NO: 1079574 - RNA, 22 nt, Human
acaaaguaagggcuaaugagca

SEQ ID NO: 1079575 - RNA, 21 nt, Human
ccugagggugguugugaagau

SEQ ID NO: 1079576 - RNA, 22 nt, Human
aucagcaaucucguguauuagg

SEQ ID NO: 1079577 - RNA, 22 nt, Human
gcccugcugcuggcagaggcgc

SEQ ID NO: 1079578 - RNA, 23 nt, Human
uuucacagcuuuuauucugcauc

SEQ ID NO: 1079579 - RNA, 22 nt, Human
uauuuggaaaguuuaucuaucu

SEQ ID NO: 1079580 - RNA, 22 nt, Human
uucuaaauguaaauaguaugau

SEQ ID NO: 1079581 - RNA, 22 nt, Human
uaaagucaucuuuaaacaugcc

SEQ ID NO: 1079582 - RNA, 22 nt, Human
gcucugcccagugcccugagac

SEQ ID NO: 1079583 - RNA, 22 nt, Human
uuagugauaggacuuuaaagcc

SEQ ID NO: 1079584 - RNA, 22 nt, Human
ucuccuggauggaccuucucuu

SEQ ID NO: 1079585 - RNA, 22 nt, Human
cacagugaagcaugcagacauc

SEQ ID NO: 1079586 - RNA, 22 nt, Human
caaggcugugcaggguccauau

SEQ ID NO: 1079587 - RNA, 22 nt, Human
cacucaggcugugucaggagga

SEQ ID NO: 1079588 - RNA, 22 nt, Human
uguaaacagccccauggagagc

SEQ ID NO: 1079589 - RNA, 19 nt, Human
agagaaggauccuaugguu

SEQ ID NO: 1079590 - RNA, 19 nt, Human
gggcuccuugggccucucu

SEQ ID NO: 1079591 - RNA, 22 nt, Human
ucacaguaaauccagaagaaau

SEQ ID NO: 1079592 - RNA, 23 nt, Human
ucacacagcuggucagguacaga

SEQ ID NO: 1079593 - RNA, 22 nt, Human
cagugaguucaucaagacauga

SEQ ID NO: 1079594 - RNA, 22 nt, Human
uuacuuuugcaccaaacuaaua

SEQ ID NO: 1079595 - RNA, 22 nt, Human
uccaggaaacagcaucucagca

SEQ ID NO: 1079596 - RNA, 19 nt, Human
uuucuaagcuaaaugcuuc

SEQ ID NO: 1079597 - RNA, 22 nt, Human
ccacagagacaggguccuugcu

SEQ ID NO: 1079598 - RNA, 22 nt, Human
aagacaauguuucugauagaua

SEQ ID NO: 1079599 - RNA, 22 nt, Human
guucacaguuaggacaacugcu

SEQ ID NO: 1079600 - RNA, 22 nt, Human
caugggcaguuggcagggcuca

SEQ ID NO: 1079601 - RNA, 22 nt, Human
auguuuucuagaguuuaaaauc

SEQ ID NO: 1079602 - RNA, 22 nt, Human
ccugugcauccgguggucauug

SEQ ID NO: 1079603 - RNA, 22 nt, Human
aagcagaugcguuggagcaguu

SEQ ID NO: 1079604 - RNA, 22 nt, Human
aaagacagauggcaaggaugau

SEQ ID NO: 1079605 - RNA, 22 nt, Human
uuuuugagauggauuuagcucu

SEQ ID NO: 1079606 - RNA, 23 nt, Human
agaugaaagcuucccaucacagu

SEQ ID NO: 1079607 - RNA, 22 nt, Human
aaaguuacacaucuaguaagug

SEQ ID NO: 1079608 - RNA, 22 nt, Human
ucugccuguucccgauuccaug

SEQ ID NO: 1079609 - RNA, 22 nt, Human
guuauuaaaguauuugauguua

SEQ ID NO: 1079610 - RNA, 22 nt, Human
cuucuuggaagucguccuucca

SEQ ID NO: 1079611 - RNA, 23 nt, Human
gcugucugucaucucugcgggag

SEQ ID NO: 1079612 - RNA, 23 nt, Human
uguggcugagaaauugacaacuu

SEQ ID NO: 1079613 - RNA, 23 nt, Human
ucuccuccuagauacagucaugg

SEQ ID NO: 1079614 - RNA, 22 nt, Human
aauaaugaacauuuaaaaccug

SEQ ID NO: 1079615 - RNA, 22 nt, Human
cacaggagggagcgggcagcca

SEQ ID NO: 1079616 - RNA, 22 nt, Human
acacauuaaaacgucuacaaug

SEQ ID NO: 1079617 - RNA, 22 nt, Human
uggggugggcaugcgcuguccu

SEQ ID NO: 1079618 - RNA, 22 nt, Human
cugggccucaaucucagaguuu

SEQ ID NO: 1079619 - RNA, 22 nt, Human
ugugaaauauuuauauacucaa

SEQ ID NO: 1079620 - RNA, 22 nt, Human
cccagccuuugcuuccugguuc

SEQ ID NO: 1079621 - RNA, 22 nt, Human
gcucucuggguggugggcaaca

SEQ ID NO: 1079622 - RNA, 22 nt, Human
ccagagccucuuaugaagaucg

SEQ ID NO: 1079623 - RNA, 22 nt, Human
gcugcucuuuucagagaugaga

SEQ ID NO: 1079624 - RNA, 20 nt, Human
ccugccuguguuugugauga

SEQ ID NO: 1079625 - RNA, 22 nt, Human
aacaucuuuuuguuugcugaaa

SEQ ID NO: 1079626 - RNA, 22 nt, Human
acuagacaucgagcuacagagu

SEQ ID NO: 1079627 - RNA, 22 nt, Human
agcugccacaugcccaagggca

SEQ ID NO: 1079628 - RNA, 22 nt, Human
guauuugauacaugaaauggug

SEQ ID NO: 1079629 - RNA, 22 nt, Human
cugggccuugcaucccagagcc

SEQ ID NO: 1079630 - RNA, 20 nt, Human
cacaggaaagcuacucaguu

SEQ ID NO: 1079631 - RNA, 22 nt, Human
agggcagcacaaggcauggacu

SEQ ID NO: 1079632 - RNA, 22 nt, Human
cugaagcaaaggaucgagcuaa

SEQ ID NO: 1079633 - RNA, 22 nt, Human
caggcagcaucagucugcugua

SEQ ID NO: 1079634 - RNA, 22 nt, Human
gucuuuauauuuacuaaagaau

SEQ ID NO: 1079635 - RNA, 22 nt, Human
uaacaacuggacaauguugcuc

SEQ ID NO: 1079636 - RNA, 21 nt, Human
gcagggacaaagcuucaggag

SEQ ID NO: 1079637 - RNA, 22 nt, Human
auggauaauggugauaguugca

SEQ ID NO: 1079638 - RNA, 22 nt, Human
accacugcccauggugaaaacu

SEQ ID NO: 1079639 - RNA, 22 nt, Human
accugagaaugggggcaugugu

SEQ ID NO: 1079640 - RNA, 22 nt, Human
cccuggaggucagaggccuggg

SEQ ID NO: 1079641 - RNA, 22 nt, Human
uuugcauaggauggacauuuua

SEQ ID NO: 1079642 - RNA, 22 nt, Human
augaaauuugcugcuaaguucc

SEQ ID NO: 1079643 - RNA, 18 nt, Human
cccucuugcacaaagcaa

SEQ ID NO: 1079644 - RNA, 23 nt, Human
ucuggcugcuccuuucaaugcuc

SEQ ID NO: 1079645 - RNA, 21 nt, Human
auacagugguaugaauguagg

SEQ ID NO: 1079646 - RNA, 22 nt, Human
gagguggcauuaagauucuggu

SEQ ID NO: 1079647 - RNA, 22 nt, Human
aagcacaguucuuagaguuaca

SEQ ID NO: 1079648 - RNA, 22 nt, Human
uuacacaaaaauaagauauggc

SEQ ID NO: 1079649 - RNA, 22 nt, Human
uuguauuugauugucauaucgu

SEQ ID NO: 1079650 - RNA, 19 nt, Human
ugccuggcaccagcuccac

SEQ ID NO: 1079651 - RNA, 22 nt, Human
cuaucaaacagccauuaauaua

SEQ ID NO: 1079652 - RNA, 22 nt, Human
uaguuuuuaaguguacaauuuc

SEQ ID NO: 1079653 - RNA, 22 nt, Human
uuuucacacaaggugauaaguu

SEQ ID NO: 1079654 - RNA, 22 nt, Human
aagagcugauuaagucaugagg

SEQ ID NO: 1079655 - RNA, 22 nt, Human
ucaaaguuacuugugguuuucu

SEQ ID NO: 1079656 - RNA, 22 nt, Human
aaaauccucuaauucuagaaua

SEQ ID NO: 1079657 - RNA, 19 nt, Human
aaaaagaggcuauaauauu

SEQ ID NO: 1079658 - RNA, 22 nt, Human
agcugcagagguuugugcaaca

SEQ ID NO: 1079659 - RNA, 23 nt, Human
aguguuaaauuucgcaccuaaau

SEQ ID NO: 1079660 - RNA, 22 nt, Human
uacaaaguuugagaaugcuuuc

SEQ ID NO: 1079661 - RNA, 22 nt, Human
ucucagagauuuuguuucccuu

SEQ ID NO: 1079662 - RNA, 22 nt, Human
cuacaucaaguaaucuucaaaa

SEQ ID NO: 1079663 - RNA, 22 nt, Human
aucuggcuuggguguggguagc

SEQ ID NO: 1079664 - RNA, 22 nt, Human
auucauuagccacuaacuagca

SEQ ID NO: 1079665 - RNA, 22 nt, Human
acaguguaauucauggcugaaa

SEQ ID NO: 1079666 - RNA, 22 nt, Human
ugaggccaggaucccaggcucu

SEQ ID NO: 1079667 - RNA, 22 nt, Human
acugcagccuagggaccacagu

SEQ ID NO: 1079668 - RNA, 22 nt, Human
ucucuaaacuuauaugaacuau

SEQ ID NO: 1079669 - RNA, 22 nt, Human
gaaaacuaacggaaaaguuagg

SEQ ID NO: 1079670 - RNA, 22 nt, Human
uggccugucuuguugugcuaga

SEQ ID NO: 1079671 - RNA, 22 nt, Human
uaaaaaguagugagaauggcgc

SEQ ID NO: 1079672 - RNA, 22 nt, Human
ugugcuucuugcagcuccugua

SEQ ID NO: 1079673 - RNA, 22 nt, Human
gggcugcuuuuuucuuagcaga

SEQ ID NO: 1079674 - RNA, 21 nt, Human
auccauccaucuuggccuaac

SEQ ID NO: 1079675 - RNA, 22 nt, Human
guuugaaaguucaacaggaaaa

SEQ ID NO: 1079676 - RNA, 22 nt, Human
aaacaucuacuguaggcuggag

SEQ ID NO: 1079677 - RNA, 22 nt, Human
uaaggcuucagcauucaaaaca

SEQ ID NO: 1079678 - RNA, 22 nt, Human
uuuccucuuccgagggggaggc

SEQ ID NO: 1079679 - RNA, 23 nt, Human
auuuuuugucuuuguaacuagau

SEQ ID NO: 1079680 - RNA, 22 nt, Human
ugaaagacaagguuuuuucaga

SEQ ID NO: 1079681 - RNA, 22 nt, Human
gcagauggagauaaauggaacu

SEQ ID NO: 1079682 - RNA, 22 nt, Human
caucagaaugaauguucuggag

SEQ ID NO: 1079683 - RNA, 22 nt, Human
aagagcagccuccaggggugga

SEQ ID NO: 1079684 - RNA, 22 nt, Human
uucucagagcucacuguaguaa

SEQ ID NO: 1079685 - RNA, 22 nt, Human
guaauuuuuaguucauucuauc

SEQ ID NO: 1079686 - RNA, 22 nt, Human
cagaaauggucuguucagcuua

SEQ ID NO: 1079687 - RNA, 22 nt, Human
uuucuucucuaaucucaaugau

SEQ ID NO: 1079688 - RNA, 22 nt, Human
gcacacauauauaugagcaugu

SEQ ID NO: 1079689 - RNA, 22 nt, Human
gcacugaaugccaaaguguagg

SEQ ID NO: 1079690 - RNA, 22 nt, Human
auugaggcagcauaguucaggg

SEQ ID NO: 1079691 - RNA, 22 nt, Human
gcugggcugcgucggggaagcc

SEQ ID NO: 1079692 - RNA, 22 nt, Human
auuagaauuaugcuugcuaaug

SEQ ID NO: 1079693 - RNA, 22 nt, Human
caccaggcuggagugcagaggu

SEQ ID NO: 1079694 - RNA, 22 nt, Human
uuuguguguauauccuuccaga

SEQ ID NO: 1079695 - RNA, 22 nt, Human
ucagacaggccucuccagccuc

SEQ ID NO: 1079696 - RNA, 22 nt, Human
uggcagagucugggcuugggca

SEQ ID NO: 1079697 - RNA, 22 nt, Human
gccuucugaucgcuggacugac

SEQ ID NO: 1079698 - RNA, 22 nt, Human
uggccuggccacauccagcagg

SEQ ID NO: 1079699 - RNA, 22 nt, Human
uucaacauguucuacauaaggg

SEQ ID NO: 1079700 - RNA, 22 nt, Human
aaugucuucaguucuguauugu

SEQ ID NO: 1079701 - RNA, 22 nt, Human
ucuuuccuguaacugcuguuca

SEQ ID NO: 1079702 - RNA, 22 nt, Human
uaaacaucaccuucugcaguug

SEQ ID NO: 1079703 - RNA, 22 nt, Human
aggugcagcaugaguccaacgg

SEQ ID NO: 1079704 - RNA, 22 nt, Human
uagccggguguugugucaugca

SEQ ID NO: 1079705 - RNA, 22 nt, Human
gaaucacgguauucugcacggg

SEQ ID NO: 1079706 - RNA, 22 nt, Human
cccuggaggagcuuagagcuug

SEQ ID NO: 1079707 - RNA, 18 nt, Human
aggccagcccugcuacug

SEQ ID NO: 1079708 - RNA, 22 nt, Human
agcucccagcuccuuugagaga

SEQ ID NO: 1079709 - RNA, 22 nt, Human
cacagcagaaauaugaaggcag

SEQ ID NO: 1079710 - RNA, 22 nt, Human
aaacugcuuuccacaguggcua

SEQ ID NO: 1079711 - RNA, 22 nt, Human
aguuucaauucuuuucacaaag

SEQ ID NO: 1079712 - RNA, 22 nt, Human
auguuggagucguaaggcaugg

SEQ ID NO: 1079713 - RNA, 22 nt, Human
ggcugggccagggccuguggac

SEQ ID NO: 1079714 - RNA, 20 nt, Human
gcugaggucauuaugccuca

SEQ ID NO: 1079715 - RNA, 22 nt, Human
ucaucucaaaacccaaggggca

SEQ ID NO: 1079716 - RNA, 21 nt, Human
acuuuacaauuuacauaguga

SEQ ID NO: 1079717 - RNA, 22 nt, Human
gcuuccgcgauguccuaggugg

SEQ ID NO: 1079718 - RNA, 22 nt, Human
uagcagagcgggugcgaggcgg

SEQ ID NO: 1079719 - RNA, 22 nt, Human
cccuucucuuucacucacuauu

SEQ ID NO: 1079720 - RNA, 18 nt, Human
ugaguggaaugagggggc

SEQ ID NO: 1079721 - RNA, 22 nt, Human
cagcuguuaugagguguacaug

SEQ ID NO: 1079722 - RNA, 22 nt, Human
ucucuggagcugcagauccagg

SEQ ID NO: 1079723 - RNA, 22 nt, Human
gagaagcagguuuagcagacaa

SEQ ID NO: 1079724 - RNA, 22 nt, Human
gaaggaagauucuguuggaauc

SEQ ID NO: 1079725 - RNA, 22 nt, Human
acaacauucuuaaauacacuga

SEQ ID NO: 1079726 - RNA, 22 nt, Human
agccagccgggggaccacagug

SEQ ID NO: 1079727 - RNA, 22 nt, Human
cauauacuuuucuauagcuuuc

SEQ ID NO: 1079728 - RNA, 19 nt, Human
uggcugagcuggacugagg

SEQ ID NO: 1079729 - RNA, 22 nt, Human
acugcaucugaaacauggguca

SEQ ID NO: 1079730 - RNA, 22 nt, Human
acucagaguuuuacccagagac

SEQ ID NO: 1079731 - RNA, 22 nt, Human
uuucacagcugggaagagauau

SEQ ID NO: 1079732 - RNA, 22 nt, Human
auuuaauaccacuuggugcuuu

SEQ ID NO: 1079733 - RNA, 22 nt, Human
caggcugccaaggcuggggagg

SEQ ID NO: 1079734 - RNA, 22 nt, Human
cuuuuucaagucaaagagggua

SEQ ID NO: 1079735 - RNA, 22 nt, Human
ggcucugcagugacuugagggg

SEQ ID NO: 1079736 - RNA, 22 nt, Human
uggcauuucaguauuuucauaa

SEQ ID NO: 1079737 - RNA, 22 nt, Human
ggaggcucugcuccguguguuc

SEQ ID NO: 1079738 - RNA, 22 nt, Human
ggcaucuguccaucucuccagc

SEQ ID NO: 1079739 - RNA, 22 nt, Human
augggggccugaacaggcaaaa

SEQ ID NO: 1079740 - RNA, 22 nt, Human
aggcagccaguucagguuucuu

SEQ ID NO: 1079741 - RNA, 22 nt, Human
gcagagguggcaucugggcucu

SEQ ID NO: 1079742 - RNA, 23 nt, Human
cuggggcucauugcaguagccau

SEQ ID NO: 1079743 - RNA, 22 nt, Human
aggcagggcugggauuagacuc

SEQ ID NO: 1079744 - RNA, 22 nt, Human
aagcugcccucauucccagugc

SEQ ID NO: 1079745 - RNA, 22 nt, Human
cagugaggaagcugucuggacc

SEQ ID NO: 1079746 - RNA, 19 nt, Human
gcaucaaagcugacuccug

SEQ ID NO: 1079747 - RNA, 22 nt, Human
uguuacauuucucuuucuugga

SEQ ID NO: 1079748 - RNA, 23 nt, Human
uugcauccugacgucuauuuucu

SEQ ID NO: 1079749 - RNA, 22 nt, Human
gagaggcuaugagguucugugu

SEQ ID NO: 1079750 - RNA, 22 nt, Human
uauuuaauaaaacuauggcaug

SEQ ID NO: 1079751 - RNA, 22 nt, Human
uuccaagugucagaucagauuu

SEQ ID NO: 1079752 - RNA, 22 nt, Human
acaagauacucagcuacaagac

SEQ ID NO: 1079753 - RNA, 20 nt, Human
ugcugcaguuucaugggacu

SEQ ID NO: 1079754 - RNA, 22 nt, Human
aaaaacuguaauuacuuuugca

SEQ ID NO: 1079755 - RNA, 18 nt, Human
gucuggaggucaggagcu

SEQ ID NO: 1079756 - RNA, 22 nt, Human
gucaggauuauaauccccaugg

SEQ ID NO: 1079757 - RNA, 22 nt, Human
gagaaagggaacuuacagagug

SEQ ID NO: 1079758 - RNA, 22 nt, Human
gccaagcuuauaugaugcuuga

SEQ ID NO: 1079759 - RNA, 22 nt, Human
cuggcuggcagaugcucuugcu

SEQ ID NO: 1079760 - RNA, 22 nt, Human
uauuagguuggugcaacaguaa

SEQ ID NO: 1079761 - RNA, 22 nt, Human
acaguucuuuguuuauagcuug

SEQ ID NO: 1079762 - RNA, 22 nt, Human
acugggaaaagcuauggcaaau

SEQ ID NO: 1079763 - RNA, 22 nt, Human
ucugccuucgcugcucccugaa

SEQ ID NO: 1079764 - RNA, 19 nt, Human
uuaugaaggcuggggggag

SEQ ID NO: 1079765 - RNA, 22 nt, Human
gcucccugcagcugagaguucc

SEQ ID NO: 1079766 - RNA, 22 nt, Human
ugugggaggaauuagaauggga

SEQ ID NO: 1079767 - RNA, 22 nt, Human
ccugugcuggcuuuauucucag

SEQ ID NO: 1079768 - RNA, 22 nt, Human
gucccaggcuuauguggagcuu

SEQ ID NO: 1079769 - RNA, 22 nt, Human
aggagucaggaccaaauggaaa

SEQ ID NO: 1079770 - RNA, 22 nt, Human
ugaaaaggagccuuagguaggu

SEQ ID NO: 1079771 - RNA, 22 nt, Human
gaagcagagccuaaggcagaca

SEQ ID NO: 1079772 - RNA, 22 nt, Human
uaucuguuaggaucagagcugg

SEQ ID NO: 1079773 - RNA, 22 nt, Human
ccugugcuuuaggccucaaacu

SEQ ID NO: 1079774 - RNA, 22 nt, Human
gcugugcagguccccacugccu

SEQ ID NO: 1079775 - RNA, 22 nt, Human
ugccucugggugaccaaggagc

SEQ ID NO: 1079776 - RNA, 22 nt, Human
uagaggcagaagaaauugacaa

SEQ ID NO: 1079777 - RNA, 22 nt, Human
acucugcuuauugcugcaggca

SEQ ID NO: 1079778 - RNA, 22 nt, Human
ucaacugcaaguuugcuuaguu

SEQ ID NO: 1079779 - RNA, 22 nt, Human
uauuugugagacugacugaagu

SEQ ID NO: 1079780 - RNA, 22 nt, Human
ucagggagaggugagagccugu

SEQ ID NO: 1079781 - RNA, 16 nt, Human
ggggaaggcaagaggg

SEQ ID NO: 1079782 - RNA, 22 nt, Human
agucccagccuaggcugugcug

SEQ ID NO: 1079783 - RNA, 22 nt, Human
caagagcugcaaauagcgugac

SEQ ID NO: 1079784 - RNA, 22 nt, Human
auuucacucucccugccacuua

SEQ ID NO: 1079785 - RNA, 22 nt, Human
aaugagaauguaagugaagaga

SEQ ID NO: 1079786 - RNA, 17 nt, Human
gcaaucucagucuccuu

SEQ ID NO: 1079787 - RNA, 22 nt, Human
acaauguaggauauguacuugu

SEQ ID NO: 1079788 - RNA, 22 nt, Human
cucucugaggaaggagcaucug

SEQ ID NO: 1079789 - RNA, 22 nt, Human
guuccuuuguuuagcagagaca

SEQ ID NO: 1079790 - RNA, 22 nt, Human
gaggcacaucacuuggugcauu

SEQ ID NO: 1079791 - RNA, 22 nt, Human
caagauggacauaaggagagaa

SEQ ID NO: 1079792 - RNA, 22 nt, Human
gcugugcccauauucugcugac

SEQ ID NO: 1079793 - RNA, 22 nt, Human
ggaccugaacauaaaacgaggc

SEQ ID NO: 1079794 - RNA, 22 nt, Human
cgccaggcuugguagcucaugc

SEQ ID NO: 1079795 - RNA, 22 nt, Human
aaauacugcugcuauuccuuuu

SEQ ID NO: 1079796 - RNA, 18 nt, Human
ccucccucauuuucccag

SEQ ID NO: 1079797 - RNA, 22 nt, Human
ugaaagaagugucacauugcca

SEQ ID NO: 1079798 - RNA, 22 nt, Human
uuauggaaaacuccagagagua

SEQ ID NO: 1079799 - RNA, 22 nt, Human
gcacauuucucaaagaauuguc

SEQ ID NO: 1079800 - RNA, 22 nt, Human
ggcuucccaaggagccaggaug

SEQ ID NO: 1079801 - RNA, 22 nt, Human
cugggcuuagcagcuccugguc

SEQ ID NO: 1079802 - RNA, 22 nt, Human
ccaagauaagagacaagauuua

SEQ ID NO: 1079803 - RNA, 22 nt, Human
ugggcagauguccucugaagug

SEQ ID NO: 1079804 - RNA, 22 nt, Human
cagaaacauguauaaaguugua

SEQ ID NO: 1079805 - RNA, 22 nt, Human
uacacagauuucaguaucauca

SEQ ID NO: 1079806 - RNA, 22 nt, Human
ucacagaagagcauuaagauga

SEQ ID NO: 1079807 - RNA, 22 nt, Human
ggguggcacaggugcagagggu

SEQ ID NO: 1079808 - RNA, 22 nt, Human
agaauucuggaguugggaggaa

SEQ ID NO: 1079809 - RNA, 22 nt, Human
uaaacaucugaauccugcuucc

SEQ ID NO: 1079810 - RNA, 22 nt, Human
uuagcuuucuuggagaauuaca

SEQ ID NO: 1079811 - RNA, 22 nt, Human
ugaagaugucagcagggguggu

SEQ ID NO: 1079812 - RNA, 22 nt, Human
auaaauagugugucauaaaguc

SEQ ID NO: 1079813 - RNA, 22 nt, Human
acugaaggaagcgggcaggggu

SEQ ID NO: 1079814 - RNA, 22 nt, Human
agagucccagggacacuccaga

SEQ ID NO: 1079815 - RNA, 22 nt, Human
ggcagcugauuagcaucaagga

SEQ ID NO: 1079816 - RNA, 22 nt, Human
gaggggaugcagagaggcuuau

SEQ ID NO: 1079817 - RNA, 22 nt, Human
acaggcugcugagccauuugcu

SEQ ID NO: 1079818 - RNA, 22 nt, Human
cagggcaguuuuacuucucucu

SEQ ID NO: 1079819 - RNA, 22 nt, Human
ucccauauaugcaaaaauguaa

SEQ ID NO: 1079820 - RNA, 22 nt, Human
ccugcuggcagaggggguuacu

SEQ ID NO: 1079821 - RNA, 22 nt, Human
ugcuggggagugauugaccauc

SEQ ID NO: 1079822 - RNA, 22 nt, Human
uguggcugacuccuggucccca

SEQ ID NO: 1079823 - RNA, 22 nt, Human
uccugggguuuuggccgcagcu

SEQ ID NO: 1079824 - RNA, 22 nt, Human
aucacaauguacguuaaaaugu

SEQ ID NO: 1079825 - RNA, 22 nt, Human
uucaacauaugaauuuugggug

SEQ ID NO: 1079826 - RNA, 22 nt, Human
uggagccauaacccuuucguac

SEQ ID NO: 1079827 - RNA, 22 nt, Human
ugcaggccggcccuaggccuca

SEQ ID NO: 1079828 - RNA, 23 nt, Human
gcccugcccuuagcacacucaca

SEQ ID NO: 1079829 - RNA, 22 nt, Human
aggguggggugcuacaucuuua

SEQ ID NO: 1079830 - RNA, 21 nt, Human
ucagaguggaagacaguuuga

SEQ ID NO: 1079831 - RNA, 22 nt, Human
aaccaggacaauuuugaaagua

SEQ ID NO: 1079832 - RNA, 22 nt, Human
ggccuugggcuggcugcaguau

SEQ ID NO: 1079833 - RNA, 22 nt, Human
acauuuguugccauucauggag

SEQ ID NO: 1079834 - RNA, 22 nt, Human
uaggcgaaggucugggugggca

SEQ ID NO: 1079835 - RNA, 22 nt, Human
gugggguguccagcagcgagcu

SEQ ID NO: 1079836 - RNA, 22 nt, Human
accaggagccacaggaggagcc

SEQ ID NO: 1079837 - RNA, 22 nt, Human
gcucccugacucaguuccugag

SEQ ID NO: 1079838 - RNA, 22 nt, Human
ucagggaaaccuaaggaagcca

SEQ ID NO: 1079839 - RNA, 22 nt, Human
acucccagguugccuggcaggc

SEQ ID NO: 1079840 - RNA, 22 nt, Human
uugugugguagcuucauugaac

SEQ ID NO: 1079841 - RNA, 22 nt, Human
uuguaauuugcaaauguauugu

SEQ ID NO: 1079842 - RNA, 22 nt, Human
aaguuacauaaauguccucuag

SEQ ID NO: 1079843 - RNA, 22 nt, Human
cugggcugucaguuuuguuuua

SEQ ID NO: 1079844 - RNA, 22 nt, Human
aaaaagauguccugaaguuuag

SEQ ID NO: 1079845 - RNA, 22 nt, Human
cuguuuuugugcugugucuccc

SEQ ID NO: 1079846 - RNA, 22 nt, Human
auacauaguucugugaaaagua

SEQ ID NO: 1079847 - RNA, 22 nt, Human
gagagugagauccuccugggga

SEQ ID NO: 1079848 - RNA, 22 nt, Human
ucugcccaguuugugcucaggu

SEQ ID NO: 1079849 - RNA, 19 nt, Human
cacagggcaggucucaugu

SEQ ID NO: 1079850 - RNA, 22 nt, Human
augcucugggcaggagcccugg

SEQ ID NO: 1079851 - RNA, 22 nt, Human
ugugcucugcaaucaguucuuu

SEQ ID NO: 1079852 - RNA, 22 nt, Human
cagcagcuggugagacacagcc

SEQ ID NO: 1079853 - RNA, 22 nt, Human
agaagccauagucugggaggca

SEQ ID NO: 1079854 - RNA, 21 nt, Human
uuugggcuuuuacuggacgug

SEQ ID NO: 1079855 - RNA, 22 nt, Human
uauacuuuccugcaacuuugau

SEQ ID NO: 1079856 - RNA, 22 nt, Human
uucuaaacacuacgggauuugg

SEQ ID NO: 1079857 - RNA, 22 nt, Human
aacaugaaacccaaacagaaua

SEQ ID NO: 1079858 - RNA, 22 nt, Human
ucugagugagggugugagauau

SEQ ID NO: 1079859 - RNA, 22 nt, Human
uccuuaaagugcaccuccucau

SEQ ID NO: 1079860 - RNA, 22 nt, Human
gcugccuggcuuuaguccacuu

SEQ ID NO: 1079861 - RNA, 18 nt, Human
agucucagcggaggagua

SEQ ID NO: 1079862 - RNA, 22 nt, Human
ucaaagaacaucaucugaaaug

SEQ ID NO: 1079863 - RNA, 22 nt, Human
aagaggaaaugauugacuauau

SEQ ID NO: 1079864 - RNA, 22 nt, Human
cagugccaugucugagccccua

SEQ ID NO: 1079865 - RNA, 21 nt, Human
ggacucuacacaggccaucuu

SEQ ID NO: 1079866 - RNA, 22 nt, Human
uccauuuucuugcucuagguaa

SEQ ID NO: 1079867 - RNA, 22 nt, Human
caguuaaaaugugcuauaagaa

SEQ ID NO: 1079868 - RNA, 22 nt, Human
uccaggaaaucauaaauugcuu

SEQ ID NO: 1079869 - RNA, 22 nt, Human
accucaggauguggacacagaa

SEQ ID NO: 1079870 - RNA, 19 nt, Human
aucugagauuauaaacaga

SEQ ID NO: 1079871 - RNA, 22 nt, Human
aagaagugguuggaagaagcau

SEQ ID NO: 1079872 - RNA, 22 nt, Human
ucagauuuccuugcaguuugga

SEQ ID NO: 1079873 - RNA, 22 nt, Human
cuggaacagaagcacuggagag

SEQ ID NO: 1079874 - RNA, 22 nt, Human
aaaccacaugccuucaaaugcu

SEQ ID NO: 1079875 - RNA, 22 nt, Human
guauuccuucagaagacguuua

SEQ ID NO: 1079876 - RNA, 22 nt, Human
ggcuuuggggugugcagagaug

SEQ ID NO: 1079877 - RNA, 22 nt, Human
uggagccaugccuggccuuucc

SEQ ID NO: 1079878 - RNA, 22 nt, Human
ucugagcugggcacagaaggcg

SEQ ID NO: 1079879 - RNA, 22 nt, Human
cugucugcuagaacaucuauac

SEQ ID NO: 1079880 - RNA, 22 nt, Human
cugcacaaauuaaucaguuaau

SEQ ID NO: 1079881 - RNA, 22 nt, Human
gcacagggccuggcacauaaga

SEQ ID NO: 1079882 - RNA, 22 nt, Human
aggagccaaauuacuagcucug

SEQ ID NO: 1079883 - RNA, 22 nt, Human
ggggugugaguagagcugggga

SEQ ID NO: 1079884 - RNA, 22 nt, Human
aauaugugggugcuaaucaaaa

SEQ ID NO: 1079885 - RNA, 22 nt, Human
cugugaccuccaggaaggggug

SEQ ID NO: 1079886 - RNA, 22 nt, Human
uggacucagugcugccauuccc

SEQ ID NO: 1079887 - RNA, 22 nt, Human
gcaggagucacugacuuggucc

SEQ ID NO: 1079888 - RNA, 22 nt, Human
ggagucaggagcaggcugggcu

SEQ ID NO: 1079889 - RNA, 22 nt, Human
ugcuucaggaagaaacgccagg

SEQ ID NO: 1079890 - RNA, 22 nt, Human
gacacagacaguuagagguaau

SEQ ID NO: 1079891 - RNA, 22 nt, Human
ccagcagcgauagggugagugc

SEQ ID NO: 1079892 - RNA, 22 nt, Human
uucucuucuguucagugcccaa

SEQ ID NO: 1079893 - RNA, 22 nt, Human
agcccuuaguacauuucucaag

SEQ ID NO: 1079894 - RNA, 22 nt, Human
gaauucuuugaucuuaaucuug

SEQ ID NO: 1079895 - RNA, 22 nt, Human
acauuaaagaguaagguuaguu

SEQ ID NO: 1079896 - RNA, 22 nt, Human
gagcugggaggacugggaacuu

SEQ ID NO: 1079897 - RNA, 22 nt, Human
ggccucagagaaggcugugcgg

SEQ ID NO: 1079898 - RNA, 22 nt, Human
uuucacagaacucacuaaggag

SEQ ID NO: 1079899 - RNA, 22 nt, Human
ugaaggcccuaucuccauauac

SEQ ID NO: 1079900 - RNA, 22 nt, Human
ucagggacuuacaaaccagaag

SEQ ID NO: 1079901 - RNA, 22 nt, Human
ucaaaaguuucacauagagaua

SEQ ID NO: 1079902 - RNA, 22 nt, Human
aaagggagcauggcugcaggga

SEQ ID NO: 1079903 - RNA, 22 nt, Human
cugagaggugcugguggcugca

SEQ ID NO: 1079904 - RNA, 22 nt, Human
ugccuggcugaggugacagguu

SEQ ID NO: 1079905 - RNA, 22 nt, Human
aguuacaucuguuauguguguu

SEQ ID NO: 1079906 - RNA, 21 nt, Human
ucugaacaacauacgaaucuu

SEQ ID NO: 1079907 - RNA, 22 nt, Human
gccuccuggauuuuagugccau

SEQ ID NO: 1079908 - RNA, 22 nt, Human
agcugagcacauucaaacaggu

SEQ ID NO: 1079909 - RNA, 22 nt, Human
uacugacacaaagccaaucccu

SEQ ID NO: 1079910 - RNA, 22 nt, Human
uccaguggugguuugaagggca

SEQ ID NO: 1079911 - RNA, 19 nt, Human
uaucuuuaugcaguggugg

SEQ ID NO: 1079912 - RNA, 22 nt, Human
gaauuuuucuggaagcaauuau

SEQ ID NO: 1079913 - RNA, 20 nt, Human
auugugaauacugcauaugu

SEQ ID NO: 1079914 - RNA, 22 nt, Human
ggcugugcgggcagccguggga

SEQ ID NO: 1079915 - RNA, 22 nt, Human
agaagcuugaaggagcagugac

SEQ ID NO: 1079916 - RNA, 22 nt, Human
aggguccaucaaggacugcaca

SEQ ID NO: 1079917 - RNA, 22 nt, Human
uggcagggaauacagauguuua

SEQ ID NO: 1079918 - RNA, 22 nt, Human
gcaacaaguguaaacaugcauu

SEQ ID NO: 1079919 - RNA, 22 nt, Human
uccaugucuucaugugucuaac

SEQ ID NO: 1079920 - RNA, 22 nt, Human
agacucugcuaagaauauaauu

SEQ ID NO: 1079921 - RNA, 22 nt, Human
caggagugaaaugaggcccagg

SEQ ID NO: 1079922 - RNA, 22 nt, Human
uuuguucacaugucauguacaa

SEQ ID NO: 1079923 - RNA, 22 nt, Human
gacaugcaugaaugcaggucuc

SEQ ID NO: 1079924 - RNA, 22 nt, Human
ugaugggacugccagcugcuga

SEQ ID NO: 1079925 - RNA, 22 nt, Human
ucccagaaucuuuggaagagca

SEQ ID NO: 1079926 - RNA, 22 nt, Human
caggccucuuccaugcagcagc

SEQ ID NO: 1079927 - RNA, 22 nt, Human
gcuggcuuugcacugggugcau

SEQ ID NO: 1079928 - RNA, 22 nt, Human
aauguauucucuuuauaagaua

SEQ ID NO: 1079929 - RNA, 22 nt, Human
cagucuuugacaagcccuuuca

SEQ ID NO: 1079930 - RNA, 22 nt, Human
cccuggcaaaacacucucuuga

SEQ ID NO: 1079931 - RNA, 21 nt, Human
cuugggcuuguagauggugga

SEQ ID NO: 1079932 - RNA, 22 nt, Human
gaauucuaggguaaauauccua

SEQ ID NO: 1079933 - RNA, 22 nt, Human
uggcucugucacugugagcuau

SEQ ID NO: 1079934 - RNA, 22 nt, Human
gcagguggaagcagcagacuca

SEQ ID NO: 1079935 - RNA, 19 nt, Human
agcuguggggccuagcacc

SEQ ID NO: 1079936 - RNA, 22 nt, Human
cacugcuucuggaggaauuugg

SEQ ID NO: 1079937 - RNA, 22 nt, Human
ugaaaugcuguagagacuguau

SEQ ID NO: 1079938 - RNA, 22 nt, Human
uuaugcaacaggugagcagaca

SEQ ID NO: 1079939 - RNA, 22 nt, Human
aacaaauuaguugcaagacugg

SEQ ID NO: 1079940 - RNA, 22 nt, Human
aaucacaaauuuagacagagcu

SEQ ID NO: 1079941 - RNA, 22 nt, Human
caggacccaaccucccugcucu

SEQ ID NO: 1079942 - RNA, 22 nt, Human
ucaguuuucucaucuguaauuu

SEQ ID NO: 1079943 - RNA, 22 nt, Human
uugacaaaaaccucauuucacc

SEQ ID NO: 1079944 - RNA, 22 nt, Human
ucccucagauuggcaauuagau

SEQ ID NO: 1079945 - RNA, 22 nt, Human
gggagcuguaguccagauaccg

SEQ ID NO: 1079946 - RNA, 22 nt, Human
caggauggucucgaucuccuga

SEQ ID NO: 1079947 - RNA, 22 nt, Human
agaggcagccguauuucaaagg

SEQ ID NO: 1079948 - RNA, 22 nt, Human
cugauauuaacaggcaagugag

SEQ ID NO: 1079949 - RNA, 22 nt, Human
uauauguagauuguaccaaugu

SEQ ID NO: 1079950 - RNA, 22 nt, Human
uucugaugcaugggucucuguu

SEQ ID NO: 1079951 - RNA, 22 nt, Human
gccugcuggcuguccauugcag

SEQ ID NO: 1079952 - RNA, 22 nt, Human
auauuugucaauucacuguuca

SEQ ID NO: 1079953 - RNA, 23 nt, Human
ugaaacagaugccaaugaucaag

SEQ ID NO: 1079954 - RNA, 22 nt, Human
ugaccaaaaaauucccugugag

SEQ ID NO: 1079955 - RNA, 22 nt, Human
accugccuaguugguucugccc

SEQ ID NO: 1079956 - RNA, 18 nt, Human
aguuccuuaaauuggugu

SEQ ID NO: 1079957 - RNA, 22 nt, Human
uguggccucaaggcugcccuca

SEQ ID NO: 1079958 - RNA, 22 nt, Human
acauauuuccaugcagcauguc

SEQ ID NO: 1079959 - RNA, 22 nt, Human
cagcugccugcaacacaagcuu

SEQ ID NO: 1079960 - RNA, 22 nt, Human
agugaaauggaugcugcuacug

SEQ ID NO: 1079961 - RNA, 21 nt, Human
ggucagggggugccuccaggu

SEQ ID NO: 1079962 - RNA, 22 nt, Human
agccaggacguugcucagcucc

SEQ ID NO: 1079963 - RNA, 22 nt, Human
agcuuacaccccccaagauucu

SEQ ID NO: 1079964 - RNA, 23 nt, Human
gcucugagggcuuaucccuccca

SEQ ID NO: 1079965 - RNA, 22 nt, Human
ggaacacagugccuuacaaacu

SEQ ID NO: 1079966 - RNA, 23 nt, Human
uccagcagccaagaaggguagaa

SEQ ID NO: 1079967 - RNA, 22 nt, Human
uccaggcccugggaugggagca

SEQ ID NO: 1079968 - RNA, 22 nt, Human
aggagcucauguggcugccugu

SEQ ID NO: 1079969 - RNA, 22 nt, Human
ggagacacuggaaaguauuaca

SEQ ID NO: 1079970 - RNA, 22 nt, Human
uuuaagguacagcuagcagcau

SEQ ID NO: 1079971 - RNA, 22 nt, Human
guaauucugugugaaucuauua

SEQ ID NO: 1079972 - RNA, 22 nt, Human
cuggcuuugcgucuuugccaca

SEQ ID NO: 1079973 - RNA, 22 nt, Human
uuugcauuuguucaaguauuga

SEQ ID NO: 1079974 - RNA, 22 nt, Human
uggugucaggcacuagcaugca

SEQ ID NO: 1079975 - RNA, 22 nt, Human
uucaauaucucuaagaaugagg

SEQ ID NO: 1079976 - RNA, 22 nt, Human
acucagcuugcacacaucaaug

SEQ ID NO: 1079977 - RNA, 22 nt, Human
gaaggcaaggagggaagccacc

SEQ ID NO: 1079978 - RNA, 23 nt, Human
caggcucccggaccaggauccgc

SEQ ID NO: 1079979 - RNA, 20 nt, Human
cagcaaaaugaaaauggauu

SEQ ID NO: 1079980 - RNA, 22 nt, Human
ccacaggggucucuguagcuga

SEQ ID NO: 1079981 - RNA, 22 nt, Human
cagcuccugcagcugcugccgu

SEQ ID NO: 1079982 - RNA, 22 nt, Human
auugcuuuuccuuaacacaugc

SEQ ID NO: 1079983 - RNA, 22 nt, Human
uuuuauuaucuuugaaugggac

SEQ ID NO: 1079984 - RNA, 22 nt, Human
uacaggcaugaaugaaaucugu

SEQ ID NO: 1079985 - RNA, 23 nt, Human
uucuuucaagaaguucacagugc

SEQ ID NO: 1079986 - RNA, 22 nt, Human
uuucuagggcucuugucuucug

SEQ ID NO: 1079987 - RNA, 22 nt, Human
ccagccaggcuggcuguggagg

SEQ ID NO: 1079988 - RNA, 22 nt, Human
caucaaacaaaugcuuuuagau

SEQ ID NO: 1079989 - RNA, 22 nt, Human
cacuggaauggauagagcagag

SEQ ID NO: 1079990 - RNA, 21 nt, Human
ucugggcccaugcugccucac

SEQ ID NO: 1079991 - RNA, 22 nt, Human
gcugagggcagccuccuagguc

SEQ ID NO: 1079992 - RNA, 22 nt, Human
aagcucugcucagcagacuagg

SEQ ID NO: 1079993 - RNA, 18 nt, Human
aagaggaggaaacccagg

SEQ ID NO: 1079994 - RNA, 22 nt, Human
auacaucuaugccuuucugaca

SEQ ID NO: 1079995 - RNA, 22 nt, Human
ucuauaaaacucaagagcaauu

SEQ ID NO: 1079996 - RNA, 21 nt, Human
aggggacagaguagcuccagg

SEQ ID NO: 1079997 - RNA, 22 nt, Human
aggcuccauaccaucuccggag

SEQ ID NO: 1079998 - RNA, 22 nt, Human
augggccuugacacauggagug

SEQ ID NO: 1079999 - RNA, 20 nt, Human
uuucacaaugaacaugucuc

SEQ ID NO: 1080000 - RNA, 21 nt, Human
gagugucuaauccaggcuguc

SEQ ID NO: 1080001 - RNA, 22 nt, Human
agaagauuuagguugacgcuau

SEQ ID NO: 1080002 - RNA, 22 nt, Human
augcagcagcuacuugggaagg

SEQ ID NO: 1080003 - RNA, 22 nt, Human
ggagagcugguagcuggcucca

SEQ ID NO: 1080004 - RNA, 22 nt, Human
ugccuguguggucugcgcauua

SEQ ID NO: 1080005 - RNA, 22 nt, Human
acagcugaaaccagggaucugg

SEQ ID NO: 1080006 - RNA, 22 nt, Human
cauuuuaaaugauuuaagccaa

SEQ ID NO: 1080007 - RNA, 21 nt, Human
ccacuguagacucauucugag

SEQ ID NO: 1080008 - RNA, 22 nt, Human
ucccugaaucucgaacuagccu

SEQ ID NO: 1080009 - RNA, 22 nt, Human
auuauucauugguaggcaagcu

SEQ ID NO: 1080010 - RNA, 22 nt, Human
gcucuggaagcaucugagagga

SEQ ID NO: 1080011 - RNA, 22 nt, Human
aaucugauguuaaauguaaggu

SEQ ID NO: 1080012 - RNA, 22 nt, Human
agucuggggucugguagaacga

SEQ ID NO: 1080013 - RNA, 19 nt, Human
uuacaucugcaacacuggu

SEQ ID NO: 1080014 - RNA, 22 nt, Human
aagcacugagcacaguggcuga

SEQ ID NO: 1080015 - RNA, 22 nt, Human
ucuguggcacgauugcacugca

SEQ ID NO: 1080016 - RNA, 22 nt, Human
agggcucacuacaacccuggga

SEQ ID NO: 1080017 - RNA, 22 nt, Human
uucuagcuuuuugcaccaaggu

SEQ ID NO: 1080018 - RNA, 18 nt, Human
gcagcuagccaggggggc

SEQ ID NO: 1080019 - RNA, 22 nt, Human
cagagccauuauggagacuugc

SEQ ID NO: 1080020 - RNA, 22 nt, Human
uguaacagagcuuuuuuauagc

SEQ ID NO: 1080021 - RNA, 22 nt, Human
cuuugaaaacuuaaauaacagc

SEQ ID NO: 1080022 - RNA, 22 nt, Human
ccagaggagggcucugaugagg

SEQ ID NO: 1080023 - RNA, 21 nt, Human
aaacaucucugcuuuuguguc

SEQ ID NO: 1080024 - RNA, 22 nt, Human
ucccugccaguccuggucugaa

SEQ ID NO: 1080025 - RNA, 22 nt, Human
cugggcaggagggcucuaugga

SEQ ID NO: 1080026 - RNA, 22 nt, Human
gacagccaugcacuucugcugu

SEQ ID NO: 1080027 - RNA, 22 nt, Human
agcugccacauggugucacugu

SEQ ID NO: 1080028 - RNA, 22 nt, Human
uggcauuuagagaaaugaagga

SEQ ID NO: 1080029 - RNA, 22 nt, Human
guuuccaacuaguaugaucagg

SEQ ID NO: 1080030 - RNA, 22 nt, Human
agccaaagaucagugugcaagu

SEQ ID NO: 1080031 - RNA, 22 nt, Human
uuuccucuucuggcaggcaggg

SEQ ID NO: 1080032 - RNA, 22 nt, Human
uagcagaggcaaggaugugaau

SEQ ID NO: 1080033 - RNA, 22 nt, Human
ggccuuggugccauggccaguu

SEQ ID NO: 1080034 - RNA, 19 nt, Human
ucccuuccugucgggcucc

SEQ ID NO: 1080035 - RNA, 22 nt, Human
gagacugaggucaccaggcugu

SEQ ID NO: 1080036 - RNA, 22 nt, Human
uaaaacuagaccgugagucuaa

SEQ ID NO: 1080037 - RNA, 23 nt, Human
agccucagccgguggcagaagug

SEQ ID NO: 1080038 - RNA, 22 nt, Human
aggggagcaucugugaugguua

SEQ ID NO: 1080039 - RNA, 22 nt, Human
gaaggagagaaaggcaauucug

SEQ ID NO: 1080040 - RNA, 22 nt, Human
gaugaaauagaauuaauuuagg

SEQ ID NO: 1080041 - RNA, 17 nt, Human
auuucccagcagugcua

SEQ ID NO: 1080042 - RNA, 22 nt, Human
ggccaggagcaagccaggcucu

SEQ ID NO: 1080043 - RNA, 22 nt, Human
uauguuucuuccuuuucauaca

SEQ ID NO: 1080044 - RNA, 22 nt, Human
gcagggcuugcagcagcuagac

SEQ ID NO: 1080045 - RNA, 22 nt, Human
ugggccacuugaaaguggaugu

SEQ ID NO: 1080046 - RNA, 22 nt, Human
gagagugucuggaggaagcuaa

SEQ ID NO: 1080047 - RNA, 22 nt, Human
ccuggggagccgccugagcccc

SEQ ID NO: 1080048 - RNA, 22 nt, Human
gccaccuguuucgcuugcccag

SEQ ID NO: 1080049 - RNA, 22 nt, Human
cuuuacaaacuauaaagugcgg

SEQ ID NO: 1080050 - RNA, 21 nt, Human
cauuuacaugacagauugguu

SEQ ID NO: 1080051 - RNA, 22 nt, Human
aggagcaaaugaugagacagca

SEQ ID NO: 1080052 - RNA, 22 nt, Human
aagagccagcuagugaagaggc

SEQ ID NO: 1080053 - RNA, 21 nt, Human
uuucugaaggcaacaucuauc

SEQ ID NO: 1080054 - RNA, 22 nt, Human
agugaggggcagcugagugggc

SEQ ID NO: 1080055 - RNA, 21 nt, Human
gagugcagcaagguagagucu

SEQ ID NO: 1080056 - RNA, 22 nt, Human
aggggaaggccagccuguagag

SEQ ID NO: 1080057 - RNA, 22 nt, Human
aagaugauguuguguuuucacu

SEQ ID NO: 1080058 - RNA, 19 nt, Human
ucucuggaugacagacacu

SEQ ID NO: 1080059 - RNA, 22 nt, Human
cagacaggcuagccagacucac

SEQ ID NO: 1080060 - RNA, 22 nt, Human
gcuuccaggcuuccuaccuuug

SEQ ID NO: 1080061 - RNA, 22 nt, Human
uaaguucaccaguuguaauaag

SEQ ID NO: 1080062 - RNA, 22 nt, Human
ugucauuuaguccucugugugu

SEQ ID NO: 1080063 - RNA, 22 nt, Human
uccuugagagccacugucuugg

SEQ ID NO: 1080064 - RNA, 22 nt, Human
cugaggcuggggaagggaagug

SEQ ID NO: 1080065 - RNA, 22 nt, Human
gaauucugucgcuuacuagaug

SEQ ID NO: 1080066 - RNA, 22 nt, Human
acaacaggguaaggcaggccau

SEQ ID NO: 1080067 - RNA, 22 nt, Human
aguaauuuguuauaaagcaaua

SEQ ID NO: 1080068 - RNA, 19 nt, Human
gggagcaggaaagcugugg

SEQ ID NO: 1080069 - RNA, 22 nt, Human
gcuggcuggaggugaggaagaa

SEQ ID NO: 1080070 - RNA, 22 nt, Human
agucucuuuguauaaauaggca

SEQ ID NO: 1080071 - RNA, 22 nt, Human
uaaaggaggaguuaaugagacu

SEQ ID NO: 1080072 - RNA, 22 nt, Human
uguucuugagccuuuagaccua

SEQ ID NO: 1080073 - RNA, 22 nt, Human
ugaugcuucacgcugaauaugc

SEQ ID NO: 1080074 - RNA, 22 nt, Human
gcagcugccccgacugugaguc

SEQ ID NO: 1080075 - RNA, 22 nt, Human
ggcccagcgaggccaccuacag

SEQ ID NO: 1080076 - RNA, 23 nt, Human
ugguccugccaacggugccccuc

SEQ ID NO: 1080077 - RNA, 22 nt, Human
aggcagacuuaccuucugggga

SEQ ID NO: 1080078 - RNA, 22 nt, Human
ugguacauaaauggauguuuuc

SEQ ID NO: 1080079 - RNA, 22 nt, Human
aaguaaaagcuuuaccaugcgc

SEQ ID NO: 1080080 - RNA, 22 nt, Human
uccaggaauagucauguuuuag

SEQ ID NO: 1080081 - RNA, 22 nt, Human
ggcugcagagcugggugggccu

SEQ ID NO: 1080082 - RNA, 22 nt, Human
uggcauuuuguucaguauaugg

SEQ ID NO: 1080083 - RNA, 22 nt, Human
uagacaauauuugaaaguagug

SEQ ID NO: 1080084 - RNA, 22 nt, Human
cuggugccuccucccugugcuu

SEQ ID NO: 1080085 - RNA, 22 nt, Human
auucauaaguaaaugauuaccu

SEQ ID NO: 1080086 - RNA, 22 nt, Human
gccaggagacuccauucauuug

SEQ ID NO: 1080087 - RNA, 22 nt, Human
ugggcugcacccucagccucug

SEQ ID NO: 1080088 - RNA, 22 nt, Human
gaaagccauagcccagcuuuac

SEQ ID NO: 1080089 - RNA, 22 nt, Human
gcucccagcaauugaggcagcc

SEQ ID NO: 1080090 - RNA, 22 nt, Human
ucaaagucacaacucucuaauu

SEQ ID NO: 1080091 - RNA, 22 nt, Human
aacuuuaaaaaauaugucuguu

SEQ ID NO: 1080092 - RNA, 22 nt, Human
gccucccugagucacccaagca

SEQ ID NO: 1080093 - RNA, 22 nt, Human
ccuggcucuucagagguuccua

SEQ ID NO: 1080094 - RNA, 22 nt, Human
accagagcgcucaagccuuccc

SEQ ID NO: 1080095 - RNA, 22 nt, Human
gggccuguguguucaggagccu

SEQ ID NO: 1080096 - RNA, 22 nt, Human
aguacagaccugucucuuccug

SEQ ID NO: 1080097 - RNA, 22 nt, Human
ucugagaguacgggcugcgcgc

SEQ ID NO: 1080098 - RNA, 17 nt, Human
gggcugacaguggccuc

SEQ ID NO: 1080099 - RNA, 22 nt, Human
cuggagccccaggcugugcaga

SEQ ID NO: 1080100 - RNA, 22 nt, Human
gaagauauucucuaaauacuuu

SEQ ID NO: 1080101 - RNA, 23 nt, Human
uucaaagaucuucugaaaucugu

SEQ ID NO: 1080102 - RNA, 22 nt, Human
agagcagccugugaugaugcac

SEQ ID NO: 1080103 - RNA, 22 nt, Human
caucaucaaaacaaauggaguc

SEQ ID NO: 1080104 - RNA, 22 nt, Human
gcaaagaaagccaaggucuaac

SEQ ID NO: 1080105 - RNA, 18 nt, Human
gagacacaagggccugga

SEQ ID NO: 1080106 - RNA, 22 nt, Human
ugacucuguaccugucugccuu

SEQ ID NO: 1080107 - RNA, 23 nt, Human
gugagcagcccacuaggaaugcc

SEQ ID NO: 1080108 - RNA, 22 nt, Human
caucagcagucacaugaugcug

SEQ ID NO: 1080109 - RNA, 22 nt, Human
uugauuucaaaauauaugcuug

SEQ ID NO: 1080110 - RNA, 22 nt, Human
gugcucagggccuggcugggga

SEQ ID NO: 1080111 - RNA, 22 nt, Human
gaguccaguaguuaggacagag

SEQ ID NO: 1080112 - RNA, 22 nt, Human
agcucacagaaauccugcagga

SEQ ID NO: 1080113 - RNA, 22 nt, Human
uuugugugcgucuggccugggg

SEQ ID NO: 1080114 - RNA, 22 nt, Human
aagggcugggucugguuaaccc

SEQ ID NO: 1080115 - RNA, 22 nt, Human
cuuccaaagcacuuuauggacc

SEQ ID NO: 1080116 - RNA, 22 nt, Human
caugagaaguggccuucaaaaa

SEQ ID NO: 1080117 - RNA, 22 nt, Human
ucaggaaagaagaugcucagug

SEQ ID NO: 1080118 - RNA, 22 nt, Human
aagcuagauuggcauucauuuc

SEQ ID NO: 1080119 - RNA, 22 nt, Human
cccaguggagauaggagugugg

SEQ ID NO: 1080120 - RNA, 21 nt, Human
aucagaaguuuuggucaguag

SEQ ID NO: 1080121 - RNA, 22 nt, Human
uuuucuaauuuaguuacccucc

SEQ ID NO: 1080122 - RNA, 22 nt, Human
agccaggcuacuccuugcugac

SEQ ID NO: 1080123 - RNA, 22 nt, Human
ucagaaaagagaaaaucuuaua

SEQ ID NO: 1080124 - RNA, 22 nt, Human
ccaggcagcaaauuuucugaau

SEQ ID NO: 1080125 - RNA, 22 nt, Human
gagacaucauaaugaaguuucc

SEQ ID NO: 1080126 - RNA, 21 nt, Human
acauuauaauucauauuccac

SEQ ID NO: 1080127 - RNA, 22 nt, Human
aucaagaauugggagcuauuga

SEQ ID NO: 1080128 - RNA, 22 nt, Human
ggcagcaguuacaaaugugcag

SEQ ID NO: 1080129 - RNA, 22 nt, Human
cccaggaaaggaaaugaauggg

SEQ ID NO: 1080130 - RNA, 22 nt, Human
cucugagaauaugagcucuuug

SEQ ID NO: 1080131 - RNA, 22 nt, Human
gaagcagcuuucuggugaggag

SEQ ID NO: 1080132 - RNA, 22 nt, Human
ugaauucauccauuuaugcaag

SEQ ID NO: 1080133 - RNA, 22 nt, Human
ggcucaggagaggggcuaaaag

SEQ ID NO: 1080134 - RNA, 22 nt, Human
aggaacacaacuuccugagagc

SEQ ID NO: 1080135 - RNA, 22 nt, Human
uucuccagcucaucagggaggg

SEQ ID NO: 1080136 - RNA, 22 nt, Human
caucaguucaugucuagcugcu

SEQ ID NO: 1080137 - RNA, 22 nt, Human
ugccugggagugaccaagacuc

SEQ ID NO: 1080138 - RNA, 22 nt, Human
auccaaagcccuaaguuaacug

SEQ ID NO: 1080139 - RNA, 22 nt, Human
aauucacuguuccuucugcuuu

SEQ ID NO: 1080140 - RNA, 22 nt, Human
cugggcuccuaaccauccaggu

SEQ ID NO: 1080141 - RNA, 22 nt, Human
gaaaccucuuagccucucuuug

SEQ ID NO: 1080142 - RNA, 22 nt, Human
agggagaacaguugcagcagac

SEQ ID NO: 1080143 - RNA, 22 nt, Human
ccagcugcgggcaucgagaguu

SEQ ID NO: 1080144 - RNA, 22 nt, Human
ggcugcagguugguuggcagcu

SEQ ID NO: 1080145 - RNA, 22 nt, Human
ucagaguguuuuacuaaacaag

SEQ ID NO: 1080146 - RNA, 22 nt, Human
ggcucuggguucugcaaugcgu

SEQ ID NO: 1080147 - RNA, 22 nt, Human
gcagacagccagacugcacugg

SEQ ID NO: 1080148 - RNA, 22 nt, Human
ugaauaguccuuggaauaacug

SEQ ID NO: 1080149 - RNA, 22 nt, Human
ggcaccaggcugggcauaggcc

SEQ ID NO: 1080150 - RNA, 22 nt, Human
ggucugagcuugagcccaugcu

SEQ ID NO: 1080151 - RNA, 22 nt, Human
auuuuguuuccuuuggaguaga

SEQ ID NO: 1080152 - RNA, 22 nt, Human
ucagaaaugaucguuauucauu

SEQ ID NO: 1080153 - RNA, 17 nt, Human
ugccugugauaagcaca

SEQ ID NO: 1080154 - RNA, 22 nt, Human
agaaacaucgcuuaguccucau

SEQ ID NO: 1080155 - RNA, 22 nt, Human
agccccaguccgcugcgggcgg

SEQ ID NO: 1080156 - RNA, 22 nt, Human
gucuuuuugucuggcagagguc

SEQ ID NO: 1080157 - RNA, 22 nt, Human
agugucugccugggaggagcau

SEQ ID NO: 1080158 - RNA, 20 nt, Human
auacacauauucuugcaacu

SEQ ID NO: 1080159 - RNA, 22 nt, Human
cacaaucauaauguauguacau

SEQ ID NO: 1080160 - RNA, 22 nt, Human
aaacuguaagagaauaaacuac

SEQ ID NO: 1080161 - RNA, 22 nt, Human
uuuucuuacugucugugauccu

SEQ ID NO: 1080162 - RNA, 22 nt, Human
uuuuuccacauacccuaggcca

SEQ ID NO: 1080163 - RNA, 22 nt, Human
ucaggccacuucacaggugauu

SEQ ID NO: 1080164 - RNA, 22 nt, Human
uucuggauguuguagucugaga

SEQ ID NO: 1080165 - RNA, 22 nt, Human
gccaggcuggaaagaacagaca

SEQ ID NO: 1080166 - RNA, 22 nt, Human
cucacagcagcucugcgagaua

SEQ ID NO: 1080167 - RNA, 22 nt, Human
gggcuacauugugagagaaguu

SEQ ID NO: 1080168 - RNA, 22 nt, Human
caugggagcuaucuccaucacu

SEQ ID NO: 1080169 - RNA, 22 nt, Human
caggccuggcugcagcucgccu

SEQ ID NO: 1080170 - RNA, 22 nt, Human
auuucugugcaguaaaugguga

SEQ ID NO: 1080171 - RNA, 22 nt, Human
ucuguuucuccaacauugugag

SEQ ID NO: 1080172 - RNA, 22 nt, Human
aaggaggcacucgcucucaggg

SEQ ID NO: 1080173 - RNA, 22 nt, Human
cucaaguaagaaacagaauugg

SEQ ID NO: 1080174 - RNA, 22 nt, Human
auguuuuaaauauguguguaaa

SEQ ID NO: 1080175 - RNA, 22 nt, Human
uauuucaugugcaccauaauuc

SEQ ID NO: 1080176 - RNA, 22 nt, Human
cugaagcacagcauauaaauaa

SEQ ID NO: 1080177 - RNA, 22 nt, Human
agggcagcaaugcagcugcugc

SEQ ID NO: 1080178 - RNA, 22 nt, Human
uuaugcuaaaugaaucaaguca

SEQ ID NO: 1080179 - RNA, 22 nt, Human
gguucaguuuacauuaaaaucu

SEQ ID NO: 1080180 - RNA, 22 nt, Human
augguuuguaacccaauacucc

SEQ ID NO: 1080181 - RNA, 22 nt, Human
ccugcucugccaaguccucuuu

SEQ ID NO: 1080182 - RNA, 22 nt, Human
uuaauaauaaugagcccauuuu

SEQ ID NO: 1080183 - RNA, 19 nt, Human
ucaaaugccaaugucacag

SEQ ID NO: 1080184 - RNA, 22 nt, Human
gcaggcucagagcagauuagca

SEQ ID NO: 1080185 - RNA, 22 nt, Human
cuggcaguguccagcucgugau

SEQ ID NO: 1080186 - RNA, 22 nt, Human
ugcuucaaggacacugacuuuu

SEQ ID NO: 1080187 - RNA, 22 nt, Human
acccaggagccgugagagguua

SEQ ID NO: 1080188 - RNA, 22 nt, Human
aucacuaugggcauuauauuua

SEQ ID NO: 1080189 - RNA, 22 nt, Human
gucagaucuuuggggaugcugu

SEQ ID NO: 1080190 - RNA, 22 nt, Human
aggcuuaacuuaacuuuagagc

SEQ ID NO: 1080191 - RNA, 22 nt, Human
ucauaaaguuacccaaauuuua

SEQ ID NO: 1080192 - RNA, 22 nt, Human
gcugggcugagaaguuaagcaa

SEQ ID NO: 1080193 - RNA, 22 nt, Human
cagugauaggacagcuagaacu

SEQ ID NO: 1080194 - RNA, 22 nt, Human
acuucucucauucagacauagc

SEQ ID NO: 1080195 - RNA, 22 nt, Human
agcucccagggcugggcaaguu

SEQ ID NO: 1080196 - RNA, 20 nt, Human
agugggagagggcagacugc

SEQ ID NO: 1080197 - RNA, 22 nt, Human
ugaacaugcuguugauggccug

SEQ ID NO: 1080198 - RNA, 19 nt, Human
ggccuugaugaguggggag

SEQ ID NO: 1080199 - RNA, 22 nt, Human
cucuggacagcaggugcugugg

SEQ ID NO: 1080200 - RNA, 22 nt, Human
caggaaaaaugccaggagucag

SEQ ID NO: 1080201 - RNA, 22 nt, Human
uuuguuuacaaaaauaagcagu

SEQ ID NO: 1080202 - RNA, 22 nt, Human
agcaggugggaucaagcuggca

SEQ ID NO: 1080203 - RNA, 22 nt, Human
uucugaugaggaggucucuaag

SEQ ID NO: 1080204 - RNA, 22 nt, Human
ccuguaacuccuuggcucaagu

SEQ ID NO: 1080205 - RNA, 22 nt, Human
gccucugcaccaguacugugcc

SEQ ID NO: 1080206 - RNA, 22 nt, Human
aguaacaguaacaucuuccuag

SEQ ID NO: 1080207 - RNA, 23 nt, Human
ggaaagagaggaguugugcauag

SEQ ID NO: 1080208 - RNA, 22 nt, Human
uuucaaagguuuugucaugucu

SEQ ID NO: 1080209 - RNA, 22 nt, Human
ugggccaggugcagugcuuuag

SEQ ID NO: 1080210 - RNA, 22 nt, Human
gcaccaggcagcugagcaggcc

SEQ ID NO: 1080211 - RNA, 22 nt, Human
gaggcugguaggaaaggaaaca

SEQ ID NO: 1080212 - RNA, 22 nt, Human
cacuacuugaaagaauuacaga

SEQ ID NO: 1080213 - RNA, 22 nt, Human
ucugagugauguugagucagaa

SEQ ID NO: 1080214 - RNA, 22 nt, Human
augccuuuuuaucauggaugau

SEQ ID NO: 1080215 - RNA, 20 nt, Human
aggcucagagcaguaguaca

SEQ ID NO: 1080216 - RNA, 22 nt, Human
ccucccacuucuugcugagguc

SEQ ID NO: 1080217 - RNA, 22 nt, Human
ucaucuaagagucuuacauuua

SEQ ID NO: 1080218 - RNA, 22 nt, Human
cugcuuuggcagaagucagcua

SEQ ID NO: 1080219 - RNA, 22 nt, Human
aggugcuggagucugggcagga

SEQ ID NO: 1080220 - RNA, 22 nt, Human
aggaaccagacagaacugaaug

SEQ ID NO: 1080221 - RNA, 22 nt, Human
caggaauaguggagcaacaaga

SEQ ID NO: 1080222 - RNA, 22 nt, Human
ggcacugacacuagcauggcac

SEQ ID NO: 1080223 - RNA, 22 nt, Human
uguggggcugugguguucuucu

SEQ ID NO: 1080224 - RNA, 22 nt, Human
cagcacacagugacucgcaccu

SEQ ID NO: 1080225 - RNA, 22 nt, Human
ccccuuccuuccucagacagcc

SEQ ID NO: 1080226 - RNA, 22 nt, Human
ucugucaauuauucacauaggc

SEQ ID NO: 1080227 - RNA, 22 nt, Human
ugccuuuuguuagggcugccag

SEQ ID NO: 1080228 - RNA, 22 nt, Human
aaacagugcaggaaguuaagca

SEQ ID NO: 1080229 - RNA, 22 nt, Human
acugugcuuucucuggaggcau

SEQ ID NO: 1080230 - RNA, 22 nt, Human
uuucauggcuaggacuagagug

SEQ ID NO: 1080231 - RNA, 22 nt, Human
uauugcaagcaauuccaaaagg

SEQ ID NO: 1080232 - RNA, 22 nt, Human
agcugcugagccauguccugcu

SEQ ID NO: 1080233 - RNA, 23 nt, Human
auuugagaaaguauuuuuaagac

SEQ ID NO: 1080234 - RNA, 22 nt, Human
uccauuuucaucucauguauaa

SEQ ID NO: 1080235 - RNA, 22 nt, Human
ggcacuuuucuccccggucaug

SEQ ID NO: 1080236 - RNA, 21 nt, Human
guuuguaaggcacuguguucu

SEQ ID NO: 1080237 - RNA, 22 nt, Human
ugcacacagccagugaguggca

SEQ ID NO: 1080238 - RNA, 22 nt, Human
acaguauauaugguuaucugau

SEQ ID NO: 1080239 - RNA, 21 nt, Human
cuacagaaucgagcauucugg

SEQ ID NO: 1080240 - RNA, 22 nt, Human
ggguaauuggggccuugcagug

SEQ ID NO: 1080241 - RNA, 22 nt, Human
ucucagagggaaacaugaguga

SEQ ID NO: 1080242 - RNA, 22 nt, Human
ucagccauggugagagugagag

SEQ ID NO: 1080243 - RNA, 22 nt, Human
agacacagcuaccauaauacca

SEQ ID NO: 1080244 - RNA, 22 nt, Human
gcuaacauugauucagugccug

SEQ ID NO: 1080245 - RNA, 22 nt, Human
ucaaaggcccauugucccguug

SEQ ID NO: 1080246 - RNA, 22 nt, Human
agugcaugccuuccuguggaug

SEQ ID NO: 1080247 - RNA, 22 nt, Human
agguggguaucaugagagauua

SEQ ID NO: 1080248 - RNA, 22 nt, Human
gaagccaguacugugcucugca

SEQ ID NO: 1080249 - RNA, 20 nt, Human
gcugaagauucccaugcaag

SEQ ID NO: 1080250 - RNA, 22 nt, Human
cugggccugucccugauugagg

SEQ ID NO: 1080251 - RNA, 22 nt, Human
caauuucauuaauagauauaga

SEQ ID NO: 1080252 - RNA, 22 nt, Human
agccaggggauucaucagggac

SEQ ID NO: 1080253 - RNA, 19 nt, Human
ccaggccuccugggagguc

SEQ ID NO: 1080254 - RNA, 22 nt, Human
ugcagauucaaaugaaaugcaa

SEQ ID NO: 1080255 - RNA, 22 nt, Human
cacaugggugugccuggaggaa

SEQ ID NO: 1080256 - RNA, 22 nt, Human
ucacccuugauaauguucuucu

SEQ ID NO: 1080257 - RNA, 22 nt, Human
uggcugcuagccagagcuucag

SEQ ID NO: 1080258 - RNA, 20 nt, Human
cucuccucacccgugucagg

SEQ ID NO: 1080259 - RNA, 22 nt, Human
uaaaugauuuauguaugugaaa

SEQ ID NO: 1080260 - RNA, 22 nt, Human
uugaauucauuucucauugagu

SEQ ID NO: 1080261 - RNA, 22 nt, Human
aaggccugcucagcugucugug

SEQ ID NO: 1080262 - RNA, 22 nt, Human
caaagcagagccagagcuuguc

SEQ ID NO: 1080263 - RNA, 21 nt, Human
aaagaaaucucccauugguag

SEQ ID NO: 1080264 - RNA, 22 nt, Human
caggcuccucacucaugcuccc

SEQ ID NO: 1080265 - RNA, 22 nt, Human
cugccacuagcuuucacaucuu

SEQ ID NO: 1080266 - RNA, 17 nt, Human
gccaguugucuuggcau

SEQ ID NO: 1080267 - RNA, 22 nt, Human
uguggcagaaccagaauucaaa

SEQ ID NO: 1080268 - RNA, 22 nt, Human
uuucaaguggggacauuugaga

SEQ ID NO: 1080269 - RNA, 22 nt, Human
aggagcccugcgggaggcagag

SEQ ID NO: 1080270 - RNA, 22 nt, Human
uccuggcccgaucccugugaag

SEQ ID NO: 1080271 - RNA, 22 nt, Human
ccugccaggccagugagcuucc

SEQ ID NO: 1080272 - RNA, 23 nt, Human
aauuacaaccaagaacuggaagg

SEQ ID NO: 1080273 - RNA, 22 nt, Human
cugcucuggucucuucauguuu

SEQ ID NO: 1080274 - RNA, 22 nt, Human
uguuucuaggucaauaauuuuu

SEQ ID NO: 1080275 - RNA, 23 nt, Human
agugcugaauugaaagcuccagg

SEQ ID NO: 1080276 - RNA, 22 nt, Human
ggcuggaaguccaagaucaaga

SEQ ID NO: 1080277 - RNA, 22 nt, Human
cugggccacaagccugugugau

SEQ ID NO: 1080278 - RNA, 22 nt, Human
gcuggcagguccaagauagagc

SEQ ID NO: 1080279 - RNA, 22 nt, Human
uaaauguuuagucuuauuuggg

SEQ ID NO: 1080280 - RNA, 19 nt, Human
gggucgggaaguugagaau

SEQ ID NO: 1080281 - RNA, 20 nt, Human
cagcucugggaaagaggcca

SEQ ID NO: 1080282 - RNA, 22 nt, Human
uaugaagaaguucugugaaaug

SEQ ID NO: 1080283 - RNA, 19 nt, Human
aauacaguguuauagaauu

SEQ ID NO: 1080284 - RNA, 22 nt, Human
cauuucaaguaacagauugcuu

SEQ ID NO: 1080285 - RNA, 23 nt, Human
uggagcugggcucagacccuggg

SEQ ID NO: 1080286 - RNA, 22 nt, Human
uaauacauuaccuaaccucucu

SEQ ID NO: 1080287 - RNA, 22 nt, Human
uacuugccaucagaguuuauua

SEQ ID NO: 1080288 - RNA, 22 nt, Human
agcugcucugggaaacagaagu

SEQ ID NO: 1080289 - RNA, 22 nt, Human
ccuggcaguggugaagaagagg

SEQ ID NO: 1080290 - RNA, 22 nt, Human
agaagcuggaggaagacuaagc

SEQ ID NO: 1080291 - RNA, 22 nt, Human
cgucuuccucuuacgaugcgcu

SEQ ID NO: 1080292 - RNA, 22 nt, Human
uagacagauuuaaaggaaugga

SEQ ID NO: 1080293 - RNA, 22 nt, Human
cugcccaggaaggagaggaugg

SEQ ID NO: 1080294 - RNA, 22 nt, Human
agcauuuaauccuacauagauc

SEQ ID NO: 1080295 - RNA, 18 nt, Human
ccaaggccccugcugggg

SEQ ID NO: 1080296 - RNA, 22 nt, Human
agcccagaggcugggcgugcau

SEQ ID NO: 1080297 - RNA, 22 nt, Human
ucuuuuggguucuuaugauuua

SEQ ID NO: 1080298 - RNA, 22 nt, Human
gagaggcuuaagggcugugaag

SEQ ID NO: 1080299 - RNA, 22 nt, Human
gcagggucgcucuaggagauca

SEQ ID NO: 1080300 - RNA, 22 nt, Human
acauuuaaccuuugaggaacug

SEQ ID NO: 1080301 - RNA, 22 nt, Human
uggccuggggaccugugagacc

SEQ ID NO: 1080302 - RNA, 22 nt, Human
gcaugggcuuucucagaguucu

SEQ ID NO: 1080303 - RNA, 20 nt, Human
ugaaggccagcagcauaggg

SEQ ID NO: 1080304 - RNA, 22 nt, Human
ggcacugauaauguccucucuc

SEQ ID NO: 1080305 - RNA, 22 nt, Human
uggggcagcagaccuuucuugg

SEQ ID NO: 1080306 - RNA, 22 nt, Human
ggcaggguccacaccugggaaa

SEQ ID NO: 1080307 - RNA, 22 nt, Human
cccucagcucaagccccugugc

SEQ ID NO: 1080308 - RNA, 21 nt, Human
agaauucuuaaguauucuaau

SEQ ID NO: 1080309 - RNA, 22 nt, Human
augagguuugagccucuugacc

SEQ ID NO: 1080310 - RNA, 22 nt, Human
caaaggcaguuacugaaugaag

SEQ ID NO: 1080311 - RNA, 22 nt, Human
agaugcugugucuguucccuug

SEQ ID NO: 1080312 - RNA, 22 nt, Human
cccagccucugggcucacccaa

SEQ ID NO: 1080313 - RNA, 22 nt, Human
caggagcccugguggguggaca

SEQ ID NO: 1080314 - RNA, 22 nt, Human
uugcaugcaccuaacaaauuau

SEQ ID NO: 1080315 - RNA, 22 nt, Human
guauuuucaugauuucagacca

SEQ ID NO: 1080316 - RNA, 22 nt, Human
acccuguaugcuauaucccuaa

SEQ ID NO: 1080317 - RNA, 22 nt, Human
uuaacauuguccuuagcagauu

SEQ ID NO: 1080318 - RNA, 22 nt, Human
aucaagaaaagugcuuucggcu

SEQ ID NO: 1080319 - RNA, 22 nt, Human
acaaaguaggcagugggcugga

SEQ ID NO: 1080320 - RNA, 22 nt, Human
uauuuguccagguaaauuucag

SEQ ID NO: 1080321 - RNA, 22 nt, Human
acccucaguaaucgugcaguuu

SEQ ID NO: 1080322 - RNA, 22 nt, Human
auguuucaugacugagcaaaau

SEQ ID NO: 1080323 - RNA, 22 nt, Human
guggagaccuccuaggaugugu

SEQ ID NO: 1080324 - RNA, 22 nt, Human
gcugucacaagcaucuggggca

SEQ ID NO: 1080325 - RNA, 22 nt, Human
cauggaacugugcugaaaagug

SEQ ID NO: 1080326 - RNA, 22 nt, Human
caguggguccuaaguacaguuc

SEQ ID NO: 1080327 - RNA, 22 nt, Human
uuuaccuaguauaaugcaaccu

SEQ ID NO: 1080328 - RNA, 21 nt, Human
caccugugagacucucagacc

SEQ ID NO: 1080329 - RNA, 22 nt, Human
ggccucgcggcuucugguggcu

SEQ ID NO: 1080330 - RNA, 22 nt, Human
gggcuucucuuuagugagcuga

SEQ ID NO: 1080331 - RNA, 22 nt, Human
uuucauaaccucaagcuacagu

SEQ ID NO: 1080332 - RNA, 22 nt, Human
uuggcauuggagaugcaagaac

SEQ ID NO: 1080333 - RNA, 21 nt, Human
ccagucuguaaaauggggaca

SEQ ID NO: 1080334 - RNA, 22 nt, Human
aguacuuuacuucuuacaguuu

SEQ ID NO: 1080335 - RNA, 22 nt, Human
agacuucucaguuuuauuagua

SEQ ID NO: 1080336 - RNA, 22 nt, Human
uggugugggcguggcaggcaag

SEQ ID NO: 1080337 - RNA, 21 nt, Human
agacagaacaacugcucucca

SEQ ID NO: 1080338 - RNA, 22 nt, Human
ccauuuaguaaggaagaacagc

SEQ ID NO: 1080339 - RNA, 22 nt, Human
cugcuuccauaaauaaugugcu

SEQ ID NO: 1080340 - RNA, 19 nt, Human
uguugccagguaucauguu

SEQ ID NO: 1080341 - RNA, 19 nt, Human
agcaccugugagagccugg

SEQ ID NO: 1080342 - RNA, 23 nt, Human
aaguaccuacacauuauuucaga

SEQ ID NO: 1080343 - RNA, 22 nt, Human
gaaggcugcugggaaguguggu

SEQ ID NO: 1080344 - RNA, 22 nt, Human
gcuccuucaggugguagcuguu

SEQ ID NO: 1080345 - RNA, 22 nt, Human
auauuucagguuuugcaggccg

SEQ ID NO: 1080346 - RNA, 22 nt, Human
uggcuaggacucauccuguuuc

SEQ ID NO: 1080347 - RNA, 22 nt, Human
aggcacugacaauucuggacug

SEQ ID NO: 1080348 - RNA, 22 nt, Human
acuuccaggaacugccgcuaac

SEQ ID NO: 1080349 - RNA, 22 nt, Human
uucuguaugccaauggguuuuu

SEQ ID NO: 1080350 - RNA, 22 nt, Human
aguauuucugcucaugaaagag

SEQ ID NO: 1080351 - RNA, 22 nt, Human
ccuggcaggccccuccuggauu

SEQ ID NO: 1080352 - RNA, 22 nt, Human
uaggggugaggccaggcaucag

SEQ ID NO: 1080353 - RNA, 22 nt, Human
aggcugagcuggcccuugaaau

SEQ ID NO: 1080354 - RNA, 22 nt, Human
ggggagugacgcagggccauag

SEQ ID NO: 1080355 - RNA, 22 nt, Human
ucuuuacaagucacauuuucug

SEQ ID NO: 1080356 - RNA, 22 nt, Human
ucugccuuggcaaccacagcuu

SEQ ID NO: 1080357 - RNA, 22 nt, Human
uacugugacagaguacuuaaac

SEQ ID NO: 1080358 - RNA, 22 nt, Human
aagacccacaaggcugaauguu

SEQ ID NO: 1080359 - RNA, 22 nt, Human
agggcagaaauauugauacugu

SEQ ID NO: 1080360 - RNA, 22 nt, Human
aaaugcagccuagcucaguuuu

SEQ ID NO: 1080361 - RNA, 22 nt, Human
gcuggccugcaaagcccggcug

SEQ ID NO: 1080362 - RNA, 22 nt, Human
gcucugggaauucagaaagccu

SEQ ID NO: 1080363 - RNA, 22 nt, Human
cugggagcccugacuagccugg

SEQ ID NO: 1080364 - RNA, 22 nt, Human
gagagcuggguucaaguagcug

SEQ ID NO: 1080365 - RNA, 20 nt, Human
cugagcccuuccugugaacc

SEQ ID NO: 1080366 - RNA, 22 nt, Human
cugcugugaguuuggaggucua

SEQ ID NO: 1080367 - RNA, 18 nt, Human
aggggcagcuugugugga

SEQ ID NO: 1080368 - RNA, 22 nt, Human
ggcaggcacauuugggggccgu

SEQ ID NO: 1080369 - RNA, 22 nt, Human
uacacuuuuuacuacagauucu

SEQ ID NO: 1080370 - RNA, 22 nt, Human
cugcugugcagacagacucucu

SEQ ID NO: 1080371 - RNA, 22 nt, Human
gcugggcuucaccuccagaguu

SEQ ID NO: 1080372 - RNA, 22 nt, Human
ggcugaguugagaggauuacuu

SEQ ID NO: 1080373 - RNA, 22 nt, Human
aagaagcuaagacuaucugggu

SEQ ID NO: 1080374 - RNA, 22 nt, Human
ucaggaagaaagaagggagugu

SEQ ID NO: 1080375 - RNA, 22 nt, Human
acagcuggaggccccauugucc

SEQ ID NO: 1080376 - RNA, 22 nt, Human
gcuggacaggccacauggagga

SEQ ID NO: 1080377 - RNA, 22 nt, Human
gggaggugaaagguugcugcag

SEQ ID NO: 1080378 - RNA, 20 nt, Human
guccugggagccacagcaca

SEQ ID NO: 1080379 - RNA, 18 nt, Human
aguguuuauuuaggugaa

SEQ ID NO: 1080380 - RNA, 22 nt, Human
ggugaggguaaauauaggcaaa

SEQ ID NO: 1080381 - RNA, 22 nt, Human
cuggagcuaggaaguccaagau

SEQ ID NO: 1080382 - RNA, 22 nt, Human
uuguguaacuugagcaaacaca

SEQ ID NO: 1080383 - RNA, 22 nt, Human
uggcugccuuucaccucaucuc

SEQ ID NO: 1080384 - RNA, 22 nt, Human
gcccccucuuuggagccagcca

SEQ ID NO: 1080385 - RNA, 22 nt, Human
uauuuggagcugugugagcuca

SEQ ID NO: 1080386 - RNA, 22 nt, Human
uuugcagcaaggagagagcauu

SEQ ID NO: 1080387 - RNA, 22 nt, Human
ggccucugaggacagccuuggc

SEQ ID NO: 1080388 - RNA, 22 nt, Human
cauuguuaauugguaucuuaca

SEQ ID NO: 1080389 - RNA, 22 nt, Human
ucccaagauacgcuguaagaag

SEQ ID NO: 1080390 - RNA, 22 nt, Human
ggucccaggcugcgggcuggug

SEQ ID NO: 1080391 - RNA, 22 nt, Human
uuacugauggaacagagauaga

SEQ ID NO: 1080392 - RNA, 22 nt, Human
agcugaaggcuagaacagcugg

SEQ ID NO: 1080393 - RNA, 22 nt, Human
gagggaggcaucaugaauccag

SEQ ID NO: 1080394 - RNA, 22 nt, Human
uucuuacauauuuucauauggu

SEQ ID NO: 1080395 - RNA, 22 nt, Human
ccaggaagcggugagggcugcc

SEQ ID NO: 1080396 - RNA, 22 nt, Human
ccagcugggauuaagggaaaau

SEQ ID NO: 1080397 - RNA, 22 nt, Human
ugggcucauggcccagcacugg

SEQ ID NO: 1080398 - RNA, 22 nt, Human
gccaguggcaugcggcagggac

SEQ ID NO: 1080399 - RNA, 22 nt, Human
uucaacaaaauauauuuuucca

SEQ ID NO: 1080400 - RNA, 22 nt, Human
cugguggguagagggcaucagg

SEQ ID NO: 1080401 - RNA, 22 nt, Human
caagucaaagacuagaacuagu

SEQ ID NO: 1080402 - RNA, 22 nt, Human
uggcauuugagcuggaaggaug

SEQ ID NO: 1080403 - RNA, 22 nt, Human
aaucagaaucaguugacacagc

SEQ ID NO: 1080404 - RNA, 22 nt, Human
caggguggcacaucacagcauu

SEQ ID NO: 1080405 - RNA, 22 nt, Human
ugugaaaucugaugaauugacc

SEQ ID NO: 1080406 - RNA, 22 nt, Human
acuugguguauuagcucucacu

SEQ ID NO: 1080407 - RNA, 22 nt, Human
aaaggccagguuggcugguauu

SEQ ID NO: 1080408 - RNA, 22 nt, Human
ccacugucuuuuccaggcugaa

SEQ ID NO: 1080409 - RNA, 22 nt, Human
agcagggguaacagaaggaaag

SEQ ID NO: 1080410 - RNA, 22 nt, Human
uguauagaguuggaagaugacu

SEQ ID NO: 1080411 - RNA, 22 nt, Human
uuuuuuccagcuucuagaggcc

SEQ ID NO: 1080412 - RNA, 22 nt, Human
uacaguauuaugagugauugaa

SEQ ID NO: 1080413 - RNA, 21 nt, Human
uccucagggccccagagcacu

SEQ ID NO: 1080414 - RNA, 22 nt, Human
ucagaggauagaaauacuuauu

SEQ ID NO: 1080415 - RNA, 23 nt, Human
cuugcagggcuggaggcuuagaa

SEQ ID NO: 1080416 - RNA, 22 nt, Human
gggcccacuggcugucugaccc

SEQ ID NO: 1080417 - RNA, 22 nt, Human
agcccugcuucaccauuuacuu

SEQ ID NO: 1080418 - RNA, 22 nt, Human
uuacagcacagugcuuuuacug

SEQ ID NO: 1080419 - RNA, 22 nt, Human
ugcagaugccugggcugcacca

SEQ ID NO: 1080420 - RNA, 22 nt, Human
gggcagcacagacagugaaggc

SEQ ID NO: 1080421 - RNA, 22 nt, Human
ugcagcaauuugcaguaauuua

SEQ ID NO: 1080422 - RNA, 20 nt, Human
acauuugaguaucaucuacu

SEQ ID NO: 1080423 - RNA, 22 nt, Human
cucccacuccuggcucaccaca

SEQ ID NO: 1080424 - RNA, 23 nt, Human
cagaagcaccuguugacugcugc

SEQ ID NO: 1080425 - RNA, 20 nt, Human
gggagaagggcugaugagag

SEQ ID NO: 1080426 - RNA, 22 nt, Human
gggugcagggucuccagcagcu

SEQ ID NO: 1080427 - RNA, 22 nt, Human
cugcugagagcugaaggcugua

SEQ ID NO: 1080428 - RNA, 22 nt, Human
ugagccagccuugcagcugugc

SEQ ID NO: 1080429 - RNA, 23 nt, Human
aggauccugguacaggagcagag

SEQ ID NO: 1080430 - RNA, 22 nt, Human
gacauaaaauggaauucuguug

SEQ ID NO: 1080431 - RNA, 22 nt, Human
aagccaggcugcacuugcuggg

SEQ ID NO: 1080432 - RNA, 22 nt, Human
cuauuuuucuguacccuaauuu

SEQ ID NO: 1080433 - RNA, 21 nt, Human
aaugaugaaagaugacagagu

SEQ ID NO: 1080434 - RNA, 22 nt, Human
cauuucacgcacacucauuacu

SEQ ID NO: 1080435 - RNA, 22 nt, Human
caggaaacggcuauucuuuugu

SEQ ID NO: 1080436 - RNA, 22 nt, Human
aggaacacaaugcuucugugug

SEQ ID NO: 1080437 - RNA, 22 nt, Human
ggagagaacugaccugaaagga

SEQ ID NO: 1080438 - RNA, 22 nt, Human
cauuugaacuaauaacugugcu

SEQ ID NO: 1080439 - RNA, 22 nt, Human
cccuucagcugagugggacagc

SEQ ID NO: 1080440 - RNA, 22 nt, Human
gggcugagccacagcuuuuguu

SEQ ID NO: 1080441 - RNA, 22 nt, Human
ggcaggugacggggaugaguau

SEQ ID NO: 1080442 - RNA, 22 nt, Human
cauucuuauauuuacucauuca

SEQ ID NO: 1080443 - RNA, 22 nt, Human
uccaggccccacugaagccccu

SEQ ID NO: 1080444 - RNA, 22 nt, Human
ucagggcacaggccuguggguu

SEQ ID NO: 1080445 - RNA, 22 nt, Human
cucuccagccacagaagcugcu

SEQ ID NO: 1080446 - RNA, 22 nt, Human
cacauguaguaagcaggcaaug

SEQ ID NO: 1080447 - RNA, 22 nt, Human
auugcuggcugccaucuugccc

SEQ ID NO: 1080448 - RNA, 22 nt, Human
ugccugggugcuggcuggucac

SEQ ID NO: 1080449 - RNA, 22 nt, Human
uuccacauuccuuacauucaua

SEQ ID NO: 1080450 - RNA, 22 nt, Human
ccaggcauccauugcuuccucu

SEQ ID NO: 1080451 - RNA, 22 nt, Human
uccugaccugaacuggggucuu

SEQ ID NO: 1080452 - RNA, 20 nt, Human
ggaagccagcauccuugagg

SEQ ID NO: 1080453 - RNA, 22 nt, Human
agacagggucuugaucagagcu

SEQ ID NO: 1080454 - RNA, 20 nt, Human
acugggccuaggggaggcau

SEQ ID NO: 1080455 - RNA, 22 nt, Human
cccagcucaagcagagagcuaa

SEQ ID NO: 1080456 - RNA, 18 nt, Human
gugcaaugaauagcagag

SEQ ID NO: 1080457 - RNA, 22 nt, Human
gcugccaauccagcugugggag

SEQ ID NO: 1080458 - RNA, 22 nt, Human
cugcugagccuggugcgggaug

SEQ ID NO: 1080459 - RNA, 22 nt, Human
uuugcauuuugauaagaucacu

SEQ ID NO: 1080460 - RNA, 22 nt, Human
guucacagauccuugaagccag

SEQ ID NO: 1080461 - RNA, 22 nt, Human
ucuuuccagaggaauuuuuaga

SEQ ID NO: 1080462 - RNA, 20 nt, Human
ggcugcaggacucauuggcu

SEQ ID NO: 1080463 - RNA, 22 nt, Human
gagcagcuccagccgcaugacu

SEQ ID NO: 1080464 - RNA, 18 nt, Human
uggcagggaggaaauaua

SEQ ID NO: 1080465 - RNA, 22 nt, Human
gagcugggcacacgccacuuga

SEQ ID NO: 1080466 - RNA, 21 nt, Human
guucaaauggguagauucaca

SEQ ID NO: 1080467 - RNA, 22 nt, Human
aggaagacaaucugugugcugu

SEQ ID NO: 1080468 - RNA, 19 nt, Human
gcgaggaagucacuguggc

SEQ ID NO: 1080469 - RNA, 22 nt, Human
caaaugaagggagcugaagucu

SEQ ID NO: 1080470 - RNA, 22 nt, Human
ugguccuggggaucugcaguga

SEQ ID NO: 1080471 - RNA, 22 nt, Human
aaucaguuaaauauugaguaca

SEQ ID NO: 1080472 - RNA, 23 nt, Human
agcagugaguaaacagauaggau

SEQ ID NO: 1080473 - RNA, 22 nt, Human
guguucuuuauuuagugaugcu

SEQ ID NO: 1080474 - RNA, 22 nt, Human
uaggaacaaaagguuuuccuga

SEQ ID NO: 1080475 - RNA, 22 nt, Human
ugaggcaggacuugcauaaagu

SEQ ID NO: 1080476 - RNA, 22 nt, Human
auagauguucaaucagauauuu

SEQ ID NO: 1080477 - RNA, 22 nt, Human
gaggguccccaugcagagcuca

SEQ ID NO: 1080478 - RNA, 22 nt, Human
caggggcaggugugagaucauc

SEQ ID NO: 1080479 - RNA, 22 nt, Human
acagguggcuuauuggcugauu

SEQ ID NO: 1080480 - RNA, 18 nt, Human
agcagggcauuuugccau

SEQ ID NO: 1080481 - RNA, 22 nt, Human
uuucuaaaauagauuuuauggu

SEQ ID NO: 1080482 - RNA, 22 nt, Human
acguguucaauuuccaucugac

SEQ ID NO: 1080483 - RNA, 22 nt, Human
aagacauuuauuugaaucaauu

SEQ ID NO: 1080484 - RNA, 22 nt, Human
auucuguauggaaaagcacuau

SEQ ID NO: 1080485 - RNA, 22 nt, Human
aggcugaggagggauguugcuu

SEQ ID NO: 1080486 - RNA, 22 nt, Human
aaaugucuuuaucucauguaac

SEQ ID NO: 1080487 - RNA, 22 nt, Human
guuauuagaagugaaggauugu

SEQ ID NO: 1080488 - RNA, 22 nt, Human
cuagaaauauuuuacagucaag

SEQ ID NO: 1080489 - RNA, 22 nt, Human
gggcucagagcauuuggguugg

SEQ ID NO: 1080490 - RNA, 22 nt, Human
agaauaguggcaaugacugcac

SEQ ID NO: 1080491 - RNA, 22 nt, Human
gcagggcaucccugagcgggug

SEQ ID NO: 1080492 - RNA, 21 nt, Human
agaguaauuccugcuggaaag

SEQ ID NO: 1080493 - RNA, 22 nt, Human
gagauggcaggugugugggaca

SEQ ID NO: 1080494 - RNA, 22 nt, Human
uggcccugcuaugauccugcaa

SEQ ID NO: 1080495 - RNA, 22 nt, Human
uuccaaguuaggcgagcuggug

SEQ ID NO: 1080496 - RNA, 22 nt, Human
caugcugugugguuagaacugu

SEQ ID NO: 1080497 - RNA, 22 nt, Human
cuguccugauggugccacuggu

SEQ ID NO: 1080498 - RNA, 22 nt, Human
gaagaaagaucaaauaguuucc

SEQ ID NO: 1080499 - RNA, 22 nt, Human
uggaaauuacuaacacuuagag

SEQ ID NO: 1080500 - RNA, 22 nt, Human
cuucuuaaugcauaaacugugu

SEQ ID NO: 1080501 - RNA, 22 nt, Human
ccucugcaaagaauuugucucc

SEQ ID NO: 1080502 - RNA, 22 nt, Human
uuugaaauguaucaguauaggu

SEQ ID NO: 1080503 - RNA, 22 nt, Human
uucaaucauuccaacacuuuaa

SEQ ID NO: 1080504 - RNA, 22 nt, Human
caggaugguggcaugaucagaa

SEQ ID NO: 1080505 - RNA, 22 nt, Human
aguggucuagucugaggauuau

SEQ ID NO: 1080506 - RNA, 22 nt, Human
agcaguuaugugucucuugacu

SEQ ID NO: 1080507 - RNA, 22 nt, Human
agcuucucaggagucugaggca

SEQ ID NO: 1080508 - RNA, 22 nt, Human
aauugagaugacagaggaauag

SEQ ID NO: 1080509 - RNA, 22 nt, Human
ugcuaagucacucaagaccucu

SEQ ID NO: 1080510 - RNA, 22 nt, Human
acaggaacgaauguacauuguu

SEQ ID NO: 1080511 - RNA, 22 nt, Human
caucacaaauguaauaaugucu

SEQ ID NO: 1080512 - RNA, 22 nt, Human
gagguauguaugcuacauucuu

SEQ ID NO: 1080513 - RNA, 22 nt, Human
caugugucaaaugauguagcug

SEQ ID NO: 1080514 - RNA, 22 nt, Human
caugcuccaaaaacaagagaau

SEQ ID NO: 1080515 - RNA, 22 nt, Human
auaucaaaauaaacagcaugca

SEQ ID NO: 1080516 - RNA, 22 nt, Human
ugcauuguugaauauuucauag

SEQ ID NO: 1080517 - RNA, 22 nt, Human
acaauacaggcuucuggacuua

SEQ ID NO: 1080518 - RNA, 21 nt, Human
agaaaauggcguuuuagauuu

SEQ ID NO: 1080519 - RNA, 20 nt, Human
ccuggcugcauucaggacgg

SEQ ID NO: 1080520 - RNA, 20 nt, Human
ucacuaguaaccaucugcuu

SEQ ID NO: 1080521 - RNA, 22 nt, Human
aagcagggugucuugacccaug

SEQ ID NO: 1080522 - RNA, 22 nt, Human
uuucaaagguggaagagugaau

SEQ ID NO: 1080523 - RNA, 22 nt, Human
acuuaaaaagaaucuuuucacg

SEQ ID NO: 1080524 - RNA, 22 nt, Human
uuuagcagagcauaugauaucc

SEQ ID NO: 1080525 - RNA, 22 nt, Human
ucugggcuuuaguuuguuaucu

SEQ ID NO: 1080526 - RNA, 22 nt, Human
uggcucagugaagagauaacuu

SEQ ID NO: 1080527 - RNA, 22 nt, Human
uuuguuaaaaugcagauucugu

SEQ ID NO: 1080528 - RNA, 22 nt, Human
ugggccaguccagccccaggga

SEQ ID NO: 1080529 - RNA, 22 nt, Human
cagcaugcaaguccagaugugg

SEQ ID NO: 1080530 - RNA, 22 nt, Human
ugagaaccaugaaaagcuguca

SEQ ID NO: 1080531 - RNA, 22 nt, Human
uuaaagcauccugucagucugu

SEQ ID NO: 1080532 - RNA, 22 nt, Human
gcugggccagacuuucaauguc

SEQ ID NO: 1080533 - RNA, 22 nt, Human
gcaggcucccuugcagagcagg

SEQ ID NO: 1080534 - RNA, 21 nt, Human
guggcccugccgcagugucca

SEQ ID NO: 1080535 - RNA, 22 nt, Human
ccugggcucaagugauccuccu

SEQ ID NO: 1080536 - RNA, 22 nt, Human
ggccugagucacaucaggagag

SEQ ID NO: 1080537 - RNA, 22 nt, Human
agcaaggggcagugaaagugug

SEQ ID NO: 1080538 - RNA, 22 nt, Human
caggugggcguggcgagaaggc

SEQ ID NO: 1080539 - RNA, 22 nt, Human
aaggccugggaggccucucuuc

SEQ ID NO: 1080540 - RNA, 22 nt, Human
aagcaucaacacuauauugaug

SEQ ID NO: 1080541 - RNA, 22 nt, Human
gcugaaaugucuuuagcagugu

SEQ ID NO: 1080542 - RNA, 20 nt, Human
accccacagaguccauugca

SEQ ID NO: 1080543 - RNA, 22 nt, Human
gugucaggcagucagcauggag

SEQ ID NO: 1080544 - RNA, 18 nt, Human
uagauggcagucugcaga

SEQ ID NO: 1080545 - RNA, 22 nt, Human
ucugagagucucugaggcagau

SEQ ID NO: 1080546 - RNA, 22 nt, Human
gaggagaaauuuggggaccuga

SEQ ID NO: 1080547 - RNA, 22 nt, Human
augcccugcugccaucuggccg

SEQ ID NO: 1080548 - RNA, 22 nt, Human
uugcuucaguagcucuuuaaag

SEQ ID NO: 1080549 - RNA, 19 nt, Human
ugcuaaguccuuuagaggc

SEQ ID NO: 1080550 - RNA, 22 nt, Human
gcagggaccugccacugcuguc

SEQ ID NO: 1080551 - RNA, 22 nt, Human
gucagcaggguccccuugagug

SEQ ID NO: 1080552 - RNA, 22 nt, Human
auagaaacagggaagcaaagca

SEQ ID NO: 1080553 - RNA, 22 nt, Human
cugucucucuaggacacugggg

SEQ ID NO: 1080554 - RNA, 22 nt, Human
gcucagagggaacaaggggcug

SEQ ID NO: 1080555 - RNA, 21 nt, Human
gaucuuuacuuuccuacuuac

SEQ ID NO: 1080556 - RNA, 22 nt, Human
cagccagcuucagauccaagcc

SEQ ID NO: 1080557 - RNA, 22 nt, Human
gaagaaagauuggcaugcuuca

SEQ ID NO: 1080558 - RNA, 22 nt, Human
cuuaaagaaauugaggagagga

SEQ ID NO: 1080559 - RNA, 22 nt, Human
gcacacaguauaugcucauuaa

SEQ ID NO: 1080560 - RNA, 22 nt, Human
auucuugcaguauacaacuacu

SEQ ID NO: 1080561 - RNA, 22 nt, Human
cuggagcagcagguggccaggg

SEQ ID NO: 1080562 - RNA, 22 nt, Human
caaggcuguguuagcugcccuc

SEQ ID NO: 1080563 - RNA, 22 nt, Human
ccaaggcuucccagagaugcuc

SEQ ID NO: 1080564 - RNA, 22 nt, Human
ucagcuccucaugcaggggaua

SEQ ID NO: 1080565 - RNA, 22 nt, Human
uccuguggagaggacuggaggu

SEQ ID NO: 1080566 - RNA, 22 nt, Human
augaaaauucuaugcaggccag

SEQ ID NO: 1080567 - RNA, 22 nt, Human
cugaggcugggcugaggguaua

SEQ ID NO: 1080568 - RNA, 22 nt, Human
guaaucucagcuacuugggagg

SEQ ID NO: 1080569 - RNA, 22 nt, Human
guauauaucggcacuauuuuaa

SEQ ID NO: 1080570 - RNA, 22 nt, Human
aggacuucuccgauaagucaga

SEQ ID NO: 1080571 - RNA, 22 nt, Human
uggcacugggacagaugcucuc

SEQ ID NO: 1080572 - RNA, 18 nt, Human
gcccaugguaaaugcugu

SEQ ID NO: 1080573 - RNA, 22 nt, Human
gaguaauuagagcaaugacuuu

SEQ ID NO: 1080574 - RNA, 22 nt, Human
gcugucuguggugucagcugac

SEQ ID NO: 1080575 - RNA, 22 nt, Human
uuagauaaauuaagacuuuaca

SEQ ID NO: 1080576 - RNA, 22 nt, Human
uuuuuauaacucuuuugugaca

SEQ ID NO: 1080577 - RNA, 23 nt, Human
cugguaaaucacuaaaauuacaa

SEQ ID NO: 1080578 - RNA, 22 nt, Human
aggcacugaagugguaaaugua

SEQ ID NO: 1080579 - RNA, 22 nt, Human
uaaauacagucauuugagccau

SEQ ID NO: 1080580 - RNA, 22 nt, Human
cucucugucuuggcauuugguc

SEQ ID NO: 1080581 - RNA, 22 nt, Human
ugcacacauguauguauaugug

SEQ ID NO: 1080582 - RNA, 22 nt, Human
cucagggcaguauggcugagag

SEQ ID NO: 1080583 - RNA, 22 nt, Human
ugcugcucuucaccauggccuc

SEQ ID NO: 1080584 - RNA, 18 nt, Human
gcagagugcgucucugug

SEQ ID NO: 1080585 - RNA, 22 nt, Human
uugucccaggacuugcauagau

SEQ ID NO: 1080586 - RNA, 22 nt, Human
gaagaagccucuguggaucuga

SEQ ID NO: 1080587 - RNA, 22 nt, Human
uuuauucacucauucagccagu

SEQ ID NO: 1080588 - RNA, 22 nt, Human
gagcccaggcagagguugcagu

SEQ ID NO: 1080589 - RNA, 19 nt, Human
gcuggggaauggauauuga

SEQ ID NO: 1080590 - RNA, 22 nt, Human
acaucccacagaaacauacaua

SEQ ID NO: 1080591 - RNA, 22 nt, Human
ucaguuuuuaaaugauauaauu

SEQ ID NO: 1080592 - RNA, 22 nt, Human
ugcuauugugaacagugccaca

SEQ ID NO: 1080593 - RNA, 22 nt, Human
ggcacacaggcagauggagugu

SEQ ID NO: 1080594 - RNA, 22 nt, Human
aacacuuuuuccuccugucugg

SEQ ID NO: 1080595 - RNA, 22 nt, Human
cuuucaaucaaaguuucuagug

SEQ ID NO: 1080596 - RNA, 22 nt, Human
gauuucaaguaucuugggcgag

SEQ ID NO: 1080597 - RNA, 22 nt, Human
ucuucaugaaauugauugcuua

SEQ ID NO: 1080598 - RNA, 22 nt, Human
gagguggguguaucacagguca

SEQ ID NO: 1080599 - RNA, 22 nt, Human
augcacacacauuaugucugug

SEQ ID NO: 1080600 - RNA, 18 nt, Human
aggaaagacgaagagggc

SEQ ID NO: 1080601 - RNA, 22 nt, Human
cucuuccuacagucugcuaugc

SEQ ID NO: 1080602 - RNA, 22 nt, Human
acaaaggcaggauugacuuagu

SEQ ID NO: 1080603 - RNA, 22 nt, Human
uuuccuuuuauaaggcuugagg

SEQ ID NO: 1080604 - RNA, 21 nt, Human
uucagcuauucagaaggggag

SEQ ID NO: 1080605 - RNA, 22 nt, Human
cagucccacuagugccaauacc

SEQ ID NO: 1080606 - RNA, 22 nt, Human
agccugguuuaagcauuuuaua

SEQ ID NO: 1080607 - RNA, 22 nt, Human
gugugguggcccuccuucaggc

SEQ ID NO: 1080608 - RNA, 22 nt, Human
uuuguagacgucagaaguuacu

SEQ ID NO: 1080609 - RNA, 22 nt, Human
ugaguguauaucaggagagagc

SEQ ID NO: 1080610 - RNA, 22 nt, Human
uaagauaauccauuauaauguu

SEQ ID NO: 1080611 - RNA, 22 nt, Human
ggcugagcaauuuugaugacau

SEQ ID NO: 1080612 - RNA, 22 nt, Human
ugcaaagucgcaaaauucuucu

SEQ ID NO: 1080613 - RNA, 22 nt, Human
gggagggaaggaccuuaugaau

SEQ ID NO: 1080614 - RNA, 22 nt, Human
aggaggcccuagagcucuagag

SEQ ID NO: 1080615 - RNA, 22 nt, Human
cuggagcccugaaugggcagga

SEQ ID NO: 1080616 - RNA, 22 nt, Human
caccuagggcaucccugcccca

SEQ ID NO: 1080617 - RNA, 22 nt, Human
cuggcagcaguuaugaaacaau

SEQ ID NO: 1080618 - RNA, 18 nt, Human
ugcaggcuguugaaacug

SEQ ID NO: 1080619 - RNA, 21 nt, Human
ugcugccauagaccugaggga

SEQ ID NO: 1080620 - RNA, 22 nt, Human
auguggcugguaguugacaacu

SEQ ID NO: 1080621 - RNA, 22 nt, Human
uguucuuuagcagaccauguug

SEQ ID NO: 1080622 - RNA, 22 nt, Human
cagaaaaggguguuuguucagg

SEQ ID NO: 1080623 - RNA, 22 nt, Human
aagagaauucugguuuuccuau

SEQ ID NO: 1080624 - RNA, 22 nt, Human
uggcagcagggccccuggagga

SEQ ID NO: 1080625 - RNA, 22 nt, Human
guaaacaagucuaccauuagaa

SEQ ID NO: 1080626 - RNA, 22 nt, Human
aggcagguccccuggaaggcac

SEQ ID NO: 1080627 - RNA, 22 nt, Human
uauguacaguccuuaacuuaaa

SEQ ID NO: 1080628 - RNA, 22 nt, Human
uucuuuucaagaggggcaagga

SEQ ID NO: 1080629 - RNA, 22 nt, Human
uggcucagcugucacagccugg

SEQ ID NO: 1080630 - RNA, 22 nt, Human
guguggggcucagugggaaugu

SEQ ID NO: 1080631 - RNA, 19 nt, Human
agggcugcucuggccuggg

SEQ ID NO: 1080632 - RNA, 22 nt, Human
aguauuucuaguugguucuacu

SEQ ID NO: 1080633 - RNA, 22 nt, Human
gccagccugugggggcucugug

SEQ ID NO: 1080634 - RNA, 22 nt, Human
ggggcugacgggcauguggcuu

SEQ ID NO: 1080635 - RNA, 22 nt, Human
cacacagacagcucucugaaga

SEQ ID NO: 1080636 - RNA, 23 nt, Human
acuuaaaugguucuuuaucucag

SEQ ID NO: 1080637 - RNA, 22 nt, Human
uccuccagugucuggggccuug

SEQ ID NO: 1080638 - RNA, 22 nt, Human
cacugaaaucgaaaaauguagg

SEQ ID NO: 1080639 - RNA, 22 nt, Human
ugucuccucauacugucauauu

SEQ ID NO: 1080640 - RNA, 22 nt, Human
cugccuggcccagggaugggcc

SEQ ID NO: 1080641 - RNA, 22 nt, Human
gauuuauuggucuuucauuggu

SEQ ID NO: 1080642 - RNA, 17 nt, Human
ucaaagaaugcaugcag

SEQ ID NO: 1080643 - RNA, 22 nt, Human
uugauacauagcacaguuuagg

SEQ ID NO: 1080644 - RNA, 22 nt, Human
ugacauuuaaucccuaaauauu

SEQ ID NO: 1080645 - RNA, 21 nt, Human
uucaagauauuuaaaaggugg

SEQ ID NO: 1080646 - RNA, 22 nt, Human
ugauuuccuagcugacaugaaa

SEQ ID NO: 1080647 - RNA, 22 nt, Human
gaggcccuccagcugucagcug

SEQ ID NO: 1080648 - RNA, 19 nt, Human
auuccucaaggacagaaau

SEQ ID NO: 1080649 - RNA, 17 nt, Human
aggaauacagaucuuca

SEQ ID NO: 1080650 - RNA, 20 nt, Human
ggcagccaaucagcgugccg

SEQ ID NO: 1080651 - RNA, 22 nt, Human
uacauuccacuagugacuggcg

SEQ ID NO: 1080652 - RNA, 22 nt, Human
uacacuuucguuuguggauuag

SEQ ID NO: 1080653 - RNA, 22 nt, Human
uggcugucagcugccuggugcg

SEQ ID NO: 1080654 - RNA, 17 nt, Human
gcucugccccagccucu

SEQ ID NO: 1080655 - RNA, 22 nt, Human
aaauuagaucaguggauuuucu

SEQ ID NO: 1080656 - RNA, 22 nt, Human
ggcuguggucauuaggagguug

SEQ ID NO: 1080657 - RNA, 22 nt, Human
ucaguuuucucaucugugaaau

SEQ ID NO: 1080658 - RNA, 22 nt, Human
uucuugauguaccaacuuggga

SEQ ID NO: 1080659 - RNA, 22 nt, Human
ugcaagagacauggguugugug

SEQ ID NO: 1080660 - RNA, 22 nt, Human
aagggcaggugggcauuucugg

SEQ ID NO: 1080661 - RNA, 22 nt, Human
aagcagagguagggugugcagu

SEQ ID NO: 1080662 - RNA, 22 nt, Human
cuuggaggagguggugcuugau

SEQ ID NO: 1080663 - RNA, 22 nt, Human
gcuggaccaggugugcacaggc

SEQ ID NO: 1080664 - RNA, 22 nt, Human
cauuuauauaaaauguccagaa

SEQ ID NO: 1080665 - RNA, 22 nt, Human
aagggcaggaaaagauggaugu

SEQ ID NO: 1080666 - RNA, 23 nt, Human
uaaagucacauauuagagugagc

SEQ ID NO: 1080667 - RNA, 22 nt, Human
ugaacacaguucugaugagcuu

SEQ ID NO: 1080668 - RNA, 22 nt, Human
ccagcuggucugugcucauguu

SEQ ID NO: 1080669 - RNA, 22 nt, Human
cagaggcaaaagagguggaggu

SEQ ID NO: 1080670 - RNA, 22 nt, Human
cuauuuguacagcauuaguaau

SEQ ID NO: 1080671 - RNA, 22 nt, Human
ucagaggaucaugucccuacuc

SEQ ID NO: 1080672 - RNA, 21 nt, Human
ucauuucagggccuuggcuuc

SEQ ID NO: 1080673 - RNA, 22 nt, Human
gagggggagaugugcacacacu

SEQ ID NO: 1080674 - RNA, 22 nt, Human
cuauuugucaguuuggcuuuaa

SEQ ID NO: 1080675 - RNA, 22 nt, Human
ucucagggcagcaaggaagcau

SEQ ID NO: 1080676 - RNA, 22 nt, Human
gucccuggaucugggacagcug

SEQ ID NO: 1080677 - RNA, 17 nt, Human
uuuaaacuacuacaagg

SEQ ID NO: 1080678 - RNA, 22 nt, Human
caguucugguuugcagauauau

SEQ ID NO: 1080679 - RNA, 22 nt, Human
cagcaaauacuacuaguuuuua

SEQ ID NO: 1080680 - RNA, 22 nt, Human
agggcagagaaauguaguugag

SEQ ID NO: 1080681 - RNA, 22 nt, Human
ggcacagcgacuaccaucgaaa

SEQ ID NO: 1080682 - RNA, 22 nt, Human
acagucuuucaguaauaauacu

SEQ ID NO: 1080683 - RNA, 22 nt, Human
caggaaccaggagagucccuga

SEQ ID NO: 1080684 - RNA, 19 nt, Human
uccaaaggacccaccucca

SEQ ID NO: 1080685 - RNA, 22 nt, Human
cuccugggagcuguggcagagc

SEQ ID NO: 1080686 - RNA, 21 nt, Human
ugcucacagaugugcucagug

SEQ ID NO: 1080687 - RNA, 22 nt, Human
caggguugcaugcaucuguggg

SEQ ID NO: 1080688 - RNA, 22 nt, Human
uuuaugaacuacagauauaacu

SEQ ID NO: 1080689 - RNA, 23 nt, Human
agaaaaguucauaccuuuuuaac

SEQ ID NO: 1080690 - RNA, 22 nt, Human
gaggcagagguuguugcaguga

SEQ ID NO: 1080691 - RNA, 22 nt, Human
aucagagauggcuccagugcuc

SEQ ID NO: 1080692 - RNA, 22 nt, Human
ucccagaggaaauggcagcuga

SEQ ID NO: 1080693 - RNA, 22 nt, Human
cacugaagguaggaccaaggcu

SEQ ID NO: 1080694 - RNA, 22 nt, Human
acacauuuauggaucgcagaaa

SEQ ID NO: 1080695 - RNA, 22 nt, Human
cagcugaagaaagagugguuag

SEQ ID NO: 1080696 - RNA, 22 nt, Human
ucccaagagcuacucaauggaa

SEQ ID NO: 1080697 - RNA, 22 nt, Human
gcagagaacccagcagauuggc

SEQ ID NO: 1080698 - RNA, 22 nt, Human
gggcugacucugcacugagcca

SEQ ID NO: 1080699 - RNA, 22 nt, Human
uaucaaauugaggcagcugggg

SEQ ID NO: 1080700 - RNA, 23 nt, Human
gggagaauaugaggaugauggug

SEQ ID NO: 1080701 - RNA, 22 nt, Human
acagagucucagggaugaaagc

SEQ ID NO: 1080702 - RNA, 22 nt, Human
cugugucccaguaccuugggua

SEQ ID NO: 1080703 - RNA, 22 nt, Human
gguaacacauggaacauuuaca

SEQ ID NO: 1080704 - RNA, 22 nt, Human
cauugcuguuaauugucucuag

SEQ ID NO: 1080705 - RNA, 22 nt, Human
acauuugaaaugccaugugagg

SEQ ID NO: 1080706 - RNA, 21 nt, Human
uuuacugagcacuuacuaugu

SEQ ID NO: 1080707 - RNA, 22 nt, Human
ggaggaggggugacugaaugcu

SEQ ID NO: 1080708 - RNA, 22 nt, Human
uccaguucuaggucacucucug

SEQ ID NO: 1080709 - RNA, 22 nt, Human
cugaaggaagcagaagcgaggu

SEQ ID NO: 1080710 - RNA, 22 nt, Human
ucagagugaggcccagcaaucu

SEQ ID NO: 1080711 - RNA, 21 nt, Human
uaaacauaaccuuguauggcu

SEQ ID NO: 1080712 - RNA, 22 nt, Human
gagucugagaacugggcucagu

SEQ ID NO: 1080713 - RNA, 22 nt, Human
gacagaggcaagaccagaagcc

SEQ ID NO: 1080714 - RNA, 22 nt, Human
gggcugaggcuaccacuggucu

SEQ ID NO: 1080715 - RNA, 22 nt, Human
ccagaccacccuggccaugcac

SEQ ID NO: 1080716 - RNA, 22 nt, Human
gcuuuaaaccucuacucugucc

SEQ ID NO: 1080717 - RNA, 22 nt, Human
caggaccaagcaaaguuucuuu

SEQ ID NO: 1080718 - RNA, 22 nt, Human
cuuauucagcaaguuuggguac

SEQ ID NO: 1080719 - RNA, 22 nt, Human
acucacagcagacuaugaggga

SEQ ID NO: 1080720 - RNA, 22 nt, Human
uuaagucacuggacuugccuag

SEQ ID NO: 1080721 - RNA, 22 nt, Human
cugggcagugcagcuauagaac

SEQ ID NO: 1080722 - RNA, 22 nt, Human
uagcagaguuugguaccugggg

SEQ ID NO: 1080723 - RNA, 22 nt, Human
uuagcaagauaacaguaauuuu

SEQ ID NO: 1080724 - RNA, 22 nt, Human
aaagcagaacugagagagcugg

SEQ ID NO: 1080725 - RNA, 22 nt, Human
aaguaacacauguuacuucugc

SEQ ID NO: 1080726 - RNA, 22 nt, Human
gcugugcucaacgugccuuccu

SEQ ID NO: 1080727 - RNA, 22 nt, Human
uuuaaggcuucacuggaguggg

SEQ ID NO: 1080728 - RNA, 22 nt, Human
ugggccuccuuuccauucagag

SEQ ID NO: 1080729 - RNA, 22 nt, Human
guuuucuuccugcaauuggcau

SEQ ID NO: 1080730 - RNA, 22 nt, Human
auaaaguuuaaaagucaauagu

SEQ ID NO: 1080731 - RNA, 22 nt, Human
ucagaggagggacucagaccca

SEQ ID NO: 1080732 - RNA, 22 nt, Human
uuuuuagaauuggcugagaauu

SEQ ID NO: 1080733 - RNA, 21 nt, Human
ucacacacguuuccaagggca

SEQ ID NO: 1080734 - RNA, 22 nt, Human
ucaaaguaagaauuuauuacaa

SEQ ID NO: 1080735 - RNA, 22 nt, Human
cauuuauucaugaucuguagcu

SEQ ID NO: 1080736 - RNA, 22 nt, Human
aaauauacggucccuaacaguc

SEQ ID NO: 1080737 - RNA, 22 nt, Human
cggccuugacaagcuuagcagc

SEQ ID NO: 1080738 - RNA, 22 nt, Human
cuggguggcagagccugcagug

SEQ ID NO: 1080739 - RNA, 22 nt, Human
ucucagugauggcccauuugga

SEQ ID NO: 1080740 - RNA, 22 nt, Human
cuaggaggcgggggcugcagua

SEQ ID NO: 1080741 - RNA, 22 nt, Human
uuuccuaaucccaaugacauuu

SEQ ID NO: 1080742 - RNA, 22 nt, Human
cugccaaguaaugccugggcuc

SEQ ID NO: 1080743 - RNA, 22 nt, Human
uucuugauucuuccuugaagga

SEQ ID NO: 1080744 - RNA, 22 nt, Human
uuuuuucagccugucugugcca

SEQ ID NO: 1080745 - RNA, 22 nt, Human
aagggacuuugucagcuuucca

SEQ ID NO: 1080746 - RNA, 22 nt, Human
cuucugggauuaauuuuuccug

SEQ ID NO: 1080747 - RNA, 22 nt, Human
caagucaucauagaaguucccc

SEQ ID NO: 1080748 - RNA, 22 nt, Human
gggauggggucaacauguaccu

SEQ ID NO: 1080749 - RNA, 20 nt, Human
agcaggaaaagugccagucu

SEQ ID NO: 1080750 - RNA, 22 nt, Human
aguacuucagaggcugcccagg

SEQ ID NO: 1080751 - RNA, 22 nt, Human
gaaaauguuuccuguuauuugc

SEQ ID NO: 1080752 - RNA, 22 nt, Human
agccagagagccccagguucua

SEQ ID NO: 1080753 - RNA, 21 nt, Human
agcucagccgggcacaguggc

SEQ ID NO: 1080754 - RNA, 22 nt, Human
cagcagcaguguucuagaaucu

SEQ ID NO: 1080755 - RNA, 22 nt, Human
caggggcuuuuccucuauaagg

SEQ ID NO: 1080756 - RNA, 22 nt, Human
uuggugggagaagacucugguu

SEQ ID NO: 1080757 - RNA, 22 nt, Human
uguaucaaggguuuauguaagc

SEQ ID NO: 1080758 - RNA, 22 nt, Human
ugggacuuguguggcaguauuu

SEQ ID NO: 1080759 - RNA, 22 nt, Human
agaaaagguugaaaguaggauu

SEQ ID NO: 1080760 - RNA, 22 nt, Human
cuggcgagcaggaggcgacggc

SEQ ID NO: 1080761 - RNA, 22 nt, Human
agcugcuguggggcucggccug

SEQ ID NO: 1080762 - RNA, 22 nt, Human
gugggguagaucuuucucagga

SEQ ID NO: 1080763 - RNA, 22 nt, Human
gucuccagaauucuugggaggg

SEQ ID NO: 1080764 - RNA, 22 nt, Human
uagcacauacauaauagauaga

SEQ ID NO: 1080765 - RNA, 21 nt, Human
uaucuacuggugucuuucaga

SEQ ID NO: 1080766 - RNA, 22 nt, Human
guccugaaugccuucauagucc

SEQ ID NO: 1080767 - RNA, 20 nt, Human
caaauucuguugaauacacc

SEQ ID NO: 1080768 - RNA, 18 nt, Human
gggcauggaugcagcauc

SEQ ID NO: 1080769 - RNA, 22 nt, Human
gugagcagaacagguggcuucu

SEQ ID NO: 1080770 - RNA, 22 nt, Human
cccucugccugcgcccuggugu

SEQ ID NO: 1080771 - RNA, 22 nt, Human
cuaaaucaggccuuacagcuuc

SEQ ID NO: 1080772 - RNA, 22 nt, Human
uaagacaugguugaucuagugu

SEQ ID NO: 1080773 - RNA, 22 nt, Human
ggucucugacuuagagauggau

SEQ ID NO: 1080774 - RNA, 22 nt, Human
gaaaggccagcucacagaugag

SEQ ID NO: 1080775 - RNA, 22 nt, Human
ccagcugcccaagaggcauccu

SEQ ID NO: 1080776 - RNA, 22 nt, Human
uacagaggguaauugaucaagg

SEQ ID NO: 1080777 - RNA, 22 nt, Human
uuacagaguagugcagaacuca

SEQ ID NO: 1080778 - RNA, 22 nt, Human
ugagaauuuuuugucaugcauu

SEQ ID NO: 1080779 - RNA, 22 nt, Human
ggcagcaacucggagagaagag

SEQ ID NO: 1080780 - RNA, 22 nt, Human
ucccagcccagauuugugugac

SEQ ID NO: 1080781 - RNA, 22 nt, Human
ggcuggcuugccaagcucaggg

SEQ ID NO: 1080782 - RNA, 22 nt, Human
aaaccauggcucauuggagaug

SEQ ID NO: 1080783 - RNA, 18 nt, Human
ucuggaacaacuucaugu

SEQ ID NO: 1080784 - RNA, 19 nt, Human
gagcugccuuuugaagacc

SEQ ID NO: 1080785 - RNA, 22 nt, Human
cagcccaaagccccaggcuaga

SEQ ID NO: 1080786 - RNA, 22 nt, Human
ugcagaagugagucaugaggaa

SEQ ID NO: 1080787 - RNA, 22 nt, Human
agugucugccagcugccaggug

SEQ ID NO: 1080788 - RNA, 22 nt, Human
cugagccccucugaccucagag

SEQ ID NO: 1080789 - RNA, 22 nt, Human
caggaaaggugugucaugaugg

SEQ ID NO: 1080790 - RNA, 18 nt, Human
auuuugaacugggaauau

SEQ ID NO: 1080791 - RNA, 22 nt, Human
uggugcagucauuggcccaggg

SEQ ID NO: 1080792 - RNA, 22 nt, Human
ucucagaguuugaaucuggagu

SEQ ID NO: 1080793 - RNA, 22 nt, Human
uccuuggagaaucuuguuuuac

SEQ ID NO: 1080794 - RNA, 22 nt, Human
cucuggagaacuccuugugucu

SEQ ID NO: 1080795 - RNA, 22 nt, Human
uggagacucugcaucugugaca

SEQ ID NO: 1080796 - RNA, 22 nt, Human
gaauucuuuaggugaauuucua

SEQ ID NO: 1080797 - RNA, 22 nt, Human
cuuauuagugucugucugaguu

SEQ ID NO: 1080798 - RNA, 20 nt, Human
aaagucuguuuaucucugga

SEQ ID NO: 1080799 - RNA, 22 nt, Human
aauagaauuuguacuguguuuu

SEQ ID NO: 1080800 - RNA, 22 nt, Human
ggaggcagaacuucccgucagu

SEQ ID NO: 1080801 - RNA, 22 nt, Human
ccucugaguagacuggacauga

SEQ ID NO: 1080802 - RNA, 22 nt, Human
cuuucccuuagccccauucuau

SEQ ID NO: 1080803 - RNA, 22 nt, Human
aauucauccaugaacaauucca

SEQ ID NO: 1080804 - RNA, 22 nt, Human
uguggcagcuggagguggagaa

SEQ ID NO: 1080805 - RNA, 22 nt, Human
gaggagaaauuauccuuggugu

SEQ ID NO: 1080806 - RNA, 22 nt, Human
auuugcuuuaagguauaaaagg

SEQ ID NO: 1080807 - RNA, 22 nt, Human
ccuggcagcagcacaugccuuc

SEQ ID NO: 1080808 - RNA, 22 nt, Human
uagaagagacauagccuguggu

SEQ ID NO: 1080809 - RNA, 22 nt, Human
cugugaaucuugauguuauuuc

SEQ ID NO: 1080810 - RNA, 22 nt, Human
ucugcucuaguugcuuccugcc

SEQ ID NO: 1080811 - RNA, 22 nt, Human
aauauguugagucuaucuuuau

SEQ ID NO: 1080812 - RNA, 19 nt, Human
agacuuuuguaaguugaga

SEQ ID NO: 1080813 - RNA, 22 nt, Human
cccaggagauggagguugcagu

SEQ ID NO: 1080814 - RNA, 22 nt, Human
cccuggguucuggcugggcugc

SEQ ID NO: 1080815 - RNA, 22 nt, Human
acagaauuuacacaucucuaaa

SEQ ID NO: 1080816 - RNA, 22 nt, Human
cagugaaguucuacugaauggu

SEQ ID NO: 1080817 - RNA, 18 nt, Human
gcuccuggaccaggucac

SEQ ID NO: 1080818 - RNA, 22 nt, Human
agugggaggcggcugacgggcg

SEQ ID NO: 1080819 - RNA, 22 nt, Human
cagagacccuucucaguggcca

SEQ ID NO: 1080820 - RNA, 22 nt, Human
cagagcugcaaaugccccuccg

SEQ ID NO: 1080821 - RNA, 22 nt, Human
acagacauuuaauaaaugcuga

SEQ ID NO: 1080822 - RNA, 22 nt, Human
ggaaaagaaagggacugauugg

SEQ ID NO: 1080823 - RNA, 22 nt, Human
ugucugugcccaaggcucccgg

SEQ ID NO: 1080824 - RNA, 22 nt, Human
acuccuggggcugccaucacag

SEQ ID NO: 1080825 - RNA, 22 nt, Human
uuguuuuggaagaacuuacucu

SEQ ID NO: 1080826 - RNA, 22 nt, Human
ugugaaauguguguauaauuaa

SEQ ID NO: 1080827 - RNA, 19 nt, Human
gcucagagggcccugugcu

SEQ ID NO: 1080828 - RNA, 22 nt, Human
ucucagagugacaaugagaauu

SEQ ID NO: 1080829 - RNA, 22 nt, Human
uaugagaaaauaaauaucuguu

SEQ ID NO: 1080830 - RNA, 22 nt, Human
gcaggcugagaguccaagaagg

SEQ ID NO: 1080831 - RNA, 22 nt, Human
gccugcugagggaaguugggca

SEQ ID NO: 1080832 - RNA, 22 nt, Human
uagaugaagcaacauguguaau

SEQ ID NO: 1080833 - RNA, 22 nt, Human
guccuggcccacuggcaggcug

SEQ ID NO: 1080834 - RNA, 22 nt, Human
gguguccaucaggcugugcuuc

SEQ ID NO: 1080835 - RNA, 22 nt, Human
gcuggggacuccccaccauagc

SEQ ID NO: 1080836 - RNA, 22 nt, Human
aggagcucauugaaguggauga

SEQ ID NO: 1080837 - RNA, 17 nt, Human
ggcaccagacggagagu

SEQ ID NO: 1080838 - RNA, 22 nt, Human
ucaaauaccagcaauuucaugu

SEQ ID NO: 1080839 - RNA, 22 nt, Human
cagaguccuggacacagagaca

SEQ ID NO: 1080840 - RNA, 22 nt, Human
cagcaucuaaucuucaugccgg

SEQ ID NO: 1080841 - RNA, 22 nt, Human
gacacuauaugacacuucaguu

SEQ ID NO: 1080842 - RNA, 22 nt, Human
uagggcagccuuauagcuccca

SEQ ID NO: 1080843 - RNA, 22 nt, Human
acaguaaaacauuuuuauuagg

SEQ ID NO: 1080844 - RNA, 18 nt, Human
cugccccuucucugagau

SEQ ID NO: 1080845 - RNA, 22 nt, Human
aacagcugcuucuaucuuuuca

SEQ ID NO: 1080846 - RNA, 22 nt, Human
caggaagaaggguggugagucc

SEQ ID NO: 1080847 - RNA, 22 nt, Human
caggaugagguagaggcagaua

SEQ ID NO: 1080848 - RNA, 22 nt, Human
aggaauauggauuugcucagcu

SEQ ID NO: 1080849 - RNA, 22 nt, Human
ucacaucauuaagacuucuccu

SEQ ID NO: 1080850 - RNA, 19 nt, Human
cagaguccuugaccagucc

SEQ ID NO: 1080851 - RNA, 22 nt, Human
auugaaagaguuuucugcugca

SEQ ID NO: 1080852 - RNA, 22 nt, Human
acagcagcaauagcagugacau

SEQ ID NO: 1080853 - RNA, 22 nt, Human
acuuugugcccaacagaaagaa

SEQ ID NO: 1080854 - RNA, 23 nt, Human
caggcaggaugaggacuacacuc

SEQ ID NO: 1080855 - RNA, 22 nt, Human
cauuuacacuucuaaccacaag

SEQ ID NO: 1080856 - RNA, 22 nt, Human
aggcucagugcaaaucauucug

SEQ ID NO: 1080857 - RNA, 22 nt, Human
aagcauuucuguuuaucuaucg

SEQ ID NO: 1080858 - RNA, 22 nt, Human
acucacagacugcagguuuauu

SEQ ID NO: 1080859 - RNA, 22 nt, Human
cacagaacaccaaagaaccuuc

SEQ ID NO: 1080860 - RNA, 22 nt, Human
aaaugcagguucuugagccaag

SEQ ID NO: 1080861 - RNA, 22 nt, Human
aaucauaauuguauacauucau

SEQ ID NO: 1080862 - RNA, 20 nt, Human
gaaggaagggggcaagguga

SEQ ID NO: 1080863 - RNA, 22 nt, Human
guuucuaaauguucugaguuuu

SEQ ID NO: 1080864 - RNA, 22 nt, Human
aggcuauuuccacucuucucau

SEQ ID NO: 1080865 - RNA, 22 nt, Human
cugggcagcuaccaccacugcu

SEQ ID NO: 1080866 - RNA, 22 nt, Human
acccucaagauggaagcaguuu

SEQ ID NO: 1080867 - RNA, 22 nt, Human
agccagggagguggagguugca

SEQ ID NO: 1080868 - RNA, 20 nt, Human
accuccuggaagcaggugcc

SEQ ID NO: 1080869 - RNA, 22 nt, Human
uaagauaaguggguugagaugg

SEQ ID NO: 1080870 - RNA, 22 nt, Human
uuuuguuuguguccacugcagu

SEQ ID NO: 1080871 - RNA, 22 nt, Human
ucaaaggcgguccaggaauaaa

SEQ ID NO: 1080872 - RNA, 22 nt, Human
aagcaucucuauguggagagug

SEQ ID NO: 1080873 - RNA, 22 nt, Human
uuuauucacuggggucugcccg

SEQ ID NO: 1080874 - RNA, 22 nt, Human
aguccugaugcucuggcaggag

SEQ ID NO: 1080875 - RNA, 22 nt, Human
gugccugcugcagcugagcagu

SEQ ID NO: 1080876 - RNA, 23 nt, Human
aggaggccugaaacugaggcuga

SEQ ID NO: 1080877 - RNA, 22 nt, Human
acuuuguuuuauagcacauaag

SEQ ID NO: 1080878 - RNA, 22 nt, Human
uacagaaugauguguuuaaaua

SEQ ID NO: 1080879 - RNA, 22 nt, Human
gcaaagcacacuggagaugucg

SEQ ID NO: 1080880 - RNA, 22 nt, Human
aguugaagguuggcugauccau

SEQ ID NO: 1080881 - RNA, 22 nt, Human
uucccaugccuggccccuaucc

SEQ ID NO: 1080882 - RNA, 22 nt, Human
uuagugguaaggaugaaauuuc

SEQ ID NO: 1080883 - RNA, 22 nt, Human
cacagcauuaacugggacagcu

SEQ ID NO: 1080884 - RNA, 23 nt, Human
uucuucucaauuaguugauucag

SEQ ID NO: 1080885 - RNA, 22 nt, Human
agggugcagguguggagucuag

SEQ ID NO: 1080886 - RNA, 20 nt, Human
ucacagaaugccugaagaag

SEQ ID NO: 1080887 - RNA, 22 nt, Human
aggcaacaugggccaggcagaa

SEQ ID NO: 1080888 - RNA, 22 nt, Human
acagaaugggauuugaauauuu

SEQ ID NO: 1080889 - RNA, 22 nt, Human
uuuuaaacuccccuaguuggug

SEQ ID NO: 1080890 - RNA, 22 nt, Human
gcugggaaugauuuuggagagg

SEQ ID NO: 1080891 - RNA, 22 nt, Human
uguggaaaagaauaagggagau

SEQ ID NO: 1080892 - RNA, 22 nt, Human
augauggugggagaugacccag

SEQ ID NO: 1080893 - RNA, 22 nt, Human
uuggaaggugagucccuggguu

SEQ ID NO: 1080894 - RNA, 22 nt, Human
uagcagagauaugggcauagau

SEQ ID NO: 1080895 - RNA, 22 nt, Human
gaguuaauacugaguuuauuaa

SEQ ID NO: 1080896 - RNA, 22 nt, Human
ccaggugucuguggccagcccu

SEQ ID NO: 1080897 - RNA, 22 nt, Human
auagaaauggcagcuggugcua

SEQ ID NO: 1080898 - RNA, 22 nt, Human
cagcuggguggcucuucugcuc

SEQ ID NO: 1080899 - RNA, 22 nt, Human
ucacuuagauggggaucaucac

SEQ ID NO: 1080900 - RNA, 22 nt, Human
aaacauugcuaaauaaugcugc

SEQ ID NO: 1080901 - RNA, 22 nt, Human
gguggccucgguggugcacagg

SEQ ID NO: 1080902 - RNA, 23 nt, Human
agcagcaggagguauugauaagg

SEQ ID NO: 1080903 - RNA, 22 nt, Human
gcaggggaguggcaggcccgga

SEQ ID NO: 1080904 - RNA, 22 nt, Human
cagagcaggcccacugcccucc

SEQ ID NO: 1080905 - RNA, 22 nt, Human
ccagaaaaggagcugcaggaug

SEQ ID NO: 1080906 - RNA, 22 nt, Human
gcugugugcucuggucuuucuu

SEQ ID NO: 1080907 - RNA, 22 nt, Human
uuucucauggacccuucaugau

SEQ ID NO: 1080908 - RNA, 22 nt, Human
aggacacacagaauacaaaucc

SEQ ID NO: 1080909 - RNA, 22 nt, Human
aagccacugagauuucacugca

SEQ ID NO: 1080910 - RNA, 22 nt, Human
uuauaaagauuguuauguaucu

SEQ ID NO: 1080911 - RNA, 22 nt, Human
aguggcagagaccccagccagc

SEQ ID NO: 1080912 - RNA, 22 nt, Human
caggauggugugagugugagga

SEQ ID NO: 1080913 - RNA, 22 nt, Human
aaauccaguguucaaaguuuga

SEQ ID NO: 1080914 - RNA, 22 nt, Human
uauacagaacauuaagaacugu

SEQ ID NO: 1080915 - RNA, 22 nt, Human
uugguucaaagggauucaauuu

SEQ ID NO: 1080916 - RNA, 22 nt, Human
uacauuuauaaggcuucucugu

SEQ ID NO: 1080917 - RNA, 22 nt, Human
gccuggcaggccugggccagca

SEQ ID NO: 1080918 - RNA, 22 nt, Human
uaggaguaggaguggccauccc

SEQ ID NO: 1080919 - RNA, 22 nt, Human
guccucugggcuuugagcaguc

SEQ ID NO: 1080920 - RNA, 22 nt, Human
ggccagaggugguacauagcuu

SEQ ID NO: 1080921 - RNA, 22 nt, Human
aucaguuucacuugcuugcaaa

SEQ ID NO: 1080922 - RNA, 22 nt, Human
ggggcugguggugguuucucca

SEQ ID NO: 1080923 - RNA, 22 nt, Human
ucccuggcugggggcugccuug

SEQ ID NO: 1080924 - RNA, 22 nt, Human
aauguguauacuggcaauuaag

SEQ ID NO: 1080925 - RNA, 22 nt, Human
agcaucuggugagggccuaguu

SEQ ID NO: 1080926 - RNA, 22 nt, Human
uguuugaauuuugcuaacgugu

SEQ ID NO: 1080927 - RNA, 22 nt, Human
cucucugcuguauccuuaggcu

SEQ ID NO: 1080928 - RNA, 22 nt, Human
cucagggacguuagaggacagg

SEQ ID NO: 1080929 - RNA, 22 nt, Human
ccaggaaaaagagaaacauggu

SEQ ID NO: 1080930 - RNA, 22 nt, Human
auaaggcagaaaugauucuagu

SEQ ID NO: 1080931 - RNA, 16 nt, Human
cuuccucuucacuggc

SEQ ID NO: 1080932 - RNA, 22 nt, Human
ggcugaaggaugaaagcugcag

SEQ ID NO: 1080933 - RNA, 22 nt, Human
cagcacagugaccagacccacu

SEQ ID NO: 1080934 - RNA, 22 nt, Human
aucaaaguaggcauauguuuuu

SEQ ID NO: 1080935 - RNA, 22 nt, Human
caagccugucucaccagugcua

SEQ ID NO: 1080936 - RNA, 22 nt, Human
aggcagcauuucugcuuaucca

SEQ ID NO: 1080937 - RNA, 22 nt, Human
gugaaguucaagcuugccaucu

SEQ ID NO: 1080938 - RNA, 22 nt, Human
gcaaggagacuguagggccaag

SEQ ID NO: 1080939 - RNA, 22 nt, Human
ggggaaggauugaguugaccca

SEQ ID NO: 1080940 - RNA, 22 nt, Human
uuagaaaggggugaaucaaugg

SEQ ID NO: 1080941 - RNA, 22 nt, Human
aaaagucagucucuccuagcuc

SEQ ID NO: 1080942 - RNA, 22 nt, Human
acuggaaaacacuacuacaugc

SEQ ID NO: 1080943 - RNA, 22 nt, Human
gagaaagaugaagaguggcguu

SEQ ID NO: 1080944 - RNA, 22 nt, Human
auuugucucugcacuuuacuca

SEQ ID NO: 1080945 - RNA, 22 nt, Human
ucuuuaaaguuggagcuugcaa

SEQ ID NO: 1080946 - RNA, 22 nt, Human
ucagaggacaagcucccuggug

SEQ ID NO: 1080947 - RNA, 22 nt, Human
ucucagggcgcagugaggcagu

SEQ ID NO: 1080948 - RNA, 22 nt, Human
gagaaggcugauccuuggaguu

SEQ ID NO: 1080949 - RNA, 22 nt, Human
agccuggcuguaaccucauggu

SEQ ID NO: 1080950 - RNA, 22 nt, Human
gcagggccagugcagagaggaa

SEQ ID NO: 1080951 - RNA, 22 nt, Human
ggucuggaccauggacgccggg

SEQ ID NO: 1080952 - RNA, 22 nt, Human
caugcucuccauuggacacaga

SEQ ID NO: 1080953 - RNA, 22 nt, Human
aauucaacagucaguuaucuca

SEQ ID NO: 1080954 - RNA, 22 nt, Human
acaggaagaaagugcaguagau

SEQ ID NO: 1080955 - RNA, 22 nt, Human
cugggccagcaacugcaaugga

SEQ ID NO: 1080956 - RNA, 22 nt, Human
ccaggcagccaagugugugugu

SEQ ID NO: 1080957 - RNA, 23 nt, Human
ccucagcauggcaggagcccagc

SEQ ID NO: 1080958 - RNA, 22 nt, Human
auugauuugaacaaagauauua

SEQ ID NO: 1080959 - RNA, 22 nt, Human
acugucuuguguuaaagaacca

SEQ ID NO: 1080960 - RNA, 22 nt, Human
ggaacacugccuuuuauuuucc

SEQ ID NO: 1080961 - RNA, 22 nt, Human
acuuucaauucacugagauaua

SEQ ID NO: 1080962 - RNA, 22 nt, Human
gcugccugugcacuuucucgua

SEQ ID NO: 1080963 - RNA, 22 nt, Human
acaaaauuuuuagacaaggcuu

SEQ ID NO: 1080964 - RNA, 22 nt, Human
cuggacagaaagggcugcugug

SEQ ID NO: 1080965 - RNA, 22 nt, Human
cuggaagguuccucccagcucc

SEQ ID NO: 1080966 - RNA, 22 nt, Human
aaauuuaaaaagcagcauugca

SEQ ID NO: 1080967 - RNA, 22 nt, Human
ggagcuggcuacagagaacucc

SEQ ID NO: 1080968 - RNA, 23 nt, Human
ugguugcagugccaaguaucacg

SEQ ID NO: 1080969 - RNA, 22 nt, Human
augccugagacuguuaauuggc

SEQ ID NO: 1080970 - RNA, 22 nt, Human
guggccuggaguuugauguagg

SEQ ID NO: 1080971 - RNA, 22 nt, Human
ucuucacaccgggcagcaggaa

SEQ ID NO: 1080972 - RNA, 22 nt, Human
agaaucugcauuucuaauaagc

SEQ ID NO: 1080973 - RNA, 21 nt, Human
agaagagaagcaggacccucu

SEQ ID NO: 1080974 - RNA, 22 nt, Human
ugcccugggaggcuuuccuguu

SEQ ID NO: 1080975 - RNA, 21 nt, Human
gcuccuggugcugcguggcgc

SEQ ID NO: 1080976 - RNA, 22 nt, Human
uuggccuucugguguucauuuu

SEQ ID NO: 1080977 - RNA, 23 nt, Human
gggaagugaggagccccucugcc

SEQ ID NO: 1080978 - RNA, 22 nt, Human
acuggagcugagagcaugggua

SEQ ID NO: 1080979 - RNA, 22 nt, Human
agccuggccugggcaggcacau

SEQ ID NO: 1080980 - RNA, 16 nt, Human
gcaggaguaccacuug

SEQ ID NO: 1080981 - RNA, 22 nt, Human
aguuacauucugagcugaguag

SEQ ID NO: 1080982 - RNA, 22 nt, Human
ugccucugguuaucugguaccu

SEQ ID NO: 1080983 - RNA, 22 nt, Human
ucaggauccauagacucccaaa

SEQ ID NO: 1080984 - RNA, 22 nt, Human
ggcugcaggcagaggcugucug

SEQ ID NO: 1080985 - RNA, 22 nt, Human
cacagaggaaaggcaguuggua

SEQ ID NO: 1080986 - RNA, 22 nt, Human
ccaggcucacugacuaccacau

SEQ ID NO: 1080987 - RNA, 22 nt, Human
agauuugucagcucagucuuua

SEQ ID NO: 1080988 - RNA, 22 nt, Human
aaaggccacacagagcagggag

SEQ ID NO: 1080989 - RNA, 22 nt, Human
augaauauguacacaucuguca

SEQ ID NO: 1080990 - RNA, 22 nt, Human
auucaguuaaaaacuguacuuc

SEQ ID NO: 1080991 - RNA, 20 nt, Human
gauuucaaagcagaguggcc

SEQ ID NO: 1080992 - RNA, 22 nt, Human
ucuucuuccucauuuauacaua

SEQ ID NO: 1080993 - RNA, 22 nt, Human
cuuggccagacagggagcucca

SEQ ID NO: 1080994 - RNA, 22 nt, Human
ugagaauucuacaauagaucaa

SEQ ID NO: 1080995 - RNA, 22 nt, Human
aaagacauugaagaaggacuua

SEQ ID NO: 1080996 - RNA, 18 nt, Human
guucaagccaacaucaag

SEQ ID NO: 1080997 - RNA, 22 nt, Human
ugaaaaaacaaguuggcccauu

SEQ ID NO: 1080998 - RNA, 22 nt, Human
ugggcuccguugccuggggcag

SEQ ID NO: 1080999 - RNA, 22 nt, Human
uccuggguccauggcagccgaa

SEQ ID NO: 1081000 - RNA, 22 nt, Human
uuugcuaaauaagugauuaagu

SEQ ID NO: 1081001 - RNA, 22 nt, Human
uugcauuuuuagaugcuucugu

SEQ ID NO: 1081002 - RNA, 20 nt, Human
uccucccccaccuuugcagc

SEQ ID NO: 1081003 - RNA, 22 nt, Human
gagcagggccacuucuguaccu

SEQ ID NO: 1081004 - RNA, 22 nt, Human
cagaacuguuauaacagcuguu

SEQ ID NO: 1081005 - RNA, 22 nt, Human
uaaacagagagugcaguuauag

SEQ ID NO: 1081006 - RNA, 20 nt, Human
ggcaccaggcuaggauugga

SEQ ID NO: 1081007 - RNA, 22 nt, Human
cuguccuggagggcauaggacg

SEQ ID NO: 1081008 - RNA, 22 nt, Human
gacagggcgagacucagucuca

SEQ ID NO: 1081009 - RNA, 22 nt, Human
ccucccaccauuuagagagagc

SEQ ID NO: 1081010 - RNA, 22 nt, Human
ugagccugggcuuucucuggag

SEQ ID NO: 1081011 - RNA, 22 nt, Human
agcagcuguggaaaaguaacua

SEQ ID NO: 1081012 - RNA, 22 nt, Human
aaguguguugacugaauugggg

SEQ ID NO: 1081013 - RNA, 22 nt, Human
agggacuuguguccuauguaug

SEQ ID NO: 1081014 - RNA, 22 nt, Human
aagggcuggcccugggaagagu

SEQ ID NO: 1081015 - RNA, 22 nt, Human
uccagccuccuauuuacccuaa

SEQ ID NO: 1081016 - RNA, 22 nt, Human
aaaacugaaccuugagaucuuu

SEQ ID NO: 1081017 - RNA, 22 nt, Human
aagcagcugauuucacagcuca

SEQ ID NO: 1081018 - RNA, 22 nt, Human
acaguggaggccauaugguccu

SEQ ID NO: 1081019 - RNA, 22 nt, Human
aagauggcugcagcaauuccaa

SEQ ID NO: 1081020 - RNA, 22 nt, Human
agcagguggacagaggaagaaa

SEQ ID NO: 1081021 - RNA, 22 nt, Human
gaagcagcuaggaucuucauuu

SEQ ID NO: 1081022 - RNA, 22 nt, Human
auugcaaaggucccauucaaga

SEQ ID NO: 1081023 - RNA, 22 nt, Human
ugcccugguagacacagacugu

SEQ ID NO: 1081024 - RNA, 22 nt, Human
ugggcuggcugaacuucaaccu

SEQ ID NO: 1081025 - RNA, 22 nt, Human
gagagaagaaagccaugguccu

SEQ ID NO: 1081026 - RNA, 22 nt, Human
gaggagaaugcgcaccacauau

SEQ ID NO: 1081027 - RNA, 22 nt, Human
gucucuaucauagcugaacccu

SEQ ID NO: 1081028 - RNA, 22 nt, Human
gacaaaacugagaucacacugu

SEQ ID NO: 1081029 - RNA, 23 nt, Human
ugugggaauguuggagaggaaac

SEQ ID NO: 1081030 - RNA, 22 nt, Human
gagagggcugccuggugugagg

SEQ ID NO: 1081031 - RNA, 22 nt, Human
cugcccugucuuuuucugauga

SEQ ID NO: 1081032 - RNA, 22 nt, Human
caauguuucuuguaaccaguga

SEQ ID NO: 1081033 - RNA, 22 nt, Human
augagcaguagguucauggcug

SEQ ID NO: 1081034 - RNA, 22 nt, Human
ucacagaaaucuguuuuuucua

SEQ ID NO: 1081035 - RNA, 22 nt, Human
aaaaaccuuucauugcaaaugu

SEQ ID NO: 1081036 - RNA, 22 nt, Human
uccaaucuaguaugauaaauga

SEQ ID NO: 1081037 - RNA, 22 nt, Human
acuuccaggguagaggggaaga

SEQ ID NO: 1081038 - RNA, 22 nt, Human
aagguuucuccgaggcuauuuu

SEQ ID NO: 1081039 - RNA, 22 nt, Human
ggccugcacagagguggcucua

SEQ ID NO: 1081040 - RNA, 22 nt, Human
aaucccuuuuucauuuaauaga

SEQ ID NO: 1081041 - RNA, 22 nt, Human
ggcagugaaaaaguauguuucc

SEQ ID NO: 1081042 - RNA, 22 nt, Human
acacacaaaucuauuagugaau

SEQ ID NO: 1081043 - RNA, 22 nt, Human
uauguagaaaacaaaaguugaa

SEQ ID NO: 1081044 - RNA, 22 nt, Human
ugugccaagacuauauugugcu

SEQ ID NO: 1081045 - RNA, 22 nt, Human
gguggccuuucaguggaucagg

SEQ ID NO: 1081046 - RNA, 22 nt, Human
cuuggauuccgugaacuuaacc

SEQ ID NO: 1081047 - RNA, 23 nt, Human
uggacgccgacuuuggaggcgcu

SEQ ID NO: 1081048 - RNA, 21 nt, Human
uucucagagucuauuacaguu

SEQ ID NO: 1081049 - RNA, 17 nt, Human
gcugagaggcagcacag

SEQ ID NO: 1081050 - RNA, 22 nt, Human
gcuucuccucccgcucccaggc

SEQ ID NO: 1081051 - RNA, 22 nt, Human
gggcugggauggcuugaagauu

SEQ ID NO: 1081052 - RNA, 22 nt, Human
ugauacagucagcucacaauug

SEQ ID NO: 1081053 - RNA, 19 nt, Human
gccugagccagccaugcaa

SEQ ID NO: 1081054 - RNA, 22 nt, Human
gacauuuauuagaaaacuauca

SEQ ID NO: 1081055 - RNA, 22 nt, Human
aggcucaguucuguggugagcc

SEQ ID NO: 1081056 - RNA, 22 nt, Human
gcugcugguccucagagcucau

SEQ ID NO: 1081057 - RNA, 22 nt, Human
gucaggauuuuaaaaucccagu

SEQ ID NO: 1081058 - RNA, 22 nt, Human
uacuuugucauucuaaccuucc

SEQ ID NO: 1081059 - RNA, 19 nt, Human
ggcugagcgccuuggcugc

SEQ ID NO: 1081060 - RNA, 22 nt, Human
uuuggaauuggcauucuauucu

SEQ ID NO: 1081061 - RNA, 22 nt, Human
aucuuacaauuacaagacacuc

SEQ ID NO: 1081062 - RNA, 22 nt, Human
ucagcagggccuccuugugcag

SEQ ID NO: 1081063 - RNA, 22 nt, Human
uccuggccgccgcguggggccg

SEQ ID NO: 1081064 - RNA, 22 nt, Human
gaugcugggaccacagaguguu

SEQ ID NO: 1081065 - RNA, 22 nt, Human
auucacaguucauuagcuguaa

SEQ ID NO: 1081066 - RNA, 22 nt, Human
uguucccaagauaagauuauga

SEQ ID NO: 1081067 - RNA, 22 nt, Human
ucaagcaucuuggucuacgauc

SEQ ID NO: 1081068 - RNA, 22 nt, Human
cccugaggggaguggugaggug

SEQ ID NO: 1081069 - RNA, 22 nt, Human
ccagcgcuucccaucagggagg

SEQ ID NO: 1081070 - RNA, 22 nt, Human
gcacauacugcaaagauuacua

SEQ ID NO: 1081071 - RNA, 19 nt, Human
aggaaggaaccugagucug

SEQ ID NO: 1081072 - RNA, 22 nt, Human
cggggccucaguuuccccaccu

SEQ ID NO: 1081073 - RNA, 22 nt, Human
uaccugagcccagugcagcaua

SEQ ID NO: 1081074 - RNA, 22 nt, Human
gagauggccagugccaggacaa

SEQ ID NO: 1081075 - RNA, 22 nt, Human
guggggaaaggaguggggcuca

SEQ ID NO: 1081076 - RNA, 22 nt, Human
uccagucaggcugaauucaagg

SEQ ID NO: 1081077 - RNA, 17 nt, Human
uggagcugcguguguuc

SEQ ID NO: 1081078 - RNA, 23 nt, Human
cuggcucauccugguugcagugg

SEQ ID NO: 1081079 - RNA, 22 nt, Human
aagucacacuagacaacugagg

SEQ ID NO: 1081080 - RNA, 22 nt, Human
caggcccugccuugagggaccu

SEQ ID NO: 1081081 - RNA, 22 nt, Human
acccaggaggcagagguugcag

SEQ ID NO: 1081082 - RNA, 22 nt, Human
acagugaugccgggcgagaaug

SEQ ID NO: 1081083 - RNA, 22 nt, Human
auccuuaauuuacuugcaucuu

SEQ ID NO: 1081084 - RNA, 22 nt, Human
ucuuuucuccagaccugggauc

SEQ ID NO: 1081085 - RNA, 22 nt, Human
guagaaauagugguugacagga

SEQ ID NO: 1081086 - RNA, 22 nt, Human
ucacauuuggagaaagccugcc

SEQ ID NO: 1081087 - RNA, 22 nt, Human
agcaaagaagacacaggcuuca

SEQ ID NO: 1081088 - RNA, 22 nt, Human
cucagacuggggcucccugagu

SEQ ID NO: 1081089 - RNA, 22 nt, Human
ugcagggccagacuggguugga

SEQ ID NO: 1081090 - RNA, 22 nt, Human
cccucaugucagucccugccca

SEQ ID NO: 1081091 - RNA, 22 nt, Human
agggccugggauguccuccuag

SEQ ID NO: 1081092 - RNA, 22 nt, Human
uaagagaaggaucuguuccagg

SEQ ID NO: 1081093 - RNA, 22 nt, Human
guuugcauaucugugaaaugga

SEQ ID NO: 1081094 - RNA, 20 nt, Human
augaaauuccuguuuucuga

SEQ ID NO: 1081095 - RNA, 22 nt, Human
auguuuccagguucuuccuaug

SEQ ID NO: 1081096 - RNA, 22 nt, Human
auuccaaaaggauguuagaaug

SEQ ID NO: 1081097 - RNA, 22 nt, Human
gccagagagauggaaaagcuua

SEQ ID NO: 1081098 - RNA, 22 nt, Human
cagcuccagcccaggcagcucc

SEQ ID NO: 1081099 - RNA, 22 nt, Human
gcugguggcagagacaucaggu

SEQ ID NO: 1081100 - RNA, 22 nt, Human
ccggggacuuaaagugaaggaa

SEQ ID NO: 1081101 - RNA, 22 nt, Human
ccugggcugaagucaagugugg

SEQ ID NO: 1081102 - RNA, 22 nt, Human
cugagguggaacagaggugaag

SEQ ID NO: 1081103 - RNA, 22 nt, Human
aggccuggccugggcggcauug

SEQ ID NO: 1081104 - RNA, 22 nt, Human
auacauguaacugcauuguaau

SEQ ID NO: 1081105 - RNA, 22 nt, Human
uucaacaaacuguucacgaaug

SEQ ID NO: 1081106 - RNA, 22 nt, Human
ugagaagagcaaggaacugguu

SEQ ID NO: 1081107 - RNA, 22 nt, Human
gcugagaggcacuaucuccgga

SEQ ID NO: 1081108 - RNA, 22 nt, Human
aggcuccaugcaaaggcuguuu

SEQ ID NO: 1081109 - RNA, 22 nt, Human
cuuccucccccacacacucacu

SEQ ID NO: 1081110 - RNA, 22 nt, Human
acaaagucugaaaccugaggca

SEQ ID NO: 1081111 - RNA, 22 nt, Human
ugccugugcccuuugcugggag

SEQ ID NO: 1081112 - RNA, 22 nt, Human
aauauaugagggagcuauuuga

SEQ ID NO: 1081113 - RNA, 23 nt, Human
ugagaagccaggggagcgugagg

SEQ ID NO: 1081114 - RNA, 22 nt, Human
aaagucaucagaaccuuccaga

SEQ ID NO: 1081115 - RNA, 22 nt, Human
gagcagagcuucucaaaguaaa

SEQ ID NO: 1081116 - RNA, 22 nt, Human
uccuuugguucucuaagaugcu

SEQ ID NO: 1081117 - RNA, 22 nt, Human
uugacaagaaucguugccuugg

SEQ ID NO: 1081118 - RNA, 22 nt, Human
aauuauacauugaacaaucuag

SEQ ID NO: 1081119 - RNA, 22 nt, Human
ugucagcucauugaaggcacaa

SEQ ID NO: 1081120 - RNA, 22 nt, Human
ucuuuacaucacaauuguaugg

SEQ ID NO: 1081121 - RNA, 22 nt, Human
gugcccugcaugccccggguau

SEQ ID NO: 1081122 - RNA, 22 nt, Human
gaauuaaaauaguuuuggucga

SEQ ID NO: 1081123 - RNA, 22 nt, Human
acugggaagauggaggcaagca

SEQ ID NO: 1081124 - RNA, 22 nt, Human
ccccagccagcaggaccucuga

SEQ ID NO: 1081125 - RNA, 20 nt, Human
aggaaaaggguggugguaga

SEQ ID NO: 1081126 - RNA, 22 nt, Human
ggaaagggcagaggccuuggag

SEQ ID NO: 1081127 - RNA, 22 nt, Human
uuucuccaauguaucagcacac

SEQ ID NO: 1081128 - RNA, 22 nt, Human
ugauucaagcuacuguuacugg

SEQ ID NO: 1081129 - RNA, 22 nt, Human
ugaugcaauguuuacaucuuga

SEQ ID NO: 1081130 - RNA, 22 nt, Human
caggcagcucaaccuugggagc

SEQ ID NO: 1081131 - RNA, 22 nt, Human
ugucacaauaucccaaucugcc

SEQ ID NO: 1081132 - RNA, 22 nt, Human
ugagaagcaguuucaguaagaa

SEQ ID NO: 1081133 - RNA, 22 nt, Human
gcaccuggacagugacccuagc

SEQ ID NO: 1081134 - RNA, 22 nt, Human
gcaaaaauuccagggacgacuc

SEQ ID NO: 1081135 - RNA, 19 nt, Human
cuccaaguuaagagggagg

SEQ ID NO: 1081136 - RNA, 22 nt, Human
cagagagcuuagugugcugcau

SEQ ID NO: 1081137 - RNA, 22 nt, Human
ucugggcucuuaguguacccuc

SEQ ID NO: 1081138 - RNA, 22 nt, Human
ucucucugccaacucacagcca

SEQ ID NO: 1081139 - RNA, 22 nt, Human
aggcccaguccucugccgucug

SEQ ID NO: 1081140 - RNA, 22 nt, Human
ugaacacugccauauuuaagaa

SEQ ID NO: 1081141 - RNA, 22 nt, Human
auuaauuuuaccuuuguaaaca

SEQ ID NO: 1081142 - RNA, 22 nt, Human
ugaggcaggagaaucaccggaa

SEQ ID NO: 1081143 - RNA, 22 nt, Human
ugcucuggaauaguccuaggca

SEQ ID NO: 1081144 - RNA, 22 nt, Human
acagauggcaccuuuuugcugu

SEQ ID NO: 1081145 - RNA, 22 nt, Human
agcagccaaccuuacauucauc

SEQ ID NO: 1081146 - RNA, 16 nt, Human
uacauucugaucacug

SEQ ID NO: 1081147 - RNA, 22 nt, Human
ccugcccuaugaccagcuucac

SEQ ID NO: 1081148 - RNA, 22 nt, Human
ugcuggcuuccugugcacagca

SEQ ID NO: 1081149 - RNA, 22 nt, Human
uuuggaacaagacaaaacauua

SEQ ID NO: 1081150 - RNA, 22 nt, Human
agaagccaaucagcucucugcu

SEQ ID NO: 1081151 - RNA, 22 nt, Human
gucacuguuuccuauuauauuu

SEQ ID NO: 1081152 - RNA, 22 nt, Human
aauguugccccaggacaaagga

SEQ ID NO: 1081153 - RNA, 22 nt, Human
cacacaguggaguauuacucag

SEQ ID NO: 1081154 - RNA, 22 nt, Human
ucauugcaguugaguuguguua

SEQ ID NO: 1081155 - RNA, 22 nt, Human
guauuauugucaugaaauaaua

SEQ ID NO: 1081156 - RNA, 22 nt, Human
augggaugcauggcuguggcca

SEQ ID NO: 1081157 - RNA, 22 nt, Human
gucugagacccacucccagaga

SEQ ID NO: 1081158 - RNA, 22 nt, Human
ggaggcugcugccucacguggg

SEQ ID NO: 1081159 - RNA, 22 nt, Human
ugagagugauugguucgaaugu

SEQ ID NO: 1081160 - RNA, 22 nt, Human
uggcagugggaagcuggaaguc

SEQ ID NO: 1081161 - RNA, 22 nt, Human
gaagggugcauggagggaaguc

SEQ ID NO: 1081162 - RNA, 20 nt, Human
cacugggcuggagucagggc

SEQ ID NO: 1081163 - RNA, 22 nt, Human
uuaccaccuguaucacauuuuu

SEQ ID NO: 1081164 - RNA, 22 nt, Human
ggucccagguugacagggagac

SEQ ID NO: 1081165 - RNA, 18 nt, Human
cacaggaaggggaauauc

SEQ ID NO: 1081166 - RNA, 22 nt, Human
auaaagcuaagacuuacaugaa

SEQ ID NO: 1081167 - RNA, 22 nt, Human
gagggcugauguugccaccuca

SEQ ID NO: 1081168 - RNA, 22 nt, Human
caggaacaggggagugaaccug

SEQ ID NO: 1081169 - RNA, 22 nt, Human
gucaaauauuaugcagcuugga

SEQ ID NO: 1081170 - RNA, 22 nt, Human
gcugaaauuagacugcagaagu

SEQ ID NO: 1081171 - RNA, 22 nt, Human
cugggccaagaaguuguguaug

SEQ ID NO: 1081172 - RNA, 22 nt, Human
gcugggcaaggcugaagcuacc

SEQ ID NO: 1081173 - RNA, 22 nt, Human
ggucauugucagagccuguacu

SEQ ID NO: 1081174 - RNA, 22 nt, Human
uaacaugucccugauucuuugu

SEQ ID NO: 1081175 - RNA, 22 nt, Human
acuugguucuaacuaguguaua

SEQ ID NO: 1081176 - RNA, 22 nt, Human
uuauucacucauuaaagcagga

SEQ ID NO: 1081177 - RNA, 22 nt, Human
uucuuaagcaccuaaaaagugg

SEQ ID NO: 1081178 - RNA, 22 nt, Human
cuccugggagcagggauggaug

SEQ ID NO: 1081179 - RNA, 22 nt, Human
gcacaugagcugcugggauggg

SEQ ID NO: 1081180 - RNA, 22 nt, Human
agcugaagcaacaacaggaugg

SEQ ID NO: 1081181 - RNA, 22 nt, Human
ucucccuggagcccugaagcau

SEQ ID NO: 1081182 - RNA, 22 nt, Human
agucugggagaaggugagauua

SEQ ID NO: 1081183 - RNA, 22 nt, Human
gcaggagagucugugccagguu

SEQ ID NO: 1081184 - RNA, 22 nt, Human
agaggaugguugaggaagaccu

SEQ ID NO: 1081185 - RNA, 21 nt, Human
ggccagcucggaaggucccau

SEQ ID NO: 1081186 - RNA, 22 nt, Human
ccaggcuagaaacugaggcaca

SEQ ID NO: 1081187 - RNA, 19 nt, Human
auaaggcaauuggauuugg

SEQ ID NO: 1081188 - RNA, 22 nt, Human
uacauacacaaauauacuguuu

SEQ ID NO: 1081189 - RNA, 22 nt, Human
cacagcuugggcucugacaaua

SEQ ID NO: 1081190 - RNA, 22 nt, Human
gcagcugccgugagcucacgcc

SEQ ID NO: 1081191 - RNA, 22 nt, Human
uuccagaauuuuguucugcuug

SEQ ID NO: 1081192 - RNA, 22 nt, Human
auauuaguguagguagcuaaua

SEQ ID NO: 1081193 - RNA, 22 nt, Human
uguguucaaugacuucaucuuu

SEQ ID NO: 1081194 - RNA, 22 nt, Human
caaagcagcggauugggauagu

SEQ ID NO: 1081195 - RNA, 22 nt, Human
gcagagugaagcaguauggaaa

SEQ ID NO: 1081196 - RNA, 22 nt, Human
gggaccugaggagggguuucag

SEQ ID NO: 1081197 - RNA, 22 nt, Human
ugccaggcacgugagaguggcc

SEQ ID NO: 1081198 - RNA, 22 nt, Human
uuacacaaaagcaagugugugu

SEQ ID NO: 1081199 - RNA, 22 nt, Human
caggaaccuaaugaaggcucac

SEQ ID NO: 1081200 - RNA, 22 nt, Human
accauuaagaaucugguuuccu

SEQ ID NO: 1081201 - RNA, 22 nt, Human
gcagugauggggaucucacugg

SEQ ID NO: 1081202 - RNA, 22 nt, Human
caagaauuaagaauuuugaugu

SEQ ID NO: 1081203 - RNA, 22 nt, Human
agcaaagcacuuugcauacaua

SEQ ID NO: 1081204 - RNA, 22 nt, Human
uaauguuuagaagcagacagcu

SEQ ID NO: 1081205 - RNA, 21 nt, Human
ugaggccucuccugggcuggc

SEQ ID NO: 1081206 - RNA, 22 nt, Human
cuaguucuagaucccugaggaa

SEQ ID NO: 1081207 - RNA, 20 nt, Human
aguggggagucaggagugcc

SEQ ID NO: 1081208 - RNA, 22 nt, Human
uccuucagccaugggcucucca

SEQ ID NO: 1081209 - RNA, 22 nt, Human
uccaggccccugccugggccug

SEQ ID NO: 1081210 - RNA, 22 nt, Human
gcagccacugggagugcuuaua

SEQ ID NO: 1081211 - RNA, 22 nt, Human
cugagcccguugugaauauucc

SEQ ID NO: 1081212 - RNA, 22 nt, Human
ggaggagacccugugucaguuu

SEQ ID NO: 1081213 - RNA, 22 nt, Human
cucagugaauuggaggauggcc

SEQ ID NO: 1081214 - RNA, 22 nt, Human
uguuagcugugcuuuagccuuc

SEQ ID NO: 1081215 - RNA, 22 nt, Human
ccuggccagaggcgugccugug

SEQ ID NO: 1081216 - RNA, 21 nt, Human
guucuggaggcugcaagucca

SEQ ID NO: 1081217 - RNA, 21 nt, Human
cccuguguuccacagcagaca

SEQ ID NO: 1081218 - RNA, 22 nt, Human
agcuccugcacccagccuugag

SEQ ID NO: 1081219 - RNA, 22 nt, Human
caagcagauauuuuagucaaga

SEQ ID NO: 1081220 - RNA, 22 nt, Human
gucugaggaagaugcaggggga

SEQ ID NO: 1081221 - RNA, 22 nt, Human
uuucacaacugcuuauuugaga

SEQ ID NO: 1081222 - RNA, 22 nt, Human
accuuaaaugugacauagucua

SEQ ID NO: 1081223 - RNA, 22 nt, Human
ggcaugggccgaggugccuccu

SEQ ID NO: 1081224 - RNA, 22 nt, Human
agggcacagccuaaagccuaug

SEQ ID NO: 1081225 - RNA, 22 nt, Human
cagagcugacccaaggauugaa

SEQ ID NO: 1081226 - RNA, 22 nt, Human
guaacaguuuggguuccaauug

SEQ ID NO: 1081227 - RNA, 22 nt, Human
gggcagcucuggcugugggaag

SEQ ID NO: 1081228 - RNA, 22 nt, Human
agacagagauacuauguuguca

SEQ ID NO: 1081229 - RNA, 22 nt, Human
gaauauuuguaauuacuguuga

SEQ ID NO: 1081230 - RNA, 22 nt, Human
gcagagucugguaggugcuggu

SEQ ID NO: 1081231 - RNA, 18 nt, Human
ugcaaaggacacugagau

SEQ ID NO: 1081232 - RNA, 20 nt, Human
gcagagcuguucugugggga

SEQ ID NO: 1081233 - RNA, 22 nt, Human
ucacaucacaugagugcaagga

SEQ ID NO: 1081234 - RNA, 22 nt, Human
aggcagcagggccacuggcuga

SEQ ID NO: 1081235 - RNA, 22 nt, Human
aaauccuggccucaaguggucc

SEQ ID NO: 1081236 - RNA, 22 nt, Human
acucaggaagaaagcagcuggu

SEQ ID NO: 1081237 - RNA, 22 nt, Human
guucacaguuucuaaucccagc

SEQ ID NO: 1081238 - RNA, 22 nt, Human
ugggcuuaggucggaggcggcc

SEQ ID NO: 1081239 - RNA, 22 nt, Human
guuauucugcacaccuuuaaaa

SEQ ID NO: 1081240 - RNA, 22 nt, Human
agagacaagaaauaccugggac

SEQ ID NO: 1081241 - RNA, 22 nt, Human
cucccucccuacgugagcucac

SEQ ID NO: 1081242 - RNA, 22 nt, Human
cagguggcuuagucccauuuua

SEQ ID NO: 1081243 - RNA, 22 nt, Human
aaggugguuguaggcuggucug

SEQ ID NO: 1081244 - RNA, 22 nt, Human
uuuuaucuaccuaugcucauuu

SEQ ID NO: 1081245 - RNA, 22 nt, Human
acagugauaaaauuucacaugu

SEQ ID NO: 1081246 - RNA, 22 nt, Human
aaaaguauaggguuuggaguca

SEQ ID NO: 1081247 - RNA, 21 nt, Human
uuugugugucacgugcacagg

SEQ ID NO: 1081248 - RNA, 22 nt, Human
ggcaggcuccagagcccucucc

SEQ ID NO: 1081249 - RNA, 22 nt, Human
ugggcacuguagcuggugcugg

SEQ ID NO: 1081250 - RNA, 22 nt, Human
aaaucagagaauauauuuagaa

SEQ ID NO: 1081251 - RNA, 22 nt, Human
agaccaaagaaaacacaucugg

SEQ ID NO: 1081252 - RNA, 22 nt, Human
ugagagagcgccugggaucauu

SEQ ID NO: 1081253 - RNA, 22 nt, Human
ggcagguggacgugcuaaagcu

SEQ ID NO: 1081254 - RNA, 22 nt, Human
aauguuaauguguuugcuuaug

SEQ ID NO: 1081255 - RNA, 20 nt, Human
ccuuuagaaacucauaugua

SEQ ID NO: 1081256 - RNA, 22 nt, Human
ugccuguggaaaggcuggugcu

SEQ ID NO: 1081257 - RNA, 22 nt, Human
gccacccccaaguagguggucu

SEQ ID NO: 1081258 - RNA, 21 nt, Human
uccuccuucaaguccuggccu

SEQ ID NO: 1081259 - RNA, 22 nt, Human
gaacuacagugcauuuucuuaa

SEQ ID NO: 1081260 - RNA, 22 nt, Human
ucucaggaagauuagggcuaag

SEQ ID NO: 1081261 - RNA, 22 nt, Human
ucaggcagaaaaaucacuaauu

SEQ ID NO: 1081262 - RNA, 22 nt, Human
agucccuguacuuuccacugcc

SEQ ID NO: 1081263 - RNA, 22 nt, Human
cauccugguuaccccauaguca

SEQ ID NO: 1081264 - RNA, 22 nt, Human
cagcugagaaauggggaaaggg

SEQ ID NO: 1081265 - RNA, 22 nt, Human
ggcugccugaacuuuggggaaa

SEQ ID NO: 1081266 - RNA, 22 nt, Human
gauucacagaacuuagucaagc

SEQ ID NO: 1081267 - RNA, 22 nt, Human
cccagccugucuuucccaauga

SEQ ID NO: 1081268 - RNA, 22 nt, Human
uuaaggaauuacgaaaauauuu

SEQ ID NO: 1081269 - RNA, 22 nt, Human
ugcuugucagugugcuagaaac

SEQ ID NO: 1081270 - RNA, 22 nt, Human
ucaggagguugaccacggggca

SEQ ID NO: 1081271 - RNA, 22 nt, Human
auucuacaaucauguagauccu

SEQ ID NO: 1081272 - RNA, 22 nt, Human
aaaguuaguuucuuauaugucu

SEQ ID NO: 1081273 - RNA, 18 nt, Human
uuauuuguuacagcacau

SEQ ID NO: 1081274 - RNA, 22 nt, Human
agaagugcuccagugaguuggg

SEQ ID NO: 1081275 - RNA, 22 nt, Human
aaacaccagcacuguuuacaaa

SEQ ID NO: 1081276 - RNA, 19 nt, Human
acuaaaaaugauguuugag

SEQ ID NO: 1081277 - RNA, 22 nt, Human
ugcuggccgugagcucucggga

SEQ ID NO: 1081278 - RNA, 22 nt, Human
acagggcagagggcaguuggua

SEQ ID NO: 1081279 - RNA, 22 nt, Human
cccucacucugccuccuggggu

SEQ ID NO: 1081280 - RNA, 22 nt, Human
gcuucucuggccugcagggcau

SEQ ID NO: 1081281 - RNA, 22 nt, Human
gcauacaaagguuuacaacuga

SEQ ID NO: 1081282 - RNA, 22 nt, Human
gcuggcugggucccugagaggc

SEQ ID NO: 1081283 - RNA, 17 nt, Human
aagacagaagccaugag

SEQ ID NO: 1081284 - RNA, 20 nt, Human
uagauuucauacuucucuuu

SEQ ID NO: 1081285 - RNA, 22 nt, Human
acuugcauuauauuuaucacaa

SEQ ID NO: 1081286 - RNA, 22 nt, Human
cagugcaguugguggcaggggu

SEQ ID NO: 1081287 - RNA, 22 nt, Human
ggcagagcuugcagugagccga

SEQ ID NO: 1081288 - RNA, 22 nt, Human
ugagccugggagauggaggcug

SEQ ID NO: 1081289 - RNA, 22 nt, Human
cugggcacaggggagcagaguc

SEQ ID NO: 1081290 - RNA, 22 nt, Human
augaggcacaucacagccaaug

SEQ ID NO: 1081291 - RNA, 19 nt, Human
uuucaaagggcauaagccu

SEQ ID NO: 1081292 - RNA, 22 nt, Human
ggcgugggaaguggggcuucug

SEQ ID NO: 1081293 - RNA, 22 nt, Human
augucaaaugcugcaaacucau

SEQ ID NO: 1081294 - RNA, 23 nt, Human
acaacuuuacagauacauuuugu

SEQ ID NO: 1081295 - RNA, 22 nt, Human
cugcaggguuucgccaguugug

SEQ ID NO: 1081296 - RNA, 22 nt, Human
acacuucaaagggugacuugau

SEQ ID NO: 1081297 - RNA, 22 nt, Human
agacaaagaaaccguagaagca

SEQ ID NO: 1081298 - RNA, 22 nt, Human
caaaaccaagaacauucauuuc

SEQ ID NO: 1081299 - RNA, 22 nt, Human
gagcagcuagauaaagcccuuc

SEQ ID NO: 1081300 - RNA, 20 nt, Human
caccuucaaauuuccuggca

SEQ ID NO: 1081301 - RNA, 22 nt, Human
acaugcugggcaauguuguuuu

SEQ ID NO: 1081302 - RNA, 22 nt, Human
ucuuaacaagcuccucagugcu

SEQ ID NO: 1081303 - RNA, 22 nt, Human
ugccaggcucaggaugucccug

SEQ ID NO: 1081304 - RNA, 22 nt, Human
uaguuauuauuguuacuaucag

SEQ ID NO: 1081305 - RNA, 22 nt, Human
uuugugaacaaacaugaagaug

SEQ ID NO: 1081306 - RNA, 22 nt, Human
ugaggugaagaguggagcucag

SEQ ID NO: 1081307 - RNA, 22 nt, Human
caggcacuggccagucagcaca

SEQ ID NO: 1081308 - RNA, 22 nt, Human
auguaacaaaugguauacaugu

SEQ ID NO: 1081309 - RNA, 22 nt, Human
auuagaacuaggcuaaguaaaa

SEQ ID NO: 1081310 - RNA, 22 nt, Human
uuugggcugagaugugggccga

SEQ ID NO: 1081311 - RNA, 22 nt, Human
gccuggaggggacagucucugg

SEQ ID NO: 1081312 - RNA, 22 nt, Human
agauuucccucuuguauuugca

SEQ ID NO: 1081313 - RNA, 22 nt, Human
uacuuucuaagacauacaacuu

SEQ ID NO: 1081314 - RNA, 22 nt, Human
uacagaaagaccucucgggaaa

SEQ ID NO: 1081315 - RNA, 22 nt, Human
uuagauaacaguagaauaucaa

SEQ ID NO: 1081316 - RNA, 22 nt, Human
agggggcaggagagaccugcug

SEQ ID NO: 1081317 - RNA, 22 nt, Human
ggucccagaauugguuagcaca

SEQ ID NO: 1081318 - RNA, 22 nt, Human
ugcuuggcuuucugagcuucug

SEQ ID NO: 1081319 - RNA, 22 nt, Human
ugggcagaguugugaugaacug

SEQ ID NO: 1081320 - RNA, 22 nt, Human
agaggccagggacacugcucaa

SEQ ID NO: 1081321 - RNA, 22 nt, Human
aguuauuacucuuuaacauauu

SEQ ID NO: 1081322 - RNA, 22 nt, Human
agcaguggugugaggagggcuc

SEQ ID NO: 1081323 - RNA, 22 nt, Human
ccaaggagcaaggcucaacaag

SEQ ID NO: 1081324 - RNA, 22 nt, Human
gcaggggaguccacucuaugca

SEQ ID NO: 1081325 - RNA, 22 nt, Human
ugcugccagggcucugcccaca

SEQ ID NO: 1081326 - RNA, 22 nt, Human
uucccuccgaaccucagugcug

SEQ ID NO: 1081327 - RNA, 19 nt, Human
cagauguuuucaguucauu

SEQ ID NO: 1081328 - RNA, 22 nt, Human
caucauuuuauuaaccaagaaa

SEQ ID NO: 1081329 - RNA, 22 nt, Human
guucauuuuuagaaugcuagua

SEQ ID NO: 1081330 - RNA, 20 nt, Human
agccaggguucuggaugcac

SEQ ID NO: 1081331 - RNA, 22 nt, Human
ccagagccuaagaucugauccu

SEQ ID NO: 1081332 - RNA, 22 nt, Human
aggcagcagucaugaggaaaga

SEQ ID NO: 1081333 - RNA, 17 nt, Human
cuauuuuggagauuaaa

SEQ ID NO: 1081334 - RNA, 22 nt, Human
cugaggugcuauggaggauacg

SEQ ID NO: 1081335 - RNA, 22 nt, Human
gcaaagcaagauucagauguag

SEQ ID NO: 1081336 - RNA, 21 nt, Human
ccucaucaaacuuucacuugc

SEQ ID NO: 1081337 - RNA, 22 nt, Human
uauuaacaugaacugacuuuuc

SEQ ID NO: 1081338 - RNA, 22 nt, Human
uaauguagggguguaacacaca

SEQ ID NO: 1081339 - RNA, 22 nt, Human
gcccaggcuggagugcaguagc

SEQ ID NO: 1081340 - RNA, 18 nt, Human
ggcaggcucucuggguca

SEQ ID NO: 1081341 - RNA, 22 nt, Human
gcuggcugcgucaucacagggc

SEQ ID NO: 1081342 - RNA, 22 nt, Human
uuguuaaagaugcagauuccau

SEQ ID NO: 1081343 - RNA, 22 nt, Human
agggggcaucagguccuggcuc

SEQ ID NO: 1081344 - RNA, 22 nt, Human
ucagagccaaucauggugcauu

SEQ ID NO: 1081345 - RNA, 22 nt, Human
uucucugagauagacuaagugg

SEQ ID NO: 1081346 - RNA, 22 nt, Human
caagcccaggauuccccaguua

SEQ ID NO: 1081347 - RNA, 22 nt, Human
uucuggaggccccuuccuucuc

SEQ ID NO: 1081348 - RNA, 22 nt, Human
uagggcuauucugaguaauaau

SEQ ID NO: 1081349 - RNA, 18 nt, Human
gaguguggcacugggccc

SEQ ID NO: 1081350 - RNA, 22 nt, Human
uccaggcauaaugcccaguggu

SEQ ID NO: 1081351 - RNA, 22 nt, Human
acauuugagucauauuugcuua

SEQ ID NO: 1081352 - RNA, 22 nt, Human
ccugccuggaucagccauccug

SEQ ID NO: 1081353 - RNA, 22 nt, Human
gggaagugaggagccccucugc

SEQ ID NO: 1081354 - RNA, 22 nt, Human
uuuaucacagaauaagaaguca

SEQ ID NO: 1081355 - RNA, 22 nt, Human
cagcuucucagaaagcugaggu

SEQ ID NO: 1081356 - RNA, 22 nt, Human
ccucugcagcagagagccagag

SEQ ID NO: 1081357 - RNA, 22 nt, Human
ugggagcaagcuggugcuggag

SEQ ID NO: 1081358 - RNA, 22 nt, Human
aauucacaaaaccagauugcuu

SEQ ID NO: 1081359 - RNA, 22 nt, Human
aguucuggaacucuacagcaac

SEQ ID NO: 1081360 - RNA, 22 nt, Human
auuaaagaaacccagcauguga

SEQ ID NO: 1081361 - RNA, 22 nt, Human
cguagguggcucagcaccuggg

SEQ ID NO: 1081362 - RNA, 22 nt, Human
aucagaaaguucaucauguuug

SEQ ID NO: 1081363 - RNA, 22 nt, Human
cagagcagagugauuguucugg

SEQ ID NO: 1081364 - RNA, 23 nt, Human
gguccaggaaaggcagcagcacc

SEQ ID NO: 1081365 - RNA, 22 nt, Human
ucuggauggucagcucuuccug

SEQ ID NO: 1081366 - RNA, 22 nt, Human
cacauuuaauugguuuagggug

SEQ ID NO: 1081367 - RNA, 22 nt, Human
ugcuuccugaggccgucuucuc

SEQ ID NO: 1081368 - RNA, 22 nt, Human
caggaacaauaccucuugccag

SEQ ID NO: 1081369 - RNA, 22 nt, Human
ccuggaggagcgcugaccagcu

SEQ ID NO: 1081370 - RNA, 22 nt, Human
ugaggcucagaaauguaaguuu

SEQ ID NO: 1081371 - RNA, 23 nt, Human
ugggcagcuucugcaugcccacc

SEQ ID NO: 1081372 - RNA, 22 nt, Human
uuugaaguggaaaaggauuuaa

SEQ ID NO: 1081373 - RNA, 22 nt, Human
gaagaaagggaauuaacuugag

SEQ ID NO: 1081374 - RNA, 22 nt, Human
aagaauggugguggggccagca

SEQ ID NO: 1081375 - RNA, 22 nt, Human
gagaaagauguaggcugggagg

SEQ ID NO: 1081376 - RNA, 22 nt, Human
ggcagcucugaugaugcucugg

SEQ ID NO: 1081377 - RNA, 22 nt, Human
cugccagcucucuggaggcucu

SEQ ID NO: 1081378 - RNA, 22 nt, Human
ccagaaacaccuggauucuguu

SEQ ID NO: 1081379 - RNA, 22 nt, Human
ucugaaauggggcugaagcacu

SEQ ID NO: 1081380 - RNA, 21 nt, Human
uagagccagugguguucugac

SEQ ID NO: 1081381 - RNA, 22 nt, Human
acucugggccccagguggagcu

SEQ ID NO: 1081382 - RNA, 22 nt, Human
ggcucuggcaaggggaggcuac

SEQ ID NO: 1081383 - RNA, 23 nt, Human
ugagggacaugguggcuucugag

SEQ ID NO: 1081384 - RNA, 22 nt, Human
gaaagauaaucaauuacuccuu

SEQ ID NO: 1081385 - RNA, 22 nt, Human
acauucuauuucaucaugucua

SEQ ID NO: 1081386 - RNA, 22 nt, Human
uugcccugaagaacgucccaga

SEQ ID NO: 1081387 - RNA, 22 nt, Human
uccuucaguuaaagaucucaca

SEQ ID NO: 1081388 - RNA, 22 nt, Human
cuggccuuggugcuugcagaca

SEQ ID NO: 1081389 - RNA, 22 nt, Human
gccucugcaauuacauugugcc

SEQ ID NO: 1081390 - RNA, 22 nt, Human
cagccugcccuggaagcccagc

SEQ ID NO: 1081391 - RNA, 22 nt, Human
agcaggagauggggcgugaugu

SEQ ID NO: 1081392 - RNA, 22 nt, Human
caaggauagguacuauguaaua

SEQ ID NO: 1081393 - RNA, 22 nt, Human
ugggcagaucuuugguggcuag

SEQ ID NO: 1081394 - RNA, 22 nt, Human
caguggccugagccaggcuucc

SEQ ID NO: 1081395 - RNA, 22 nt, Human
agauguuuuguguauuucauca

SEQ ID NO: 1081396 - RNA, 22 nt, Human
gcccucagaugggaaaggaggg

SEQ ID NO: 1081397 - RNA, 22 nt, Human
auguagcaucuauccugauaaa

SEQ ID NO: 1081398 - RNA, 22 nt, Human
aacaauaggagugaugcaguau

SEQ ID NO: 1081399 - RNA, 22 nt, Human
cuguugucccugggagcucagc

SEQ ID NO: 1081400 - RNA, 22 nt, Human
auauuucuugagcaccugguau

SEQ ID NO: 1081401 - RNA, 22 nt, Human
uuugucaaaucaaaccacauuc

SEQ ID NO: 1081402 - RNA, 22 nt, Human
ucccagccuuccuuguggugaa

SEQ ID NO: 1081403 - RNA, 22 nt, Human
caugggcaccuuaaaaugaggc

SEQ ID NO: 1081404 - RNA, 22 nt, Human
augauacucuaggugauuuaca

SEQ ID NO: 1081405 - RNA, 22 nt, Human
cuuuagauguugcuuuaacuau

SEQ ID NO: 1081406 - RNA, 22 nt, Human
caggguggcccuguggucucau

SEQ ID NO: 1081407 - RNA, 22 nt, Human
ccugccuggcuuccagaagaga

SEQ ID NO: 1081408 - RNA, 22 nt, Human
ucugggagcacacgcagugauc

SEQ ID NO: 1081409 - RNA, 22 nt, Human
cagcauuuuccauagaaagaag

SEQ ID NO: 1081410 - RNA, 22 nt, Human
guguuuccuaguuuaaugaaug

SEQ ID NO: 1081411 - RNA, 22 nt, Human
augcaaaaguaguugcaguuuu

SEQ ID NO: 1081412 - RNA, 22 nt, Human
ucccagagcugauaagccuuua

SEQ ID NO: 1081413 - RNA, 22 nt, Human
ucccagggugcgccugcccucg

SEQ ID NO: 1081414 - RNA, 22 nt, Human
gaagcagcucagauugacugaa

SEQ ID NO: 1081415 - RNA, 22 nt, Human
uguccuguccuuccuggaaguc

SEQ ID NO: 1081416 - RNA, 22 nt, Human
agaagcugacagaugcagcagg

SEQ ID NO: 1081417 - RNA, 22 nt, Human
cugagccccaucugaggugccc

SEQ ID NO: 1081418 - RNA, 19 nt, Human
ugcaagugucuuggacaag

SEQ ID NO: 1081419 - RNA, 22 nt, Human
cccaugccuucugacucacagg

SEQ ID NO: 1081420 - RNA, 18 nt, Human
gccaggaagaggaaugug

SEQ ID NO: 1081421 - RNA, 22 nt, Human
agagagcccgggccagggcaca

SEQ ID NO: 1081422 - RNA, 22 nt, Human
auguuaaaugguuuauuauuaa

SEQ ID NO: 1081423 - RNA, 22 nt, Human
agauuauuuccagacuaaugaa

SEQ ID NO: 1081424 - RNA, 22 nt, Human
ggaggaugagcuacgaggagcu

SEQ ID NO: 1081425 - RNA, 22 nt, Human
uggcucagagccuugagagcug

SEQ ID NO: 1081426 - RNA, 22 nt, Human
aauacuugggcugagauuuuug

SEQ ID NO: 1081427 - RNA, 23 nt, Human
gcccauggagucuggaucuggcc

SEQ ID NO: 1081428 - RNA, 19 nt, Human
aucagcaagguaggaugug

SEQ ID NO: 1081429 - RNA, 22 nt, Human
ucaguaaaugaaugaauauaug

SEQ ID NO: 1081430 - RNA, 22 nt, Human
aacaguaagagauguuuuaucu

SEQ ID NO: 1081431 - RNA, 22 nt, Human
uuucucaaguucagauauuuga

SEQ ID NO: 1081432 - RNA, 22 nt, Human
gacuuuaaagguucugcugcuu

SEQ ID NO: 1081433 - RNA, 22 nt, Human
uucaggcaucccuacaguuagg

SEQ ID NO: 1081434 - RNA, 20 nt, Human
uuugucuguuaaguguuucu

SEQ ID NO: 1081435 - RNA, 22 nt, Human
ugggcccaagagagucuccaac

SEQ ID NO: 1081436 - RNA, 22 nt, Human
auuccaaagacagaagcagcug

SEQ ID NO: 1081437 - RNA, 22 nt, Human
aagcaccucuaugauugcuuuu

SEQ ID NO: 1081438 - RNA, 22 nt, Human
cccaaggcugcagugagcauga

SEQ ID NO: 1081439 - RNA, 22 nt, Human
gccggggcuggggagagacaug

SEQ ID NO: 1081440 - RNA, 22 nt, Human
aacacuuaaggagagaucaaau

SEQ ID NO: 1081441 - RNA, 22 nt, Human
uggaagggagugacagucagag

SEQ ID NO: 1081442 - RNA, 22 nt, Human
gugcccuguugcacacuugagg

SEQ ID NO: 1081443 - RNA, 22 nt, Human
gggaccugccauugcucacagg

SEQ ID NO: 1081444 - RNA, 22 nt, Human
ugggcuuuaucaugggucuggu

SEQ ID NO: 1081445 - RNA, 22 nt, Human
ucaacacaacagagaaaugcug

SEQ ID NO: 1081446 - RNA, 22 nt, Human
ccugagguggcugcagcacugc

SEQ ID NO: 1081447 - RNA, 22 nt, Human
ugaaucaaugaauugcacuuca

SEQ ID NO: 1081448 - RNA, 21 nt, Human
uuauaggcugggguuugcuuu

SEQ ID NO: 1081449 - RNA, 22 nt, Human
gugggggcaggcagugcuagga

SEQ ID NO: 1081450 - RNA, 17 nt, Human
caaggccagcaucuuca

SEQ ID NO: 1081451 - RNA, 22 nt, Human
uugcaggggaaggagcagagcu

SEQ ID NO: 1081452 - RNA, 22 nt, Human
uagcugccuaugugauaagaga

SEQ ID NO: 1081453 - RNA, 22 nt, Human
agcagcagaaaguugauggcag

SEQ ID NO: 1081454 - RNA, 22 nt, Human
ucaggccacggcucacugagac

SEQ ID NO: 1081455 - RNA, 22 nt, Human
uugcaacaucugaacauuuauc

SEQ ID NO: 1081456 - RNA, 22 nt, Human
acuauacaccaaaauauuaagg

SEQ ID NO: 1081457 - RNA, 22 nt, Human
uguaauauuguagugacaguac

SEQ ID NO: 1081458 - RNA, 22 nt, Human
aaauuauuaaacagugggaugc

SEQ ID NO: 1081459 - RNA, 22 nt, Human
cauuuaauagaugcuguuucag

SEQ ID NO: 1081460 - RNA, 22 nt, Human
gugcaugugucuuuauaguagc

SEQ ID NO: 1081461 - RNA, 22 nt, Human
gcuucuggaggagcugggcuga

SEQ ID NO: 1081462 - RNA, 22 nt, Human
uaacagaauccuguuauugcca

SEQ ID NO: 1081463 - RNA, 22 nt, Human
guaacaaacgguuccaagaugc

SEQ ID NO: 1081464 - RNA, 22 nt, Human
ugaaaagucuuauauugucuga

SEQ ID NO: 1081465 - RNA, 22 nt, Human
ggccauggaccccgagcugacc

SEQ ID NO: 1081466 - RNA, 22 nt, Human
acacauuuuguuaaacccugug

SEQ ID NO: 1081467 - RNA, 22 nt, Human
gcugccacucugagcuugcuuc

SEQ ID NO: 1081468 - RNA, 22 nt, Human
uuuuggaauuuauacaguaaug

SEQ ID NO: 1081469 - RNA, 22 nt, Human
uccucugccaaagggaguugcc

SEQ ID NO: 1081470 - RNA, 22 nt, Human
aggcccagcccguccucgugcu

SEQ ID NO: 1081471 - RNA, 22 nt, Human
ucugaggcauaaccuguucugc

SEQ ID NO: 1081472 - RNA, 22 nt, Human
ugaagcuggaagcaugcagacu

SEQ ID NO: 1081473 - RNA, 18 nt, Human
ccagcaugccagaggcug

SEQ ID NO: 1081474 - RNA, 21 nt, Human
uggcugcuggcccucucucca

SEQ ID NO: 1081475 - RNA, 22 nt, Human
cucagaguccccacaucugggu

SEQ ID NO: 1081476 - RNA, 22 nt, Human
agggcugacaaauggcagugac

SEQ ID NO: 1081477 - RNA, 22 nt, Human
aaugacaauaaucauuaacuuu

SEQ ID NO: 1081478 - RNA, 22 nt, Human
gaggucagucagaccaggguuu

SEQ ID NO: 1081479 - RNA, 22 nt, Human
uuguguccugauuugacacaau

SEQ ID NO: 1081480 - RNA, 20 nt, Human
accuugaacccgccagccau

SEQ ID NO: 1081481 - RNA, 22 nt, Human
acagucuugcuguauggucagg

SEQ ID NO: 1081482 - RNA, 21 nt, Human
auugaaagucaacaaucaguu

SEQ ID NO: 1081483 - RNA, 22 nt, Human
agagaaggucacuaaggaccca

SEQ ID NO: 1081484 - RNA, 22 nt, Human
ugucagugaguuaguugcaagu

SEQ ID NO: 1081485 - RNA, 22 nt, Human
acagaagauaacugggaccaga

SEQ ID NO: 1081486 - RNA, 22 nt, Human
uauugaguuacagaaaauacuu

SEQ ID NO: 1081487 - RNA, 22 nt, Human
uuaggcauauggcacaugauag

SEQ ID NO: 1081488 - RNA, 22 nt, Human
ucugagagcuguagaagccuau

SEQ ID NO: 1081489 - RNA, 22 nt, Human
gagccaggcccguacuugcugu

SEQ ID NO: 1081490 - RNA, 22 nt, Human
uucaaacacugcuuugagaggg

SEQ ID NO: 1081491 - RNA, 23 nt, Human
uccagcagagccuuccaggaggg

SEQ ID NO: 1081492 - RNA, 22 nt, Human
gcauuucagaaagguuaccaac

SEQ ID NO: 1081493 - RNA, 22 nt, Human
uucuuacaaguaugacguagca

SEQ ID NO: 1081494 - RNA, 23 nt, Human
uccuggugacaugccugagcauc

SEQ ID NO: 1081495 - RNA, 22 nt, Human
ccuuaaauucuccauuugaaag

SEQ ID NO: 1081496 - RNA, 22 nt, Human
cucugugcccuacugcucagcu

SEQ ID NO: 1081497 - RNA, 22 nt, Human
gaggccugaaaggggaccuaug

SEQ ID NO: 1081498 - RNA, 22 nt, Human
agugucauuuuguccaucuucu

SEQ ID NO: 1081499 - RNA, 22 nt, Human
aagaaauauugggccuuauaaa

SEQ ID NO: 1081500 - RNA, 18 nt, Human
ccucacagacuuccaugu

SEQ ID NO: 1081501 - RNA, 22 nt, Human
uauguauaugguagaaguaugu

SEQ ID NO: 1081502 - RNA, 21 nt, Human
gggcagaggggccuccugggu

SEQ ID NO: 1081503 - RNA, 22 nt, Human
aaacuacugauuugugaauuga

SEQ ID NO: 1081504 - RNA, 22 nt, Human
ugagcuggucuugaguguagcu

SEQ ID NO: 1081505 - RNA, 22 nt, Human
acagccauagaugcuuauguaa

SEQ ID NO: 1081506 - RNA, 22 nt, Human
ucaggcaggaagggaggacuug

SEQ ID NO: 1081507 - RNA, 22 nt, Human
ugugugcagacagauauuacuu

SEQ ID NO: 1081508 - RNA, 22 nt, Human
agugagggaugaagaacugcgg

SEQ ID NO: 1081509 - RNA, 22 nt, Human
caaaaagcuuagguaacaagcc

SEQ ID NO: 1081510 - RNA, 22 nt, Human
gaggguggcuccucccugggcc

SEQ ID NO: 1081511 - RNA, 23 nt, Human
ucuuuacauacugaugaguucuc

SEQ ID NO: 1081512 - RNA, 22 nt, Human
ucuggccuacuggaguccauga

SEQ ID NO: 1081513 - RNA, 21 nt, Human
ggacuuacauagguaaggggu

SEQ ID NO: 1081514 - RNA, 22 nt, Human
gugaagcagggaaggaaaggau

SEQ ID NO: 1081515 - RNA, 22 nt, Human
ucuggggacggggcccagcaau

SEQ ID NO: 1081516 - RNA, 22 nt, Human
uagugcuuaauaaauuucagaa

SEQ ID NO: 1081517 - RNA, 22 nt, Human
gggcugugggacccggcacuuu

SEQ ID NO: 1081518 - RNA, 22 nt, Human
agaaacuucagcuauucuuuug

SEQ ID NO: 1081519 - RNA, 22 nt, Human
auguuaacugaagccauucucg

SEQ ID NO: 1081520 - RNA, 22 nt, Human
gccugugguuugauuaagcauu

SEQ ID NO: 1081521 - RNA, 22 nt, Human
aaggagagagcuuugcuggaac

SEQ ID NO: 1081522 - RNA, 22 nt, Human
agcugaggcucugagagggaag

SEQ ID NO: 1081523 - RNA, 21 nt, Human
acagucuccccagaucucucc

SEQ ID NO: 1081524 - RNA, 22 nt, Human
aaaagcagaccacgcuuugugg

SEQ ID NO: 1081525 - RNA, 22 nt, Human
ucucaaguuauguaacagcugu

SEQ ID NO: 1081526 - RNA, 22 nt, Human
cuaugagaagaaaacaagauua

SEQ ID NO: 1081527 - RNA, 22 nt, Human
uggggcuguggauucucacgaa

SEQ ID NO: 1081528 - RNA, 22 nt, Human
agcucaggcaacucugggcccc

SEQ ID NO: 1081529 - RNA, 22 nt, Human
uucaguuuuauuguacugcuau

SEQ ID NO: 1081530 - RNA, 22 nt, Human
cagggcccagucccugcuguca

SEQ ID NO: 1081531 - RNA, 22 nt, Human
ugcugaaauauuuaugggucaa

SEQ ID NO: 1081532 - RNA, 22 nt, Human
augugggccgugcggguguccu

SEQ ID NO: 1081533 - RNA, 22 nt, Human
ugaagccagcuuuggaagacac

SEQ ID NO: 1081534 - RNA, 22 nt, Human
ccaaggagcaaguuuacaccug

SEQ ID NO: 1081535 - RNA, 19 nt, Human
guuuuucccagacgaggca

SEQ ID NO: 1081536 - RNA, 22 nt, Human
gaggaagcagggcuuggcugag

SEQ ID NO: 1081537 - RNA, 22 nt, Human
guacacacuauguauuguacac

SEQ ID NO: 1081538 - RNA, 22 nt, Human
acagagucugacagguaggcgc

SEQ ID NO: 1081539 - RNA, 22 nt, Human
cuccagggaggucugcaggacu

SEQ ID NO: 1081540 - RNA, 21 nt, Human
cugauugugaaagucaucauu

SEQ ID NO: 1081541 - RNA, 22 nt, Human
ucaggggacagccagcuggagg

SEQ ID NO: 1081542 - RNA, 22 nt, Human
ucaggcagaccaccgugggcag

SEQ ID NO: 1081543 - RNA, 22 nt, Human
gcagagccaugggagguuuuug

SEQ ID NO: 1081544 - RNA, 22 nt, Human
gagcagugaugggaggacguca

SEQ ID NO: 1081545 - RNA, 16 nt, Human
cagaguguaaacagga

SEQ ID NO: 1081546 - RNA, 22 nt, Human
auaucuuuguuuuugccaagau

SEQ ID NO: 1081547 - RNA, 19 nt, Human
ucuaauaucuacuucccug

SEQ ID NO: 1081548 - RNA, 22 nt, Human
aaguggagcuauaggcucagau

SEQ ID NO: 1081549 - RNA, 22 nt, Human
ccaaggaguagagcaggaagcu

SEQ ID NO: 1081550 - RNA, 22 nt, Human
aaggcacacaguuagauagagc

SEQ ID NO: 1081551 - RNA, 19 nt, Human
aggagaagacucucucccc

SEQ ID NO: 1081552 - RNA, 22 nt, Human
uaaggcacccuucugaguagag

SEQ ID NO: 1081553 - RNA, 22 nt, Human
aaaaguaauugaugcaaucgua

SEQ ID NO: 1081554 - RNA, 18 nt, Human
ugugguggagcugccuuc

SEQ ID NO: 1081555 - RNA, 22 nt, Human
cccuugcaucccauguguggcc

SEQ ID NO: 1081556 - RNA, 20 nt, Human
uuucagauuuacagaaaugu

SEQ ID NO: 1081557 - RNA, 22 nt, Human
uuacaaagagaaguuguagaau

SEQ ID NO: 1081558 - RNA, 22 nt, Human
acugggccuggauuggcguguc

SEQ ID NO: 1081559 - RNA, 22 nt, Human
gagaggugaaggcugcccuggg

SEQ ID NO: 1081560 - RNA, 22 nt, Human
caagagcugaggcuggagaggu

SEQ ID NO: 1081561 - RNA, 18 nt, Human
aaagaaggauuggagagc

SEQ ID NO: 1081562 - RNA, 22 nt, Human
cagacccucgggugaguuggcc

SEQ ID NO: 1081563 - RNA, 22 nt, Human
cauuugcagagggugacacucu

SEQ ID NO: 1081564 - RNA, 22 nt, Human
ucaggaggacagauaaggauag

SEQ ID NO: 1081565 - RNA, 22 nt, Human
uugguccugggcacugauuaac

SEQ ID NO: 1081566 - RNA, 22 nt, Human
uggggcuccuccuggcaggagg

SEQ ID NO: 1081567 - RNA, 22 nt, Human
uggcagcagccauggaaggccc

SEQ ID NO: 1081568 - RNA, 22 nt, Human
uuccucagccaaggcugggauc

SEQ ID NO: 1081569 - RNA, 22 nt, Human
uccaaagaauagaggugacauu

SEQ ID NO: 1081570 - RNA, 22 nt, Human
uccaacuuucuccuccggcuug

SEQ ID NO: 1081571 - RNA, 22 nt, Human
aauuuuaugccuugcacguugg

SEQ ID NO: 1081572 - RNA, 22 nt, Human
agggaguguaaauggugcucag

SEQ ID NO: 1081573 - RNA, 17 nt, Human
guccuacccauggucua

SEQ ID NO: 1081574 - RNA, 22 nt, Human
cugagccauaagggaggcuggg

SEQ ID NO: 1081575 - RNA, 22 nt, Human
agucaccaacaugguucccagg

SEQ ID NO: 1081576 - RNA, 22 nt, Human
agagcagauggagcuggaagag

SEQ ID NO: 1081577 - RNA, 22 nt, Human
cuggcagauauuugcagacaug

SEQ ID NO: 1081578 - RNA, 22 nt, Human
cgccucagccguggucaucuuc

SEQ ID NO: 1081579 - RNA, 22 nt, Human
acagauauaaacuauaguagug

SEQ ID NO: 1081580 - RNA, 22 nt, Human
aacugcauuugcauaaguccau

SEQ ID NO: 1081581 - RNA, 22 nt, Human
agccucagugucaccaucuacc

SEQ ID NO: 1081582 - RNA, 22 nt, Human
aucaaagugguuuucugugcuu

SEQ ID NO: 1081583 - RNA, 22 nt, Human
cuggccagcugacagcagggcu

SEQ ID NO: 1081584 - RNA, 22 nt, Human
uucaacauuugaaaugaaugaa

SEQ ID NO: 1081585 - RNA, 22 nt, Human
ucaauuucucagaaauggucuu

SEQ ID NO: 1081586 - RNA, 22 nt, Human
ggagugaaucacuagaugcaga

SEQ ID NO: 1081587 - RNA, 22 nt, Human
cacagccuugagcgaggacaag

SEQ ID NO: 1081588 - RNA, 22 nt, Human
uguaucuuucuguacuuuuaug

SEQ ID NO: 1081589 - RNA, 22 nt, Human
caggaguggugugagggacucc

SEQ ID NO: 1081590 - RNA, 22 nt, Human
ugucccaguucccaggguugcu

SEQ ID NO: 1081591 - RNA, 21 nt, Human
ggccucagccaccuggcucug

SEQ ID NO: 1081592 - RNA, 22 nt, Human
cugugccaggcccagcugacuu

SEQ ID NO: 1081593 - RNA, 22 nt, Human
auucuaaagcuuguggagcuua

SEQ ID NO: 1081594 - RNA, 22 nt, Human
gcuguagguuuuuccaggaguu

SEQ ID NO: 1081595 - RNA, 22 nt, Human
aaaggugacugcagcagcuauu

SEQ ID NO: 1081596 - RNA, 22 nt, Human
cugggcucagaaccuuguuaag

SEQ ID NO: 1081597 - RNA, 22 nt, Human
cuuuuuaucucuuaaugauguu

SEQ ID NO: 1081598 - RNA, 22 nt, Human
guccucagggaauguggcgggu

SEQ ID NO: 1081599 - RNA, 22 nt, Human
aaacagugauguugaguguaaa

SEQ ID NO: 1081600 - RNA, 21 nt, Human
caggaaaagcggaagucuagc

SEQ ID NO: 1081601 - RNA, 22 nt, Human
acuuucaagaacuucuuuaaug

SEQ ID NO: 1081602 - RNA, 22 nt, Human
auggcagagggauugaacagcu

SEQ ID NO: 1081603 - RNA, 18 nt, Human
acuggcuuuagcaucaga

SEQ ID NO: 1081604 - RNA, 22 nt, Human
uauaaagaauccagaagagaca

SEQ ID NO: 1081605 - RNA, 22 nt, Human
ucccaguguggcaggccaugga

SEQ ID NO: 1081606 - RNA, 22 nt, Human
aaggcagguauugaugccacag

SEQ ID NO: 1081607 - RNA, 22 nt, Human
ccugggucacucaggcaggcgg

SEQ ID NO: 1081608 - RNA, 22 nt, Human
ccaaggcaacguuggugucagg

SEQ ID NO: 1081609 - RNA, 22 nt, Human
aaaucauguuggcacaauaaaa

SEQ ID NO: 1081610 - RNA, 22 nt, Human
ucugaaggucugagaaccagga

SEQ ID NO: 1081611 - RNA, 21 nt, Human
uucaaagagugggcauuguca

SEQ ID NO: 1081612 - RNA, 22 nt, Human
ggccuugagagccagugcaggc

SEQ ID NO: 1081613 - RNA, 22 nt, Human
gugaaaugaaucuggaaauauu

SEQ ID NO: 1081614 - RNA, 22 nt, Human
ugguuccucaagcgcuggcggc

SEQ ID NO: 1081615 - RNA, 23 nt, Human
uguugaaguaacuguuacauaga

SEQ ID NO: 1081616 - RNA, 22 nt, Human
caggccaaaauucaggcauucu

SEQ ID NO: 1081617 - RNA, 22 nt, Human
cagccagugguugaagaugcag

SEQ ID NO: 1081618 - RNA, 22 nt, Human
ccugccugcguccucugagggc

SEQ ID NO: 1081619 - RNA, 22 nt, Human
cugcccuggcagccuaccaugg

SEQ ID NO: 1081620 - RNA, 22 nt, Human
ucaaagcuuagauaauuucuuu

SEQ ID NO: 1081621 - RNA, 22 nt, Human
acuccuggggauccauuccuuu

SEQ ID NO: 1081622 - RNA, 22 nt, Human
cugggccucaugcacagagaug

SEQ ID NO: 1081623 - RNA, 22 nt, Human
agcauugccugccuauugcuaa

SEQ ID NO: 1081624 - RNA, 22 nt, Human
uggcagaauuucuagcagauuc

SEQ ID NO: 1081625 - RNA, 22 nt, Human
gaugugggguugagggaccagc

SEQ ID NO: 1081626 - RNA, 22 nt, Human
uguguucaguaugacauucaca

SEQ ID NO: 1081627 - RNA, 20 nt, Human
cuuccacacaagaagcacag

SEQ ID NO: 1081628 - RNA, 21 nt, Human
acccuggguucuccauacccu

SEQ ID NO: 1081629 - RNA, 22 nt, Human
uucauuuuuaccgcgugucaaa

SEQ ID NO: 1081630 - RNA, 22 nt, Human
gcagguggucacucauccccag

SEQ ID NO: 1081631 - RNA, 22 nt, Human
uugcuugaacccaggaagugga

SEQ ID NO: 1081632 - RNA, 22 nt, Human
ucauggaagaaagguuuguuuc

SEQ ID NO: 1081633 - RNA, 22 nt, Human
ugggccugggagggcagacgcu

SEQ ID NO: 1081634 - RNA, 22 nt, Human
ggcagcagggucuagauugaug

SEQ ID NO: 1081635 - RNA, 22 nt, Human
uccaacuaggcacacagcuggu

SEQ ID NO: 1081636 - RNA, 22 nt, Human
agaauaucguagcauauuaucu

SEQ ID NO: 1081637 - RNA, 21 nt, Human
uuaccaauggcuucucuuucc

SEQ ID NO: 1081638 - RNA, 22 nt, Human
cccuggagggacagcugcucua

SEQ ID NO: 1081639 - RNA, 22 nt, Human
ucuaggaguaaugagcuagcac

SEQ ID NO: 1081640 - RNA, 22 nt, Human
ugugccagccucuggcuguguc

SEQ ID NO: 1081641 - RNA, 22 nt, Human
auaaauucucugauguauagua

SEQ ID NO: 1081642 - RNA, 22 nt, Human
agggcucauugacauggaaaag

SEQ ID NO: 1081643 - RNA, 22 nt, Human
uuguacagaaacugcauuugga

SEQ ID NO: 1081644 - RNA, 22 nt, Human
gggugcccuggguaggucaguu

SEQ ID NO: 1081645 - RNA, 22 nt, Human
uuacugaugaucuggaggggcu

SEQ ID NO: 1081646 - RNA, 20 nt, Human
uacauucaaaacaaacucug

SEQ ID NO: 1081647 - RNA, 22 nt, Human
ugcagugugaccuguagcgagc

SEQ ID NO: 1081648 - RNA, 22 nt, Human
cagaaggcaaacaaaaggauuu

SEQ ID NO: 1081649 - RNA, 22 nt, Human
gauuucuuuaugaaguacagaa

SEQ ID NO: 1081650 - RNA, 22 nt, Human
ucugccuggauuuuggaaagcu

SEQ ID NO: 1081651 - RNA, 22 nt, Human
ugggaguguucuuggcuugcuu

SEQ ID NO: 1081652 - RNA, 21 nt, Human
uccagggaacuucucaggaau

SEQ ID NO: 1081653 - RNA, 22 nt, Human
ucugggcuuuuccaugccugug

SEQ ID NO: 1081654 - RNA, 22 nt, Human
guuauuaguaagacucgcacau

SEQ ID NO: 1081655 - RNA, 22 nt, Human
uucucugaguacguuucagugu

SEQ ID NO: 1081656 - RNA, 16 nt, Human
ggagagugucugcaaa

SEQ ID NO: 1081657 - RNA, 22 nt, Human
uugggggcagagggagcaucug

SEQ ID NO: 1081658 - RNA, 22 nt, Human
agcuuccuguugagagagggag

SEQ ID NO: 1081659 - RNA, 22 nt, Human
gagaagaaauagaaucacauuu

SEQ ID NO: 1081660 - RNA, 22 nt, Human
ccuccuucuggggccuucugcu

SEQ ID NO: 1081661 - RNA, 22 nt, Human
caguagcauguaauaaagacag

SEQ ID NO: 1081662 - RNA, 22 nt, Human
ggaggaaauccuuaguaaggca

SEQ ID NO: 1081663 - RNA, 22 nt, Human
uugagaaaaccaucguaagaau

SEQ ID NO: 1081664 - RNA, 22 nt, Human
ugaaaucauugggguugaauaa

SEQ ID NO: 1081665 - RNA, 22 nt, Human
ucucccaacauguggaggucag

SEQ ID NO: 1081666 - RNA, 22 nt, Human
uuugacaucuaagaauucuuac

SEQ ID NO: 1081667 - RNA, 22 nt, Human
cuggcccagagagcagagcuua

SEQ ID NO: 1081668 - RNA, 22 nt, Human
ugcuaagcucacauggcucuag

SEQ ID NO: 1081669 - RNA, 22 nt, Human
gagcagagacaguacaacuggc

SEQ ID NO: 1081670 - RNA, 22 nt, Human
gcucagggaaggccacgugaga

SEQ ID NO: 1081671 - RNA, 18 nt, Human
aauuuccauaugaauugc

SEQ ID NO: 1081672 - RNA, 22 nt, Human
aaugucuuuugauacaaguuac

SEQ ID NO: 1081673 - RNA, 22 nt, Human
ugcagagagauccucaggguuu

SEQ ID NO: 1081674 - RNA, 22 nt, Human
uuugaauaugugcuuguuaaau

SEQ ID NO: 1081675 - RNA, 22 nt, Human
acagugauauuuuuacucaaau

SEQ ID NO: 1081676 - RNA, 22 nt, Human
ccucugggagacugcuacugag

SEQ ID NO: 1081677 - RNA, 22 nt, Human
gggcucaguucugcuucaugcu

SEQ ID NO: 1081678 - RNA, 22 nt, Human
gaaaggcaguacagcugagccu

SEQ ID NO: 1081679 - RNA, 21 nt, Human
gcucuuggaaggggcucagcu

SEQ ID NO: 1081680 - RNA, 22 nt, Human
aaggcagcccuggcucagccug

SEQ ID NO: 1081681 - RNA, 22 nt, Human
agcugcugagccaggcugaugu

SEQ ID NO: 1081682 - RNA, 22 nt, Human
aucaaaauggaagaauuuggcu

SEQ ID NO: 1081683 - RNA, 22 nt, Human
ugcugaaugguaaagaaguaua

SEQ ID NO: 1081684 - RNA, 22 nt, Human
cugggcucagcaggccaaggcc

SEQ ID NO: 1081685 - RNA, 22 nt, Human
cacuguuuuauuccaacauagg

SEQ ID NO: 1081686 - RNA, 23 nt, Human
aacagcaggaugauagaggaggu

SEQ ID NO: 1081687 - RNA, 22 nt, Human
uauuuuaaagacugccagccua

SEQ ID NO: 1081688 - RNA, 18 nt, Human
ggaaaaggagugucuagc

SEQ ID NO: 1081689 - RNA, 22 nt, Human
agagguggagcucuuggcauca

SEQ ID NO: 1081690 - RNA, 22 nt, Human
ugggaggcagguaggugaugau

SEQ ID NO: 1081691 - RNA, 22 nt, Human
ugcuggcccuggcucagggaac

SEQ ID NO: 1081692 - RNA, 21 nt, Human
ugacugaggcuucuucacaca

SEQ ID NO: 1081693 - RNA, 22 nt, Human
ggggccagcaauguugaggaau

SEQ ID NO: 1081694 - RNA, 22 nt, Human
cucaggggaccuggcuccgagu

SEQ ID NO: 1081695 - RNA, 22 nt, Human
gcagcguggggacaggagcuca

SEQ ID NO: 1081696 - RNA, 22 nt, Human
aggcccagagagccaguuagug

SEQ ID NO: 1081697 - RNA, 22 nt, Human
uugguucaauacuaacuugaac

SEQ ID NO: 1081698 - RNA, 22 nt, Human
auugaaaguccuaucuaaggga

SEQ ID NO: 1081699 - RNA, 22 nt, Human
uggcugaggcacagcugccgcc

SEQ ID NO: 1081700 - RNA, 22 nt, Human
acacauauaccacuguaaauga

SEQ ID NO: 1081701 - RNA, 22 nt, Human
ccuguguggaaaccgcaugacg

SEQ ID NO: 1081702 - RNA, 22 nt, Human
gagucacaaagccuuucuuauu

SEQ ID NO: 1081703 - RNA, 21 nt, Human
ucucugggaggacuugugaga

SEQ ID NO: 1081704 - RNA, 23 nt, Human
ugcucugugaauaguuggugacu

SEQ ID NO: 1081705 - RNA, 22 nt, Human
aggcacugaaagguggccagag

SEQ ID NO: 1081706 - RNA, 19 nt, Human
gaaaacaugggugaggguc

SEQ ID NO: 1081707 - RNA, 22 nt, Human
ucagguggagaccuccuuggcc

SEQ ID NO: 1081708 - RNA, 22 nt, Human
cucagcagugacaagagaguau

SEQ ID NO: 1081709 - RNA, 23 nt, Human
ucugcagacgcuguucuauuguc

SEQ ID NO: 1081710 - RNA, 22 nt, Human
uuuauuaugauggacaccuucg

SEQ ID NO: 1081711 - RNA, 22 nt, Human
ccaggccuuccaguacgcagaa

SEQ ID NO: 1081712 - RNA, 22 nt, Human
aaggcaguaaaaucuaccuugc

SEQ ID NO: 1081713 - RNA, 22 nt, Human
uugccuugauucuucucaugug

SEQ ID NO: 1081714 - RNA, 22 nt, Human
uuggaaaacuuacacagagcug

SEQ ID NO: 1081715 - RNA, 22 nt, Human
gggcucagccccauugaaccag

SEQ ID NO: 1081716 - RNA, 22 nt, Human
ggugaagcucuaccauucccag

SEQ ID NO: 1081717 - RNA, 20 nt, Human
uggcuccugcgguggaacca

SEQ ID NO: 1081718 - RNA, 17 nt, Human
uuacagcagcaauagag

SEQ ID NO: 1081719 - RNA, 22 nt, Human
cugagcugggaguagagacucu

SEQ ID NO: 1081720 - RNA, 22 nt, Human
guauaucagacacucauaugua

SEQ ID NO: 1081721 - RNA, 22 nt, Human
ugccaggcccagcagggcggcc

SEQ ID NO: 1081722 - RNA, 22 nt, Human
gugucccagcagcacauuggcu

SEQ ID NO: 1081723 - RNA, 22 nt, Human
uuaagcuagugaagucccucaa

SEQ ID NO: 1081724 - RNA, 22 nt, Human
ucuacaaagaagaauuaauguc

SEQ ID NO: 1081725 - RNA, 22 nt, Human
uuugcaaaugcucugcagagcu

SEQ ID NO: 1081726 - RNA, 22 nt, Human
aggcuuguggauuggagcgagu

SEQ ID NO: 1081727 - RNA, 22 nt, Human
agacccagaaagcagcugcauu

SEQ ID NO: 1081728 - RNA, 20 nt, Human
uggcaucucucaauuguagg

SEQ ID NO: 1081729 - RNA, 22 nt, Human
gaaggacccacgaagucacugg

SEQ ID NO: 1081730 - RNA, 22 nt, Human
aagcugcccaagacugaagcau

SEQ ID NO: 1081731 - RNA, 22 nt, Human
cuucugggagagcuuuugcuuc

SEQ ID NO: 1081732 - RNA, 22 nt, Human
ucccaggaucugagggcagaga

SEQ ID NO: 1081733 - RNA, 22 nt, Human
ccucagaguaggucucagcugu

SEQ ID NO: 1081734 - RNA, 22 nt, Human
uuucacaacacaaucucguuaa

SEQ ID NO: 1081735 - RNA, 22 nt, Human
ccugggcucacagccaaggcuc

SEQ ID NO: 1081736 - RNA, 22 nt, Human
gcagagugagccgaggcugcuc

SEQ ID NO: 1081737 - RNA, 17 nt, Human
uccuggcucugccacug

SEQ ID NO: 1081738 - RNA, 22 nt, Human
cugacuuuagaacccaaaaagu

SEQ ID NO: 1081739 - RNA, 22 nt, Human
aacagugaguugaugacugaau

SEQ ID NO: 1081740 - RNA, 22 nt, Human
aucuggguucaccaugcuccug

SEQ ID NO: 1081741 - RNA, 19 nt, Human
aagcagcccuggcaagagc

SEQ ID NO: 1081742 - RNA, 22 nt, Human
ugaggcaggagguugagaacug

SEQ ID NO: 1081743 - RNA, 22 nt, Human
uuccaacuucccaucccugcug

SEQ ID NO: 1081744 - RNA, 22 nt, Human
auuaaagcuauccagucaugaa

SEQ ID NO: 1081745 - RNA, 22 nt, Human
ccagcucccugaagccuggucu

SEQ ID NO: 1081746 - RNA, 17 nt, Human
caacuucacaaacuguc

SEQ ID NO: 1081747 - RNA, 18 nt, Human
acccauuauauuuguagc

SEQ ID NO: 1081748 - RNA, 21 nt, Human
uggcauuuguacagggacuuu

SEQ ID NO: 1081749 - RNA, 22 nt, Human
cugggcaggagaggugguugga

SEQ ID NO: 1081750 - RNA, 22 nt, Human
ucuugacauuguuguuagcagg

SEQ ID NO: 1081751 - RNA, 22 nt, Human
agaaacaagguguagguugacc

SEQ ID NO: 1081752 - RNA, 22 nt, Human
gauggguggucucagacuugcc

SEQ ID NO: 1081753 - RNA, 22 nt, Human
uuucacauacaguguauaguag

SEQ ID NO: 1081754 - RNA, 22 nt, Human
aaagacauuagauuaacguaca

SEQ ID NO: 1081755 - RNA, 19 nt, Human
ucucucaauugcuucaauu

SEQ ID NO: 1081756 - RNA, 22 nt, Human
gaggugggguuuuguucuugaa

SEQ ID NO: 1081757 - RNA, 22 nt, Human
aacacaguuucucuaugagagu

SEQ ID NO: 1081758 - RNA, 22 nt, Human
accacugggcgggcagccugcu

SEQ ID NO: 1081759 - RNA, 22 nt, Human
uuccaguuaaggaagcuauucu

SEQ ID NO: 1081760 - RNA, 22 nt, Human
acccaggagguggaggcugcag

SEQ ID NO: 1081761 - RNA, 22 nt, Human
ugucaaauuuuuauugcaguau

SEQ ID NO: 1081762 - RNA, 22 nt, Human
ugcccugcuucucuugggacag

SEQ ID NO: 1081763 - RNA, 22 nt, Human
gccaggaaaaaggguggccaau

SEQ ID NO: 1081764 - RNA, 22 nt, Human
uucuugaaggggauauaaauag

SEQ ID NO: 1081765 - RNA, 22 nt, Human
ugggaaggauacguuacaagau

SEQ ID NO: 1081766 - RNA, 22 nt, Human
uguguggauucaucucaaagag

SEQ ID NO: 1081767 - RNA, 22 nt, Human
gagcucagccugaggccuggcu

SEQ ID NO: 1081768 - RNA, 22 nt, Human
uguaaaagguuguucuuucguu

SEQ ID NO: 1081769 - RNA, 22 nt, Human
ccucagaguuggccacgagagc

SEQ ID NO: 1081770 - RNA, 22 nt, Human
aagauuuucagcuaauggugca

SEQ ID NO: 1081771 - RNA, 22 nt, Human
ccagggcauguccaagacuuag

SEQ ID NO: 1081772 - RNA, 22 nt, Human
ucacauaaauuauacaauuuca

SEQ ID NO: 1081773 - RNA, 22 nt, Human
cagcuguugugauccauuuacg

SEQ ID NO: 1081774 - RNA, 20 nt, Human
acaaaauagguacuggguag

SEQ ID NO: 1081775 - RNA, 22 nt, Human
ggcaggcaguguggugugaaac

SEQ ID NO: 1081776 - RNA, 22 nt, Human
ccaggugggcgugucuucaccu

SEQ ID NO: 1081777 - RNA, 21 nt, Human
uucaaaguuugccuaaagauu

SEQ ID NO: 1081778 - RNA, 19 nt, Human
accaggcuuauggucagug

SEQ ID NO: 1081779 - RNA, 22 nt, Human
uaacagaaguuguucauugugg

SEQ ID NO: 1081780 - RNA, 22 nt, Human
acacucugcucugagcuucagg

SEQ ID NO: 1081781 - RNA, 22 nt, Human
agcuucuguucaucuuccaggc

SEQ ID NO: 1081782 - RNA, 22 nt, Human
ucccaaggcacagggcagggac

SEQ ID NO: 1081783 - RNA, 22 nt, Human
uauugcaaguggcauaaaauuu

SEQ ID NO: 1081784 - RNA, 21 nt, Human
gggcaggucucugaugucaac

SEQ ID NO: 1081785 - RNA, 22 nt, Human
ugggccuccugcccuggccuag

SEQ ID NO: 1081786 - RNA, 23 nt, Human
gugaagguuucugcauuuauugg

SEQ ID NO: 1081787 - RNA, 22 nt, Human
aagugucuuaacuccuuuuggg

SEQ ID NO: 1081788 - RNA, 22 nt, Human
agaaaacuugucacagcucuca

SEQ ID NO: 1081789 - RNA, 19 nt, Human
uuuguaaguccuuacugau

SEQ ID NO: 1081790 - RNA, 22 nt, Human
aaagguuugcauggaauuuacc

SEQ ID NO: 1081791 - RNA, 22 nt, Human
gcagcugccuauucagggcuug

SEQ ID NO: 1081792 - RNA, 21 nt, Human
gcaggggauagaaauggucug

SEQ ID NO: 1081793 - RNA, 22 nt, Human
uccaugccaggcagucgaugca

SEQ ID NO: 1081794 - RNA, 22 nt, Human
ugggccugaaggagcugcgccc

SEQ ID NO: 1081795 - RNA, 22 nt, Human
gccucucucuacccaguaugau

SEQ ID NO: 1081796 - RNA, 22 nt, Human
ucuguugcaaugugcaugguga

SEQ ID NO: 1081797 - RNA, 22 nt, Human
ccaggagcaacuugaaggcaag

SEQ ID NO: 1081798 - RNA, 22 nt, Human
uggagcauauucuggagcuugg

SEQ ID NO: 1081799 - RNA, 22 nt, Human
augauacaucuucaugucagug

SEQ ID NO: 1081800 - RNA, 20 nt, Human
ggcucugcuugugagcagcc

SEQ ID NO: 1081801 - RNA, 22 nt, Human
auggcaagcaagcugaagagau

SEQ ID NO: 1081802 - RNA, 22 nt, Human
cugcugugcaacauugcaccua

SEQ ID NO: 1081803 - RNA, 22 nt, Human
auuuccaccggcucaggaaguu

SEQ ID NO: 1081804 - RNA, 22 nt, Human
augcuguguggucaaguuaauu

SEQ ID NO: 1081805 - RNA, 22 nt, Human
acauauuaacugcacuacacua

SEQ ID NO: 1081806 - RNA, 22 nt, Human
gccuucugugcuccuggccuuu

SEQ ID NO: 1081807 - RNA, 22 nt, Human
cugagaggcacaaggcauuucg

SEQ ID NO: 1081808 - RNA, 22 nt, Human
uaggcagaaaggaaggcaaguu

SEQ ID NO: 1081809 - RNA, 22 nt, Human
uauauuaacuugugauccugga

SEQ ID NO: 1081810 - RNA, 22 nt, Human
agguaaggcuguaagcuaagcc

SEQ ID NO: 1081811 - RNA, 22 nt, Human
cccuggaagguucucuggcuca

SEQ ID NO: 1081812 - RNA, 22 nt, Human
ucagggcagaauccaaagaauu

SEQ ID NO: 1081813 - RNA, 22 nt, Human
gcucugcuggagggaaagagaa

SEQ ID NO: 1081814 - RNA, 22 nt, Human
gccuggaguuguggugaagcca

SEQ ID NO: 1081815 - RNA, 22 nt, Human
ccagguguggggaggacucaca

SEQ ID NO: 1081816 - RNA, 22 nt, Human
ccucagagguguggcaucucug

SEQ ID NO: 1081817 - RNA, 22 nt, Human
gcagcguggggcugagucagcu

SEQ ID NO: 1081818 - RNA, 22 nt, Human
ggcagcuggggcagugcccugu

SEQ ID NO: 1081819 - RNA, 22 nt, Human
cccauggggacaccaugaagga

SEQ ID NO: 1081820 - RNA, 22 nt, Human
aauuuuauuaacuggauguagc

SEQ ID NO: 1081821 - RNA, 22 nt, Human
uucauauaaauggaaucagaau

SEQ ID NO: 1081822 - RNA, 22 nt, Human
aagacaauccuggacagucagc

SEQ ID NO: 1081823 - RNA, 22 nt, Human
acaguacaccacuguguacagu

SEQ ID NO: 1081824 - RNA, 22 nt, Human
ugcauugcaguuaacucaguau

SEQ ID NO: 1081825 - RNA, 19 nt, Human
ggcugucucggcccagcca

SEQ ID NO: 1081826 - RNA, 22 nt, Human
ugggcagacugagcccuguccc

SEQ ID NO: 1081827 - RNA, 22 nt, Human
uccuucagauuccugcuucugg

SEQ ID NO: 1081828 - RNA, 22 nt, Human
cuuucauccgcagaugagccuc

SEQ ID NO: 1081829 - RNA, 22 nt, Human
ccugcuguaaugugucuuuauu

SEQ ID NO: 1081830 - RNA, 22 nt, Human
guucacagcuuguguuuucucu

SEQ ID NO: 1081831 - RNA, 22 nt, Human
ugggcuguccagcaccugggcu

SEQ ID NO: 1081832 - RNA, 22 nt, Human
auuuccugcaaggaguggguuu

SEQ ID NO: 1081833 - RNA, 22 nt, Human
uuccauaaaggugauaguauac

SEQ ID NO: 1081834 - RNA, 22 nt, Human
cagucccaggguugguucagcu

SEQ ID NO: 1081835 - RNA, 22 nt, Human
uagaaagaucuguaggcaagag

SEQ ID NO: 1081836 - RNA, 22 nt, Human
uggcuggcuuguucacugacug

SEQ ID NO: 1081837 - RNA, 22 nt, Human
uuucuuuugcugagaggggcac

SEQ ID NO: 1081838 - RNA, 22 nt, Human
ucugggcacugcugagccugua

SEQ ID NO: 1081839 - RNA, 22 nt, Human
ccugccugcagaaaguaucucc

SEQ ID NO: 1081840 - RNA, 22 nt, Human
uugcauuguaggauguuagaag

SEQ ID NO: 1081841 - RNA, 22 nt, Human
guggccugucagaagccguggg

SEQ ID NO: 1081842 - RNA, 22 nt, Human
aguaggaggcgggagcaugaag

SEQ ID NO: 1081843 - RNA, 22 nt, Human
ucagugaaccuucuguggcagg

SEQ ID NO: 1081844 - RNA, 22 nt, Human
uaaaaugccagaccaguucacg

SEQ ID NO: 1081845 - RNA, 22 nt, Human
gacauuuauuggauuuuacgag

SEQ ID NO: 1081846 - RNA, 22 nt, Human
auuucuuccauugccucuucaa

SEQ ID NO: 1081847 - RNA, 22 nt, Human
acucuucacuuccccugccagc

SEQ ID NO: 1081848 - RNA, 22 nt, Human
aaaugauugucaaaguucuguu

SEQ ID NO: 1081849 - RNA, 22 nt, Human
uuucacagcagugugcugcuuu

SEQ ID NO: 1081850 - RNA, 22 nt, Human
agugauuaauuguaaaaauucu

SEQ ID NO: 1081851 - RNA, 22 nt, Human
gaaguuaguguaaugcagggug

SEQ ID NO: 1081852 - RNA, 22 nt, Human
gucaggaugggcagccaaacua

SEQ ID NO: 1081853 - RNA, 22 nt, Human
ugaagauuuucggguacuugau

SEQ ID NO: 1081854 - RNA, 22 nt, Human
aucuuucaggccuaguguuuaa

SEQ ID NO: 1081855 - RNA, 22 nt, Human
guuccauaucacagcagacgaa

SEQ ID NO: 1081856 - RNA, 19 nt, Human
aggcugugagggaggacuc

SEQ ID NO: 1081857 - RNA, 20 nt, Human
ucuuacaaucguuacaucca

SEQ ID NO: 1081858 - RNA, 22 nt, Human
uagagcuguaucaaagagccuu

SEQ ID NO: 1081859 - RNA, 22 nt, Human
agcacacaggacuugauucaug

SEQ ID NO: 1081860 - RNA, 22 nt, Human
ugaggcaggaaguuauauaaug

SEQ ID NO: 1081861 - RNA, 22 nt, Human
cuucuggaaacuuuuccaauuu

SEQ ID NO: 1081862 - RNA, 22 nt, Human
gagguuagaggucagugcaguc

SEQ ID NO: 1081863 - RNA, 23 nt, Human
uggccugcagaguuucugcuggg

SEQ ID NO: 1081864 - RNA, 22 nt, Human
uuucuacaguacugauuucaua

SEQ ID NO: 1081865 - RNA, 22 nt, Human
ccagagcuucggggcggcugua

SEQ ID NO: 1081866 - RNA, 22 nt, Human
agaggccuaauugcuacccuuu

SEQ ID NO: 1081867 - RNA, 22 nt, Human
gugcaugugcauccauguguac

SEQ ID NO: 1081868 - RNA, 22 nt, Human
agggagccagaguugggagcuc

SEQ ID NO: 1081869 - RNA, 22 nt, Human
ccaggagcaggagcugcagcug

SEQ ID NO: 1081870 - RNA, 22 nt, Human
cucaggaaccgcggcagcagcc

SEQ ID NO: 1081871 - RNA, 20 nt, Human
uauuucacucuccagauggc

SEQ ID NO: 1081872 - RNA, 21 nt, Human
uaggugggagccccaguaugc

SEQ ID NO: 1081873 - RNA, 22 nt, Human
augcaguacagauaauucuaca

SEQ ID NO: 1081874 - RNA, 22 nt, Human
gcuucaugggugugcaaccugu

SEQ ID NO: 1081875 - RNA, 22 nt, Human
ggaggggagauguuugggcuca

SEQ ID NO: 1081876 - RNA, 22 nt, Human
gccugaagaacagcugugagga

SEQ ID NO: 1081877 - RNA, 22 nt, Human
gcuggccugcugggcaccaccg

SEQ ID NO: 1081878 - RNA, 22 nt, Human
gccagggcugugcagguuuguu

SEQ ID NO: 1081879 - RNA, 22 nt, Human
ggagugucagaaacaguguccu

SEQ ID NO: 1081880 - RNA, 22 nt, Human
ccagagucauuuugagucauaa

SEQ ID NO: 1081881 - RNA, 22 nt, Human
ccucucagcgauuccucuugga

SEQ ID NO: 1081882 - RNA, 22 nt, Human
uuucacauucagauauagacuu

SEQ ID NO: 1081883 - RNA, 20 nt, Human
uuugagaccagucugcccaa

SEQ ID NO: 1081884 - RNA, 19 nt, Human
auagucuuuccaauuauac

SEQ ID NO: 1081885 - RNA, 22 nt, Human
acacuguuccacacuaagaagg

SEQ ID NO: 1081886 - RNA, 21 nt, Human
acagcagggcuggcaugacag

SEQ ID NO: 1081887 - RNA, 22 nt, Human
cagugccacaggaauggccaau

SEQ ID NO: 1081888 - RNA, 18 nt, Human
gaaguuaguggugugcua

SEQ ID NO: 1081889 - RNA, 22 nt, Human
ugaguagcggcuauguguaacu

SEQ ID NO: 1081890 - RNA, 22 nt, Human
ccugcuggccaguggagggcug

SEQ ID NO: 1081891 - RNA, 22 nt, Human
uucaaagcaauagaaagaguga

SEQ ID NO: 1081892 - RNA, 22 nt, Human
ggcucaccauggccucccugcu

SEQ ID NO: 1081893 - RNA, 22 nt, Human
cucagggcuugaguguccagga

SEQ ID NO: 1081894 - RNA, 22 nt, Human
aaaucagagucugauuuuaagg

SEQ ID NO: 1081895 - RNA, 22 nt, Human
uguuccaauaaggaguugaaau

SEQ ID NO: 1081896 - RNA, 22 nt, Human
agugcaaagccgagguuucuug

SEQ ID NO: 1081897 - RNA, 22 nt, Human
gccagggagucugggccacaga

SEQ ID NO: 1081898 - RNA, 22 nt, Human
ccagcuggugacauccccaacc

SEQ ID NO: 1081899 - RNA, 23 nt, Human
gugcucugcggucugcuagucug

SEQ ID NO: 1081900 - RNA, 22 nt, Human
acagcagcuugcgugucugguc

SEQ ID NO: 1081901 - RNA, 22 nt, Human
acaaggauuuguuccuaauguu

SEQ ID NO: 1081902 - RNA, 22 nt, Human
ugugucccuuggaaccucagcu

SEQ ID NO: 1081903 - RNA, 22 nt, Human
ucuuacaccauucaaauauuuu

SEQ ID NO: 1081904 - RNA, 22 nt, Human
agcugucagugcugugccugua

SEQ ID NO: 1081905 - RNA, 21 nt, Human
cccucaggaaacagaaugcac

SEQ ID NO: 1081906 - RNA, 22 nt, Human
ugaagcagagugaaggugaauu

SEQ ID NO: 1081907 - RNA, 19 nt, Human
agccuggagggcuggucac

SEQ ID NO: 1081908 - RNA, 22 nt, Human
uucuguguggguagcuccuguu

SEQ ID NO: 1081909 - RNA, 22 nt, Human
ugccugaguuuaacccucagag

SEQ ID NO: 1081910 - RNA, 22 nt, Human
ccagggcagugggagaaggugc

SEQ ID NO: 1081911 - RNA, 23 nt, Human
uguaugaauaugccacaguuuaa

SEQ ID NO: 1081912 - RNA, 22 nt, Human
uuacuuuggauggucaagaaag

SEQ ID NO: 1081913 - RNA, 22 nt, Human
auuguacuuuuauuacauguag

SEQ ID NO: 1081914 - RNA, 22 nt, Human
ucacagaagcaucauacccgga

SEQ ID NO: 1081915 - RNA, 22 nt, Human
gcucugcuguguuuguucagca

SEQ ID NO: 1081916 - RNA, 22 nt, Human
uaucuguuaugggcugaauugc

SEQ ID NO: 1081917 - RNA, 22 nt, Human
uccuccaggucuaggguggcuu

SEQ ID NO: 1081918 - RNA, 22 nt, Human
aggcacugugcugaugucuuau

SEQ ID NO: 1081919 - RNA, 19 nt, Human
acauuuaaauucagaucuc

SEQ ID NO: 1081920 - RNA, 22 nt, Human
aucuccaggauuuucacacuca

SEQ ID NO: 1081921 - RNA, 22 nt, Human
uggcucaggccacuucuuuuau

SEQ ID NO: 1081922 - RNA, 22 nt, Human
uugggcugaacccugcagcuga

SEQ ID NO: 1081923 - RNA, 22 nt, Human
uacugauaagaguuguaggagu

SEQ ID NO: 1081924 - RNA, 22 nt, Human
ucaucaguccuuuucauuauga

SEQ ID NO: 1081925 - RNA, 22 nt, Human
caguguuuagcacagugcuugg

SEQ ID NO: 1081926 - RNA, 22 nt, Human
uucuuaaguauuucagagacug

SEQ ID NO: 1081927 - RNA, 22 nt, Human
uaauguuugggaaggugcuuug

SEQ ID NO: 1081928 - RNA, 22 nt, Human
cuuugaagagauuacugugcuc

SEQ ID NO: 1081929 - RNA, 22 nt, Human
uuucacagguauccacgggucu

SEQ ID NO: 1081930 - RNA, 23 nt, Human
uggcuggcagaaacugaagcaug

SEQ ID NO: 1081931 - RNA, 22 nt, Human
aagcagcuuuugaagagugagg

SEQ ID NO: 1081932 - RNA, 22 nt, Human
acccaggggcagccuugcugug

SEQ ID NO: 1081933 - RNA, 18 nt, Human
gggcacuggggacuggag

SEQ ID NO: 1081934 - RNA, 22 nt, Human
cagguaggauggaagggcucaa

SEQ ID NO: 1081935 - RNA, 22 nt, Human
uggaacacuuuguugaaaugca

SEQ ID NO: 1081936 - RNA, 22 nt, Human
gcauuucauguagauugagaac

SEQ ID NO: 1081937 - RNA, 22 nt, Human
gccuccuguuaugccaugugcc

SEQ ID NO: 1081938 - RNA, 22 nt, Human
uuagauacauucucauuuguuu

SEQ ID NO: 1081939 - RNA, 22 nt, Human
gcugccugccuaguuccacagu

SEQ ID NO: 1081940 - RNA, 22 nt, Human
ggaacacuggcucaauuauauc

SEQ ID NO: 1081941 - RNA, 22 nt, Human
uggaggaaaauuacuggggucu

SEQ ID NO: 1081942 - RNA, 22 nt, Human
uccuccuucgggacugcuugac

SEQ ID NO: 1081943 - RNA, 22 nt, Human
agggcuggccacaugauuuggu

SEQ ID NO: 1081944 - RNA, 17 nt, Human
aggaagggcaaguuucu

SEQ ID NO: 1081945 - RNA, 22 nt, Human
uggugagaccuuguuccuuaug

SEQ ID NO: 1081946 - RNA, 22 nt, Human
ucacagggcauuauggcuccag

SEQ ID NO: 1081947 - RNA, 22 nt, Human
gccauccucugagcacuaggca

SEQ ID NO: 1081948 - RNA, 22 nt, Human
ucuccuggaagaauaccacacu

SEQ ID NO: 1081949 - RNA, 21 nt, Human
gcagccacugccuucaacaau

SEQ ID NO: 1081950 - RNA, 18 nt, Human
cggcagagugcuucuagc

SEQ ID NO: 1081951 - RNA, 22 nt, Human
gacuuucucuccucccaggugu

SEQ ID NO: 1081952 - RNA, 18 nt, Human
cuguucuagaacuccugu

SEQ ID NO: 1081953 - RNA, 22 nt, Human
ccagcucuuuuggcugagugag

SEQ ID NO: 1081954 - RNA, 22 nt, Human
cugccugugccaaugcuccuuu

SEQ ID NO: 1081955 - RNA, 22 nt, Human
guucuucaucauuaacacucug

SEQ ID NO: 1081956 - RNA, 22 nt, Human
ccuguggcacaugcagggauuc

SEQ ID NO: 1081957 - RNA, 22 nt, Human
uuuucuaacaucuaguaauuug

SEQ ID NO: 1081958 - RNA, 22 nt, Human
aaaguuagaaugauaucaacga

SEQ ID NO: 1081959 - RNA, 21 nt, Human
agucuguuaggaugacucuga

SEQ ID NO: 1081960 - RNA, 20 nt, Human
uguaaauaggcauuguaguu

SEQ ID NO: 1081961 - RNA, 21 nt, Human
uuaagagcuuagcaguaggcc

SEQ ID NO: 1081962 - RNA, 22 nt, Human
aagcagaauuuaauagaaaggu

SEQ ID NO: 1081963 - RNA, 22 nt, Human
ccugcucagccccagcucaccc

SEQ ID NO: 1081964 - RNA, 19 nt, Human
agggaaggauucugucauu

SEQ ID NO: 1081965 - RNA, 22 nt, Human
ucacacagauugguagagcuga

SEQ ID NO: 1081966 - RNA, 22 nt, Human
agccaacuuggaaagucagauu

SEQ ID NO: 1081967 - RNA, 22 nt, Human
uaccaaguguauuaugcuuugu

SEQ ID NO: 1081968 - RNA, 22 nt, Human
aucaaauacaaagggcauaagg

SEQ ID NO: 1081969 - RNA, 22 nt, Human
auuccaaacagugcugcagacu

SEQ ID NO: 1081970 - RNA, 22 nt, Human
aggccugaggaccuucuggagg

SEQ ID NO: 1081971 - RNA, 22 nt, Human
acaaaggcagagaauucaacau

SEQ ID NO: 1081972 - RNA, 19 nt, Human
ggaaggagagaaaugcaug

SEQ ID NO: 1081973 - RNA, 22 nt, Human
ggcuucaccgcgggguugcagg

SEQ ID NO: 1081974 - RNA, 21 nt, Human
aagacagaaaagccuauuuuc

SEQ ID NO: 1081975 - RNA, 22 nt, Human
uaguccagccuuggguguagcc

SEQ ID NO: 1081976 - RNA, 18 nt, Human
cucucuggucuggauccc

SEQ ID NO: 1081977 - RNA, 22 nt, Human
ucauuuuuugcauaccuguguc

SEQ ID NO: 1081978 - RNA, 20 nt, Human
aguagcagugugacauugac

SEQ ID NO: 1081979 - RNA, 22 nt, Human
uaugagaucccuuuuccuagag

SEQ ID NO: 1081980 - RNA, 22 nt, Human
aaauaacuugguuucaucagag

SEQ ID NO: 1081981 - RNA, 22 nt, Human
ugcaaagaagccacagucccag

SEQ ID NO: 1081982 - RNA, 22 nt, Human
ucugggcagccaugugccuggc

SEQ ID NO: 1081983 - RNA, 21 nt, Human
ugcccuggggcucuucccuca

SEQ ID NO: 1081984 - RNA, 22 nt, Human
ccaaaguuuuuauaguuagcau

SEQ ID NO: 1081985 - RNA, 22 nt, Human
cccagcacuuugaauaugucac

SEQ ID NO: 1081986 - RNA, 22 nt, Human
ugaggcucaagaaagauuuguu

SEQ ID NO: 1081987 - RNA, 22 nt, Human
gcagagugauggaaugugggug

SEQ ID NO: 1081988 - RNA, 22 nt, Human
uccuugaagagugggcggucga

SEQ ID NO: 1081989 - RNA, 18 nt, Human
uggugaaggguggaggag

SEQ ID NO: 1081990 - RNA, 22 nt, Human
ucagggcauucaagaggccugg

SEQ ID NO: 1081991 - RNA, 22 nt, Human
gcucccaggaugaggagccagg

SEQ ID NO: 1081992 - RNA, 22 nt, Human
gaggcuguuagggccugaggua

SEQ ID NO: 1081993 - RNA, 21 nt, Human
ugggcgcuugaccucugcacu

SEQ ID NO: 1081994 - RNA, 22 nt, Human
cugcccugugaggguccuuggg

SEQ ID NO: 1081995 - RNA, 22 nt, Human
cccccaaaguuugcacggauaa

SEQ ID NO: 1081996 - RNA, 22 nt, Human
uagagcagauagugaaacagaa

SEQ ID NO: 1081997 - RNA, 17 nt, Human
ucugcagaggcaaaccu

SEQ ID NO: 1081998 - RNA, 22 nt, Human
uuaaggcugauaagucagauau

SEQ ID NO: 1081999 - RNA, 22 nt, Human
uuauauaucuugauuuguucca

SEQ ID NO: 1082000 - RNA, 22 nt, Human
ucacauuuguuccucugcacuu

SEQ ID NO: 1082001 - RNA, 22 nt, Human
uacaagcucacaaauuuuuaag

SEQ ID NO: 1082002 - RNA, 22 nt, Human
aaggguggauuucugagcucua

SEQ ID NO: 1082003 - RNA, 22 nt, Human
cagagccagcccacuguucccg

SEQ ID NO: 1082004 - RNA, 22 nt, Human
ucucacuggguauaaaugagua

SEQ ID NO: 1082005 - RNA, 20 nt, Human
gccuggaggcaaugggaaga

SEQ ID NO: 1082006 - RNA, 19 nt, Human
ugggcagcucccucugucc

SEQ ID NO: 1082007 - RNA, 22 nt, Human
gguuggaggugggaauagcuag

SEQ ID NO: 1082008 - RNA, 22 nt, Human
cucaagaaucuagggaggauuc

SEQ ID NO: 1082009 - RNA, 19 nt, Human
uucaggauugacccuacug

SEQ ID NO: 1082010 - RNA, 22 nt, Human
cuggaguuagaguagacacuga

SEQ ID NO: 1082011 - RNA, 22 nt, Human
auuacagagggucggucguuuu

SEQ ID NO: 1082012 - RNA, 22 nt, Human
uuagaaaaaacgucuucuagug

SEQ ID NO: 1082013 - RNA, 23 nt, Human
ucaggauauugugugccaaggug

SEQ ID NO: 1082014 - RNA, 22 nt, Human
uggcagagcaaaaagauagaau

SEQ ID NO: 1082015 - RNA, 22 nt, Human
uuccucuuucucugugcuaugu

SEQ ID NO: 1082016 - RNA, 22 nt, Human
auuuguucagcauugaauuugg

SEQ ID NO: 1082017 - RNA, 22 nt, Human
acaugcuagguacagaucuaaa

SEQ ID NO: 1082018 - RNA, 18 nt, Human
uccucucuuuccccaggg

SEQ ID NO: 1082019 - RNA, 18 nt, Human
agguacacauacuucuca

SEQ ID NO: 1082020 - RNA, 22 nt, Human
aucuggagaucagcugguggca

SEQ ID NO: 1082021 - RNA, 22 nt, Human
uguaaagauuagauuacaugaa

SEQ ID NO: 1082022 - RNA, 22 nt, Human
aggcuuaaaugcucauaucagu

SEQ ID NO: 1082023 - RNA, 22 nt, Human
caggaaccauuuucucuuuaua

SEQ ID NO: 1082024 - RNA, 22 nt, Human
auuccaaacgccucgcggacuu

SEQ ID NO: 1082025 - RNA, 22 nt, Human
agggccagcccauaaugccaaa

SEQ ID NO: 1082026 - RNA, 22 nt, Human
gccaggcuggcaaaaggaaacc

SEQ ID NO: 1082027 - RNA, 22 nt, Human
cacaaaaucuuucucgauuauu

SEQ ID NO: 1082028 - RNA, 22 nt, Human
cuugcugucuugcauuuagagc

SEQ ID NO: 1082029 - RNA, 22 nt, Human
aguaaaauuucugcugaggaga

SEQ ID NO: 1082030 - RNA, 22 nt, Human
ugcaggugugggcaggggagca

SEQ ID NO: 1082031 - RNA, 22 nt, Human
aggcugucaucuuugcaggcag

SEQ ID NO: 1082032 - RNA, 22 nt, Human
gggccccaaaaugccaggcucu

SEQ ID NO: 1082033 - RNA, 22 nt, Human
ucauacaacuaagaguuucaga

SEQ ID NO: 1082034 - RNA, 22 nt, Human
aacauuucagcaaauaagaaca

SEQ ID NO: 1082035 - RNA, 22 nt, Human
aaauucagauggcuuucuuuuc

SEQ ID NO: 1082036 - RNA, 22 nt, Human
ugcugugguucccagaguggau

SEQ ID NO: 1082037 - RNA, 23 nt, Human
uugaggcaaacauguaaguagga

SEQ ID NO: 1082038 - RNA, 22 nt, Human
ggugcccugccaggaugugcca

SEQ ID NO: 1082039 - RNA, 23 nt, Human
agaaaagcuuggacacauggccu

SEQ ID NO: 1082040 - RNA, 22 nt, Human
gaggccugucgcuaggccucug

SEQ ID NO: 1082041 - RNA, 22 nt, Human
caggaacacaaugagucucaaa

SEQ ID NO: 1082042 - RNA, 22 nt, Human
cuggcucccagcuuucagggag

SEQ ID NO: 1082043 - RNA, 22 nt, Human
gagcccaggaaguggaggcuga

SEQ ID NO: 1082044 - RNA, 22 nt, Human
gagagcugcaagguagggcggg

SEQ ID NO: 1082045 - RNA, 22 nt, Human
aguuuuguaauucucaaaaaua

SEQ ID NO: 1082046 - RNA, 21 nt, Human
ccugggagaucagcugccuuc

SEQ ID NO: 1082047 - RNA, 21 nt, Human
uuucuaagugcuugguuuggg

SEQ ID NO: 1082048 - RNA, 22 nt, Human
aggcacuguacuagguacaggg

SEQ ID NO: 1082049 - RNA, 22 nt, Human
caguauucaucuaaggagcuug

SEQ ID NO: 1082050 - RNA, 19 nt, Human
aacaucuuuccaguagagg

SEQ ID NO: 1082051 - RNA, 23 nt, Human
ucucaggacacacaugucuauca

SEQ ID NO: 1082052 - RNA, 22 nt, Human
uugagaagaauguguugaguuu

SEQ ID NO: 1082053 - RNA, 22 nt, Human
cccagcuccuuggaugggcagg

SEQ ID NO: 1082054 - RNA, 22 nt, Human
gcuggcagugugaaugacaagc

SEQ ID NO: 1082055 - RNA, 22 nt, Human
uguacagucaugcuuucuguuc

SEQ ID NO: 1082056 - RNA, 22 nt, Human
caggcccaugagggcagccaca

SEQ ID NO: 1082057 - RNA, 22 nt, Human
cccuggugguacggcacuggca

SEQ ID NO: 1082058 - RNA, 22 nt, Human
ccaaagugcugggguuacaggc

SEQ ID NO: 1082059 - RNA, 22 nt, Human
auuaaaauuccaagguaugcca

SEQ ID NO: 1082060 - RNA, 22 nt, Human
ugacuuuagacuuagucaaguu

SEQ ID NO: 1082061 - RNA, 22 nt, Human
gugcauuugugcaugcacaugu

SEQ ID NO: 1082062 - RNA, 22 nt, Human
gcacugcagccucagauggugg

SEQ ID NO: 1082063 - RNA, 22 nt, Human
gauugaaaggucuuuaaauugg

SEQ ID NO: 1082064 - RNA, 22 nt, Human
gacccucaaacaauuacacugc

SEQ ID NO: 1082065 - RNA, 17 nt, Human
cccugccaccaggaagc

SEQ ID NO: 1082066 - RNA, 22 nt, Human
gcugggagcaaguacucaucuu

SEQ ID NO: 1082067 - RNA, 22 nt, Human
gcuuugcauuguuuaaucagga

SEQ ID NO: 1082068 - RNA, 22 nt, Human
agggaggaucugcuccuugucu

SEQ ID NO: 1082069 - RNA, 22 nt, Human
gccuucagcggccgcucgcugc

SEQ ID NO: 1082070 - RNA, 22 nt, Human
ucugucugcaccuaagcacagu

SEQ ID NO: 1082071 - RNA, 22 nt, Human
ugcacacaaaugugaacgugcc

SEQ ID NO: 1082072 - RNA, 22 nt, Human
aaugcuuucuuauaaccacugc

SEQ ID NO: 1082073 - RNA, 22 nt, Human
uaaggcaccuguccaggcuggg

SEQ ID NO: 1082074 - RNA, 19 nt, Human
ugaguggagugcaaugaag

SEQ ID NO: 1082075 - RNA, 22 nt, Human
cagagcagugaggaguugugua

SEQ ID NO: 1082076 - RNA, 22 nt, Human
cucaccaggaacagcugcggag

SEQ ID NO: 1082077 - RNA, 22 nt, Human
gcagcaaucuucacagugucau

SEQ ID NO: 1082078 - RNA, 22 nt, Human
auuuucaugacuaccuuaaaua

SEQ ID NO: 1082079 - RNA, 22 nt, Human
gcagcccagagcgcaggacccc

SEQ ID NO: 1082080 - RNA, 22 nt, Human
acaaugcaccagcaucuucacc

SEQ ID NO: 1082081 - RNA, 22 nt, Human
aauacuugugaauucaaagucu

SEQ ID NO: 1082082 - RNA, 22 nt, Human
agaauuuuaucuaaagggagua

SEQ ID NO: 1082083 - RNA, 22 nt, Human
aacagugauaucaagacagaca

SEQ ID NO: 1082084 - RNA, 23 nt, Human
aggaagagagagugccucuuucu

SEQ ID NO: 1082085 - RNA, 22 nt, Human
cuggagccuagguugaccuggg

SEQ ID NO: 1082086 - RNA, 22 nt, Human
gagagggccagggugagaacua

SEQ ID NO: 1082087 - RNA, 22 nt, Human
ucaauaauggcaggauaaauuu

SEQ ID NO: 1082088 - RNA, 21 nt, Human
cccuugccugcacuccucggc

SEQ ID NO: 1082089 - RNA, 21 nt, Human
gcuugguuuugguuacuugcc

SEQ ID NO: 1082090 - RNA, 22 nt, Human
cucagaagaacaaaggcucuac

SEQ ID NO: 1082091 - RNA, 22 nt, Human
cugaagaauagcaggugggcac

SEQ ID NO: 1082092 - RNA, 22 nt, Human
ggucccugcccaccugggagcu

SEQ ID NO: 1082093 - RNA, 22 nt, Human
augcaaaaguaauugcaauuuu

SEQ ID NO: 1082094 - RNA, 22 nt, Human
uagcugaugaauaauuauucuu

SEQ ID NO: 1082095 - RNA, 22 nt, Human
ucuuuacauaguguggacuacu

SEQ ID NO: 1082096 - RNA, 22 nt, Human
agcuguguagggaaucagagaa

SEQ ID NO: 1082097 - RNA, 22 nt, Human
gcuuuccuggcccugucccugc

SEQ ID NO: 1082098 - RNA, 22 nt, Human
guucacagucuacauaguaaag

SEQ ID NO: 1082099 - RNA, 22 nt, Human
ucuuugucugaacagggacauu

SEQ ID NO: 1082100 - RNA, 22 nt, Human
cucaguagaaaauacauggacu

SEQ ID NO: 1082101 - RNA, 22 nt, Human
uuguaugagcuccaggaacuca

SEQ ID NO: 1082102 - RNA, 21 nt, Human
uucaggguuucacaauacuaa

SEQ ID NO: 1082103 - RNA, 22 nt, Human
aaugaacaggugaaugucagau

SEQ ID NO: 1082104 - RNA, 22 nt, Human
agagcagaggcauggccguggg

SEQ ID NO: 1082105 - RNA, 22 nt, Human
gguaacacaggugcaguuuuaa

SEQ ID NO: 1082106 - RNA, 22 nt, Human
agggccucugacgcccccagcc

SEQ ID NO: 1082107 - RNA, 18 nt, Human
ugucucaggcugaaacag

SEQ ID NO: 1082108 - RNA, 22 nt, Human
ggaaggaauuccaagacuaaag

SEQ ID NO: 1082109 - RNA, 22 nt, Human
aguaaaaucuuaagcacagugg

SEQ ID NO: 1082110 - RNA, 22 nt, Human
aguggcaguggcugggcagagc

SEQ ID NO: 1082111 - RNA, 22 nt, Human
guguuuccaguucagaaagcaa

SEQ ID NO: 1082112 - RNA, 22 nt, Human
ucuggcucggauuugucuagca

SEQ ID NO: 1082113 - RNA, 22 nt, Human
gcacugugcuagaagccagggg

SEQ ID NO: 1082114 - RNA, 22 nt, Human
gccucagccggcggacgccagg

SEQ ID NO: 1082115 - RNA, 22 nt, Human
uauacagauaucuaagauguaa

SEQ ID NO: 1082116 - RNA, 22 nt, Human
uggcugaguucuccaggaguag

SEQ ID NO: 1082117 - RNA, 22 nt, Human
aacauacauauuucagugucca

SEQ ID NO: 1082118 - RNA, 22 nt, Human
agucucagcaagcauggcuagu

SEQ ID NO: 1082119 - RNA, 19 nt, Human
ggcggguggacuggagccc

SEQ ID NO: 1082120 - RNA, 22 nt, Human
gaggcagugaacaauuccugug

SEQ ID NO: 1082121 - RNA, 22 nt, Human
aggugucuucagggugagacag

SEQ ID NO: 1082122 - RNA, 22 nt, Human
agugcugucaguuuuauagaua

SEQ ID NO: 1082123 - RNA, 22 nt, Human
acaguucugcaagauauuuuuu

SEQ ID NO: 1082124 - RNA, 22 nt, Human
agagaagcugacaggggcgugc

SEQ ID NO: 1082125 - RNA, 22 nt, Human
uucacagucacccuucuccaug

SEQ ID NO: 1082126 - RNA, 22 nt, Human
cagaacuggccuuucaucaguc

SEQ ID NO: 1082127 - RNA, 22 nt, Human
gaauuuuaauaaagguuuauca

SEQ ID NO: 1082128 - RNA, 22 nt, Human
auaauuuacaacugcuuuuaau

SEQ ID NO: 1082129 - RNA, 22 nt, Human
caaacuauuuacaauggaauca

SEQ ID NO: 1082130 - RNA, 22 nt, Human
ugcuccagugagcuggccaucc

SEQ ID NO: 1082131 - RNA, 22 nt, Human
cuccaggguuccccgauccacu

SEQ ID NO: 1082132 - RNA, 22 nt, Human
cagcaauaagccagguuagaca

SEQ ID NO: 1082133 - RNA, 22 nt, Human
ucauccaguaugacuggugucu

SEQ ID NO: 1082134 - RNA, 22 nt, Human
ucugaaauucacaguugaguca

SEQ ID NO: 1082135 - RNA, 22 nt, Human
agggcugaugcaccauguagcc

SEQ ID NO: 1082136 - RNA, 22 nt, Human
ugagccaguggaagauggcagu

SEQ ID NO: 1082137 - RNA, 20 nt, Human
ccagucccugagcaccaggg

SEQ ID NO: 1082138 - RNA, 22 nt, Human
cuggagcagguuuaggaguccc

SEQ ID NO: 1082139 - RNA, 18 nt, Human
gaagggagcuggaaugca

SEQ ID NO: 1082140 - RNA, 22 nt, Human
auucaguguaguuauuaucuuu

SEQ ID NO: 1082141 - RNA, 22 nt, Human
ugcaagaaaugugaagcuacaa

SEQ ID NO: 1082142 - RNA, 22 nt, Human
aaggcagugguugugauacugu

SEQ ID NO: 1082143 - RNA, 19 nt, Human
agcagccauagacaauaug

SEQ ID NO: 1082144 - RNA, 22 nt, Human
ggcugccugccgcccacuuggc

SEQ ID NO: 1082145 - RNA, 22 nt, Human
gagcaacaguuuaugguuuuuc

SEQ ID NO: 1082146 - RNA, 22 nt, Human
cagucccacaagaucuccacaa

SEQ ID NO: 1082147 - RNA, 22 nt, Human
uucagaggcuguaugacuagau

SEQ ID NO: 1082148 - RNA, 22 nt, Human
guuuccuuuuggaauuagagcu

SEQ ID NO: 1082149 - RNA, 22 nt, Human
auuuggggcucaccagggcuga

SEQ ID NO: 1082150 - RNA, 21 nt, Human
auuuuguacauagaauuuguc

SEQ ID NO: 1082151 - RNA, 22 nt, Human
uugucuuucccagcuucuagag

SEQ ID NO: 1082152 - RNA, 22 nt, Human
cacaggguuguucugaggauuc

SEQ ID NO: 1082153 - RNA, 22 nt, Human
caggccugugaguugaggcccc

SEQ ID NO: 1082154 - RNA, 22 nt, Human
cuucuggggauggagcccagaa

SEQ ID NO: 1082155 - RNA, 22 nt, Human
uguguuuauaguguaucuucca

SEQ ID NO: 1082156 - RNA, 22 nt, Human
ucuucacagaugcauauacuuc

SEQ ID NO: 1082157 - RNA, 22 nt, Human
gcucucuggaggccauggacag

SEQ ID NO: 1082158 - RNA, 22 nt, Human
aucuacaggauuuuacagaguu

SEQ ID NO: 1082159 - RNA, 22 nt, Human
ucagggaauaaguagaugagug

SEQ ID NO: 1082160 - RNA, 22 nt, Human
cugauucuguaauuuuuccuaa

SEQ ID NO: 1082161 - RNA, 22 nt, Human
caaugaaaauuuaaguugcagc

SEQ ID NO: 1082162 - RNA, 22 nt, Human
uuacaugguuguuggaaaugcu

SEQ ID NO: 1082163 - RNA, 22 nt, Human
ugaguuaaaugagaacaugaaa

SEQ ID NO: 1082164 - RNA, 19 nt, Human
ugggccugcaucugggucu

SEQ ID NO: 1082165 - RNA, 20 nt, Human
cacaacuguccacaugcucc

SEQ ID NO: 1082166 - RNA, 22 nt, Human
uggcagcaguggagguagaaag

SEQ ID NO: 1082167 - RNA, 22 nt, Human
cacugaagaugcgacuagugcu

SEQ ID NO: 1082168 - RNA, 22 nt, Human
cugggccucaagcucagauuuc

SEQ ID NO: 1082169 - RNA, 22 nt, Human
gaaagcacccaagauuuccuuc

SEQ ID NO: 1082170 - RNA, 22 nt, Human
uucaaacuaguuaaaagucaga

SEQ ID NO: 1082171 - RNA, 22 nt, Human
ugacauuuuaucaauaucacag

SEQ ID NO: 1082172 - RNA, 22 nt, Human
gucucaguuuuccaaacuguca

SEQ ID NO: 1082173 - RNA, 22 nt, Human
uuugggcaauucagugggaccu

SEQ ID NO: 1082174 - RNA, 22 nt, Human
agagucauaguuuaacuuuugu

SEQ ID NO: 1082175 - RNA, 22 nt, Human
cuggagagauccuccugaaaaa

SEQ ID NO: 1082176 - RNA, 22 nt, Human
uauaacacucagaaagaaucau

SEQ ID NO: 1082177 - RNA, 22 nt, Human
aauguuucguaaauugucuaug

SEQ ID NO: 1082178 - RNA, 22 nt, Human
ugacccugcuucuuggugcagg

SEQ ID NO: 1082179 - RNA, 22 nt, Human
gccagcaaguaucaccaaagcc

SEQ ID NO: 1082180 - RNA, 22 nt, Human
aagugguagacaaagauaauug

SEQ ID NO: 1082181 - RNA, 22 nt, Human
caaacauuugacuucucucagg

SEQ ID NO: 1082182 - RNA, 22 nt, Human
auauucuuauccuuuucucugu

SEQ ID NO: 1082183 - RNA, 17 nt, Human
uuucaucugggaccacc

SEQ ID NO: 1082184 - RNA, 22 nt, Human
cuggcuccaucacugggugaug

SEQ ID NO: 1082185 - RNA, 22 nt, Human
aaggaagagucuagaacaggca

SEQ ID NO: 1082186 - RNA, 19 nt, Human
ucucuggggacacuuucac

SEQ ID NO: 1082187 - RNA, 22 nt, Human
uacugcuugguguuguuguauc

SEQ ID NO: 1082188 - RNA, 22 nt, Human
gagcucuggcagggcaggucug

SEQ ID NO: 1082189 - RNA, 22 nt, Human
cugauuccaaagccaaagcuau

SEQ ID NO: 1082190 - RNA, 22 nt, Human
cccugcagcuuuugcauaguca

SEQ ID NO: 1082191 - RNA, 20 nt, Human
uccucagaagacauuugggg

SEQ ID NO: 1082192 - RNA, 16 nt, Human
cucagcuaaggagagg

SEQ ID NO: 1082193 - RNA, 22 nt, Human
uucacaauuucccuucaucagg

SEQ ID NO: 1082194 - RNA, 22 nt, Human
ucugucacccgagcaggcgaga

SEQ ID NO: 1082195 - RNA, 22 nt, Human
ggcaguagccagggacuggcag

SEQ ID NO: 1082196 - RNA, 22 nt, Human
cuccaggggccagaagccuggc

SEQ ID NO: 1082197 - RNA, 22 nt, Human
gcugccugcacagagcugcuuu

SEQ ID NO: 1082198 - RNA, 22 nt, Human
uuccauaaugagauucccagcc

SEQ ID NO: 1082199 - RNA, 22 nt, Human
auguuuauguugggcuauauuu

SEQ ID NO: 1082200 - RNA, 22 nt, Human
guccugcuggcuucaggagauu

SEQ ID NO: 1082201 - RNA, 22 nt, Human
cucaguuucugacauuaaaauc

SEQ ID NO: 1082202 - RNA, 22 nt, Human
aaagcacugcacauauauuugc

SEQ ID NO: 1082203 - RNA, 22 nt, Human
cagaggcauauaauugcugggg

SEQ ID NO: 1082204 - RNA, 22 nt, Human
uuuuacaguuccaugcaaagcg

SEQ ID NO: 1082205 - RNA, 16 nt, Human
agcccugccguguacu

SEQ ID NO: 1082206 - RNA, 22 nt, Human
cacaggcucuucucacuugauu

SEQ ID NO: 1082207 - RNA, 22 nt, Human
acuagcagggauauuauauaag

SEQ ID NO: 1082208 - RNA, 22 nt, Human
guggcagguggagccuccugca

SEQ ID NO: 1082209 - RNA, 22 nt, Human
gccacuggcaucuaguugguag

SEQ ID NO: 1082210 - RNA, 22 nt, Human
agagcagaguggcuguagcuug

SEQ ID NO: 1082211 - RNA, 22 nt, Human
cggcagagacggcgcuuugaac

SEQ ID NO: 1082212 - RNA, 22 nt, Human
ugcuggcuccaaccuggcaucu

SEQ ID NO: 1082213 - RNA, 22 nt, Human
uucauucauuacgugccaggca

SEQ ID NO: 1082214 - RNA, 22 nt, Human
cuccuggacauggagcggagga

SEQ ID NO: 1082215 - RNA, 21 nt, Human
ugcaggaaagugcugcgaccc

SEQ ID NO: 1082216 - RNA, 22 nt, Human
cccaggagguggagguugcagc

SEQ ID NO: 1082217 - RNA, 22 nt, Human
cccagcucucucaguucugcuu

SEQ ID NO: 1082218 - RNA, 22 nt, Human
uuucaagcaugucaaguuaguc

SEQ ID NO: 1082219 - RNA, 22 nt, Human
agcacauucugccuugcuuugc

SEQ ID NO: 1082220 - RNA, 22 nt, Human
aaauuucuaagcagccacuucc

SEQ ID NO: 1082221 - RNA, 22 nt, Human
ccucugagccugugugcggcac

SEQ ID NO: 1082222 - RNA, 22 nt, Human
ugacagggugauuaugagagcu

SEQ ID NO: 1082223 - RNA, 22 nt, Human
aggggcugccuggcuuggcacu

SEQ ID NO: 1082224 - RNA, 22 nt, Human
uucaugugaauauauuugucuu

SEQ ID NO: 1082225 - RNA, 22 nt, Human
aagauacugaugauguaggcua

SEQ ID NO: 1082226 - RNA, 22 nt, Human
aaagaaggaccuggaggaggau

SEQ ID NO: 1082227 - RNA, 22 nt, Human
guggcaggaucacggcucacug

SEQ ID NO: 1082228 - RNA, 22 nt, Human
agcagggcuuugcagacuuggg

SEQ ID NO: 1082229 - RNA, 22 nt, Human
ugaaggugucuuugugaacauc

SEQ ID NO: 1082230 - RNA, 22 nt, Human
uaccuugaaccccaagcuuugc

SEQ ID NO: 1082231 - RNA, 22 nt, Human
agagaggcgaguuaccugugcu

SEQ ID NO: 1082232 - RNA, 22 nt, Human
acagaccaaguuuccagcaggu

SEQ ID NO: 1082233 - RNA, 23 nt, Human
gcagagucaaguagucaugagug

SEQ ID NO: 1082234 - RNA, 22 nt, Human
gccaggcugcuccagggaggcc

SEQ ID NO: 1082235 - RNA, 22 nt, Human
cuggcucuaagugucagcuccc

SEQ ID NO: 1082236 - RNA, 22 nt, Human
uaaagcagcguggguggggcag

SEQ ID NO: 1082237 - RNA, 22 nt, Human
gagacacacacaggagguggca

SEQ ID NO: 1082238 - RNA, 22 nt, Human
caugccuguauuucugaucuau

SEQ ID NO: 1082239 - RNA, 22 nt, Human
aguaauagugaaucgacuauga

SEQ ID NO: 1082240 - RNA, 22 nt, Human
uugguucaaaacauggaagggu

SEQ ID NO: 1082241 - RNA, 22 nt, Human
gcuggccauucucuuugagaug

SEQ ID NO: 1082242 - RNA, 22 nt, Human
cagcacaggucaguuuuuuaag

SEQ ID NO: 1082243 - RNA, 22 nt, Human
acaucagagggcucacaugauc

SEQ ID NO: 1082244 - RNA, 22 nt, Human
gagccaggucgggccgcggcga

SEQ ID NO: 1082245 - RNA, 22 nt, Human
gaagacauuaagucuaugucac

SEQ ID NO: 1082246 - RNA, 22 nt, Human
agcugccucccugugcuugucc

SEQ ID NO: 1082247 - RNA, 22 nt, Human
cucacagcacuugugucauugg

SEQ ID NO: 1082248 - RNA, 22 nt, Human
auaaagcaagcauaccauuaag

SEQ ID NO: 1082249 - RNA, 22 nt, Human
uguguucauguugauucauagc

SEQ ID NO: 1082250 - RNA, 22 nt, Human
augggaugaacuugaucugcuu

SEQ ID NO: 1082251 - RNA, 22 nt, Human
ucaggauggcuucugcaucaaa

SEQ ID NO: 1082252 - RNA, 22 nt, Human
auaaggcacacauagauagggu

SEQ ID NO: 1082253 - RNA, 22 nt, Human
acauuuugcccuuauuugcuga

SEQ ID NO: 1082254 - RNA, 22 nt, Human
ccaaggagaaugacaccaugga

SEQ ID NO: 1082255 - RNA, 22 nt, Human
cuuucuuugcagugagccagag

SEQ ID NO: 1082256 - RNA, 18 nt, Human
gcucaggcccuagucagu

SEQ ID NO: 1082257 - RNA, 22 nt, Human
gugcuugggggaaguaacagac

SEQ ID NO: 1082258 - RNA, 23 nt, Human
acuuuucaauuagcuaugcuuaa

SEQ ID NO: 1082259 - RNA, 22 nt, Human
cagaggcugccagccaugugca

SEQ ID NO: 1082260 - RNA, 22 nt, Human
agggccagggaagcuguauuuu

SEQ ID NO: 1082261 - RNA, 21 nt, Human
gauuuaguggcuguucuaccu

SEQ ID NO: 1082262 - RNA, 22 nt, Human
uugugaauagugccgcuauaaa

SEQ ID NO: 1082263 - RNA, 22 nt, Human
cacagcagaaaguguaggagga

SEQ ID NO: 1082264 - RNA, 22 nt, Human
cugggcuucucccccuggcaga

SEQ ID NO: 1082265 - RNA, 22 nt, Human
caagggaccugagauggucucu

SEQ ID NO: 1082266 - RNA, 22 nt, Human
ggcacugagaggcucuuccuaa

SEQ ID NO: 1082267 - RNA, 22 nt, Human
aauaagauccugaagauauguu

SEQ ID NO: 1082268 - RNA, 20 nt, Human
cugagcccccagccugcagg

SEQ ID NO: 1082269 - RNA, 22 nt, Human
uguguuuuaucuauuguaucuu

SEQ ID NO: 1082270 - RNA, 22 nt, Human
cuuccugguuugaagcucgccg

SEQ ID NO: 1082271 - RNA, 22 nt, Human
ccucccucuguuagagcugucu

SEQ ID NO: 1082272 - RNA, 22 nt, Human
ucagggaacaauguuauggcuu

SEQ ID NO: 1082273 - RNA, 22 nt, Human
ggcugccugcuccuccugcacg

SEQ ID NO: 1082274 - RNA, 22 nt, Human
cucugggcaaguuucuucauga

SEQ ID NO: 1082275 - RNA, 22 nt, Human
uauuacuguuacuucacacugu

SEQ ID NO: 1082276 - RNA, 22 nt, Human
cacccugggcugggccuguuaa

SEQ ID NO: 1082277 - RNA, 22 nt, Human
guggcaggggcgggcuguuccg

SEQ ID NO: 1082278 - RNA, 22 nt, Human
guuaauauuuaccugucaagaa

SEQ ID NO: 1082279 - RNA, 22 nt, Human
ggaguugauuuuggauauauua

SEQ ID NO: 1082280 - RNA, 22 nt, Human
ccucacagcuuuucaaagugga

SEQ ID NO: 1082281 - RNA, 22 nt, Human
uagaagaaagugaagcugggga

SEQ ID NO: 1082282 - RNA, 22 nt, Human
ugccaggcgugguggugcgcac

SEQ ID NO: 1082283 - RNA, 22 nt, Human
aggagucauugagagggguccu

SEQ ID NO: 1082284 - RNA, 22 nt, Human
ccugucucuuucaaucugagag

SEQ ID NO: 1082285 - RNA, 22 nt, Human
agagggaaugugauugcaccau

SEQ ID NO: 1082286 - RNA, 22 nt, Human
gaagaagguggcccagggguag

SEQ ID NO: 1082287 - RNA, 22 nt, Human
agcagcaacuuauuuuucuuau

SEQ ID NO: 1082288 - RNA, 22 nt, Human
cuucagggaggagcauggguuc

SEQ ID NO: 1082289 - RNA, 20 nt, Human
uccaggcccacucagcugaa

SEQ ID NO: 1082290 - RNA, 22 nt, Human
guucucucugcuuccaagaugg

SEQ ID NO: 1082291 - RNA, 22 nt, Human
guucagggagggacagaugaag

SEQ ID NO: 1082292 - RNA, 22 nt, Human
aagggaggaggauuuauuguac

SEQ ID NO: 1082293 - RNA, 22 nt, Human
ggcugcucugccuuccagcugg

SEQ ID NO: 1082294 - RNA, 22 nt, Human
cuuucaaagaccuuggcauggg

SEQ ID NO: 1082295 - RNA, 23 nt, Human
aggaaagcauucauuuuuaccau

SEQ ID NO: 1082296 - RNA, 22 nt, Human
uucaacauagcugaggcauaua

SEQ ID NO: 1082297 - RNA, 22 nt, Human
uuuuuaagagauucuccagucu

SEQ ID NO: 1082298 - RNA, 20 nt, Human
cucugcccccagacugacag

SEQ ID NO: 1082299 - RNA, 22 nt, Human
cuguccucuguccucagcagga

SEQ ID NO: 1082300 - RNA, 23 nt, Human
cuuuuaacuagaguaucagcugc

SEQ ID NO: 1082301 - RNA, 22 nt, Human
auccagggauaaaaguaagguu

SEQ ID NO: 1082302 - RNA, 21 nt, Human
acucaagugggcaugcgcaga

SEQ ID NO: 1082303 - RNA, 23 nt, Human
cucugcaggagagugggcagggc

SEQ ID NO: 1082304 - RNA, 22 nt, Human
acaggcacaacugaguagacuc

SEQ ID NO: 1082305 - RNA, 22 nt, Human
acccuuucuuacucacacgcuc

SEQ ID NO: 1082306 - RNA, 22 nt, Human
gggcaugagagggcagcuggca

SEQ ID NO: 1082307 - RNA, 22 nt, Human
ucuuacauauagcaugaguaca

SEQ ID NO: 1082308 - RNA, 22 nt, Human
gcagagucaggauuccauccca

SEQ ID NO: 1082309 - RNA, 22 nt, Human
ucaauguuuguucaugaaaaua

SEQ ID NO: 1082310 - RNA, 22 nt, Human
ggaagccaguugcuuggugugg

SEQ ID NO: 1082311 - RNA, 22 nt, Human
uccaggcuggacaugaggcggg

SEQ ID NO: 1082312 - RNA, 22 nt, Human
ccaaaguauuaaaucuuagcaa

SEQ ID NO: 1082313 - RNA, 22 nt, Human
ucucuccuuaucauuguguuua

SEQ ID NO: 1082314 - RNA, 22 nt, Human
auagaauuacaguguguuugga

SEQ ID NO: 1082315 - RNA, 22 nt, Human
aauuuuaaucaguggugcugag

SEQ ID NO: 1082316 - RNA, 22 nt, Human
ugagcaggcgcagcaggagguc

SEQ ID NO: 1082317 - RNA, 22 nt, Human
acacagugugugcagucggacg

SEQ ID NO: 1082318 - RNA, 22 nt, Human
cuucccacagaauucaaucagu

SEQ ID NO: 1082319 - RNA, 22 nt, Human
ucccugggcaucacguugcuuc

SEQ ID NO: 1082320 - RNA, 19 nt, Human
ccaaaagcaauuccaagua

SEQ ID NO: 1082321 - RNA, 20 nt, Human
ucccagucagccagagugag

SEQ ID NO: 1082322 - RNA, 17 nt, Human
aggcuggcucacaggga

SEQ ID NO: 1082323 - RNA, 20 nt, Human
aacuuuagacauaaucucuu

SEQ ID NO: 1082324 - RNA, 22 nt, Human
auccuugagaaaauaaaugacc

SEQ ID NO: 1082325 - RNA, 22 nt, Human
ccugggugaugugcugcccucg

SEQ ID NO: 1082326 - RNA, 22 nt, Human
cacuaagucaacagccucucuu

SEQ ID NO: 1082327 - RNA, 22 nt, Human
aaggggauagagcagacacucc

SEQ ID NO: 1082328 - RNA, 22 nt, Human
ggugggguuuuaggcugcugca

SEQ ID NO: 1082329 - RNA, 22 nt, Human
cauacuuuuuagaucugccuuc

SEQ ID NO: 1082330 - RNA, 22 nt, Human
cccagaguggagggugcagaau

SEQ ID NO: 1082331 - RNA, 22 nt, Human
ggaaaucagcagaugcugguga

SEQ ID NO: 1082332 - RNA, 22 nt, Human
ucugaaaucuguaagcacuagc

SEQ ID NO: 1082333 - RNA, 22 nt, Human
cugcuggagguuggagcaugca

SEQ ID NO: 1082334 - RNA, 22 nt, Human
aacaucuuugccaaauugcuau

SEQ ID NO: 1082335 - RNA, 22 nt, Human
cuuugaucuacucacuaaacaa

SEQ ID NO: 1082336 - RNA, 22 nt, Human
cacaauuuuccuuuaaguguau

SEQ ID NO: 1082337 - RNA, 22 nt, Human
ucaggaugguguggaggaaaua

SEQ ID NO: 1082338 - RNA, 22 nt, Human
ucucccaagccuggcaggggca

SEQ ID NO: 1082339 - RNA, 20 nt, Human
gcuucaguuuccucacuggu

SEQ ID NO: 1082340 - RNA, 22 nt, Human
uuuugcuuaaucuagauuuugc

SEQ ID NO: 1082341 - RNA, 22 nt, Human
uugguucauuuucucaucuaga

SEQ ID NO: 1082342 - RNA, 22 nt, Human
guccagggaaauagcgacaggg

SEQ ID NO: 1082343 - RNA, 22 nt, Human
aauauuucuguagcuauguucu

SEQ ID NO: 1082344 - RNA, 22 nt, Human
guuccacaaaauguacccaguu

SEQ ID NO: 1082345 - RNA, 22 nt, Human
uggcagggugccaguugcgagu

SEQ ID NO: 1082346 - RNA, 22 nt, Human
ggccucugcccucacuccuguc

SEQ ID NO: 1082347 - RNA, 22 nt, Human
cagcagaggaaagcaaaucuaa

SEQ ID NO: 1082348 - RNA, 22 nt, Human
cagauccacccuuguagugaca

SEQ ID NO: 1082349 - RNA, 22 nt, Human
ucccagggcagcuguccagaag

SEQ ID NO: 1082350 - RNA, 22 nt, Human
aguaugaaucucuuuauucugc

SEQ ID NO: 1082351 - RNA, 22 nt, Human
aggugagggugccagugcaugg

SEQ ID NO: 1082352 - RNA, 22 nt, Human
aagaaaucagaaaagcauucgu

SEQ ID NO: 1082353 - RNA, 22 nt, Human
aaugaugguuaaacacuggagg

SEQ ID NO: 1082354 - RNA, 22 nt, Human
acagcaaaugguuuucugucug

SEQ ID NO: 1082355 - RNA, 23 nt, Human
gaagcagaugucugaguaggcag

SEQ ID NO: 1082356 - RNA, 19 nt, Human
cuggugcuugagugaguca

SEQ ID NO: 1082357 - RNA, 22 nt, Human
cacaugacucuggcuacccaga

SEQ ID NO: 1082358 - RNA, 22 nt, Human
acccucaggcagaauguauucu

SEQ ID NO: 1082359 - RNA, 22 nt, Human
guccucuggaagaugaguucuu

SEQ ID NO: 1082360 - RNA, 22 nt, Human
auugaaagauauacuguucuca

SEQ ID NO: 1082361 - RNA, 22 nt, Human
cagccucucuguaucucaggau

SEQ ID NO: 1082362 - RNA, 22 nt, Human
gcagggaagaucuuggagcugc

SEQ ID NO: 1082363 - RNA, 22 nt, Human
cagcaggcugcgauugcucauu

SEQ ID NO: 1082364 - RNA, 21 nt, Human
cagugguuuauaaacaacaga

SEQ ID NO: 1082365 - RNA, 22 nt, Human
aggcaacauaacacgaaagucu

SEQ ID NO: 1082366 - RNA, 22 nt, Human
ucuugcccucaacaagagcaug

SEQ ID NO: 1082367 - RNA, 22 nt, Human
ugauguuauuagauacaaacca

SEQ ID NO: 1082368 - RNA, 22 nt, Human
gcaaaggccacuggggcgaugg

SEQ ID NO: 1082369 - RNA, 22 nt, Human
aagguaaugaaacagcagcuaa

SEQ ID NO: 1082370 - RNA, 22 nt, Human
uaaaaaguugaaaggacuuauc

SEQ ID NO: 1082371 - RNA, 21 nt, Human
uaauaauuccacuacagagua

SEQ ID NO: 1082372 - RNA, 22 nt, Human
uaacuucuggaaaugcaucugc

SEQ ID NO: 1082373 - RNA, 22 nt, Human
ugcacacacaugaaguagcaug

SEQ ID NO: 1082374 - RNA, 22 nt, Human
aggcaggcuagucgcuugagcc

SEQ ID NO: 1082375 - RNA, 18 nt, Human
ggccugaggauuucagca

SEQ ID NO: 1082376 - RNA, 19 nt, Human
agcaacaccguuuauuucc

SEQ ID NO: 1082377 - RNA, 22 nt, Human
ugggcagagucguggggaauag

SEQ ID NO: 1082378 - RNA, 22 nt, Human
uauuauuauaguuauugggaag

SEQ ID NO: 1082379 - RNA, 19 nt, Human
uuccugugcugcugugucc

SEQ ID NO: 1082380 - RNA, 22 nt, Human
ucagcugccuuucccaugcuag

SEQ ID NO: 1082381 - RNA, 22 nt, Human
uacagaauaaagcgugaagcuu

SEQ ID NO: 1082382 - RNA, 22 nt, Human
acacaggaagucagcacugaug

SEQ ID NO: 1082383 - RNA, 22 nt, Human
uauauuaccugccugaucuaua

SEQ ID NO: 1082384 - RNA, 22 nt, Human
ucacaguuaauuguuggaaugu

SEQ ID NO: 1082385 - RNA, 22 nt, Human
aaggaagaugcuggccugggga

SEQ ID NO: 1082386 - RNA, 22 nt, Human
acagagcaguucuggagcuggc

SEQ ID NO: 1082387 - RNA, 22 nt, Human
agucugucugucacuucugcag

SEQ ID NO: 1082388 - RNA, 21 nt, Human
uggcacugcuuagcagguucc

SEQ ID NO: 1082389 - RNA, 18 nt, Human
aggagaaagggaccaggg

SEQ ID NO: 1082390 - RNA, 22 nt, Human
caaagcagaccuuuacccuuua

SEQ ID NO: 1082391 - RNA, 22 nt, Human
uuuugauaucaugaugaacaga

SEQ ID NO: 1082392 - RNA, 22 nt, Human
guguguuucagaagccaggugu

SEQ ID NO: 1082393 - RNA, 22 nt, Human
uccuccuguuucucaggccugg

SEQ ID NO: 1082394 - RNA, 17 nt, Human
uccuucagugccucugc

SEQ ID NO: 1082395 - RNA, 19 nt, Human
gggcuucugggaucaagag

SEQ ID NO: 1082396 - RNA, 20 nt, Human
ucucagcauaagaacccuuc

SEQ ID NO: 1082397 - RNA, 22 nt, Human
uuucacagcgucuuucucuugc

SEQ ID NO: 1082398 - RNA, 21 nt, Human
ugaaaucugaugggacaaaug

SEQ ID NO: 1082399 - RNA, 19 nt, Human
cugucaggggcuggauguu

SEQ ID NO: 1082400 - RNA, 22 nt, Human
uuacaaagaaaauuaggcauuu

SEQ ID NO: 1082401 - RNA, 22 nt, Human
uggcagugccccuugaccagug

SEQ ID NO: 1082402 - RNA, 22 nt, Human
cuuucuuauaccugucagggcc

SEQ ID NO: 1082403 - RNA, 22 nt, Human
ggcugccugaggcugaggcccg

SEQ ID NO: 1082404 - RNA, 16 nt, Human
gaagcagaggguguug

SEQ ID NO: 1082405 - RNA, 22 nt, Human
ugggacagugaccccagagguc

SEQ ID NO: 1082406 - RNA, 22 nt, Human
gacagcagaugaagccugcaga

SEQ ID NO: 1082407 - RNA, 22 nt, Human
aauaagaacuugucucuggcag

SEQ ID NO: 1082408 - RNA, 22 nt, Human
agagccugaggccaggaaaaug

SEQ ID NO: 1082409 - RNA, 22 nt, Human
aaagauuagauaagauagauuu

SEQ ID NO: 1082410 - RNA, 20 nt, Human
ucaaagcacugccugucauc

SEQ ID NO: 1082411 - RNA, 22 nt, Human
auucacaugugcuucuuaucac

SEQ ID NO: 1082412 - RNA, 22 nt, Human
cuacacagagccuacuucugca

SEQ ID NO: 1082413 - RNA, 22 nt, Human
uuacugcuguuaggauauuuuu

SEQ ID NO: 1082414 - RNA, 22 nt, Human
caaauacucuggauguguuugu

SEQ ID NO: 1082415 - RNA, 22 nt, Human
ccuaugccugucacucugcgcu

SEQ ID NO: 1082416 - RNA, 22 nt, Human
aaguaugcuaauuaacuagcac

SEQ ID NO: 1082417 - RNA, 22 nt, Human
ugaggcagucacccccuccugc

SEQ ID NO: 1082418 - RNA, 23 nt, Human
cuucagugugggacugcagcgug

SEQ ID NO: 1082419 - RNA, 22 nt, Human
uuauuauugugguugcauuauc

SEQ ID NO: 1082420 - RNA, 16 nt, Human
gagaagagcccggcag

SEQ ID NO: 1082421 - RNA, 22 nt, Human
augcuguguuuuaaauggaaau

SEQ ID NO: 1082422 - RNA, 22 nt, Human
acagggcccuugccagcacaag

SEQ ID NO: 1082423 - RNA, 22 nt, Human
uuucuagaaugacucaucugag

SEQ ID NO: 1082424 - RNA, 22 nt, Human
aaaaucacacaaguagaugggg

SEQ ID NO: 1082425 - RNA, 22 nt, Human
cucugagaggauccugcccggg

SEQ ID NO: 1082426 - RNA, 22 nt, Human
ggacucagcagccaggaguggc

SEQ ID NO: 1082427 - RNA, 22 nt, Human
cagcucuuuuucacacaacaug

SEQ ID NO: 1082428 - RNA, 22 nt, Human
ugguccagacuuugaccucuca

SEQ ID NO: 1082429 - RNA, 22 nt, Human
augcaguggcagcuccuggugu

SEQ ID NO: 1082430 - RNA, 22 nt, Human
gacugggcuccaagagggagag

SEQ ID NO: 1082431 - RNA, 22 nt, Human
ccucccauggagcucuguccau

SEQ ID NO: 1082432 - RNA, 22 nt, Human
uggcauuuuguagcuguguauc

SEQ ID NO: 1082433 - RNA, 22 nt, Human
cucucugguacauagaguuugg

SEQ ID NO: 1082434 - RNA, 22 nt, Human
caagagcucagaaacccuugcu

SEQ ID NO: 1082435 - RNA, 22 nt, Human
acaguuacaugauucuugugag

SEQ ID NO: 1082436 - RNA, 22 nt, Human
gcacugugcuagguaucaggga

SEQ ID NO: 1082437 - RNA, 22 nt, Human
ucugacuuggugcuaccagcca

SEQ ID NO: 1082438 - RNA, 22 nt, Human
cugcugggaaggucugcucagu

SEQ ID NO: 1082439 - RNA, 22 nt, Human
uuuccugugacuaaucuggaca

SEQ ID NO: 1082440 - RNA, 22 nt, Human
cacagguggcuccaaguuagag

SEQ ID NO: 1082441 - RNA, 22 nt, Human
gcucacuggccugaagaggacg

SEQ ID NO: 1082442 - RNA, 22 nt, Human
uuucaauguaugucuuucugag

SEQ ID NO: 1082443 - RNA, 22 nt, Human
ugggcaggagagaagcuaaaga

SEQ ID NO: 1082444 - RNA, 20 nt, Human
ccucaagcagacugacagcu

SEQ ID NO: 1082445 - RNA, 22 nt, Human
caggcugcagcagcaguggccc

SEQ ID NO: 1082446 - RNA, 22 nt, Human
aguaaacauguaauuguucauu

SEQ ID NO: 1082447 - RNA, 20 nt, Human
ccugggcucaaagcauccuc

SEQ ID NO: 1082448 - RNA, 22 nt, Human
agccccucuccgcccugagucg

SEQ ID NO: 1082449 - RNA, 22 nt, Human
ccaggcugggcuacaaguugag

SEQ ID NO: 1082450 - RNA, 19 nt, Human
cuugccuguuccuacagcu

SEQ ID NO: 1082451 - RNA, 22 nt, Human
gucagaggaggcugaguaggaa

SEQ ID NO: 1082452 - RNA, 22 nt, Human
cuggcugcgucugcucugacag

SEQ ID NO: 1082453 - RNA, 22 nt, Human
uccagcccgacugggccugccg

SEQ ID NO: 1082454 - RNA, 22 nt, Human
aaggguugaagauaaauaaggu

SEQ ID NO: 1082455 - RNA, 22 nt, Human
ggcagcaggagccaucugguag

SEQ ID NO: 1082456 - RNA, 22 nt, Human
guuucuuucuauugacugaaca

SEQ ID NO: 1082457 - RNA, 23 nt, Human
guugccuuugcaucuucauccau

SEQ ID NO: 1082458 - RNA, 22 nt, Human
ucucucagcuuugagaccugcu

SEQ ID NO: 1082459 - RNA, 21 nt, Human
uucaaugaaaacaaagugagg

SEQ ID NO: 1082460 - RNA, 22 nt, Human
auuucacucuuaauugcuuccu

SEQ ID NO: 1082461 - RNA, 22 nt, Human
uccagaguuugagucuccuucc

SEQ ID NO: 1082462 - RNA, 22 nt, Human
gcacagggagacagccguggcc

SEQ ID NO: 1082463 - RNA, 22 nt, Human
ucaggcagguggcuggcuaugg

SEQ ID NO: 1082464 - RNA, 16 nt, Human
acaaauacaacugcug

SEQ ID NO: 1082465 - RNA, 22 nt, Human
cuucugggcauggcagagccug

SEQ ID NO: 1082466 - RNA, 22 nt, Human
ugagaaauauugcacagugagg

SEQ ID NO: 1082467 - RNA, 22 nt, Human
aauaucaucucucuuuucugca

SEQ ID NO: 1082468 - RNA, 22 nt, Human
cccaggaaugggaaggaggaau

SEQ ID NO: 1082469 - RNA, 22 nt, Human
aaggggaaaaaguguuaggagu

SEQ ID NO: 1082470 - RNA, 22 nt, Human
ucucccaagggcacauucaagg

SEQ ID NO: 1082471 - RNA, 22 nt, Human
agaaggcagaugggacggagca

SEQ ID NO: 1082472 - RNA, 22 nt, Human
gggaggaaggcuugggugagua

SEQ ID NO: 1082473 - RNA, 21 nt, Human
acagaacuguauagugauaaa

SEQ ID NO: 1082474 - RNA, 22 nt, Human
aaaguagaacauuuucuuaucu

SEQ ID NO: 1082475 - RNA, 22 nt, Human
gaaaacauccagagauagaccu

SEQ ID NO: 1082476 - RNA, 22 nt, Human
ugucauugaggaaaacuaggug

SEQ ID NO: 1082477 - RNA, 22 nt, Human
agcuggagaucaugcugauacu

SEQ ID NO: 1082478 - RNA, 22 nt, Human
agccaaggcagcuagagcucug

SEQ ID NO: 1082479 - RNA, 22 nt, Human
uucuuaagaggaacauuuuugu

SEQ ID NO: 1082480 - RNA, 22 nt, Human
ugggccuguggcuuggcucuag

SEQ ID NO: 1082481 - RNA, 22 nt, Human
auuccacacaguaauacucaau

SEQ ID NO: 1082482 - RNA, 22 nt, Human
agcuuagucacucuuaaauuua

SEQ ID NO: 1082483 - RNA, 22 nt, Human
aaggcauauauucuaaacagga

SEQ ID NO: 1082484 - RNA, 22 nt, Human
ggugacaguuccggagguacag

SEQ ID NO: 1082485 - RNA, 22 nt, Human
cauugaaaccuaacauaggcug

SEQ ID NO: 1082486 - RNA, 22 nt, Human
auguuuaaucggcugccuuucc

SEQ ID NO: 1082487 - RNA, 22 nt, Human
uggcccugcacccagagcaguu

SEQ ID NO: 1082488 - RNA, 22 nt, Human
uuucccuacuuguaacuggaaa

SEQ ID NO: 1082489 - RNA, 22 nt, Human
aucuccagguugugccugcguc

SEQ ID NO: 1082490 - RNA, 22 nt, Human
uauuuguccuuauuaagaucug

SEQ ID NO: 1082491 - RNA, 22 nt, Human
gggagccuugggagugccagcc

SEQ ID NO: 1082492 - RNA, 22 nt, Human
uccucccugaguggggacagcu

SEQ ID NO: 1082493 - RNA, 22 nt, Human
ugaggugguucaagagccuugu

SEQ ID NO: 1082494 - RNA, 22 nt, Human
ugggugggagcgcccugucugg

SEQ ID NO: 1082495 - RNA, 22 nt, Human
uuccagauguuuaaguucugcu

SEQ ID NO: 1082496 - RNA, 22 nt, Human
uaacagaaaggcucaggugcuc

SEQ ID NO: 1082497 - RNA, 22 nt, Human
acauguuuacauuaggugauau

SEQ ID NO: 1082498 - RNA, 22 nt, Human
ugcaggcuguuugguggaucuc

SEQ ID NO: 1082499 - RNA, 22 nt, Human
uguggcagaguaaggacccagu

SEQ ID NO: 1082500 - RNA, 22 nt, Human
uggcucuggcgugaagcccaga

SEQ ID NO: 1082501 - RNA, 22 nt, Human
aguggggcggacaggaccagga

SEQ ID NO: 1082502 - RNA, 22 nt, Human
gcuggagugcugaggugcagug

SEQ ID NO: 1082503 - RNA, 22 nt, Human
uaagauaauaaguaugucuaug

SEQ ID NO: 1082504 - RNA, 20 nt, Human
agaaaucagaccacacacua

SEQ ID NO: 1082505 - RNA, 22 nt, Human
augcugaagagugcacaggcua

SEQ ID NO: 1082506 - RNA, 22 nt, Human
ucagguggcugguugcuggcua

SEQ ID NO: 1082507 - RNA, 22 nt, Human
caggcagcugcgacaagagagc

SEQ ID NO: 1082508 - RNA, 22 nt, Human
cacacagaaccgcucgccacuu

SEQ ID NO: 1082509 - RNA, 22 nt, Human
auuucuacugugagaaacauga

SEQ ID NO: 1082510 - RNA, 22 nt, Human
agcugccagcaucccggaaggg

SEQ ID NO: 1082511 - RNA, 22 nt, Human
ucccagggacucucugccuucc

SEQ ID NO: 1082512 - RNA, 22 nt, Human
aucuucuauagauauucugaag

SEQ ID NO: 1082513 - RNA, 22 nt, Human
gaagagcuuagacagaaucaaa

SEQ ID NO: 1082514 - RNA, 22 nt, Human
uuucacuguuaggaguaugcua

SEQ ID NO: 1082515 - RNA, 22 nt, Human
uucaggauuauacucucuuccc

SEQ ID NO: 1082516 - RNA, 21 nt, Human
augauaugcuuguauuuccaa

SEQ ID NO: 1082517 - RNA, 22 nt, Human
uuguaaagcugauuagaaagcc

SEQ ID NO: 1082518 - RNA, 22 nt, Human
ccuuucucuuggauaccgauug

SEQ ID NO: 1082519 - RNA, 22 nt, Human
gcuggccucaucacugacuucu

SEQ ID NO: 1082520 - RNA, 19 nt, Human
ggccuggauuuagggcucc

SEQ ID NO: 1082521 - RNA, 22 nt, Human
cagggggugcaggcccugugac

SEQ ID NO: 1082522 - RNA, 22 nt, Human
ggacagaaaccauaugagugua

SEQ ID NO: 1082523 - RNA, 22 nt, Human
auuucacaaaccauccugauuu

SEQ ID NO: 1082524 - RNA, 22 nt, Human
ccacugucugcaggccucagca

SEQ ID NO: 1082525 - RNA, 22 nt, Human
uauggaaaguguuuucuucugu

SEQ ID NO: 1082526 - RNA, 22 nt, Human
uugucuuagagugaaaacuuua

SEQ ID NO: 1082527 - RNA, 22 nt, Human
cugggugguucuaacuguugau

SEQ ID NO: 1082528 - RNA, 22 nt, Human
agccuggagaagauguguauug

SEQ ID NO: 1082529 - RNA, 22 nt, Human
ggcacucagagauucaggcugu

SEQ ID NO: 1082530 - RNA, 22 nt, Human
gcagguggaucaccacgucagg

SEQ ID NO: 1082531 - RNA, 22 nt, Human
aaaacugaaauacgauccaaug

SEQ ID NO: 1082532 - RNA, 22 nt, Human
auaguuuucuaugcacuguuau

SEQ ID NO: 1082533 - RNA, 22 nt, Human
aggagaaggaagugcaucacua

SEQ ID NO: 1082534 - RNA, 22 nt, Human
caugcaguguguaucuacuuaa

SEQ ID NO: 1082535 - RNA, 22 nt, Human
uccuuuguuaaggagguuuguu

SEQ ID NO: 1082536 - RNA, 22 nt, Human
caggcacugugcuagauccuug

SEQ ID NO: 1082537 - RNA, 22 nt, Human
auuagcuucaaagccaucaacc

SEQ ID NO: 1082538 - RNA, 22 nt, Human
uuucugaaaacugaaguagugc

SEQ ID NO: 1082539 - RNA, 22 nt, Human
ucacaucaaggacugucuggcu

SEQ ID NO: 1082540 - RNA, 22 nt, Human
uuaacaaucauaggaccauuua

SEQ ID NO: 1082541 - RNA, 22 nt, Human
cacagggcuucucauggggugc

SEQ ID NO: 1082542 - RNA, 22 nt, Human
acacaggaaaugguuuaguuuu

SEQ ID NO: 1082543 - RNA, 22 nt, Human
ugccuggcacuccuggagcuca

SEQ ID NO: 1082544 - RNA, 22 nt, Human
ugcaaagauuuaucuuucucca

SEQ ID NO: 1082545 - RNA, 22 nt, Human
caagcuuguuucuccugggggu

SEQ ID NO: 1082546 - RNA, 22 nt, Human
uuuguguuggaagaaaugcuac

SEQ ID NO: 1082547 - RNA, 22 nt, Human
uggagccuccucacacuguggc

SEQ ID NO: 1082548 - RNA, 22 nt, Human
gauuuccuagacauggggcaga

SEQ ID NO: 1082549 - RNA, 22 nt, Human
ucuggcagguucccauguuaug

SEQ ID NO: 1082550 - RNA, 22 nt, Human
gugcauccacuagggcucuccc

SEQ ID NO: 1082551 - RNA, 22 nt, Human
caacagcuggaggcuuggcccg

SEQ ID NO: 1082552 - RNA, 21 nt, Human
cucuggagucaagagcuucca

SEQ ID NO: 1082553 - RNA, 22 nt, Human
acagaaauugggcaaauggaag

SEQ ID NO: 1082554 - RNA, 22 nt, Human
ggcuggaaaagacaaagcuauu

SEQ ID NO: 1082555 - RNA, 22 nt, Human
agagacaggguuuugccauguu

SEQ ID NO: 1082556 - RNA, 22 nt, Human
aaucuugaguaucagaccaaga

SEQ ID NO: 1082557 - RNA, 22 nt, Human
ucuuuacaguccucugucaauc

SEQ ID NO: 1082558 - RNA, 22 nt, Human
aaauucauuuuucuuagugugc

SEQ ID NO: 1082559 - RNA, 22 nt, Human
uaugucaugggucaaaaugaag

SEQ ID NO: 1082560 - RNA, 22 nt, Human
agaggcagcagucauacuacag

SEQ ID NO: 1082561 - RNA, 22 nt, Human
guggucaggggcugaggugccc

SEQ ID NO: 1082562 - RNA, 22 nt, Human
cagacagagcucacaagucuuu

SEQ ID NO: 1082563 - RNA, 21 nt, Human
cacugcagccuugaccugggc

SEQ ID NO: 1082564 - RNA, 22 nt, Human
auuucugccaaaguggggaccu

SEQ ID NO: 1082565 - RNA, 22 nt, Human
ggcuagggacuccuccucaggg

SEQ ID NO: 1082566 - RNA, 22 nt, Human
uguaaaagacauuucuaagcaa

SEQ ID NO: 1082567 - RNA, 22 nt, Human
aagaucaagaucagagaacagc

SEQ ID NO: 1082568 - RNA, 22 nt, Human
ccaggagccacucaggcccaca

SEQ ID NO: 1082569 - RNA, 22 nt, Human
cacugagaggucucauuuccaa

SEQ ID NO: 1082570 - RNA, 22 nt, Human
gccaggaagagagagcccucca

SEQ ID NO: 1082571 - RNA, 22 nt, Human
gggacccagguaauccugugcu

SEQ ID NO: 1082572 - RNA, 22 nt, Human
cuccugggcucaagugauccuc

SEQ ID NO: 1082573 - RNA, 22 nt, Human
ucacaaauauuuuaacaguagg

SEQ ID NO: 1082574 - RNA, 22 nt, Human
acaucaguaacuguaaaacagg

SEQ ID NO: 1082575 - RNA, 22 nt, Human
gcggggacagaaggcgguucuc

SEQ ID NO: 1082576 - RNA, 22 nt, Human
ugcacuacugugauacacagcc

SEQ ID NO: 1082577 - RNA, 22 nt, Human
gacauuuaaauugcaggcagcc

SEQ ID NO: 1082578 - RNA, 20 nt, Human
agaagucagcucagaaguga

SEQ ID NO: 1082579 - RNA, 22 nt, Human
ggaggccaaggagggcggauca

SEQ ID NO: 1082580 - RNA, 22 nt, Human
uaaugguauuuguugaaaaacu

SEQ ID NO: 1082581 - RNA, 22 nt, Human
ugucucugagaugacucccacc

SEQ ID NO: 1082582 - RNA, 22 nt, Human
ugacagaacagguugggagcaa

SEQ ID NO: 1082583 - RNA, 22 nt, Human
acagaacugggaaaugcacaua

SEQ ID NO: 1082584 - RNA, 22 nt, Human
acuucaugcagaagagagcugu

SEQ ID NO: 1082585 - RNA, 22 nt, Human
guuccaaaguuagaguguauug

SEQ ID NO: 1082586 - RNA, 22 nt, Human
gcuccucuauuccccacauuuu

SEQ ID NO: 1082587 - RNA, 22 nt, Human
agggugcaaaagcaaggacagu

SEQ ID NO: 1082588 - RNA, 22 nt, Human
uuugaaagggaaauaaacuccu

SEQ ID NO: 1082589 - RNA, 22 nt, Human
auagauacauuagguaacuugu

SEQ ID NO: 1082590 - RNA, 22 nt, Human
uacacauuagugagguauuuug

SEQ ID NO: 1082591 - RNA, 22 nt, Human
gcugccugguuucucagcugca

SEQ ID NO: 1082592 - RNA, 22 nt, Human
gcaugcaaauagucaugcuucc

SEQ ID NO: 1082593 - RNA, 22 nt, Human
ugcagaugaaugcugagacacu

SEQ ID NO: 1082594 - RNA, 22 nt, Human
ugcugugacgccucaggaaucc

SEQ ID NO: 1082595 - RNA, 22 nt, Human
uuauaaagguuugugcauauuu

SEQ ID NO: 1082596 - RNA, 22 nt, Human
uuucucaacuguauuaugcaga

SEQ ID NO: 1082597 - RNA, 22 nt, Human
uacacauucuagggcacaguua

SEQ ID NO: 1082598 - RNA, 22 nt, Human
ugaggcaggacauggacaacug

SEQ ID NO: 1082599 - RNA, 22 nt, Human
ugaaaugaaugugauucgauag

SEQ ID NO: 1082600 - RNA, 20 nt, Human
ugcagcuucaccugugucau

SEQ ID NO: 1082601 - RNA, 22 nt, Human
cuuauuuugcugaugacccagg

SEQ ID NO: 1082602 - RNA, 22 nt, Human
uucaggaugcucagaguagucu

SEQ ID NO: 1082603 - RNA, 22 nt, Human
gugggcugcccuugaggucagc

SEQ ID NO: 1082604 - RNA, 22 nt, Human
agaaaucuuugaaguguaaugu

SEQ ID NO: 1082605 - RNA, 22 nt, Human
ccugggugucaugggcagcugg

SEQ ID NO: 1082606 - RNA, 22 nt, Human
ggcccacacugacagcugagcu

SEQ ID NO: 1082607 - RNA, 22 nt, Human
uagcagggaaggugugcugagc

SEQ ID NO: 1082608 - RNA, 22 nt, Human
cuguccucaacccauccuucuc

SEQ ID NO: 1082609 - RNA, 22 nt, Human
ucuguaaagucuguguaaaguc

SEQ ID NO: 1082610 - RNA, 22 nt, Human
uauuuguauuucaugcaguaaa

SEQ ID NO: 1082611 - RNA, 22 nt, Human
uuuguaagcaguguuuuuacag

SEQ ID NO: 1082612 - RNA, 20 nt, Human
ucccucaguccuggcuuugu

SEQ ID NO: 1082613 - RNA, 22 nt, Human
agugaguauuuguugagugcua

SEQ ID NO: 1082614 - RNA, 22 nt, Human
ugccuguccugaggaugagggu

SEQ ID NO: 1082615 - RNA, 19 nt, Human
cagcugcaccgugaccauc

SEQ ID NO: 1082616 - RNA, 22 nt, Human
accucugcaaugcaaugucaug

SEQ ID NO: 1082617 - RNA, 22 nt, Human
ucaugcugaguccuggcuuugu

SEQ ID NO: 1082618 - RNA, 22 nt, Human
ugugugccugagccgugccugg

SEQ ID NO: 1082619 - RNA, 22 nt, Human
aaacagauaaugcuauaaaugg

SEQ ID NO: 1082620 - RNA, 22 nt, Human
caguauuuggaauauagcuaag

SEQ ID NO: 1082621 - RNA, 22 nt, Human
ggcugguguugagugccuguag

SEQ ID NO: 1082622 - RNA, 22 nt, Human
gaagauuuucuccuuuaaauga

SEQ ID NO: 1082623 - RNA, 22 nt, Human
ccuggcugaacaaagucccucc

SEQ ID NO: 1082624 - RNA, 22 nt, Human
acccucgauaugaucugaugaa

SEQ ID NO: 1082625 - RNA, 22 nt, Human
uacaaagagguaauugcauaua

SEQ ID NO: 1082626 - RNA, 22 nt, Human
acacagauuuuacauguuaugc

SEQ ID NO: 1082627 - RNA, 22 nt, Human
gucauuuuuuucguaauagugg

SEQ ID NO: 1082628 - RNA, 22 nt, Human
ggagaagcagcuucuugaugaa

SEQ ID NO: 1082629 - RNA, 22 nt, Human
aagagggcugcaaucuuauugc

SEQ ID NO: 1082630 - RNA, 22 nt, Human
gcuuuucauagauaaaauucua

SEQ ID NO: 1082631 - RNA, 22 nt, Human
ggagccagagucugcaguguaa

SEQ ID NO: 1082632 - RNA, 22 nt, Human
uugcauugaaaauauauuuuaa

SEQ ID NO: 1082633 - RNA, 22 nt, Human
gucacacaauaguaaguggucc

SEQ ID NO: 1082634 - RNA, 22 nt, Human
cagccucugagccuuggcagau

SEQ ID NO: 1082635 - RNA, 20 nt, Human
agcccaggccugugugaguc

SEQ ID NO: 1082636 - RNA, 22 nt, Human
cagucccagaagagccugggag

SEQ ID NO: 1082637 - RNA, 22 nt, Human
uggcagagcccagacuccaguc

SEQ ID NO: 1082638 - RNA, 20 nt, Human
guuaggagguuggacaugga

SEQ ID NO: 1082639 - RNA, 21 nt, Human
ggagaaggacaauguugagua

SEQ ID NO: 1082640 - RNA, 22 nt, Human
agaauuacauaaauacaugaau

SEQ ID NO: 1082641 - RNA, 18 nt, Human
gagcugccauauuuaguu

SEQ ID NO: 1082642 - RNA, 22 nt, Human
cagcauggugccagugagucca

SEQ ID NO: 1082643 - RNA, 22 nt, Human
uguugauuaguguuuagacuua

SEQ ID NO: 1082644 - RNA, 22 nt, Human
uggguaggccaggaagcagugu

SEQ ID NO: 1082645 - RNA, 22 nt, Human
acagacagauuuugucugaugu

SEQ ID NO: 1082646 - RNA, 22 nt, Human
agauauaauaauuuacaagugu

SEQ ID NO: 1082647 - RNA, 22 nt, Human
aggucagaagugccagggaauu

SEQ ID NO: 1082648 - RNA, 22 nt, Human
uguauuaucaaguaaauacaug

SEQ ID NO: 1082649 - RNA, 22 nt, Human
uggcccugcuggccaaaggcua

SEQ ID NO: 1082650 - RNA, 22 nt, Human
aggcagcaauugaaaucauugu

SEQ ID NO: 1082651 - RNA, 22 nt, Human
aaaaaugaauucuucaguggca

SEQ ID NO: 1082652 - RNA, 22 nt, Human
aagcugauuccacuuuuuccac

SEQ ID NO: 1082653 - RNA, 22 nt, Human
cugcucucuguuccccuggauc

SEQ ID NO: 1082654 - RNA, 22 nt, Human
aaagcaugcuacuuuauauagg

SEQ ID NO: 1082655 - RNA, 22 nt, Human
uauuuggaggccacuguugagu

SEQ ID NO: 1082656 - RNA, 22 nt, Human
aacauucaaaacccaguucagu

SEQ ID NO: 1082657 - RNA, 22 nt, Human
ccaaaguccauaguuuacuuua

SEQ ID NO: 1082658 - RNA, 22 nt, Human
uugggacagaaaaggagaagau

SEQ ID NO: 1082659 - RNA, 22 nt, Human
ggcucagguuuccuucccagcu

SEQ ID NO: 1082660 - RNA, 22 nt, Human
auucacacuguauacacaggau

SEQ ID NO: 1082661 - RNA, 22 nt, Human
ugcucccagggacucuggcugg

SEQ ID NO: 1082662 - RNA, 21 nt, Human
aggagccagccugucagucua

SEQ ID NO: 1082663 - RNA, 22 nt, Human
ucacacagguuugcaaugauuu

SEQ ID NO: 1082664 - RNA, 22 nt, Human
aguuuucauuaccaugcugcaa

SEQ ID NO: 1082665 - RNA, 22 nt, Human
ugcccaggguggagugcagcgg

SEQ ID NO: 1082666 - RNA, 22 nt, Human
uacauguauugauuucucuucu

SEQ ID NO: 1082667 - RNA, 22 nt, Human
ccugcugggccugagcaaugag

SEQ ID NO: 1082668 - RNA, 22 nt, Human
aggguccugggugcaguugcuu

SEQ ID NO: 1082669 - RNA, 22 nt, Human
agaauucugacaauagaauugg

SEQ ID NO: 1082670 - RNA, 22 nt, Human
uuccauauguauauagcuguua

SEQ ID NO: 1082671 - RNA, 22 nt, Human
ucagcagggcugugguguggcu

SEQ ID NO: 1082672 - RNA, 22 nt, Human
ucauuucaguuguucccugguu

SEQ ID NO: 1082673 - RNA, 22 nt, Human
cacaugcuccauacagaauggg

SEQ ID NO: 1082674 - RNA, 22 nt, Human
acauguaaaagauaaauuaaca

SEQ ID NO: 1082675 - RNA, 22 nt, Human
uagcagagcacaucuucauucu

SEQ ID NO: 1082676 - RNA, 22 nt, Human
aggagcugaagucucugcacuc

SEQ ID NO: 1082677 - RNA, 22 nt, Human
ucucagggaugggaggccccag

SEQ ID NO: 1082678 - RNA, 22 nt, Human
aaaguuagucagaaccagccau

SEQ ID NO: 1082679 - RNA, 22 nt, Human
caggaagcaagugauuuucuug

SEQ ID NO: 1082680 - RNA, 22 nt, Human
cucugagacucaagugaguggg

SEQ ID NO: 1082681 - RNA, 22 nt, Human
ccagcccucacugaggccucuc

SEQ ID NO: 1082682 - RNA, 22 nt, Human
agagcugcgucuauucacaauc

SEQ ID NO: 1082683 - RNA, 22 nt, Human
gcuggccuucugcagaguucug

SEQ ID NO: 1082684 - RNA, 22 nt, Human
ugggguggauagaaagugaugu

SEQ ID NO: 1082685 - RNA, 17 nt, Human
aggaaacauuuucuuuc

SEQ ID NO: 1082686 - RNA, 22 nt, Human
aacuuacaauguuagagucuca

SEQ ID NO: 1082687 - RNA, 23 nt, Human
ccugcagcugcuggggcuccacc

SEQ ID NO: 1082688 - RNA, 22 nt, Human
aaacaucugguuaccuaggguc

SEQ ID NO: 1082689 - RNA, 22 nt, Human
acagaacaggcugagaaaaaca

SEQ ID NO: 1082690 - RNA, 22 nt, Human
uaugaagaaaccuauccucuag

SEQ ID NO: 1082691 - RNA, 21 nt, Human
ugaggccugccagucucagaa

SEQ ID NO: 1082692 - RNA, 22 nt, Human
caugaaaucacaagcugaggac

SEQ ID NO: 1082693 - RNA, 22 nt, Human
agcccccaaaagugcuuaugau

SEQ ID NO: 1082694 - RNA, 22 nt, Human
aggccuccuggcuccaggccuu

SEQ ID NO: 1082695 - RNA, 22 nt, Human
ucuccuccuuuuuucaacauag

SEQ ID NO: 1082696 - RNA, 22 nt, Human
agugucaaaucagcaucugggu

SEQ ID NO: 1082697 - RNA, 22 nt, Human
gaaugaguauucuuuauaggau

SEQ ID NO: 1082698 - RNA, 22 nt, Human
ugaggggagacagaguggacuc

SEQ ID NO: 1082699 - RNA, 22 nt, Human
aacuacucaacucugccauugu

SEQ ID NO: 1082700 - RNA, 22 nt, Human
uaaugagucauuccugaaugcu

SEQ ID NO: 1082701 - RNA, 22 nt, Human
ucuggaguguguguauucagcu

SEQ ID NO: 1082702 - RNA, 22 nt, Human
agcagccagagaaugaugcagu

SEQ ID NO: 1082703 - RNA, 22 nt, Human
ugggaagccuagcagacagcug

SEQ ID NO: 1082704 - RNA, 22 nt, Human
augcaguaaaauaggagguaau

SEQ ID NO: 1082705 - RNA, 22 nt, Human
cccacacaaaucauggggagaa

SEQ ID NO: 1082706 - RNA, 22 nt, Human
cagauaaaggcuuacuaguagu

SEQ ID NO: 1082707 - RNA, 22 nt, Human
ccugucugcagauaucucaggu

SEQ ID NO: 1082708 - RNA, 22 nt, Human
uguggcaguauaagagcuagaa

SEQ ID NO: 1082709 - RNA, 22 nt, Human
acccagagcugggcuuggcaaa

SEQ ID NO: 1082710 - RNA, 22 nt, Human
gugucaugggguuuguuauaca

SEQ ID NO: 1082711 - RNA, 22 nt, Human
ugggcagaauugugguaguuaa

SEQ ID NO: 1082712 - RNA, 22 nt, Human
acagcugggaacucacacagca

SEQ ID NO: 1082713 - RNA, 22 nt, Human
uuguggcagaccaugagucuaa

SEQ ID NO: 1082714 - RNA, 22 nt, Human
aaguggagagcccuggaggucu

SEQ ID NO: 1082715 - RNA, 22 nt, Human
ugaccaaaggugguuuauuugg

SEQ ID NO: 1082716 - RNA, 22 nt, Human
ccagggcaggggcuggaguuca

SEQ ID NO: 1082717 - RNA, 22 nt, Human
ccauggaacucaguaaauuaua

SEQ ID NO: 1082718 - RNA, 22 nt, Human
ucugccuguucaagucuucuag

SEQ ID NO: 1082719 - RNA, 22 nt, Human
cucugagagugcucagagggua

SEQ ID NO: 1082720 - RNA, 22 nt, Human
uggcugagagucauccugugug

SEQ ID NO: 1082721 - RNA, 22 nt, Human
ugcucugggcucaauggcagcu

SEQ ID NO: 1082722 - RNA, 22 nt, Human
ugaggcagggagaguggauaug

SEQ ID NO: 1082723 - RNA, 19 nt, Human
ugucuuaauuaacucagag

SEQ ID NO: 1082724 - RNA, 22 nt, Human
guuaaaagaacaacucggaggu

SEQ ID NO: 1082725 - RNA, 22 nt, Human
cugguucacaucuguuuaucug

SEQ ID NO: 1082726 - RNA, 22 nt, Human
aauaucagaauguaaugguccu

SEQ ID NO: 1082727 - RNA, 22 nt, Human
ugaauaaacuaugaggaggaau

SEQ ID NO: 1082728 - RNA, 22 nt, Human
uuuaauauuucuuuccugaagc

SEQ ID NO: 1082729 - RNA, 22 nt, Human
aagaucaaguguacuuuaugua

SEQ ID NO: 1082730 - RNA, 22 nt, Human
aggagagucuugagucacuggu

SEQ ID NO: 1082731 - RNA, 22 nt, Human
ugggacugagaauaugaugggg

SEQ ID NO: 1082732 - RNA, 22 nt, Human
uguucuggagauaagagguaga

SEQ ID NO: 1082733 - RNA, 22 nt, Human
aauguaaaguugggcacaaaug

SEQ ID NO: 1082734 - RNA, 22 nt, Human
cagcuggaucccugcagaacuu

SEQ ID NO: 1082735 - RNA, 22 nt, Human
acagugucuccugguacccagu

SEQ ID NO: 1082736 - RNA, 22 nt, Human
agagucugaggcagcugcagcc

SEQ ID NO: 1082737 - RNA, 22 nt, Human
aaagaagguagggcuggugacu

SEQ ID NO: 1082738 - RNA, 22 nt, Human
agaggaggccaggcccacaccu

SEQ ID NO: 1082739 - RNA, 22 nt, Human
gggcugccuuucuucugggagc

SEQ ID NO: 1082740 - RNA, 22 nt, Human
gauuucaaggauguuagaggug

SEQ ID NO: 1082741 - RNA, 19 nt, Human
ucccucccuguaaucucac

SEQ ID NO: 1082742 - RNA, 22 nt, Human
gugauugcccagcaccauuguu

SEQ ID NO: 1082743 - RNA, 22 nt, Human
acacccagcuuuugaaugcccu

SEQ ID NO: 1082744 - RNA, 22 nt, Human
uagggcugugucuccaggacca

SEQ ID NO: 1082745 - RNA, 22 nt, Human
uaauuuaauuccauggauucua

SEQ ID NO: 1082746 - RNA, 22 nt, Human
uucuucaaugugcccuguuuuc

SEQ ID NO: 1082747 - RNA, 22 nt, Human
uuggcagugucacuagggagcc

SEQ ID NO: 1082748 - RNA, 22 nt, Human
gugucauguagaaauugaugaa

SEQ ID NO: 1082749 - RNA, 22 nt, Human
aauaacagugccaugaaauuga

SEQ ID NO: 1082750 - RNA, 22 nt, Human
cugguccuccuugccuucagau

SEQ ID NO: 1082751 - RNA, 22 nt, Human
acagguggacacagcagcaguc

SEQ ID NO: 1082752 - RNA, 21 nt, Human
gaggccucagccucagcuccu

SEQ ID NO: 1082753 - RNA, 22 nt, Human
auccuugagccaaugacugauu

SEQ ID NO: 1082754 - RNA, 22 nt, Human
uuuccaaagcugaguugagcaa

SEQ ID NO: 1082755 - RNA, 22 nt, Human
ggagcagccgcgucucagggca

SEQ ID NO: 1082756 - RNA, 22 nt, Human
aggggccugguuggccucuguu

SEQ ID NO: 1082757 - RNA, 22 nt, Human
augugcaauuauuaagaagaga

SEQ ID NO: 1082758 - RNA, 22 nt, Human
uugauuuuuccagcuucuagag

SEQ ID NO: 1082759 - RNA, 22 nt, Human
augcugaagaguucaugauuau

SEQ ID NO: 1082760 - RNA, 22 nt, Human
cuggauuuuaucauuguaguuu

SEQ ID NO: 1082761 - RNA, 22 nt, Human
caaagcaagggcugaagacucc

SEQ ID NO: 1082762 - RNA, 22 nt, Human
aagcauuuuguuuuaagaauga

SEQ ID NO: 1082763 - RNA, 22 nt, Human
agcagaagaaagccacaugacu

SEQ ID NO: 1082764 - RNA, 22 nt, Human
aagagcugcccaaggugaacag

SEQ ID NO: 1082765 - RNA, 22 nt, Human
aacaugcugccuuucuacgagu

SEQ ID NO: 1082766 - RNA, 22 nt, Human
gagcagcugcagugcagacccu

SEQ ID NO: 1082767 - RNA, 22 nt, Human
ugagguggugcuaaucucugcu

SEQ ID NO: 1082768 - RNA, 22 nt, Human
cuuauaguaugauguugagaau

SEQ ID NO: 1082769 - RNA, 22 nt, Human
ugggaaagccagcagugucacc

SEQ ID NO: 1082770 - RNA, 22 nt, Human
uuacaacagacacauauucuaa

SEQ ID NO: 1082771 - RNA, 22 nt, Human
ugccaggcuaaguggaggacuu

SEQ ID NO: 1082772 - RNA, 20 nt, Human
acauguacuaaugaauacag

SEQ ID NO: 1082773 - RNA, 22 nt, Human
ucauauaaguuuaaaacuaucu

SEQ ID NO: 1082774 - RNA, 22 nt, Human
gggagccaugcuggucuucuuu

SEQ ID NO: 1082775 - RNA, 23 nt, Human
ugggccuggaaagccuuagagag

SEQ ID NO: 1082776 - RNA, 22 nt, Human
uguaggaagauauaaaauaucu

SEQ ID NO: 1082777 - RNA, 22 nt, Human
uagcuuguacugcaguagagaa

SEQ ID NO: 1082778 - RNA, 22 nt, Human
cauacauugaaggagaaaggaa

SEQ ID NO: 1082779 - RNA, 22 nt, Human
aggcagcauucaggggugauga

SEQ ID NO: 1082780 - RNA, 22 nt, Human
caaggccaagucucugugaaga

SEQ ID NO: 1082781 - RNA, 22 nt, Human
uuaaggagcacaguguauuaau

SEQ ID NO: 1082782 - RNA, 22 nt, Human
ccuggcagcuccguggccuucc

SEQ ID NO: 1082783 - RNA, 22 nt, Human
aggugcugaacuggugaggucu

SEQ ID NO: 1082784 - RNA, 22 nt, Human
aguaugaaccuggguucuggau

SEQ ID NO: 1082785 - RNA, 22 nt, Human
uugaggagucaggggcacggaa

SEQ ID NO: 1082786 - RNA, 22 nt, Human
cacaggcuuccaguccccagcu

SEQ ID NO: 1082787 - RNA, 22 nt, Human
cauugacaguucuuuaaguugc

SEQ ID NO: 1082788 - RNA, 22 nt, Human
ccugcagguuucccccggacgg

SEQ ID NO: 1082789 - RNA, 22 nt, Human
ucaaucauucuugccauuuauu

SEQ ID NO: 1082790 - RNA, 22 nt, Human
cauuuuaagaugaccugguuuc

SEQ ID NO: 1082791 - RNA, 22 nt, Human
uauucuugucuuuuccagaaau

SEQ ID NO: 1082792 - RNA, 22 nt, Human
ucacauaaauuuaccagaugau

SEQ ID NO: 1082793 - RNA, 22 nt, Human
aauagcacuuccugaacacauu

SEQ ID NO: 1082794 - RNA, 22 nt, Human
cauucacauucuucuuacuguu

SEQ ID NO: 1082795 - RNA, 21 nt, Human
ucacuagugccuucugucauu

SEQ ID NO: 1082796 - RNA, 22 nt, Human
agaggaugauuuuaaggacacu

SEQ ID NO: 1082797 - RNA, 22 nt, Human
ugaaagagugcaagucaaggag

SEQ ID NO: 1082798 - RNA, 22 nt, Human
cagugaguaaguagacagcuua

SEQ ID NO: 1082799 - RNA, 22 nt, Human
uuuaagugaugaaaugcagaua

SEQ ID NO: 1082800 - RNA, 22 nt, Human
guaacacagaaaugaaauucca

SEQ ID NO: 1082801 - RNA, 22 nt, Human
cagagccugccaccuuucuccc

SEQ ID NO: 1082802 - RNA, 23 nt, Human
acuuccaguugcuucagcauaug

SEQ ID NO: 1082803 - RNA, 22 nt, Human
uucugagaguuguaguguaucc

SEQ ID NO: 1082804 - RNA, 22 nt, Human
gaggugggagggcagucccuaa

SEQ ID NO: 1082805 - RNA, 22 nt, Human
aaaacagacagccaguguagag

SEQ ID NO: 1082806 - RNA, 22 nt, Human
cucugggcaaguaugauagaaa

SEQ ID NO: 1082807 - RNA, 22 nt, Human
gcagagaagaugcccaggcuuc

SEQ ID NO: 1082808 - RNA, 22 nt, Human
ggcaagagggcagauggagugc

SEQ ID NO: 1082809 - RNA, 22 nt, Human
ugaaaugauaucugauaacaaa

SEQ ID NO: 1082810 - RNA, 22 nt, Human
ugggaagggccgauggagccuc

SEQ ID NO: 1082811 - RNA, 22 nt, Human
auuauucaacacuugagaaauu

SEQ ID NO: 1082812 - RNA, 22 nt, Human
cuuucucugugugguaaagggc

SEQ ID NO: 1082813 - RNA, 22 nt, Human
auacuacaagguaugugcuaaa

SEQ ID NO: 1082814 - RNA, 22 nt, Human
ugccucuguggaaauggugguc

SEQ ID NO: 1082815 - RNA, 22 nt, Human
uauugacaauaggcaacugagg

SEQ ID NO: 1082816 - RNA, 22 nt, Human
cuguauaugugcauacacacac

SEQ ID NO: 1082817 - RNA, 22 nt, Human
aacagaaaagguagguggcuuu

SEQ ID NO: 1082818 - RNA, 22 nt, Human
aguucagcuucccaggucacug

SEQ ID NO: 1082819 - RNA, 22 nt, Human
cuuauucagauacagacucuug

SEQ ID NO: 1082820 - RNA, 22 nt, Human
uaggugucugcucuuauuuaac

SEQ ID NO: 1082821 - RNA, 22 nt, Human
gcucucugcagccuccuuggag

SEQ ID NO: 1082822 - RNA, 22 nt, Human
cuugaaagucagcagaguggau

SEQ ID NO: 1082823 - RNA, 22 nt, Human
ucaggcugaaaggacuccaguu

SEQ ID NO: 1082824 - RNA, 22 nt, Human
uggagcugaacuuugaggccag

SEQ ID NO: 1082825 - RNA, 22 nt, Human
guguaugagccuccagcugggc

SEQ ID NO: 1082826 - RNA, 22 nt, Human
ugucaccaguuccaggaaauaa

SEQ ID NO: 1082827 - RNA, 22 nt, Human
cugcggcucugcgggcagcugg

SEQ ID NO: 1082828 - RNA, 22 nt, Human
agaguggcuugcucagcuagca

SEQ ID NO: 1082829 - RNA, 22 nt, Human
cccagggcccuggacagcuaca

SEQ ID NO: 1082830 - RNA, 22 nt, Human
ugguugugcacggagcugcagg

SEQ ID NO: 1082831 - RNA, 22 nt, Human
aaaucaguucacguucugaggu

SEQ ID NO: 1082832 - RNA, 22 nt, Human
uucaaagauuuucccaaagcuc

SEQ ID NO: 1082833 - RNA, 22 nt, Human
cauaugaaauaugaguugaaca

SEQ ID NO: 1082834 - RNA, 22 nt, Human
cuucagugauugcagaaagccu

SEQ ID NO: 1082835 - RNA, 22 nt, Human
gguggggcccaggcaucugaug

SEQ ID NO: 1082836 - RNA, 22 nt, Human
uauuacugagguuuuauggagu

SEQ ID NO: 1082837 - RNA, 21 nt, Human
cucuggaggcaagggagagug

SEQ ID NO: 1082838 - RNA, 22 nt, Human
cggcagagcccugagucagccu

SEQ ID NO: 1082839 - RNA, 20 nt, Human
uucacagaggacucagguca

SEQ ID NO: 1082840 - RNA, 19 nt, Human
aaauucugacagucuuuua

SEQ ID NO: 1082841 - RNA, 22 nt, Human
uacaaaguagaaauucaguaaa

SEQ ID NO: 1082842 - RNA, 22 nt, Human
uuuuggcucuugguaggucaga

SEQ ID NO: 1082843 - RNA, 22 nt, Human
ggagugggaacaaugacauggu

SEQ ID NO: 1082844 - RNA, 22 nt, Human
gcagaggagcaagcuggacacc

SEQ ID NO: 1082845 - RNA, 23 nt, Human
cccagcagagaugaggagggguc

SEQ ID NO: 1082846 - RNA, 22 nt, Human
cagagccucagaauccugugga

SEQ ID NO: 1082847 - RNA, 18 nt, Human
gacacauccccaggccuc

SEQ ID NO: 1082848 - RNA, 22 nt, Human
ucaggaagugguaaaggauguu

SEQ ID NO: 1082849 - RNA, 22 nt, Human
gucaaauaauuuucucaauagu

SEQ ID NO: 1082850 - RNA, 22 nt, Human
aacaaucaaguuucuaaaugac

SEQ ID NO: 1082851 - RNA, 22 nt, Human
uguaucaaaccaaauuaauucu

SEQ ID NO: 1082852 - RNA, 22 nt, Human
acauauguauauguacacaguc

SEQ ID NO: 1082853 - RNA, 22 nt, Human
agcugcaguaaagcucuccagg

SEQ ID NO: 1082854 - RNA, 22 nt, Human
ccugucuguaucgguucagagu

SEQ ID NO: 1082855 - RNA, 22 nt, Human
ugccaggcugucaauucaccca

SEQ ID NO: 1082856 - RNA, 22 nt, Human
gcuccuggcaggcagugugugu

SEQ ID NO: 1082857 - RNA, 22 nt, Human
agucuuuccugcuugacuguuc

SEQ ID NO: 1082858 - RNA, 22 nt, Human
ucugcuguaaagaauuucugcc

SEQ ID NO: 1082859 - RNA, 22 nt, Human
uguuuucuguguagagaucaca

SEQ ID NO: 1082860 - RNA, 22 nt, Human
cccaggaggccaagguugcagu

SEQ ID NO: 1082861 - RNA, 22 nt, Human
agcagggcucuguggagggugg

SEQ ID NO: 1082862 - RNA, 22 nt, Human
cacugcucgcugcagcauggcc

SEQ ID NO: 1082863 - RNA, 22 nt, Human
caguagcaggcacucagcacgu

SEQ ID NO: 1082864 - RNA, 22 nt, Human
uccugggcuugcuccuccagcu

SEQ ID NO: 1082865 - RNA, 22 nt, Human
aguguaucaugguuggcagaca

SEQ ID NO: 1082866 - RNA, 22 nt, Human
gaaagacuaacuagaaagugca

SEQ ID NO: 1082867 - RNA, 22 nt, Human
gagcuggaagucuguggucaga

SEQ ID NO: 1082868 - RNA, 22 nt, Human
gggcugcugcccaggaggcacc

SEQ ID NO: 1082869 - RNA, 22 nt, Human
ccugcaggggagagacuucuag

SEQ ID NO: 1082870 - RNA, 22 nt, Human
ccagcugguuaaaauagagaaa

SEQ ID NO: 1082871 - RNA, 22 nt, Human
agagccuggucugagauaggac

SEQ ID NO: 1082872 - RNA, 22 nt, Human
uuugacagauccuuaacucagc

SEQ ID NO: 1082873 - RNA, 22 nt, Human
ggcugggcugcugggucagagc

SEQ ID NO: 1082874 - RNA, 22 nt, Human
uucaggaaauuugugucacagg

SEQ ID NO: 1082875 - RNA, 22 nt, Human
ucccacaugugaauccucaggu

SEQ ID NO: 1082876 - RNA, 22 nt, Human
guccucuguguaggcugcagac

SEQ ID NO: 1082877 - RNA, 22 nt, Human
ggcagucuuaucagcauuggac

SEQ ID NO: 1082878 - RNA, 22 nt, Human
aguguguguuugggcgguuuau

SEQ ID NO: 1082879 - RNA, 22 nt, Human
uggagcaggccggaaguggcuu

SEQ ID NO: 1082880 - RNA, 22 nt, Human
acagaugguacuaaacccauau

SEQ ID NO: 1082881 - RNA, 22 nt, Human
cccuggaguagcacugggucgc

SEQ ID NO: 1082882 - RNA, 22 nt, Human
cuggagcucuguguguuccuga

SEQ ID NO: 1082883 - RNA, 22 nt, Human
guuugaaaaaagcaguauguaa

SEQ ID NO: 1082884 - RNA, 22 nt, Human
uucuucucucauagauuaaggu

SEQ ID NO: 1082885 - RNA, 22 nt, Human
agaggcaggagguugacuugag

SEQ ID NO: 1082886 - RNA, 22 nt, Human
auaguacacauccuacaauguu

SEQ ID NO: 1082887 - RNA, 22 nt, Human
gagcuuugcuggaagccugggg

SEQ ID NO: 1082888 - RNA, 22 nt, Human
cacagagagcuacgugcagcgu

SEQ ID NO: 1082889 - RNA, 22 nt, Human
acaaauuauagaaaauugagcu

SEQ ID NO: 1082890 - RNA, 22 nt, Human
uggugagagcagaccuucuuuu

SEQ ID NO: 1082891 - RNA, 22 nt, Human
gaaaucauuauaugguauugcu

SEQ ID NO: 1082892 - RNA, 19 nt, Human
ggcucucccuugagagagc

SEQ ID NO: 1082893 - RNA, 23 nt, Human
ucacagggcacuggcugggguug

SEQ ID NO: 1082894 - RNA, 22 nt, Human
uggagcuggaauuugagcugga

SEQ ID NO: 1082895 - RNA, 22 nt, Human
agggucugacuccucuggcaag

SEQ ID NO: 1082896 - RNA, 22 nt, Human
agaucuuuugguuauuauaaga

SEQ ID NO: 1082897 - RNA, 22 nt, Human
uugguuuagagagugugguuac

SEQ ID NO: 1082898 - RNA, 22 nt, Human
aaauauaauuucugccucaaua

SEQ ID NO: 1082899 - RNA, 22 nt, Human
uggcucaggauaauuuucccaa

SEQ ID NO: 1082900 - RNA, 22 nt, Human
uggcugagcugcagcguggcuu

SEQ ID NO: 1082901 - RNA, 21 nt, Human
cucugcugucuaccagcuguu

SEQ ID NO: 1082902 - RNA, 23 nt, Human
agcagccagagauccucggcccu

SEQ ID NO: 1082903 - RNA, 22 nt, Human
agccaggaagagaggccucacc

SEQ ID NO: 1082904 - RNA, 22 nt, Human
agugccuugugugugggcagcc

SEQ ID NO: 1082905 - RNA, 22 nt, Human
agaggggacagccaccugcccg

SEQ ID NO: 1082906 - RNA, 22 nt, Human
ggaccaggggcgcacucccugc

SEQ ID NO: 1082907 - RNA, 22 nt, Human
acuugaaaccuuggcaaacaau

SEQ ID NO: 1082908 - RNA, 19 nt, Human
uggagcagggcccuuguuu

SEQ ID NO: 1082909 - RNA, 22 nt, Human
agaggccggccgagcccauggg

SEQ ID NO: 1082910 - RNA, 22 nt, Human
aaacaucuaucagcauuuuuua

SEQ ID NO: 1082911 - RNA, 22 nt, Human
agcagggccuggcacuccuggg

SEQ ID NO: 1082912 - RNA, 22 nt, Human
ugaugaaaguucaguagugaau

SEQ ID NO: 1082913 - RNA, 21 nt, Human
uggcucuguucaauauaugga

SEQ ID NO: 1082914 - RNA, 22 nt, Human
ugaagcaggguggccagauugu

SEQ ID NO: 1082915 - RNA, 22 nt, Human
gaaaucugaacucuguauccuu

SEQ ID NO: 1082916 - RNA, 22 nt, Human
gaagccacccuccuuccagccc

SEQ ID NO: 1082917 - RNA, 22 nt, Human
cauguuuucuaggcuuucacaa

SEQ ID NO: 1082918 - RNA, 22 nt, Human
acagcuaggaaauggaagaacu

SEQ ID NO: 1082919 - RNA, 22 nt, Human
gaaauguguuguucauuucuaa

SEQ ID NO: 1082920 - RNA, 22 nt, Human
gaggcucagagggagcaugguc

SEQ ID NO: 1082921 - RNA, 22 nt, Human
gaacuuuaaucccuugggcuua

SEQ ID NO: 1082922 - RNA, 22 nt, Human
gcugaggaggugugguuaggug

SEQ ID NO: 1082923 - RNA, 22 nt, Human
agcgagguuuguucuauucagu

SEQ ID NO: 1082924 - RNA, 22 nt, Human
uaaaacuucucauuuuuauggu

SEQ ID NO: 1082925 - RNA, 22 nt, Human
gauuaguauccuuauuaagaga

SEQ ID NO: 1082926 - RNA, 22 nt, Human
auguacaguggaaacuaacaaa

SEQ ID NO: 1082927 - RNA, 22 nt, Human
ccagcugaggcagccacacagg

SEQ ID NO: 1082928 - RNA, 22 nt, Human
uccuguguuacugccuggagcg

SEQ ID NO: 1082929 - RNA, 22 nt, Human
uuuguucacugauguaucccaa

SEQ ID NO: 1082930 - RNA, 22 nt, Human
auuugcuuucagguauaaaagg

SEQ ID NO: 1082931 - RNA, 22 nt, Human
ccagcucuuggugcacuuacau

SEQ ID NO: 1082932 - RNA, 22 nt, Human
uugcccugccucccugagguga

SEQ ID NO: 1082933 - RNA, 22 nt, Human
ucuucagcucugaggcucuggc

SEQ ID NO: 1082934 - RNA, 22 nt, Human
aaaaucugcuuccuuuuacaga

SEQ ID NO: 1082935 - RNA, 22 nt, Human
gcagaaagcuuagaggguuugc

SEQ ID NO: 1082936 - RNA, 22 nt, Human
aggcugcucugcgaagucagcu

SEQ ID NO: 1082937 - RNA, 22 nt, Human
uaaagucagagauccuuggcuu

SEQ ID NO: 1082938 - RNA, 22 nt, Human
gcugcuggagcuuugcagaagg

SEQ ID NO: 1082939 - RNA, 22 nt, Human
cagcaggucccacugagggccc

SEQ ID NO: 1082940 - RNA, 22 nt, Human
gcucccagggcagcgcagaaga

SEQ ID NO: 1082941 - RNA, 22 nt, Human
cuugcucacaguaccuggcuug

SEQ ID NO: 1082942 - RNA, 22 nt, Human
cugggagggguagccaauccua

SEQ ID NO: 1082943 - RNA, 19 nt, Human
agcuccaggccuggaugcu

SEQ ID NO: 1082944 - RNA, 22 nt, Human
auagauguuuuaguaauacugu

SEQ ID NO: 1082945 - RNA, 22 nt, Human
cagagccagcuguccuuggcau

SEQ ID NO: 1082946 - RNA, 22 nt, Human
aaagagcauggaaaguucagga

SEQ ID NO: 1082947 - RNA, 22 nt, Human
gcucugucauuuugcagacacu

SEQ ID NO: 1082948 - RNA, 22 nt, Human
aaggaguuuggguagucauaca

SEQ ID NO: 1082949 - RNA, 22 nt, Human
gcccaugguuacuuuucuggcu

SEQ ID NO: 1082950 - RNA, 22 nt, Human
auuuugaugcuaucuaaugaau

SEQ ID NO: 1082951 - RNA, 22 nt, Human
aggcugaggcuuuccuuggaga

SEQ ID NO: 1082952 - RNA, 22 nt, Human
gggcuggcaucgguugcugaga

SEQ ID NO: 1082953 - RNA, 22 nt, Human
ccuugaaauguucucacugggg

SEQ ID NO: 1082954 - RNA, 22 nt, Human
cuggggaccagugucuguuugu

SEQ ID NO: 1082955 - RNA, 22 nt, Human
auauguuuuuggaaagaacaca

SEQ ID NO: 1082956 - RNA, 22 nt, Human
caacuuuagaccccaaguagcu

SEQ ID NO: 1082957 - RNA, 22 nt, Human
aucacauucuuucaaagcaguc

SEQ ID NO: 1082958 - RNA, 22 nt, Human
cuucagugacagccacccaggc

SEQ ID NO: 1082959 - RNA, 22 nt, Human
ucccaagauuagguuggaaagg

SEQ ID NO: 1082960 - RNA, 22 nt, Human
uuccucuuuagggcuggccagg

SEQ ID NO: 1082961 - RNA, 22 nt, Human
gucacuuuggccucuacagcca

SEQ ID NO: 1082962 - RNA, 22 nt, Human
agcagcaauuuucacugucaau

SEQ ID NO: 1082963 - RNA, 22 nt, Human
gaaugcuaagcaugugggaguu

SEQ ID NO: 1082964 - RNA, 22 nt, Human
cagaggccccagaacuagcucu

SEQ ID NO: 1082965 - RNA, 22 nt, Human
uucaacaacuugguucaaaugg

SEQ ID NO: 1082966 - RNA, 23 nt, Human
uggggcucuggcaggccugaggu

SEQ ID NO: 1082967 - RNA, 22 nt, Human
uuucacaauuuuaaggagcaaa

SEQ ID NO: 1082968 - RNA, 22 nt, Human
uggcaaauauuuuguuuuguaa

SEQ ID NO: 1082969 - RNA, 22 nt, Human
gcauuuuaauaagauucauagg

SEQ ID NO: 1082970 - RNA, 22 nt, Human
uguccugggaaugggaugcagu

SEQ ID NO: 1082971 - RNA, 22 nt, Human
gcacacagauuaggaaacagaa

SEQ ID NO: 1082972 - RNA, 22 nt, Human
aggcugugacagggucauggag

SEQ ID NO: 1082973 - RNA, 22 nt, Human
uccuugaaugaauguucucucc

SEQ ID NO: 1082974 - RNA, 22 nt, Human
cugcaguguucuggaaugcauu

SEQ ID NO: 1082975 - RNA, 22 nt, Human
ucucacugauuugagaccaagg

SEQ ID NO: 1082976 - RNA, 22 nt, Human
uauccaaaguggcauauuauag

SEQ ID NO: 1082977 - RNA, 22 nt, Human
ggaagggccucgggcgugggac

SEQ ID NO: 1082978 - RNA, 22 nt, Human
uacagagauuuauugcuaaggc

SEQ ID NO: 1082979 - RNA, 22 nt, Human
agcagaugagccucaugacugg

SEQ ID NO: 1082980 - RNA, 22 nt, Human
ggaagccaggcugggggaucug

SEQ ID NO: 1082981 - RNA, 21 nt, Human
gccagggaagagaguuggcug

SEQ ID NO: 1082982 - RNA, 20 nt, Human
ucugggcagggcacauggaa

SEQ ID NO: 1082983 - RNA, 22 nt, Human
ccuggauucaagucuuucuuuc

SEQ ID NO: 1082984 - RNA, 22 nt, Human
aaacagaaauuuccucaugcuc

SEQ ID NO: 1082985 - RNA, 22 nt, Human
uaggagcuaaaauauuuuauau

SEQ ID NO: 1082986 - RNA, 22 nt, Human
gcucacagccggcuggcagggg

SEQ ID NO: 1082987 - RNA, 22 nt, Human
gagggcagagacagugauucac

SEQ ID NO: 1082988 - RNA, 19 nt, Human
aggcugcaagguggugggc

SEQ ID NO: 1082989 - RNA, 22 nt, Human
cacagcuucuccuugauaucgc

SEQ ID NO: 1082990 - RNA, 22 nt, Human
ggccuucacgugaccuggcgug

SEQ ID NO: 1082991 - RNA, 22 nt, Human
ugaggaagggugugacggcacc

SEQ ID NO: 1082992 - RNA, 22 nt, Human
aaauagagcuggguuaaacuuu

SEQ ID NO: 1082993 - RNA, 22 nt, Human
gagauggagucuuuuucuguca

SEQ ID NO: 1082994 - RNA, 22 nt, Human
uugaagcagagaaauacuugaa

SEQ ID NO: 1082995 - RNA, 22 nt, Human
acuguucugccaagaucaacgu

SEQ ID NO: 1082996 - RNA, 22 nt, Human
ggaggccaguccuggccgggcu

SEQ ID NO: 1082997 - RNA, 22 nt, Human
auguuugaaauuguaaguauau

SEQ ID NO: 1082998 - RNA, 22 nt, Human
ucucagaguuuuuuuccaggac

SEQ ID NO: 1082999 - RNA, 22 nt, Human
ugaucugguccuacugugggca

SEQ ID NO: 1083000 - RNA, 22 nt, Human
gauauuuucgcagggagaauuc

SEQ ID NO: 1083001 - RNA, 22 nt, Human
agcaaggaaaguaggcacggaa

SEQ ID NO: 1083002 - RNA, 22 nt, Human
gaggagcucugcuccauccuuc

SEQ ID NO: 1083003 - RNA, 22 nt, Human
gcuggcauuacaggagagaacc

SEQ ID NO: 1083004 - RNA, 23 nt, Human
ugcaggcuaggaagagagccuuc

SEQ ID NO: 1083005 - RNA, 22 nt, Human
acaguguauaaaaucuuaaaga

SEQ ID NO: 1083006 - RNA, 22 nt, Human
uuuuauaagcaagaaagggaaa

SEQ ID NO: 1083007 - RNA, 22 nt, Human
uggccaggccucuuggugccca

SEQ ID NO: 1083008 - RNA, 22 nt, Human
ugggaggaucucuugaggccag

SEQ ID NO: 1083009 - RNA, 22 nt, Human
ggaggaggggcgcuuugucuau

SEQ ID NO: 1083010 - RNA, 22 nt, Human
gcccaugcacuuucugugaugg

SEQ ID NO: 1083011 - RNA, 22 nt, Human
ggaaaacagcgauugguaucau

SEQ ID NO: 1083012 - RNA, 22 nt, Human
uugauuuauagaauguucaagc

SEQ ID NO: 1083013 - RNA, 22 nt, Human
gguuugcauucugaaaggcuca

SEQ ID NO: 1083014 - RNA, 22 nt, Human
gauauuuuuaguauuucugccu

SEQ ID NO: 1083015 - RNA, 22 nt, Human
ccagggaguuuccaaucugaga

SEQ ID NO: 1083016 - RNA, 22 nt, Human
cacacacuguuaauguaggagu

SEQ ID NO: 1083017 - RNA, 22 nt, Human
gucggccacgcaggugcgguag

SEQ ID NO: 1083018 - RNA, 22 nt, Human
uugcaaaagccgaggcacucca

SEQ ID NO: 1083019 - RNA, 20 nt, Human
uuguuagaggaaugccauag

SEQ ID NO: 1083020 - RNA, 22 nt, Human
gaggcucaccuagggagcacug

SEQ ID NO: 1083021 - RNA, 23 nt, Human
ccugugugcccuuaauucacagc

SEQ ID NO: 1083022 - RNA, 22 nt, Human
uccucuggauauaagccucacc

SEQ ID NO: 1083023 - RNA, 22 nt, Human
agaauuuuugcaguuuagccau

SEQ ID NO: 1083024 - RNA, 22 nt, Human
gaugauuuucuguguuagaaga

SEQ ID NO: 1083025 - RNA, 22 nt, Human
gcagcuuuguggagaggcccau

SEQ ID NO: 1083026 - RNA, 22 nt, Human
gaaguuaguguggaugcaggga

SEQ ID NO: 1083027 - RNA, 22 nt, Human
ggcagguguuuuuauauuaaag

SEQ ID NO: 1083028 - RNA, 22 nt, Human
uaguauuuccuguaagcuauag

SEQ ID NO: 1083029 - RNA, 22 nt, Human
gccaggcaaauuaaggaaugca

SEQ ID NO: 1083030 - RNA, 22 nt, Human
aaaggucaaaaucgugacauug

SEQ ID NO: 1083031 - RNA, 22 nt, Human
ugagaguauuuuggcauuauca

SEQ ID NO: 1083032 - RNA, 22 nt, Human
ccucuugccaaucagcuacaga

SEQ ID NO: 1083033 - RNA, 22 nt, Human
uagcuagaaagugaagaucaca

SEQ ID NO: 1083034 - RNA, 22 nt, Human
ccuucccuaaagcgucgcuuag

SEQ ID NO: 1083035 - RNA, 22 nt, Human
gagggccaacuagcaccacuuu

SEQ ID NO: 1083036 - RNA, 22 nt, Human
agcucagcgggcuucugguaag

SEQ ID NO: 1083037 - RNA, 22 nt, Human
cagggagaggcaucauagggaa

SEQ ID NO: 1083038 - RNA, 22 nt, Human
caucugcugacuugacaaguac

SEQ ID NO: 1083039 - RNA, 22 nt, Human
cuggugguucaggagaauggcu

SEQ ID NO: 1083040 - RNA, 23 nt, Human
uguggccugcagcucugguuugg

SEQ ID NO: 1083041 - RNA, 22 nt, Human
ugcagcagcagggaggaggcuc

SEQ ID NO: 1083042 - RNA, 22 nt, Human
agcccuggcccggcugugcuuu

SEQ ID NO: 1083043 - RNA, 22 nt, Human
guuaauaaagguauagaaucag

SEQ ID NO: 1083044 - RNA, 21 nt, Human
ggugggcacaggagagcagag

SEQ ID NO: 1083045 - RNA, 19 nt, Human
ggcaggcuggauagagagg

SEQ ID NO: 1083046 - RNA, 22 nt, Human
gagcugccaagauuacaaucag

SEQ ID NO: 1083047 - RNA, 22 nt, Human
ucuucaauauguguuuaauauu

SEQ ID NO: 1083048 - RNA, 17 nt, Human
ucuucucuuccagucuu

SEQ ID NO: 1083049 - RNA, 22 nt, Human
uccucuucugcccaucagaggc

SEQ ID NO: 1083050 - RNA, 22 nt, Human
ucagccagguaauguggagaug

SEQ ID NO: 1083051 - RNA, 22 nt, Human
uuggcagugaugcagcuuguuc

SEQ ID NO: 1083052 - RNA, 22 nt, Human
guggcccaggcuuggcgcuggc

SEQ ID NO: 1083053 - RNA, 22 nt, Human
aagguuucgggagcgggucugg

SEQ ID NO: 1083054 - RNA, 22 nt, Human
ccacuuucugagggaacagcag

SEQ ID NO: 1083055 - RNA, 22 nt, Human
augcaguaaauguucuaguuug

SEQ ID NO: 1083056 - RNA, 22 nt, Human
cugccugugccaccgccucauu

SEQ ID NO: 1083057 - RNA, 22 nt, Human
uaacugaacagccuaauucuuu

SEQ ID NO: 1083058 - RNA, 22 nt, Human
gcaccaggaggcccuucucauc

SEQ ID NO: 1083059 - RNA, 22 nt, Human
ccuccuggugggcgcuucuggc

SEQ ID NO: 1083060 - RNA, 22 nt, Human
aaacaucuucucuugauucuuu

SEQ ID NO: 1083061 - RNA, 22 nt, Human
cacuggggaaaacaggcuucuu

SEQ ID NO: 1083062 - RNA, 22 nt, Human
uggcuaacaguuaagauuucau

SEQ ID NO: 1083063 - RNA, 22 nt, Human
uagauuaucccugauuugucca

SEQ ID NO: 1083064 - RNA, 22 nt, Human
cuggcagcccaaccuagagucu

SEQ ID NO: 1083065 - RNA, 22 nt, Human
augggcagagcuggugggaggc

SEQ ID NO: 1083066 - RNA, 22 nt, Human
ucucuuguaauuuaaaaaaucu

SEQ ID NO: 1083067 - RNA, 22 nt, Human
auacauacauguacacauaaau

SEQ ID NO: 1083068 - RNA, 22 nt, Human
uccaggcccgagaugggcugga

SEQ ID NO: 1083069 - RNA, 22 nt, Human
cagcuguugugauuuccaggag

SEQ ID NO: 1083070 - RNA, 22 nt, Human
guccagugucuucuacauaaca

SEQ ID NO: 1083071 - RNA, 22 nt, Human
uccuggagccacggagcuuuca

SEQ ID NO: 1083072 - RNA, 22 nt, Human
cagggacaauggcagagccuga

SEQ ID NO: 1083073 - RNA, 21 nt, Human
ucuuuucucagcuuugugguu

SEQ ID NO: 1083074 - RNA, 22 nt, Human
gcuccagcucguggcucccagc

SEQ ID NO: 1083075 - RNA, 22 nt, Human
uaugacaagaaauacagaggua

SEQ ID NO: 1083076 - RNA, 22 nt, Human
uuugugaauaagagaaugacag

SEQ ID NO: 1083077 - RNA, 22 nt, Human
agcugccaggccccugagaacc

SEQ ID NO: 1083078 - RNA, 22 nt, Human
aaacauuguaauuuuagcaugg

SEQ ID NO: 1083079 - RNA, 22 nt, Human
auaaaacuuauuagaauugugu

SEQ ID NO: 1083080 - RNA, 22 nt, Human
aagaaagcauuagacaggcauu

SEQ ID NO: 1083081 - RNA, 22 nt, Human
aucagcugaaaaacaggcagca

SEQ ID NO: 1083082 - RNA, 22 nt, Human
ugugcaggugcaggaagggggc

SEQ ID NO: 1083083 - RNA, 22 nt, Human
ucagaauugucuggggaauguu

SEQ ID NO: 1083084 - RNA, 22 nt, Human
uggccucuuacgacauagccuu

SEQ ID NO: 1083085 - RNA, 22 nt, Human
agaacuuuuggagacuuuuagu

SEQ ID NO: 1083086 - RNA, 22 nt, Human
aagccaggcaugcuuggacagu

SEQ ID NO: 1083087 - RNA, 22 nt, Human
gaggaacaagcugcuuuaucuu

SEQ ID NO: 1083088 - RNA, 22 nt, Human
gaggccacagcuaucagggaca

SEQ ID NO: 1083089 - RNA, 17 nt, Human
gggcagggacuccuggg

SEQ ID NO: 1083090 - RNA, 22 nt, Human
uaacaagucauuuuaucagcag

SEQ ID NO: 1083091 - RNA, 22 nt, Human
uauggaaauaauuagacaagug

SEQ ID NO: 1083092 - RNA, 22 nt, Human
uggagcuggaagacagugauau

SEQ ID NO: 1083093 - RNA, 22 nt, Human
aagugaaauugccauucuuaua

SEQ ID NO: 1083094 - RNA, 22 nt, Human
agaaaucauucccaaacccaua

SEQ ID NO: 1083095 - RNA, 22 nt, Human
aucugcuuagaauucauugucc

SEQ ID NO: 1083096 - RNA, 22 nt, Human
aggcaguguguagcuggaagag

SEQ ID NO: 1083097 - RNA, 19 nt, Human
uggaccugugcccauggcu

SEQ ID NO: 1083098 - RNA, 22 nt, Human
aaagugacaaccauuuauuaag

SEQ ID NO: 1083099 - RNA, 22 nt, Human
gcuguucuguccccauggguaa

SEQ ID NO: 1083100 - RNA, 22 nt, Human
aaggaagacuugagaagguucc

SEQ ID NO: 1083101 - RNA, 23 nt, Human
ucuccuggcugcacuguggccac

SEQ ID NO: 1083102 - RNA, 22 nt, Human
cagagcugucauuugccaguga

SEQ ID NO: 1083103 - RNA, 22 nt, Human
aucauaaaccacuuuguaaucu

SEQ ID NO: 1083104 - RNA, 22 nt, Human
ucauauuuugcaaggucagcua

SEQ ID NO: 1083105 - RNA, 22 nt, Human
uagggcaggugaagaaaagcua

SEQ ID NO: 1083106 - RNA, 22 nt, Human
aguggugccggguggguuuugc

SEQ ID NO: 1083107 - RNA, 22 nt, Human
ugcagggcaucuuugaagugug

SEQ ID NO: 1083108 - RNA, 22 nt, Human
ccagggggcuuggugaggccau

SEQ ID NO: 1083109 - RNA, 22 nt, Human
uagagcauuuagaggggcagga

SEQ ID NO: 1083110 - RNA, 22 nt, Human
gcagguggugggggagccguuc

SEQ ID NO: 1083111 - RNA, 22 nt, Human
ccaguuuugccaugguaacacu

SEQ ID NO: 1083112 - RNA, 22 nt, Human
uacagugucccuuuuucagaca

SEQ ID NO: 1083113 - RNA, 22 nt, Human
gcugagagcggccagcugggaa

SEQ ID NO: 1083114 - RNA, 19 nt, Human
cagauggccaccuacuugc

SEQ ID NO: 1083115 - RNA, 22 nt, Human
gaggaaaaugcaacaggaaugc

SEQ ID NO: 1083116 - RNA, 22 nt, Human
uucuucuccgaggagggcuggu

SEQ ID NO: 1083117 - RNA, 22 nt, Human
guucuggaggagagccuggugu

SEQ ID NO: 1083118 - RNA, 22 nt, Human
gcccucagcuccuggacacaug

SEQ ID NO: 1083119 - RNA, 22 nt, Human
uacauagcaaggaaaugacaga

SEQ ID NO: 1083120 - RNA, 22 nt, Human
aggaugugaguggacacagucc

SEQ ID NO: 1083121 - RNA, 22 nt, Human
caggggcuuaagugacagaagg

SEQ ID NO: 1083122 - RNA, 22 nt, Human
acccugagucagacagccugac

SEQ ID NO: 1083123 - RNA, 22 nt, Human
uccaaauucuauguucuuucca

SEQ ID NO: 1083124 - RNA, 23 nt, Human
ccagccucugggucuucauccag

SEQ ID NO: 1083125 - RNA, 22 nt, Human
cacagcauaaugaaauauacuu

SEQ ID NO: 1083126 - RNA, 22 nt, Human
uggcucuggauuaaucuaggaa

SEQ ID NO: 1083127 - RNA, 22 nt, Human
ucaauucuaguggagagaguuu

SEQ ID NO: 1083128 - RNA, 19 nt, Human
ugucucugaaagaugagcu

SEQ ID NO: 1083129 - RNA, 22 nt, Human
uuuacugagugaccuagaauaa

SEQ ID NO: 1083130 - RNA, 22 nt, Human
aaucaggaugacugucauuuca

SEQ ID NO: 1083131 - RNA, 22 nt, Human
uuugcaaugugaaauuaaagaa

SEQ ID NO: 1083132 - RNA, 22 nt, Human
ggauggcagucugcaugagaaa

SEQ ID NO: 1083133 - RNA, 22 nt, Human
cagcauugaucccaggcugugg

SEQ ID NO: 1083134 - RNA, 22 nt, Human
auuacauauguuggcaacauuu

SEQ ID NO: 1083135 - RNA, 21 nt, Human
caugaagccgguucccuguuu

SEQ ID NO: 1083136 - RNA, 22 nt, Human
ucucuucuauuugagacuauuu

SEQ ID NO: 1083137 - RNA, 22 nt, Human
uugcccuagggucuuauccucc

SEQ ID NO: 1083138 - RNA, 22 nt, Human
ugaggcaguugagcuuccugag

SEQ ID NO: 1083139 - RNA, 22 nt, Human
ugccucauuaacuguccuuaau

SEQ ID NO: 1083140 - RNA, 22 nt, Human
gcugggagccguaccugucacg

SEQ ID NO: 1083141 - RNA, 22 nt, Human
uucuuuuacauuaagauuucag

SEQ ID NO: 1083142 - RNA, 22 nt, Human
caguaggaaggaugcagaaaaa

SEQ ID NO: 1083143 - RNA, 22 nt, Human
ccuuuaggagugaggaccgagc

SEQ ID NO: 1083144 - RNA, 22 nt, Human
ucuucucucauguaggagggaa

SEQ ID NO: 1083145 - RNA, 22 nt, Human
ggguacuuaauauuuacggggu

SEQ ID NO: 1083146 - RNA, 22 nt, Human
aaaagcagaucuccaaagucua

SEQ ID NO: 1083147 - RNA, 19 nt, Human
uauuauuuguagcaaggcc

SEQ ID NO: 1083148 - RNA, 22 nt, Human
aaugauguauuaguacaacaca

SEQ ID NO: 1083149 - RNA, 22 nt, Human
ugccuuuuguaugcaggccaug

SEQ ID NO: 1083150 - RNA, 22 nt, Human
gcugccuguugaagggucugug

SEQ ID NO: 1083151 - RNA, 22 nt, Human
uuucucacccaagaguuauuuu

SEQ ID NO: 1083152 - RNA, 22 nt, Human
uucugaaaccuucaguaugaag

SEQ ID NO: 1083153 - RNA, 22 nt, Human
augaaagaugauuuaaaguacu

SEQ ID NO: 1083154 - RNA, 22 nt, Human
aguaaaauuguauuggaaaaca

SEQ ID NO: 1083155 - RNA, 22 nt, Human
agggccagcugcagaauuagca

SEQ ID NO: 1083156 - RNA, 22 nt, Human
aggcuggcuuugguagcauggu

SEQ ID NO: 1083157 - RNA, 20 nt, Human
aggagaugauccagagucag

SEQ ID NO: 1083158 - RNA, 22 nt, Human
ucaggugggaguagaaugcuag

SEQ ID NO: 1083159 - RNA, 22 nt, Human
ggugaggaaagauggugacagu

SEQ ID NO: 1083160 - RNA, 22 nt, Human
cauuuggauuuugaagagagua

SEQ ID NO: 1083161 - RNA, 22 nt, Human
uuuuuugucuugaagaaauggu

SEQ ID NO: 1083162 - RNA, 22 nt, Human
augggaggcagcagagcccagc

SEQ ID NO: 1083163 - RNA, 22 nt, Human
cuuuuccuauugauucuguuac

SEQ ID NO: 1083164 - RNA, 22 nt, Human
ucuuuccauggccacacagucu

SEQ ID NO: 1083165 - RNA, 22 nt, Human
ucuuuucauugagaacacacug

SEQ ID NO: 1083166 - RNA, 22 nt, Human
gcccucgcuucuuccuaggggu

SEQ ID NO: 1083167 - RNA, 19 nt, Human
ucacaagagagauaaagug

SEQ ID NO: 1083168 - RNA, 22 nt, Human
agcuucuggaaggcaaggcuug

SEQ ID NO: 1083169 - RNA, 22 nt, Human
uuccagauuucuacacaagacc

SEQ ID NO: 1083170 - RNA, 22 nt, Human
uuucacagaggaggaagcugag

SEQ ID NO: 1083171 - RNA, 22 nt, Human
gagauucuguagucaggcaucu

SEQ ID NO: 1083172 - RNA, 22 nt, Human
cagcaucuguauccuaggcuga

SEQ ID NO: 1083173 - RNA, 22 nt, Human
aggcacugaagaacucuuuuug

SEQ ID NO: 1083174 - RNA, 21 nt, Human
uacagcaacggagguuuucua

SEQ ID NO: 1083175 - RNA, 22 nt, Human
acccaggacucucuuccaguag

SEQ ID NO: 1083176 - RNA, 20 nt, Human
cuuguacaugauaaagauuu

SEQ ID NO: 1083177 - RNA, 22 nt, Human
aauguguuaguauugauuuguc

SEQ ID NO: 1083178 - RNA, 22 nt, Human
auggaaagcuaagccauuuacc

SEQ ID NO: 1083179 - RNA, 22 nt, Human
uugcccagaguccacagcguac

SEQ ID NO: 1083180 - RNA, 22 nt, Human
gucccugggucuaaggcaguaa

SEQ ID NO: 1083181 - RNA, 19 nt, Human
gguggcucucccucaggga

SEQ ID NO: 1083182 - RNA, 22 nt, Human
cagugcagaggugcaagcaugu

SEQ ID NO: 1083183 - RNA, 22 nt, Human
uacaucuaucuagaugcucaga

SEQ ID NO: 1083184 - RNA, 22 nt, Human
ugccaggcugaacagggucuua

SEQ ID NO: 1083185 - RNA, 20 nt, Human
uuauuucaguugcuagauug

SEQ ID NO: 1083186 - RNA, 22 nt, Human
uacaaaaguaauuacgguuuuu

SEQ ID NO: 1083187 - RNA, 22 nt, Human
auauguguauuugguuagccua

SEQ ID NO: 1083188 - RNA, 22 nt, Human
uaagaauuaucucauggauaau

SEQ ID NO: 1083189 - RNA, 22 nt, Human
ccaccaggacagcccugagggg

SEQ ID NO: 1083190 - RNA, 17 nt, Human
auuuacauugucaccga

SEQ ID NO: 1083191 - RNA, 22 nt, Human
gccaaagcagucuugccucugc

SEQ ID NO: 1083192 - RNA, 18 nt, Human
gagcugggagaaggaagg

SEQ ID NO: 1083193 - RNA, 22 nt, Human
augggcaguaacaguggcaguc

SEQ ID NO: 1083194 - RNA, 19 nt, Human
uaaaucuguauucuucaaa

SEQ ID NO: 1083195 - RNA, 22 nt, Human
aguggcaggaaaguggaagaga

SEQ ID NO: 1083196 - RNA, 22 nt, Human
ucacacgugagguucuauccug

SEQ ID NO: 1083197 - RNA, 22 nt, Human
uaacagaaauuuuaguuagggg

SEQ ID NO: 1083198 - RNA, 20 nt, Human
uucuuuugauaagcuugaca

SEQ ID NO: 1083199 - RNA, 22 nt, Human
aggaagaaacugagcucugaca

SEQ ID NO: 1083200 - RNA, 21 nt, Human
ucccagcugggucagugcugc

SEQ ID NO: 1083201 - RNA, 22 nt, Human
agaggccuccgaaaggugggcu

SEQ ID NO: 1083202 - RNA, 22 nt, Human
uuagauaaaaguguucaauaaa

SEQ ID NO: 1083203 - RNA, 22 nt, Human
gccuggagaauuaaaaggaagg

SEQ ID NO: 1083204 - RNA, 22 nt, Human
ucaauucugcauacauuucacu

SEQ ID NO: 1083205 - RNA, 22 nt, Human
ggcugagggccagggcuagucu

SEQ ID NO: 1083206 - RNA, 22 nt, Human
uuuguacauguaagauugcauc

SEQ ID NO: 1083207 - RNA, 22 nt, Human
gccuguguguuuagcucugggg

SEQ ID NO: 1083208 - RNA, 22 nt, Human
uuucugaaaucucuuuugagga

SEQ ID NO: 1083209 - RNA, 22 nt, Human
cacaggcugcccgcagcuggga

SEQ ID NO: 1083210 - RNA, 18 nt, Human
gguggcaggucagaugcc

SEQ ID NO: 1083211 - RNA, 22 nt, Human
guccacauaggaacccagcuuc

SEQ ID NO: 1083212 - RNA, 22 nt, Human
auaugcaagcacauagaauacu

SEQ ID NO: 1083213 - RNA, 22 nt, Human
gguguagcucugugucccacug

SEQ ID NO: 1083214 - RNA, 22 nt, Human
aaagcagugcugugagaacacu

SEQ ID NO: 1083215 - RNA, 22 nt, Human
agcugcccuggcggagcugcuc

SEQ ID NO: 1083216 - RNA, 22 nt, Human
ucucagucagccuugauguccc

SEQ ID NO: 1083217 - RNA, 22 nt, Human
ugcuggcugcagugcugucaaa

SEQ ID NO: 1083218 - RNA, 22 nt, Human
gucuaaacuuagggaucgaaca

SEQ ID NO: 1083219 - RNA, 22 nt, Human
agaucacagucaauugcaaguu

SEQ ID NO: 1083220 - RNA, 22 nt, Human
ugaggcagcaauugauuauuca

SEQ ID NO: 1083221 - RNA, 22 nt, Human
agggcucaucugagacugacau

SEQ ID NO: 1083222 - RNA, 18 nt, Human
uccagcgugcuccagggc

SEQ ID NO: 1083223 - RNA, 22 nt, Human
ugcagggaacuuggacagcuag

SEQ ID NO: 1083224 - RNA, 22 nt, Human
caggagcugggucuggaagcag

SEQ ID NO: 1083225 - RNA, 22 nt, Human
gggcccugugauuucuugagga

SEQ ID NO: 1083226 - RNA, 22 nt, Human
gcugucacacaugggaucucag

SEQ ID NO: 1083227 - RNA, 22 nt, Human
aaggcacuuuucuaaagaccuu

SEQ ID NO: 1083228 - RNA, 22 nt, Human
gcagcuggcccugacacgcaga

SEQ ID NO: 1083229 - RNA, 18 nt, Human
gcugagguggugucagag

SEQ ID NO: 1083230 - RNA, 22 nt, Human
ggcaggugguaaggauuucaua

SEQ ID NO: 1083231 - RNA, 22 nt, Human
caucaaagcuuuuuucuguguu

SEQ ID NO: 1083232 - RNA, 22 nt, Human
ucuuccaggcuagaguuguugc

SEQ ID NO: 1083233 - RNA, 22 nt, Human
caaguuaguuauucuugugagc

SEQ ID NO: 1083234 - RNA, 22 nt, Human
acagaagugacaauuucuuggg

SEQ ID NO: 1083235 - RNA, 22 nt, Human
cugcagcuguagaggacagugg

SEQ ID NO: 1083236 - RNA, 22 nt, Human
uccugcuuccuugucuuuagac

SEQ ID NO: 1083237 - RNA, 22 nt, Human
ugcauuguaggauguuuagcag

SEQ ID NO: 1083238 - RNA, 22 nt, Human
agagccugucugccuuucuacc

SEQ ID NO: 1083239 - RNA, 21 nt, Human
gaaggagaaagcaagugcugc

SEQ ID NO: 1083240 - RNA, 22 nt, Human
uucaggagcuggcugcgaagga

SEQ ID NO: 1083241 - RNA, 22 nt, Human
ccagguacauggagaagaacag

SEQ ID NO: 1083242 - RNA, 22 nt, Human
agaaugcuuguaccuuuguuuu

SEQ ID NO: 1083243 - RNA, 22 nt, Human
gugcauguuaaugguguacaaa

SEQ ID NO: 1083244 - RNA, 22 nt, Human
gcccaugggcuccagaccuggg

SEQ ID NO: 1083245 - RNA, 22 nt, Human
cagaauaaacagaaacguagcu

SEQ ID NO: 1083246 - RNA, 22 nt, Human
ccaggagucuggaugagguguc

SEQ ID NO: 1083247 - RNA, 22 nt, Human
cagcugccuaugaccuagccuc

SEQ ID NO: 1083248 - RNA, 22 nt, Human
cccuggcauaaaacuucuccag

SEQ ID NO: 1083249 - RNA, 22 nt, Human
cagaggcugcucuggguggcau

SEQ ID NO: 1083250 - RNA, 22 nt, Human
caggccugagacaucugagaua

SEQ ID NO: 1083251 - RNA, 22 nt, Human
ucccagagacagagccuccucc

SEQ ID NO: 1083252 - RNA, 22 nt, Human
caagagcucccagaccugggca

SEQ ID NO: 1083253 - RNA, 22 nt, Human
cacucacuuauuucuaacagaa

SEQ ID NO: 1083254 - RNA, 22 nt, Human
caggccaggcugcauuugcccc

SEQ ID NO: 1083255 - RNA, 22 nt, Human
ccagcuccccucagcagguaau

SEQ ID NO: 1083256 - RNA, 21 nt, Human
ugcucaugcaaugcaugucca

SEQ ID NO: 1083257 - RNA, 22 nt, Human
gucaggaucucccaguacauau

SEQ ID NO: 1083258 - RNA, 22 nt, Human
aguuuuaugcaguguucugaua

SEQ ID NO: 1083259 - RNA, 22 nt, Human
agcucccugagaugccacagca

SEQ ID NO: 1083260 - RNA, 22 nt, Human
ucauucauacucuuuucuauua

SEQ ID NO: 1083261 - RNA, 22 nt, Human
caguuuuuagauuaguuggugg

SEQ ID NO: 1083262 - RNA, 20 nt, Human
gagccuuccccucaccacug

SEQ ID NO: 1083263 - RNA, 22 nt, Human
ugccaggcauguaguagacuug

SEQ ID NO: 1083264 - RNA, 22 nt, Human
uuuguuuagaugguaaaucagu

SEQ ID NO: 1083265 - RNA, 22 nt, Human
uagcauuucacugaucuucacu

SEQ ID NO: 1083266 - RNA, 22 nt, Human
cugcuccacaccuccauuuccu

SEQ ID NO: 1083267 - RNA, 22 nt, Human
uuacauuuggcuauguccucua

SEQ ID NO: 1083268 - RNA, 22 nt, Human
agcagcagggacaaaggaacag

SEQ ID NO: 1083269 - RNA, 22 nt, Human
cuguccuccggccaccuacagu

SEQ ID NO: 1083270 - RNA, 22 nt, Human
agaccaggaaggccuacagaua

SEQ ID NO: 1083271 - RNA, 22 nt, Human
ggcugcaguuugucuuuugcuu

SEQ ID NO: 1083272 - RNA, 22 nt, Human
gagaaaugcuagcuuaggaauc

SEQ ID NO: 1083273 - RNA, 22 nt, Human
cacaauuuuaauacacagucaa

SEQ ID NO: 1083274 - RNA, 22 nt, Human
uuaauuuugaugagguucaguu

SEQ ID NO: 1083275 - RNA, 22 nt, Human
acaagaauguagauuaguuaag

SEQ ID NO: 1083276 - RNA, 22 nt, Human
gaaggcuguggcuggucucagu

SEQ ID NO: 1083277 - RNA, 22 nt, Human
aggcacugacagauucuguguc

SEQ ID NO: 1083278 - RNA, 22 nt, Human
caaaguccuagaacagugcuug

SEQ ID NO: 1083279 - RNA, 22 nt, Human
gccuggccugaacuaggaggug

SEQ ID NO: 1083280 - RNA, 21 nt, Human
gcugcucgagauccagugcuu

SEQ ID NO: 1083281 - RNA, 22 nt, Human
gagccuggccuccugccucagc

SEQ ID NO: 1083282 - RNA, 22 nt, Human
uucuuucuguccauaaugagac

SEQ ID NO: 1083283 - RNA, 22 nt, Human
uuaaaauagccagugccccucu

SEQ ID NO: 1083284 - RNA, 22 nt, Human
uggcucugucaaacugcacaca

SEQ ID NO: 1083285 - RNA, 22 nt, Human
ggccacuccgcugcuacuggaa

SEQ ID NO: 1083286 - RNA, 19 nt, Human
ggaggccuggguauuugcc

SEQ ID NO: 1083287 - RNA, 22 nt, Human
guggaggagaggcgccuugcgg

SEQ ID NO: 1083288 - RNA, 22 nt, Human
cuguggcuuucucugccuccuu

SEQ ID NO: 1083289 - RNA, 22 nt, Human
acaguggaagaagcacugaacu

SEQ ID NO: 1083290 - RNA, 20 nt, Human
acacaguagcaauuagugca

SEQ ID NO: 1083291 - RNA, 22 nt, Human
guguaaaucagcuuguguaaua

SEQ ID NO: 1083292 - RNA, 18 nt, Human
uuaagagcugaaagggga

SEQ ID NO: 1083293 - RNA, 22 nt, Human
uucuuuucuuuaggcauugugu

SEQ ID NO: 1083294 - RNA, 22 nt, Human
acagaauaguagcuuaaaguca

SEQ ID NO: 1083295 - RNA, 22 nt, Human
uacaugcucaguaacuuucagu

SEQ ID NO: 1083296 - RNA, 22 nt, Human
uuuuccucugcagagcaguuag

SEQ ID NO: 1083297 - RNA, 22 nt, Human
cuuucugauuuuaagcucuaau

SEQ ID NO: 1083298 - RNA, 22 nt, Human
uuucuuuuccaauaucccuacu

SEQ ID NO: 1083299 - RNA, 22 nt, Human
gcaguccucucauuggccuccu

SEQ ID NO: 1083300 - RNA, 22 nt, Human
uaaagcagugguucucaaacuu

SEQ ID NO: 1083301 - RNA, 16 nt, Human
ccuuuucucaucucua

SEQ ID NO: 1083302 - RNA, 22 nt, Human
ucuggaguuacugcuggcuuug

SEQ ID NO: 1083303 - RNA, 22 nt, Human
uuaguaucuggaaaucacauua

SEQ ID NO: 1083304 - RNA, 22 nt, Human
ggggcagaaagcccacagagug

SEQ ID NO: 1083305 - RNA, 23 nt, Human
agacaaaagccucagucuuaggc

SEQ ID NO: 1083306 - RNA, 22 nt, Human
auaaaaacugacccauccuuug

SEQ ID NO: 1083307 - RNA, 20 nt, Human
uauauuuucucuuuggccuu

SEQ ID NO: 1083308 - RNA, 22 nt, Human
ccagaggaguugaggcuuuggg

SEQ ID NO: 1083309 - RNA, 22 nt, Human
auuagcuuccuauaguaagggg

SEQ ID NO: 1083310 - RNA, 17 nt, Human
agggacagcaguuuagg

SEQ ID NO: 1083311 - RNA, 22 nt, Human
cucuccuccaacagcccugccg

SEQ ID NO: 1083312 - RNA, 22 nt, Human
gccacuguuccaccaucuugau

SEQ ID NO: 1083313 - RNA, 22 nt, Human
uguaaauugaaggaaauuugug

SEQ ID NO: 1083314 - RNA, 21 nt, Human
cugaggcagcacagcuaguca

SEQ ID NO: 1083315 - RNA, 21 nt, Human
ugcuccuuagcugccccugcc

SEQ ID NO: 1083316 - RNA, 22 nt, Human
cugacuuuuuucagccacagug

SEQ ID NO: 1083317 - RNA, 22 nt, Human
guggcgcagaggguggcagaga

SEQ ID NO: 1083318 - RNA, 22 nt, Human
aucccacaccccuacaacauau

SEQ ID NO: 1083319 - RNA, 19 nt, Human
uggcagggagaguuugaag

SEQ ID NO: 1083320 - RNA, 22 nt, Human
ucugugcucaaguucugccucu

SEQ ID NO: 1083321 - RNA, 22 nt, Human
ucuuuauaaaagucauuauguc

SEQ ID NO: 1083322 - RNA, 22 nt, Human
cagcugagcugccagacuacug

SEQ ID NO: 1083323 - RNA, 22 nt, Human
cacaggaggaggccagagcgua

SEQ ID NO: 1083324 - RNA, 22 nt, Human
gacauucacaguuuccgauggu

SEQ ID NO: 1083325 - RNA, 22 nt, Human
ggcacacauagaucugcacugg

SEQ ID NO: 1083326 - RNA, 22 nt, Human
agggucaggagacacuggcaac

SEQ ID NO: 1083327 - RNA, 22 nt, Human
ugcucucucaggccuggcccac

SEQ ID NO: 1083328 - RNA, 22 nt, Human
cacugcuuuaaggcugaguaac

SEQ ID NO: 1083329 - RNA, 22 nt, Human
auagacaaugguuugccaagaa

SEQ ID NO: 1083330 - RNA, 22 nt, Human
cauuuguaucugggcugcugug

SEQ ID NO: 1083331 - RNA, 22 nt, Human
cacagacccagaagggaugaag

SEQ ID NO: 1083332 - RNA, 22 nt, Human
cuuuguagcugcuucugauuua

SEQ ID NO: 1083333 - RNA, 22 nt, Human
gcucucugccauaugaggauac

SEQ ID NO: 1083334 - RNA, 22 nt, Human
acugagcugcuugaagugaacu

SEQ ID NO: 1083335 - RNA, 22 nt, Human
uaaagcaaggaauagaguaguc

SEQ ID NO: 1083336 - RNA, 22 nt, Human
uuuguguuuuagcuggugaggc

SEQ ID NO: 1083337 - RNA, 22 nt, Human
caaugauguuuagauaaaaucc

SEQ ID NO: 1083338 - RNA, 22 nt, Human
uucauuccuucuguaccuugcc

SEQ ID NO: 1083339 - RNA, 22 nt, Human
gcugcaggcgccugcggucucu

SEQ ID NO: 1083340 - RNA, 20 nt, Human
ucuguaaagacuccagaagc

SEQ ID NO: 1083341 - RNA, 22 nt, Human
cauucugcauuuggaaggggca

SEQ ID NO: 1083342 - RNA, 22 nt, Human
aucugcccaucuguccugcuuc

SEQ ID NO: 1083343 - RNA, 22 nt, Human
uguacuuccccaaugacagcac

SEQ ID NO: 1083344 - RNA, 20 nt, Human
cagcagaaauggggugggaa

SEQ ID NO: 1083345 - RNA, 22 nt, Human
caucacagaaauaaacauaccu

SEQ ID NO: 1083346 - RNA, 22 nt, Human
gucugucucucuccagagugca

SEQ ID NO: 1083347 - RNA, 18 nt, Human
aucuuuccauagcauguu

SEQ ID NO: 1083348 - RNA, 20 nt, Human
augcaugcaugcacaugcac

SEQ ID NO: 1083349 - RNA, 22 nt, Human
uagagcugauaaugaggccaag

SEQ ID NO: 1083350 - RNA, 22 nt, Human
uucuuaagugagaaagcaggag

SEQ ID NO: 1083351 - RNA, 22 nt, Human
caggaagcuggucagauccugu

SEQ ID NO: 1083352 - RNA, 22 nt, Human
uagcagggaagaugaucagaau

SEQ ID NO: 1083353 - RNA, 22 nt, Human
gaccaccagagguccgugggua

SEQ ID NO: 1083354 - RNA, 22 nt, Human
ccagagccggauugugaagugc

SEQ ID NO: 1083355 - RNA, 22 nt, Human
gcccauggacacccaagugcca

SEQ ID NO: 1083356 - RNA, 22 nt, Human
uccuagucacaggaaaauuuca

SEQ ID NO: 1083357 - RNA, 22 nt, Human
aauuucacuggaaaagauaauu

SEQ ID NO: 1083358 - RNA, 22 nt, Human
uacauggguagguuaagucaua

SEQ ID NO: 1083359 - RNA, 22 nt, Human
agcucccagaaggcccugcgcc

SEQ ID NO: 1083360 - RNA, 22 nt, Human
uggaaugaauauguuuuaagga

SEQ ID NO: 1083361 - RNA, 22 nt, Human
agaagcauuauaacaugcaagg

SEQ ID NO: 1083362 - RNA, 22 nt, Human
gaggaggucgcugcugagcccc

SEQ ID NO: 1083363 - RNA, 22 nt, Human
gucaggauuugaacucaggucu

SEQ ID NO: 1083364 - RNA, 22 nt, Human
cuccagucuaguagagccugcu

SEQ ID NO: 1083365 - RNA, 22 nt, Human
aggccugagccccagguuuguu

SEQ ID NO: 1083366 - RNA, 22 nt, Human
uucaagauggcaccagugagug

SEQ ID NO: 1083367 - RNA, 22 nt, Human
cagcccugggaguuggggccga

SEQ ID NO: 1083368 - RNA, 22 nt, Human
uagcagcucacagccucccauu

SEQ ID NO: 1083369 - RNA, 20 nt, Human
gcccucagucuugucuuuau

SEQ ID NO: 1083370 - RNA, 22 nt, Human
uggacaggugagugacucaggg

SEQ ID NO: 1083371 - RNA, 22 nt, Human
gcugagccccccugcguggguc

SEQ ID NO: 1083372 - RNA, 22 nt, Human
uaggaaaacgugauuuucucac

SEQ ID NO: 1083373 - RNA, 21 nt, Human
aagcuucccugcucuccaggg

SEQ ID NO: 1083374 - RNA, 22 nt, Human
uaaugaauaaacuugagaguca

SEQ ID NO: 1083375 - RNA, 22 nt, Human
auuuguagugaagugaaaauaa

SEQ ID NO: 1083376 - RNA, 17 nt, Human
ccuuccucaucuccuuc

SEQ ID NO: 1083377 - RNA, 22 nt, Human
gagguggauguugcagugagcu

SEQ ID NO: 1083378 - RNA, 23 nt, Human
ccagcucccaggucugaggacug

SEQ ID NO: 1083379 - RNA, 23 nt, Human
gucagggcuggggucagagugac

SEQ ID NO: 1083380 - RNA, 22 nt, Human
ccuuuucuaggaugcuuuauag

SEQ ID NO: 1083381 - RNA, 22 nt, Human
uuuccucugggcccugccaccc

SEQ ID NO: 1083382 - RNA, 21 nt, Human
ucccucagacagggugccuau

SEQ ID NO: 1083383 - RNA, 22 nt, Human
aggaaccuaagagccugcaguc

SEQ ID NO: 1083384 - RNA, 22 nt, Human
gcaugcugcugaggcuggaaua

SEQ ID NO: 1083385 - RNA, 22 nt, Human
acacuucucccaucuccuguug

SEQ ID NO: 1083386 - RNA, 22 nt, Human
ucugccuguagucccacaccuc

SEQ ID NO: 1083387 - RNA, 22 nt, Human
guggccagcaagugcugccucu

SEQ ID NO: 1083388 - RNA, 22 nt, Human
gcuguuccugcuuagaggucgg

SEQ ID NO: 1083389 - RNA, 22 nt, Human
uagaaacauauaggauggcagg

SEQ ID NO: 1083390 - RNA, 22 nt, Human
aauuagagaagcuucuuccauu

SEQ ID NO: 1083391 - RNA, 19 nt, Human
cucuggagcagacacugga

SEQ ID NO: 1083392 - RNA, 22 nt, Human
cagccuguagaauacaguaaau

SEQ ID NO: 1083393 - RNA, 18 nt, Human
uggaggcagaguucuggc

SEQ ID NO: 1083394 - RNA, 22 nt, Human
ucugccuguggauacaugcucu

SEQ ID NO: 1083395 - RNA, 20 nt, Human
cucucuggaaggugggagcc

SEQ ID NO: 1083396 - RNA, 22 nt, Human
aaacaaguuuguagacuagcca

SEQ ID NO: 1083397 - RNA, 22 nt, Human
ccauacacacaccaaauuugua

SEQ ID NO: 1083398 - RNA, 22 nt, Human
agccaggcuaaaugagccauga

SEQ ID NO: 1083399 - RNA, 22 nt, Human
ugagccugcugucgcuggaccc

SEQ ID NO: 1083400 - RNA, 22 nt, Human
cuuucuuuguccaccaacaaug

SEQ ID NO: 1083401 - RNA, 22 nt, Human
ugucucagauacgccaucaagg

SEQ ID NO: 1083402 - RNA, 22 nt, Human
aaaacucaaacauuuuggcaua

SEQ ID NO: 1083403 - RNA, 22 nt, Human
gcaggguaggugacagguaguc

SEQ ID NO: 1083404 - RNA, 22 nt, Human
guuauaaauaccuaauaggauu

SEQ ID NO: 1083405 - RNA, 23 nt, Human
auguauuuaaauuucagugauga

SEQ ID NO: 1083406 - RNA, 22 nt, Human
cuugcuggugguguuuucuaug

SEQ ID NO: 1083407 - RNA, 22 nt, Human
gagcugguuuuaggcuaugucu

SEQ ID NO: 1083408 - RNA, 22 nt, Human
aguucuggcgcccaugagcaga

SEQ ID NO: 1083409 - RNA, 22 nt, Human
cagcugcaguucaaugcuugcu

SEQ ID NO: 1083410 - RNA, 22 nt, Human
cccaaguuaauuuguagcugaa

SEQ ID NO: 1083411 - RNA, 22 nt, Human
acacaugauaagaaaguuuaaa

SEQ ID NO: 1083412 - RNA, 22 nt, Human
caggccuggcccccggcacacc

SEQ ID NO: 1083413 - RNA, 22 nt, Human
ccagggucuuggagaggagugc

SEQ ID NO: 1083414 - RNA, 16 nt, Human
cacauauauuuauaug

SEQ ID NO: 1083415 - RNA, 22 nt, Human
cagggguguuuuuggccaggag

SEQ ID NO: 1083416 - RNA, 22 nt, Human
acagagcauuugggacagagag

SEQ ID NO: 1083417 - RNA, 22 nt, Human
uggcccugcuggacacgccugc

SEQ ID NO: 1083418 - RNA, 22 nt, Human
ggucccaggcucccucuugucc

SEQ ID NO: 1083419 - RNA, 22 nt, Human
uuaucuugguguuuuaguaauu

SEQ ID NO: 1083420 - RNA, 22 nt, Human
agcuucuugaccaagccuguaa

SEQ ID NO: 1083421 - RNA, 22 nt, Human
ccagggcagcgccccuccacgc

SEQ ID NO: 1083422 - RNA, 22 nt, Human
agccuccuggaguuucugggau

SEQ ID NO: 1083423 - RNA, 22 nt, Human
cuagagggauguuaggauagca

SEQ ID NO: 1083424 - RNA, 22 nt, Human
acuuucuauuguuuagauucug

SEQ ID NO: 1083425 - RNA, 22 nt, Human
uuucagugcacguaguuuauuu

SEQ ID NO: 1083426 - RNA, 22 nt, Human
ugucaguucagugauuacaaaa

SEQ ID NO: 1083427 - RNA, 22 nt, Human
uucacaaaaaugcugaacaguu

SEQ ID NO: 1083428 - RNA, 22 nt, Human
uagcugucagcaaucaaguggu

SEQ ID NO: 1083429 - RNA, 22 nt, Human
auuugucuagugguauucacgu

SEQ ID NO: 1083430 - RNA, 22 nt, Human
agcaaagcugauuaagagcaca

SEQ ID NO: 1083431 - RNA, 22 nt, Human
aagcuguguaaguugcuugguu

SEQ ID NO: 1083432 - RNA, 19 nt, Human
aguuuauuauaggugauuc

SEQ ID NO: 1083433 - RNA, 22 nt, Human
cagagugaacagugggaugugc

SEQ ID NO: 1083434 - RNA, 22 nt, Human
aauauaauuuuauuccuagagu

SEQ ID NO: 1083435 - RNA, 22 nt, Human
gauuaaguaacugaacacuuug

SEQ ID NO: 1083436 - RNA, 22 nt, Human
aaguccaucucugccccacaca

SEQ ID NO: 1083437 - RNA, 22 nt, Human
uaaagcaaggcaaauuguuggu

SEQ ID NO: 1083438 - RNA, 22 nt, Human
cucagcaagauuaagcagcuug

SEQ ID NO: 1083439 - RNA, 22 nt, Human
cagcuguugaucucuuaagccu

SEQ ID NO: 1083440 - RNA, 22 nt, Human
gaauguuuuuauaaguguuaca

SEQ ID NO: 1083441 - RNA, 20 nt, Human
ugcccagcaagagugcaguu

SEQ ID NO: 1083442 - RNA, 22 nt, Human
uuuuucugccauucaaagagga

SEQ ID NO: 1083443 - RNA, 22 nt, Human
ccacccugagccgcaagagcag

SEQ ID NO: 1083444 - RNA, 22 nt, Human
gggccuucagccuuggacugag

SEQ ID NO: 1083445 - RNA, 22 nt, Human
gcgagggcacgcgguugaaggc

SEQ ID NO: 1083446 - RNA, 22 nt, Human
aaagcagcuuucggcccucggg

SEQ ID NO: 1083447 - RNA, 22 nt, Human
agcugccaccucugccuuuggg

SEQ ID NO: 1083448 - RNA, 22 nt, Human
gcuguggccaacaaaccacuuu

SEQ ID NO: 1083449 - RNA, 22 nt, Human
aguuacagaauguacagagguu

SEQ ID NO: 1083450 - RNA, 22 nt, Human
ccagucccaucucugucgcuua

SEQ ID NO: 1083451 - RNA, 22 nt, Human
ucucucagggggaaggcugaag

SEQ ID NO: 1083452 - RNA, 22 nt, Human
gugggcagagcaagggaacuca

SEQ ID NO: 1083453 - RNA, 22 nt, Human
accuccuggcuuaucauggaca

SEQ ID NO: 1083454 - RNA, 22 nt, Human
aggagguggccugagcgugccc

SEQ ID NO: 1083455 - RNA, 22 nt, Human
cuuucauucuuagauauuagug

SEQ ID NO: 1083456 - RNA, 22 nt, Human
gugugccagacaugaugcuaug

SEQ ID NO: 1083457 - RNA, 22 nt, Human
gaggcucauugcauugugcauu

SEQ ID NO: 1083458 - RNA, 22 nt, Human
agcuggcaguaugacuggugac

SEQ ID NO: 1083459 - RNA, 23 nt, Human
uggccaggguacuacacccaccc

SEQ ID NO: 1083460 - RNA, 22 nt, Human
uuaagucaauaucaaucucagc

SEQ ID NO: 1083461 - RNA, 22 nt, Human
ccucugccaccucccacgaggc

SEQ ID NO: 1083462 - RNA, 22 nt, Human
gagcagugacuggagcaugaga

SEQ ID NO: 1083463 - RNA, 22 nt, Human
uugauuuucaauucauugacaa

SEQ ID NO: 1083464 - RNA, 22 nt, Human
augaaacaaaccucuauggagu

SEQ ID NO: 1083465 - RNA, 22 nt, Human
cugguucaaguccuggcucugu

SEQ ID NO: 1083466 - RNA, 22 nt, Human
ccagggccucguguucugagug

SEQ ID NO: 1083467 - RNA, 22 nt, Human
cauauaaauacaacauguguua

SEQ ID NO: 1083468 - RNA, 22 nt, Human
cugguggggaguccuggucucc

SEQ ID NO: 1083469 - RNA, 22 nt, Human
aaaugcaugagaaaguauucug

SEQ ID NO: 1083470 - RNA, 22 nt, Human
agcugcagucaagcugggccac

SEQ ID NO: 1083471 - RNA, 22 nt, Human
uauuugcugaaucugauucaga

SEQ ID NO: 1083472 - RNA, 18 nt, Human
uugcuuuguaagcuugca

SEQ ID NO: 1083473 - RNA, 22 nt, Human
acagugauuucugcaagggcuc

SEQ ID NO: 1083474 - RNA, 22 nt, Human
cagggagccuccaaagcuuuca

SEQ ID NO: 1083475 - RNA, 22 nt, Human
uucccucuccuacucaggaaag

SEQ ID NO: 1083476 - RNA, 22 nt, Human
gccuggagacagcagaggcggc

SEQ ID NO: 1083477 - RNA, 22 nt, Human
ugcaggcugugucauuuaguga

SEQ ID NO: 1083478 - RNA, 22 nt, Human
uccugaggcucacuuugaaugu

SEQ ID NO: 1083479 - RNA, 22 nt, Human
ccugccugcuuucugcuuugca

SEQ ID NO: 1083480 - RNA, 22 nt, Human
gggcagcagaauuggacagaaa

SEQ ID NO: 1083481 - RNA, 22 nt, Human
cccuggcuuggcacucuccacu

SEQ ID NO: 1083482 - RNA, 22 nt, Human
cagggcaguuugugccuaugag

SEQ ID NO: 1083483 - RNA, 22 nt, Human
aagccuuccugagugcaaggcc

SEQ ID NO: 1083484 - RNA, 22 nt, Human
auaauauuuggauaggacagua

SEQ ID NO: 1083485 - RNA, 22 nt, Human
ugaggcaggaguuaaugugcuc

SEQ ID NO: 1083486 - RNA, 22 nt, Human
ucuauuuuauacucaaaucuuc

SEQ ID NO: 1083487 - RNA, 22 nt, Human
aaaugguaagacaacacauuau

SEQ ID NO: 1083488 - RNA, 22 nt, Human
aaagcauguucugggaauagua

SEQ ID NO: 1083489 - RNA, 22 nt, Human
gggcugacaccacccaggcgca

SEQ ID NO: 1083490 - RNA, 22 nt, Human
gccugcuguuaacugcaggaau

SEQ ID NO: 1083491 - RNA, 22 nt, Human
agugucugaaccaccggggcau

SEQ ID NO: 1083492 - RNA, 22 nt, Human
uagaaaugugauaauagcuuaa

SEQ ID NO: 1083493 - RNA, 18 nt, Human
gugggguguugugaggau

SEQ ID NO: 1083494 - RNA, 22 nt, Human
acuggcaguagagggagcgcau

SEQ ID NO: 1083495 - RNA, 22 nt, Human
acuggagcccguggaggcgcag

SEQ ID NO: 1083496 - RNA, 22 nt, Human
aaaugcauguagaauaauagag

SEQ ID NO: 1083497 - RNA, 22 nt, Human
uaguucuguguagcucaagagu

SEQ ID NO: 1083498 - RNA, 22 nt, Human
uuugacagacauuuacuacauu

SEQ ID NO: 1083499 - RNA, 22 nt, Human
uacaaagucccauugccaugga

SEQ ID NO: 1083500 - RNA, 22 nt, Human
guuuuucucugaaauaguugac

SEQ ID NO: 1083501 - RNA, 22 nt, Human
ucaaagcacuggggaaagccug

SEQ ID NO: 1083502 - RNA, 22 nt, Human
uauaaaguuucgaaagauguau

SEQ ID NO: 1083503 - RNA, 22 nt, Human
ugugaaaucugaacucaaagau

SEQ ID NO: 1083504 - RNA, 22 nt, Human
uuugaguugcuuauuuaauagg

SEQ ID NO: 1083505 - RNA, 22 nt, Human
aggcaguccccagggguguugc

SEQ ID NO: 1083506 - RNA, 22 nt, Human
agccucugacugucagcaaggu

SEQ ID NO: 1083507 - RNA, 22 nt, Human
cuguggaacuuagugggagaca

SEQ ID NO: 1083508 - RNA, 20 nt, Human
agggucaguagcacagagcu

SEQ ID NO: 1083509 - RNA, 22 nt, Human
cagcccuuuccuucucagcuuu

SEQ ID NO: 1083510 - RNA, 22 nt, Human
aaacaaguguaaacuagucugu

SEQ ID NO: 1083511 - RNA, 22 nt, Human
ugcugugggcaguacauaagcu

SEQ ID NO: 1083512 - RNA, 22 nt, Human
uucuacaaauauuuacuguucc

SEQ ID NO: 1083513 - RNA, 22 nt, Human
ugauuucucauauuguucaaaa

SEQ ID NO: 1083514 - RNA, 20 nt, Human
aggcugagggugauuguguc

SEQ ID NO: 1083515 - RNA, 22 nt, Human
gaggccuggcucugcccuccug

SEQ ID NO: 1083516 - RNA, 22 nt, Human
aguguccaacucagcuugucaa

SEQ ID NO: 1083517 - RNA, 22 nt, Human
aggaaaggugagagcggccgcg

SEQ ID NO: 1083518 - RNA, 22 nt, Human
aggacugacuuuugccaugaaa

SEQ ID NO: 1083519 - RNA, 22 nt, Human
augcagaaagcggcaaacaggu

SEQ ID NO: 1083520 - RNA, 22 nt, Human
aucuccagauugugaucaucag

SEQ ID NO: 1083521 - RNA, 22 nt, Human
caguuuuaugucgaauguauac

SEQ ID NO: 1083522 - RNA, 22 nt, Human
ugagccugcaauaagcacagcc

SEQ ID NO: 1083523 - RNA, 22 nt, Human
cucacagcugcuucaggaucca

SEQ ID NO: 1083524 - RNA, 22 nt, Human
uuacaagauaugugagaacuag

SEQ ID NO: 1083525 - RNA, 19 nt, Human
ggcugucuggcguguggau

SEQ ID NO: 1083526 - RNA, 22 nt, Human
uuucuuuuacaguguggcuauu

SEQ ID NO: 1083527 - RNA, 22 nt, Human
uaaagcauaaugaauaucuaga

SEQ ID NO: 1083528 - RNA, 22 nt, Human
ucagauggguuuugaaggaugu

SEQ ID NO: 1083529 - RNA, 22 nt, Human
uacaagaaggauggagcccacu

SEQ ID NO: 1083530 - RNA, 22 nt, Human
uuuccucuccaccaggaggucu

SEQ ID NO: 1083531 - RNA, 22 nt, Human
uaaagcacauaucuuacaauaa

SEQ ID NO: 1083532 - RNA, 22 nt, Human
ugcagcugcuugauucaucuug

SEQ ID NO: 1083533 - RNA, 22 nt, Human
uauuucacaucuaugaagugag

SEQ ID NO: 1083534 - RNA, 22 nt, Human
agacuuugagcucuuagagaag

SEQ ID NO: 1083535 - RNA, 21 nt, Human
gcugagagguugggaaguuca

SEQ ID NO: 1083536 - RNA, 22 nt, Human
cggggccuagcugcacacccuc

SEQ ID NO: 1083537 - RNA, 22 nt, Human
uuuauaugugaagguuugcaga

SEQ ID NO: 1083538 - RNA, 21 nt, Human
caaauacuuagaaacuuaaga

SEQ ID NO: 1083539 - RNA, 22 nt, Human
ugggcuucauaauugguccuag

SEQ ID NO: 1083540 - RNA, 22 nt, Human
uugaaaacauuuauauuagaau

SEQ ID NO: 1083541 - RNA, 22 nt, Human
uagaaacagagagauaugcccc

SEQ ID NO: 1083542 - RNA, 22 nt, Human
uuuccaaaaugaaucuaaugca

SEQ ID NO: 1083543 - RNA, 22 nt, Human
cuggcagcuuagcacucugguu

SEQ ID NO: 1083544 - RNA, 22 nt, Human
ugugagacacacugcugcuuca

SEQ ID NO: 1083545 - RNA, 21 nt, Human
gggcuggacaugguggcucau

SEQ ID NO: 1083546 - RNA, 23 nt, Human
uaggggaaaaaucuucugcaauu

SEQ ID NO: 1083547 - RNA, 22 nt, Human
aguuguaauaacaauaccaaaa

SEQ ID NO: 1083548 - RNA, 22 nt, Human
auuacagaagauaugcucaaca

SEQ ID NO: 1083549 - RNA, 22 nt, Human
uuuauugucuaugaacugcuug

SEQ ID NO: 1083550 - RNA, 22 nt, Human
acacaguauugugacuauaacu

SEQ ID NO: 1083551 - RNA, 22 nt, Human
gccaucacauccaggcuaccuc

SEQ ID NO: 1083552 - RNA, 22 nt, Human
auuuuuccauucucuguuagua

SEQ ID NO: 1083553 - RNA, 22 nt, Human
ugaaagaugcucaaugaauggu

SEQ ID NO: 1083554 - RNA, 22 nt, Human
accaucagucacauguagagaa

SEQ ID NO: 1083555 - RNA, 22 nt, Human
uauaagaaauugccaaccuguu

SEQ ID NO: 1083556 - RNA, 22 nt, Human
ggauggagaugaccauggugac

SEQ ID NO: 1083557 - RNA, 22 nt, Human
ucaguguccggagccugagugc

SEQ ID NO: 1083558 - RNA, 22 nt, Human
cuccuuaaguaugggcugugca

SEQ ID NO: 1083559 - RNA, 22 nt, Human
cugccuguuccugaucauucua

SEQ ID NO: 1083560 - RNA, 22 nt, Human
gggacuggaacuacuggugcag

SEQ ID NO: 1083561 - RNA, 22 nt, Human
ucugggcuggcuuuaugcugac

SEQ ID NO: 1083562 - RNA, 22 nt, Human
caguggcgugaucucugcucac

SEQ ID NO: 1083563 - RNA, 22 nt, Human
gugcccagcuccaccucacaga

SEQ ID NO: 1083564 - RNA, 22 nt, Human
aggggcuccuggccuggagagc

SEQ ID NO: 1083565 - RNA, 22 nt, Human
aaaggcaaaauucuuagcagga

SEQ ID NO: 1083566 - RNA, 22 nt, Human
uuauguuuuauggcuauaucau

SEQ ID NO: 1083567 - RNA, 22 nt, Human
guuuucaauuauaagauggcuu

SEQ ID NO: 1083568 - RNA, 22 nt, Human
cagcaggcccagaguuucaugg

SEQ ID NO: 1083569 - RNA, 21 nt, Human
acacauuaugagcauagacuc

SEQ ID NO: 1083570 - RNA, 22 nt, Human
uuucacaguagaaaucauuaug

SEQ ID NO: 1083571 - RNA, 22 nt, Human
agccuucaaccuagcuagagca

SEQ ID NO: 1083572 - RNA, 22 nt, Human
caguucugacuuucauaauguc

SEQ ID NO: 1083573 - RNA, 22 nt, Human
uuuacugaauuugguauauucc

SEQ ID NO: 1083574 - RNA, 23 nt, Human
ugagccuguuaauacuggcucug

SEQ ID NO: 1083575 - RNA, 22 nt, Human
aagcaguaugguauuuaaguca

SEQ ID NO: 1083576 - RNA, 22 nt, Human
ugcagcuucuuguccugugauu

SEQ ID NO: 1083577 - RNA, 22 nt, Human
ccucucauagucuguauccuuu

SEQ ID NO: 1083578 - RNA, 22 nt, Human
caagcaacgacuuucaagcugu

SEQ ID NO: 1083579 - RNA, 22 nt, Human
ucugucacucuagagauggcag

SEQ ID NO: 1083580 - RNA, 22 nt, Human
uagcugccaaaagggugggcua

SEQ ID NO: 1083581 - RNA, 22 nt, Human
gggcugggcaugguguucccuc

SEQ ID NO: 1083582 - RNA, 22 nt, Human
uagcaaggcguggcacucaaau

SEQ ID NO: 1083583 - RNA, 22 nt, Human
aguuucacagucugucauuguu

SEQ ID NO: 1083584 - RNA, 18 nt, Human
aacaugcauuagaacugc

SEQ ID NO: 1083585 - RNA, 22 nt, Human
agaaaugaaaccaaagccuaga

SEQ ID NO: 1083586 - RNA, 22 nt, Human
ucaggaauccagacagggcaca

SEQ ID NO: 1083587 - RNA, 22 nt, Human
caggaagaaagaggugaggugu

SEQ ID NO: 1083588 - RNA, 22 nt, Human
gggaaauugugugagaucuuug

SEQ ID NO: 1083589 - RNA, 22 nt, Human
gacugucauucuagugcccaug

SEQ ID NO: 1083590 - RNA, 22 nt, Human
agggguggccugccuuacuccc

SEQ ID NO: 1083591 - RNA, 22 nt, Human
aagauuuacuagcauaauagcu

SEQ ID NO: 1083592 - RNA, 22 nt, Human
gcuuagucaauuauaaauaggc

SEQ ID NO: 1083593 - RNA, 22 nt, Human
uugaucuugugauaguucaacu

SEQ ID NO: 1083594 - RNA, 22 nt, Human
ugggcucagccucagucugugg

SEQ ID NO: 1083595 - RNA, 22 nt, Human
aggccaaguagcuagcauugaa

SEQ ID NO: 1083596 - RNA, 22 nt, Human
uguucuaaauuugcauggucca

SEQ ID NO: 1083597 - RNA, 21 nt, Human
ccaccaggucuucugcucggg

SEQ ID NO: 1083598 - RNA, 22 nt, Human
cagcuguguaaacacaugugua

SEQ ID NO: 1083599 - RNA, 22 nt, Human
auaucaaacgaaguuauuuuaa

SEQ ID NO: 1083600 - RNA, 22 nt, Human
gcaggaugaaggcagaggcuga

SEQ ID NO: 1083601 - RNA, 22 nt, Human
ugcuguguucuccugacucacc

SEQ ID NO: 1083602 - RNA, 22 nt, Human
gaacagcccuguuaagucuguu

SEQ ID NO: 1083603 - RNA, 22 nt, Human
cagacaugagauacagcugcua

SEQ ID NO: 1083604 - RNA, 20 nt, Human
aggcugggguguuuugccca

SEQ ID NO: 1083605 - RNA, 22 nt, Human
gggcacuggaggccaaggagcu

SEQ ID NO: 1083606 - RNA, 22 nt, Human
gaggaggcuggcgccgccugcc

SEQ ID NO: 1083607 - RNA, 22 nt, Human
ucugcccacaguccaauaguug

SEQ ID NO: 1083608 - RNA, 22 nt, Human
ugggagaugguucugagacuuu

SEQ ID NO: 1083609 - RNA, 22 nt, Human
acauugaugaaaagguaucauu

SEQ ID NO: 1083610 - RNA, 22 nt, Human
uuuguagaggguaauugacaga

SEQ ID NO: 1083611 - RNA, 22 nt, Human
auuaaaagcuucccaagaguua

SEQ ID NO: 1083612 - RNA, 22 nt, Human
auucuuauuauaguaaaacagu

SEQ ID NO: 1083613 - RNA, 22 nt, Human
auacuucaacauaucagucaga

SEQ ID NO: 1083614 - RNA, 22 nt, Human
aaugcaaagaguugcuuaucaa

SEQ ID NO: 1083615 - RNA, 22 nt, Human
uuucugaagguuaaggaauuag

SEQ ID NO: 1083616 - RNA, 22 nt, Human
uuguaaagcuuugagacuacau

SEQ ID NO: 1083617 - RNA, 22 nt, Human
aguguacauguacacauuagua

SEQ ID NO: 1083618 - RNA, 22 nt, Human
uugaccuauguuucuucaucug

SEQ ID NO: 1083619 - RNA, 22 nt, Human
augaagucuagcaagcauugaa

SEQ ID NO: 1083620 - RNA, 22 nt, Human
aauaaagccuuauugauuuuac

SEQ ID NO: 1083621 - RNA, 22 nt, Human
gaggagcaugggaaggcucugg

SEQ ID NO: 1083622 - RNA, 22 nt, Human
caaagucauggggaugcagguc

SEQ ID NO: 1083623 - RNA, 22 nt, Human
aagaacauucgaacuauuuucu

SEQ ID NO: 1083624 - RNA, 22 nt, Human
agaagggccagcuggacaccug

SEQ ID NO: 1083625 - RNA, 18 nt, Human
gcugggguugagcucucc

SEQ ID NO: 1083626 - RNA, 22 nt, Human
auuuguaucuucuaauauuauc

SEQ ID NO: 1083627 - RNA, 17 nt, Human
gcugccugcaacugacu

SEQ ID NO: 1083628 - RNA, 22 nt, Human
uucaacuauuaugaauaaaauu

SEQ ID NO: 1083629 - RNA, 22 nt, Human
ggcuagggaaaaugauuggaua

SEQ ID NO: 1083630 - RNA, 20 nt, Human
acauuugaagucgcauuucu

SEQ ID NO: 1083631 - RNA, 22 nt, Human
ugggcagaaugugggauccaga

SEQ ID NO: 1083632 - RNA, 22 nt, Human
gcuccuggcuccaggcagccaa

SEQ ID NO: 1083633 - RNA, 21 nt, Human
gcuuucuguggacucugcacc

SEQ ID NO: 1083634 - RNA, 22 nt, Human
agcagggcagcuuuuuucagaa

SEQ ID NO: 1083635 - RNA, 23 nt, Human
ugcuggguaucagaaucacugag

SEQ ID NO: 1083636 - RNA, 22 nt, Human
acuuccugcuaugagcuucugu

SEQ ID NO: 1083637 - RNA, 22 nt, Human
aaggcacaacacaagaggguga

SEQ ID NO: 1083638 - RNA, 22 nt, Human
uaaguucauuagacuacagaua

SEQ ID NO: 1083639 - RNA, 23 nt, Human
ucagagagcuguugagagcugcc

SEQ ID NO: 1083640 - RNA, 22 nt, Human
agauuucagaugcucggcaguu

SEQ ID NO: 1083641 - RNA, 22 nt, Human
auacauuagcucauaugauuaa

SEQ ID NO: 1083642 - RNA, 22 nt, Human
uggggcuggcacagucucuauu

SEQ ID NO: 1083643 - RNA, 22 nt, Human
uuuuaucuucauuccuaucuac

SEQ ID NO: 1083644 - RNA, 22 nt, Human
uguaagaaaaguaaauagugac

SEQ ID NO: 1083645 - RNA, 22 nt, Human
caucaguguggcaguucacugu

SEQ ID NO: 1083646 - RNA, 22 nt, Human
aaggugguuugcagacagaaua

SEQ ID NO: 1083647 - RNA, 22 nt, Human
uuuauuguuaucaugggugagu

SEQ ID NO: 1083648 - RNA, 19 nt, Human
gauuuaaacguggcucuau

SEQ ID NO: 1083649 - RNA, 22 nt, Human
caggcccacugcuugucuaguc

SEQ ID NO: 1083650 - RNA, 22 nt, Human
cuguaauucacuagggucagcg

SEQ ID NO: 1083651 - RNA, 22 nt, Human
uacagagacuuuauggcacaaa

SEQ ID NO: 1083652 - RNA, 22 nt, Human
aaacuaagacuaaugaagaacu

SEQ ID NO: 1083653 - RNA, 22 nt, Human
ccuggccucagccuagggcuga

SEQ ID NO: 1083654 - RNA, 22 nt, Human
auaagguaugaaaaguaaaugg

SEQ ID NO: 1083655 - RNA, 22 nt, Human
cagcccugcacgcugccuccgc

SEQ ID NO: 1083656 - RNA, 21 nt, Human
agcucuggagcagcaaucaag

SEQ ID NO: 1083657 - RNA, 22 nt, Human
auguacacaugcaugcaugugc

SEQ ID NO: 1083658 - RNA, 22 nt, Human
uaacaagauuuguaaaauugua

SEQ ID NO: 1083659 - RNA, 19 nt, Human
gcaggguggcagagcucuu

SEQ ID NO: 1083660 - RNA, 22 nt, Human
guggcugcagagggcacagcau

SEQ ID NO: 1083661 - RNA, 22 nt, Human
gggcugcugcugccagcgacac

SEQ ID NO: 1083662 - RNA, 22 nt, Human
ucacacagcuuggaguuauggu

SEQ ID NO: 1083663 - RNA, 22 nt, Human
uuguuugcccacaacuauuaag

SEQ ID NO: 1083664 - RNA, 18 nt, Human
aggcaggugcuggaaguc

SEQ ID NO: 1083665 - RNA, 23 nt, Human
ccuggaguacuaaggggauggaa

SEQ ID NO: 1083666 - RNA, 22 nt, Human
ggggaccuaggcucugucucuu

SEQ ID NO: 1083667 - RNA, 22 nt, Human
uucagaguaggauacuagcuua

SEQ ID NO: 1083668 - RNA, 20 nt, Human
uuucuggguacucucccucu

SEQ ID NO: 1083669 - RNA, 22 nt, Human
aggaacacccccuuccuaccag

SEQ ID NO: 1083670 - RNA, 20 nt, Human
ucugugugccaucaccuaac

SEQ ID NO: 1083671 - RNA, 22 nt, Human
cugggaaguggugagggccuga

SEQ ID NO: 1083672 - RNA, 22 nt, Human
cagguggggggcuuccgagccu

SEQ ID NO: 1083673 - RNA, 22 nt, Human
uuucucaaccucaacacuauuu

SEQ ID NO: 1083674 - RNA, 20 nt, Human
acuugcugggcuuuguuacc

SEQ ID NO: 1083675 - RNA, 22 nt, Human
uucucaaggacaaaaugacaug

SEQ ID NO: 1083676 - RNA, 21 nt, Human
aguguccuugaucuugccuug

SEQ ID NO: 1083677 - RNA, 22 nt, Human
uggaagaaaauucaaucgaguu

SEQ ID NO: 1083678 - RNA, 22 nt, Human
aggcaggcuggucugaagagug

SEQ ID NO: 1083679 - RNA, 22 nt, Human
uggccaggcagguagaacggcc

SEQ ID NO: 1083680 - RNA, 22 nt, Human
aaagccacguggccuggggagc

SEQ ID NO: 1083681 - RNA, 22 nt, Human
cugcucugacccuuucaccuuc

SEQ ID NO: 1083682 - RNA, 22 nt, Human
gccaggaaagccacuggcauac

SEQ ID NO: 1083683 - RNA, 22 nt, Human
gggaaggacacagccaugacug

SEQ ID NO: 1083684 - RNA, 22 nt, Human
gaaggcaacaccaggaugcacu

SEQ ID NO: 1083685 - RNA, 21 nt, Human
acagggcaugcagcuggcugu

SEQ ID NO: 1083686 - RNA, 22 nt, Human
cccaggaaauagccaggaggug

SEQ ID NO: 1083687 - RNA, 21 nt, Human
uucuucaggccaaugcucauu

SEQ ID NO: 1083688 - RNA, 22 nt, Human
ucuggagcuuguuucagauggu

SEQ ID NO: 1083689 - RNA, 21 nt, Human
uuuucccacugaaagcuccca

SEQ ID NO: 1083690 - RNA, 22 nt, Human
cccucccaggaguggccagaga

SEQ ID NO: 1083691 - RNA, 22 nt, Human
ggaccagagaagugagcaccug

SEQ ID NO: 1083692 - RNA, 22 nt, Human
ugcuuaauauugugauguaaua

SEQ ID NO: 1083693 - RNA, 22 nt, Human
augaugguaaauucaguauccg

SEQ ID NO: 1083694 - RNA, 22 nt, Human
uguaaacauaccagagccaagu

SEQ ID NO: 1083695 - RNA, 22 nt, Human
uauuuggagugauggaaauguu

SEQ ID NO: 1083696 - RNA, 22 nt, Human
ugcuucuggguaggccucagga

SEQ ID NO: 1083697 - RNA, 22 nt, Human
uggccuggggaagaccaugggc

SEQ ID NO: 1083698 - RNA, 22 nt, Human
gcucagagaugucugcugccuu

SEQ ID NO: 1083699 - RNA, 22 nt, Human
caguacuuguccucagguguua

SEQ ID NO: 1083700 - RNA, 22 nt, Human
cagggccucgaagccucugggc

SEQ ID NO: 1083701 - RNA, 22 nt, Human
gcuguggcuugcagcuggggcu

SEQ ID NO: 1083702 - RNA, 22 nt, Human
gcugaggaagucagguggccca

SEQ ID NO: 1083703 - RNA, 22 nt, Human
acagccagguaaaggcauggca

SEQ ID NO: 1083704 - RNA, 22 nt, Human
aaagguuuuucagcagggagau

SEQ ID NO: 1083705 - RNA, 22 nt, Human
aagcugccugggaggaagggcu

SEQ ID NO: 1083706 - RNA, 22 nt, Human
ugcuucugcauucaauguugga

SEQ ID NO: 1083707 - RNA, 22 nt, Human
aguacauacuucaaauguacuu

SEQ ID NO: 1083708 - RNA, 22 nt, Human
uggcagucuucaucaguucugg

SEQ ID NO: 1083709 - RNA, 22 nt, Human
accugggagucacaccugagaa

SEQ ID NO: 1083710 - RNA, 22 nt, Human
ccuacucugagcgccuccgcau

SEQ ID NO: 1083711 - RNA, 22 nt, Human
aggcagcagugauaagauagga

SEQ ID NO: 1083712 - RNA, 22 nt, Human
acagauaaaaguuguuuaaaau

SEQ ID NO: 1083713 - RNA, 22 nt, Human
ccagccuggacugggucuugug

SEQ ID NO: 1083714 - RNA, 22 nt, Human
ggacacuguauaaguuagagua

SEQ ID NO: 1083715 - RNA, 22 nt, Human
gugcagugacccuggagagcug

SEQ ID NO: 1083716 - RNA, 22 nt, Human
uauguauaaaugcaugugugga

SEQ ID NO: 1083717 - RNA, 22 nt, Human
agaggcuguuacacucccagau

SEQ ID NO: 1083718 - RNA, 22 nt, Human
uuuugaauaauucagaaacagc

SEQ ID NO: 1083719 - RNA, 22 nt, Human
auugguauguauucugaaaacu

SEQ ID NO: 1083720 - RNA, 20 nt, Human
cugggcucaagugauccucc

SEQ ID NO: 1083721 - RNA, 22 nt, Human
ggcugccaggagaagcucagug

SEQ ID NO: 1083722 - RNA, 22 nt, Human
acauuucauuugcaguauggau

SEQ ID NO: 1083723 - RNA, 22 nt, Human
cucccuggcuuuguccugaggc

SEQ ID NO: 1083724 - RNA, 22 nt, Human
gacagcagacagccuggccccu

SEQ ID NO: 1083725 - RNA, 22 nt, Human
acuaucaacaucauugcucuag

SEQ ID NO: 1083726 - RNA, 22 nt, Human
ucagaggagccaaaguucugag

SEQ ID NO: 1083727 - RNA, 22 nt, Human
auugaaaaugacauuugugccc

SEQ ID NO: 1083728 - RNA, 22 nt, Human
agaggccuuucuguugagugaa

SEQ ID NO: 1083729 - RNA, 22 nt, Human
accagccagccacaguggcucc

SEQ ID NO: 1083730 - RNA, 22 nt, Human
cuggugugauugagcccaggug

SEQ ID NO: 1083731 - RNA, 22 nt, Human
aaagaacaaaugauauaugguu

SEQ ID NO: 1083732 - RNA, 22 nt, Human
agcuggguucagaggcacaugg

SEQ ID NO: 1083733 - RNA, 22 nt, Human
ucucaggagccacagcgggagu

SEQ ID NO: 1083734 - RNA, 22 nt, Human
uuccuccacgugacaggagcca

SEQ ID NO: 1083735 - RNA, 22 nt, Human
ggggccuguagagcuucaggga

SEQ ID NO: 1083736 - RNA, 22 nt, Human
guuauuuuaucucugagagguu

SEQ ID NO: 1083737 - RNA, 22 nt, Human
ucauugcagacuaacaaucuca

SEQ ID NO: 1083738 - RNA, 22 nt, Human
gucaauaucuugguuguacuau

SEQ ID NO: 1083739 - RNA, 22 nt, Human
ccaguuuuuccagugcuuucug

SEQ ID NO: 1083740 - RNA, 22 nt, Human
accgggaaguccugcacugggc

SEQ ID NO: 1083741 - RNA, 22 nt, Human
ccucccacauccuagcucugcu

SEQ ID NO: 1083742 - RNA, 22 nt, Human
gucaacaucggaaagcguguaa

SEQ ID NO: 1083743 - RNA, 22 nt, Human
cugccuagcgccaucugccucu

SEQ ID NO: 1083744 - RNA, 22 nt, Human
ugcagggcaguggagguugagu

SEQ ID NO: 1083745 - RNA, 18 nt, Human
ggguccuguucuuggaag

SEQ ID NO: 1083746 - RNA, 22 nt, Human
uuuaaagugcugcuccuauccu

SEQ ID NO: 1083747 - RNA, 22 nt, Human
ccaggcucagggcagacuuuca

SEQ ID NO: 1083748 - RNA, 22 nt, Human
caguacuuaguucucaugguuu

SEQ ID NO: 1083749 - RNA, 22 nt, Human
gggccagguggaccccagccuc

SEQ ID NO: 1083750 - RNA, 22 nt, Human
caucucaugggcaugccaagcu

SEQ ID NO: 1083751 - RNA, 20 nt, Human
uucuugagccaaaaggcaua

SEQ ID NO: 1083752 - RNA, 22 nt, Human
cagcuggcguggagugauugca

SEQ ID NO: 1083753 - RNA, 18 nt, Human
uauaaccuguuuugaugg

SEQ ID NO: 1083754 - RNA, 22 nt, Human
ugaugcaauagagagauagaua

SEQ ID NO: 1083755 - RNA, 22 nt, Human
aauacugcugccugcaaauuau

SEQ ID NO: 1083756 - RNA, 22 nt, Human
gcagagcuguuaauggagcuga

SEQ ID NO: 1083757 - RNA, 22 nt, Human
uugccugugaacgcugaguccu

SEQ ID NO: 1083758 - RNA, 22 nt, Human
augagcuguaagguggcuuccu

SEQ ID NO: 1083759 - RNA, 22 nt, Human
uugcugaggacgcagugcagug

SEQ ID NO: 1083760 - RNA, 22 nt, Human
accugccuaucagcugccugcu

SEQ ID NO: 1083761 - RNA, 22 nt, Human
ucuguccuguuuccuccugaca

SEQ ID NO: 1083762 - RNA, 22 nt, Human
gcccagcaggacagagugguuu

SEQ ID NO: 1083763 - RNA, 17 nt, Human
ccugggaggaguuauga

SEQ ID NO: 1083764 - RNA, 22 nt, Human
caugcugagcacauucuguauu

SEQ ID NO: 1083765 - RNA, 22 nt, Human
ugggaaggaacugccuuuagcu

SEQ ID NO: 1083766 - RNA, 22 nt, Human
uuucaaguuguugcauuaaaug

SEQ ID NO: 1083767 - RNA, 22 nt, Human
aaaaucuggcaacacuaaguuu

SEQ ID NO: 1083768 - RNA, 22 nt, Human
uauauuuuagacacccucacgc

SEQ ID NO: 1083769 - RNA, 22 nt, Human
aggugggcaccaggcuuguggu

SEQ ID NO: 1083770 - RNA, 17 nt, Human
acccucaaucuccugca

SEQ ID NO: 1083771 - RNA, 22 nt, Human
auguucuuccuucaauuuggaa

SEQ ID NO: 1083772 - RNA, 22 nt, Human
gggguuaacaguauugcucaug

SEQ ID NO: 1083773 - RNA, 22 nt, Human
acaguuauuuucccagcauuua

SEQ ID NO: 1083774 - RNA, 22 nt, Human
acagcagcuuccugacuguacu

SEQ ID NO: 1083775 - RNA, 22 nt, Human
augggaggcagacacuaaguuc

SEQ ID NO: 1083776 - RNA, 22 nt, Human
aucuuagaaguuugauaaaauc

SEQ ID NO: 1083777 - RNA, 21 nt, Human
uuacuuuagaaauugccuuuu

SEQ ID NO: 1083778 - RNA, 22 nt, Human
ggcucagggaaugaggaagaau

SEQ ID NO: 1083779 - RNA, 22 nt, Human
ugucucaggcccaagccaguaa

SEQ ID NO: 1083780 - RNA, 22 nt, Human
auuacacaggcuggcucuuuga

SEQ ID NO: 1083781 - RNA, 22 nt, Human
acuaguuuauuacaguuccacu

SEQ ID NO: 1083782 - RNA, 22 nt, Human
aaguuagugccuccuuaaauuu

SEQ ID NO: 1083783 - RNA, 22 nt, Human
ggggccuuuucugaauguggaa

SEQ ID NO: 1083784 - RNA, 22 nt, Human
aucacccaagcuggagugcagu

SEQ ID NO: 1083785 - RNA, 22 nt, Human
gagcucugacugcugggugaca

SEQ ID NO: 1083786 - RNA, 22 nt, Human
ucugccuguaauauuuggagaa

SEQ ID NO: 1083787 - RNA, 22 nt, Human
cugagcaggacagugggagacc

SEQ ID NO: 1083788 - RNA, 22 nt, Human
cacacacucuuccuggcaccua

SEQ ID NO: 1083789 - RNA, 22 nt, Human
uuuuggaaugaggaacauccag

SEQ ID NO: 1083790 - RNA, 22 nt, Human
ccuggcuccugccucugcaggg

SEQ ID NO: 1083791 - RNA, 22 nt, Human
cagggcugucuccaaaggcccc

SEQ ID NO: 1083792 - RNA, 22 nt, Human
uccaguggagugugggggugaa

SEQ ID NO: 1083793 - RNA, 20 nt, Human
agcaggugacggggccugcu

SEQ ID NO: 1083794 - RNA, 22 nt, Human
caguguggagggagagagccug

SEQ ID NO: 1083795 - RNA, 22 nt, Human
ucccuucacagaugcgauguuu

SEQ ID NO: 1083796 - RNA, 22 nt, Human
ggucccaaucuaaucacaugag

SEQ ID NO: 1083797 - RNA, 19 nt, Human
uugguggugguuuugguuc

SEQ ID NO: 1083798 - RNA, 22 nt, Human
gggccugacugagagcuccuca

SEQ ID NO: 1083799 - RNA, 22 nt, Human
uagcagagaggggacaguggca

SEQ ID NO: 1083800 - RNA, 22 nt, Human
ucugggagggagccucagaauc

SEQ ID NO: 1083801 - RNA, 22 nt, Human
ccugugaugguguuacacuguu

SEQ ID NO: 1083802 - RNA, 22 nt, Human
aguuaaaucauuacugacagag

SEQ ID NO: 1083803 - RNA, 22 nt, Human
ucagcucggccuaggcccacgg

SEQ ID NO: 1083804 - RNA, 22 nt, Human
uuucacagcugauaccucuucc

SEQ ID NO: 1083805 - RNA, 22 nt, Human
uuccacagguuucagacuguuc

SEQ ID NO: 1083806 - RNA, 22 nt, Human
ugugggcaggcccgggucugag

SEQ ID NO: 1083807 - RNA, 22 nt, Human
gccucagcucccagcccaggcu

SEQ ID NO: 1083808 - RNA, 22 nt, Human
auuuccagugcacugaauagaa

SEQ ID NO: 1083809 - RNA, 22 nt, Human
accagugggaaguggaaaauga

SEQ ID NO: 1083810 - RNA, 22 nt, Human
acaauagaguucucauaggaca

SEQ ID NO: 1083811 - RNA, 22 nt, Human
cauaauaucuccgauuacuugc

SEQ ID NO: 1083812 - RNA, 22 nt, Human
aagcacagagagguaaaguaac

SEQ ID NO: 1083813 - RNA, 17 nt, Human
agccaggcauaugaagu

SEQ ID NO: 1083814 - RNA, 22 nt, Human
ugcagagagaccccugggccag

SEQ ID NO: 1083815 - RNA, 22 nt, Human
uguacuguauucaucuuuaacu

SEQ ID NO: 1083816 - RNA, 22 nt, Human
aggcugggaaauguauuccagc

SEQ ID NO: 1083817 - RNA, 22 nt, Human
gggcugagucaucuggggccuc

SEQ ID NO: 1083818 - RNA, 22 nt, Human
auuucaguagaaaaucuugauu

SEQ ID NO: 1083819 - RNA, 22 nt, Human
cacacaugacccacuuuuaccg

SEQ ID NO: 1083820 - RNA, 22 nt, Human
gcuuugcagacaaaauuccagc

SEQ ID NO: 1083821 - RNA, 22 nt, Human
acuacauucaugcucguguugg

SEQ ID NO: 1083822 - RNA, 22 nt, Human
guugugcagggcgaggaccuga

SEQ ID NO: 1083823 - RNA, 22 nt, Human
uaauuacuggaaauuucaaaua

SEQ ID NO: 1083824 - RNA, 22 nt, Human
aauaaauguuuguuggauguuu

SEQ ID NO: 1083825 - RNA, 22 nt, Human
uuagagucaaaauggcauguua

SEQ ID NO: 1083826 - RNA, 22 nt, Human
agcucugggcugacaugcuccc

SEQ ID NO: 1083827 - RNA, 20 nt, Human
gucaggauuaguaaacucug

SEQ ID NO: 1083828 - RNA, 22 nt, Human
ugagaagauugggcagagugga

SEQ ID NO: 1083829 - RNA, 22 nt, Human
uaacaaaguaccauagauuggg

SEQ ID NO: 1083830 - RNA, 22 nt, Human
aaugguacccuggugacuuaga

SEQ ID NO: 1083831 - RNA, 22 nt, Human
accaaugugaugauauuaggag

SEQ ID NO: 1083832 - RNA, 21 nt, Human
gaguaacauuuccucuccaca

SEQ ID NO: 1083833 - RNA, 22 nt, Human
ggcugccugugcccaggcacac

SEQ ID NO: 1083834 - RNA, 22 nt, Human
ucaugacaucuguuuaucucaa

SEQ ID NO: 1083835 - RNA, 22 nt, Human
aggaagcaaaaggcagggucua

SEQ ID NO: 1083836 - RNA, 19 nt, Human
uccugggcugggccagguc

SEQ ID NO: 1083837 - RNA, 22 nt, Human
cuggggcuguaggaggacuuau

SEQ ID NO: 1083838 - RNA, 22 nt, Human
uucuuaaguaugaucuuaacgg

SEQ ID NO: 1083839 - RNA, 22 nt, Human
cccagggacagcuagguggggc

SEQ ID NO: 1083840 - RNA, 22 nt, Human
auucacauuuacaaagcacuca

SEQ ID NO: 1083841 - RNA, 22 nt, Human
auauaauaguuucauaaaggcu

SEQ ID NO: 1083842 - RNA, 22 nt, Human
caaacugaacacgaaagucuuu

SEQ ID NO: 1083843 - RNA, 22 nt, Human
uccacauccauugcuugacuuu

SEQ ID NO: 1083844 - RNA, 22 nt, Human
ucugggugcccuuugcucuguu

SEQ ID NO: 1083845 - RNA, 22 nt, Human
ucugugcucuucucaguaucac

SEQ ID NO: 1083846 - RNA, 22 nt, Human
ccauuaaguauuauuaaugauu

SEQ ID NO: 1083847 - RNA, 22 nt, Human
ggcuggcuuucucuccgcaccu

SEQ ID NO: 1083848 - RNA, 22 nt, Human
uccagcagguuggucaggugca

SEQ ID NO: 1083849 - RNA, 22 nt, Human
augcucuggaguacgugaaauu

SEQ ID NO: 1083850 - RNA, 22 nt, Human
cuggagccugcaguuuucacuu

SEQ ID NO: 1083851 - RNA, 22 nt, Human
uaugacuuuggaaaaauuacuu

SEQ ID NO: 1083852 - RNA, 19 nt, Human
cuguccuuggcugcacugu

SEQ ID NO: 1083853 - RNA, 22 nt, Human
agcccugcauaaaucaguuggu

SEQ ID NO: 1083854 - RNA, 22 nt, Human
ugagauuuucagcaucacuuca

SEQ ID NO: 1083855 - RNA, 22 nt, Human
acagaguauuggaaaggcagug

SEQ ID NO: 1083856 - RNA, 22 nt, Human
uuuucuuauagagcuuaaaguu

SEQ ID NO: 1083857 - RNA, 22 nt, Human
aagcccagaugggagcauuuca

SEQ ID NO: 1083858 - RNA, 22 nt, Human
caagauaauuuauucugaguuu

SEQ ID NO: 1083859 - RNA, 22 nt, Human
acugggcuguuuuuugagugga

SEQ ID NO: 1083860 - RNA, 22 nt, Human
aguacaaacuguuucaaaguag

SEQ ID NO: 1083861 - RNA, 22 nt, Human
ucucuucuuguguuuuccugcc

SEQ ID NO: 1083862 - RNA, 22 nt, Human
ucauguuuuaguaaagugaagg

SEQ ID NO: 1083863 - RNA, 22 nt, Human
ccugggcuucugucuagauguu

SEQ ID NO: 1083864 - RNA, 22 nt, Human
gacagggaaacauugaaguguc

SEQ ID NO: 1083865 - RNA, 22 nt, Human
aaguacaaucuuucuguaaagg

SEQ ID NO: 1083866 - RNA, 22 nt, Human
aagauauagauaaaacuaugca

SEQ ID NO: 1083867 - RNA, 22 nt, Human
aaacuuuaggaaggaauuuaca

SEQ ID NO: 1083868 - RNA, 22 nt, Human
cccagcccccgagugucuggaa

SEQ ID NO: 1083869 - RNA, 22 nt, Human
uuuauucaucaucuguucauau

SEQ ID NO: 1083870 - RNA, 22 nt, Human
auacaucauuuauggaauaagg

SEQ ID NO: 1083871 - RNA, 22 nt, Human
ucaucaguguccuuaucacuua

SEQ ID NO: 1083872 - RNA, 22 nt, Human
uugugugucuucuucacugccc

SEQ ID NO: 1083873 - RNA, 22 nt, Human
uguuaaaaauucagcucuagau

SEQ ID NO: 1083874 - RNA, 22 nt, Human
uaacaacuugcuuuuaucuuag

SEQ ID NO: 1083875 - RNA, 22 nt, Human
uuucaaacuuaaauaccuuucc

SEQ ID NO: 1083876 - RNA, 22 nt, Human
agugaaaugauucugagcaaga

SEQ ID NO: 1083877 - RNA, 22 nt, Human
cagcaggguuaagugacucacc

SEQ ID NO: 1083878 - RNA, 22 nt, Human
ccucugaggucauggacuuggc

SEQ ID NO: 1083879 - RNA, 19 nt, Human
gucagcaccauggacaggg

SEQ ID NO: 1083880 - RNA, 22 nt, Human
aaagcaauuacaaaagggauaa

SEQ ID NO: 1083881 - RNA, 21 nt, Human
uggagcugaauuuuuggcauc

SEQ ID NO: 1083882 - RNA, 22 nt, Human
uagauuuuuuggagacucucug

SEQ ID NO: 1083883 - RNA, 22 nt, Human
cugcccugcucuccgggaucuu

SEQ ID NO: 1083884 - RNA, 22 nt, Human
auauguuucaguauucaaguca

SEQ ID NO: 1083885 - RNA, 20 nt, Human
aacagggggcugcagagggc

SEQ ID NO: 1083886 - RNA, 22 nt, Human
uggcugagcucccuguguguug

SEQ ID NO: 1083887 - RNA, 22 nt, Human
gaugccuccaaaugagggcaga

SEQ ID NO: 1083888 - RNA, 22 nt, Human
cggcccugcugagcuugucugg

SEQ ID NO: 1083889 - RNA, 22 nt, Human
ugugguggggucugguauucca

SEQ ID NO: 1083890 - RNA, 22 nt, Human
ugaagccaaucugccaggcaga

SEQ ID NO: 1083891 - RNA, 22 nt, Human
ggggaaagugaauuguguagug

SEQ ID NO: 1083892 - RNA, 22 nt, Human
aagucuuucauaagucucuuau

SEQ ID NO: 1083893 - RNA, 22 nt, Human
cugguucauccccuuccaggaa

SEQ ID NO: 1083894 - RNA, 22 nt, Human
gugugcaggugucagugcagcu

SEQ ID NO: 1083895 - RNA, 18 nt, Human
cugcugcaggcacucagg

SEQ ID NO: 1083896 - RNA, 22 nt, Human
cugggaagcuucgagcaggaaa

SEQ ID NO: 1083897 - RNA, 22 nt, Human
gauaauaucugguuuauucacc

SEQ ID NO: 1083898 - RNA, 20 nt, Human
aggagaaauucgggacaccu

SEQ ID NO: 1083899 - RNA, 22 nt, Human
cccuuuaaaguuuuaccagcag

SEQ ID NO: 1083900 - RNA, 22 nt, Human
aagauggcaucuccuauagaug

SEQ ID NO: 1083901 - RNA, 22 nt, Human
aauagcaaacagacaugcacaa

SEQ ID NO: 1083902 - RNA, 22 nt, Human
ucuacacaagugaguggcacaa

SEQ ID NO: 1083903 - RNA, 22 nt, Human
uaagaccaaaguucuguaggga

SEQ ID NO: 1083904 - RNA, 22 nt, Human
ugcagguggccaucuucguucu

SEQ ID NO: 1083905 - RNA, 22 nt, Human
caggagccgccaggcacguugg

SEQ ID NO: 1083906 - RNA, 21 nt, Human
ucuggcccuagguugggccuc

SEQ ID NO: 1083907 - RNA, 22 nt, Human
uucaaugauuuuuagggaucau

SEQ ID NO: 1083908 - RNA, 22 nt, Human
ucucaggaaauaggauuugagu

SEQ ID NO: 1083909 - RNA, 18 nt, Human
caagaaucucuaaagaag

SEQ ID NO: 1083910 - RNA, 22 nt, Human
aagacuaaauguguucuaaagu

SEQ ID NO: 1083911 - RNA, 22 nt, Human
ggcucugcuggauugaggccag

SEQ ID NO: 1083912 - RNA, 21 nt, Human
uagggcaggcauuggaagaga

SEQ ID NO: 1083913 - RNA, 22 nt, Human
uuauccaaacuggugaaucauu

SEQ ID NO: 1083914 - RNA, 22 nt, Human
gcagggcagccacaggcccccu

SEQ ID NO: 1083915 - RNA, 22 nt, Human
uggccagguguggguucucaga

SEQ ID NO: 1083916 - RNA, 22 nt, Human
uuacaacauauuuagcuugauu

SEQ ID NO: 1083917 - RNA, 22 nt, Human
gucagugucuuaacagagauua

SEQ ID NO: 1083918 - RNA, 22 nt, Human
cuucaugcugauauccucgaug

SEQ ID NO: 1083919 - RNA, 22 nt, Human
gacauguauuaguacauauggu

SEQ ID NO: 1083920 - RNA, 22 nt, Human
acaugauucuugauaggcauug

SEQ ID NO: 1083921 - RNA, 22 nt, Human
caaggcaggaagccugucuuau

SEQ ID NO: 1083922 - RNA, 22 nt, Human
cugaggcugggcuugccuucuu

SEQ ID NO: 1083923 - RNA, 22 nt, Human
ugaaggccuaacuuccagugcu

SEQ ID NO: 1083924 - RNA, 22 nt, Human
uuauuucauauaauguuaucaa

SEQ ID NO: 1083925 - RNA, 22 nt, Human
ucaucugucauccacaaagcug

SEQ ID NO: 1083926 - RNA, 22 nt, Human
auauuuaacuggucccaauaua

SEQ ID NO: 1083927 - RNA, 22 nt, Human
cagcugcccugccuugcccuua

SEQ ID NO: 1083928 - RNA, 22 nt, Human
cccuggaguccggagcucaccu

SEQ ID NO: 1083929 - RNA, 22 nt, Human
aagcgccacgagaagcuggacc

SEQ ID NO: 1083930 - RNA, 22 nt, Human
uuuauccagaaucaggauuuuu

SEQ ID NO: 1083931 - RNA, 22 nt, Human
aggaaggguucuuucuguuuau

SEQ ID NO: 1083932 - RNA, 22 nt, Human
gcaacagcauucucauugacau

SEQ ID NO: 1083933 - RNA, 22 nt, Human
gacaaagcagacaagauaauuc

SEQ ID NO: 1083934 - RNA, 22 nt, Human
gcccuggauguacaggcauguu

SEQ ID NO: 1083935 - RNA, 22 nt, Human
ccagcccugccucucagggccc

SEQ ID NO: 1083936 - RNA, 22 nt, Human
cuggaagaguccuaaacagaua

SEQ ID NO: 1083937 - RNA, 22 nt, Human
uuuagacacacuuuguauauuu

SEQ ID NO: 1083938 - RNA, 22 nt, Human
gccuggcacauugcaguggauu

SEQ ID NO: 1083939 - RNA, 22 nt, Human
ugggaagcacgcucagcagaaa

SEQ ID NO: 1083940 - RNA, 22 nt, Human
gcagagucccagcagguggugg

SEQ ID NO: 1083941 - RNA, 22 nt, Human
cagcuggguuuaguggggugug

SEQ ID NO: 1083942 - RNA, 22 nt, Human
gguguccucaugauuuucuaga

SEQ ID NO: 1083943 - RNA, 22 nt, Human
agcagcuggugagcaagcucag

SEQ ID NO: 1083944 - RNA, 22 nt, Human
ggcauuugagccauuggccugu

SEQ ID NO: 1083945 - RNA, 22 nt, Human
ucaagagacaggacguguuuca

SEQ ID NO: 1083946 - RNA, 22 nt, Human
uucucugaucuugcuagacuga

SEQ ID NO: 1083947 - RNA, 22 nt, Human
gaauucuuuucuuucugaaagu

SEQ ID NO: 1083948 - RNA, 22 nt, Human
ucucacuuuccagacuuuucaa

SEQ ID NO: 1083949 - RNA, 22 nt, Human
aagaccauugcuguauuuguag

SEQ ID NO: 1083950 - RNA, 22 nt, Human
gagacacaaacacauuuagagg

SEQ ID NO: 1083951 - RNA, 22 nt, Human
uguuucaaaacagugauaauuu

SEQ ID NO: 1083952 - RNA, 22 nt, Human
cuggagcuccagggucuccucu

SEQ ID NO: 1083953 - RNA, 22 nt, Human
gaugucuuuuuccaggcucuuu

SEQ ID NO: 1083954 - RNA, 22 nt, Human
cugagaguagcuggagaacauu

SEQ ID NO: 1083955 - RNA, 22 nt, Human
cuauuacauuucuggacauuca

SEQ ID NO: 1083956 - RNA, 22 nt, Human
uggcuucaaagguagcauacaa

SEQ ID NO: 1083957 - RNA, 22 nt, Human
uuugaacuguucuaggauuuaa

SEQ ID NO: 1083958 - RNA, 22 nt, Human
auaucauuauguuaugagcaca

SEQ ID NO: 1083959 - RNA, 22 nt, Human
guucagcuuacaaaauacaccu

SEQ ID NO: 1083960 - RNA, 22 nt, Human
aagauugucaggcuugcuguau

SEQ ID NO: 1083961 - RNA, 22 nt, Human
auuucucuuagcaagacauuac

SEQ ID NO: 1083962 - RNA, 22 nt, Human
gccccucccagucaggagcacu

SEQ ID NO: 1083963 - RNA, 22 nt, Human
aacacugagaggggaguggcac

SEQ ID NO: 1083964 - RNA, 18 nt, Human
cccagugcucacugccuc

SEQ ID NO: 1083965 - RNA, 22 nt, Human
ugcagagggacagccacagcuc

SEQ ID NO: 1083966 - RNA, 22 nt, Human
uccucagggaagaugagccuca

SEQ ID NO: 1083967 - RNA, 22 nt, Human
gagcugggucuccaccuuggca

SEQ ID NO: 1083968 - RNA, 22 nt, Human
gaggaaaauauucagggagguu

SEQ ID NO: 1083969 - RNA, 22 nt, Human
gcccaagcuggacugcaguggc

SEQ ID NO: 1083970 - RNA, 22 nt, Human
ucaguggaacugucugggugag

SEQ ID NO: 1083971 - RNA, 22 nt, Human
uacagcaugaucacaauggaaa

SEQ ID NO: 1083972 - RNA, 22 nt, Human
ucauugcaccccagucccagcu

SEQ ID NO: 1083973 - RNA, 22 nt, Human
caagcugguaucagcuagagcg

SEQ ID NO: 1083974 - RNA, 22 nt, Human
caagggcuucaaguggccaaga

SEQ ID NO: 1083975 - RNA, 22 nt, Human
acugccugccucugauucugca

SEQ ID NO: 1083976 - RNA, 22 nt, Human
guuucuuaccacuuggaccucu

SEQ ID NO: 1083977 - RNA, 22 nt, Human
ccagcagagcauggggaggaag

SEQ ID NO: 1083978 - RNA, 22 nt, Human
gucucagagagcuacucucuua

SEQ ID NO: 1083979 - RNA, 22 nt, Human
caagggcauugcuugggaccuu

SEQ ID NO: 1083980 - RNA, 22 nt, Human
agcuguguguuuccacugagcu

SEQ ID NO: 1083981 - RNA, 22 nt, Human
ugccuuuucuguagcucuggaa

SEQ ID NO: 1083982 - RNA, 22 nt, Human
uguaacacucaaucuguuuaac

SEQ ID NO: 1083983 - RNA, 22 nt, Human
cagcccuggugccaagguuccc

SEQ ID NO: 1083984 - RNA, 22 nt, Human
gugucacaugguuuacugcagc

SEQ ID NO: 1083985 - RNA, 22 nt, Human
ggcuggaaguccaagaucaagg

SEQ ID NO: 1083986 - RNA, 18 nt, Human
agcagcugugccacacug

SEQ ID NO: 1083987 - RNA, 22 nt, Human
cagggccugucacgacgcucau

SEQ ID NO: 1083988 - RNA, 22 nt, Human
uggcucaguuuagcagcucagu

SEQ ID NO: 1083989 - RNA, 22 nt, Human
ucugacuuccuuuucugaucca

SEQ ID NO: 1083990 - RNA, 22 nt, Human
auuauuacuccugauuguacug

SEQ ID NO: 1083991 - RNA, 22 nt, Human
aggaagggauacauaggauagu

SEQ ID NO: 1083992 - RNA, 22 nt, Human
caguacuuugcaucauuccacu

SEQ ID NO: 1083993 - RNA, 22 nt, Human
ggccacugccuccgccauggcu

SEQ ID NO: 1083994 - RNA, 22 nt, Human
aucauacacucacauaaacaga

SEQ ID NO: 1083995 - RNA, 22 nt, Human
auguucuguuuuguaauucaua

SEQ ID NO: 1083996 - RNA, 22 nt, Human
uugguucaacuuuucuaaguag

SEQ ID NO: 1083997 - RNA, 22 nt, Human
uagaugaccuuguguuaggcaa

SEQ ID NO: 1083998 - RNA, 22 nt, Human
ucagaggagaccaaggggaaua

SEQ ID NO: 1083999 - RNA, 22 nt, Human
cacugggcuuuguaguuagcau

SEQ ID NO: 1084000 - RNA, 22 nt, Human
ccaggcugcuuagccuuaucuu

SEQ ID NO: 1084001 - RNA, 22 nt, Human
cugggccuaacccacagcguuu

SEQ ID NO: 1084002 - RNA, 22 nt, Human
agauuucaaugugagcauuagu

SEQ ID NO: 1084003 - RNA, 22 nt, Human
uggcucagauuuuuguaggcuu

SEQ ID NO: 1084004 - RNA, 22 nt, Human
aaagcagagcagggcacuuaug

SEQ ID NO: 1084005 - RNA, 22 nt, Human
ccagucacagguguguuuauau

SEQ ID NO: 1084006 - RNA, 22 nt, Human
agagcugggaccgucuggaagu

SEQ ID NO: 1084007 - RNA, 22 nt, Human
gaggaaaagagacagguuauug

SEQ ID NO: 1084008 - RNA, 22 nt, Human
acaaacagaguugaaaaauagg

SEQ ID NO: 1084009 - RNA, 22 nt, Human
gaggagaagcuauuggaaggac

SEQ ID NO: 1084010 - RNA, 22 nt, Human
cugagccaaggggacagugaca

SEQ ID NO: 1084011 - RNA, 22 nt, Human
aagcgcagacacagagagugga

SEQ ID NO: 1084012 - RNA, 22 nt, Human
ugcacacaaguuggagaaugaa

SEQ ID NO: 1084013 - RNA, 22 nt, Human
uaauuucacaguucaacgcaca

SEQ ID NO: 1084014 - RNA, 21 nt, Human
ggagauggguaucgccugggc

SEQ ID NO: 1084015 - RNA, 22 nt, Human
acauuucaguaaguguuaauuu

SEQ ID NO: 1084016 - RNA, 22 nt, Human
ccagagucccuguucucggccu

SEQ ID NO: 1084017 - RNA, 22 nt, Human
cagcagguauguuuguucagca

SEQ ID NO: 1084018 - RNA, 22 nt, Human
auacaagacucagcacagacgg

SEQ ID NO: 1084019 - RNA, 22 nt, Human
auuuugaagggaauugaaguuc

SEQ ID NO: 1084020 - RNA, 22 nt, Human
uuuucauuguaaaucaggaaac

SEQ ID NO: 1084021 - RNA, 22 nt, Human
auugacuuccauagcuaccugg

SEQ ID NO: 1084022 - RNA, 22 nt, Human
agagucaaaauuuaccagaaug

SEQ ID NO: 1084023 - RNA, 22 nt, Human
cagaggccaccuguggccacug

SEQ ID NO: 1084024 - RNA, 22 nt, Human
acuauacauugaauguuaaggu

SEQ ID NO: 1084025 - RNA, 22 nt, Human
guucagauuugacugguuucuc

SEQ ID NO: 1084026 - RNA, 22 nt, Human
gaaauacaaagccagccauuuu

SEQ ID NO: 1084027 - RNA, 22 nt, Human
ggaaaucaagaagcagaugagu

SEQ ID NO: 1084028 - RNA, 22 nt, Human
ugaggcucagugagcccugcag

SEQ ID NO: 1084029 - RNA, 22 nt, Human
cgguccuggcacuugcggcucc

SEQ ID NO: 1084030 - RNA, 22 nt, Human
gcugccugggcaggaggcgcug

SEQ ID NO: 1084031 - RNA, 22 nt, Human
cagcugaagagaggugcugagu

SEQ ID NO: 1084032 - RNA, 21 nt, Human
cugggcuuucucucaaagaca

SEQ ID NO: 1084033 - RNA, 22 nt, Human
ucuggcaguuccuuguugauau

SEQ ID NO: 1084034 - RNA, 22 nt, Human
ucauauuaggguaaugauaaga

SEQ ID NO: 1084035 - RNA, 22 nt, Human
gagauggcccuggcauguagcu

SEQ ID NO: 1084036 - RNA, 22 nt, Human
gaaaucugcuucuugcauagua

SEQ ID NO: 1084037 - RNA, 22 nt, Human
cuuacauuaaguaagagauuga

SEQ ID NO: 1084038 - RNA, 22 nt, Human
cagccagagaaagggcacugcc

SEQ ID NO: 1084039 - RNA, 22 nt, Human
cugccuggccacaacccagggu

SEQ ID NO: 1084040 - RNA, 22 nt, Human
ggaggccaaagugugggcggcu

SEQ ID NO: 1084041 - RNA, 21 nt, Human
caguuacagccaggacaaggc

SEQ ID NO: 1084042 - RNA, 22 nt, Human
ucacacguccuugcuacuccuc

SEQ ID NO: 1084043 - RNA, 22 nt, Human
ugccucugugggccuuccuggc

SEQ ID NO: 1084044 - RNA, 22 nt, Human
uacagaguggugagaucuuuug

SEQ ID NO: 1084045 - RNA, 22 nt, Human
gucaacauguucugggugaaug

SEQ ID NO: 1084046 - RNA, 22 nt, Human
ccugggcuuugcuggcaaggcc

SEQ ID NO: 1084047 - RNA, 22 nt, Human
cggggacacacuggcagcuccu

SEQ ID NO: 1084048 - RNA, 22 nt, Human
gccaggaagugcagcccugcca

SEQ ID NO: 1084049 - RNA, 22 nt, Human
ucucuucuagcuucuugugguu

SEQ ID NO: 1084050 - RNA, 22 nt, Human
caggacagagcccagacugugu

SEQ ID NO: 1084051 - RNA, 22 nt, Human
uauuuucuggacagucuugcuu

SEQ ID NO: 1084052 - RNA, 22 nt, Human
gggacagcuguagugcuuggcu

SEQ ID NO: 1084053 - RNA, 17 nt, Human
ggaaaagaagaguagga

SEQ ID NO: 1084054 - RNA, 22 nt, Human
aggacccugcucaagcaucucc

SEQ ID NO: 1084055 - RNA, 22 nt, Human
uguaaggagugugaguuugagu

SEQ ID NO: 1084056 - RNA, 22 nt, Human
ggcugagugcugcuguucacga

SEQ ID NO: 1084057 - RNA, 22 nt, Human
gccaagcucaccuucugaugga

SEQ ID NO: 1084058 - RNA, 22 nt, Human
gcuggggagcuagaccucagca

SEQ ID NO: 1084059 - RNA, 22 nt, Human
ugaaugcaagucacacauuucu

SEQ ID NO: 1084060 - RNA, 22 nt, Human
guuuauuauucaacuucauguu

SEQ ID NO: 1084061 - RNA, 22 nt, Human
agggccugaggcugacggggag

SEQ ID NO: 1084062 - RNA, 22 nt, Human
aggcucagccugggccuagagc

SEQ ID NO: 1084063 - RNA, 22 nt, Human
aaauaugagauguucucuuucg

SEQ ID NO: 1084064 - RNA, 22 nt, Human
accacuguaucuccagcacauu

SEQ ID NO: 1084065 - RNA, 22 nt, Human
agagaaaugggguaaucuuuca

SEQ ID NO: 1084066 - RNA, 22 nt, Human
uggcucuguucgccaucaggag

SEQ ID NO: 1084067 - RNA, 22 nt, Human
ugucucuuggcucuaucacuua

SEQ ID NO: 1084068 - RNA, 22 nt, Human
uuuagcauguuccuuucauaga

SEQ ID NO: 1084069 - RNA, 22 nt, Human
gaagcagcuagcccacuaguca

SEQ ID NO: 1084070 - RNA, 22 nt, Human
uuggagagcaguaaaccacacu

SEQ ID NO: 1084071 - RNA, 22 nt, Human
gggcugagggccaauuccuacu

SEQ ID NO: 1084072 - RNA, 22 nt, Human
ugggcucucucaccuggaggcu

SEQ ID NO: 1084073 - RNA, 22 nt, Human
aucaacaugugagagcaccagu

SEQ ID NO: 1084074 - RNA, 22 nt, Human
augaggcucucaggggagcugu

SEQ ID NO: 1084075 - RNA, 22 nt, Human
aagaagcaugagaagauuuuau

SEQ ID NO: 1084076 - RNA, 22 nt, Human
gucugagaacuacugaggauaa

SEQ ID NO: 1084077 - RNA, 22 nt, Human
aaagucacauauaacaagggca

SEQ ID NO: 1084078 - RNA, 22 nt, Human
cugagggcaugaacauuccaua

SEQ ID NO: 1084079 - RNA, 22 nt, Human
cccaggaaguggagguugcagu

SEQ ID NO: 1084080 - RNA, 22 nt, Human
cugacaggguagacagagggca

SEQ ID NO: 1084081 - RNA, 22 nt, Human
cuaccggguucucagccaggca

SEQ ID NO: 1084082 - RNA, 22 nt, Human
uuacacagacauggcaucauga

SEQ ID NO: 1084083 - RNA, 21 nt, Human
ucagcagcuuuugcagucccu

SEQ ID NO: 1084084 - RNA, 22 nt, Human
ggccugugcugucagcccuagu

SEQ ID NO: 1084085 - RNA, 22 nt, Human
cugugccuaagaugcaugucuc

SEQ ID NO: 1084086 - RNA, 22 nt, Human
gcucuccaaacccuguggcuuu

SEQ ID NO: 1084087 - RNA, 22 nt, Human
uccacuugcccucuucugugcu

SEQ ID NO: 1084088 - RNA, 22 nt, Human
agggcucugggguggcagagau

SEQ ID NO: 1084089 - RNA, 19 nt, Human
acccagagcccuuugcagg

SEQ ID NO: 1084090 - RNA, 22 nt, Human
uagcuaucuguguccagaucca

SEQ ID NO: 1084091 - RNA, 22 nt, Human
gaaggcuugcagcucuguggca

SEQ ID NO: 1084092 - RNA, 22 nt, Human
aaagcaauugugguuuuuguca

SEQ ID NO: 1084093 - RNA, 21 nt, Human
uggcugccuacaugcugcagg

SEQ ID NO: 1084094 - RNA, 22 nt, Human
guuuacauaugucugucugcac

SEQ ID NO: 1084095 - RNA, 22 nt, Human
cucagacugguggguaaaaccu

SEQ ID NO: 1084096 - RNA, 22 nt, Human
auguaugagagauucuuuuauu

SEQ ID NO: 1084097 - RNA, 19 nt, Human
ccaggaaccccuagcuacc

SEQ ID NO: 1084098 - RNA, 22 nt, Human
cagugucuuauuuguagcucag

SEQ ID NO: 1084099 - RNA, 22 nt, Human
ccaggacuuauuacaguauaac

SEQ ID NO: 1084100 - RNA, 22 nt, Human
uaagaacaguagaacaguaggu

SEQ ID NO: 1084101 - RNA, 22 nt, Human
cugcagccuccuccagcuacgu

SEQ ID NO: 1084102 - RNA, 22 nt, Human
aaagccuuggucaucugguucc

SEQ ID NO: 1084103 - RNA, 22 nt, Human
uggcugaguuccuggcacacgg

SEQ ID NO: 1084104 - RNA, 22 nt, Human
gcuuccugauauucauacuguu

SEQ ID NO: 1084105 - RNA, 22 nt, Human
ggcuccagggaguggagagaag

SEQ ID NO: 1084106 - RNA, 22 nt, Human
acaucaguccaccacugcaguu

SEQ ID NO: 1084107 - RNA, 20 nt, Human
uggcaggaggcagcagugga

SEQ ID NO: 1084108 - RNA, 22 nt, Human
gcugcccaggguggagccggcu

SEQ ID NO: 1084109 - RNA, 22 nt, Human
augaauacgcggucauacacau

SEQ ID NO: 1084110 - RNA, 22 nt, Human
ccacuguuuuucaguuaacuuu

SEQ ID NO: 1084111 - RNA, 22 nt, Human
acugugaugaugaagcaugguu

SEQ ID NO: 1084112 - RNA, 22 nt, Human
aggaggaacucagaaagaaggu

SEQ ID NO: 1084113 - RNA, 22 nt, Human
uuugucagucaugucugcuuuu

SEQ ID NO: 1084114 - RNA, 22 nt, Human
uggcagguuuccuccucauagu

SEQ ID NO: 1084115 - RNA, 22 nt, Human
ugcugccaaaugcgagcucugu

SEQ ID NO: 1084116 - RNA, 22 nt, Human
aggcuccuuguucaucauccau

SEQ ID NO: 1084117 - RNA, 22 nt, Human
gaauuuaaauuuaaaucuacca

SEQ ID NO: 1084118 - RNA, 22 nt, Human
cugccagcaaugugaccaugcu

SEQ ID NO: 1084119 - RNA, 22 nt, Human
ccacuguaaguuugaaaauaac

SEQ ID NO: 1084120 - RNA, 22 nt, Human
aaggaggagcggaggcuuguug

SEQ ID NO: 1084121 - RNA, 22 nt, Human
cuucaagauccauagauauugc

SEQ ID NO: 1084122 - RNA, 22 nt, Human
cugcugggucuaugcaagugga

SEQ ID NO: 1084123 - RNA, 22 nt, Human
aaggagucucagcugggccuga

SEQ ID NO: 1084124 - RNA, 22 nt, Human
cucuuucugauucgcugggacc

SEQ ID NO: 1084125 - RNA, 22 nt, Human
cugggagcaccauacuuguuuc

SEQ ID NO: 1084126 - RNA, 22 nt, Human
uucauucuuauuugugaucugg

SEQ ID NO: 1084127 - RNA, 22 nt, Human
cuggugcuggagccuagucccu

SEQ ID NO: 1084128 - RNA, 22 nt, Human
caggaaauguauaauuuuauaa

SEQ ID NO: 1084129 - RNA, 22 nt, Human
acacaguaucaaauuucaucuu

SEQ ID NO: 1084130 - RNA, 22 nt, Human
uguaagaauaaugauuucuaag

SEQ ID NO: 1084131 - RNA, 22 nt, Human
gucacacagguugaaaugcagu

SEQ ID NO: 1084132 - RNA, 22 nt, Human
uugaaauggaagugaaaauucu

SEQ ID NO: 1084133 - RNA, 22 nt, Human
uccuuugguuguagacaggaau

SEQ ID NO: 1084134 - RNA, 23 nt, Human
agcugcugggccugccguggccu

SEQ ID NO: 1084135 - RNA, 22 nt, Human
uguuugacaacaggcucacaga

SEQ ID NO: 1084136 - RNA, 22 nt, Human
ugauuuccccagucuugcugcu

SEQ ID NO: 1084137 - RNA, 22 nt, Human
gagguggccaagcgaggaaggg

SEQ ID NO: 1084138 - RNA, 22 nt, Human
ucugucuccucugaggugccag

SEQ ID NO: 1084139 - RNA, 22 nt, Human
cagagccacugucugccaggca

SEQ ID NO: 1084140 - RNA, 21 nt, Human
ggugggguaccuaagguagcu

SEQ ID NO: 1084141 - RNA, 22 nt, Human
ugcuucugaacucagcaugugg

SEQ ID NO: 1084142 - RNA, 22 nt, Human
ggguguccugugccaagcuggg

SEQ ID NO: 1084143 - RNA, 22 nt, Human
gccuggggaacuugauccuguc

SEQ ID NO: 1084144 - RNA, 22 nt, Human
acagaaagauaggcacaagguc

SEQ ID NO: 1084145 - RNA, 22 nt, Human
auuuacagaagcauguaauagc

SEQ ID NO: 1084146 - RNA, 22 nt, Human
ugugucagagguagagauggca

SEQ ID NO: 1084147 - RNA, 22 nt, Human
acagaauuaacauuugaugaau

SEQ ID NO: 1084148 - RNA, 22 nt, Human
guguuuuaagaaagaagcucag

SEQ ID NO: 1084149 - RNA, 22 nt, Human
gggcacagucuaaaguugggcc

SEQ ID NO: 1084150 - RNA, 22 nt, Human
gcucagccgaacuucagagcag

SEQ ID NO: 1084151 - RNA, 22 nt, Human
ggaagccaugagggacaguucu

SEQ ID NO: 1084152 - RNA, 22 nt, Human
ggcauggcuggguucuggugag

SEQ ID NO: 1084153 - RNA, 17 nt, Human
agaugcuggccacaugu

SEQ ID NO: 1084154 - RNA, 22 nt, Human
ggcaaggggucaggcugagaca

SEQ ID NO: 1084155 - RNA, 22 nt, Human
agcucccugcacgacccugccc

SEQ ID NO: 1084156 - RNA, 22 nt, Human
uaacaaagguugccaaacuaag

SEQ ID NO: 1084157 - RNA, 19 nt, Human
cagguaacauaugcacaaa

SEQ ID NO: 1084158 - RNA, 22 nt, Human
ucugccuggagaguucuucucu

SEQ ID NO: 1084159 - RNA, 19 nt, Human
augucuggguaacagcugc

SEQ ID NO: 1084160 - RNA, 22 nt, Human
uucugagauuguuaggcacuaa

SEQ ID NO: 1084161 - RNA, 22 nt, Human
gacagcaggagaucaugauaga

SEQ ID NO: 1084162 - RNA, 19 nt, Human
guugaaaguaggugagggu

SEQ ID NO: 1084163 - RNA, 22 nt, Human
aauguuucaauuaagucuuuua

SEQ ID NO: 1084164 - RNA, 22 nt, Human
cauuuguuggucagauuguagu

SEQ ID NO: 1084165 - RNA, 22 nt, Human
uuguuuuugugaggcagcccau

SEQ ID NO: 1084166 - RNA, 22 nt, Human
gaggaggaggaaguggaaccca

SEQ ID NO: 1084167 - RNA, 22 nt, Human
uucagaaagugaaucuuguuau

SEQ ID NO: 1084168 - RNA, 22 nt, Human
uuccaggacaagauguuucagg

SEQ ID NO: 1084169 - RNA, 22 nt, Human
auccagcuuugucuggucuucg

SEQ ID NO: 1084170 - RNA, 22 nt, Human
uggcugaggagagggcggaagu

SEQ ID NO: 1084171 - RNA, 22 nt, Human
gggccacacagaaccuccuggu

SEQ ID NO: 1084172 - RNA, 22 nt, Human
caagaauccuguucuugaagau

SEQ ID NO: 1084173 - RNA, 22 nt, Human
acccucagcuggagauugaauu

SEQ ID NO: 1084174 - RNA, 22 nt, Human
ugaguuuuggaagacaacacaa

SEQ ID NO: 1084175 - RNA, 22 nt, Human
cagggacaaagugagaaaggaa

SEQ ID NO: 1084176 - RNA, 19 nt, Human
ucugccucuggucaggcuc

SEQ ID NO: 1084177 - RNA, 22 nt, Human
agguggaacguucaggugcuag

SEQ ID NO: 1084178 - RNA, 22 nt, Human
cagagaaagaagcccauucauu

SEQ ID NO: 1084179 - RNA, 22 nt, Human
uucuccucuguuggccuucccu

SEQ ID NO: 1084180 - RNA, 22 nt, Human
uuccaugugaguacacugugau

SEQ ID NO: 1084181 - RNA, 22 nt, Human
gggguggaucaggcaggcccag

SEQ ID NO: 1084182 - RNA, 22 nt, Human
acauacauugccucauugguaa

SEQ ID NO: 1084183 - RNA, 22 nt, Human
cugaggugcuagggucccugcu

SEQ ID NO: 1084184 - RNA, 22 nt, Human
gccugccacgcaugcagaguca

SEQ ID NO: 1084185 - RNA, 22 nt, Human
acuucaaauuuucagaagaaau

SEQ ID NO: 1084186 - RNA, 22 nt, Human
agccaggccuuuucucaagguu

SEQ ID NO: 1084187 - RNA, 22 nt, Human
cugugagcuggguggccaggac

SEQ ID NO: 1084188 - RNA, 22 nt, Human
guauuugauagauuucaaagga

SEQ ID NO: 1084189 - RNA, 22 nt, Human
agcagggcuguguagguaauga

SEQ ID NO: 1084190 - RNA, 22 nt, Human
uggccuuggacagagcgcuccu

SEQ ID NO: 1084191 - RNA, 22 nt, Human
ccugcugucaguggggcaggca

SEQ ID NO: 1084192 - RNA, 22 nt, Human
ggagacagugguagggccuaag

SEQ ID NO: 1084193 - RNA, 22 nt, Human
auauuugugguuuuuggcuccu

SEQ ID NO: 1084194 - RNA, 22 nt, Human
gguggguauugaauacaggugu

SEQ ID NO: 1084195 - RNA, 22 nt, Human
auuucauccauuaagaguacuc

SEQ ID NO: 1084196 - RNA, 22 nt, Human
ccaggccugcaucugcugcgca

SEQ ID NO: 1084197 - RNA, 22 nt, Human
aguaugaacggaaggccuggga

SEQ ID NO: 1084198 - RNA, 22 nt, Human
cacaaauaccaguuuccuaaca

SEQ ID NO: 1084199 - RNA, 22 nt, Human
uguauuuucugaggagcauuag

SEQ ID NO: 1084200 - RNA, 22 nt, Human
uucccacauucuuuacauucau

SEQ ID NO: 1084201 - RNA, 22 nt, Human
gggcagcaaaucugagucuggu

SEQ ID NO: 1084202 - RNA, 22 nt, Human
cgcaggcuuuagaaucugcuac

SEQ ID NO: 1084203 - RNA, 22 nt, Human
ucugaaauacugcagguucucu

SEQ ID NO: 1084204 - RNA, 22 nt, Human
auuuaaaugcuuaagaggguuu

SEQ ID NO: 1084205 - RNA, 19 nt, Human
ggcuccuguggcugcagcc

SEQ ID NO: 1084206 - RNA, 22 nt, Human
ugagaaaaguguggaggucaau

SEQ ID NO: 1084207 - RNA, 22 nt, Human
acaaagugaauugcaucgaguu

SEQ ID NO: 1084208 - RNA, 22 nt, Human
acagcugugaagcaagcacucu

SEQ ID NO: 1084209 - RNA, 17 nt, Human
ccugccugagccauagc

SEQ ID NO: 1084210 - RNA, 22 nt, Human
agcacuuugggagauaaagcug

SEQ ID NO: 1084211 - RNA, 23 nt, Human
aaggucacagaacuuagcaagcc

SEQ ID NO: 1084212 - RNA, 22 nt, Human
uucacagggccacuggcaggag

SEQ ID NO: 1084213 - RNA, 22 nt, Human
ugagaacauacaaacagagaaa

SEQ ID NO: 1084214 - RNA, 19 nt, Human
uucuggggccuggccuugg

SEQ ID NO: 1084215 - RNA, 19 nt, Human
uggucucugucucuuugca

SEQ ID NO: 1084216 - RNA, 22 nt, Human
auaaggcuuaaaccuuguugcc

SEQ ID NO: 1084217 - RNA, 22 nt, Human
uccaggaauagaucagagauuu

SEQ ID NO: 1084218 - RNA, 22 nt, Human
gagagcugggaaagccguggag

SEQ ID NO: 1084219 - RNA, 22 nt, Human
aaguaaauguuggagcucaaau

SEQ ID NO: 1084220 - RNA, 17 nt, Human
ucaggauguagcaguag

SEQ ID NO: 1084221 - RNA, 22 nt, Human
uuucugaauuccuaggauguug

SEQ ID NO: 1084222 - RNA, 22 nt, Human
ugagagucucagaccuccuggu

SEQ ID NO: 1084223 - RNA, 22 nt, Human
auuuauuaugggauuuggcaca

SEQ ID NO: 1084224 - RNA, 22 nt, Human
agcaggaggagagccuggcggu

SEQ ID NO: 1084225 - RNA, 22 nt, Human
uagaaacaaagaccugggugcu

SEQ ID NO: 1084226 - RNA, 22 nt, Human
gaguuaauaggguucuuuguga

SEQ ID NO: 1084227 - RNA, 22 nt, Human
uuuugguagaaucaacaaugua

SEQ ID NO: 1084228 - RNA, 22 nt, Human
aggggccucgcaggaccgcucc

SEQ ID NO: 1084229 - RNA, 20 nt, Human
cuggggaggaggauguguuc

SEQ ID NO: 1084230 - RNA, 20 nt, Human
ugaagcagccuugauucugu

SEQ ID NO: 1084231 - RNA, 22 nt, Human
guggccugagcuucagaguugg

SEQ ID NO: 1084232 - RNA, 22 nt, Human
cccuggagaaggggacgcggag

SEQ ID NO: 1084233 - RNA, 16 nt, Human
ccugggcucuguugga

SEQ ID NO: 1084234 - RNA, 22 nt, Human
cuguuguuccgggagcugcagc

SEQ ID NO: 1084235 - RNA, 22 nt, Human
caggccugguugagcccugaga

SEQ ID NO: 1084236 - RNA, 22 nt, Human
agucccagccuguaggauuggg

SEQ ID NO: 1084237 - RNA, 21 nt, Human
gauuucacuuaccuucauuua

SEQ ID NO: 1084238 - RNA, 22 nt, Human
aaugauggucauggcaacuuuu

SEQ ID NO: 1084239 - RNA, 22 nt, Human
aaggcacugaaaaauugugugu

SEQ ID NO: 1084240 - RNA, 22 nt, Human
ugcaggaggcuuuauucaggau

SEQ ID NO: 1084241 - RNA, 22 nt, Human
cccaggaaguugagacugcagu

SEQ ID NO: 1084242 - RNA, 22 nt, Human
aagcauuugguucugaagacuc

SEQ ID NO: 1084243 - RNA, 22 nt, Human
gagaaguuucugguuugcauag

SEQ ID NO: 1084244 - RNA, 22 nt, Human
auuauuaggacuacugggguug

SEQ ID NO: 1084245 - RNA, 19 nt, Human
aagaacuaugugauuacag

SEQ ID NO: 1084246 - RNA, 22 nt, Human
aagcagaaguugaucuaccaua

SEQ ID NO: 1084247 - RNA, 22 nt, Human
gucaccaggucugaugcagcca

SEQ ID NO: 1084248 - RNA, 22 nt, Human
ucugaaauaaaugcacuguuag

SEQ ID NO: 1084249 - RNA, 22 nt, Human
ggaggggagucucccaaagccg

SEQ ID NO: 1084250 - RNA, 22 nt, Human
gaggaacagcagccacaugucc

SEQ ID NO: 1084251 - RNA, 22 nt, Human
gggugaagcuccugcaggggcc

SEQ ID NO: 1084252 - RNA, 19 nt, Human
uggcuuccaucucucucau

SEQ ID NO: 1084253 - RNA, 22 nt, Human
cacaguuagcuccagucuuagc

SEQ ID NO: 1084254 - RNA, 21 nt, Human
aucuuuauuacgcagagaaga

SEQ ID NO: 1084255 - RNA, 22 nt, Human
ccugagcugaacuaagcaguuu

SEQ ID NO: 1084256 - RNA, 22 nt, Human
uggaggcauaggccugggcccu

SEQ ID NO: 1084257 - RNA, 22 nt, Human
cucaggaugcaggucacaggac

SEQ ID NO: 1084258 - RNA, 22 nt, Human
acagugauuucauccuucuggg

SEQ ID NO: 1084259 - RNA, 22 nt, Human
auuguucauguaugaauaaaua

SEQ ID NO: 1084260 - RNA, 19 nt, Human
uggagacugagagugagca

SEQ ID NO: 1084261 - RNA, 22 nt, Human
uggcucuguugagguauggauu

SEQ ID NO: 1084262 - RNA, 22 nt, Human
uaucuguuccaggcacucagcu

SEQ ID NO: 1084263 - RNA, 18 nt, Human
aagcugcccucaggcagg

SEQ ID NO: 1084264 - RNA, 22 nt, Human
uauagcauggcuauauuguugc

SEQ ID NO: 1084265 - RNA, 22 nt, Human
aagccagccagugccagucuua

SEQ ID NO: 1084266 - RNA, 22 nt, Human
agccaggccagacucacacccu

SEQ ID NO: 1084267 - RNA, 22 nt, Human
uggaaagaauuccuaugguuca

SEQ ID NO: 1084268 - RNA, 22 nt, Human
uugcugaagugaagguauguuu

SEQ ID NO: 1084269 - RNA, 22 nt, Human
cagacacagauaugcauauggc

SEQ ID NO: 1084270 - RNA, 22 nt, Human
auuuuaauaagauucccaagua

SEQ ID NO: 1084271 - RNA, 22 nt, Human
gaagcagcaaaucugcaguauc

SEQ ID NO: 1084272 - RNA, 22 nt, Human
uuggaauuuaguaaaauaaugc

SEQ ID NO: 1084273 - RNA, 22 nt, Human
aggcuucuugauaaaaugcaga

SEQ ID NO: 1084274 - RNA, 22 nt, Human
uuucauuauacagcuucauaaa

SEQ ID NO: 1084275 - RNA, 22 nt, Human
uacaguuuuuauucaugacaag

SEQ ID NO: 1084276 - RNA, 23 nt, Human
agcaaauaaucugcuugcuuuuu

SEQ ID NO: 1084277 - RNA, 22 nt, Human
ucagggaaaacaucccgccuaa

SEQ ID NO: 1084278 - RNA, 22 nt, Human
uaggaagaaacuuucccugcag

SEQ ID NO: 1084279 - RNA, 21 nt, Human
ccagguacauggagaaugugg

SEQ ID NO: 1084280 - RNA, 22 nt, Human
acauucaugucccacuucuagc

SEQ ID NO: 1084281 - RNA, 18 nt, Human
cucucugggugaggacaa

SEQ ID NO: 1084282 - RNA, 22 nt, Human
uauuaagauacguaguuguaaa

SEQ ID NO: 1084283 - RNA, 21 nt, Human
uagcuucuugaggcuuggccg

SEQ ID NO: 1084284 - RNA, 22 nt, Human
uagaaagcuugggguguuuaaa

SEQ ID NO: 1084285 - RNA, 22 nt, Human
cugaggcaugggaaguugggug

SEQ ID NO: 1084286 - RNA, 20 nt, Human
auuccauaguuggcacuuuu

SEQ ID NO: 1084287 - RNA, 22 nt, Human
gcacacaugcaugcacaggagu

SEQ ID NO: 1084288 - RNA, 20 nt, Human
cugagcgucuaagaggugag

SEQ ID NO: 1084289 - RNA, 22 nt, Human
cauuuuauguuuauggagugcu

SEQ ID NO: 1084290 - RNA, 22 nt, Human
ccauuuuauuagugacauuuag

SEQ ID NO: 1084291 - RNA, 22 nt, Human
uggaacacuguggaugagaaga

SEQ ID NO: 1084292 - RNA, 22 nt, Human
aggaaaaucgagucuggaggca

SEQ ID NO: 1084293 - RNA, 21 nt, Human
ugaggcaggggugcuuuuguc

SEQ ID NO: 1084294 - RNA, 22 nt, Human
gcaguggauccaaugguaucuu

SEQ ID NO: 1084295 - RNA, 22 nt, Human
auuucacagcugcuguucaggu

SEQ ID NO: 1084296 - RNA, 22 nt, Human
aggccaggcaacauucugaagu

SEQ ID NO: 1084297 - RNA, 22 nt, Human
aaagauuucagaagccugugcc

SEQ ID NO: 1084298 - RNA, 22 nt, Human
uuguuuuuaaacaugugacuga

SEQ ID NO: 1084299 - RNA, 22 nt, Human
agucaggguuguaggcucaccc

SEQ ID NO: 1084300 - RNA, 22 nt, Human
aaacaaugaaauucauucuuca

SEQ ID NO: 1084301 - RNA, 22 nt, Human
auuaauaaaauaccacuuuguu

SEQ ID NO: 1084302 - RNA, 22 nt, Human
uuuguguguguauaggaaagga

SEQ ID NO: 1084303 - RNA, 22 nt, Human
acacagaguuugacacauggga

SEQ ID NO: 1084304 - RNA, 22 nt, Human
uuagcugucaagguggcugcag

SEQ ID NO: 1084305 - RNA, 22 nt, Human
acagaauaagguuuaucucucc

SEQ ID NO: 1084306 - RNA, 22 nt, Human
uugggugcugucauggggcacg

SEQ ID NO: 1084307 - RNA, 22 nt, Human
ucgagucauguucucccauuaa

SEQ ID NO: 1084308 - RNA, 22 nt, Human
cugagcagcacagggcgccagg

SEQ ID NO: 1084309 - RNA, 18 nt, Human
gcugucugaggucugagg

SEQ ID NO: 1084310 - RNA, 21 nt, Human
caaagccaggcaacucucucc

SEQ ID NO: 1084311 - RNA, 23 nt, Human
acuuuauugaccccaggucaguu

SEQ ID NO: 1084312 - RNA, 20 nt, Human
agcuggagaagggcccuucc

SEQ ID NO: 1084313 - RNA, 22 nt, Human
gccuccugcccagaugagugau

SEQ ID NO: 1084314 - RNA, 22 nt, Human
gucacuguauccagguuccagc

SEQ ID NO: 1084315 - RNA, 22 nt, Human
uaguucuagccagugaaaugua

SEQ ID NO: 1084316 - RNA, 22 nt, Human
ucaggaagcuacugccagcagc

SEQ ID NO: 1084317 - RNA, 22 nt, Human
uguggccuccccacuucugggg

SEQ ID NO: 1084318 - RNA, 22 nt, Human
aguguuaacaugaaugguuucc

SEQ ID NO: 1084319 - RNA, 22 nt, Human
ugggaccaagucauuucuuuag

SEQ ID NO: 1084320 - RNA, 22 nt, Human
ugagccagauaagggcucacgc

SEQ ID NO: 1084321 - RNA, 22 nt, Human
cagcugagcaucacuagucugg

SEQ ID NO: 1084322 - RNA, 19 nt, Human
agggaauccggcugaggga

SEQ ID NO: 1084323 - RNA, 22 nt, Human
caugcagugaugcacugcauca

SEQ ID NO: 1084324 - RNA, 22 nt, Human
augauuucuauauaaacuuaaa

SEQ ID NO: 1084325 - RNA, 22 nt, Human
gacaggaaacaagaaggcagga

SEQ ID NO: 1084326 - RNA, 22 nt, Human
cacagcugccauggcugcacuu

SEQ ID NO: 1084327 - RNA, 22 nt, Human
gcugggaagagaugcacaugau

SEQ ID NO: 1084328 - RNA, 22 nt, Human
ggcugcagggcagcuggugugg

SEQ ID NO: 1084329 - RNA, 22 nt, Human
uuaugaaguuccuguuacagug

SEQ ID NO: 1084330 - RNA, 19 nt, Human
aguuauuucuaaauuuacc

SEQ ID NO: 1084331 - RNA, 22 nt, Human
uuagccauauagaaaaagagcu

SEQ ID NO: 1084332 - RNA, 22 nt, Human
cucacuguuuaauagcuggauc

SEQ ID NO: 1084333 - RNA, 22 nt, Human
guuacauuaaaaacauucacug

SEQ ID NO: 1084334 - RNA, 22 nt, Human
agaaaaacacaaucgggccucc

SEQ ID NO: 1084335 - RNA, 22 nt, Human
agccuggaagaaccugaagucu

SEQ ID NO: 1084336 - RNA, 22 nt, Human
auauccuuuucggaagagcagc

SEQ ID NO: 1084337 - RNA, 20 nt, Human
agacccuguguccuguggcc

SEQ ID NO: 1084338 - RNA, 22 nt, Human
cgcagcagccccgugguaggug

SEQ ID NO: 1084339 - RNA, 22 nt, Human
cugaggcugaagagggccuacg

SEQ ID NO: 1084340 - RNA, 22 nt, Human
ccagagaaauaaggggaaaaug

SEQ ID NO: 1084341 - RNA, 19 nt, Human
gcugugccucucuccugcu

SEQ ID NO: 1084342 - RNA, 22 nt, Human
ucuucagagacucugagccccu

SEQ ID NO: 1084343 - RNA, 22 nt, Human
uccagccaccaccuugauugcc

SEQ ID NO: 1084344 - RNA, 22 nt, Human
auauuucaugggguuccauacu

SEQ ID NO: 1084345 - RNA, 21 nt, Human
ggcugcugggagagcugcgug

SEQ ID NO: 1084346 - RNA, 22 nt, Human
ggguggaguagaaagaugaauu

SEQ ID NO: 1084347 - RNA, 22 nt, Human
ucaccugggagggcugugguag

SEQ ID NO: 1084348 - RNA, 22 nt, Human
uaacaaaguauuguuuguguau

SEQ ID NO: 1084349 - RNA, 22 nt, Human
aacaucaggaucuuguuacagu

SEQ ID NO: 1084350 - RNA, 22 nt, Human
uggcucugcaccucaguguacc

SEQ ID NO: 1084351 - RNA, 22 nt, Human
aaagguuugaggugggaagagg

SEQ ID NO: 1084352 - RNA, 22 nt, Human
cacauggaagagauacagugag

SEQ ID NO: 1084353 - RNA, 22 nt, Human
gugcucacugugagacguccug

SEQ ID NO: 1084354 - RNA, 22 nt, Human
cagggagcuggcuggcgugagu

SEQ ID NO: 1084355 - RNA, 22 nt, Human
uuaaacauuuuugaugaucgau

SEQ ID NO: 1084356 - RNA, 22 nt, Human
acacauguauggcacuuacauu

SEQ ID NO: 1084357 - RNA, 22 nt, Human
uuguaacaaagacacuccaaaa

SEQ ID NO: 1084358 - RNA, 23 nt, Human
cauaaaauauuaguaugguagca

SEQ ID NO: 1084359 - RNA, 22 nt, Human
aggcagucagcccugcuagggu

SEQ ID NO: 1084360 - RNA, 22 nt, Human
uaucacauaguguuuaguaaau

SEQ ID NO: 1084361 - RNA, 22 nt, Human
gccugaaguuucaugccucuau

SEQ ID NO: 1084362 - RNA, 22 nt, Human
acugcacuucacccugggugac

SEQ ID NO: 1084363 - RNA, 19 nt, Human
cuggaaggagggacuguuc

SEQ ID NO: 1084364 - RNA, 22 nt, Human
aggaaggacugcagcauuuggu

SEQ ID NO: 1084365 - RNA, 22 nt, Human
ugugaagauuuggcaugcagaa

SEQ ID NO: 1084366 - RNA, 22 nt, Human
uaaggccaauuacauauguuca

SEQ ID NO: 1084367 - RNA, 22 nt, Human
ucagggcaaagggcagaguuug

SEQ ID NO: 1084368 - RNA, 22 nt, Human
cuuucaaaacgcucuguaugca

SEQ ID NO: 1084369 - RNA, 22 nt, Human
ucagggaaacagguuuucccuu

SEQ ID NO: 1084370 - RNA, 22 nt, Human
gaaacacucaauuuaguaauuc

SEQ ID NO: 1084371 - RNA, 22 nt, Human
aguacaaaugcagccagaguag

SEQ ID NO: 1084372 - RNA, 22 nt, Human
gguccugcauugccagcaagcu

SEQ ID NO: 1084373 - RNA, 22 nt, Human
aguuaguagacuuuuccauuua

SEQ ID NO: 1084374 - RNA, 22 nt, Human
cucaugauguagcgaaugagaa

SEQ ID NO: 1084375 - RNA, 22 nt, Human
cccagggguaaggcgcagcgug

SEQ ID NO: 1084376 - RNA, 22 nt, Human
cuccuccagcucucccuggggg

SEQ ID NO: 1084377 - RNA, 22 nt, Human
gucccuggagcugagcagugcu

SEQ ID NO: 1084378 - RNA, 22 nt, Human
uugauacagcagccugugaucc

SEQ ID NO: 1084379 - RNA, 22 nt, Human
guggcucucgccagccugcggg

SEQ ID NO: 1084380 - RNA, 22 nt, Human
uuuguguggauggaaggcagua

SEQ ID NO: 1084381 - RNA, 22 nt, Human
uaaugcaguacugauauaaaca

SEQ ID NO: 1084382 - RNA, 22 nt, Human
cagugggauaugggggcagcau

SEQ ID NO: 1084383 - RNA, 22 nt, Human
ucugcucuccauacuuccgcac

SEQ ID NO: 1084384 - RNA, 22 nt, Human
acacaugcugauaagaauauaa

SEQ ID NO: 1084385 - RNA, 22 nt, Human
acugucaaaagagauuauauua

SEQ ID NO: 1084386 - RNA, 22 nt, Human
acacauauguggcaacuguaga

SEQ ID NO: 1084387 - RNA, 22 nt, Human
auaguacaagggaagagugaag

SEQ ID NO: 1084388 - RNA, 22 nt, Human
agcaggugaugugagucuggaa

SEQ ID NO: 1084389 - RNA, 22 nt, Human
agcagguguuuguaucauaagg

SEQ ID NO: 1084390 - RNA, 18 nt, Human
uggcaggggcaguacgcc

SEQ ID NO: 1084391 - RNA, 22 nt, Human
uucuagaacaggcaaaaccaau

SEQ ID NO: 1084392 - RNA, 22 nt, Human
ucugcagcuugcacaggcaggc

SEQ ID NO: 1084393 - RNA, 22 nt, Human
uuugaaagggacaaagucacug

SEQ ID NO: 1084394 - RNA, 22 nt, Human
cagcuggaggagcagcuuccag

SEQ ID NO: 1084395 - RNA, 22 nt, Human
agcagaaagcuuauuuugacug

SEQ ID NO: 1084396 - RNA, 22 nt, Human
ccugggcuguaccugugcgcgg

SEQ ID NO: 1084397 - RNA, 22 nt, Human
cauaacuugguguuggaaacug

SEQ ID NO: 1084398 - RNA, 22 nt, Human
uuuugaaagaguccugcuacag

SEQ ID NO: 1084399 - RNA, 22 nt, Human
ccagcagacacacaggcguggg

SEQ ID NO: 1084400 - RNA, 22 nt, Human
cucucugggggccaugccaaga

SEQ ID NO: 1084401 - RNA, 22 nt, Human
ugaagaagccaauugguaggcu

SEQ ID NO: 1084402 - RNA, 18 nt, Human
uuucacagauucaugacu

SEQ ID NO: 1084403 - RNA, 22 nt, Human
ugugaaagcaagucuaguucuc

SEQ ID NO: 1084404 - RNA, 22 nt, Human
cacaggagauugaucuauuggu

SEQ ID NO: 1084405 - RNA, 22 nt, Human
guccaggcuaagucccuucugc

SEQ ID NO: 1084406 - RNA, 22 nt, Human
gagccccaggacagcucuaguu

SEQ ID NO: 1084407 - RNA, 22 nt, Human
aaggagcuuguucgccuuccuc

SEQ ID NO: 1084408 - RNA, 22 nt, Human
aaauaguuagcccugcauauau

SEQ ID NO: 1084409 - RNA, 23 nt, Human
ugcuccagccucuuugauagugu

SEQ ID NO: 1084410 - RNA, 22 nt, Human
ugcugcugaucauuuauagucu

SEQ ID NO: 1084411 - RNA, 22 nt, Human
cauuucucauaauauuagcacu

SEQ ID NO: 1084412 - RNA, 22 nt, Human
guaaacaacacaaaucauuuga

SEQ ID NO: 1084413 - RNA, 22 nt, Human
uugcauuucccauugaguaaug

SEQ ID NO: 1084414 - RNA, 22 nt, Human
agagccugugauugucaucacc

SEQ ID NO: 1084415 - RNA, 22 nt, Human
agagucugaaugcucagaguug

SEQ ID NO: 1084416 - RNA, 22 nt, Human
uucaaaacagcuagauauugga

SEQ ID NO: 1084417 - RNA, 17 nt, Human
ggccuugggcugcucuu

SEQ ID NO: 1084418 - RNA, 22 nt, Human
cuugucugugucggauaaaacu

SEQ ID NO: 1084419 - RNA, 22 nt, Human
ugucuacagaauguuaauauuu

SEQ ID NO: 1084420 - RNA, 18 nt, Human
ucacaucaucccaugcuu

SEQ ID NO: 1084421 - RNA, 23 nt, Human
caucagugagggggaaucacuaa

SEQ ID NO: 1084422 - RNA, 22 nt, Human
uuugaaauuggcucauugguuu

SEQ ID NO: 1084423 - RNA, 22 nt, Human
uguauacaagucguguaaacuu

SEQ ID NO: 1084424 - RNA, 23 nt, Human
aaaugcagggucgcagguuacag

SEQ ID NO: 1084425 - RNA, 22 nt, Human
aauuuauauguaauuaggcaca

SEQ ID NO: 1084426 - RNA, 19 nt, Human
ugcauacauguuaacaugu

SEQ ID NO: 1084427 - RNA, 22 nt, Human
ucugccucgcuaacagcagcca

SEQ ID NO: 1084428 - RNA, 22 nt, Human
uccaggaaagcacugggcuggg

SEQ ID NO: 1084429 - RNA, 22 nt, Human
ucaggaacagcagggaggaaag

SEQ ID NO: 1084430 - RNA, 22 nt, Human
aucaggauucaguaucuccagc

SEQ ID NO: 1084431 - RNA, 18 nt, Human
ucugggcuucccgaggcu

SEQ ID NO: 1084432 - RNA, 22 nt, Human
cccaggaauuggaggcugcagu

SEQ ID NO: 1084433 - RNA, 22 nt, Human
uauguuauuuucauacaacaga

SEQ ID NO: 1084434 - RNA, 22 nt, Human
uauuuaaaauaagccccagugg

SEQ ID NO: 1084435 - RNA, 22 nt, Human
agaacuuacauuauagagcugu

SEQ ID NO: 1084436 - RNA, 22 nt, Human
uggcucugccacuaacuuggua

SEQ ID NO: 1084437 - RNA, 22 nt, Human
aaagguuuauugcuaugguugu

SEQ ID NO: 1084438 - RNA, 22 nt, Human
uuuccucuucgauuaaguuugg

SEQ ID NO: 1084439 - RNA, 22 nt, Human
ucugccugaggacugacaccag

SEQ ID NO: 1084440 - RNA, 22 nt, Human
ucucagaggcccgacguucucc

SEQ ID NO: 1084441 - RNA, 22 nt, Human
cuguggagcuuguggcaguggg

SEQ ID NO: 1084442 - RNA, 22 nt, Human
aagggcugccagggggugccag

SEQ ID NO: 1084443 - RNA, 21 nt, Human
ucucacaauaugaugccagau

SEQ ID NO: 1084444 - RNA, 22 nt, Human
ugcuuuaacauaagauaucuuu

SEQ ID NO: 1084445 - RNA, 22 nt, Human
augcaguagauaggcacuuuua

SEQ ID NO: 1084446 - RNA, 22 nt, Human
gccccagguugccugucccagg

SEQ ID NO: 1084447 - RNA, 22 nt, Human
uggcuggcuagugggcaggauu

SEQ ID NO: 1084448 - RNA, 22 nt, Human
ucagggcauguauguuucuuua

SEQ ID NO: 1084449 - RNA, 22 nt, Human
agaauuagguaaguucaucuga

SEQ ID NO: 1084450 - RNA, 22 nt, Human
ucagagucuuggcaauagguua

SEQ ID NO: 1084451 - RNA, 22 nt, Human
ggccaggcugcugggaccccgc

SEQ ID NO: 1084452 - RNA, 22 nt, Human
augguggaagagcaucagaaag

SEQ ID NO: 1084453 - RNA, 22 nt, Human
uggcuaggaccucugcggagca

SEQ ID NO: 1084454 - RNA, 22 nt, Human
auuucaugugaagaagagauaa

SEQ ID NO: 1084455 - RNA, 22 nt, Human
gcauccaaauguuucauuucuu

SEQ ID NO: 1084456 - RNA, 22 nt, Human
uggaugcuguaggacacgcucu

SEQ ID NO: 1084457 - RNA, 22 nt, Human
gacacagaaugggugcucagua

SEQ ID NO: 1084458 - RNA, 22 nt, Human
caaagauaugacauggaaaaug

SEQ ID NO: 1084459 - RNA, 22 nt, Human
ccaguggaguuuuuauacccag

SEQ ID NO: 1084460 - RNA, 22 nt, Human
uuauagaauguuuccaaugccu

SEQ ID NO: 1084461 - RNA, 22 nt, Human
uagccucuggaauccuuucucu

SEQ ID NO: 1084462 - RNA, 22 nt, Human
ugucacauauauaauguucaau

SEQ ID NO: 1084463 - RNA, 22 nt, Human
ugcaaacauccgacugaaagcc

SEQ ID NO: 1084464 - RNA, 22 nt, Human
ucuggaguccagauccauuugg

SEQ ID NO: 1084465 - RNA, 22 nt, Human
cuggcucuaucuccaaggcugg

SEQ ID NO: 1084466 - RNA, 22 nt, Human
gaauuaguguugaaaucagggc

SEQ ID NO: 1084467 - RNA, 22 nt, Human
cacacacaguuuuguauucugu

SEQ ID NO: 1084468 - RNA, 22 nt, Human
acagagcuguacaugugccaug

SEQ ID NO: 1084469 - RNA, 22 nt, Human
gauuucaaccuaacaguaugac

SEQ ID NO: 1084470 - RNA, 17 nt, Human
gcugagugcagggaguc

SEQ ID NO: 1084471 - RNA, 20 nt, Human
ggccuuggguuucgccuguu

SEQ ID NO: 1084472 - RNA, 22 nt, Human
ucccaagaccuggcauccaagu

SEQ ID NO: 1084473 - RNA, 22 nt, Human
cugggagcuggaugcccugccc

SEQ ID NO: 1084474 - RNA, 19 nt, Human
accuuacagaaacaggcau

SEQ ID NO: 1084475 - RNA, 22 nt, Human
uggcaggcaaguucagcuccac

SEQ ID NO: 1084476 - RNA, 22 nt, Human
uuccucuuugcauccucaacuc

SEQ ID NO: 1084477 - RNA, 22 nt, Human
uuuauacauggagaauuuuugc

SEQ ID NO: 1084478 - RNA, 22 nt, Human
uaauccaggguauucuaguuuc

SEQ ID NO: 1084479 - RNA, 22 nt, Human
uggcccugaggggcugugcccc

SEQ ID NO: 1084480 - RNA, 21 nt, Human
ggcacugagccagauggacuc

SEQ ID NO: 1084481 - RNA, 22 nt, Human
ucuugccucuuccccuuuccau

SEQ ID NO: 1084482 - RNA, 22 nt, Human
ucugcccugccauucacuggaa

SEQ ID NO: 1084483 - RNA, 22 nt, Human
uaauagaauaguggaaacauug

SEQ ID NO: 1084484 - RNA, 22 nt, Human
guggauggacaugggcaagagg

SEQ ID NO: 1084485 - RNA, 22 nt, Human
gaggaaggcuaaggggcuuaga

SEQ ID NO: 1084486 - RNA, 20 nt, Human
acucuaccagggcagcagca

SEQ ID NO: 1084487 - RNA, 22 nt, Human
gaaggcugcgaggggagugccg

SEQ ID NO: 1084488 - RNA, 23 nt, Human
ucacaggggccagcgcucugugg

SEQ ID NO: 1084489 - RNA, 22 nt, Human
aagggcagaaagggacgcuuug

SEQ ID NO: 1084490 - RNA, 22 nt, Human
ucuggccauggcaagccgagug

SEQ ID NO: 1084491 - RNA, 22 nt, Human
augcugaugcugcuuuugcccu

SEQ ID NO: 1084492 - RNA, 22 nt, Human
ugccucugcugcuguggcauca

SEQ ID NO: 1084493 - RNA, 22 nt, Human
guuucucuguaccucuguccca

SEQ ID NO: 1084494 - RNA, 22 nt, Human
cugaauuaagcauuacauacau

SEQ ID NO: 1084495 - RNA, 22 nt, Human
ugaggcagcaauuguauuguau

SEQ ID NO: 1084496 - RNA, 22 nt, Human
ugaggcagaguaagauacauga

SEQ ID NO: 1084497 - RNA, 22 nt, Human
acucuucaguacaauaauaucu

SEQ ID NO: 1084498 - RNA, 20 nt, Human
cccaggagugagcagcuuua

SEQ ID NO: 1084499 - RNA, 22 nt, Human
ccagucccagcucugccaugcu

SEQ ID NO: 1084500 - RNA, 20 nt, Human
uucuauacauaucacugaaa

SEQ ID NO: 1084501 - RNA, 22 nt, Human
acaaugcaccuauuuuaaaacu

SEQ ID NO: 1084502 - RNA, 22 nt, Human
ucuaaagcuccuuccacuaaaa

SEQ ID NO: 1084503 - RNA, 22 nt, Human
gaggccagcgcgcagcacuuuu

SEQ ID NO: 1084504 - RNA, 23 nt, Human
auuugaaacuuucuuguuuccag

SEQ ID NO: 1084505 - RNA, 22 nt, Human
aaagucauuuagccuuaucucc

SEQ ID NO: 1084506 - RNA, 22 nt, Human
uuugcugaauagauuguaaacu

SEQ ID NO: 1084507 - RNA, 22 nt, Human
cuguggcugcguaggucuggca

SEQ ID NO: 1084508 - RNA, 22 nt, Human
agcagggaggcccagggcacug

SEQ ID NO: 1084509 - RNA, 22 nt, Human
cuuugcaagggauuucaugucu

SEQ ID NO: 1084510 - RNA, 22 nt, Human
gugugagagacugaagaaagcc

SEQ ID NO: 1084511 - RNA, 22 nt, Human
gcagcuggauuucaagagggag

SEQ ID NO: 1084512 - RNA, 22 nt, Human
aagcagcauucagugaaaugug

SEQ ID NO: 1084513 - RNA, 22 nt, Human
acuguggcgucaggaagaaauu

SEQ ID NO: 1084514 - RNA, 22 nt, Human
caggcucuuuugguggcaagga

SEQ ID NO: 1084515 - RNA, 23 nt, Human
uagcagcauuuuuagccucuguc

SEQ ID NO: 1084516 - RNA, 22 nt, Human
uuuccaauguagaugucucugg

SEQ ID NO: 1084517 - RNA, 22 nt, Human
ugcugcugauggcaccuaggca

SEQ ID NO: 1084518 - RNA, 22 nt, Human
gauauuuucagucuccuuucaa

SEQ ID NO: 1084519 - RNA, 22 nt, Human
ugucucagaggcaggaagagcc

SEQ ID NO: 1084520 - RNA, 22 nt, Human
guggcucuaggugagcauggag

SEQ ID NO: 1084521 - RNA, 22 nt, Human
cuggcccucggaguccagcugc

SEQ ID NO: 1084522 - RNA, 22 nt, Human
gccugggagggcagcagugugg

SEQ ID NO: 1084523 - RNA, 22 nt, Human
gcagagccugacgggauuuuuc

SEQ ID NO: 1084524 - RNA, 22 nt, Human
ugggcuucuggaguggggcaga

SEQ ID NO: 1084525 - RNA, 22 nt, Human
aagcagcaugcuaugcuggugg

SEQ ID NO: 1084526 - RNA, 22 nt, Human
gguggggccagggcuccaaccu

SEQ ID NO: 1084527 - RNA, 22 nt, Human
aaaggaagaugccaggacucug

SEQ ID NO: 1084528 - RNA, 22 nt, Human
gcuguccagagcaugggagcaa

SEQ ID NO: 1084529 - RNA, 22 nt, Human
ucagagucuuaacuauucagag

SEQ ID NO: 1084530 - RNA, 22 nt, Human
guuauacaguuuugggucugcu

SEQ ID NO: 1084531 - RNA, 22 nt, Human
uuuacaaggcagaacugauuaa

SEQ ID NO: 1084532 - RNA, 22 nt, Human
agaauauaugacugcaagacua

SEQ ID NO: 1084533 - RNA, 22 nt, Human
gggcuggaucuccugcaggcag

SEQ ID NO: 1084534 - RNA, 22 nt, Human
cacugccugugagcugugugcc

SEQ ID NO: 1084535 - RNA, 22 nt, Human
gaggcacaauacaugucucaag

SEQ ID NO: 1084536 - RNA, 22 nt, Human
auggaagacagauaaggcagaa

SEQ ID NO: 1084537 - RNA, 16 nt, Human
gcagguggggcgcgca

SEQ ID NO: 1084538 - RNA, 19 nt, Human
uggcuaauuuuauagaggc

SEQ ID NO: 1084539 - RNA, 20 nt, Human
gccagcacagggagcaguuc

SEQ ID NO: 1084540 - RNA, 22 nt, Human
ugcauguuuuauaccaaagcuu

SEQ ID NO: 1084541 - RNA, 22 nt, Human
acugccuguagcccugagaugu

SEQ ID NO: 1084542 - RNA, 21 nt, Human
ugcaggcuguuuaagaggcaa

SEQ ID NO: 1084543 - RNA, 22 nt, Human
aaucucaugagcuucuuguccc

SEQ ID NO: 1084544 - RNA, 22 nt, Human
cagagugaaauaggggaucaag

SEQ ID NO: 1084545 - RNA, 19 nt, Human
ccagcccugucacuucuug

SEQ ID NO: 1084546 - RNA, 18 nt, Human
ugcugggcauuaggcuua

SEQ ID NO: 1084547 - RNA, 22 nt, Human
ccacuggcauccagcugccauc

SEQ ID NO: 1084548 - RNA, 22 nt, Human
uauauuguagcugaugacaaau

SEQ ID NO: 1084549 - RNA, 18 nt, Human
gggcagcacagcagccuc

SEQ ID NO: 1084550 - RNA, 22 nt, Human
uuugaagacuacugggagugaa

SEQ ID NO: 1084551 - RNA, 22 nt, Human
ugaugggaaaaugaggccuggg

SEQ ID NO: 1084552 - RNA, 22 nt, Human
ccagggaagcuggucacgcagg

SEQ ID NO: 1084553 - RNA, 23 nt, Human
cugaaauucagaugcuaaagaua

SEQ ID NO: 1084554 - RNA, 22 nt, Human
ggaagcacagcauaaaguuacu

SEQ ID NO: 1084555 - RNA, 22 nt, Human
ugccugagugauguggcagcca

SEQ ID NO: 1084556 - RNA, 22 nt, Human
cuggccuucagacucggacuga

SEQ ID NO: 1084557 - RNA, 22 nt, Human
cagucacuggaauagcugagga

SEQ ID NO: 1084558 - RNA, 22 nt, Human
ucuucaugaccucuguguuuua

SEQ ID NO: 1084559 - RNA, 22 nt, Human
ucuaaacauuaugauaguagag

SEQ ID NO: 1084560 - RNA, 22 nt, Human
aauacugccugugagguaacuc

SEQ ID NO: 1084561 - RNA, 22 nt, Human
aauaaggugugggugcuaauau

SEQ ID NO: 1084562 - RNA, 21 nt, Human
aggucccagguuugggcagca

SEQ ID NO: 1084563 - RNA, 22 nt, Human
guuuuccauggaggucugaccu

SEQ ID NO: 1084564 - RNA, 22 nt, Human
ugcuucaggagaugucaccaug

SEQ ID NO: 1084565 - RNA, 22 nt, Human
ucaaaguagaguucagugcagc

SEQ ID NO: 1084566 - RNA, 20 nt, Human
aaacuugauggcauagaaua

SEQ ID NO: 1084567 - RNA, 20 nt, Human
gccugcagagaaggucagag

SEQ ID NO: 1084568 - RNA, 22 nt, Human
agccuucacugggaccuuggau

SEQ ID NO: 1084569 - RNA, 22 nt, Human
cuaauuauguuguuauaaucaa

SEQ ID NO: 1084570 - RNA, 22 nt, Human
aagcaaaggaaagcugacuuuu

SEQ ID NO: 1084571 - RNA, 23 nt, Human
gagugcagaauagacaugcagug

SEQ ID NO: 1084572 - RNA, 23 nt, Human
aauuaccaugcaacuugugaaac

SEQ ID NO: 1084573 - RNA, 22 nt, Human
ggaagauuucccguagcugugc

SEQ ID NO: 1084574 - RNA, 22 nt, Human
gaauccaucaugcagaacaaug

SEQ ID NO: 1084575 - RNA, 22 nt, Human
aagagccauauaugcagcuaga

SEQ ID NO: 1084576 - RNA, 22 nt, Human
ugagaauuacaaaugagucaca

SEQ ID NO: 1084577 - RNA, 22 nt, Human
aaaggcaggcuuucacaucuca

SEQ ID NO: 1084578 - RNA, 22 nt, Human
acagaacaagaccugcuuauug

SEQ ID NO: 1084579 - RNA, 22 nt, Human
uccugccucuccaugcuaacua

SEQ ID NO: 1084580 - RNA, 22 nt, Human
ucagugcagaauagugaugcau

SEQ ID NO: 1084581 - RNA, 22 nt, Human
ucuuauaaucucuauuuuaaug

SEQ ID NO: 1084582 - RNA, 23 nt, Human
cucccuggcccuugggagaccug

SEQ ID NO: 1084583 - RNA, 20 nt, Human
ucauuucuugggguuccaag

SEQ ID NO: 1084584 - RNA, 22 nt, Human
cugguggagggacaggcuuagc

SEQ ID NO: 1084585 - RNA, 22 nt, Human
acaugggaucaaugaggcaggc

SEQ ID NO: 1084586 - RNA, 22 nt, Human
ucuuuuaaaagcccugcugucu

SEQ ID NO: 1084587 - RNA, 22 nt, Human
acaaggcugugggagaaccucu

SEQ ID NO: 1084588 - RNA, 22 nt, Human
aaauuauuauaggcagagcuga

SEQ ID NO: 1084589 - RNA, 22 nt, Human
ggcaggugaccuggccucccag

SEQ ID NO: 1084590 - RNA, 22 nt, Human
uggcucagucuggguugacuga

SEQ ID NO: 1084591 - RNA, 22 nt, Human
gcaugcugcaccagagccucuc

SEQ ID NO: 1084592 - RNA, 22 nt, Human
cugauacaaugcuaauaaauuu

SEQ ID NO: 1084593 - RNA, 22 nt, Human
uagcagagcugcaauauagacc

SEQ ID NO: 1084594 - RNA, 22 nt, Human
ucacauuuuaucugagauugac

SEQ ID NO: 1084595 - RNA, 23 nt, Human
auguuuuaugucucuagcugcca

SEQ ID NO: 1084596 - RNA, 22 nt, Human
acagcagcauccuauuucacuc

SEQ ID NO: 1084597 - RNA, 22 nt, Human
cagucaacagagagcccgucag

SEQ ID NO: 1084598 - RNA, 22 nt, Human
gucccagggagguucagggcuu

SEQ ID NO: 1084599 - RNA, 22 nt, Human
aaaaugaauaaguuaacccagg

SEQ ID NO: 1084600 - RNA, 22 nt, Human
gcccacaccauuuauucuuugu

SEQ ID NO: 1084601 - RNA, 22 nt, Human
ccugacuagcugggacuacaga

SEQ ID NO: 1084602 - RNA, 22 nt, Human
ggacuggguaggagcccagggc

SEQ ID NO: 1084603 - RNA, 22 nt, Human
cacagcagccagaacauuuuug

SEQ ID NO: 1084604 - RNA, 22 nt, Human
cccaguggaaggaguagaagac

SEQ ID NO: 1084605 - RNA, 22 nt, Human
uaucacacauaacuaagcugca

SEQ ID NO: 1084606 - RNA, 21 nt, Human
uccaaaaaggagcguccuucu

SEQ ID NO: 1084607 - RNA, 22 nt, Human
gugaagagcuguugcagagauu

SEQ ID NO: 1084608 - RNA, 22 nt, Human
gcagagccuugcgucaugugcc

SEQ ID NO: 1084609 - RNA, 22 nt, Human
aaugaagcaguccaucugcucu

SEQ ID NO: 1084610 - RNA, 22 nt, Human
acagauauccucagucuccaac

SEQ ID NO: 1084611 - RNA, 22 nt, Human
cccuggagcugcuugcauguug

SEQ ID NO: 1084612 - RNA, 22 nt, Human
cagccucuguggcugccacacc

SEQ ID NO: 1084613 - RNA, 22 nt, Human
aaagcagcagcacguggaagag

SEQ ID NO: 1084614 - RNA, 22 nt, Human
cuuuaguuugugauacgaagau

SEQ ID NO: 1084615 - RNA, 22 nt, Human
ucaaaguauuuuaacuguaucc

SEQ ID NO: 1084616 - RNA, 22 nt, Human
cuaagcacaaugcuuugaguau

SEQ ID NO: 1084617 - RNA, 22 nt, Human
uuuacagucucuauagucaaaa

SEQ ID NO: 1084618 - RNA, 22 nt, Human
auacauguucguguacauguuc

SEQ ID NO: 1084619 - RNA, 22 nt, Human
aaggcugagggcuguaccuggc

SEQ ID NO: 1084620 - RNA, 19 nt, Human
cugccuguuauggagagaa

SEQ ID NO: 1084621 - RNA, 22 nt, Human
cagggacauugguggccagguu

SEQ ID NO: 1084622 - RNA, 22 nt, Human
gauuauauaauggaagcucuug

SEQ ID NO: 1084623 - RNA, 22 nt, Human
aucagcaagacuaggggaauac

SEQ ID NO: 1084624 - RNA, 22 nt, Human
gaacuacaggugcagcaaguga

SEQ ID NO: 1084625 - RNA, 19 nt, Human
auuuccaagaauuggagag

SEQ ID NO: 1084626 - RNA, 22 nt, Human
cuguccagcugaccagagcagc

SEQ ID NO: 1084627 - RNA, 18 nt, Human
cuucagugacagucuggc

SEQ ID NO: 1084628 - RNA, 22 nt, Human
aacagucugggaguuccuuaua

SEQ ID NO: 1084629 - RNA, 22 nt, Human
gauaauaagcacagcaggaugu

SEQ ID NO: 1084630 - RNA, 20 nt, Human
aaaagcagccagagauggua

SEQ ID NO: 1084631 - RNA, 20 nt, Human
gacaacacagcuucaggucc

SEQ ID NO: 1084632 - RNA, 22 nt, Human
agaacuauacauuacucauuga

SEQ ID NO: 1084633 - RNA, 22 nt, Human
agaggaaguaaucaggaccugc

SEQ ID NO: 1084634 - RNA, 23 nt, Human
aaaugacauaugguuucugaagg

SEQ ID NO: 1084635 - RNA, 22 nt, Human
ccucacuggccagccaggggug

SEQ ID NO: 1084636 - RNA, 22 nt, Human
ucucugggaaugggccugggua

SEQ ID NO: 1084637 - RNA, 22 nt, Human
acaguuuacagggauuugagcu

SEQ ID NO: 1084638 - RNA, 22 nt, Human
guuucaaagcacagcucacauu

SEQ ID NO: 1084639 - RNA, 19 nt, Human
aggcagcaggccagggaug

SEQ ID NO: 1084640 - RNA, 22 nt, Human
acauucugugagucauguuuua

SEQ ID NO: 1084641 - RNA, 22 nt, Human
guagaaaauuaggaugaggcuu

SEQ ID NO: 1084642 - RNA, 22 nt, Human
uuuauuggauauuuacaagaua

SEQ ID NO: 1084643 - RNA, 17 nt, Human
ugaaggaaggaugaugu

SEQ ID NO: 1084644 - RNA, 22 nt, Human
cuuucucuguguuucacaugcu

SEQ ID NO: 1084645 - RNA, 17 nt, Human
gcaguggagggguaguu

SEQ ID NO: 1084646 - RNA, 22 nt, Human
gccaggcauucuagaaguagug

SEQ ID NO: 1084647 - RNA, 22 nt, Human
caccagggcucugagcucugaa

SEQ ID NO: 1084648 - RNA, 22 nt, Human
uccagcagaccaucaaggcuca

SEQ ID NO: 1084649 - RNA, 22 nt, Human
aaugcaaugcagcaccuccuug

SEQ ID NO: 1084650 - RNA, 22 nt, Human
uggguaaacugggucuggagag

SEQ ID NO: 1084651 - RNA, 22 nt, Human
auauuaaauggauuuugggagc

SEQ ID NO: 1084652 - RNA, 22 nt, Human
agacaggagagggaacugccgg

SEQ ID NO: 1084653 - RNA, 22 nt, Human
gcaggggcuaaggacacagaga

SEQ ID NO: 1084654 - RNA, 22 nt, Human
ggcugccugccuccaagccggg

SEQ ID NO: 1084655 - RNA, 22 nt, Human
aucaagcuacuugucuucguuu

SEQ ID NO: 1084656 - RNA, 22 nt, Human
cuucaaaugugauuuuaauaac

SEQ ID NO: 1084657 - RNA, 22 nt, Human
gacauguaaauggcaauuaugg

SEQ ID NO: 1084658 - RNA, 22 nt, Human
cugggagcaagaggcugcaaau

SEQ ID NO: 1084659 - RNA, 22 nt, Human
ugcccagcagggagcuaccugg

SEQ ID NO: 1084660 - RNA, 22 nt, Human
aggccagggucccacacucgca

SEQ ID NO: 1084661 - RNA, 22 nt, Human
gcugcagcaagcccuccagggg

SEQ ID NO: 1084662 - RNA, 22 nt, Human
gcugaguguaaugauggcagag

SEQ ID NO: 1084663 - RNA, 22 nt, Human
uugugcagagaaaucuuucuug

SEQ ID NO: 1084664 - RNA, 22 nt, Human
caggccucaggggcucaggcug

SEQ ID NO: 1084665 - RNA, 22 nt, Human
cuacaaagaaaguauacuggac

SEQ ID NO: 1084666 - RNA, 22 nt, Human
acuaaacugaagcaugaaaagg

SEQ ID NO: 1084667 - RNA, 19 nt, Human
cuggggcuuugguacugcc

SEQ ID NO: 1084668 - RNA, 22 nt, Human
ucagacagugugaucagucucu

SEQ ID NO: 1084669 - RNA, 22 nt, Human
cugccugugauuuuucucuagu

SEQ ID NO: 1084670 - RNA, 22 nt, Human
gagaaagauggaaucuuacagg

SEQ ID NO: 1084671 - RNA, 22 nt, Human
aucccucagccaccuuugagga

SEQ ID NO: 1084672 - RNA, 22 nt, Human
uugcauugggagugaggagacc

SEQ ID NO: 1084673 - RNA, 23 nt, Human
cccagagucaucuguagcugugg

SEQ ID NO: 1084674 - RNA, 22 nt, Human
gaagccccaaacccucgccauc

SEQ ID NO: 1084675 - RNA, 22 nt, Human
ucacuuauaaaaugcaagaucu

SEQ ID NO: 1084676 - RNA, 22 nt, Human
cauugcuuccuaugucccuucu

SEQ ID NO: 1084677 - RNA, 22 nt, Human
gaaggcugaugacagauucugc

SEQ ID NO: 1084678 - RNA, 22 nt, Human
ggcccuguuagagcucccacaa

SEQ ID NO: 1084679 - RNA, 22 nt, Human
uccaaguuucuucugcacaaca

SEQ ID NO: 1084680 - RNA, 22 nt, Human
ugcucacugaacucuugcuguc

SEQ ID NO: 1084681 - RNA, 17 nt, Human
uuauuuuuugggcugag

SEQ ID NO: 1084682 - RNA, 22 nt, Human
agguggggcugggaaagauucc

SEQ ID NO: 1084683 - RNA, 22 nt, Human
aucaggaucacagaaacuuuua

SEQ ID NO: 1084684 - RNA, 22 nt, Human
augugcauaaacauauuguugg

SEQ ID NO: 1084685 - RNA, 22 nt, Human
gagacacaaucucauuuacauu

SEQ ID NO: 1084686 - RNA, 22 nt, Human
ucccugcugggagaugaccuua

SEQ ID NO: 1084687 - RNA, 22 nt, Human
cugcuuugauuagaagaguaca

SEQ ID NO: 1084688 - RNA, 22 nt, Human
ccuuaccugauugcuggcaucc

SEQ ID NO: 1084689 - RNA, 22 nt, Human
uaguuuuacaucagccauuguu

SEQ ID NO: 1084690 - RNA, 22 nt, Human
ugggcagaaaucaguaucagau

SEQ ID NO: 1084691 - RNA, 22 nt, Human
cagcuguggagauggggugcau

SEQ ID NO: 1084692 - RNA, 22 nt, Human
aagugaagaaauacaugagaau

SEQ ID NO: 1084693 - RNA, 22 nt, Human
aggcaagaacagacaugggagu

SEQ ID NO: 1084694 - RNA, 23 nt, Human
gacagagugagaccuugucuuac

SEQ ID NO: 1084695 - RNA, 22 nt, Human
agcccaugguguacucuguggc

SEQ ID NO: 1084696 - RNA, 22 nt, Human
aaggugggcagaucacaagguc

SEQ ID NO: 1084697 - RNA, 22 nt, Human
uccaggagguuuggaggaagca

SEQ ID NO: 1084698 - RNA, 22 nt, Human
aaagguuuuauucugagcucug

SEQ ID NO: 1084699 - RNA, 22 nt, Human
acauuugauaauuauaaagaca

SEQ ID NO: 1084700 - RNA, 22 nt, Human
augaggcaaggaucagguaagg

SEQ ID NO: 1084701 - RNA, 23 nt, Human
aaagugcaguugaggaaucauag

SEQ ID NO: 1084702 - RNA, 22 nt, Human
uaaacuaucuguguuugaaguu

SEQ ID NO: 1084703 - RNA, 22 nt, Human
cugccugacugauaaucucuga

SEQ ID NO: 1084704 - RNA, 22 nt, Human
ucuggcucuauaacuccuagcu

SEQ ID NO: 1084705 - RNA, 22 nt, Human
aggagccaccuaggagcuguuu

SEQ ID NO: 1084706 - RNA, 22 nt, Human
uaaauguauaggcacuaaaccu

SEQ ID NO: 1084707 - RNA, 19 nt, Human
ugcugcuguccuugcaggg

SEQ ID NO: 1084708 - RNA, 23 nt, Human
acacauuuuucccguucugaggu

SEQ ID NO: 1084709 - RNA, 22 nt, Human
caauguacuacaaagauuguca

SEQ ID NO: 1084710 - RNA, 19 nt, Human
gcugccugucuuagccagu

SEQ ID NO: 1084711 - RNA, 22 nt, Human
gcacagaaaugucuacacaugu

SEQ ID NO: 1084712 - RNA, 22 nt, Human
uuuaugagccucaaaucugagu

SEQ ID NO: 1084713 - RNA, 22 nt, Human
aucugcuuuugagaauuuacuu

SEQ ID NO: 1084714 - RNA, 22 nt, Human
uagugucugaaugcaccuguuu

SEQ ID NO: 1084715 - RNA, 22 nt, Human
uguaaggaggaaaauuaguggu

SEQ ID NO: 1084716 - RNA, 22 nt, Human
uuuaaugugagucccuuucaag

SEQ ID NO: 1084717 - RNA, 22 nt, Human
ucuucaaugcauucucuuguuu

SEQ ID NO: 1084718 - RNA, 22 nt, Human
caagaugaaacuacagggagga

SEQ ID NO: 1084719 - RNA, 23 nt, Human
gcaguuaguccacuuugcagaga

SEQ ID NO: 1084720 - RNA, 20 nt, Human
cugcaucaugguuaagaaca

SEQ ID NO: 1084721 - RNA, 22 nt, Human
cagcugccccgcuggcugacca

SEQ ID NO: 1084722 - RNA, 22 nt, Human
gaagagcugcaguuuccugggc

SEQ ID NO: 1084723 - RNA, 22 nt, Human
ucacauuuauacuccauuugca

SEQ ID NO: 1084724 - RNA, 22 nt, Human
gagccucguggcggccacugcg

SEQ ID NO: 1084725 - RNA, 22 nt, Human
aaccaggacaauuugaauagaa

SEQ ID NO: 1084726 - RNA, 22 nt, Human
guacaaguugccuaccuuaagu

SEQ ID NO: 1084727 - RNA, 22 nt, Human
gaagcagcaaguauaggacagg

SEQ ID NO: 1084728 - RNA, 22 nt, Human
aggcugaggcagguggaucacc

SEQ ID NO: 1084729 - RNA, 22 nt, Human
cucuguccuccaccugcuuuca

SEQ ID NO: 1084730 - RNA, 22 nt, Human
uccuggcccggccgggccugcu

SEQ ID NO: 1084731 - RNA, 22 nt, Human
uugcccuguggggccuccagcc

SEQ ID NO: 1084732 - RNA, 22 nt, Human
agaccauagggaccucagguug

SEQ ID NO: 1084733 - RNA, 22 nt, Human
ggaggaagggcccaggcuuuau

SEQ ID NO: 1084734 - RNA, 22 nt, Human
cagcugagaccagaaugcaggu

SEQ ID NO: 1084735 - RNA, 22 nt, Human
aacuuuuagacuuggguauaaa

SEQ ID NO: 1084736 - RNA, 17 nt, Human
ugcugccaagucccaac

SEQ ID NO: 1084737 - RNA, 22 nt, Human
ccuagagcucugcuuuaucuaa

SEQ ID NO: 1084738 - RNA, 22 nt, Human
gcacacacaugugaguacaugc

SEQ ID NO: 1084739 - RNA, 20 nt, Human
ucagggcaugggacagcccc

SEQ ID NO: 1084740 - RNA, 22 nt, Human
cagagcugcuucccaguuugug

SEQ ID NO: 1084741 - RNA, 22 nt, Human
uggcccgaccucugcucaugca

SEQ ID NO: 1084742 - RNA, 19 nt, Human
agggagaauuccaagagga

SEQ ID NO: 1084743 - RNA, 22 nt, Human
auuuccuguaccuaucaaggca

SEQ ID NO: 1084744 - RNA, 22 nt, Human
cucuugaagcaggggccaguuc

SEQ ID NO: 1084745 - RNA, 22 nt, Human
ucuuuccuaggugauaugcaau

SEQ ID NO: 1084746 - RNA, 22 nt, Human
gagggucccugcucagggccag

SEQ ID NO: 1084747 - RNA, 22 nt, Human
uucugaaaauugggucauacuu

SEQ ID NO: 1084748 - RNA, 22 nt, Human
ggugaggcagguggcugcugag

SEQ ID NO: 1084749 - RNA, 23 nt, Human
cguuuuuuccucagauguucugg

SEQ ID NO: 1084750 - RNA, 22 nt, Human
uagucuuuuuaauaaauaaugc

SEQ ID NO: 1084751 - RNA, 22 nt, Human
uguggggcugucaggcaacugg

SEQ ID NO: 1084752 - RNA, 22 nt, Human
uuccaaaggaauggggagcuau

SEQ ID NO: 1084753 - RNA, 22 nt, Human
gucccauuuucuacuauggaau

SEQ ID NO: 1084754 - RNA, 22 nt, Human
acacauuuauuacaugcaugug

SEQ ID NO: 1084755 - RNA, 22 nt, Human
cugagaggggaccaggguguuu

SEQ ID NO: 1084756 - RNA, 22 nt, Human
cuuaauaauaggugaggcuaug

SEQ ID NO: 1084757 - RNA, 22 nt, Human
cuucaguguugguucauuacga

SEQ ID NO: 1084758 - RNA, 22 nt, Human
cagcagaacaguuaaagaaacc

SEQ ID NO: 1084759 - RNA, 22 nt, Human
cuugaaagauuuggccucugug

SEQ ID NO: 1084760 - RNA, 22 nt, Human
uacuuucuguccuucuguuaaa

SEQ ID NO: 1084761 - RNA, 22 nt, Human
acacuuuaugucuagaucuggg

SEQ ID NO: 1084762 - RNA, 22 nt, Human
uuacagagcucauuucuaaggg

SEQ ID NO: 1084763 - RNA, 22 nt, Human
aaugagcugcugcuguuccacc

SEQ ID NO: 1084764 - RNA, 19 nt, Human
acugggaaaaaggcacugg

SEQ ID NO: 1084765 - RNA, 22 nt, Human
gcccuccuuugcuucuccuagu

SEQ ID NO: 1084766 - RNA, 21 nt, Human
agcagguguaaaggaggaaau

SEQ ID NO: 1084767 - RNA, 22 nt, Human
cuggccagguuuugaacaguug

SEQ ID NO: 1084768 - RNA, 23 nt, Human
uuuaacuuuccaauaauucauug

SEQ ID NO: 1084769 - RNA, 22 nt, Human
acaagagucugcauuucuaaca

SEQ ID NO: 1084770 - RNA, 22 nt, Human
acagaguccuagcugcaaagaa

SEQ ID NO: 1084771 - RNA, 21 nt, Human
aggcacuuaaccaauguuagc

SEQ ID NO: 1084772 - RNA, 23 nt, Human
aggaaggagguccuaacaguauc

SEQ ID NO: 1084773 - RNA, 22 nt, Human
uaauuucaauagcuugcauaau

SEQ ID NO: 1084774 - RNA, 22 nt, Human
gagccagcugagcugcacuguc

SEQ ID NO: 1084775 - RNA, 22 nt, Human
aaucuggcauguaagcuuagag

SEQ ID NO: 1084776 - RNA, 22 nt, Human
auguauuugaaauuugagacau

SEQ ID NO: 1084777 - RNA, 20 nt, Human
agaaaucagcauguccucug

SEQ ID NO: 1084778 - RNA, 17 nt, Human
ugcccugugccuggugu

SEQ ID NO: 1084779 - RNA, 22 nt, Human
gccaggaaggcugaagccagaa

SEQ ID NO: 1084780 - RNA, 22 nt, Human
gcucugagacaguagagauggc

SEQ ID NO: 1084781 - RNA, 22 nt, Human
agcaagcuaccuagauagucua

SEQ ID NO: 1084782 - RNA, 22 nt, Human
aaaucugguucaguaaguccuc

SEQ ID NO: 1084783 - RNA, 22 nt, Human
gcuggccauggccugcgccauc

SEQ ID NO: 1084784 - RNA, 22 nt, Human
uggcaccugaacuuagaggugu

SEQ ID NO: 1084785 - RNA, 22 nt, Human
uccaggcugauccaugaagaau

SEQ ID NO: 1084786 - RNA, 22 nt, Human
acagcagcuaaaggugucuccu

SEQ ID NO: 1084787 - RNA, 22 nt, Human
augcugagaaaccugucuggca

SEQ ID NO: 1084788 - RNA, 22 nt, Human
ucagauuuggacacaggaacuu

SEQ ID NO: 1084789 - RNA, 19 nt, Human
cuucuucuuggcagccaag

SEQ ID NO: 1084790 - RNA, 22 nt, Human
uugacacagaucaauauucaac

SEQ ID NO: 1084791 - RNA, 22 nt, Human
ugguuucccauuaucugcagga

SEQ ID NO: 1084792 - RNA, 22 nt, Human
ucccuccuggugagcaggggcu

SEQ ID NO: 1084793 - RNA, 22 nt, Human
cgggaacaugcuuucauuucag

SEQ ID NO: 1084794 - RNA, 22 nt, Human
uuuguaaggcuaaauaauauuc

SEQ ID NO: 1084795 - RNA, 22 nt, Human
agcugaagggaggauauguaca

SEQ ID NO: 1084796 - RNA, 22 nt, Human
auaaggcagucccuuaacaagg

SEQ ID NO: 1084797 - RNA, 22 nt, Human
caucacaaaaugauuauucccu

SEQ ID NO: 1084798 - RNA, 22 nt, Human
acuucacagauauuuauuuggu

SEQ ID NO: 1084799 - RNA, 22 nt, Human
aggccagacagcuagaaacagg

SEQ ID NO: 1084800 - RNA, 22 nt, Human
ucauugaauuucacagcuuuau

SEQ ID NO: 1084801 - RNA, 22 nt, Human
cagcucagucuggagagaugca

SEQ ID NO: 1084802 - RNA, 17 nt, Human
gcuggcugacccaugcc

SEQ ID NO: 1084803 - RNA, 22 nt, Human
cugggcacuuuggggagccuac

SEQ ID NO: 1084804 - RNA, 22 nt, Human
ggcugcuggaagacugaacaag

SEQ ID NO: 1084805 - RNA, 22 nt, Human
gaugauggacaaagcauuggug

SEQ ID NO: 1084806 - RNA, 21 nt, Human
acacagaggcaucaucacuuu

SEQ ID NO: 1084807 - RNA, 20 nt, Human
guuuccaaauugugcauuuu

SEQ ID NO: 1084808 - RNA, 22 nt, Human
aggcacuuaaccuacuaacuga

SEQ ID NO: 1084809 - RNA, 22 nt, Human
aauaauuuccagccaacuggaa

SEQ ID NO: 1084810 - RNA, 22 nt, Human
ugcagcuguuacggacccuguc

SEQ ID NO: 1084811 - RNA, 22 nt, Human
gcagugggagcuuaggcagugc

SEQ ID NO: 1084812 - RNA, 22 nt, Human
cucgcaggacagugcuaggacu

SEQ ID NO: 1084813 - RNA, 18 nt, Human
gguggcucagucaugggg

SEQ ID NO: 1084814 - RNA, 22 nt, Human
cacagaaaaaggcuugaaaauc

SEQ ID NO: 1084815 - RNA, 22 nt, Human
uccagagugcugacgcagaccc

SEQ ID NO: 1084816 - RNA, 21 nt, Human
ucugugcuuuuuuggcuccua

SEQ ID NO: 1084817 - RNA, 22 nt, Human
ucaguggauuggaugagaucug

SEQ ID NO: 1084818 - RNA, 19 nt, Human
ucuuucauuucuagcucug

SEQ ID NO: 1084819 - RNA, 22 nt, Human
gaagucugacucuuuguaagcu

SEQ ID NO: 1084820 - RNA, 22 nt, Human
ucucaggacuuugggaagcuca

SEQ ID NO: 1084821 - RNA, 22 nt, Human
ggaagcugccaguccaccagcu

SEQ ID NO: 1084822 - RNA, 17 nt, Human
aaggugagagcuguucu

SEQ ID NO: 1084823 - RNA, 22 nt, Human
ugcugccuccaacuccugggcu

SEQ ID NO: 1084824 - RNA, 22 nt, Human
cagggcaguaacgggaacaucu

SEQ ID NO: 1084825 - RNA, 22 nt, Human
uccaguggcacuggagacuaga

SEQ ID NO: 1084826 - RNA, 22 nt, Human
auacauucaaaggaaggauaga

SEQ ID NO: 1084827 - RNA, 22 nt, Human
ucucuucugaaaccugucuuua

SEQ ID NO: 1084828 - RNA, 22 nt, Human
cugccguccaucuacgucucag

SEQ ID NO: 1084829 - RNA, 22 nt, Human
gcuucuggcagugcagccacca

SEQ ID NO: 1084830 - RNA, 22 nt, Human
ugugcuucagguugucgccacg

SEQ ID NO: 1084831 - RNA, 22 nt, Human
uuucuggauucauacagaugua

SEQ ID NO: 1084832 - RNA, 22 nt, Human
uaguaaauuaaaauauugacuu

SEQ ID NO: 1084833 - RNA, 22 nt, Human
uggcucuguuuguuaacuagac

SEQ ID NO: 1084834 - RNA, 22 nt, Human
acagaaguguugaaguuuucau

SEQ ID NO: 1084835 - RNA, 20 nt, Human
cugcugugugugccucagcc

SEQ ID NO: 1084836 - RNA, 22 nt, Human
cugggcugucaauggcccucug

SEQ ID NO: 1084837 - RNA, 22 nt, Human
gaaaucacuuuuuucauaguug

SEQ ID NO: 1084838 - RNA, 22 nt, Human
uuuauucauuguuucgucgcag

SEQ ID NO: 1084839 - RNA, 22 nt, Human
gagcugccggcccacaguacua

SEQ ID NO: 1084840 - RNA, 22 nt, Human
ggcuucucgugccgaagcaaga

SEQ ID NO: 1084841 - RNA, 22 nt, Human
aaagucaucuaggagcagauuu

SEQ ID NO: 1084842 - RNA, 22 nt, Human
acugaaggcuuaacucuuucau

SEQ ID NO: 1084843 - RNA, 22 nt, Human
cagcugaguuacucugaggucu

SEQ ID NO: 1084844 - RNA, 20 nt, Human
ggcagagcuaugucuguugc

SEQ ID NO: 1084845 - RNA, 22 nt, Human
cucugagacuuuucaccuccca

SEQ ID NO: 1084846 - RNA, 22 nt, Human
caucaucaaaagugacagagaa

SEQ ID NO: 1084847 - RNA, 23 nt, Human
cuggggcuuucaaaucugggcag

SEQ ID NO: 1084848 - RNA, 20 nt, Human
ugugccuggcuuuguccuga

SEQ ID NO: 1084849 - RNA, 22 nt, Human
ccacaggaccagaggagaucac

SEQ ID NO: 1084850 - RNA, 22 nt, Human
uggcuuccacugugugcccccu

SEQ ID NO: 1084851 - RNA, 22 nt, Human
ggaaagaaagugugaacaacuu

SEQ ID NO: 1084852 - RNA, 22 nt, Human
cacggaaacacagguuauaaga

SEQ ID NO: 1084853 - RNA, 22 nt, Human
ggaaaggagauauuggagagug

SEQ ID NO: 1084854 - RNA, 22 nt, Human
cacauacaugcacaccuaaaua

SEQ ID NO: 1084855 - RNA, 22 nt, Human
ggcuucagaggagaagagggug

SEQ ID NO: 1084856 - RNA, 22 nt, Human
acacagagauguaaaguuaggc

SEQ ID NO: 1084857 - RNA, 22 nt, Human
ucuggcuccacuuucuucauuu

SEQ ID NO: 1084858 - RNA, 22 nt, Human
ugcagaagauggucugagcacc

SEQ ID NO: 1084859 - RNA, 20 nt, Human
uuucacagucccuguuuccu

SEQ ID NO: 1084860 - RNA, 22 nt, Human
aaauauagugacacuuauaguc

SEQ ID NO: 1084861 - RNA, 22 nt, Human
aggcacugaccugcuuccuuga

SEQ ID NO: 1084862 - RNA, 22 nt, Human
agucucuuucuaaauaagguca

SEQ ID NO: 1084863 - RNA, 22 nt, Human
gguuccccaggcggcccuugga

SEQ ID NO: 1084864 - RNA, 22 nt, Human
cucugcuuggaacuggacagaa

SEQ ID NO: 1084865 - RNA, 22 nt, Human
augaaaugauugaaaucuuuac

SEQ ID NO: 1084866 - RNA, 22 nt, Human
gcugggccuuccgauucucaag

SEQ ID NO: 1084867 - RNA, 22 nt, Human
uggggacacagagguucguugg

SEQ ID NO: 1084868 - RNA, 22 nt, Human
agagugaaguuuuugaaaguga

SEQ ID NO: 1084869 - RNA, 22 nt, Human
cugggaggacaacuuggagcuc

SEQ ID NO: 1084870 - RNA, 22 nt, Human
acagaguagcucaagaagauug

SEQ ID NO: 1084871 - RNA, 22 nt, Human
guggccucugugcuccugccua

SEQ ID NO: 1084872 - RNA, 22 nt, Human
aaugagauggaauucccgccua

SEQ ID NO: 1084873 - RNA, 22 nt, Human
gaggcugggaaguccaagauca

SEQ ID NO: 1084874 - RNA, 22 nt, Human
uauuucugggaguucagaaauu

SEQ ID NO: 1084875 - RNA, 22 nt, Human
acacagggauauuucagguggu

SEQ ID NO: 1084876 - RNA, 22 nt, Human
acacagggcaaugcuuugaccu

SEQ ID NO: 1084877 - RNA, 22 nt, Human
uguaaggacaacaggagaaaaa

SEQ ID NO: 1084878 - RNA, 23 nt, Human
uacaugcuauaauuucacccuca

SEQ ID NO: 1084879 - RNA, 22 nt, Human
caguuacagagccaguuagaga

SEQ ID NO: 1084880 - RNA, 22 nt, Human
ggucccaggagaauaggugcaa

SEQ ID NO: 1084881 - RNA, 22 nt, Human
uucuuuucuuggcaggaguaga

SEQ ID NO: 1084882 - RNA, 22 nt, Human
uucauuugaguuuauaguugcu

SEQ ID NO: 1084883 - RNA, 22 nt, Human
uuuauguuauggguaggaucaa

SEQ ID NO: 1084884 - RNA, 22 nt, Human
gugagagggcugggcucaugau

SEQ ID NO: 1084885 - RNA, 22 nt, Human
uagggcagcugcaucaggcacu

SEQ ID NO: 1084886 - RNA, 22 nt, Human
auaugucgcuacaucauuagau

SEQ ID NO: 1084887 - RNA, 22 nt, Human
uacuuucuagcucuccccaguu

SEQ ID NO: 1084888 - RNA, 22 nt, Human
gugcucuggcuggucucccggu

SEQ ID NO: 1084889 - RNA, 22 nt, Human
ccagaggacuugggggcugaau

SEQ ID NO: 1084890 - RNA, 22 nt, Human
gugggcagacagugcuuugcag

SEQ ID NO: 1084891 - RNA, 22 nt, Human
uguauuaugauuguuguucaug

SEQ ID NO: 1084892 - RNA, 17 nt, Human
accagaguuuuccaugc

SEQ ID NO: 1084893 - RNA, 22 nt, Human
aucuuuaggaaccuaaccuauu

SEQ ID NO: 1084894 - RNA, 22 nt, Human
ucugccugcgcucacggggccg

SEQ ID NO: 1084895 - RNA, 22 nt, Human
uggagcaggcaucuuucucucu

SEQ ID NO: 1084896 - RNA, 18 nt, Human
caggaaccucuccuuuuu

SEQ ID NO: 1084897 - RNA, 22 nt, Human
acaugaaaagacuaucugauua

SEQ ID NO: 1084898 - RNA, 20 nt, Human
uuccuguauacaaagaguuc

SEQ ID NO: 1084899 - RNA, 22 nt, Human
acauguaaaaggaacaugcaug

SEQ ID NO: 1084900 - RNA, 22 nt, Human
ccaggcuggagugcaauggugc

SEQ ID NO: 1084901 - RNA, 22 nt, Human
guguggcuaccucagaggagca

SEQ ID NO: 1084902 - RNA, 22 nt, Human
cagcuguucacauuuccaaaac

SEQ ID NO: 1084903 - RNA, 22 nt, Human
agaagccagaggcaguggguac

SEQ ID NO: 1084904 - RNA, 22 nt, Human
gaggcuggugguuaguuccauu

SEQ ID NO: 1084905 - RNA, 22 nt, Human
ggccccaggaccuccacggucc

SEQ ID NO: 1084906 - RNA, 22 nt, Human
uauaguacauggaaucuucaua

SEQ ID NO: 1084907 - RNA, 22 nt, Human
ccucugcucugguccaugugcu

SEQ ID NO: 1084908 - RNA, 22 nt, Human
ugucaguggaccuggagaggcc

SEQ ID NO: 1084909 - RNA, 22 nt, Human
accuccccugacucgaaaccca

SEQ ID NO: 1084910 - RNA, 18 nt, Human
caaagcaggugacagugu

SEQ ID NO: 1084911 - RNA, 22 nt, Human
aggccagguuccucaaucuuga

SEQ ID NO: 1084912 - RNA, 22 nt, Human
aauacuugucagaugaauaaga

SEQ ID NO: 1084913 - RNA, 22 nt, Human
uggaggcaguuuaagucugaga

SEQ ID NO: 1084914 - RNA, 22 nt, Human
cagggccugagggcugcucugc

SEQ ID NO: 1084915 - RNA, 22 nt, Human
gcuguccucuuggacucagggc

SEQ ID NO: 1084916 - RNA, 22 nt, Human
ugcagcucugaacagucaugaa

SEQ ID NO: 1084917 - RNA, 22 nt, Human
gggccuccggggugagcugugg

SEQ ID NO: 1084918 - RNA, 22 nt, Human
cugguucauauaggcaaguuua

SEQ ID NO: 1084919 - RNA, 22 nt, Human
accaggaacaagccauggagga

SEQ ID NO: 1084920 - RNA, 22 nt, Human
aggcacugauucuguuuuccau

SEQ ID NO: 1084921 - RNA, 22 nt, Human
cagagccaggguugcaccccug

SEQ ID NO: 1084922 - RNA, 22 nt, Human
ccagggugagaaaaggcuggau

SEQ ID NO: 1084923 - RNA, 22 nt, Human
cauguccacaguucugagaggc

SEQ ID NO: 1084924 - RNA, 22 nt, Human
cuuucucuucacugucaugauc

SEQ ID NO: 1084925 - RNA, 22 nt, Human
agggcagcagcccauggcucug

SEQ ID NO: 1084926 - RNA, 22 nt, Human
gagauuuuucaacaagaauagg

SEQ ID NO: 1084927 - RNA, 22 nt, Human
ggccagaggccacagcuguguc

SEQ ID NO: 1084928 - RNA, 22 nt, Human
uucagcuaaugggaauaagagu

SEQ ID NO: 1084929 - RNA, 22 nt, Human
uuuaucuuuggaucuucagaaa

SEQ ID NO: 1084930 - RNA, 20 nt, Human
ggcuuaaggaauucuuuucu

SEQ ID NO: 1084931 - RNA, 22 nt, Human
gauggcacacagacauccccgc

SEQ ID NO: 1084932 - RNA, 22 nt, Human
gcagggaagacccggagcagcg

SEQ ID NO: 1084933 - RNA, 22 nt, Human
caccugggcuaaacuaugcagg

SEQ ID NO: 1084934 - RNA, 22 nt, Human
uuuucugaaguuuaagacauuu

SEQ ID NO: 1084935 - RNA, 22 nt, Human
auguuuaaaggguugagaaaua

SEQ ID NO: 1084936 - RNA, 18 nt, Human
ucacuggguguauguggc

SEQ ID NO: 1084937 - RNA, 22 nt, Human
aacacuuugggcauggccuucc

SEQ ID NO: 1084938 - RNA, 22 nt, Human
uccugcuugaaacucugccuuc

SEQ ID NO: 1084939 - RNA, 22 nt, Human
uggaggcagucaccugaaguca

SEQ ID NO: 1084940 - RNA, 22 nt, Human
cccucagggaccacugacuuca

SEQ ID NO: 1084941 - RNA, 22 nt, Human
ccagggcaauaggaacacuuuu

SEQ ID NO: 1084942 - RNA, 22 nt, Human
agugcuuuagcauccaacuguc

SEQ ID NO: 1084943 - RNA, 17 nt, Human
aaucuguuuacagucag

SEQ ID NO: 1084944 - RNA, 22 nt, Human
caacuauauagaaauugauugu

SEQ ID NO: 1084945 - RNA, 22 nt, Human
ugaaagcuguccacuaggcugu

SEQ ID NO: 1084946 - RNA, 22 nt, Human
ggucccuggggaacuaggcugu

SEQ ID NO: 1084947 - RNA, 22 nt, Human
gucauauugaagaagacuggca

SEQ ID NO: 1084948 - RNA, 22 nt, Human
uaguguuuucuagaaugguuuu

SEQ ID NO: 1084949 - RNA, 22 nt, Human
ugguccagacauuucugaggua

SEQ ID NO: 1084950 - RNA, 22 nt, Human
aaagagcuaacauugccgagau

SEQ ID NO: 1084951 - RNA, 22 nt, Human
gcugucagugaggugagacaug

SEQ ID NO: 1084952 - RNA, 22 nt, Human
ucucugaguaagugacaguuca

SEQ ID NO: 1084953 - RNA, 22 nt, Human
aagcucuuugaccugggccugg

SEQ ID NO: 1084954 - RNA, 21 nt, Human
agacagagugcagucuacaua

SEQ ID NO: 1084955 - RNA, 22 nt, Human
gggacuggcacagggcugggag

SEQ ID NO: 1084956 - RNA, 22 nt, Human
ccuggcuggauggagccccugg

SEQ ID NO: 1084957 - RNA, 22 nt, Human
auuucuguugcuuauaaauuac

SEQ ID NO: 1084958 - RNA, 22 nt, Human
cugcucugcaaggcacagugau

SEQ ID NO: 1084959 - RNA, 20 nt, Human
aaaggaauauaugaaguaua

SEQ ID NO: 1084960 - RNA, 22 nt, Human
auguuuguugaacaucuacugc

SEQ ID NO: 1084961 - RNA, 22 nt, Human
agggucugacaaugugacuuag

SEQ ID NO: 1084962 - RNA, 22 nt, Human
caugcugugcaucuugaugacc

SEQ ID NO: 1084963 - RNA, 22 nt, Human
ugugcagggaagggcaugcuau

SEQ ID NO: 1084964 - RNA, 22 nt, Human
acacagcugugcaguuuuuuca

SEQ ID NO: 1084965 - RNA, 22 nt, Human
agcccaugcaacaggccuagcg

SEQ ID NO: 1084966 - RNA, 22 nt, Human
ugagacaguuuuucuauuucca

SEQ ID NO: 1084967 - RNA, 22 nt, Human
ucccagagugagccaggggcag

SEQ ID NO: 1084968 - RNA, 21 nt, Human
uaacaaagacuucuggucagg

SEQ ID NO: 1084969 - RNA, 22 nt, Human
ccagaagaccccguccaccucc

SEQ ID NO: 1084970 - RNA, 22 nt, Human
aucacaaaggcugcuucaugau

SEQ ID NO: 1084971 - RNA, 22 nt, Human
uuuugguagccaacaaaauguu

SEQ ID NO: 1084972 - RNA, 22 nt, Human
aaagucauugcuguuaucaaug

SEQ ID NO: 1084973 - RNA, 22 nt, Human
agggaagaaaauccaucgcugc

SEQ ID NO: 1084974 - RNA, 22 nt, Human
cauggcaggugcagauucugug

SEQ ID NO: 1084975 - RNA, 22 nt, Human
guguccuuauuucugucucuca

SEQ ID NO: 1084976 - RNA, 22 nt, Human
acagacagacagagaacuauuc

SEQ ID NO: 1084977 - RNA, 22 nt, Human
gaugaagccccaguguaaguaa

SEQ ID NO: 1084978 - RNA, 22 nt, Human
cuggagccgcauggagcaggga

SEQ ID NO: 1084979 - RNA, 22 nt, Human
ucacauuuuaguaccaugauuu

SEQ ID NO: 1084980 - RNA, 22 nt, Human
gaauauuuuuaaagggacuaau

SEQ ID NO: 1084981 - RNA, 22 nt, Human
ucuguuccaguagaaaggugca

SEQ ID NO: 1084982 - RNA, 22 nt, Human
gcugucuugcucacucuugcag

SEQ ID NO: 1084983 - RNA, 21 nt, Human
uugcacagaaaaccauagaga

SEQ ID NO: 1084984 - RNA, 22 nt, Human
agccacaggaaacagagacagc

SEQ ID NO: 1084985 - RNA, 20 nt, Human
agugccagggcaggugagag

SEQ ID NO: 1084986 - RNA, 20 nt, Human
cuggguggcaagcaaggggg

SEQ ID NO: 1084987 - RNA, 22 nt, Human
cugaggcugggcauggggucca

SEQ ID NO: 1084988 - RNA, 22 nt, Human
acuguucuucauuuagcaaaga

SEQ ID NO: 1084989 - RNA, 22 nt, Human
aguggcaaagucuucagaaguu

SEQ ID NO: 1084990 - RNA, 22 nt, Human
caguaacacaaccacuccguga

SEQ ID NO: 1084991 - RNA, 22 nt, Human
uuucuaggcacagugucuuccc

SEQ ID NO: 1084992 - RNA, 22 nt, Human
ucauucuugaucacuaguuagu

SEQ ID NO: 1084993 - RNA, 22 nt, Human
caucacugacgcugagauucca

SEQ ID NO: 1084994 - RNA, 20 nt, Human
ucuaaacaguuggcaugggg

SEQ ID NO: 1084995 - RNA, 22 nt, Human
aggcugggcaccguuuugaucc

SEQ ID NO: 1084996 - RNA, 22 nt, Human
ugaagguggcauaggagagaug

SEQ ID NO: 1084997 - RNA, 20 nt, Human
auuugcugagcuuuuucucc

SEQ ID NO: 1084998 - RNA, 22 nt, Human
cugggagagaagcgaagcuggg

SEQ ID NO: 1084999 - RNA, 23 nt, Human
agucaguguaaguuuggaaugca

SEQ ID NO: 1085000 - RNA, 22 nt, Human
ggaaucagaauuaggauuugaa

SEQ ID NO: 1085001 - RNA, 22 nt, Human
agcagcuuuaagucacugguua

SEQ ID NO: 1085002 - RNA, 22 nt, Human
ggaggguuagcaaaggcacaga

SEQ ID NO: 1085003 - RNA, 22 nt, Human
aacuuaaacccacucauguaga

SEQ ID NO: 1085004 - RNA, 22 nt, Human
agucccagcucugccacuuacu

SEQ ID NO: 1085005 - RNA, 22 nt, Human
cagcacaauuuucaggagucca

SEQ ID NO: 1085006 - RNA, 18 nt, Human
uggcaggaaaugcacuuu

SEQ ID NO: 1085007 - RNA, 22 nt, Human
aagacuguacauuuuccagucu

SEQ ID NO: 1085008 - RNA, 21 nt, Human
aucucacagcccagagaagcc

SEQ ID NO: 1085009 - RNA, 20 nt, Human
agugugcauuuagagucugc

SEQ ID NO: 1085010 - RNA, 22 nt, Human
augcuuuuccaggagaaauaua

SEQ ID NO: 1085011 - RNA, 22 nt, Human
acagccugcugccugcuucuug

SEQ ID NO: 1085012 - RNA, 22 nt, Human
cagcugccacuugcucucggcu

SEQ ID NO: 1085013 - RNA, 22 nt, Human
cagagcacacaugcauagagug

SEQ ID NO: 1085014 - RNA, 22 nt, Human
agucucuuaauuuuuucuaagu

SEQ ID NO: 1085015 - RNA, 20 nt, Human
ucuggcaggugaacgagcug

SEQ ID NO: 1085016 - RNA, 22 nt, Human
uggagaaggacagccugagaaa

SEQ ID NO: 1085017 - RNA, 22 nt, Human
uagaaagacaugggccagcagc

SEQ ID NO: 1085018 - RNA, 22 nt, Human
ggaaguauuuguuuuugcaucc

SEQ ID NO: 1085019 - RNA, 22 nt, Human
auacuuaugauaaauaauugcu

SEQ ID NO: 1085020 - RNA, 22 nt, Human
aaccuuuauuugguacuauucu

SEQ ID NO: 1085021 - RNA, 23 nt, Human
ccucccaccuauuucacuuucuu

SEQ ID NO: 1085022 - RNA, 22 nt, Human
uagggcugcugcagaugacagg

SEQ ID NO: 1085023 - RNA, 22 nt, Human
cuggaagugggguuggcuugaa

SEQ ID NO: 1085024 - RNA, 22 nt, Human
uuucagugucaguaaugcagca

SEQ ID NO: 1085025 - RNA, 22 nt, Human
gggcugcacagaucuucaaggg

SEQ ID NO: 1085026 - RNA, 22 nt, Human
uguguuggcugccggcacagga

SEQ ID NO: 1085027 - RNA, 22 nt, Human
gccugucaauuuuguguacaau

SEQ ID NO: 1085028 - RNA, 22 nt, Human
gaccugguccuuguacuuugaa

SEQ ID NO: 1085029 - RNA, 22 nt, Human
caguacuuauuucuauuuaggg

SEQ ID NO: 1085030 - RNA, 22 nt, Human
cauggaacaaggaagauguuug

SEQ ID NO: 1085031 - RNA, 22 nt, Human
ggcuccaaagggcagugugagg

SEQ ID NO: 1085032 - RNA, 22 nt, Human
ggccagaggccauccuccugcu

SEQ ID NO: 1085033 - RNA, 22 nt, Human
uuccaaaugaguuccaucgaau

SEQ ID NO: 1085034 - RNA, 22 nt, Human
ugaaauuccaggagaguuaaaa

SEQ ID NO: 1085035 - RNA, 22 nt, Human
ucauaaauugauuaugugcuuu

SEQ ID NO: 1085036 - RNA, 22 nt, Human
agggcagcccuucugggagggc

SEQ ID NO: 1085037 - RNA, 22 nt, Human
aagccacuuggggaaagaugga

SEQ ID NO: 1085038 - RNA, 22 nt, Human
gagaaggacuacacaucuggcc

SEQ ID NO: 1085039 - RNA, 17 nt, Human
agcuuguuuuugaaagc

SEQ ID NO: 1085040 - RNA, 22 nt, Human
cagcccagcacuaaguagauuu

SEQ ID NO: 1085041 - RNA, 22 nt, Human
agcccagcaaagggagguucag

SEQ ID NO: 1085042 - RNA, 22 nt, Human
cuugcugggguaagucugugcu

SEQ ID NO: 1085043 - RNA, 22 nt, Human
acagaagaaagggagguuuugc

SEQ ID NO: 1085044 - RNA, 22 nt, Human
cagagcuguccaaacccugaca

SEQ ID NO: 1085045 - RNA, 22 nt, Human
gcuggcagacugggggcagaac

SEQ ID NO: 1085046 - RNA, 22 nt, Human
accagccugucugagucguggg

SEQ ID NO: 1085047 - RNA, 22 nt, Human
augucuuucaaauucugccuag

SEQ ID NO: 1085048 - RNA, 22 nt, Human
guauucuugaguggcaacuagg

SEQ ID NO: 1085049 - RNA, 21 nt, Human
gucuuuuuaauugcgauuucc

SEQ ID NO: 1085050 - RNA, 22 nt, Human
uauuacagggcuaguuaugagu

SEQ ID NO: 1085051 - RNA, 22 nt, Human
cugacuuuuccaaauaauacuu

SEQ ID NO: 1085052 - RNA, 22 nt, Human
auuucucaaccaggucaaaaag

SEQ ID NO: 1085053 - RNA, 22 nt, Human
aagguacaaaguauuauuuaaa

SEQ ID NO: 1085054 - RNA, 22 nt, Human
agagugcagaggucaaagaaca

SEQ ID NO: 1085055 - RNA, 22 nt, Human
caagugaucagacacugaaguc

SEQ ID NO: 1085056 - RNA, 22 nt, Human
cugaaggacuuggugauaguug

SEQ ID NO: 1085057 - RNA, 22 nt, Human
uguacagacuuugcagugugca

SEQ ID NO: 1085058 - RNA, 22 nt, Human
aaguguuuaugguuauuguuaa

SEQ ID NO: 1085059 - RNA, 22 nt, Human
ucucuuaauucagaggcaguua

SEQ ID NO: 1085060 - RNA, 22 nt, Human
uuuaccaaaguacucugaggca

SEQ ID NO: 1085061 - RNA, 22 nt, Human
auaaggcagugacuucaucuau

SEQ ID NO: 1085062 - RNA, 22 nt, Human
agaaggaaggcugagugcugau

SEQ ID NO: 1085063 - RNA, 22 nt, Human
ucucagagcuucagaaagcacc

SEQ ID NO: 1085064 - RNA, 20 nt, Human
uucauuugggaaaaucugcg

SEQ ID NO: 1085065 - RNA, 22 nt, Human
aggaaaaucaaugucuuuuuaa

SEQ ID NO: 1085066 - RNA, 22 nt, Human
auggaauugaagacagcauagg

SEQ ID NO: 1085067 - RNA, 21 nt, Human
auuuccaaggguaccuaagau

SEQ ID NO: 1085068 - RNA, 22 nt, Human
aauguacaggcuggcuaugggg

SEQ ID NO: 1085069 - RNA, 22 nt, Human
aacugaaacggugaucuuuuaa

SEQ ID NO: 1085070 - RNA, 22 nt, Human
gauaaugaugacaaugacaacc

SEQ ID NO: 1085071 - RNA, 22 nt, Human
aaauauuauugcuuaaggggag

SEQ ID NO: 1085072 - RNA, 19 nt, Human
ggcugccuggagcgagggc

SEQ ID NO: 1085073 - RNA, 22 nt, Human
ucagucuucuagcaaauccagg

SEQ ID NO: 1085074 - RNA, 22 nt, Human
agugcuuugguauagaacuauu

SEQ ID NO: 1085075 - RNA, 22 nt, Human
cccagggagguagcaggagaaa

SEQ ID NO: 1085076 - RNA, 22 nt, Human
agagugaaguucaucgugcagc

SEQ ID NO: 1085077 - RNA, 21 nt, Human
cuugaaagguagagucuacag

SEQ ID NO: 1085078 - RNA, 22 nt, Human
ucaaaugcucuuugcagagagg

SEQ ID NO: 1085079 - RNA, 22 nt, Human
accagagcuggcucugagcacc

SEQ ID NO: 1085080 - RNA, 22 nt, Human
ucacaggcuccagggccuggau

SEQ ID NO: 1085081 - RNA, 22 nt, Human
cccagcuccgagcuccgagccg

SEQ ID NO: 1085082 - RNA, 22 nt, Human
gcuggcagucccaucagcuggg

SEQ ID NO: 1085083 - RNA, 22 nt, Human
auuaaggagggcugggcaugau

SEQ ID NO: 1085084 - RNA, 22 nt, Human
agcucaggucucaggagguguc

SEQ ID NO: 1085085 - RNA, 22 nt, Human
gacagaguuguugauguaugcu

SEQ ID NO: 1085086 - RNA, 22 nt, Human
auaugcacgcauacacacauaa

SEQ ID NO: 1085087 - RNA, 23 nt, Human
ugucccagagggagggauaggcu

SEQ ID NO: 1085088 - RNA, 22 nt, Human
auauuuugguagcucucaauga

SEQ ID NO: 1085089 - RNA, 22 nt, Human
gacucagugauuugacaugccu

SEQ ID NO: 1085090 - RNA, 22 nt, Human
uuuucauguuccuuguuaagug

SEQ ID NO: 1085091 - RNA, 22 nt, Human
guauuucuagaaccaaaagcca

SEQ ID NO: 1085092 - RNA, 20 nt, Human
uucaugggagcaaagaggcc

SEQ ID NO: 1085093 - RNA, 22 nt, Human
guucacagcuucuuaggucaua

SEQ ID NO: 1085094 - RNA, 22 nt, Human
gggcagcugccaagugcaucgc

SEQ ID NO: 1085095 - RNA, 22 nt, Human
caagauuuauauuuucacacaa

SEQ ID NO: 1085096 - RNA, 22 nt, Human
agccuggauccuaggcucagcu

SEQ ID NO: 1085097 - RNA, 22 nt, Human
cauggcugcgagaagagugggu

SEQ ID NO: 1085098 - RNA, 22 nt, Human
uacaugaauguuucaauauugu

SEQ ID NO: 1085099 - RNA, 22 nt, Human
cuguaguugaugauuucugaua

SEQ ID NO: 1085100 - RNA, 22 nt, Human
uuacaguaugaucaacuuuuca

SEQ ID NO: 1085101 - RNA, 22 nt, Human
agucugucuaauauuauucagg

SEQ ID NO: 1085102 - RNA, 22 nt, Human
guccucaguaagagggccucug

SEQ ID NO: 1085103 - RNA, 22 nt, Human
gucaccugaggggaggugacag

SEQ ID NO: 1085104 - RNA, 22 nt, Human
uagaaaucuuguuacuaugugu

SEQ ID NO: 1085105 - RNA, 19 nt, Human
caaggccaccauuucuccg

SEQ ID NO: 1085106 - RNA, 22 nt, Human
ucugggagacguguguugucag

SEQ ID NO: 1085107 - RNA, 23 nt, Human
uuacuacacaaguaacgauuccc

SEQ ID NO: 1085108 - RNA, 22 nt, Human
agcugugggauuugggugugcc

SEQ ID NO: 1085109 - RNA, 20 nt, Human
ucaggcaguggggaaaggca

SEQ ID NO: 1085110 - RNA, 22 nt, Human
uaucacacuguuuuaauuacuu

SEQ ID NO: 1085111 - RNA, 22 nt, Human
cacagcuggugacagagcccag

SEQ ID NO: 1085112 - RNA, 22 nt, Human
augggaagugaagucagggagg

SEQ ID NO: 1085113 - RNA, 22 nt, Human
cuguuuuaauggagacugaugu

SEQ ID NO: 1085114 - RNA, 22 nt, Human
uuugaaaucuaaucaaggaaca

SEQ ID NO: 1085115 - RNA, 22 nt, Human
agaagccauucccuguaggcuc

SEQ ID NO: 1085116 - RNA, 22 nt, Human
uacaguauuacuguguuguuuu

SEQ ID NO: 1085117 - RNA, 19 nt, Human
auuucaagagguuuauugg

SEQ ID NO: 1085118 - RNA, 23 nt, Human
gaaagucaauaugguagcuuuga

SEQ ID NO: 1085119 - RNA, 20 nt, Human
augggcugguuaggaagugu

SEQ ID NO: 1085120 - RNA, 22 nt, Human
uguggcaaagaccauuucuuuc

SEQ ID NO: 1085121 - RNA, 20 nt, Human
uccugagauuuaagggguuc

SEQ ID NO: 1085122 - RNA, 21 nt, Human
agagccugagaucuuccagca

SEQ ID NO: 1085123 - RNA, 22 nt, Human
acuuugaaauguguaagagaga

SEQ ID NO: 1085124 - RNA, 22 nt, Human
cuucagugcauguuuauaauca

SEQ ID NO: 1085125 - RNA, 19 nt, Human
cuggaaugagaacaugccc

SEQ ID NO: 1085126 - RNA, 22 nt, Human
gggagaaggaggacugugcugu

SEQ ID NO: 1085127 - RNA, 22 nt, Human
ugggcuggugagggaucauuua

SEQ ID NO: 1085128 - RNA, 16 nt, Human
cuucacagaggagagu

SEQ ID NO: 1085129 - RNA, 22 nt, Human
gggaggcacgaggcgcgcagug

SEQ ID NO: 1085130 - RNA, 22 nt, Human
acuuccagaacagguacauuuu

SEQ ID NO: 1085131 - RNA, 22 nt, Human
cccagcucuuccugggagcuaa

SEQ ID NO: 1085132 - RNA, 22 nt, Human
cuccagcucgcgagcucugcuc

SEQ ID NO: 1085133 - RNA, 22 nt, Human
ugucccuuuguguucugaaacu

SEQ ID NO: 1085134 - RNA, 22 nt, Human
ggcagcagcaagguuggagcug

SEQ ID NO: 1085135 - RNA, 22 nt, Human
ggcaggcauggggucugccauu

SEQ ID NO: 1085136 - RNA, 20 nt, Human
guggcaggcagugaaggagc

SEQ ID NO: 1085137 - RNA, 22 nt, Human
cugaggcacagugaacuucucc

SEQ ID NO: 1085138 - RNA, 22 nt, Human
gugggaugguagguagguaaua

SEQ ID NO: 1085139 - RNA, 22 nt, Human
cccaggaaauauguuucuuaac

SEQ ID NO: 1085140 - RNA, 22 nt, Human
guuaaugugucugacacaaugg

SEQ ID NO: 1085141 - RNA, 23 nt, Human
uugauacagaagaaucaguuugu

SEQ ID NO: 1085142 - RNA, 22 nt, Human
auguuuguguuacacucugcag

SEQ ID NO: 1085143 - RNA, 20 nt, Human
cucugagguaucuguaaagu

SEQ ID NO: 1085144 - RNA, 19 nt, Human
aggccugggguuuugcacu

SEQ ID NO: 1085145 - RNA, 21 nt, Human
guguuuccuguuuauggcuug

SEQ ID NO: 1085146 - RNA, 22 nt, Human
acuugcauguguaaaucuuccu

SEQ ID NO: 1085147 - RNA, 22 nt, Human
cccugccuugggguccacaccg

SEQ ID NO: 1085148 - RNA, 22 nt, Human
uuccaaguagaagcauuugcau

SEQ ID NO: 1085149 - RNA, 22 nt, Human
agggaagaagcugguaguaggu

SEQ ID NO: 1085150 - RNA, 22 nt, Human
gcugcggugaacuuggauggug

SEQ ID NO: 1085151 - RNA, 16 nt, Human
gaggcuggcagauguc

SEQ ID NO: 1085152 - RNA, 22 nt, Human
uggcauuuggcuuacuuauguu

SEQ ID NO: 1085153 - RNA, 22 nt, Human
auccugggaagcugacauugaa

SEQ ID NO: 1085154 - RNA, 21 nt, Human
uucuucaaagaagaaggcaca

SEQ ID NO: 1085155 - RNA, 22 nt, Human
gaaaugugugacaaguuucaau

SEQ ID NO: 1085156 - RNA, 22 nt, Human
aacauuucugagaauaucaguu

SEQ ID NO: 1085157 - RNA, 22 nt, Human
aagaaguuaauaauggugagaa

SEQ ID NO: 1085158 - RNA, 21 nt, Human
uaacuuuugugccuaucuugu

SEQ ID NO: 1085159 - RNA, 22 nt, Human
ucagccuggugauuccucuguc

SEQ ID NO: 1085160 - RNA, 22 nt, Human
aggccuggugugccggaugcag

SEQ ID NO: 1085161 - RNA, 22 nt, Human
aaaugcauuaagucagaacaau

SEQ ID NO: 1085162 - RNA, 22 nt, Human
uugcaaggucaucaugcauugg

SEQ ID NO: 1085163 - RNA, 22 nt, Human
ccugguggcuucuggguggacg

SEQ ID NO: 1085164 - RNA, 22 nt, Human
uuauuguuuacuaguuugcaga

SEQ ID NO: 1085165 - RNA, 22 nt, Human
ugagcuuacuucuguacacaga

SEQ ID NO: 1085166 - RNA, 22 nt, Human
cagggcugagaauuuagagaca

SEQ ID NO: 1085167 - RNA, 19 nt, Human
ucagggcaguccggucccc

SEQ ID NO: 1085168 - RNA, 22 nt, Human
ugucccaggccucauguugcca

SEQ ID NO: 1085169 - RNA, 22 nt, Human
aagcacuugcuuagaugugguu

SEQ ID NO: 1085170 - RNA, 22 nt, Human
agagcuggccagggaucacucu

SEQ ID NO: 1085171 - RNA, 22 nt, Human
uucauugaaauacagucuugac

SEQ ID NO: 1085172 - RNA, 22 nt, Human
ucauuucaguucagaggccuuu

SEQ ID NO: 1085173 - RNA, 19 nt, Human
ugcucagcuccugugaguc

SEQ ID NO: 1085174 - RNA, 20 nt, Human
cuggggacagcaauggcugu

SEQ ID NO: 1085175 - RNA, 22 nt, Human
uacagcauguccuuagcaaggc

SEQ ID NO: 1085176 - RNA, 22 nt, Human
gaagaaggaagaucaugcuuga

SEQ ID NO: 1085177 - RNA, 22 nt, Human
agugcaggcucgcuugugaggc

SEQ ID NO: 1085178 - RNA, 22 nt, Human
ugaggaagcaaaggcuugugug

SEQ ID NO: 1085179 - RNA, 22 nt, Human
agagccaggcggcugggcaccu

SEQ ID NO: 1085180 - RNA, 22 nt, Human
gucccugcaucaccacgggacu

SEQ ID NO: 1085181 - RNA, 22 nt, Human
acacaaacagucuauagcacca

SEQ ID NO: 1085182 - RNA, 20 nt, Human
ucccucaguuuccagcccug

SEQ ID NO: 1085183 - RNA, 22 nt, Human
ugggccucaguuuccuuaggau

SEQ ID NO: 1085184 - RNA, 23 nt, Human
cuggcuccgaagacuccaggauc

SEQ ID NO: 1085185 - RNA, 22 nt, Human
accagaguaauguguggaaauu

SEQ ID NO: 1085186 - RNA, 22 nt, Human
auacauacguacauacguaugu

SEQ ID NO: 1085187 - RNA, 20 nt, Human
aggcacuggggauagguaag

SEQ ID NO: 1085188 - RNA, 22 nt, Human
caaggaaguuuuaggagaggaa

SEQ ID NO: 1085189 - RNA, 22 nt, Human
caaucugaguugggaauguauu

SEQ ID NO: 1085190 - RNA, 22 nt, Human
gauguuucugggaaggaaaagu

SEQ ID NO: 1085191 - RNA, 22 nt, Human
gaggccuggcugggaggaggug

SEQ ID NO: 1085192 - RNA, 22 nt, Human
uaaacaucuguagccuucaguc

SEQ ID NO: 1085193 - RNA, 18 nt, Human
agaauuaccaaagugcuu

SEQ ID NO: 1085194 - RNA, 22 nt, Human
gcucuuccauuucucuugaacu

SEQ ID NO: 1085195 - RNA, 22 nt, Human
agcccugcugccugaauuagcu

SEQ ID NO: 1085196 - RNA, 19 nt, Human
aaaaggaauauucuuuggg

SEQ ID NO: 1085197 - RNA, 22 nt, Human
gccagguggagguugcagugag

SEQ ID NO: 1085198 - RNA, 22 nt, Human
uccaggcaguuuuccagguugu

SEQ ID NO: 1085199 - RNA, 22 nt, Human
gcagcuguaaagcagaaauagu

SEQ ID NO: 1085200 - RNA, 22 nt, Human
cucagcuaguaacguacauguc

SEQ ID NO: 1085201 - RNA, 22 nt, Human
aaaacuuucagggauacagaaa

SEQ ID NO: 1085202 - RNA, 20 nt, Human
gggcccugggauucagagca

SEQ ID NO: 1085203 - RNA, 22 nt, Human
caagggaguuacugagggcggg

SEQ ID NO: 1085204 - RNA, 22 nt, Human
acuuccugcagcuucucagccc

SEQ ID NO: 1085205 - RNA, 22 nt, Human
ucacagaauaaauugagaagac

SEQ ID NO: 1085206 - RNA, 22 nt, Human
aguuuuuccugauuuuacagaa

SEQ ID NO: 1085207 - RNA, 22 nt, Human
acauacuugaagcaagugauca

SEQ ID NO: 1085208 - RNA, 22 nt, Human
uuguaugaggauagcaagaagc

SEQ ID NO: 1085209 - RNA, 22 nt, Human
aagcugauucuaaaauuuauua

SEQ ID NO: 1085210 - RNA, 22 nt, Human
gaagagcuccaaaaacagugag

SEQ ID NO: 1085211 - RNA, 22 nt, Human
ucugcccugcagggagcaguaa

SEQ ID NO: 1085212 - RNA, 22 nt, Human
caaaacuaucaggcucaaagcu

SEQ ID NO: 1085213 - RNA, 22 nt, Human
cuuccucugcggcgccgggcgc

SEQ ID NO: 1085214 - RNA, 20 nt, Human
aggaacuggaagggaggaaa

SEQ ID NO: 1085215 - RNA, 22 nt, Human
auuguuaugaaaauaagauguu

SEQ ID NO: 1085216 - RNA, 22 nt, Human
acagaaguguguguguaggaau

SEQ ID NO: 1085217 - RNA, 22 nt, Human
uguggcagucucacuggagggc

SEQ ID NO: 1085218 - RNA, 22 nt, Human
guacacacaaucucuggucagu

SEQ ID NO: 1085219 - RNA, 21 nt, Human
ugucagcaacaauacuuucuc

SEQ ID NO: 1085220 - RNA, 22 nt, Human
cagaggccuauccaguguccau

SEQ ID NO: 1085221 - RNA, 22 nt, Human
uuuacaguuaagaaauguuacc

SEQ ID NO: 1085222 - RNA, 22 nt, Human
uauuucucuucaaaauugaugu

SEQ ID NO: 1085223 - RNA, 22 nt, Human
uugaggagcacuagucagguau

SEQ ID NO: 1085224 - RNA, 22 nt, Human
uaaguuaacccuguuaauagau

SEQ ID NO: 1085225 - RNA, 22 nt, Human
ggacuucuaagugccagacacu

SEQ ID NO: 1085226 - RNA, 22 nt, Human
agccucucuuuauucccagcua

SEQ ID NO: 1085227 - RNA, 20 nt, Human
uaaaugcaugaauguaaggc

SEQ ID NO: 1085228 - RNA, 22 nt, Human
cugagccaguagucagggacaa

SEQ ID NO: 1085229 - RNA, 22 nt, Human
uuguuaaaaauagauuuccagg

SEQ ID NO: 1085230 - RNA, 22 nt, Human
accaugccaguggcagccagac

SEQ ID NO: 1085231 - RNA, 22 nt, Human
uuuguaaaauuagggaauucaa

SEQ ID NO: 1085232 - RNA, 22 nt, Human
ucugcugugauuugcuaccugu

SEQ ID NO: 1085233 - RNA, 22 nt, Human
cagguacacaggacaaaguacu

SEQ ID NO: 1085234 - RNA, 22 nt, Human
aacaacugcuaagguguguccu

SEQ ID NO: 1085235 - RNA, 22 nt, Human
agcagugaguaacacagaccag

SEQ ID NO: 1085236 - RNA, 21 nt, Human
cucugcccagggccuccugcc

SEQ ID NO: 1085237 - RNA, 22 nt, Human
cuggccaacuugcuuguuggca

SEQ ID NO: 1085238 - RNA, 22 nt, Human
gagagugaggcaucaggggcag

SEQ ID NO: 1085239 - RNA, 22 nt, Human
ucuuuucuugcauuauugcacu

SEQ ID NO: 1085240 - RNA, 22 nt, Human
ugagcccagucugucugacaug

SEQ ID NO: 1085241 - RNA, 22 nt, Human
ucccacacagcccgcucaccgg

SEQ ID NO: 1085242 - RNA, 22 nt, Human
uugaaauccaauuaucauaugu

SEQ ID NO: 1085243 - RNA, 22 nt, Human
gggcacugugcuaggugcugag

SEQ ID NO: 1085244 - RNA, 22 nt, Human
ucauuucuaucuaugcagcuuc

SEQ ID NO: 1085245 - RNA, 22 nt, Human
agcucuuuugugagcauuuggc

SEQ ID NO: 1085246 - RNA, 22 nt, Human
uugaaacauucuccuauugauu

SEQ ID NO: 1085247 - RNA, 22 nt, Human
ugucauuaugaggauuacaaua

SEQ ID NO: 1085248 - RNA, 22 nt, Human
uuuacaaccucauauucugaug

SEQ ID NO: 1085249 - RNA, 22 nt, Human
cacaugaagagagucuaguaau

SEQ ID NO: 1085250 - RNA, 22 nt, Human
gugggggagaugcuuagguccg

SEQ ID NO: 1085251 - RNA, 22 nt, Human
uuucuucuugauuuaaacaggg

SEQ ID NO: 1085252 - RNA, 22 nt, Human
guauuucaucuugaaaaccagu

SEQ ID NO: 1085253 - RNA, 22 nt, Human
augcugugucaccuuaggauuu

SEQ ID NO: 1085254 - RNA, 22 nt, Human
ccuccugggacucauuagcacc

SEQ ID NO: 1085255 - RNA, 22 nt, Human
ggggaugguggcauuuguaaaa

SEQ ID NO: 1085256 - RNA, 22 nt, Human
ccugggcucugaggagggaguc

SEQ ID NO: 1085257 - RNA, 22 nt, Human
cugggccuggggcuguugagag

SEQ ID NO: 1085258 - RNA, 22 nt, Human
gcugccagccaacuugcugugc

SEQ ID NO: 1085259 - RNA, 22 nt, Human
agcuaguucacugaagccuaug

SEQ ID NO: 1085260 - RNA, 22 nt, Human
acuuucucaggaauucacagac

SEQ ID NO: 1085261 - RNA, 22 nt, Human
ggaugcugggagacagcaggca

SEQ ID NO: 1085262 - RNA, 22 nt, Human
gccaggcuguggggaacuugaa

SEQ ID NO: 1085263 - RNA, 23 nt, Human
ucucagugaaucucagaauucgc

SEQ ID NO: 1085264 - RNA, 22 nt, Human
ugcugccaccccucaccagagc

SEQ ID NO: 1085265 - RNA, 22 nt, Human
uuacagauucaagcucuuugaa

SEQ ID NO: 1085266 - RNA, 22 nt, Human
guuccugggccugcauucacca

SEQ ID NO: 1085267 - RNA, 22 nt, Human
agagcaaagggacauggaagag

SEQ ID NO: 1085268 - RNA, 21 nt, Human
aguuuuuacucuuaacugugg

SEQ ID NO: 1085269 - RNA, 22 nt, Human
ccagcuaguaagcaccugcauc

SEQ ID NO: 1085270 - RNA, 18 nt, Human
uguaaacacuuucauucu

SEQ ID NO: 1085271 - RNA, 22 nt, Human
gccaccagugggggccugggca

SEQ ID NO: 1085272 - RNA, 22 nt, Human
aggaggccgauuucagaggucg

SEQ ID NO: 1085273 - RNA, 22 nt, Human
uuucagaaauggcacugaaauc

SEQ ID NO: 1085274 - RNA, 23 nt, Human
ccagcugugccuggcccaggagc

SEQ ID NO: 1085275 - RNA, 22 nt, Human
acaggccugacacacagagggc

SEQ ID NO: 1085276 - RNA, 22 nt, Human
cccagagucacaugggguguuc

SEQ ID NO: 1085277 - RNA, 22 nt, Human
auuguugggucucacuccuaga

SEQ ID NO: 1085278 - RNA, 22 nt, Human
ggagccagugcccucuggugga

SEQ ID NO: 1085279 - RNA, 22 nt, Human
gccugagcuacuagggagucug

SEQ ID NO: 1085280 - RNA, 22 nt, Human
cagccuggauugcagaaugcua

SEQ ID NO: 1085281 - RNA, 22 nt, Human
aagauuuucucaacuguauuug

SEQ ID NO: 1085282 - RNA, 22 nt, Human
caugacacccaggcauagcacc

SEQ ID NO: 1085283 - RNA, 22 nt, Human
aggagcuguuuuguucagcaaa

SEQ ID NO: 1085284 - RNA, 20 nt, Human
ugcagcugguuucacaggga

SEQ ID NO: 1085285 - RNA, 22 nt, Human
auuaacagaauuuuacaugcuu

SEQ ID NO: 1085286 - RNA, 21 nt, Human
ugauuucugccaaguucacua

SEQ ID NO: 1085287 - RNA, 22 nt, Human
acuucaugaacuaagggaucgg

SEQ ID NO: 1085288 - RNA, 22 nt, Human
cuucagcuaggaucccugcagc

SEQ ID NO: 1085289 - RNA, 22 nt, Human
agccuccuguagcccucaccca

SEQ ID NO: 1085290 - RNA, 22 nt, Human
ccacagaaccucagcuuugagc

SEQ ID NO: 1085291 - RNA, 22 nt, Human
cauguggcuuuggcaugugccc

SEQ ID NO: 1085292 - RNA, 22 nt, Human
gcagauggagacgagguuccgc

SEQ ID NO: 1085293 - RNA, 22 nt, Human
gccagcccagcuccaggggaaa

SEQ ID NO: 1085294 - RNA, 22 nt, Human
ggguguguuccuaaggaaacca

SEQ ID NO: 1085295 - RNA, 22 nt, Human
cuucugcaauaaguuuuggucc

SEQ ID NO: 1085296 - RNA, 22 nt, Human
gugcugcgaugauuuuacagag

SEQ ID NO: 1085297 - RNA, 22 nt, Human
cagcaauaaugucuacaaaucu

SEQ ID NO: 1085298 - RNA, 22 nt, Human
uaagaaguguugccuaaugcaa

SEQ ID NO: 1085299 - RNA, 22 nt, Human
agguggggccaaaugcuacagu

SEQ ID NO: 1085300 - RNA, 22 nt, Human
guuucuuauuucaacuggaaca

SEQ ID NO: 1085301 - RNA, 22 nt, Human
agggcagccucucagccuaggu

SEQ ID NO: 1085302 - RNA, 22 nt, Human
agaaguuuguuauguaaacaaa

SEQ ID NO: 1085303 - RNA, 22 nt, Human
gcugugcagauguagggagugg

SEQ ID NO: 1085304 - RNA, 22 nt, Human
uacagaguuuuccugccaagaa

SEQ ID NO: 1085305 - RNA, 21 nt, Human
ucucccaaggagguccugagg

SEQ ID NO: 1085306 - RNA, 22 nt, Human
gcuuuacagagaaaguuugccu

SEQ ID NO: 1085307 - RNA, 22 nt, Human
agcucugguuauugaagcaggg

SEQ ID NO: 1085308 - RNA, 22 nt, Human
uggagccaaggccaguucucag

SEQ ID NO: 1085309 - RNA, 22 nt, Human
ccugccugguguaagucuaagg

SEQ ID NO: 1085310 - RNA, 22 nt, Human
cugaaggauuagagagcacuua

SEQ ID NO: 1085311 - RNA, 22 nt, Human
uuacaugaugauuucauaaaca

SEQ ID NO: 1085312 - RNA, 20 nt, Human
agagccuugaggaagaugau

SEQ ID NO: 1085313 - RNA, 22 nt, Human
gagaauuagggcguaauucaga

SEQ ID NO: 1085314 - RNA, 22 nt, Human
gucacaggccuggaugaggggc

SEQ ID NO: 1085315 - RNA, 22 nt, Human
caggagguuguaagagcaggcc

SEQ ID NO: 1085316 - RNA, 22 nt, Human
cuguguccugcgucaagccaau

SEQ ID NO: 1085317 - RNA, 22 nt, Human
caugauaacacuucuguuuaau

SEQ ID NO: 1085318 - RNA, 22 nt, Human
cagcuuugauucuuucugccau

SEQ ID NO: 1085319 - RNA, 22 nt, Human
uaagaccaguaugcauuuucac

SEQ ID NO: 1085320 - RNA, 22 nt, Human
uugaaaggccuguuuauccagc

SEQ ID NO: 1085321 - RNA, 22 nt, Human
uaauguuuuucucaacauugcu

SEQ ID NO: 1085322 - RNA, 22 nt, Human
gccucuagggcuguugggaauu

SEQ ID NO: 1085323 - RNA, 22 nt, Human
gauuaaaaauaacccaugcuga

SEQ ID NO: 1085324 - RNA, 22 nt, Human
guuuuccacuggauuguuugga

SEQ ID NO: 1085325 - RNA, 22 nt, Human
ggcacacaaaggcagcauuuga

SEQ ID NO: 1085326 - RNA, 22 nt, Human
ggcagccaugcacgcugccugg

SEQ ID NO: 1085327 - RNA, 22 nt, Human
uucuuaggagcauuaguaauuu

SEQ ID NO: 1085328 - RNA, 22 nt, Human
gugcuuccccaagccacagccu

SEQ ID NO: 1085329 - RNA, 22 nt, Human
aaggcagcaugaaucccuguac

SEQ ID NO: 1085330 - RNA, 22 nt, Human
acugaacauaugcaagaccauu

SEQ ID NO: 1085331 - RNA, 22 nt, Human
uucuuuuuggauagcugaugaa

SEQ ID NO: 1085332 - RNA, 22 nt, Human
agacccucuccucauggacaug

SEQ ID NO: 1085333 - RNA, 18 nt, Human
caugggugacagguggau

SEQ ID NO: 1085334 - RNA, 22 nt, Human
caggccacaaguuggguucaag

SEQ ID NO: 1085335 - RNA, 22 nt, Human
agcuaugguaaucauccaccaa

SEQ ID NO: 1085336 - RNA, 22 nt, Human
gaaacaacuacuauugauuucu

SEQ ID NO: 1085337 - RNA, 22 nt, Human
uacagaaaaacuuggaggcuuu

SEQ ID NO: 1085338 - RNA, 22 nt, Human
ucuucauguugcuguagggaga

SEQ ID NO: 1085339 - RNA, 22 nt, Human
gcguggugcugcccugcacaca

SEQ ID NO: 1085340 - RNA, 18 nt, Human
ugagagugugugcucuug

SEQ ID NO: 1085341 - RNA, 19 nt, Human
ugagaaggcaguggggagc

SEQ ID NO: 1085342 - RNA, 22 nt, Human
gcugggcuucucaaugcugccu

SEQ ID NO: 1085343 - RNA, 22 nt, Human
gucuccaguguucaggugacug

SEQ ID NO: 1085344 - RNA, 22 nt, Human
uagacacauccguggaagcuuc

SEQ ID NO: 1085345 - RNA, 20 nt, Human
uccaguggccugaaucugga

SEQ ID NO: 1085346 - RNA, 22 nt, Human
agagugguacuucuuuuucuuc

SEQ ID NO: 1085347 - RNA, 22 nt, Human
aaauuuguauuccuuuuccgua

SEQ ID NO: 1085348 - RNA, 22 nt, Human
cggcagagcggcgagccccucc

SEQ ID NO: 1085349 - RNA, 22 nt, Human
gugucauuaaccaccaugcaaa

SEQ ID NO: 1085350 - RNA, 21 nt, Human
agagcugggacuugccugaga

SEQ ID NO: 1085351 - RNA, 21 nt, Human
agcagagugcuuugacuuugu

SEQ ID NO: 1085352 - RNA, 22 nt, Human
acacaugcucauaaauaaauag

SEQ ID NO: 1085353 - RNA, 22 nt, Human
ucaaagacuauauauuuuauuu

SEQ ID NO: 1085354 - RNA, 22 nt, Human
ucacuuauugcucaucucaugc

SEQ ID NO: 1085355 - RNA, 22 nt, Human
uaaaggcaaauguguguuugug

SEQ ID NO: 1085356 - RNA, 23 nt, Human
gcaguggaaugucucuguuugga

SEQ ID NO: 1085357 - RNA, 21 nt, Human
uaaagaagaugaaugugauca

SEQ ID NO: 1085358 - RNA, 22 nt, Human
augcucucuguccugcucagag

SEQ ID NO: 1085359 - RNA, 22 nt, Human
agggcugacacaccuuauccuc

SEQ ID NO: 1085360 - RNA, 22 nt, Human
uaaacagaaugcguaagaagug

SEQ ID NO: 1085361 - RNA, 22 nt, Human
gcuguggccgucagggaaaugg

SEQ ID NO: 1085362 - RNA, 22 nt, Human
ggagggagcauccccuugcuga

SEQ ID NO: 1085363 - RNA, 22 nt, Human
caauguaucaaccagaaaguuc

SEQ ID NO: 1085364 - RNA, 22 nt, Human
uuacauuuuaguuaaccuguga

SEQ ID NO: 1085365 - RNA, 22 nt, Human
caaauucucuuacuguuugaca

SEQ ID NO: 1085366 - RNA, 22 nt, Human
aagugauuuuccuacuugcuaa

SEQ ID NO: 1085367 - RNA, 22 nt, Human
uuauagaucuaaaugugaaggg

SEQ ID NO: 1085368 - RNA, 22 nt, Human
cugaaggacacgugaggagcca

SEQ ID NO: 1085369 - RNA, 22 nt, Human
uaucagaaagauauuacugggg

SEQ ID NO: 1085370 - RNA, 22 nt, Human
agaaaugaauauguagugguua

SEQ ID NO: 1085371 - RNA, 22 nt, Human
aaauacagaguuauggaccuca

SEQ ID NO: 1085372 - RNA, 22 nt, Human
ugagagagccugaaucucuuac

SEQ ID NO: 1085373 - RNA, 22 nt, Human
aacucacagcuguuuggauuag

SEQ ID NO: 1085374 - RNA, 19 nt, Human
cuggcagccugucuguguc

SEQ ID NO: 1085375 - RNA, 22 nt, Human
ggcuguggggccggguacagug

SEQ ID NO: 1085376 - RNA, 22 nt, Human
uauuuggagaugggaucuucaa

SEQ ID NO: 1085377 - RNA, 22 nt, Human
agugaaaugauaguguaaauac

SEQ ID NO: 1085378 - RNA, 22 nt, Human
auccucagcaucuagcaugaag

SEQ ID NO: 1085379 - RNA, 22 nt, Human
gaagaccaauuugggccauggc

SEQ ID NO: 1085380 - RNA, 22 nt, Human
aaguaaaauguuuccuuuauua

SEQ ID NO: 1085381 - RNA, 22 nt, Human
ucaucagucagaacuuaagcuu

SEQ ID NO: 1085382 - RNA, 22 nt, Human
gaggucuuagaagaaaaaucau

SEQ ID NO: 1085383 - RNA, 22 nt, Human
cuggccugaggccgccuucaga

SEQ ID NO: 1085384 - RNA, 22 nt, Human
uccugcacauuaguauuuuuua

SEQ ID NO: 1085385 - RNA, 22 nt, Human
cuucccuuuagcauauaguagu

SEQ ID NO: 1085386 - RNA, 22 nt, Human
uucuuauguucacauaauucca

SEQ ID NO: 1085387 - RNA, 22 nt, Human
ccucuuccacugggccccaucc

SEQ ID NO: 1085388 - RNA, 22 nt, Human
auuugucugcuugcugccuucc

SEQ ID NO: 1085389 - RNA, 22 nt, Human
gcucucugucguuaugcuucau

SEQ ID NO: 1085390 - RNA, 22 nt, Human
ggccaccuuccaguugccugca

SEQ ID NO: 1085391 - RNA, 22 nt, Human
gugaagaugccucaggugaccc

SEQ ID NO: 1085392 - RNA, 22 nt, Human
cucuuucaguucugauagucuc

SEQ ID NO: 1085393 - RNA, 22 nt, Human
ccagaaggcggagauugcagug

SEQ ID NO: 1085394 - RNA, 22 nt, Human
auuuugaaaagcauuugaguaa

SEQ ID NO: 1085395 - RNA, 22 nt, Human
uggcuuccgccgcgggccucgg

SEQ ID NO: 1085396 - RNA, 22 nt, Human
ugcugggggcuuucuggauacc

SEQ ID NO: 1085397 - RNA, 17 nt, Human
uuugaaaggaugucagu

SEQ ID NO: 1085398 - RNA, 22 nt, Human
ucauugcaagcucauuuaucug

SEQ ID NO: 1085399 - RNA, 22 nt, Human
ugccaggcuguccugggccugg

SEQ ID NO: 1085400 - RNA, 22 nt, Human
gcugaggacaucauggaaggaa

SEQ ID NO: 1085401 - RNA, 22 nt, Human
cuucuugcugggggccucagug

SEQ ID NO: 1085402 - RNA, 22 nt, Human
guucuugccagcauccucaggu

SEQ ID NO: 1085403 - RNA, 22 nt, Human
caaaugaagaaccuucucaccu

SEQ ID NO: 1085404 - RNA, 22 nt, Human
caaugauuuuuccauugcagga

SEQ ID NO: 1085405 - RNA, 22 nt, Human
ucuuuuaagccucuggcauagg

SEQ ID NO: 1085406 - RNA, 21 nt, Human
gcagagccugagguucuugag

SEQ ID NO: 1085407 - RNA, 22 nt, Human
caugaacuccaagcuuccuucc

SEQ ID NO: 1085408 - RNA, 22 nt, Human
auacuuuagagcuagauugccu

SEQ ID NO: 1085409 - RNA, 22 nt, Human
cacauauaugaaaugaggaauu

SEQ ID NO: 1085410 - RNA, 15 nt, Human
ugggcagaucacuug

SEQ ID NO: 1085411 - RNA, 22 nt, Human
uuacuacauuguaacacaguac

SEQ ID NO: 1085412 - RNA, 22 nt, Human
accaaggaguuugguauuuuag

SEQ ID NO: 1085413 - RNA, 22 nt, Human
ugcagggccaugguggcggcug

SEQ ID NO: 1085414 - RNA, 22 nt, Human
cagggcacaguuauggaggugg

SEQ ID NO: 1085415 - RNA, 22 nt, Human
cagcacaguagaguaguuguaa

SEQ ID NO: 1085416 - RNA, 22 nt, Human
ugcauauacccgcauuuacaua

SEQ ID NO: 1085417 - RNA, 22 nt, Human
agcagccacacgccuccuucuc

SEQ ID NO: 1085418 - RNA, 20 nt, Human
cucugcagcaaggccugggu

SEQ ID NO: 1085419 - RNA, 22 nt, Human
ccugcagggugcugccacagau

SEQ ID NO: 1085420 - RNA, 22 nt, Human
uccagucaucucccuucacauu

SEQ ID NO: 1085421 - RNA, 18 nt, Human
ccuggcagccaugcgcgc

SEQ ID NO: 1085422 - RNA, 22 nt, Human
uugggccucucaaagugcuggg

SEQ ID NO: 1085423 - RNA, 22 nt, Human
uaaggcacccauguucauacag

SEQ ID NO: 1085424 - RNA, 22 nt, Human
uucaacaucauuguaagccucu

SEQ ID NO: 1085425 - RNA, 22 nt, Human
aagagguugucugugaugaguu

SEQ ID NO: 1085426 - RNA, 22 nt, Human
acaauauacacauccuaauggg

SEQ ID NO: 1085427 - RNA, 22 nt, Human
uccauuaacaccuguacguggc

SEQ ID NO: 1085428 - RNA, 22 nt, Human
gagggcugcugccagauaugcc

SEQ ID NO: 1085429 - RNA, 22 nt, Human
aucuagaacuuaaagucaguca

SEQ ID NO: 1085430 - RNA, 22 nt, Human
aauguuucauucuugcccauug

SEQ ID NO: 1085431 - RNA, 22 nt, Human
uuugaaaguccuaggagagucc

SEQ ID NO: 1085432 - RNA, 22 nt, Human
gccagguggcugagugacugag

SEQ ID NO: 1085433 - RNA, 22 nt, Human
ucaggaacuucuaggaaagcug

SEQ ID NO: 1085434 - RNA, 22 nt, Human
uuucaagcauaacugggaagag

SEQ ID NO: 1085435 - RNA, 22 nt, Human
ugcccaagauucuuacaucaug

SEQ ID NO: 1085436 - RNA, 22 nt, Human
uggcagggaguugcaggauuuc

SEQ ID NO: 1085437 - RNA, 22 nt, Human
cucuggagugcagccugguggc

SEQ ID NO: 1085438 - RNA, 22 nt, Human
acugcuggaaacccagaauggu

SEQ ID NO: 1085439 - RNA, 19 nt, Human
aaacuaaggggaaauguuu

SEQ ID NO: 1085440 - RNA, 22 nt, Human
ucauuucaaguucugacagcua

SEQ ID NO: 1085441 - RNA, 22 nt, Human
acacacaugguauuguucagaa

SEQ ID NO: 1085442 - RNA, 22 nt, Human
aaaccuauauagucuuagaagc

SEQ ID NO: 1085443 - RNA, 22 nt, Human
agcuuccauacuaagacaaaag

SEQ ID NO: 1085444 - RNA, 20 nt, Human
gagauggcuaagugcugaac

SEQ ID NO: 1085445 - RNA, 22 nt, Human
uacauucuggaaaggcacagac

SEQ ID NO: 1085446 - RNA, 18 nt, Human
acaaauguagugucuuaa

SEQ ID NO: 1085447 - RNA, 22 nt, Human
ccugugucagccccugccucca

SEQ ID NO: 1085448 - RNA, 22 nt, Human
uuucacacuagucagaauacca

SEQ ID NO: 1085449 - RNA, 22 nt, Human
uuuucuuuaaucugguggggug

SEQ ID NO: 1085450 - RNA, 22 nt, Human
ugauuuccaguugcugggugcu

SEQ ID NO: 1085451 - RNA, 22 nt, Human
aucugaaauagucuuaucugag

SEQ ID NO: 1085452 - RNA, 22 nt, Human
ccacauuuacugauguauguau

SEQ ID NO: 1085453 - RNA, 22 nt, Human
cucuaaauccaaauaagugucc

SEQ ID NO: 1085454 - RNA, 22 nt, Human
agggcagagcacugaauuggga

SEQ ID NO: 1085455 - RNA, 22 nt, Human
gagcgggaggaacggcucgggc

SEQ ID NO: 1085456 - RNA, 22 nt, Human
aauuccagucucugcucuauuu

SEQ ID NO: 1085457 - RNA, 22 nt, Human
augagcagaugcuccugccucu

SEQ ID NO: 1085458 - RNA, 22 nt, Human
cagauauuaggagcucaauaau

SEQ ID NO: 1085459 - RNA, 22 nt, Human
acagccuggccugaguuaaggc

SEQ ID NO: 1085460 - RNA, 22 nt, Human
ugaacaaauggaaauaaccagu

SEQ ID NO: 1085461 - RNA, 22 nt, Human
uguuucuucucacacaaacuca

SEQ ID NO: 1085462 - RNA, 22 nt, Human
uggcagagagagugcagucgac

SEQ ID NO: 1085463 - RNA, 22 nt, Human
cuagaaaaauacuuuauuguga

SEQ ID NO: 1085464 - RNA, 22 nt, Human
cuugaaagucacaugcagcccu

SEQ ID NO: 1085465 - RNA, 22 nt, Human
cuuguagaauugaaauggucuc

SEQ ID NO: 1085466 - RNA, 22 nt, Human
uuuccuaagggaugcggcucaa

SEQ ID NO: 1085467 - RNA, 23 nt, Human
uccagagugugagcuugccgugc

SEQ ID NO: 1085468 - RNA, 22 nt, Human
uauaauccugcuucacauugaa

SEQ ID NO: 1085469 - RNA, 22 nt, Human
gggcuggagccagcuguggcug

SEQ ID NO: 1085470 - RNA, 22 nt, Human
uggcagcugucuguggggucuc

SEQ ID NO: 1085471 - RNA, 22 nt, Human
cuguguuggcuuuucucuugua

SEQ ID NO: 1085472 - RNA, 20 nt, Human
ugggccuguggcagaagucu

SEQ ID NO: 1085473 - RNA, 22 nt, Human
acaaauguggacauggauaaug

SEQ ID NO: 1085474 - RNA, 22 nt, Human
cuguccuggccgcccuugugag

SEQ ID NO: 1085475 - RNA, 22 nt, Human
uuugugugcuugguauugaaga

SEQ ID NO: 1085476 - RNA, 22 nt, Human
aacacagcuaauuucugucaau

SEQ ID NO: 1085477 - RNA, 22 nt, Human
aacaugcucuggauugcuguga

SEQ ID NO: 1085478 - RNA, 22 nt, Human
ugcaagggcuuagggggcugug

SEQ ID NO: 1085479 - RNA, 22 nt, Human
agggcugaguggugcagucaaa

SEQ ID NO: 1085480 - RNA, 22 nt, Human
uuugucuuguguccuuaggacc

SEQ ID NO: 1085481 - RNA, 22 nt, Human
ucucuucuaauuuucccgagua

SEQ ID NO: 1085482 - RNA, 22 nt, Human
acagugaaugcccaagaaaagu

SEQ ID NO: 1085483 - RNA, 19 nt, Human
aaccaggacaaggggcugg

SEQ ID NO: 1085484 - RNA, 22 nt, Human
ccuuuucuauguaccagcagug

SEQ ID NO: 1085485 - RNA, 22 nt, Human
cuuugaaagcucccaggacuua

SEQ ID NO: 1085486 - RNA, 22 nt, Human
ugauuuccacgugcacccaggu

SEQ ID NO: 1085487 - RNA, 22 nt, Human
agcaugcaggaaccacauggca

SEQ ID NO: 1085488 - RNA, 22 nt, Human
ucucacucauuuccuaggucuu

SEQ ID NO: 1085489 - RNA, 22 nt, Human
cuuggcagagggcugggcucag

SEQ ID NO: 1085490 - RNA, 22 nt, Human
cauuugcaagagauaaauguuu

SEQ ID NO: 1085491 - RNA, 22 nt, Human
gcuuuucuagcuagaacauccg

SEQ ID NO: 1085492 - RNA, 22 nt, Human
caagggcucacggucugcuggg

SEQ ID NO: 1085493 - RNA, 22 nt, Human
ggcacagcacagagcacaugua

SEQ ID NO: 1085494 - RNA, 22 nt, Human
uggcuaggaauccaugacucuc

SEQ ID NO: 1085495 - RNA, 22 nt, Human
aaugguaauauuucauaguugu

SEQ ID NO: 1085496 - RNA, 22 nt, Human
auccaaauauauuuuauucacu

SEQ ID NO: 1085497 - RNA, 22 nt, Human
ucacugcucagucuguacuaca

SEQ ID NO: 1085498 - RNA, 22 nt, Human
cugagacacaguggcugaaaag

SEQ ID NO: 1085499 - RNA, 22 nt, Human
ggggcagcucccgagggcagga

SEQ ID NO: 1085500 - RNA, 22 nt, Human
ugcugggcacugucuagguacu

SEQ ID NO: 1085501 - RNA, 22 nt, Human
gggaccaggucagggcucugac

SEQ ID NO: 1085502 - RNA, 22 nt, Human
uuugacaucaauacccuagaau

SEQ ID NO: 1085503 - RNA, 23 nt, Human
ucucagaggauuccugggccuug

SEQ ID NO: 1085504 - RNA, 19 nt, Human
ucuggagcugaugcaggug

SEQ ID NO: 1085505 - RNA, 22 nt, Human
ccucucucuccugcacacacac

SEQ ID NO: 1085506 - RNA, 22 nt, Human
auauauuugagaauauucauga

SEQ ID NO: 1085507 - RNA, 22 nt, Human
agccaagcaccacuggcacucg

SEQ ID NO: 1085508 - RNA, 22 nt, Human
cagggcagggauguugcggcag

SEQ ID NO: 1085509 - RNA, 22 nt, Human
aaacauuccauuucuauguaag

SEQ ID NO: 1085510 - RNA, 22 nt, Human
ucuggcuccaggaccgggcaca

SEQ ID NO: 1085511 - RNA, 22 nt, Human
ugacacagauuagagacauacc

SEQ ID NO: 1085512 - RNA, 22 nt, Human
ucugggagauccaagcagaacu

SEQ ID NO: 1085513 - RNA, 22 nt, Human
augggguggaguccgggcagcg

SEQ ID NO: 1085514 - RNA, 22 nt, Human
uuucucugaggcuggccucccu

SEQ ID NO: 1085515 - RNA, 22 nt, Human
uggaauuuaguuaauuccauuu

SEQ ID NO: 1085516 - RNA, 22 nt, Human
uuuaaauguuuauagagaguac

SEQ ID NO: 1085517 - RNA, 22 nt, Human
ugaaagggaaccugcuggacug

SEQ ID NO: 1085518 - RNA, 22 nt, Human
uuggucuuguggcaucuuucca

SEQ ID NO: 1085519 - RNA, 22 nt, Human
ucuucaaaauugauuggagaag

SEQ ID NO: 1085520 - RNA, 22 nt, Human
uaagaaauuuaguuauagaaug

SEQ ID NO: 1085521 - RNA, 22 nt, Human
ucaggugggcguuccggugcgg

SEQ ID NO: 1085522 - RNA, 22 nt, Human
gcuggccacauugugccguccu

SEQ ID NO: 1085523 - RNA, 22 nt, Human
agaauauaaagauaauucuguu

SEQ ID NO: 1085524 - RNA, 22 nt, Human
cagagccaaaaccguaacagcc

SEQ ID NO: 1085525 - RNA, 20 nt, Human
ggggcugcaugcagagaaga

SEQ ID NO: 1085526 - RNA, 22 nt, Human
agagggaucacccuguuucugg

SEQ ID NO: 1085527 - RNA, 22 nt, Human
gcuggggaggcagcagagaaca

SEQ ID NO: 1085528 - RNA, 22 nt, Human
cacauuuaagcagauguggacc

SEQ ID NO: 1085529 - RNA, 22 nt, Human
acuggcaguggcagcagaaaga

SEQ ID NO: 1085530 - RNA, 22 nt, Human
aacuauuuuuggagcuaacucu

SEQ ID NO: 1085531 - RNA, 22 nt, Human
uagcucuucauuucaucugauu

SEQ ID NO: 1085532 - RNA, 22 nt, Human
ggacacacaaguuaucuaauga

SEQ ID NO: 1085533 - RNA, 22 nt, Human
uugauaaaaugauaucuucuuu

SEQ ID NO: 1085534 - RNA, 22 nt, Human
cauucaaauuaagauuuuguua

SEQ ID NO: 1085535 - RNA, 22 nt, Human
aaagaugaucuacaaguucauu

SEQ ID NO: 1085536 - RNA, 22 nt, Human
ugcagcaaggggcccugauagg

SEQ ID NO: 1085537 - RNA, 22 nt, Human
ccaggccaaauucagucagcag

SEQ ID NO: 1085538 - RNA, 22 nt, Human
uccaagggcagccauagaacuu

SEQ ID NO: 1085539 - RNA, 22 nt, Human
gcuggccauagaagccaaagag

SEQ ID NO: 1085540 - RNA, 22 nt, Human
ucuucaaagaauuuuaguaauu

SEQ ID NO: 1085541 - RNA, 22 nt, Human
uuuauuccaugugucuaugacc

SEQ ID NO: 1085542 - RNA, 22 nt, Human
ccaguggacuucucccuguggu

SEQ ID NO: 1085543 - RNA, 22 nt, Human
uuuauuauccaguguugucaug

SEQ ID NO: 1085544 - RNA, 22 nt, Human
auggccuggccagagcucugcu

SEQ ID NO: 1085545 - RNA, 22 nt, Human
uauucacagguucuggggauca

SEQ ID NO: 1085546 - RNA, 22 nt, Human
acugccucuuggugcugagaga

SEQ ID NO: 1085547 - RNA, 22 nt, Human
gagcucugccauggcucccacc

SEQ ID NO: 1085548 - RNA, 22 nt, Human
gacacauagaucuaucucacuc

SEQ ID NO: 1085549 - RNA, 22 nt, Human
aaauauguaagauuagcacuag

SEQ ID NO: 1085550 - RNA, 22 nt, Human
gcccagcagaucucagugucuc

SEQ ID NO: 1085551 - RNA, 22 nt, Human
aaaguuagguguggauuucuca

SEQ ID NO: 1085552 - RNA, 22 nt, Human
gagcuagacagcaagggccugc

SEQ ID NO: 1085553 - RNA, 22 nt, Human
cacacacuggagcaaggagaug

SEQ ID NO: 1085554 - RNA, 22 nt, Human
gaucuguuucauucacagucug

SEQ ID NO: 1085555 - RNA, 23 nt, Human
uuggggacaaacaugcuacuuuc

SEQ ID NO: 1085556 - RNA, 22 nt, Human
ucacaagaauuuguagaugaaa

SEQ ID NO: 1085557 - RNA, 22 nt, Human
agcucccaauugacuugaacua

SEQ ID NO: 1085558 - RNA, 22 nt, Human
aggaagagcauucacaugguag

SEQ ID NO: 1085559 - RNA, 22 nt, Human
gaacagcauguaagaagcuacu

SEQ ID NO: 1085560 - RNA, 22 nt, Human
uuguaaacugcugcaggagugc

SEQ ID NO: 1085561 - RNA, 22 nt, Human
cugccucuccccagaguggccc

SEQ ID NO: 1085562 - RNA, 22 nt, Human
aauuuuaucucuaagcaggcuu

SEQ ID NO: 1085563 - RNA, 22 nt, Human
aucugauuuguaauuuuagaaa

SEQ ID NO: 1085564 - RNA, 22 nt, Human
auucuucaccauggauaauuug

SEQ ID NO: 1085565 - RNA, 22 nt, Human
ugguuccaguuuucaauagagc

SEQ ID NO: 1085566 - RNA, 18 nt, Human
uaacauguuuucauuaag

SEQ ID NO: 1085567 - RNA, 22 nt, Human
ugagugugcagggaaguggcgg

SEQ ID NO: 1085568 - RNA, 22 nt, Human
uucuggagggcaugcugcugcc

SEQ ID NO: 1085569 - RNA, 22 nt, Human
uuaugcaaagaaauagacuaau

SEQ ID NO: 1085570 - RNA, 22 nt, Human
acaauuuauccauuguauaguu

SEQ ID NO: 1085571 - RNA, 22 nt, Human
uagggcagccacccaggcugcu

SEQ ID NO: 1085572 - RNA, 22 nt, Human
gccuggcaggccuguuggggcu

SEQ ID NO: 1085573 - RNA, 22 nt, Human
aggccuggccccaguugcuagg

SEQ ID NO: 1085574 - RNA, 22 nt, Human
gccauuuucugucuuguuuauu

SEQ ID NO: 1085575 - RNA, 20 nt, Human
gacaggagaguuagguaggu

SEQ ID NO: 1085576 - RNA, 22 nt, Human
uccaaagaacauugcugagacc

SEQ ID NO: 1085577 - RNA, 22 nt, Human
gaggcucacuuucauccucuuc

SEQ ID NO: 1085578 - RNA, 22 nt, Human
uucaggauaguggugaguggca

SEQ ID NO: 1085579 - RNA, 22 nt, Human
uuuauuuggcaucucugccaag

SEQ ID NO: 1085580 - RNA, 22 nt, Human
ccagccuggggaggcagcuucu

SEQ ID NO: 1085581 - RNA, 22 nt, Human
aaucaguuaggguguuaaugag

SEQ ID NO: 1085582 - RNA, 22 nt, Human
gccugcagauauauaggauggu

SEQ ID NO: 1085583 - RNA, 22 nt, Human
aaagcagucacuccagugugau

SEQ ID NO: 1085584 - RNA, 22 nt, Human
gagggcuguggggcaugaccag

SEQ ID NO: 1085585 - RNA, 22 nt, Human
cagugggugaugaguccugggg

SEQ ID NO: 1085586 - RNA, 19 nt, Human
gaauguuuguauucagcgc

SEQ ID NO: 1085587 - RNA, 22 nt, Human
uguggggcagcuagccggccug

SEQ ID NO: 1085588 - RNA, 22 nt, Human
agcugcugcggaaagaugccac

SEQ ID NO: 1085589 - RNA, 22 nt, Human
ccacauuuacuggaugcucagg

SEQ ID NO: 1085590 - RNA, 22 nt, Human
ugcuucaugcuucugacaauag

SEQ ID NO: 1085591 - RNA, 22 nt, Human
uaggaacacagggacuugauga

SEQ ID NO: 1085592 - RNA, 22 nt, Human
cauucauuuaugaaauaucuau

SEQ ID NO: 1085593 - RNA, 22 nt, Human
aggcagccagauggcagccugc

SEQ ID NO: 1085594 - RNA, 22 nt, Human
agucauauguggcauuuucuaa

SEQ ID NO: 1085595 - RNA, 22 nt, Human
uagcuagagguagauggguuag

SEQ ID NO: 1085596 - RNA, 22 nt, Human
uaguauuuaaucacuuuugucu

SEQ ID NO: 1085597 - RNA, 22 nt, Human
accucagagaccucucaggugc

SEQ ID NO: 1085598 - RNA, 22 nt, Human
ccugagaccaaguugcagccau

SEQ ID NO: 1085599 - RNA, 22 nt, Human
gggcugcuuauacugaugauaa

SEQ ID NO: 1085600 - RNA, 22 nt, Human
cugaggagugggugggcaguga

SEQ ID NO: 1085601 - RNA, 22 nt, Human
acagauguacacucauauauaa

SEQ ID NO: 1085602 - RNA, 22 nt, Human
uuaucauugucgcagucuaauu

SEQ ID NO: 1085603 - RNA, 22 nt, Human
aaggcugugucagaagcucccu

SEQ ID NO: 1085604 - RNA, 22 nt, Human
gguggccugaauuagcucaggg

SEQ ID NO: 1085605 - RNA, 22 nt, Human
uggaggaaaaaaccaggcagag

SEQ ID NO: 1085606 - RNA, 22 nt, Human
ccacagagagugucagccuuug

SEQ ID NO: 1085607 - RNA, 22 nt, Human
acaaguauuggugaggauguag

SEQ ID NO: 1085608 - RNA, 22 nt, Human
ggccucuggucaagacaagcau

SEQ ID NO: 1085609 - RNA, 22 nt, Human
ucucagagaugucaagagucua

SEQ ID NO: 1085610 - RNA, 22 nt, Human
ugcauguuugugucugagaacu

SEQ ID NO: 1085611 - RNA, 22 nt, Human
cuuccucccggcccaugcucug

SEQ ID NO: 1085612 - RNA, 23 nt, Human
ggggccugcaccggucugcgcgg

SEQ ID NO: 1085613 - RNA, 22 nt, Human
ccagguggacggcgaguacagg

SEQ ID NO: 1085614 - RNA, 22 nt, Human
auacagaagccuguauuucugg

SEQ ID NO: 1085615 - RNA, 22 nt, Human
agcaggcuccuuccuucucugg

SEQ ID NO: 1085616 - RNA, 22 nt, Human
agccagcaugaagacagaggcc

SEQ ID NO: 1085617 - RNA, 22 nt, Human
uaucuuuugaguucucaagaug

SEQ ID NO: 1085618 - RNA, 22 nt, Human
cucuggagaugguucucaauug

SEQ ID NO: 1085619 - RNA, 22 nt, Human
ccuggacuguguccugugguca

SEQ ID NO: 1085620 - RNA, 22 nt, Human
cuccugaguaguagcauuguca

SEQ ID NO: 1085621 - RNA, 22 nt, Human
gagcuccaccaccuucaggcag

SEQ ID NO: 1085622 - RNA, 22 nt, Human
aaagccagggacagugugcaug

SEQ ID NO: 1085623 - RNA, 22 nt, Human
ugcaggugccaucgcugcucau

SEQ ID NO: 1085624 - RNA, 22 nt, Human
cucuucaacugccaggcagucu

SEQ ID NO: 1085625 - RNA, 22 nt, Human
gacacagcacuguacaaggaau

SEQ ID NO: 1085626 - RNA, 22 nt, Human
agaaacagaagggaaagcuuuu

SEQ ID NO: 1085627 - RNA, 22 nt, Human
ucccugccugacagcacccacc

SEQ ID NO: 1085628 - RNA, 22 nt, Human
aagaugcacaauguggcaauua

SEQ ID NO: 1085629 - RNA, 22 nt, Human
gagccagagcuacaagugucug

SEQ ID NO: 1085630 - RNA, 22 nt, Human
gggcaugguggcaggcaccugu

SEQ ID NO: 1085631 - RNA, 23 nt, Human
auuuacagguuaaaugaaaucag

SEQ ID NO: 1085632 - RNA, 22 nt, Human
ccagugcuucuuugcuagcugg

SEQ ID NO: 1085633 - RNA, 22 nt, Human
caucccugcccucaugccuaua

SEQ ID NO: 1085634 - RNA, 22 nt, Human
acuaccuuauacaaaauguagg

SEQ ID NO: 1085635 - RNA, 22 nt, Human
aauaagaauugccagauuugaa

SEQ ID NO: 1085636 - RNA, 22 nt, Human
auggaacaggcucagagaugcu

SEQ ID NO: 1085637 - RNA, 22 nt, Human
cagcuggcuggucagugcacaa

SEQ ID NO: 1085638 - RNA, 21 nt, Human
ucuuuucucugcaggauuccu

SEQ ID NO: 1085639 - RNA, 22 nt, Human
caacacagccauuccccuagaa

SEQ ID NO: 1085640 - RNA, 22 nt, Human
guuaaccaaggcaccaagugua

SEQ ID NO: 1085641 - RNA, 22 nt, Human
ugcuggggguucagaugaguaa

SEQ ID NO: 1085642 - RNA, 22 nt, Human
agccucugcuggcccuggcacu

SEQ ID NO: 1085643 - RNA, 22 nt, Human
cugggccugagcucugaagagu

SEQ ID NO: 1085644 - RNA, 22 nt, Human
aggagcugagucagcccgacag

SEQ ID NO: 1085645 - RNA, 23 nt, Human
ugaaaucagaacccuuaccucuc

SEQ ID NO: 1085646 - RNA, 22 nt, Human
caguccaggccuggaggagcca

SEQ ID NO: 1085647 - RNA, 22 nt, Human
cagccagaaccuaggaugagcu

SEQ ID NO: 1085648 - RNA, 22 nt, Human
aagacauuacuggaaucugacu

SEQ ID NO: 1085649 - RNA, 22 nt, Human
uaguggagguggucugugaacu

SEQ ID NO: 1085650 - RNA, 22 nt, Human
uauuuguguggguaucuauaua

SEQ ID NO: 1085651 - RNA, 22 nt, Human
uccugcugugcuuauuauccug

SEQ ID NO: 1085652 - RNA, 20 nt, Human
uaggacaggcagccgagggg

SEQ ID NO: 1085653 - RNA, 20 nt, Human
auacaagaugaguaauuucu

SEQ ID NO: 1085654 - RNA, 22 nt, Human
cauacaagcgugcaugugcuug

SEQ ID NO: 1085655 - RNA, 22 nt, Human
uuugaauagaggccccucagaa

SEQ ID NO: 1085656 - RNA, 22 nt, Human
agccaagcugaucuccugcuga

SEQ ID NO: 1085657 - RNA, 22 nt, Human
gcacacaggggaguucucagaa

SEQ ID NO: 1085658 - RNA, 23 nt, Human
uggcagcagaucuuaaagugacc

SEQ ID NO: 1085659 - RNA, 22 nt, Human
agcugccccaugagaggcaggu

SEQ ID NO: 1085660 - RNA, 22 nt, Human
ugcaccaagucuggcacugaau

SEQ ID NO: 1085661 - RNA, 22 nt, Human
ugggcccugacuucaagcaucc

SEQ ID NO: 1085662 - RNA, 22 nt, Human
uccucagggggccaacccagcc

SEQ ID NO: 1085663 - RNA, 22 nt, Human
ucccacauaugcaauccugaau

SEQ ID NO: 1085664 - RNA, 22 nt, Human
aaauggcaacagaagggaguuc

SEQ ID NO: 1085665 - RNA, 22 nt, Human
ucugggcuuggauuggcucugc

SEQ ID NO: 1085666 - RNA, 22 nt, Human
aaacugaauucccaagggcaug

SEQ ID NO: 1085667 - RNA, 22 nt, Human
uccaucaccacagaggacagag

SEQ ID NO: 1085668 - RNA, 22 nt, Human
ucucagagggaggauuacugcc

SEQ ID NO: 1085669 - RNA, 22 nt, Human
cagccugcauuuguaucuguau

SEQ ID NO: 1085670 - RNA, 22 nt, Human
guucacagggauccuuguugaa

SEQ ID NO: 1085671 - RNA, 22 nt, Human
gcuuacacuaaacaaguuuccu

SEQ ID NO: 1085672 - RNA, 22 nt, Human
cuguggugagcaacugacugaa

SEQ ID NO: 1085673 - RNA, 22 nt, Human
agcaaauaaagacaauuauguc

SEQ ID NO: 1085674 - RNA, 22 nt, Human
gguggcucucugucagugacag

SEQ ID NO: 1085675 - RNA, 22 nt, Human
cugagggucaacuugauuguau

SEQ ID NO: 1085676 - RNA, 22 nt, Human
cacacaugugugcagcuuagaa

SEQ ID NO: 1085677 - RNA, 23 nt, Human
uggcccugugcaugcugcuuccc

SEQ ID NO: 1085678 - RNA, 22 nt, Human
ccaggaaggaagcagggguuuc

SEQ ID NO: 1085679 - RNA, 22 nt, Human
ucuuccuaugccaacauucugu

SEQ ID NO: 1085680 - RNA, 22 nt, Human
uacagaaauugccaccagcucu

SEQ ID NO: 1085681 - RNA, 22 nt, Human
ugcagucuggauguccucagau

SEQ ID NO: 1085682 - RNA, 22 nt, Human
aauuuuaagcauaugacugguu

SEQ ID NO: 1085683 - RNA, 22 nt, Human
gugcucuguguauuaggauguc

SEQ ID NO: 1085684 - RNA, 22 nt, Human
uuguaaggguuacaagaaaaca

SEQ ID NO: 1085685 - RNA, 22 nt, Human
cucugcauuuuaacagaugauu

SEQ ID NO: 1085686 - RNA, 22 nt, Human
aggcaguggagcuggaauaggc

SEQ ID NO: 1085687 - RNA, 20 nt, Human
ucuguuauugcauguacaua

SEQ ID NO: 1085688 - RNA, 22 nt, Human
gugaagcauaacugaaggauuu

SEQ ID NO: 1085689 - RNA, 22 nt, Human
cagugguugguagauacuugag

SEQ ID NO: 1085690 - RNA, 23 nt, Human
uccuccugacacagccugaguga

SEQ ID NO: 1085691 - RNA, 22 nt, Human
aggugggguguuggauguuuau

SEQ ID NO: 1085692 - RNA, 22 nt, Human
uucuggggcuaauacagagguc

SEQ ID NO: 1085693 - RNA, 22 nt, Human
ugcugggccucuucccuggaua

SEQ ID NO: 1085694 - RNA, 22 nt, Human
uuuggaaaguguacaaauuuga

SEQ ID NO: 1085695 - RNA, 22 nt, Human
gagcugcugguugcuggugccu

SEQ ID NO: 1085696 - RNA, 22 nt, Human
cucacugcccugaaguuggguu

SEQ ID NO: 1085697 - RNA, 20 nt, Human
agugacagagacuguguggc

SEQ ID NO: 1085698 - RNA, 22 nt, Human
ccacugcccccugaagaccagg

SEQ ID NO: 1085699 - RNA, 22 nt, Human
gugugccaacaaaagacagugc

SEQ ID NO: 1085700 - RNA, 22 nt, Human
ugccagcuccgaggagcugcag

SEQ ID NO: 1085701 - RNA, 22 nt, Human
ugaguggagaacagaggcucuc

SEQ ID NO: 1085702 - RNA, 22 nt, Human
ggaagacaagcaguggcugagc

SEQ ID NO: 1085703 - RNA, 22 nt, Human
caagcagagaagucucuaggcu

SEQ ID NO: 1085704 - RNA, 20 nt, Human
ggcugccuccuuccuuuccu

SEQ ID NO: 1085705 - RNA, 22 nt, Human
uaaauuaaagauuggagaagga

SEQ ID NO: 1085706 - RNA, 22 nt, Human
aagauuaaaggggagacaagcu

SEQ ID NO: 1085707 - RNA, 22 nt, Human
acuuccagaggguguggaaaua

SEQ ID NO: 1085708 - RNA, 22 nt, Human
uggcagcuccuggggccagcac

SEQ ID NO: 1085709 - RNA, 22 nt, Human
auggaaaggcuguggaaacuua

SEQ ID NO: 1085710 - RNA, 22 nt, Human
gaaucacagaggcaaauucuga

SEQ ID NO: 1085711 - RNA, 22 nt, Human
cucagaauuuagggcucugagg

SEQ ID NO: 1085712 - RNA, 22 nt, Human
uggagcagggcaucacugugcg

SEQ ID NO: 1085713 - RNA, 22 nt, Human
cuauuucagcugccuuugacug

SEQ ID NO: 1085714 - RNA, 22 nt, Human
ucuggccugggccugccggugc

SEQ ID NO: 1085715 - RNA, 22 nt, Human
uuucaagagggaacugaacaca

SEQ ID NO: 1085716 - RNA, 22 nt, Human
ucucugagcccagugucccccu

SEQ ID NO: 1085717 - RNA, 22 nt, Human
uuuaauuuucugggcccagcag

SEQ ID NO: 1085718 - RNA, 18 nt, Human
gcagcugacacuggaguu

SEQ ID NO: 1085719 - RNA, 23 nt, Human
uccccucaggcagccagugcccu

SEQ ID NO: 1085720 - RNA, 22 nt, Human
auggcagaccuccuggccacaa

SEQ ID NO: 1085721 - RNA, 22 nt, Human
ccaggcuccccaggaggcccuu

SEQ ID NO: 1085722 - RNA, 22 nt, Human
cagugaaguguggacgucacca

SEQ ID NO: 1085723 - RNA, 22 nt, Human
gccagagccacuuuugggugau

SEQ ID NO: 1085724 - RNA, 22 nt, Human
ggcacugagcgggcucugagcg

SEQ ID NO: 1085725 - RNA, 22 nt, Human
uuugcauuugcaaauaaugaaa

SEQ ID NO: 1085726 - RNA, 22 nt, Human
aaucagaacuccuaccacagag

SEQ ID NO: 1085727 - RNA, 22 nt, Human
ucugggcugucuacagguuggc

SEQ ID NO: 1085728 - RNA, 20 nt, Human
ucugaggcugagcucuacuu

SEQ ID NO: 1085729 - RNA, 22 nt, Human
uacagcuugacccauaaugucu

SEQ ID NO: 1085730 - RNA, 22 nt, Human
gcaaguuauuuccauuuaaagc

SEQ ID NO: 1085731 - RNA, 22 nt, Human
gaaaucugaaucuucuguuggu

SEQ ID NO: 1085732 - RNA, 22 nt, Human
aucagaaaucuaggauucagaa

SEQ ID NO: 1085733 - RNA, 22 nt, Human
cuucaagauauuucuagaauca

SEQ ID NO: 1085734 - RNA, 17 nt, Human
aagauuucauuagcuga

SEQ ID NO: 1085735 - RNA, 22 nt, Human
aacuucagggacagaaaagagc

SEQ ID NO: 1085736 - RNA, 21 nt, Human
ugaggcucaucuuauguggcu

SEQ ID NO: 1085737 - RNA, 19 nt, Human
agucucaguguacagaggc

SEQ ID NO: 1085738 - RNA, 22 nt, Human
aagagcaggcugcuguggagua

SEQ ID NO: 1085739 - RNA, 19 nt, Human
caucuggaugauucuccug

SEQ ID NO: 1085740 - RNA, 22 nt, Human
uauuuggaaauagggcuuugua

SEQ ID NO: 1085741 - RNA, 22 nt, Human
aggaagccuggggcugcccucg

SEQ ID NO: 1085742 - RNA, 22 nt, Human
uaagacauuugaaaugugaucc

SEQ ID NO: 1085743 - RNA, 22 nt, Human
ucugucugagggagugacauuu

SEQ ID NO: 1085744 - RNA, 22 nt, Human
gcugccacauuuucaggacuaa

SEQ ID NO: 1085745 - RNA, 22 nt, Human
aaagagcuucauuuccauuuau

SEQ ID NO: 1085746 - RNA, 22 nt, Human
ucuuugaaguaucuuaaauggu

SEQ ID NO: 1085747 - RNA, 22 nt, Human
gcagggcugcugaaacuuguuu

SEQ ID NO: 1085748 - RNA, 20 nt, Human
cccucugcacauggcugugg

SEQ ID NO: 1085749 - RNA, 20 nt, Human
aaucagaaagugugagcucu

SEQ ID NO: 1085750 - RNA, 22 nt, Human
aacuguaaggcuuagaacagca

SEQ ID NO: 1085751 - RNA, 22 nt, Human
gccuggcccagggcuccgcagg

SEQ ID NO: 1085752 - RNA, 22 nt, Human
acagagaaagugggcugaagau

SEQ ID NO: 1085753 - RNA, 22 nt, Human
ggggaaaggccauggcaagaac

SEQ ID NO: 1085754 - RNA, 22 nt, Human
uuauguaccugaauuaguaaag

SEQ ID NO: 1085755 - RNA, 22 nt, Human
ugaaaucagugguauaaucggg

SEQ ID NO: 1085756 - RNA, 22 nt, Human
uuugaaagccuggcuuuucucu

SEQ ID NO: 1085757 - RNA, 22 nt, Human
uucagaaugacuuauguaaggc

SEQ ID NO: 1085758 - RNA, 22 nt, Human
uucucugaaggccaugcucacu

SEQ ID NO: 1085759 - RNA, 22 nt, Human
ccaggggaaacagggagcacuc

SEQ ID NO: 1085760 - RNA, 22 nt, Human
aggaaugacuuguagcucugag

SEQ ID NO: 1085761 - RNA, 22 nt, Human
gucuuuaugguaugaaaacuga

SEQ ID NO: 1085762 - RNA, 22 nt, Human
ggacacagauaaucacacagau
